United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 16

SEQ ID NO: 603366 - RNA, 15 nt, Escherichia coli CFT073
gccaccaugcccagu

SEQ ID NO: 603367 - RNA, 22 nt, Escherichia coli CFT073
gccaccauccccaccaaaacag

SEQ ID NO: 603368 - RNA, 19 nt, Escherichia coli CFT073
gccaccagguucaacagcg

SEQ ID NO: 603369 - RNA, 17 nt, Escherichia coli CFT073
gccaccaggaaaaagau

SEQ ID NO: 603370 - RNA, 12 nt, Escherichia coli CFT073
gccacccagcga

SEQ ID NO: 603371 - RNA, 21 nt, Escherichia coli CFT073
gccaccauuuuacgcccgcga

SEQ ID NO: 603372 - RNA, 11 nt, Escherichia coli CFT073
gccaccagcgu

SEQ ID NO: 603373 - RNA, 16 nt, Escherichia coli CFT073
gccaccacucaaaagc

SEQ ID NO: 603374 - RNA, 16 nt, Escherichia coli CFT073
gccaccagcgccacca

SEQ ID NO: 603375 - RNA, 15 nt, Escherichia coli CFT073
gccaccacgcccagc

SEQ ID NO: 603376 - RNA, 20 nt, Escherichia coli CFT073
gccaccaccucuuccagcga

SEQ ID NO: 603377 - RNA, 14 nt, Escherichia coli CFT073
gccaccaccagcgu

SEQ ID NO: 603378 - RNA, 15 nt, Escherichia coli CFT073
gccaccaacgcacca

SEQ ID NO: 603379 - RNA, 13 nt, Escherichia coli CFT073
gccaccacaacau

SEQ ID NO: 603380 - RNA, 22 nt, Escherichia coli CFT073
gccaccggcaaucugcuggcaa

SEQ ID NO: 603381 - RNA, 15 nt, Escherichia coli CFT073
gccaccgcuuccggc

SEQ ID NO: 603382 - RNA, 13 nt, Escherichia coli CFT073
gccacgcggcggc

SEQ ID NO: 603383 - RNA, 19 nt, Escherichia coli CFT073
gccacgccuuccugauaac

SEQ ID NO: 603384 - RNA, 17 nt, Escherichia coli CFT073
gccacgcugccgcgcag

SEQ ID NO: 603385 - RNA, 20 nt, Escherichia coli CFT073
gccacgcugccgcgcagcga

SEQ ID NO: 603386 - RNA, 14 nt, Escherichia coli CFT073
gccacgcugcgcuu

SEQ ID NO: 603387 - RNA, 20 nt, Escherichia coli CFT073
gccaccugcgaacuguaaug

SEQ ID NO: 603388 - RNA, 20 nt, Escherichia coli CFT073
gccacgucguuccccaucac

SEQ ID NO: 603389 - RNA, 20 nt, Escherichia coli CFT073
gccacgcuucaaucugauau

SEQ ID NO: 603390 - RNA, 18 nt, Escherichia coli CFT073
gccacuucuggcggcggc

SEQ ID NO: 603391 - RNA, 19 nt, Escherichia coli CFT073
gccacuucuuccagcggca

SEQ ID NO: 603392 - RNA, 21 nt, Escherichia coli CFT073
gccacuucuuccagcggcagg

SEQ ID NO: 603393 - RNA, 17 nt, Escherichia coli CFT073
gccagauguuccgccau

SEQ ID NO: 603394 - RNA, 14 nt, Escherichia coli CFT073
gccacuuucacgcc

SEQ ID NO: 603395 - RNA, 14 nt, Escherichia coli CFT073
gccagauugcugcu

SEQ ID NO: 603396 - RNA, 18 nt, Escherichia coli CFT073
gccagauuguuauccagc

SEQ ID NO: 603397 - RNA, 16 nt, Escherichia coli CFT073
gccagcaaaucagcca

SEQ ID NO: 603398 - RNA, 22 nt, Escherichia coli CFT073
gccagcaacggccaaauauccg

SEQ ID NO: 603399 - RNA, 13 nt, Escherichia coli CFT073
gccagcaccaucg

SEQ ID NO: 603400 - RNA, 16 nt, Escherichia coli CFT073
gccagcaccaucgcga

SEQ ID NO: 603401 - RNA, 13 nt, Escherichia coli CFT073
gccagcagcuuca

SEQ ID NO: 603402 - RNA, 24 nt, Escherichia coli CFT073
gccagcaucggcaacgccagcgaa

SEQ ID NO: 603403 - RNA, 22 nt, Escherichia coli CFT073
gccagcaucgggaugagcaucg

SEQ ID NO: 603404 - RNA, 23 nt, Escherichia coli CFT073
gccagcaucucaaucgcacccgc

SEQ ID NO: 603405 - RNA, 15 nt, Escherichia coli CFT073
gccagcauaaucacc

SEQ ID NO: 603406 - RNA, 21 nt, Escherichia coli CFT073
gccagcauaaucaccaucagc

SEQ ID NO: 603407 - RNA, 19 nt, Escherichia coli CFT073
gccagcggcguucgaguaa

SEQ ID NO: 603408 - RNA, 21 nt, Escherichia coli CFT073
gccagcggcguucgaguaaug

SEQ ID NO: 603409 - RNA, 12 nt, Escherichia coli CFT073
gccagcggcggc

SEQ ID NO: 603410 - RNA, 22 nt, Escherichia coli CFT073
gccagcgcggcggcaaucauca

SEQ ID NO: 603411 - RNA, 19 nt, Escherichia coli CFT073
gccagcgcgcggcuggcac

SEQ ID NO: 603412 - RNA, 21 nt, Escherichia coli CFT073
gccagcgcgccugaaugccac

SEQ ID NO: 603413 - RNA, 13 nt, Escherichia coli CFT073
gccagccgcagcu

SEQ ID NO: 603414 - RNA, 18 nt, Escherichia coli CFT073
gccaggcuuuaaauuccg

SEQ ID NO: 603415 - RNA, 17 nt, Escherichia coli CFT073
gccaguacagcccgccg

SEQ ID NO: 603416 - RNA, 23 nt, Escherichia coli CFT073
gccaguaauaacccgucagcaga

SEQ ID NO: 603417 - RNA, 22 nt, Escherichia coli CFT073
gccaguaaucggcugaacgugc

SEQ ID NO: 603418 - RNA, 14 nt, Escherichia coli CFT073
gccaguaaugcgca

SEQ ID NO: 603419 - RNA, 18 nt, Escherichia coli CFT073
gccagguauuugcguagc

SEQ ID NO: 603420 - RNA, 19 nt, Escherichia coli CFT073
gccaggcaccgcgugcgac

SEQ ID NO: 603421 - RNA, 15 nt, Escherichia coli CFT073
gccagcuuugacguu

SEQ ID NO: 603422 - RNA, 17 nt, Escherichia coli CFT073
gccagcuucgaggccgg

SEQ ID NO: 603423 - RNA, 23 nt, Escherichia coli CFT073
gccagcuucgcuucccaacgcag

SEQ ID NO: 603424 - RNA, 14 nt, Escherichia coli CFT073
gccagcucgugcag

SEQ ID NO: 603425 - RNA, 14 nt, Escherichia coli CFT073
gccagcuccagcgc

SEQ ID NO: 603426 - RNA, 19 nt, Escherichia coli CFT073
gccagcggugaaaacggca

SEQ ID NO: 603427 - RNA, 16 nt, Escherichia coli CFT073
gccagcgugucgagca

SEQ ID NO: 603428 - RNA, 13 nt, Escherichia coli CFT073
gccagcguggcga

SEQ ID NO: 603429 - RNA, 14 nt, Escherichia coli CFT073
gccagcggucauaa

SEQ ID NO: 603430 - RNA, 15 nt, Escherichia coli CFT073
gcagaaagcgacuuu

SEQ ID NO: 603431 - RNA, 21 nt, Escherichia coli CFT073
gcagaaaucaacggcgucagc

SEQ ID NO: 603432 - RNA, 15 nt, Escherichia coli CFT073
gcagaaacgacacca

SEQ ID NO: 603433 - RNA, 16 nt, Escherichia coli CFT073
gcacuuuuaacgccuc

SEQ ID NO: 603434 - RNA, 13 nt, Escherichia coli CFT073
gcagaaacaucau

SEQ ID NO: 603435 - RNA, 20 nt, Escherichia coli CFT073
gcacugguggcagugcgcga

SEQ ID NO: 603436 - RNA, 15 nt, Escherichia coli CFT073
gcacuguagaccagu

SEQ ID NO: 603437 - RNA, 22 nt, Escherichia coli CFT073
gcacuggcgagcgccagcaugg

SEQ ID NO: 603438 - RNA, 22 nt, Escherichia coli CFT073
gcacuggcggcagcaggugcgc

SEQ ID NO: 603439 - RNA, 15 nt, Escherichia coli CFT073
gcacugcucuuuaac

SEQ ID NO: 603440 - RNA, 17 nt, Escherichia coli CFT073
gcacuucagggcgcacg

SEQ ID NO: 603441 - RNA, 12 nt, Escherichia coli CFT073
gcacuucgcuga

SEQ ID NO: 603442 - RNA, 16 nt, Escherichia coli CFT073
gcacuucuuccgccag

SEQ ID NO: 603443 - RNA, 21 nt, Escherichia coli CFT073
gcacuucuuccgccagcauca

SEQ ID NO: 603444 - RNA, 16 nt, Escherichia coli CFT073
gcacugcgcccgccag

SEQ ID NO: 603445 - RNA, 15 nt, Escherichia coli CFT073
gcacucacgccaggc

SEQ ID NO: 603446 - RNA, 18 nt, Escherichia coli CFT073
gcacucauagccucugcc

SEQ ID NO: 603447 - RNA, 21 nt, Escherichia coli CFT073
gcagaccagagcugauacggg

SEQ ID NO: 603448 - RNA, 14 nt, Escherichia coli CFT073
gcagaaaggaucac

SEQ ID NO: 603449 - RNA, 12 nt, Escherichia coli CFT073
gcagaacgcgug

SEQ ID NO: 603450 - RNA, 16 nt, Escherichia coli CFT073
gcagaacgcuuucgca

SEQ ID NO: 603451 - RNA, 15 nt, Escherichia coli CFT073
aacuuuguugcgaac

SEQ ID NO: 603452 - RNA, 22 nt, Escherichia coli CFT073
aacuuuaauuuugugcagcaca

SEQ ID NO: 603453 - RNA, 15 nt, Escherichia coli CFT073
aacuuucaauaaccg

SEQ ID NO: 603454 - RNA, 19 nt, Escherichia coli CFT073
aacuugguuuucguuaauc

SEQ ID NO: 603455 - RNA, 19 nt, Escherichia coli CFT073
gcagagcgauauccagcgc

SEQ ID NO: 603456 - RNA, 14 nt, Escherichia coli CFT073
gcagagugcgcagc

SEQ ID NO: 603457 - RNA, 23 nt, Escherichia coli CFT073
gcagagugcgcagcaucggccug

SEQ ID NO: 603458 - RNA, 18 nt, Escherichia coli CFT073
gcagagcgcgaaaccuua

SEQ ID NO: 603459 - RNA, 15 nt, Escherichia coli CFT073
gcagauaacuggcca

SEQ ID NO: 603460 - RNA, 15 nt, Escherichia coli CFT073
gcagauaauagucag

SEQ ID NO: 603461 - RNA, 14 nt, Escherichia coli CFT073
gcagauaccacauc

SEQ ID NO: 603462 - RNA, 18 nt, Escherichia coli CFT073
gcagauacggcgcaucag

SEQ ID NO: 603463 - RNA, 17 nt, Escherichia coli CFT073
gcagauaucccgccagc

SEQ ID NO: 603464 - RNA, 20 nt, Escherichia coli CFT073
gcagcaaaagcaggcaccgc

SEQ ID NO: 603465 - RNA, 22 nt, Escherichia coli CFT073
gcagcaaagacgaugaaugcaa

SEQ ID NO: 603466 - RNA, 16 nt, Escherichia coli CFT073
gcagcacccugaguuu

SEQ ID NO: 603467 - RNA, 17 nt, Escherichia coli CFT073
gcagcaaucgaccaggc

SEQ ID NO: 603468 - RNA, 14 nt, Escherichia coli CFT073
gcagcaaccagagc

SEQ ID NO: 603469 - RNA, 15 nt, Escherichia coli CFT073
gcagcaacaucacgc

SEQ ID NO: 603470 - RNA, 18 nt, Escherichia coli CFT073
gcacgauauaccgugcug

SEQ ID NO: 603471 - RNA, 15 nt, Escherichia coli CFT073
gcacgcccugauaaa

SEQ ID NO: 603472 - RNA, 22 nt, Escherichia coli CFT073
gcacgcccgcgccauuaucccg

SEQ ID NO: 603473 - RNA, 21 nt, Escherichia coli CFT073
gcacgaggugccaccagugca

SEQ ID NO: 603474 - RNA, 14 nt, Escherichia coli CFT073
gcacgaaucgauaa

SEQ ID NO: 603475 - RNA, 19 nt, Escherichia coli CFT073
gcaccuucauucaggccaa

SEQ ID NO: 603476 - RNA, 23 nt, Escherichia coli CFT073
gcaccugcggaaucaccggcaaa

SEQ ID NO: 603477 - RNA, 22 nt, Escherichia coli CFT073
gcacggcgaaaauuacuuuccg

SEQ ID NO: 603478 - RNA, 20 nt, Escherichia coli CFT073
gcacguacaugcagggcaaa

SEQ ID NO: 603479 - RNA, 16 nt, Escherichia coli CFT073
gcacgguucagcguca

SEQ ID NO: 603480 - RNA, 19 nt, Escherichia coli CFT073
gcacguaggcgaucccagc

SEQ ID NO: 603481 - RNA, 22 nt, Escherichia coli CFT073
gcacguaggcgaucccagcgcc

SEQ ID NO: 603482 - RNA, 14 nt, Escherichia coli CFT073
gcacggcgcaccgc

SEQ ID NO: 603483 - RNA, 13 nt, Escherichia coli CFT073
gcacggcacacuu

SEQ ID NO: 603484 - RNA, 19 nt, Escherichia coli CFT073
gcacggcacacuuucauca

SEQ ID NO: 603485 - RNA, 19 nt, Escherichia coli CFT073
gcacauacugcaucagcgc

SEQ ID NO: 603486 - RNA, 20 nt, Escherichia coli CFT073
gcacauacugcaucagcgcc

SEQ ID NO: 603487 - RNA, 15 nt, Escherichia coli CFT073
gcaccaccagcagcu

SEQ ID NO: 603488 - RNA, 20 nt, Escherichia coli CFT073
gcaccacauaagaucaucgg

SEQ ID NO: 603489 - RNA, 16 nt, Escherichia coli CFT073
gcaccaaugacggcca

SEQ ID NO: 603490 - RNA, 20 nt, Escherichia coli CFT073
gcaccacauucugcauugcg

SEQ ID NO: 603491 - RNA, 14 nt, Escherichia coli CFT073
gcacaucuagccug

SEQ ID NO: 603492 - RNA, 24 nt, Escherichia coli CFT073
gcacauugccugaugcgacgcugc

SEQ ID NO: 603493 - RNA, 16 nt, Escherichia coli CFT073
gcaccaacaucaugcc

SEQ ID NO: 603494 - RNA, 20 nt, Escherichia coli CFT073
gcaccaaaguuaaucagcgc

SEQ ID NO: 603495 - RNA, 21 nt, Escherichia coli CFT073
gcaccaaguucuucacugacg

SEQ ID NO: 603496 - RNA, 12 nt, Escherichia coli CFT073
gcaccaaucacc

SEQ ID NO: 603497 - RNA, 12 nt, Escherichia coli CFT073
gcaccagcaauu

SEQ ID NO: 603498 - RNA, 13 nt, Escherichia coli CFT073
gcacacauaacag

SEQ ID NO: 603499 - RNA, 22 nt, Escherichia coli CFT073
gcacacauacauguauaaaaag

SEQ ID NO: 603500 - RNA, 17 nt, Escherichia coli CFT073
gcacacacacgcccagu

SEQ ID NO: 603501 - RNA, 18 nt, Escherichia coli CFT073
gcacaaagccgcgugcgc

SEQ ID NO: 603502 - RNA, 18 nt, Escherichia coli CFT073
gcacaaagccgugccaga

SEQ ID NO: 603503 - RNA, 19 nt, Escherichia coli CFT073
gcacaaagccgugccagau

SEQ ID NO: 603504 - RNA, 17 nt, Escherichia coli CFT073
gcacaaacaucccugaa

SEQ ID NO: 603505 - RNA, 15 nt, Escherichia coli CFT073
gcacaauccgccagg

SEQ ID NO: 603506 - RNA, 19 nt, Escherichia coli CFT073
gcacaaucgcauagccaga

SEQ ID NO: 603507 - RNA, 18 nt, Escherichia coli CFT073
gcacaaugccugaugcga

SEQ ID NO: 603508 - RNA, 17 nt, Escherichia coli CFT073
gcacaauggccagcaca

SEQ ID NO: 603509 - RNA, 17 nt, Escherichia coli CFT073
gcaacagguuacgcugg

SEQ ID NO: 603510 - RNA, 20 nt, Escherichia coli CFT073
gcaacaguaauaaugcccau

SEQ ID NO: 603511 - RNA, 22 nt, Escherichia coli CFT073
gcaauucgcccuucggcaucac

SEQ ID NO: 603512 - RNA, 13 nt, Escherichia coli CFT073
gcaacauauuccg

SEQ ID NO: 603513 - RNA, 15 nt, Escherichia coli CFT073
gcaacaucaucacgc

SEQ ID NO: 603514 - RNA, 14 nt, Escherichia coli CFT073
gcaauugcggcagg

SEQ ID NO: 603515 - RNA, 16 nt, Escherichia coli CFT073
gcaauuuugcccagcc

SEQ ID NO: 603516 - RNA, 23 nt, Escherichia coli CFT073
gcaauuggugcacgaugccugau

SEQ ID NO: 603517 - RNA, 19 nt, Escherichia coli CFT073
gcaauuguauccaugcgca

SEQ ID NO: 603518 - RNA, 14 nt, Escherichia coli CFT073
gcacaggcggguga

SEQ ID NO: 603519 - RNA, 16 nt, Escherichia coli CFT073
gcacaggcaauccagc

SEQ ID NO: 603520 - RNA, 18 nt, Escherichia coli CFT073
gcacagcuacgcaucaug

SEQ ID NO: 603521 - RNA, 19 nt, Escherichia coli CFT073
gcacagcuacgcaucaugc

SEQ ID NO: 603522 - RNA, 13 nt, Escherichia coli CFT073
gcaccagcuggcu

SEQ ID NO: 603523 - RNA, 17 nt, Escherichia coli CFT073
gcaccaggcaguuuauc

SEQ ID NO: 603524 - RNA, 13 nt, Escherichia coli CFT073
gcaccaugcacgg

SEQ ID NO: 603525 - RNA, 17 nt, Escherichia coli CFT073
gcacccagaacgccgaa

SEQ ID NO: 603526 - RNA, 14 nt, Escherichia coli CFT073
gcacccaaugccau

SEQ ID NO: 603527 - RNA, 17 nt, Escherichia coli CFT073
gcacccgaugcggcagu

SEQ ID NO: 603528 - RNA, 18 nt, Escherichia coli CFT073
gcaccgccuccagcgaca

SEQ ID NO: 603529 - RNA, 18 nt, Escherichia coli CFT073
gcaccgccucgcggaucu

SEQ ID NO: 603530 - RNA, 22 nt, Escherichia coli CFT073
gcaccgcgugaugcggcaucug

SEQ ID NO: 603531 - RNA, 15 nt, Escherichia coli CFT073
gcaccggaucgaugc

SEQ ID NO: 603532 - RNA, 14 nt, Escherichia coli CFT073
gcaggaucugcgcg

SEQ ID NO: 603533 - RNA, 15 nt, Escherichia coli CFT073
gcaggaugccugaug

SEQ ID NO: 603534 - RNA, 13 nt, Escherichia coli CFT073
gcaggaugcgaca

SEQ ID NO: 603535 - RNA, 22 nt, Escherichia coli CFT073
gcaggaugcgacauaaacguau

SEQ ID NO: 603536 - RNA, 18 nt, Escherichia coli CFT073
gcaggcaccgcgcccaca

SEQ ID NO: 603537 - RNA, 13 nt, Escherichia coli CFT073
gcaggcaacuuca

SEQ ID NO: 603538 - RNA, 18 nt, Escherichia coli CFT073
gcaggauuugcgguagcg

SEQ ID NO: 603539 - RNA, 16 nt, Escherichia coli CFT073
gcaggccaaacagcgu

SEQ ID NO: 603540 - RNA, 18 nt, Escherichia coli CFT073
gcaggccacgaaucagca

SEQ ID NO: 603541 - RNA, 20 nt, Escherichia coli CFT073
gcaggccacgaaucagcacc

SEQ ID NO: 603542 - RNA, 19 nt, Escherichia coli CFT073
gcaggccauaugacaccaa

SEQ ID NO: 603543 - RNA, 17 nt, Escherichia coli CFT073
gcaggccgucgcguagc

SEQ ID NO: 603544 - RNA, 18 nt, Escherichia coli CFT073
gcaggccgucgcguagca

SEQ ID NO: 603545 - RNA, 21 nt, Escherichia coli CFT073
gcaggcgagcugccaguugcg

SEQ ID NO: 603546 - RNA, 12 nt, Escherichia coli CFT073
gcaggccugaua

SEQ ID NO: 603547 - RNA, 20 nt, Escherichia coli CFT073
gcaggcgcucaccauuuccg

SEQ ID NO: 603548 - RNA, 23 nt, Escherichia coli CFT073
gcaggcguuaauauaaacgacag

SEQ ID NO: 603549 - RNA, 22 nt, Escherichia coli CFT073
gcaggcggcuucgcaucccggu

SEQ ID NO: 603550 - RNA, 16 nt, Escherichia coli CFT073
gcaggcgucgcaucag

SEQ ID NO: 603551 - RNA, 18 nt, Escherichia coli CFT073
gcaggcgucgcaucaggc

SEQ ID NO: 603552 - RNA, 21 nt, Escherichia coli CFT073
gcaggcuucaacacaggccgg

SEQ ID NO: 603553 - RNA, 12 nt, Escherichia coli CFT073
gcaggcuggugg

SEQ ID NO: 603554 - RNA, 22 nt, Escherichia coli CFT073
gcaggcugguggugaugguauu

SEQ ID NO: 603555 - RNA, 22 nt, Escherichia coli CFT073
gcaggcugauggagauuuuccg

SEQ ID NO: 603556 - RNA, 19 nt, Escherichia coli CFT073
gcagggaaagaaacgccau

SEQ ID NO: 603557 - RNA, 12 nt, Escherichia coli CFT073
aagaaccaugca

SEQ ID NO: 603558 - RNA, 14 nt, Escherichia coli CFT073
aagaacccggcaau

SEQ ID NO: 603559 - RNA, 14 nt, Escherichia coli CFT073
aagaacuccggcgc

SEQ ID NO: 603560 - RNA, 13 nt, Escherichia coli CFT073
gcagucagccagc

SEQ ID NO: 603561 - RNA, 16 nt, Escherichia coli CFT073
gcagucaccagcauca

SEQ ID NO: 603562 - RNA, 13 nt, Escherichia coli CFT073
gcagucaccugcg

SEQ ID NO: 603563 - RNA, 22 nt, Escherichia coli CFT073
gcagucaccugcggugcagccg

SEQ ID NO: 603564 - RNA, 22 nt, Escherichia coli CFT073
gcaguagaucuuauaugcgucu

SEQ ID NO: 603565 - RNA, 17 nt, Escherichia coli CFT073
gcaguacgauaauggcu

SEQ ID NO: 603566 - RNA, 23 nt, Escherichia coli CFT073
gcaguagcagcaggaauaaucag

SEQ ID NO: 603567 - RNA, 22 nt, Escherichia coli CFT073
gcaguaccagauaaucacccgc

SEQ ID NO: 603568 - RNA, 20 nt, Escherichia coli CFT073
gcaguaccagcaacgcuuca

SEQ ID NO: 603569 - RNA, 16 nt, Escherichia coli CFT073
gcaguaauauggcgac

SEQ ID NO: 603570 - RNA, 16 nt, Escherichia coli CFT073
gcagguuuuuacccaa

SEQ ID NO: 603571 - RNA, 13 nt, Escherichia coli CFT073
gcaguaaaccacc

SEQ ID NO: 603572 - RNA, 15 nt, Escherichia coli CFT073
gcaguaaaccaccca

SEQ ID NO: 603573 - RNA, 21 nt, Escherichia coli CFT073
gcaguaaaccacccaccagcg

SEQ ID NO: 603574 - RNA, 15 nt, Escherichia coli CFT073
gcaguaaaccgcucg

SEQ ID NO: 603575 - RNA, 21 nt, Escherichia coli CFT073
gcaguaaaccgcucgucacau

SEQ ID NO: 603576 - RNA, 15 nt, Escherichia coli CFT073
gcaggucgccagaaa

SEQ ID NO: 603577 - RNA, 11 nt, Escherichia coli CFT073
aagaaacggaa

SEQ ID NO: 603578 - RNA, 24 nt, Escherichia coli CFT073
gcaggucggauaagacgcgccagc

SEQ ID NO: 603579 - RNA, 19 nt, Escherichia coli CFT073
gcaggucaucgugcgucag

SEQ ID NO: 603580 - RNA, 16 nt, Escherichia coli CFT073
gcagguagcagcagcg

SEQ ID NO: 603581 - RNA, 17 nt, Escherichia coli CFT073
gcagguacugguaagca

SEQ ID NO: 603582 - RNA, 19 nt, Escherichia coli CFT073
gcaggguggugacaccaug

SEQ ID NO: 603583 - RNA, 16 nt, Escherichia coli CFT073
gcaggggcaaucagca

SEQ ID NO: 603584 - RNA, 13 nt, Escherichia coli CFT073
gcagccccagcgc

SEQ ID NO: 603585 - RNA, 19 nt, Escherichia coli CFT073
gcagccccagcgcauguuc

SEQ ID NO: 603586 - RNA, 23 nt, Escherichia coli CFT073
gcagccggagcuucacccgcagc

SEQ ID NO: 603587 - RNA, 19 nt, Escherichia coli CFT073
gcagcgauggauaaccgca

SEQ ID NO: 603588 - RNA, 23 nt, Escherichia coli CFT073
gcagcgaugguacuucaaucgcc

SEQ ID NO: 603589 - RNA, 18 nt, Escherichia coli CFT073
gcagccggaaaaccauca

SEQ ID NO: 603590 - RNA, 17 nt, Escherichia coli CFT073
gcagcggcaagcuggcg

SEQ ID NO: 603591 - RNA, 15 nt, Escherichia coli CFT073
gcagcgcgugcgcca

SEQ ID NO: 603592 - RNA, 16 nt, Escherichia coli CFT073
gcagcgcgugcgccac

SEQ ID NO: 603593 - RNA, 14 nt, Escherichia coli CFT073
gcagcggcacguuc

SEQ ID NO: 603594 - RNA, 15 nt, Escherichia coli CFT073
gcagcgccgguuuuc

SEQ ID NO: 603595 - RNA, 16 nt, Escherichia coli CFT073
gcagcgccgguuuuca

SEQ ID NO: 603596 - RNA, 15 nt, Escherichia coli CFT073
gcagcgccggauuca

SEQ ID NO: 603597 - RNA, 15 nt, Escherichia coli CFT073
gcagcguccagcgcc

SEQ ID NO: 603598 - RNA, 13 nt, Escherichia coli CFT073
gcagcuccgccag

SEQ ID NO: 603599 - RNA, 15 nt, Escherichia coli CFT073
gcagcuccgccagcu

SEQ ID NO: 603600 - RNA, 23 nt, Escherichia coli CFT073
gcagcuccccacaccaccaugcu

SEQ ID NO: 603601 - RNA, 15 nt, Escherichia coli CFT073
gcagcuaccguuuca

SEQ ID NO: 603602 - RNA, 17 nt, Escherichia coli CFT073
gcagcucuuuauccagc

SEQ ID NO: 603603 - RNA, 20 nt, Escherichia coli CFT073
gcagcucuuuauccagcagc

SEQ ID NO: 603604 - RNA, 17 nt, Escherichia coli CFT073
gcagcuguugcgccagc

SEQ ID NO: 603605 - RNA, 15 nt, Escherichia coli CFT073
gcagcuuuaacgauc

SEQ ID NO: 603606 - RNA, 17 nt, Escherichia coli CFT073
gcagcuguagcgugcga

SEQ ID NO: 603607 - RNA, 23 nt, Escherichia coli CFT073
gcagcuucacaaaggcuugcugc

SEQ ID NO: 603608 - RNA, 13 nt, Escherichia coli CFT073
gcagcuucacgcc

SEQ ID NO: 603609 - RNA, 16 nt, Escherichia coli CFT073
gcaggauaacggcaga

SEQ ID NO: 603610 - RNA, 20 nt, Escherichia coli CFT073
gcaggacguuggcgauugca

SEQ ID NO: 603611 - RNA, 17 nt, Escherichia coli CFT073
gcaggaauaaucagcag

SEQ ID NO: 603612 - RNA, 17 nt, Escherichia coli CFT073
gcaggaaucccaucaga

SEQ ID NO: 603613 - RNA, 18 nt, Escherichia coli CFT073
gcaggaaucccaucagac

SEQ ID NO: 603614 - RNA, 19 nt, Escherichia coli CFT073
gcaggaagggauuaugcag

SEQ ID NO: 603615 - RNA, 20 nt, Escherichia coli CFT073
gcaggaacuucguaagccug

SEQ ID NO: 603616 - RNA, 12 nt, Escherichia coli CFT073
gcaggaaaauca

SEQ ID NO: 603617 - RNA, 17 nt, Escherichia coli CFT073
gagcgcuuuuuccugcc

SEQ ID NO: 603618 - RNA, 23 nt, Escherichia coli CFT073
aacucuaccuggucaccgacaac

SEQ ID NO: 603619 - RNA, 23 nt, Escherichia coli CFT073
aacucuuucugacgaauuaccaa

SEQ ID NO: 603620 - RNA, 18 nt, Escherichia coli CFT073
aacugaauaauacacaca

SEQ ID NO: 603621 - RNA, 21 nt, Escherichia coli CFT073
aacugaauaauacacacagua

SEQ ID NO: 603622 - RNA, 18 nt, Escherichia coli CFT073
aacucgucugauuucuua

SEQ ID NO: 603623 - RNA, 22 nt, Escherichia coli CFT073
gagcggccuucuucuuucagag

SEQ ID NO: 603624 - RNA, 20 nt, Escherichia coli CFT073
aacugauuuagcaucagcgc

SEQ ID NO: 603625 - RNA, 15 nt, Escherichia coli CFT073
aacugcacaccgcgg

SEQ ID NO: 603626 - RNA, 21 nt, Escherichia coli CFT073
aacugcauacucgcgucuggc

SEQ ID NO: 603627 - RNA, 21 nt, Escherichia coli CFT073
aacugacgcccaguuucgaca

SEQ ID NO: 603628 - RNA, 18 nt, Escherichia coli CFT073
aacugacuuucuuuuccc

SEQ ID NO: 603629 - RNA, 16 nt, Escherichia coli CFT073
aacugauaaaccagac

SEQ ID NO: 603630 - RNA, 15 nt, Escherichia coli CFT073
aacugaucuuuauca

SEQ ID NO: 603631 - RNA, 20 nt, Escherichia coli CFT073
aacugcaugaagccaaccgg

SEQ ID NO: 603632 - RNA, 15 nt, Escherichia coli CFT073
aacugcaugucaggc

SEQ ID NO: 603633 - RNA, 19 nt, Escherichia coli CFT073
aacugccaguaaagcagcg

SEQ ID NO: 603634 - RNA, 21 nt, Escherichia coli CFT073
aacugcccaggcaaaaaggcc

SEQ ID NO: 603635 - RNA, 14 nt, Escherichia coli CFT073
gagcugagugcgaa

SEQ ID NO: 603636 - RNA, 15 nt, Escherichia coli CFT073
gagcugagugcgaaa

SEQ ID NO: 603637 - RNA, 19 nt, Escherichia coli CFT073
gagcuucacccgcagcacg

SEQ ID NO: 603638 - RNA, 12 nt, Escherichia coli CFT073
gagcuggcggac

SEQ ID NO: 603639 - RNA, 18 nt, Escherichia coli CFT073
gaggaggcuauagcaggu

SEQ ID NO: 603640 - RNA, 22 nt, Escherichia coli CFT073
gaggaucaccaguccaucggca

SEQ ID NO: 603641 - RNA, 17 nt, Escherichia coli CFT073
gaggauacagccgaagc

SEQ ID NO: 603642 - RNA, 10 nt, Escherichia coli CFT073
gaggaucaug

SEQ ID NO: 603643 - RNA, 13 nt, Escherichia coli CFT073
gagguccagcucc

SEQ ID NO: 603644 - RNA, 12 nt, Escherichia coli CFT073
gaggggaacacg

SEQ ID NO: 603645 - RNA, 20 nt, Escherichia coli CFT073
gaggggaacccguuggcaca

SEQ ID NO: 603646 - RNA, 20 nt, Escherichia coli CFT073
gaggcugcauuauccacgcc

SEQ ID NO: 603647 - RNA, 20 nt, Escherichia coli CFT073
gauaaggcgcucgcgccgca

SEQ ID NO: 603648 - RNA, 20 nt, Escherichia coli CFT073
gauaagguguucacgccgca

SEQ ID NO: 603649 - RNA, 20 nt, Escherichia coli CFT073
gauaaggcguucacgccgca

SEQ ID NO: 603650 - RNA, 20 nt, Escherichia coli CFT073
gauaaggcguucgcgccgca

SEQ ID NO: 603651 - RNA, 20 nt, Escherichia coli CFT073
gauaaggcguuuacgccgca

SEQ ID NO: 603652 - RNA, 16 nt, Escherichia coli CFT073
gauaccacaucaaccc

SEQ ID NO: 603653 - RNA, 16 nt, Escherichia coli CFT073
gauacucaagcaacca

SEQ ID NO: 603654 - RNA, 13 nt, Escherichia coli CFT073
gauacucaguccg

SEQ ID NO: 603655 - RNA, 15 nt, Escherichia coli CFT073
gauacggucaggaua

SEQ ID NO: 603656 - RNA, 20 nt, Escherichia coli CFT073
gauacggucaguuuucgccc

SEQ ID NO: 603657 - RNA, 19 nt, Escherichia coli CFT073
gauacggaaauccucuuuu

SEQ ID NO: 603658 - RNA, 22 nt, Escherichia coli CFT073
gauacggcggacgugcaccguc

SEQ ID NO: 603659 - RNA, 21 nt, Escherichia coli CFT073
gauacgcuucaaccaguuucu

SEQ ID NO: 603660 - RNA, 17 nt, Escherichia coli CFT073
gauacgcgucccggaau

SEQ ID NO: 603661 - RNA, 19 nt, Escherichia coli CFT073
gauaacggcagaagcagca

SEQ ID NO: 603662 - RNA, 13 nt, Escherichia coli CFT073
gauaacgcgcugc

SEQ ID NO: 603663 - RNA, 20 nt, Escherichia coli CFT073
gauaagcguagcgcagcagg

SEQ ID NO: 603664 - RNA, 20 nt, Escherichia coli CFT073
gauaaauucguuuucgcgcu

SEQ ID NO: 603665 - RNA, 21 nt, Escherichia coli CFT073
gauaacaaucaucaacccgcg

SEQ ID NO: 603666 - RNA, 13 nt, Escherichia coli CFT073
gauaaaugccaaa

SEQ ID NO: 603667 - RNA, 16 nt, Escherichia coli CFT073
gauaaccccagaugga

SEQ ID NO: 603668 - RNA, 16 nt, Escherichia coli CFT073
gaguacguucacuuuu

SEQ ID NO: 603669 - RNA, 17 nt, Escherichia coli CFT073
gaguaccgagaaaauca

SEQ ID NO: 603670 - RNA, 17 nt, Escherichia coli CFT073
gaguacgccauuucggg

SEQ ID NO: 603671 - RNA, 14 nt, Escherichia coli CFT073
gaguaaagcccgcc

SEQ ID NO: 603672 - RNA, 14 nt, Escherichia coli CFT073
gaguaacagauugu

SEQ ID NO: 603673 - RNA, 20 nt, Escherichia coli CFT073
gauagcguucuuuaacugcc

SEQ ID NO: 603674 - RNA, 22 nt, Escherichia coli CFT073
gauauaaccauccgagcagcaa

SEQ ID NO: 603675 - RNA, 17 nt, Escherichia coli CFT073
gauauacaccggcauca

SEQ ID NO: 603676 - RNA, 22 nt, Escherichia coli CFT073
gauauacaccggcaucaacggg

SEQ ID NO: 603677 - RNA, 16 nt, Escherichia coli CFT073
gauauacaccugauaa

SEQ ID NO: 603678 - RNA, 19 nt, Escherichia coli CFT073
gauauagcguaaagccagc

SEQ ID NO: 603679 - RNA, 15 nt, Escherichia coli CFT073
gauaucaccaauuuu

SEQ ID NO: 603680 - RNA, 22 nt, Escherichia coli CFT073
gauauucauagagaagaauauc

SEQ ID NO: 603681 - RNA, 17 nt, Escherichia coli CFT073
gauaugccggcaucaaa

SEQ ID NO: 603682 - RNA, 13 nt, Escherichia coli CFT073
gauauuggucacc

SEQ ID NO: 603683 - RNA, 18 nt, Escherichia coli CFT073
gauauuguuugcuggcaa

SEQ ID NO: 603684 - RNA, 23 nt, Escherichia coli CFT073
gauauuuaacaucauugccgccu

SEQ ID NO: 603685 - RNA, 14 nt, Escherichia coli CFT073
gaucacauccagua

SEQ ID NO: 603686 - RNA, 13 nt, Escherichia coli CFT073
gaucacacggcca

SEQ ID NO: 603687 - RNA, 21 nt, Escherichia coli CFT073
gaucaccacauucagcagccc

SEQ ID NO: 603688 - RNA, 19 nt, Escherichia coli CFT073
gaucaccugcgauaaaccg

SEQ ID NO: 603689 - RNA, 22 nt, Escherichia coli CFT073
gaucauaucguccggcaccaga

SEQ ID NO: 603690 - RNA, 16 nt, Escherichia coli CFT073
gaucaucaccaggcca

SEQ ID NO: 603691 - RNA, 21 nt, Escherichia coli CFT073
gaucaucaccugcgcuggcag

SEQ ID NO: 603692 - RNA, 18 nt, Escherichia coli CFT073
gaucauccacccgcagca

SEQ ID NO: 603693 - RNA, 13 nt, Escherichia coli CFT073
gaucauccacgac

SEQ ID NO: 603694 - RNA, 19 nt, Escherichia coli CFT073
gaucaugccgacaaacagc

SEQ ID NO: 603695 - RNA, 16 nt, Escherichia coli CFT073
gauccagcgcaauacc

SEQ ID NO: 603696 - RNA, 18 nt, Escherichia coli CFT073
gaucaugaugaugccaaa

SEQ ID NO: 603697 - RNA, 22 nt, Escherichia coli CFT073
gaucagcggcggcgcaaccauc

SEQ ID NO: 603698 - RNA, 23 nt, Escherichia coli CFT073
gaucagcgucgccaauggaauag

SEQ ID NO: 603699 - RNA, 19 nt, Escherichia coli CFT073
gaucagccauuuugcacau

SEQ ID NO: 603700 - RNA, 15 nt, Escherichia coli CFT073
gaucagccaggcgau

SEQ ID NO: 603701 - RNA, 22 nt, Escherichia coli CFT073
gauccagcuugucagacggugc

SEQ ID NO: 603702 - RNA, 18 nt, Escherichia coli CFT073
gaucccuucgccgccgcu

SEQ ID NO: 603703 - RNA, 14 nt, Escherichia coli CFT073
gauccuggauuucu

SEQ ID NO: 603704 - RNA, 17 nt, Escherichia coli CFT073
gauccugaaauuccuga

SEQ ID NO: 603705 - RNA, 14 nt, Escherichia coli CFT073
gauccugcaacaac

SEQ ID NO: 603706 - RNA, 14 nt, Escherichia coli CFT073
gaucgacaguugcu

SEQ ID NO: 603707 - RNA, 17 nt, Escherichia coli CFT073
gaucgaccgguucgccu

SEQ ID NO: 603708 - RNA, 23 nt, Escherichia coli CFT073
gaucgaacauuugcguggcgcgc

SEQ ID NO: 603709 - RNA, 12 nt, Escherichia coli CFT073
gaucgaggccau

SEQ ID NO: 603710 - RNA, 20 nt, Escherichia coli CFT073
gaugucauaaaucagcguga

SEQ ID NO: 603711 - RNA, 13 nt, Escherichia coli CFT073
gauguaucgauau

SEQ ID NO: 603712 - RNA, 15 nt, Escherichia coli CFT073
gauguaucgcccuua

SEQ ID NO: 603713 - RNA, 21 nt, Escherichia coli CFT073
gauguauucuuugaucgccgc

SEQ ID NO: 603714 - RNA, 12 nt, Escherichia coli CFT073
gaugucgcugca

SEQ ID NO: 603715 - RNA, 18 nt, Escherichia coli CFT073
gauguaauuaagcgcaaa

SEQ ID NO: 603716 - RNA, 21 nt, Escherichia coli CFT073
gauguacuucaacauaacgca

SEQ ID NO: 603717 - RNA, 19 nt, Escherichia coli CFT073
gauguagcgugauuuugua

SEQ ID NO: 603718 - RNA, 20 nt, Escherichia coli CFT073
gauguagcgugauuuuugua

SEQ ID NO: 603719 - RNA, 19 nt, Escherichia coli CFT073
gauguaacgcagcgucagc

SEQ ID NO: 603720 - RNA, 22 nt, Escherichia coli CFT073
gauggugaaaaauaaugccacc

SEQ ID NO: 603721 - RNA, 14 nt, Escherichia coli CFT073
gauggucgucaaac

SEQ ID NO: 603722 - RNA, 13 nt, Escherichia coli CFT073
gauggcucucauc

SEQ ID NO: 603723 - RNA, 20 nt, Escherichia coli CFT073
gauggcuauuacuuuaagcc

SEQ ID NO: 603724 - RNA, 12 nt, Escherichia coli CFT073
gaugggccagca

SEQ ID NO: 603725 - RNA, 18 nt, Escherichia coli CFT073
gauggcuuuccaccauca

SEQ ID NO: 603726 - RNA, 19 nt, Escherichia coli CFT073
aacuuaugcagcugcucga

SEQ ID NO: 603727 - RNA, 23 nt, Escherichia coli CFT073
aacuucaccgguucaucacgaaa

SEQ ID NO: 603728 - RNA, 17 nt, Escherichia coli CFT073
aacuuccugaaucgccg

SEQ ID NO: 603729 - RNA, 13 nt, Escherichia coli CFT073
aacuucgccauca

SEQ ID NO: 603730 - RNA, 20 nt, Escherichia coli CFT073
gaugcggcaugaacgccuga

SEQ ID NO: 603731 - RNA, 15 nt, Escherichia coli CFT073
gaugcgcuacgcuua

SEQ ID NO: 603732 - RNA, 17 nt, Escherichia coli CFT073
gauggauccccgcagca

SEQ ID NO: 603733 - RNA, 18 nt, Escherichia coli CFT073
gauggaguaguugaucgc

SEQ ID NO: 603734 - RNA, 13 nt, Escherichia coli CFT073
gaugcuccgccag

SEQ ID NO: 603735 - RNA, 18 nt, Escherichia coli CFT073
gaugcuccgccagcgcca

SEQ ID NO: 603736 - RNA, 19 nt, Escherichia coli CFT073
gaugcucuguguaggccgg

SEQ ID NO: 603737 - RNA, 20 nt, Escherichia coli CFT073
gaugcucuguguaggccgga

SEQ ID NO: 603738 - RNA, 15 nt, Escherichia coli CFT073
gaugcugacacaucu

SEQ ID NO: 603739 - RNA, 14 nt, Escherichia coli CFT073
gaugcguuuuucgg

SEQ ID NO: 603740 - RNA, 21 nt, Escherichia coli CFT073
aacuugcaaucucugacauaa

SEQ ID NO: 603741 - RNA, 18 nt, Escherichia coli CFT073
aacuugccuccggcauua

SEQ ID NO: 603742 - RNA, 17 nt, Escherichia coli CFT073
aacuugcgacagccauc

SEQ ID NO: 603743 - RNA, 15 nt, Escherichia coli CFT073
gcaaaugacgaugca

SEQ ID NO: 603744 - RNA, 21 nt, Escherichia coli CFT073
gcaaaucgccgagaucaacag

SEQ ID NO: 603745 - RNA, 17 nt, Escherichia coli CFT073
gcaaaucggcgugguaa

SEQ ID NO: 603746 - RNA, 14 nt, Escherichia coli CFT073
gcaaaucagcggca

SEQ ID NO: 603747 - RNA, 22 nt, Escherichia coli CFT073
gcaaauuaauuacacaaugcaa

SEQ ID NO: 603748 - RNA, 21 nt, Escherichia coli CFT073
gcaaauacccaaaaaauagca

SEQ ID NO: 603749 - RNA, 12 nt, Escherichia coli CFT073
gcaaauaacgcc

SEQ ID NO: 603750 - RNA, 17 nt, Escherichia coli CFT073
gcaacagcgcgucagca

SEQ ID NO: 603751 - RNA, 19 nt, Escherichia coli CFT073
gcaacagcagauccgguuc

SEQ ID NO: 603752 - RNA, 12 nt, Escherichia coli CFT073
gcaacagcagcc

SEQ ID NO: 603753 - RNA, 22 nt, Escherichia coli CFT073
gcaacagaaacgccauccagcc

SEQ ID NO: 603754 - RNA, 17 nt, Escherichia coli CFT073
gcaacagcaauacguuu

SEQ ID NO: 603755 - RNA, 15 nt, Escherichia coli CFT073
gcaacacucguuuca

SEQ ID NO: 603756 - RNA, 13 nt, Escherichia coli CFT073
gcaacacgccagc

SEQ ID NO: 603757 - RNA, 18 nt, Escherichia coli CFT073
gauuuguuucaauuaccg

SEQ ID NO: 603758 - RNA, 15 nt, Escherichia coli CFT073
gauuuccuucagaaa

SEQ ID NO: 603759 - RNA, 22 nt, Escherichia coli CFT073
gauuucacagucgauaucgcug

SEQ ID NO: 603760 - RNA, 17 nt, Escherichia coli CFT073
gauuuauuuuucuggcg

SEQ ID NO: 603761 - RNA, 18 nt, Escherichia coli CFT073
gauugugauuaccgcaaa

SEQ ID NO: 603762 - RNA, 16 nt, Escherichia coli CFT073
gauuuuuuccagcgca

SEQ ID NO: 603763 - RNA, 12 nt, Escherichia coli CFT073
gcaaacgcugga

SEQ ID NO: 603764 - RNA, 13 nt, Escherichia coli CFT073
gcaaacgcuggau

SEQ ID NO: 603765 - RNA, 16 nt, Escherichia coli CFT073
gcaaacggcggaugag

SEQ ID NO: 603766 - RNA, 18 nt, Escherichia coli CFT073
gcaaacggucaaucgcac

SEQ ID NO: 603767 - RNA, 19 nt, Escherichia coli CFT073
gcaaacguaaaugccagcc

SEQ ID NO: 603768 - RNA, 14 nt, Escherichia coli CFT073
gcaaacugcguaga

SEQ ID NO: 603769 - RNA, 23 nt, Escherichia coli CFT073
gcaaacuucucaccaucaaacag

SEQ ID NO: 603770 - RNA, 21 nt, Escherichia coli CFT073
gauucggcgcaaugauaucgc

SEQ ID NO: 603771 - RNA, 18 nt, Escherichia coli CFT073
gauucaucaccacugacg

SEQ ID NO: 603772 - RNA, 18 nt, Escherichia coli CFT073
gauucauccaguuccagu

SEQ ID NO: 603773 - RNA, 21 nt, Escherichia coli CFT073
gauucauuuggcguaguugcu

SEQ ID NO: 603774 - RNA, 15 nt, Escherichia coli CFT073
gauucgaugcccagc

SEQ ID NO: 603775 - RNA, 20 nt, Escherichia coli CFT073
gauugcacaugcuaaaaauc

SEQ ID NO: 603776 - RNA, 22 nt, Escherichia coli CFT073
gauugauagcgacgcgcuggca

SEQ ID NO: 603777 - RNA, 17 nt, Escherichia coli CFT073
gauugccggaugcggcg

SEQ ID NO: 603778 - RNA, 21 nt, Escherichia coli CFT073
gauuaccuuccugccagaucc

SEQ ID NO: 603779 - RNA, 23 nt, Escherichia coli CFT073
gauuaccgugaaucggacgugau

SEQ ID NO: 603780 - RNA, 19 nt, Escherichia coli CFT073
gauucaauuuugcagcauu

SEQ ID NO: 603781 - RNA, 15 nt, Escherichia coli CFT073
gauuaaaccaaccac

SEQ ID NO: 603782 - RNA, 19 nt, Escherichia coli CFT073
gauuaaacgggucaucaaa

SEQ ID NO: 603783 - RNA, 17 nt, Escherichia coli CFT073
gauuaaacuucaccagc

SEQ ID NO: 603784 - RNA, 16 nt, Escherichia coli CFT073
gauuaaaucgaagcgu

SEQ ID NO: 603785 - RNA, 18 nt, Escherichia coli CFT073
gauuaacagcccaugaca

SEQ ID NO: 603786 - RNA, 13 nt, Escherichia coli CFT073
gauuaacuaaaug

SEQ ID NO: 603787 - RNA, 23 nt, Escherichia coli CFT073
gauuaacucauacaucgcgcuua

SEQ ID NO: 603788 - RNA, 23 nt, Escherichia coli CFT073
gauuacagccaggcgcugcugga

SEQ ID NO: 603789 - RNA, 14 nt, Escherichia coli CFT073
gauuaccaaaacgg

SEQ ID NO: 603790 - RNA, 17 nt, Escherichia coli CFT073
gauuaccagagaaaaga

SEQ ID NO: 603791 - RNA, 20 nt, Escherichia coli CFT073
gauguggcguaaacgccuua

SEQ ID NO: 603792 - RNA, 13 nt, Escherichia coli CFT073
gauguuccgccau

SEQ ID NO: 603793 - RNA, 21 nt, Escherichia coli CFT073
gaugaaugacuguccacgaca

SEQ ID NO: 603794 - RNA, 13 nt, Escherichia coli CFT073
aacugcgccagac

SEQ ID NO: 603795 - RNA, 16 nt, Escherichia coli CFT073
gaugaaacugccggaa

SEQ ID NO: 603796 - RNA, 15 nt, Escherichia coli CFT073
aacugcuccgggaau

SEQ ID NO: 603797 - RNA, 14 nt, Escherichia coli CFT073
aacugcugcgccag

SEQ ID NO: 603798 - RNA, 14 nt, Escherichia coli CFT073
aacuggaauagcgc

SEQ ID NO: 603799 - RNA, 20 nt, Escherichia coli CFT073
gaugacgcgcucaccgcucu

SEQ ID NO: 603800 - RNA, 14 nt, Escherichia coli CFT073
gaugagcgccauau

SEQ ID NO: 603801 - RNA, 23 nt, Escherichia coli CFT073
gaugacccagcgcgaucgcgcca

SEQ ID NO: 603802 - RNA, 18 nt, Escherichia coli CFT073
gaucugacgugcacaaac

SEQ ID NO: 603803 - RNA, 22 nt, Escherichia coli CFT073
gaucuucgccaucccggcaacc

SEQ ID NO: 603804 - RNA, 22 nt, Escherichia coli CFT073
gaucuucugaccgggauuuuca

SEQ ID NO: 603805 - RNA, 15 nt, Escherichia coli CFT073
gaucuuccgaccgcc

SEQ ID NO: 603806 - RNA, 22 nt, Escherichia coli CFT073
gaucucacguccaccaaugcca

SEQ ID NO: 603807 - RNA, 17 nt, Escherichia coli CFT073
gaucgcccggcaccagc

SEQ ID NO: 603808 - RNA, 18 nt, Escherichia coli CFT073
gaugaucauccacgacca

SEQ ID NO: 603809 - RNA, 22 nt, Escherichia coli CFT073
gaugaguacgcccuguuaccgg

SEQ ID NO: 603810 - RNA, 13 nt, Escherichia coli CFT073
gaugauacuugca

SEQ ID NO: 603811 - RNA, 23 nt, Escherichia coli CFT073
gaugauccacaccggcgcauacu

SEQ ID NO: 603812 - RNA, 20 nt, Escherichia coli CFT073
gaugaucccuucgcuggcaa

SEQ ID NO: 603813 - RNA, 16 nt, Escherichia coli CFT073
gaugaucgccgccagu

SEQ ID NO: 603814 - RNA, 19 nt, Escherichia coli CFT073
gaugcaaacgauuaucaac

SEQ ID NO: 603815 - RNA, 21 nt, Escherichia coli CFT073
gaugauuaaaucgaagcguac

SEQ ID NO: 603816 - RNA, 19 nt, Escherichia coli CFT073
gaugaugcagauaaccaga

SEQ ID NO: 603817 - RNA, 16 nt, Escherichia coli CFT073
gaugaugacgcgcuca

SEQ ID NO: 603818 - RNA, 18 nt, Escherichia coli CFT073
aacuggcgcgaagauucg

SEQ ID NO: 603819 - RNA, 22 nt, Escherichia coli CFT073
gaugcacaacgcuuaucaggcu

SEQ ID NO: 603820 - RNA, 18 nt, Escherichia coli CFT073
aacugggugcacuuacaa

SEQ ID NO: 603821 - RNA, 14 nt, Escherichia coli CFT073
aacuggguuaacgu

SEQ ID NO: 603822 - RNA, 19 nt, Escherichia coli CFT073
aacugguugaaauaaacca

SEQ ID NO: 603823 - RNA, 19 nt, Escherichia coli CFT073
aacuguaaugaaucgucgg

SEQ ID NO: 603824 - RNA, 19 nt, Escherichia coli CFT073
gaugccacuggauguugca

SEQ ID NO: 603825 - RNA, 18 nt, Escherichia coli CFT073
aacugucaacaccaggga

SEQ ID NO: 603826 - RNA, 16 nt, Escherichia coli CFT073
aacugucaauaaacgc

SEQ ID NO: 603827 - RNA, 17 nt, Escherichia coli CFT073
aacugucaauaaacgcc

SEQ ID NO: 603828 - RNA, 20 nt, Escherichia coli CFT073
aacuguggaauaugcgccac

SEQ ID NO: 603829 - RNA, 12 nt, Escherichia coli CFT073
gaugcagcgucu

SEQ ID NO: 603830 - RNA, 19 nt, Escherichia coli CFT073
gaugcaccuucaacuugcu

SEQ ID NO: 603831 - RNA, 18 nt, Escherichia coli CFT073
gaugccgcuuauccccag

SEQ ID NO: 603832 - RNA, 22 nt, Escherichia coli CFT073
gaugcccccaggagcgcggcaa

SEQ ID NO: 603833 - RNA, 23 nt, Escherichia coli CFT073
gaugcccgaaagcguauccauca

SEQ ID NO: 603834 - RNA, 18 nt, Escherichia coli CFT073
gaugccguuuacgcaggu

SEQ ID NO: 603835 - RNA, 18 nt, Escherichia coli CFT073
gaugcgaccgccgcucuc

SEQ ID NO: 603836 - RNA, 18 nt, Escherichia coli CFT073
gaugcgacguuuaccgca

SEQ ID NO: 603837 - RNA, 19 nt, Escherichia coli CFT073
gaugcgaugcugacgcauc

SEQ ID NO: 603838 - RNA, 19 nt, Escherichia coli CFT073
gaugcgaugcuggcgcauc

SEQ ID NO: 603839 - RNA, 15 nt, Escherichia coli CFT073
gcgcuaccaucgaca

SEQ ID NO: 603840 - RNA, 21 nt, Escherichia coli CFT073
gcgcuaccaucgacaccaucg

SEQ ID NO: 603841 - RNA, 14 nt, Escherichia coli CFT073
gcgcguuucugcgc

SEQ ID NO: 603842 - RNA, 20 nt, Escherichia coli CFT073
gcgcuacgcuuaucaggccu

SEQ ID NO: 603843 - RNA, 20 nt, Escherichia coli CFT073
gcgcuacgcuugucaggccu

SEQ ID NO: 603844 - RNA, 16 nt, Escherichia coli CFT073
gcgcuacggcguuuca

SEQ ID NO: 603845 - RNA, 15 nt, Escherichia coli CFT073
gcgcuauaucgcuga

SEQ ID NO: 603846 - RNA, 14 nt, Escherichia coli CFT073
gcgcuauugccgua

SEQ ID NO: 603847 - RNA, 15 nt, Escherichia coli CFT073
gcgcuauugccguaa

SEQ ID NO: 603848 - RNA, 22 nt, Escherichia coli CFT073
gcgcucaucggcauacagcgac

SEQ ID NO: 603849 - RNA, 20 nt, Escherichia coli CFT073
gcgcuccgcuuaucaggccu

SEQ ID NO: 603850 - RNA, 22 nt, Escherichia coli CFT073
gcgcuccaucagauucagcagc

SEQ ID NO: 603851 - RNA, 14 nt, Escherichia coli CFT073
gcgcuccagcaucu

SEQ ID NO: 603852 - RNA, 13 nt, Escherichia coli CFT073
gcgcgugcuggga

SEQ ID NO: 603853 - RNA, 18 nt, Escherichia coli CFT073
gcgcgucuuauccgaccu

SEQ ID NO: 603854 - RNA, 16 nt, Escherichia coli CFT073
gcgcgucuuguacuuc

SEQ ID NO: 603855 - RNA, 12 nt, Escherichia coli CFT073
gcgcguccgguu

SEQ ID NO: 603856 - RNA, 14 nt, Escherichia coli CFT073
gcgcgucaccaccu

SEQ ID NO: 603857 - RNA, 17 nt, Escherichia coli CFT073
gcgcgucaagcgucgca

SEQ ID NO: 603858 - RNA, 12 nt, Escherichia coli CFT073
gcgcggucgauc

SEQ ID NO: 603859 - RNA, 22 nt, Escherichia coli CFT073
gcgcgguacgacccgauucggu

SEQ ID NO: 603860 - RNA, 11 nt, Escherichia coli CFT073
gcgcggcgcaa

SEQ ID NO: 603861 - RNA, 17 nt, Escherichia coli CFT073
gcgcgacggcgaccgaa

SEQ ID NO: 603862 - RNA, 18 nt, Escherichia coli CFT073
gcgcgccgaagcugacca

SEQ ID NO: 603863 - RNA, 22 nt, Escherichia coli CFT073
gcgcgcuaugcaacaacuggcg

SEQ ID NO: 603864 - RNA, 20 nt, Escherichia coli CFT073
gcgcgcgucaucggcgcggu

SEQ ID NO: 603865 - RNA, 14 nt, Escherichia coli CFT073
gcgcgcggcuggca

SEQ ID NO: 603866 - RNA, 16 nt, Escherichia coli CFT073
gcgcccaaccagcagg

SEQ ID NO: 603867 - RNA, 16 nt, Escherichia coli CFT073
gcgcccaauauccuga

SEQ ID NO: 603868 - RNA, 22 nt, Escherichia coli CFT073
gcgccauuuuucacugcggcaa

SEQ ID NO: 603869 - RNA, 14 nt, Escherichia coli CFT073
gcgccauuggccug

SEQ ID NO: 603870 - RNA, 21 nt, Escherichia coli CFT073
gcgcccgacaauaugcagcag

SEQ ID NO: 603871 - RNA, 20 nt, Escherichia coli CFT073
gcgcccaguagugcgcagaa

SEQ ID NO: 603872 - RNA, 22 nt, Escherichia coli CFT073
gcgccaucaaaucugccguaac

SEQ ID NO: 603873 - RNA, 23 nt, Escherichia coli CFT073
gcgccauacgucggugcagcaug

SEQ ID NO: 603874 - RNA, 17 nt, Escherichia coli CFT073
gcgccagaaugucuucg

SEQ ID NO: 603875 - RNA, 12 nt, Escherichia coli CFT073
gcgcccgccagu

SEQ ID NO: 603876 - RNA, 22 nt, Escherichia coli CFT073
gcgccgcaucgccgguuuugcc

SEQ ID NO: 603877 - RNA, 18 nt, Escherichia coli CFT073
gcgccgcgauuaaccguu

SEQ ID NO: 603878 - RNA, 15 nt, Escherichia coli CFT073
gcgauauccagcgcg

SEQ ID NO: 603879 - RNA, 15 nt, Escherichia coli CFT073
gcgcacaugcuggau

SEQ ID NO: 603880 - RNA, 13 nt, Escherichia coli CFT073
gcgcacaggcggc

SEQ ID NO: 603881 - RNA, 16 nt, Escherichia coli CFT073
gcgauaguaaucaccg

SEQ ID NO: 603882 - RNA, 12 nt, Escherichia coli CFT073
gcgauaggccuu

SEQ ID NO: 603883 - RNA, 22 nt, Escherichia coli CFT073
gcgauaggggggauugccgcga

SEQ ID NO: 603884 - RNA, 18 nt, Escherichia coli CFT073
gcgauagcauccaguucc

SEQ ID NO: 603885 - RNA, 18 nt, Escherichia coli CFT073
gcgcaccguccagcguuc

SEQ ID NO: 603886 - RNA, 17 nt, Escherichia coli CFT073
gcgcagaauuuggugaa

SEQ ID NO: 603887 - RNA, 14 nt, Escherichia coli CFT073
gcgcagcaggcggu

SEQ ID NO: 603888 - RNA, 16 nt, Escherichia coli CFT073
gcgcagcgcagcgcca

SEQ ID NO: 603889 - RNA, 23 nt, Escherichia coli CFT073
gcgcauaccaaaaucuaccagcg

SEQ ID NO: 603890 - RNA, 15 nt, Escherichia coli CFT073
gcgcaguugccggau

SEQ ID NO: 603891 - RNA, 23 nt, Escherichia coli CFT073
gcgcaucguagauuucauccggc

SEQ ID NO: 603892 - RNA, 18 nt, Escherichia coli CFT073
gcgcaucuuauccggccu

SEQ ID NO: 603893 - RNA, 19 nt, Escherichia coli CFT073
gcgcaugaccagugaggau

SEQ ID NO: 603894 - RNA, 12 nt, Escherichia coli CFT073
gcgcaugaccuu

SEQ ID NO: 603895 - RNA, 13 nt, Escherichia coli CFT073
gcgcauuguuucu

SEQ ID NO: 603896 - RNA, 14 nt, Escherichia coli CFT073
gcgcauuuaccagg

SEQ ID NO: 603897 - RNA, 16 nt, Escherichia coli CFT073
gcgcauguuggcgcgg

SEQ ID NO: 603898 - RNA, 15 nt, Escherichia coli CFT073
gcgccaccagcgcca

SEQ ID NO: 603899 - RNA, 18 nt, Escherichia coli CFT073
gcgcauuucccagcaaga

SEQ ID NO: 603900 - RNA, 21 nt, Escherichia coli CFT073
gcgcaggguuugcaucgccau

SEQ ID NO: 603901 - RNA, 14 nt, Escherichia coli CFT073
gcgcaggcgcugaa

SEQ ID NO: 603902 - RNA, 15 nt, Escherichia coli CFT073
gcgcagcgcgcgaau

SEQ ID NO: 603903 - RNA, 14 nt, Escherichia coli CFT073
gccguaaccagcgc

SEQ ID NO: 603904 - RNA, 16 nt, Escherichia coli CFT073
gccguaauccugcaaa

SEQ ID NO: 603905 - RNA, 12 nt, Escherichia coli CFT073
gccguaaacgug

SEQ ID NO: 603906 - RNA, 14 nt, Escherichia coli CFT073
gccguagccauuac

SEQ ID NO: 603907 - RNA, 15 nt, Escherichia coli CFT073
gccguacagcccagg

SEQ ID NO: 603908 - RNA, 14 nt, Escherichia coli CFT073
gccgguuaauacgc

SEQ ID NO: 603909 - RNA, 20 nt, Escherichia coli CFT073
gccgguucccagaccuucau

SEQ ID NO: 603910 - RNA, 15 nt, Escherichia coli CFT073
gccggguaaucagcu

SEQ ID NO: 603911 - RNA, 19 nt, Escherichia coli CFT073
gccggggucaaaccuggcg

SEQ ID NO: 603912 - RNA, 23 nt, Escherichia coli CFT073
gccgggugauuucaaaauuaaag

SEQ ID NO: 603913 - RNA, 17 nt, Escherichia coli CFT073
gccgggugccucccggu

SEQ ID NO: 603914 - RNA, 13 nt, Escherichia coli CFT073
gccgggagcggcg

SEQ ID NO: 603915 - RNA, 14 nt, Escherichia coli CFT073
gccgggaaugccac

SEQ ID NO: 603916 - RNA, 22 nt, Escherichia coli CFT073
gccuauaaacguucccggaaca

SEQ ID NO: 603917 - RNA, 14 nt, Escherichia coli CFT073
gccuauaccuaaca

SEQ ID NO: 603918 - RNA, 22 nt, Escherichia coli CFT073
gccucacagagcgcuuauacac

SEQ ID NO: 603919 - RNA, 24 nt, Escherichia coli CFT073
gccucacagcuaaucaucaucagc

SEQ ID NO: 603920 - RNA, 15 nt, Escherichia coli CFT073
gccucaacccauuuc

SEQ ID NO: 603921 - RNA, 21 nt, Escherichia coli CFT073
gccucaugugaugguaacgcg

SEQ ID NO: 603922 - RNA, 21 nt, Escherichia coli CFT073
gccucaguuucgacaccuuca

SEQ ID NO: 603923 - RNA, 15 nt, Escherichia coli CFT073
aagccacaucgccau

SEQ ID NO: 603924 - RNA, 16 nt, Escherichia coli CFT073
gccuccgcucaucacc

SEQ ID NO: 603925 - RNA, 22 nt, Escherichia coli CFT073
aagccacccacaccgcagaaca

SEQ ID NO: 603926 - RNA, 15 nt, Escherichia coli CFT073
gccuccucuuuuucc

SEQ ID NO: 603927 - RNA, 12 nt, Escherichia coli CFT073
gccuccccagca

SEQ ID NO: 603928 - RNA, 14 nt, Escherichia coli CFT073
gccugaauaaacgc

SEQ ID NO: 603929 - RNA, 21 nt, Escherichia coli CFT073
gccugaagaucaacgucugcg

SEQ ID NO: 603930 - RNA, 21 nt, Escherichia coli CFT073
gccugaacaccagaaccagca

SEQ ID NO: 603931 - RNA, 22 nt, Escherichia coli CFT073
gccugaacaccagaaccagcaa

SEQ ID NO: 603932 - RNA, 20 nt, Escherichia coli CFT073
gccucuuuauuuccugcgca

SEQ ID NO: 603933 - RNA, 15 nt, Escherichia coli CFT073
gccucuuucauccga

SEQ ID NO: 603934 - RNA, 14 nt, Escherichia coli CFT073
gccucuuugccaug

SEQ ID NO: 603935 - RNA, 16 nt, Escherichia coli CFT073
gccucugucagaaaug

SEQ ID NO: 603936 - RNA, 18 nt, Escherichia coli CFT073
gccucuauggaaguacca

SEQ ID NO: 603937 - RNA, 20 nt, Escherichia coli CFT073
gccugauaagacacgccagu

SEQ ID NO: 603938 - RNA, 20 nt, Escherichia coli CFT073
gccugauaagacgcgccagc

SEQ ID NO: 603939 - RNA, 20 nt, Escherichia coli CFT073
gccugauaagacgcggcagc

SEQ ID NO: 603940 - RNA, 22 nt, Escherichia coli CFT073
gccugauaagacgcggcagcgu

SEQ ID NO: 603941 - RNA, 22 nt, Escherichia coli CFT073
gccugauaagaugcguuaagcg

SEQ ID NO: 603942 - RNA, 17 nt, Escherichia coli CFT073
gccugaugcgacgcuga

SEQ ID NO: 603943 - RNA, 17 nt, Escherichia coli CFT073
gccugcacaaagcgcca

SEQ ID NO: 603944 - RNA, 19 nt, Escherichia coli CFT073
gccugcacaaagcgccaga

SEQ ID NO: 603945 - RNA, 23 nt, Escherichia coli CFT073
gccugcacaaccggaaccagcgc

SEQ ID NO: 603946 - RNA, 23 nt, Escherichia coli CFT073
gccugaucagcgaagcgcaucag

SEQ ID NO: 603947 - RNA, 15 nt, Escherichia coli CFT073
gccugaucauuuccg

SEQ ID NO: 603948 - RNA, 22 nt, Escherichia coli CFT073
gccucguggaaaccgagauaaa

SEQ ID NO: 603949 - RNA, 15 nt, Escherichia coli CFT073
gccucgguuuugcgg

SEQ ID NO: 603950 - RNA, 14 nt, Escherichia coli CFT073
gccgugcaguuugu

SEQ ID NO: 603951 - RNA, 18 nt, Escherichia coli CFT073
gccuacgggacuguucau

SEQ ID NO: 603952 - RNA, 20 nt, Escherichia coli CFT073
gccgucgcuaucgaugccgc

SEQ ID NO: 603953 - RNA, 21 nt, Escherichia coli CFT073
gccgucaccagcaucaacaac

SEQ ID NO: 603954 - RNA, 22 nt, Escherichia coli CFT073
gcgaauggcguugccguacucu

SEQ ID NO: 603955 - RNA, 15 nt, Escherichia coli CFT073
gcgaauccggcagcg

SEQ ID NO: 603956 - RNA, 13 nt, Escherichia coli CFT073
gcgaauccguucu

SEQ ID NO: 603957 - RNA, 16 nt, Escherichia coli CFT073
gcgaaucgccguuccg

SEQ ID NO: 603958 - RNA, 23 nt, Escherichia coli CFT073
gcgacaacggguuuggccgggaa

SEQ ID NO: 603959 - RNA, 18 nt, Escherichia coli CFT073
gcgacaagcucauuuccc

SEQ ID NO: 603960 - RNA, 19 nt, Escherichia coli CFT073
gcgaaugguaaucagcgac

SEQ ID NO: 603961 - RNA, 22 nt, Escherichia coli CFT073
gcgaauuaacaccaccagcgcc

SEQ ID NO: 603962 - RNA, 20 nt, Escherichia coli CFT073
gcgaauucauguucgguaaa

SEQ ID NO: 603963 - RNA, 21 nt, Escherichia coli CFT073
gcgaauucauguucgguaaac

SEQ ID NO: 603964 - RNA, 20 nt, Escherichia coli CFT073
gcgaauugagaugacgccac

SEQ ID NO: 603965 - RNA, 19 nt, Escherichia coli CFT073
gcgaauugcguuaacgcug

SEQ ID NO: 603966 - RNA, 16 nt, Escherichia coli CFT073
aagccccuucgcggaa

SEQ ID NO: 603967 - RNA, 19 nt, Escherichia coli CFT073
aagcccccacaacauugcg

SEQ ID NO: 603968 - RNA, 21 nt, Escherichia coli CFT073
aagcccccaguaaucgggcaa

SEQ ID NO: 603969 - RNA, 22 nt, Escherichia coli CFT073
aagcccccaguaaucgggcaac

SEQ ID NO: 603970 - RNA, 15 nt, Escherichia coli CFT073
gcgacaugcucugca

SEQ ID NO: 603971 - RNA, 14 nt, Escherichia coli CFT073
gcgacagaaaucag

SEQ ID NO: 603972 - RNA, 15 nt, Escherichia coli CFT073
gcgacagauucagcg

SEQ ID NO: 603973 - RNA, 16 nt, Escherichia coli CFT073
gcgacagauucagcgc

SEQ ID NO: 603974 - RNA, 20 nt, Escherichia coli CFT073
gcgacagauucgcggguaag

SEQ ID NO: 603975 - RNA, 15 nt, Escherichia coli CFT073
gcgacaucgucucca

SEQ ID NO: 603976 - RNA, 13 nt, Escherichia coli CFT073
gcgacgacuggcg

SEQ ID NO: 603977 - RNA, 15 nt, Escherichia coli CFT073
gcgaccuguuuugcc

SEQ ID NO: 603978 - RNA, 17 nt, Escherichia coli CFT073
gcgaccaguggcgggac

SEQ ID NO: 603979 - RNA, 14 nt, Escherichia coli CFT073
aagccccgcagcca

SEQ ID NO: 603980 - RNA, 17 nt, Escherichia coli CFT073
aagcccguguuucugau

SEQ ID NO: 603981 - RNA, 12 nt, Escherichia coli CFT073
gcgagcaacgca

SEQ ID NO: 603982 - RNA, 12 nt, Escherichia coli CFT073
gcgagcgccuua

SEQ ID NO: 603983 - RNA, 18 nt, Escherichia coli CFT073
gcgagcgccuuauccggc

SEQ ID NO: 603984 - RNA, 20 nt, Escherichia coli CFT073
gcgagcgccuuauccggccu

SEQ ID NO: 603985 - RNA, 21 nt, Escherichia coli CFT073
gcgagcgccuuauccggccua

SEQ ID NO: 603986 - RNA, 13 nt, Escherichia coli CFT073
gcgagcguuuuau

SEQ ID NO: 603987 - RNA, 18 nt, Escherichia coli CFT073
gcgaguucgagucucguu

SEQ ID NO: 603988 - RNA, 12 nt, Escherichia coli CFT073
gcgaguaucguu

SEQ ID NO: 603989 - RNA, 20 nt, Escherichia coli CFT073
gcgagcaaaaucguaagcag

SEQ ID NO: 603990 - RNA, 13 nt, Escherichia coli CFT073
gcgagaacgacgu

SEQ ID NO: 603991 - RNA, 14 nt, Escherichia coli CFT073
gcgacucgguugca

SEQ ID NO: 603992 - RNA, 16 nt, Escherichia coli CFT073
gcgacugaaccagcgc

SEQ ID NO: 603993 - RNA, 19 nt, Escherichia coli CFT073
gcgacugacgucacgcacc

SEQ ID NO: 603994 - RNA, 21 nt, Escherichia coli CFT073
gcgacgcugguugcgucuuau

SEQ ID NO: 603995 - RNA, 20 nt, Escherichia coli CFT073
gcgacgcugucgcgucuuau

SEQ ID NO: 603996 - RNA, 18 nt, Escherichia coli CFT073
gcgacggcuugccaugcc

SEQ ID NO: 603997 - RNA, 17 nt, Escherichia coli CFT073
gcgacgguuuccaggca

SEQ ID NO: 603998 - RNA, 21 nt, Escherichia coli CFT073
gcgacgcgggccgcgucuuau

SEQ ID NO: 603999 - RNA, 21 nt, Escherichia coli CFT073
gcgacgcugauagcgucuuau

SEQ ID NO: 604000 - RNA, 13 nt, Escherichia coli CFT073
gcgacgcggcagc

SEQ ID NO: 604001 - RNA, 13 nt, Escherichia coli CFT073
gcgaagucacaaa

SEQ ID NO: 604002 - RNA, 22 nt, Escherichia coli CFT073
gcgaagcuggucagcaucguca

SEQ ID NO: 604003 - RNA, 12 nt, Escherichia coli CFT073
gcgaauacggcu

SEQ ID NO: 604004 - RNA, 17 nt, Escherichia coli CFT073
gcgaagugaugaaaaac

SEQ ID NO: 604005 - RNA, 14 nt, Escherichia coli CFT073
gcgaaguucgccau

SEQ ID NO: 604006 - RNA, 18 nt, Escherichia coli CFT073
gcgaaguucgguaggccg

SEQ ID NO: 604007 - RNA, 19 nt, Escherichia coli CFT073
gcgaauaacaaacggcggu

SEQ ID NO: 604008 - RNA, 18 nt, Escherichia coli CFT073
gcgaacggggcugccagc

SEQ ID NO: 604009 - RNA, 22 nt, Escherichia coli CFT073
gcgaacucugacgauucuccca

SEQ ID NO: 604010 - RNA, 17 nt, Escherichia coli CFT073
gcgaacuucaggcagga

SEQ ID NO: 604011 - RNA, 16 nt, Escherichia coli CFT073
gcgaagcggcacugcu

SEQ ID NO: 604012 - RNA, 14 nt, Escherichia coli CFT073
gcgaaaucacgcac

SEQ ID NO: 604013 - RNA, 14 nt, Escherichia coli CFT073
gcgaaagcgucagc

SEQ ID NO: 604014 - RNA, 19 nt, Escherichia coli CFT073
gcgaaauugguagacgcac

SEQ ID NO: 604015 - RNA, 21 nt, Escherichia coli CFT073
gcgaacagccgcgguaaugga

SEQ ID NO: 604016 - RNA, 23 nt, Escherichia coli CFT073
gcgaacagcgucgcaucaggcac

SEQ ID NO: 604017 - RNA, 16 nt, Escherichia coli CFT073
gcgaacgggauaaacg

SEQ ID NO: 604018 - RNA, 17 nt, Escherichia coli CFT073
gcgaacgggauaaacga

SEQ ID NO: 604019 - RNA, 16 nt, Escherichia coli CFT073
gcgaaccuuccaucgc

SEQ ID NO: 604020 - RNA, 22 nt, Escherichia coli CFT073
gcgaacgacauccgccagcgcc

SEQ ID NO: 604021 - RNA, 19 nt, Escherichia coli CFT073
gcgaaccgccaaucgccac

SEQ ID NO: 604022 - RNA, 19 nt, Escherichia coli CFT073
gccuucuugcuguccggua

SEQ ID NO: 604023 - RNA, 14 nt, Escherichia coli CFT073
gccuucuccggccu

SEQ ID NO: 604024 - RNA, 21 nt, Escherichia coli CFT073
gccuucuccgggagaaggccu

SEQ ID NO: 604025 - RNA, 14 nt, Escherichia coli CFT073
gccuuauccggucu

SEQ ID NO: 604026 - RNA, 11 nt, Escherichia coli CFT073
gccuguugccc

SEQ ID NO: 604027 - RNA, 18 nt, Escherichia coli CFT073
gccuuauccggccuacgg

SEQ ID NO: 604028 - RNA, 16 nt, Escherichia coli CFT073
gccuucauaaugaaug

SEQ ID NO: 604029 - RNA, 13 nt, Escherichia coli CFT073
gccuuccaucccu

SEQ ID NO: 604030 - RNA, 19 nt, Escherichia coli CFT073
gccugcauaaaggcaaaac

SEQ ID NO: 604031 - RNA, 13 nt, Escherichia coli CFT073
gccugcaucacga

SEQ ID NO: 604032 - RNA, 17 nt, Escherichia coli CFT073
gccuguuaaucagcuaa

SEQ ID NO: 604033 - RNA, 14 nt, Escherichia coli CFT073
gccugugcgauuuc

SEQ ID NO: 604034 - RNA, 22 nt, Escherichia coli CFT073
gccuguggcgcgaccagacgca

SEQ ID NO: 604035 - RNA, 18 nt, Escherichia coli CFT073
gccuuguuuaaucaucgg

SEQ ID NO: 604036 - RNA, 20 nt, Escherichia coli CFT073
gccuuucauggucgucaccg

SEQ ID NO: 604037 - RNA, 16 nt, Escherichia coli CFT073
gccuuguucggucagc

SEQ ID NO: 604038 - RNA, 21 nt, Escherichia coli CFT073
gccuuugacuauuucaucaga

SEQ ID NO: 604039 - RNA, 21 nt, Escherichia coli CFT073
gccuuugaaaucgaacagguu

SEQ ID NO: 604040 - RNA, 17 nt, Escherichia coli CFT073
gcgaaaccuuacgccau

SEQ ID NO: 604041 - RNA, 15 nt, Escherichia coli CFT073
gcgaaacagcgcccc

SEQ ID NO: 604042 - RNA, 22 nt, Escherichia coli CFT073
gcgaaacagcugggcgauuuuc

SEQ ID NO: 604043 - RNA, 14 nt, Escherichia coli CFT073
gcgaaaaugccggu

SEQ ID NO: 604044 - RNA, 15 nt, Escherichia coli CFT073
gcgaaaccagcagcc

SEQ ID NO: 604045 - RNA, 13 nt, Escherichia coli CFT073
gcgaaacugcgug

SEQ ID NO: 604046 - RNA, 17 nt, Escherichia coli CFT073
gcgaaaaucauuuaucu

SEQ ID NO: 604047 - RNA, 21 nt, Escherichia coli CFT073
gccuuuuucagccgcaaacuc

SEQ ID NO: 604048 - RNA, 15 nt, Escherichia coli CFT073
gcgaaaaagcguuca

SEQ ID NO: 604049 - RNA, 13 nt, Escherichia coli CFT073
gcgaaaaaugaug

SEQ ID NO: 604050 - RNA, 17 nt, Escherichia coli CFT073
gccuugcagccagaacu

SEQ ID NO: 604051 - RNA, 20 nt, Escherichia coli CFT073
gccuugcgauuacguucggc

SEQ ID NO: 604052 - RNA, 18 nt, Escherichia coli CFT073
gccuugcguaccggcguu

SEQ ID NO: 604053 - RNA, 21 nt, Escherichia coli CFT073
aagcggcaacuuuauuaaguu

SEQ ID NO: 604054 - RNA, 20 nt, Escherichia coli CFT073
aagcggcaguuucagccagu

SEQ ID NO: 604055 - RNA, 16 nt, Escherichia coli CFT073
gcggcacuguuucgcc

SEQ ID NO: 604056 - RNA, 19 nt, Escherichia coli CFT073
gcggcacuccgccacguca

SEQ ID NO: 604057 - RNA, 22 nt, Escherichia coli CFT073
aagcgauaaaaauaccgagcag

SEQ ID NO: 604058 - RNA, 21 nt, Escherichia coli CFT073
aagcgauaacgcuggcagcaa

SEQ ID NO: 604059 - RNA, 19 nt, Escherichia coli CFT073
aagcgagcaguacagccgc

SEQ ID NO: 604060 - RNA, 22 nt, Escherichia coli CFT073
aagcgagcaguacagccgccag

SEQ ID NO: 604061 - RNA, 15 nt, Escherichia coli CFT073
gcgcucgauaugcgc

SEQ ID NO: 604062 - RNA, 16 nt, Escherichia coli CFT073
gcggcauccgguaacc

SEQ ID NO: 604063 - RNA, 15 nt, Escherichia coli CFT073
gcggcaguggcuaag

SEQ ID NO: 604064 - RNA, 12 nt, Escherichia coli CFT073
gcggcaguucgu

SEQ ID NO: 604065 - RNA, 16 nt, Escherichia coli CFT073
gcggcaguuuucucga

SEQ ID NO: 604066 - RNA, 20 nt, Escherichia coli CFT073
aagcgccggaugcgacgcau

SEQ ID NO: 604067 - RNA, 17 nt, Escherichia coli CFT073
aagcgcgaucgcuaccu

SEQ ID NO: 604068 - RNA, 22 nt, Escherichia coli CFT073
gcggcgcugacgcgucuuaucc

SEQ ID NO: 604069 - RNA, 22 nt, Escherichia coli CFT073
aagcgguaaaccguuaucacca

SEQ ID NO: 604070 - RNA, 20 nt, Escherichia coli CFT073
aagcguaccgccaauuacca

SEQ ID NO: 604071 - RNA, 16 nt, Escherichia coli CFT073
aagcgucgcaucaggc

SEQ ID NO: 604072 - RNA, 16 nt, Escherichia coli CFT073
aagcgucgcgccauug

SEQ ID NO: 604073 - RNA, 22 nt, Escherichia coli CFT073
aagcguccauuuacccacagac

SEQ ID NO: 604074 - RNA, 15 nt, Escherichia coli CFT073
aagcguuugcggcug

SEQ ID NO: 604075 - RNA, 17 nt, Escherichia coli CFT073
aagcguuuucugccaga

SEQ ID NO: 604076 - RNA, 15 nt, Escherichia coli CFT073
gcggcgguugacgcc

SEQ ID NO: 604077 - RNA, 17 nt, Escherichia coli CFT073
gcggcguaucuuccagg

SEQ ID NO: 604078 - RNA, 16 nt, Escherichia coli CFT073
gcggcgucauaauccg

SEQ ID NO: 604079 - RNA, 15 nt, Escherichia coli CFT073
gcggcgugauaaaag

SEQ ID NO: 604080 - RNA, 20 nt, Escherichia coli CFT073
gcggcgugaacaccucaucc

SEQ ID NO: 604081 - RNA, 17 nt, Escherichia coli CFT073
gcggcgugaacgccuua

SEQ ID NO: 604082 - RNA, 15 nt, Escherichia coli CFT073
gcggcgugaugccga

SEQ ID NO: 604083 - RNA, 15 nt, Escherichia coli CFT073
gcggcggguuaacca

SEQ ID NO: 604084 - RNA, 16 nt, Escherichia coli CFT073
gcggcucucuuucucc

SEQ ID NO: 604085 - RNA, 19 nt, Escherichia coli CFT073
gcggcgugguuccggcuua

SEQ ID NO: 604086 - RNA, 23 nt, Escherichia coli CFT073
gcggcuggcacucuuccagacca

SEQ ID NO: 604087 - RNA, 15 nt, Escherichia coli CFT073
gcggcugcgcagcgg

SEQ ID NO: 604088 - RNA, 20 nt, Escherichia coli CFT073
gcgggaaacuuccagcuuca

SEQ ID NO: 604089 - RNA, 13 nt, Escherichia coli CFT073
gcgggcaaacgga

SEQ ID NO: 604090 - RNA, 18 nt, Escherichia coli CFT073
gcgggcaacguuccagca

SEQ ID NO: 604091 - RNA, 21 nt, Escherichia coli CFT073
gcgggauguaucgcccuuacc

SEQ ID NO: 604092 - RNA, 17 nt, Escherichia coli CFT073
gcgggaauagcucaguu

SEQ ID NO: 604093 - RNA, 13 nt, Escherichia coli CFT073
gcguaaagucaaa

SEQ ID NO: 604094 - RNA, 14 nt, Escherichia coli CFT073
gcguaaaucaucgg

SEQ ID NO: 604095 - RNA, 13 nt, Escherichia coli CFT073
gcguaaacgccuu

SEQ ID NO: 604096 - RNA, 18 nt, Escherichia coli CFT073
gcguaacuuaucaauuga

SEQ ID NO: 604097 - RNA, 18 nt, Escherichia coli CFT073
gcguaaguacaguauuca

SEQ ID NO: 604098 - RNA, 19 nt, Escherichia coli CFT073
gcguaauaaccaacggcga

SEQ ID NO: 604099 - RNA, 16 nt, Escherichia coli CFT073
gcguaauagccugaug

SEQ ID NO: 604100 - RNA, 14 nt, Escherichia coli CFT073
gcguaauuauuccc

SEQ ID NO: 604101 - RNA, 16 nt, Escherichia coli CFT073
gcguacccgccugaua

SEQ ID NO: 604102 - RNA, 22 nt, Escherichia coli CFT073
gcgguucuccuggcauaaacac

SEQ ID NO: 604103 - RNA, 23 nt, Escherichia coli CFT073
gcgguuucugaacuuaagcgccu

SEQ ID NO: 604104 - RNA, 19 nt, Escherichia coli CFT073
gcgguuuuuggagagaucc

SEQ ID NO: 604105 - RNA, 23 nt, Escherichia coli CFT073
gcguaaaaaaacaaaaaccggag

SEQ ID NO: 604106 - RNA, 22 nt, Escherichia coli CFT073
gcgguuuacccugcucgcugga

SEQ ID NO: 604107 - RNA, 19 nt, Escherichia coli CFT073
gcgguuuauacggcguuuc

SEQ ID NO: 604108 - RNA, 15 nt, Escherichia coli CFT073
gcgguuguagccacg

SEQ ID NO: 604109 - RNA, 17 nt, Escherichia coli CFT073
gcgguucacgcgccaga

SEQ ID NO: 604110 - RNA, 19 nt, Escherichia coli CFT073
gcgguuacgcaccgguucc

SEQ ID NO: 604111 - RNA, 18 nt, Escherichia coli CFT073
gcgguguuuucagguuac

SEQ ID NO: 604112 - RNA, 19 nt, Escherichia coli CFT073
gcgguuaacaauacgccca

SEQ ID NO: 604113 - RNA, 18 nt, Escherichia coli CFT073
gcgguuaacgcggcagca

SEQ ID NO: 604114 - RNA, 14 nt, Escherichia coli CFT073
gcggugucgccaga

SEQ ID NO: 604115 - RNA, 13 nt, Escherichia coli CFT073
gcggugccgcgaa

SEQ ID NO: 604116 - RNA, 21 nt, Escherichia coli CFT073
gcggucuggcagcuaaugcca

SEQ ID NO: 604117 - RNA, 16 nt, Escherichia coli CFT073
gcggucggguuaagcc

SEQ ID NO: 604118 - RNA, 15 nt, Escherichia coli CFT073
gcggugauuuccgcc

SEQ ID NO: 604119 - RNA, 18 nt, Escherichia coli CFT073
gcggugcaccugccagca

SEQ ID NO: 604120 - RNA, 21 nt, Escherichia coli CFT073
gcggugacuagcagcauuuca

SEQ ID NO: 604121 - RNA, 14 nt, Escherichia coli CFT073
gcggugagcguuuc

SEQ ID NO: 604122 - RNA, 14 nt, Escherichia coli CFT073
gcggucagcgcagc

SEQ ID NO: 604123 - RNA, 20 nt, Escherichia coli CFT073
gcgguaguuccaccaguucg

SEQ ID NO: 604124 - RNA, 17 nt, Escherichia coli CFT073
gcgguaauuccggcguu

SEQ ID NO: 604125 - RNA, 23 nt, Escherichia coli CFT073
gcgguagcgggcgcaaugcccgc

SEQ ID NO: 604126 - RNA, 16 nt, Escherichia coli CFT073
gcgguaauaaacgccc

SEQ ID NO: 604127 - RNA, 19 nt, Escherichia coli CFT073
gcgguaacacgcugcucau

SEQ ID NO: 604128 - RNA, 22 nt, Escherichia coli CFT073
gcgucuugaauaaauuggcugg

SEQ ID NO: 604129 - RNA, 17 nt, Escherichia coli CFT073
gcgugauaacaguuggu

SEQ ID NO: 604130 - RNA, 19 nt, Escherichia coli CFT073
gcgucuuaucagcauacgc

SEQ ID NO: 604131 - RNA, 16 nt, Escherichia coli CFT073
gcgucuuaucaggccu

SEQ ID NO: 604132 - RNA, 20 nt, Escherichia coli CFT073
gcgucuuaucaggccuacca

SEQ ID NO: 604133 - RNA, 20 nt, Escherichia coli CFT073
gcgucuuaucaggccuacga

SEQ ID NO: 604134 - RNA, 20 nt, Escherichia coli CFT073
gcgucuuaucaggccuacgc

SEQ ID NO: 604135 - RNA, 20 nt, Escherichia coli CFT073
gcgucuuaucaggccuacgu

SEQ ID NO: 604136 - RNA, 20 nt, Escherichia coli CFT073
gcgucuuaucaugccuacga

SEQ ID NO: 604137 - RNA, 16 nt, Escherichia coli CFT073
gcgucuuauccgaccu

SEQ ID NO: 604138 - RNA, 20 nt, Escherichia coli CFT073
gcgucuuauccgaccugcgg

SEQ ID NO: 604139 - RNA, 15 nt, Escherichia coli CFT073
gcgucuggcgaaaac

SEQ ID NO: 604140 - RNA, 17 nt, Escherichia coli CFT073
gcgucguauccagcguu

SEQ ID NO: 604141 - RNA, 23 nt, Escherichia coli CFT073
gcguuacccuuguggauaacgcc

SEQ ID NO: 604142 - RNA, 17 nt, Escherichia coli CFT073
gcguuacuaccggcgug

SEQ ID NO: 604143 - RNA, 22 nt, Escherichia coli CFT073
gcguguugcuccacgccagcgu

SEQ ID NO: 604144 - RNA, 20 nt, Escherichia coli CFT073
gcguguuguaaaacgcgccc

SEQ ID NO: 604145 - RNA, 15 nt, Escherichia coli CFT073
gcguuaaaaucagcg

SEQ ID NO: 604146 - RNA, 20 nt, Escherichia coli CFT073
gcguuaaacuggaaaaccgc

SEQ ID NO: 604147 - RNA, 15 nt, Escherichia coli CFT073
gcguuaagcccaguu

SEQ ID NO: 604148 - RNA, 18 nt, Escherichia coli CFT073
gcguuaauauaaacgaca

SEQ ID NO: 604149 - RNA, 19 nt, Escherichia coli CFT073
gcguucaccuaacagcauc

SEQ ID NO: 604150 - RNA, 19 nt, Escherichia coli CFT073
gcguuauccggccaacaaa

SEQ ID NO: 604151 - RNA, 21 nt, Escherichia coli CFT073
gcguuauccggccaacaaaaa

SEQ ID NO: 604152 - RNA, 14 nt, Escherichia coli CFT073
gcguggaggggcga

SEQ ID NO: 604153 - RNA, 12 nt, Escherichia coli CFT073
gcgucagcuuca

SEQ ID NO: 604154 - RNA, 12 nt, Escherichia coli CFT073
gcgucaccaucc

SEQ ID NO: 604155 - RNA, 21 nt, Escherichia coli CFT073
gcguauccagacccagcuuca

SEQ ID NO: 604156 - RNA, 15 nt, Escherichia coli CFT073
gcguaguuuaugccg

SEQ ID NO: 604157 - RNA, 16 nt, Escherichia coli CFT073
gcguauaaaccauauc

SEQ ID NO: 604158 - RNA, 21 nt, Escherichia coli CFT073
gcguagguguauugcccgccg

SEQ ID NO: 604159 - RNA, 14 nt, Escherichia coli CFT073
gcguagccaggcuu

SEQ ID NO: 604160 - RNA, 14 nt, Escherichia coli CFT073
gcgucgccagcagc

SEQ ID NO: 604161 - RNA, 20 nt, Escherichia coli CFT073
gcgucgcaucaggcauuaug

SEQ ID NO: 604162 - RNA, 14 nt, Escherichia coli CFT073
gcgucgcauccggc

SEQ ID NO: 604163 - RNA, 14 nt, Escherichia coli CFT073
gcgucgauugcuca

SEQ ID NO: 604164 - RNA, 15 nt, Escherichia coli CFT073
gcuucacgcaccaua

SEQ ID NO: 604165 - RNA, 14 nt, Escherichia coli CFT073
gcuucacgcccagc

SEQ ID NO: 604166 - RNA, 13 nt, Escherichia coli CFT073
gcuuauugccgga

SEQ ID NO: 604167 - RNA, 20 nt, Escherichia coli CFT073
gcuuauugccggaugcggcg

SEQ ID NO: 604168 - RNA, 14 nt, Escherichia coli CFT073
gcuucaaccaguuu

SEQ ID NO: 604169 - RNA, 15 nt, Escherichia coli CFT073
gcuucaaucaacaua

SEQ ID NO: 604170 - RNA, 14 nt, Escherichia coli CFT073
gcuuacggcgcugu

SEQ ID NO: 604171 - RNA, 14 nt, Escherichia coli CFT073
gcuuacuggucaau

SEQ ID NO: 604172 - RNA, 16 nt, Escherichia coli CFT073
gcuuaucaggccuaca

SEQ ID NO: 604173 - RNA, 16 nt, Escherichia coli CFT073
gcuuaucgggccuaca

SEQ ID NO: 604174 - RNA, 17 nt, Escherichia coli CFT073
gcuuaucgggccuacaa

SEQ ID NO: 604175 - RNA, 17 nt, Escherichia coli CFT073
gcuuaucaggccuacga

SEQ ID NO: 604176 - RNA, 19 nt, Escherichia coli CFT073
gcuuaucaggccuacgauc

SEQ ID NO: 604177 - RNA, 15 nt, Escherichia coli CFT073
gcuuaagaagaacgg

SEQ ID NO: 604178 - RNA, 14 nt, Escherichia coli CFT073
gcuguuuuccagca

SEQ ID NO: 604179 - RNA, 13 nt, Escherichia coli CFT073
gcuuaaaguguuc

SEQ ID NO: 604180 - RNA, 23 nt, Escherichia coli CFT073
gcuuaacagauugagaauaaugc

SEQ ID NO: 604181 - RNA, 16 nt, Escherichia coli CFT073
gcuuacgcccgccugc

SEQ ID NO: 604182 - RNA, 13 nt, Escherichia coli CFT073
gcuuaaugcacgg

SEQ ID NO: 604183 - RNA, 17 nt, Escherichia coli CFT073
gcuuaauugcgcagcgg

SEQ ID NO: 604184 - RNA, 12 nt, Escherichia coli CFT073
gcugugggguau

SEQ ID NO: 604185 - RNA, 14 nt, Escherichia coli CFT073
gcuguuaccagaca

SEQ ID NO: 604186 - RNA, 16 nt, Escherichia coli CFT073
gcuguuguuccagcuu

SEQ ID NO: 604187 - RNA, 14 nt, Escherichia coli CFT073
gcugucgcgcagca

SEQ ID NO: 604188 - RNA, 15 nt, Escherichia coli CFT073
gcugucgaucagaga

SEQ ID NO: 604189 - RNA, 16 nt, Escherichia coli CFT073
gcugucgaucuccggc

SEQ ID NO: 604190 - RNA, 12 nt, Escherichia coli CFT073
gcugucggcacu

SEQ ID NO: 604191 - RNA, 17 nt, Escherichia coli CFT073
gcugucggucaaauuca

SEQ ID NO: 604192 - RNA, 22 nt, Escherichia coli CFT073
gcugugccuccugcggcuucaa

SEQ ID NO: 604193 - RNA, 16 nt, Escherichia coli CFT073
gcugugaagcaccugc

SEQ ID NO: 604194 - RNA, 21 nt, Escherichia coli CFT073
gcugugacauccagaucacgc

SEQ ID NO: 604195 - RNA, 16 nt, Escherichia coli CFT073
gcugucauccagcagu

SEQ ID NO: 604196 - RNA, 14 nt, Escherichia coli CFT073
gcugucauccagca

SEQ ID NO: 604197 - RNA, 14 nt, Escherichia coli CFT073
gcugucauggcuga

SEQ ID NO: 604198 - RNA, 15 nt, Escherichia coli CFT073
gcugucaguagcaaa

SEQ ID NO: 604199 - RNA, 18 nt, Escherichia coli CFT073
gcuguaguccaggccuga

SEQ ID NO: 604200 - RNA, 15 nt, Escherichia coli CFT073
gcuguagccagcucg

SEQ ID NO: 604201 - RNA, 15 nt, Escherichia coli CFT073
gcuguagaggcguuc

SEQ ID NO: 604202 - RNA, 14 nt, Escherichia coli CFT073
gcuguacucaccaa

SEQ ID NO: 604203 - RNA, 14 nt, Escherichia coli CFT073
gcuguaccagcaac

SEQ ID NO: 604204 - RNA, 20 nt, Escherichia coli CFT073
gcuguaauuaccagcgcagg

SEQ ID NO: 604205 - RNA, 17 nt, Escherichia coli CFT073
gcuguaacgaucaauuu

SEQ ID NO: 604206 - RNA, 20 nt, Escherichia coli CFT073
gcuguaacguuuggcacgcc

SEQ ID NO: 604207 - RNA, 21 nt, Escherichia coli CFT073
gcuguaagccaaaccgaaaca

SEQ ID NO: 604208 - RNA, 19 nt, Escherichia coli CFT073
gcuguaagccgccgccauc

SEQ ID NO: 604209 - RNA, 19 nt, Escherichia coli CFT073
gcugcucaggcgacgcgga

SEQ ID NO: 604210 - RNA, 14 nt, Escherichia coli CFT073
gcugcuccagcgua

SEQ ID NO: 604211 - RNA, 17 nt, Escherichia coli CFT073
gcuggcguaacgacagg

SEQ ID NO: 604212 - RNA, 14 nt, Escherichia coli CFT073
gcuggcggcuggca

SEQ ID NO: 604213 - RNA, 15 nt, Escherichia coli CFT073
gcuggcggcuggcac

SEQ ID NO: 604214 - RNA, 21 nt, Escherichia coli CFT073
gcuggcuuuacccuggcgcga

SEQ ID NO: 604215 - RNA, 21 nt, Escherichia coli CFT073
gcugggaaaucaccaccagca

SEQ ID NO: 604216 - RNA, 21 nt, Escherichia coli CFT073
gcugggccaucaggcgacacu

SEQ ID NO: 604217 - RNA, 22 nt, Escherichia coli CFT073
gcuggucagcaucgucaacgcc

SEQ ID NO: 604218 - RNA, 18 nt, Escherichia coli CFT073
gcugguaaugcucaagca

SEQ ID NO: 604219 - RNA, 14 nt, Escherichia coli CFT073
gcuucuaccgucug

SEQ ID NO: 604220 - RNA, 17 nt, Escherichia coli CFT073
gcuucuacgccaucagu

SEQ ID NO: 604221 - RNA, 21 nt, Escherichia coli CFT073
gcuucuacgccaucaguuuca

SEQ ID NO: 604222 - RNA, 14 nt, Escherichia coli CFT073
gcuucuaucgcauu

SEQ ID NO: 604223 - RNA, 21 nt, Escherichia coli CFT073
gcuucguucaucucgaauacg

SEQ ID NO: 604224 - RNA, 22 nt, Escherichia coli CFT073
gcuucucuugcuggauuucccu

SEQ ID NO: 604225 - RNA, 12 nt, Escherichia coli CFT073
gcuucuggcugg

SEQ ID NO: 604226 - RNA, 13 nt, Escherichia coli CFT073
gcuucuucaaaaa

SEQ ID NO: 604227 - RNA, 16 nt, Escherichia coli CFT073
gcuugaaaccgguuug

SEQ ID NO: 604228 - RNA, 16 nt, Escherichia coli CFT073
gcuucuucuuucgcca

SEQ ID NO: 604229 - RNA, 18 nt, Escherichia coli CFT073
gcuugaaguuacugacau

SEQ ID NO: 604230 - RNA, 17 nt, Escherichia coli CFT073
gcuugagccguagguga

SEQ ID NO: 604231 - RNA, 13 nt, Escherichia coli CFT073
gcuugauuucagg

SEQ ID NO: 604232 - RNA, 18 nt, Escherichia coli CFT073
gcuugcgcgcaaucagca

SEQ ID NO: 604233 - RNA, 20 nt, Escherichia coli CFT073
gcuugcgauguucuucacca

SEQ ID NO: 604234 - RNA, 12 nt, Escherichia coli CFT073
gcuucgcgcugu

SEQ ID NO: 604235 - RNA, 14 nt, Escherichia coli CFT073
gcuucggucgcccc

SEQ ID NO: 604236 - RNA, 16 nt, Escherichia coli CFT073
gcuucgcggacuucug

SEQ ID NO: 604237 - RNA, 18 nt, Escherichia coli CFT073
gcuuccagcaaauccauc

SEQ ID NO: 604238 - RNA, 12 nt, Escherichia coli CFT073
gcuucccaacgc

SEQ ID NO: 604239 - RNA, 13 nt, Escherichia coli CFT073
gcuuccgggcugc

SEQ ID NO: 604240 - RNA, 20 nt, Escherichia coli CFT073
gcuucagccagaggcggcaa

SEQ ID NO: 604241 - RNA, 19 nt, Escherichia coli CFT073
gcuucagcgaucgcuuucg

SEQ ID NO: 604242 - RNA, 23 nt, Escherichia coli CFT073
gcuucaguaauaccgaacgcaga

SEQ ID NO: 604243 - RNA, 19 nt, Escherichia coli CFT073
gcuucaucagguugaggaa

SEQ ID NO: 604244 - RNA, 13 nt, Escherichia coli CFT073
gcuugcugaugca

SEQ ID NO: 604245 - RNA, 16 nt, Escherichia coli CFT073
gcuuucaacguagccu

SEQ ID NO: 604246 - RNA, 18 nt, Escherichia coli CFT073
gcuuuaucaucggucagc

SEQ ID NO: 604247 - RNA, 22 nt, Escherichia coli CFT073
gcuuuauccugcccgcuccagc

SEQ ID NO: 604248 - RNA, 23 nt, Escherichia coli CFT073
gcuuuauccugcccgcuccagcu

SEQ ID NO: 604249 - RNA, 14 nt, Escherichia coli CFT073
gcuuuaaucagcac

SEQ ID NO: 604250 - RNA, 14 nt, Escherichia coli CFT073
gcuuuaccaucgcg

SEQ ID NO: 604251 - RNA, 20 nt, Escherichia coli CFT073
gcuuuacuccuaauggagaa

SEQ ID NO: 604252 - RNA, 21 nt, Escherichia coli CFT073
gcuuuccggaaaaaucaaaaa

SEQ ID NO: 604253 - RNA, 22 nt, Escherichia coli CFT073
gcuuucacuugacuaagcguuu

SEQ ID NO: 604254 - RNA, 14 nt, Escherichia coli CFT073
gcuuucauucagaa

SEQ ID NO: 604255 - RNA, 20 nt, Escherichia coli CFT073
gcuuucauuuucggcaguga

SEQ ID NO: 604256 - RNA, 16 nt, Escherichia coli CFT073
gcuuguggaacgcuga

SEQ ID NO: 604257 - RNA, 21 nt, Escherichia coli CFT073
gcuuuaaaacauaucaugaaa

SEQ ID NO: 604258 - RNA, 19 nt, Escherichia coli CFT073
gcuuuaaaauuauccagcg

SEQ ID NO: 604259 - RNA, 13 nt, Escherichia coli CFT073
gcuuguaaaacag

SEQ ID NO: 604260 - RNA, 22 nt, Escherichia coli CFT073
ggaaacagccaaucauaaacgc

SEQ ID NO: 604261 - RNA, 14 nt, Escherichia coli CFT073
ggaaaaucuggcgc

SEQ ID NO: 604262 - RNA, 16 nt, Escherichia coli CFT073
ggaaaaugaucaauaa

SEQ ID NO: 604263 - RNA, 16 nt, Escherichia coli CFT073
ggaaaaugccggaugg

SEQ ID NO: 604264 - RNA, 19 nt, Escherichia coli CFT073
ggaaaaacuacccgccagu

SEQ ID NO: 604265 - RNA, 15 nt, Escherichia coli CFT073
ggaaaaagaucagcg

SEQ ID NO: 604266 - RNA, 17 nt, Escherichia coli CFT073
gcuuuuuuacgccugca

SEQ ID NO: 604267 - RNA, 14 nt, Escherichia coli CFT073
gcuuuuuuaugcac

SEQ ID NO: 604268 - RNA, 20 nt, Escherichia coli CFT073
gcuuuuucgcgauagccgcu

SEQ ID NO: 604269 - RNA, 13 nt, Escherichia coli CFT073
gcuuuuugauacu

SEQ ID NO: 604270 - RNA, 19 nt, Escherichia coli CFT073
gcuuuuuugucaccuuuuc

SEQ ID NO: 604271 - RNA, 23 nt, Escherichia coli CFT073
ggaaagcgaggcuuauccggcau

SEQ ID NO: 604272 - RNA, 19 nt, Escherichia coli CFT073
ggaaagcguacccgccuga

SEQ ID NO: 604273 - RNA, 22 nt, Escherichia coli CFT073
ggaaauaagaagccauaaucug

SEQ ID NO: 604274 - RNA, 23 nt, Escherichia coli CFT073
ggaaaucauccagcacguuaaca

SEQ ID NO: 604275 - RNA, 15 nt, Escherichia coli CFT073
ggaaaaggccacggu

SEQ ID NO: 604276 - RNA, 21 nt, Escherichia coli CFT073
ggaaacucugcuggcggaaca

SEQ ID NO: 604277 - RNA, 16 nt, Escherichia coli CFT073
gcuuugugcuucaguu

SEQ ID NO: 604278 - RNA, 21 nt, Escherichia coli CFT073
gcuuuguuacccccauccacg

SEQ ID NO: 604279 - RNA, 15 nt, Escherichia coli CFT073
gcuuuuaccaucgcg

SEQ ID NO: 604280 - RNA, 22 nt, Escherichia coli CFT073
gcuuuuacggcuuuggcgguuu

SEQ ID NO: 604281 - RNA, 22 nt, Escherichia coli CFT073
gcuuuuaaaugcccgacaaaaa

SEQ ID NO: 604282 - RNA, 15 nt, Escherichia coli CFT073
gcuuuuggcgcguuc

SEQ ID NO: 604283 - RNA, 20 nt, Escherichia coli CFT073
gcuuuuuauguuagccgccu

SEQ ID NO: 604284 - RNA, 17 nt, Escherichia coli CFT073
gcuuuuguggucaccau

SEQ ID NO: 604285 - RNA, 15 nt, Escherichia coli CFT073
gcuuugauccgccag

SEQ ID NO: 604286 - RNA, 16 nt, Escherichia coli CFT073
gcuuugauccgccaga

SEQ ID NO: 604287 - RNA, 23 nt, Escherichia coli CFT073
gcuuucuucuggguugccugaug

SEQ ID NO: 604288 - RNA, 14 nt, Escherichia coli CFT073
gcuuucucaacaaa

SEQ ID NO: 604289 - RNA, 22 nt, Escherichia coli CFT073
gcuuucgucgagaauguagaua

SEQ ID NO: 604290 - RNA, 21 nt, Escherichia coli CFT073
gcguucaguuuauucugccgc

SEQ ID NO: 604291 - RNA, 22 nt, Escherichia coli CFT073
gcguucacgccgcauccggcau

SEQ ID NO: 604292 - RNA, 22 nt, Escherichia coli CFT073
gcguucacgccgcauccggcca

SEQ ID NO: 604293 - RNA, 17 nt, Escherichia coli CFT073
gcucauagaccauugca

SEQ ID NO: 604294 - RNA, 20 nt, Escherichia coli CFT073
gcucauaugcagcauccagc

SEQ ID NO: 604295 - RNA, 12 nt, Escherichia coli CFT073
gcucaguuggua

SEQ ID NO: 604296 - RNA, 13 nt, Escherichia coli CFT073
gcucauccuucag

SEQ ID NO: 604297 - RNA, 16 nt, Escherichia coli CFT073
gcucaggcuggcugac

SEQ ID NO: 604298 - RNA, 23 nt, Escherichia coli CFT073
gcuccacaagaaugccugccagc

SEQ ID NO: 604299 - RNA, 14 nt, Escherichia coli CFT073
gcucauuccgccgc

SEQ ID NO: 604300 - RNA, 17 nt, Escherichia coli CFT073
gcucaucguuacgccca

SEQ ID NO: 604301 - RNA, 16 nt, Escherichia coli CFT073
gcuccauaauugccag

SEQ ID NO: 604302 - RNA, 19 nt, Escherichia coli CFT073
gcuccaguuaacgccgcgc

SEQ ID NO: 604303 - RNA, 20 nt, Escherichia coli CFT073
gcuccaucauccgcggauaa

SEQ ID NO: 604304 - RNA, 11 nt, Escherichia coli CFT073
gcuccaucaug

SEQ ID NO: 604305 - RNA, 17 nt, Escherichia coli CFT073
gcuccauuccaucgccu

SEQ ID NO: 604306 - RNA, 20 nt, Escherichia coli CFT073
gcucccgcaggagcgccgaa

SEQ ID NO: 604307 - RNA, 20 nt, Escherichia coli CFT073
gcuccagugccuggcauaac

SEQ ID NO: 604308 - RNA, 22 nt, Escherichia coli CFT073
gcuccagcccgcgucguucauc

SEQ ID NO: 604309 - RNA, 13 nt, Escherichia coli CFT073
gcuccgaagugau

SEQ ID NO: 604310 - RNA, 18 nt, Escherichia coli CFT073
gcucgcgauacgcuucaa

SEQ ID NO: 604311 - RNA, 15 nt, Escherichia coli CFT073
gcucgcgauggcgau

SEQ ID NO: 604312 - RNA, 12 nt, Escherichia coli CFT073
gcucgccuacau

SEQ ID NO: 604313 - RNA, 12 nt, Escherichia coli CFT073
gcucgccauuuu

SEQ ID NO: 604314 - RNA, 17 nt, Escherichia coli CFT073
gcucgcaggcggcaucg

SEQ ID NO: 604315 - RNA, 21 nt, Escherichia coli CFT073
gcugacauaaacaccagcaau

SEQ ID NO: 604316 - RNA, 23 nt, Escherichia coli CFT073
gcugacacaucuuuuccggccuu

SEQ ID NO: 604317 - RNA, 16 nt, Escherichia coli CFT073
gcugacuuucaaacgc

SEQ ID NO: 604318 - RNA, 12 nt, Escherichia coli CFT073
gcugagaaaaag

SEQ ID NO: 604319 - RNA, 15 nt, Escherichia coli CFT073
gcugagauccgucag

SEQ ID NO: 604320 - RNA, 22 nt, Escherichia coli CFT073
gcugagaucugccuuugccgga

SEQ ID NO: 604321 - RNA, 15 nt, Escherichia coli CFT073
gcugagccgacgcca

SEQ ID NO: 604322 - RNA, 16 nt, Escherichia coli CFT073
gcugauaaccgccgcc

SEQ ID NO: 604323 - RNA, 13 nt, Escherichia coli CFT073
gcugauaacgcca

SEQ ID NO: 604324 - RNA, 13 nt, Escherichia coli CFT073
gcugaucaccgua

SEQ ID NO: 604325 - RNA, 17 nt, Escherichia coli CFT073
gcugaacgcaggccgcc

SEQ ID NO: 604326 - RNA, 17 nt, Escherichia coli CFT073
gcugaacagggcgucac

SEQ ID NO: 604327 - RNA, 13 nt, Escherichia coli CFT073
gcugaacagucgc

SEQ ID NO: 604328 - RNA, 16 nt, Escherichia coli CFT073
gcugaauuucgccgca

SEQ ID NO: 604329 - RNA, 21 nt, Escherichia coli CFT073
gcugaauuuuuuucucgcggc

SEQ ID NO: 604330 - RNA, 16 nt, Escherichia coli CFT073
gcugacaaagugcacu

SEQ ID NO: 604331 - RNA, 15 nt, Escherichia coli CFT073
gcugaauacgcacca

SEQ ID NO: 604332 - RNA, 20 nt, Escherichia coli CFT073
gcugaauacgcagcgucauc

SEQ ID NO: 604333 - RNA, 16 nt, Escherichia coli CFT073
gcugaagggcaucagc

SEQ ID NO: 604334 - RNA, 22 nt, Escherichia coli CFT073
gcucugccauaaacgguuucag

SEQ ID NO: 604335 - RNA, 18 nt, Escherichia coli CFT073
gcucuuuauccagcagcc

SEQ ID NO: 604336 - RNA, 14 nt, Escherichia coli CFT073
gcucuuucacuuua

SEQ ID NO: 604337 - RNA, 17 nt, Escherichia coli CFT073
gcucucgcuucugguga

SEQ ID NO: 604338 - RNA, 17 nt, Escherichia coli CFT073
gcugaaaucaccgccac

SEQ ID NO: 604339 - RNA, 18 nt, Escherichia coli CFT073
gcugaacacauuugucgg

SEQ ID NO: 604340 - RNA, 19 nt, Escherichia coli CFT073
gcugaacacauuugucgga

SEQ ID NO: 604341 - RNA, 18 nt, Escherichia coli CFT073
gcucuuucgacagcgauu

SEQ ID NO: 604342 - RNA, 19 nt, Escherichia coli CFT073
gcucuuuguaggccugaua

SEQ ID NO: 604343 - RNA, 16 nt, Escherichia coli CFT073
gcucuuuuaacuuacg

SEQ ID NO: 604344 - RNA, 15 nt, Escherichia coli CFT073
gcucuuuuucggggc

SEQ ID NO: 604345 - RNA, 15 nt, Escherichia coli CFT073
gcucguucagcgguc

SEQ ID NO: 604346 - RNA, 22 nt, Escherichia coli CFT073
gcugaugaaggugcuaugcaua

SEQ ID NO: 604347 - RNA, 14 nt, Escherichia coli CFT073
gcugcacauccggu

SEQ ID NO: 604348 - RNA, 22 nt, Escherichia coli CFT073
gcugcaccaacaucaugccagu

SEQ ID NO: 604349 - RNA, 14 nt, Escherichia coli CFT073
gcugcaaugccauu

SEQ ID NO: 604350 - RNA, 16 nt, Escherichia coli CFT073
gcugcagccaguugcu

SEQ ID NO: 604351 - RNA, 11 nt, Escherichia coli CFT073
gcugcaccagg

SEQ ID NO: 604352 - RNA, 14 nt, Escherichia coli CFT073
gcugcaccagcagc

SEQ ID NO: 604353 - RNA, 15 nt, Escherichia coli CFT073
gcugcaccagcagcg

SEQ ID NO: 604354 - RNA, 20 nt, Escherichia coli CFT073
gcugcaccagcagcgucagc

SEQ ID NO: 604355 - RNA, 17 nt, Escherichia coli CFT073
gcugcauccugcaccac

SEQ ID NO: 604356 - RNA, 13 nt, Escherichia coli CFT073
gcugcauuucugg

SEQ ID NO: 604357 - RNA, 13 nt, Escherichia coli CFT073
gcugcgucuuccg

SEQ ID NO: 604358 - RNA, 21 nt, Escherichia coli CFT073
gcugcgucuuccgcaauuccg

SEQ ID NO: 604359 - RNA, 20 nt, Escherichia coli CFT073
gcugcucacaccaugccaga

SEQ ID NO: 604360 - RNA, 17 nt, Escherichia coli CFT073
gcugcgccauauaccgc

SEQ ID NO: 604361 - RNA, 13 nt, Escherichia coli CFT073
gucccacaguugu

SEQ ID NO: 604362 - RNA, 23 nt, Escherichia coli CFT073
guccaguaaugcaacacuaccgg

SEQ ID NO: 604363 - RNA, 14 nt, Escherichia coli CFT073
guccaggccugauu

SEQ ID NO: 604364 - RNA, 18 nt, Escherichia coli CFT073
guccagcgccugaauaau

SEQ ID NO: 604365 - RNA, 16 nt, Escherichia coli CFT073
guccagcccuucucgc

SEQ ID NO: 604366 - RNA, 15 nt, Escherichia coli CFT073
guccgccagaauacc

SEQ ID NO: 604367 - RNA, 18 nt, Escherichia coli CFT073
guccgccaccgccaaacg

SEQ ID NO: 604368 - RNA, 13 nt, Escherichia coli CFT073
gucaggcaucggc

SEQ ID NO: 604369 - RNA, 20 nt, Escherichia coli CFT073
gucaggcuaauaccgucgau

SEQ ID NO: 604370 - RNA, 19 nt, Escherichia coli CFT073
gucaggaaggcgauauccg

SEQ ID NO: 604371 - RNA, 19 nt, Escherichia coli CFT073
gucaggaucaccaauacca

SEQ ID NO: 604372 - RNA, 14 nt, Escherichia coli CFT073
gucaguagaauaau

SEQ ID NO: 604373 - RNA, 19 nt, Escherichia coli CFT073
gucaggugagcgucauuau

SEQ ID NO: 604374 - RNA, 14 nt, Escherichia coli CFT073
guaucgaaaacauc

SEQ ID NO: 604375 - RNA, 16 nt, Escherichia coli CFT073
guaucgaccacuaaca

SEQ ID NO: 604376 - RNA, 19 nt, Escherichia coli CFT073
guaucgccuguacgcgcca

SEQ ID NO: 604377 - RNA, 14 nt, Escherichia coli CFT073
gucauaaaucagcg

SEQ ID NO: 604378 - RNA, 21 nt, Escherichia coli CFT073
gucauaaaaucaauaugcaua

SEQ ID NO: 604379 - RNA, 19 nt, Escherichia coli CFT073
gucaguugugccaguuuca

SEQ ID NO: 604380 - RNA, 17 nt, Escherichia coli CFT073
gucauaaucauuaacgg

SEQ ID NO: 604381 - RNA, 23 nt, Escherichia coli CFT073
gucagugccugcgccaccguuuc

SEQ ID NO: 604382 - RNA, 22 nt, Escherichia coli CFT073
gucaguaguuuuugcagaugga

SEQ ID NO: 604383 - RNA, 17 nt, Escherichia coli CFT073
gucaguaucgcggggau

SEQ ID NO: 604384 - RNA, 22 nt, Escherichia coli CFT073
gucagucccugcucuuucagca

SEQ ID NO: 604385 - RNA, 17 nt, Escherichia coli CFT073
gucaugaugcuccgcca

SEQ ID NO: 604386 - RNA, 23 nt, Escherichia coli CFT073
guccacaaaccguuaauccgccc

SEQ ID NO: 604387 - RNA, 17 nt, Escherichia coli CFT073
gucauguauauuaucca

SEQ ID NO: 604388 - RNA, 15 nt, Escherichia coli CFT073
gucauuaugcuggaa

SEQ ID NO: 604389 - RNA, 19 nt, Escherichia coli CFT073
gucauugauaauauccguc

SEQ ID NO: 604390 - RNA, 18 nt, Escherichia coli CFT073
gucauuguaaauugcagu

SEQ ID NO: 604391 - RNA, 20 nt, Escherichia coli CFT073
guccuucagcaccugcauca

SEQ ID NO: 604392 - RNA, 14 nt, Escherichia coli CFT073
guccuguaacgcag

SEQ ID NO: 604393 - RNA, 14 nt, Escherichia coli CFT073
guccggcugccagc

SEQ ID NO: 604394 - RNA, 13 nt, Escherichia coli CFT073
gucgaucuccggc

SEQ ID NO: 604395 - RNA, 20 nt, Escherichia coli CFT073
gucgagaaucaacacaccgc

SEQ ID NO: 604396 - RNA, 23 nt, Escherichia coli CFT073
gucgccggaugcggugcgagcgc

SEQ ID NO: 604397 - RNA, 23 nt, Escherichia coli CFT073
gucgccgucaggcaagccgcuaa

SEQ ID NO: 604398 - RNA, 19 nt, Escherichia coli CFT073
gucgccgguuugcaguaug

SEQ ID NO: 604399 - RNA, 12 nt, Escherichia coli CFT073
gucgccguaagc

SEQ ID NO: 604400 - RNA, 14 nt, Escherichia coli CFT073
gucgcgcugggcuu

SEQ ID NO: 604401 - RNA, 17 nt, Escherichia coli CFT073
gucgccugcuuuaucga

SEQ ID NO: 604402 - RNA, 14 nt, Escherichia coli CFT073
gucgccuaccauca

SEQ ID NO: 604403 - RNA, 13 nt, Escherichia coli CFT073
gucgcccuguaau

SEQ ID NO: 604404 - RNA, 20 nt, Escherichia coli CFT073
gucgccaccauacugguagg

SEQ ID NO: 604405 - RNA, 19 nt, Escherichia coli CFT073
gucgccagaaacaccguca

SEQ ID NO: 604406 - RNA, 15 nt, Escherichia coli CFT073
gucgcagccagcgca

SEQ ID NO: 604407 - RNA, 15 nt, Escherichia coli CFT073
gucgccacaaucagc

SEQ ID NO: 604408 - RNA, 16 nt, Escherichia coli CFT073
gucgauucgccgaugc

SEQ ID NO: 604409 - RNA, 19 nt, Escherichia coli CFT073
gucgauucgccgaugcaua

SEQ ID NO: 604410 - RNA, 14 nt, Escherichia coli CFT073
gucggggucgcgag

SEQ ID NO: 604411 - RNA, 17 nt, Escherichia coli CFT073
gucgggucgccguaagc

SEQ ID NO: 604412 - RNA, 24 nt, Escherichia coli CFT073
gucggugccaucauacagccagca

SEQ ID NO: 604413 - RNA, 15 nt, Escherichia coli CFT073
gucggggccagcgca

SEQ ID NO: 604414 - RNA, 14 nt, Escherichia coli CFT073
gucgggcaucagaa

SEQ ID NO: 604415 - RNA, 16 nt, Escherichia coli CFT073
gucgggacacgaacgu

SEQ ID NO: 604416 - RNA, 21 nt, Escherichia coli CFT073
gucgcggaccaacaaaaaucu

SEQ ID NO: 604417 - RNA, 14 nt, Escherichia coli CFT073
gucguaagcgccaa

SEQ ID NO: 604418 - RNA, 18 nt, Escherichia coli CFT073
gucgguuacaccgcgcgu

SEQ ID NO: 604419 - RNA, 18 nt, Escherichia coli CFT073
gucgguucguaggccaga

SEQ ID NO: 604420 - RNA, 12 nt, Escherichia coli CFT073
gucgguuucauu

SEQ ID NO: 604421 - RNA, 19 nt, Escherichia coli CFT073
gucgguuucgcgcaggauc

SEQ ID NO: 604422 - RNA, 18 nt, Escherichia coli CFT073
gucguccauuauuuucgu

SEQ ID NO: 604423 - RNA, 16 nt, Escherichia coli CFT073
gucgucacucacgcug

SEQ ID NO: 604424 - RNA, 15 nt, Escherichia coli CFT073
gucguaggccugaua

SEQ ID NO: 604425 - RNA, 16 nt, Escherichia coli CFT073
gucguuccccaucacc

SEQ ID NO: 604426 - RNA, 23 nt, Escherichia coli CFT073
gucguuccccaucaccugacagc

SEQ ID NO: 604427 - RNA, 16 nt, Escherichia coli CFT073
gucgugguaucgccac

SEQ ID NO: 604428 - RNA, 13 nt, Escherichia coli CFT073
gucuugcguuucu

SEQ ID NO: 604429 - RNA, 20 nt, Escherichia coli CFT073
gucuuaucuggcauuugcac

SEQ ID NO: 604430 - RNA, 21 nt, Escherichia coli CFT073
gucuuccgcaauuccgcccgu

SEQ ID NO: 604431 - RNA, 14 nt, Escherichia coli CFT073
gucuguuuuaucac

SEQ ID NO: 604432 - RNA, 17 nt, Escherichia coli CFT073
gucuuauccgaccugcg

SEQ ID NO: 604433 - RNA, 17 nt, Escherichia coli CFT073
gucuuccgugccugacg

SEQ ID NO: 604434 - RNA, 17 nt, Escherichia coli CFT073
gucuuccggcuguagcc

SEQ ID NO: 604435 - RNA, 16 nt, Escherichia coli CFT073
gucuuccgggaacggc

SEQ ID NO: 604436 - RNA, 22 nt, Escherichia coli CFT073
gucuuccggguagcgcggcagc

SEQ ID NO: 604437 - RNA, 16 nt, Escherichia coli CFT073
gucugguaucgcgcca

SEQ ID NO: 604438 - RNA, 18 nt, Escherichia coli CFT073
gucugguaucgcgccagc

SEQ ID NO: 604439 - RNA, 16 nt, Escherichia coli CFT073
gucuggcauuuugcug

SEQ ID NO: 604440 - RNA, 21 nt, Escherichia coli CFT073
gucugccucccauucaucgcc

SEQ ID NO: 604441 - RNA, 15 nt, Escherichia coli CFT073
gucugccuuucggug

SEQ ID NO: 604442 - RNA, 16 nt, Escherichia coli CFT073
gucugccuuucgguga

SEQ ID NO: 604443 - RNA, 21 nt, Escherichia coli CFT073
gucugccuuucggugaauacc

SEQ ID NO: 604444 - RNA, 15 nt, Escherichia coli CFT073
gucugaaucaguccc

SEQ ID NO: 604445 - RNA, 14 nt, Escherichia coli CFT073
gucucuauuucacc

SEQ ID NO: 604446 - RNA, 16 nt, Escherichia coli CFT073
gucucuauuucaccca

SEQ ID NO: 604447 - RNA, 19 nt, Escherichia coli CFT073
gucugaucggcaaucacgc

SEQ ID NO: 604448 - RNA, 13 nt, Escherichia coli CFT073
gucugaugcgacg

SEQ ID NO: 604449 - RNA, 13 nt, Escherichia coli CFT073
gucugaauaccgc

SEQ ID NO: 604450 - RNA, 14 nt, Escherichia coli CFT073
gucugcagacugaa

SEQ ID NO: 604451 - RNA, 13 nt, Escherichia coli CFT073
gucugcagauggc

SEQ ID NO: 604452 - RNA, 16 nt, Escherichia coli CFT073
gucugccacuucuucc

SEQ ID NO: 604453 - RNA, 19 nt, Escherichia coli CFT073
gucugccacuucuuccagc

SEQ ID NO: 604454 - RNA, 19 nt, Escherichia coli CFT073
gucguugucuggcuggugg

SEQ ID NO: 604455 - RNA, 23 nt, Escherichia coli CFT073
gucuaacaugagauccagcgagc

SEQ ID NO: 604456 - RNA, 15 nt, Escherichia coli CFT073
gucuacauugcucau

SEQ ID NO: 604457 - RNA, 22 nt, Escherichia coli CFT073
gucucaacaaacgauuuaucga

SEQ ID NO: 604458 - RNA, 21 nt, Escherichia coli CFT073
gucucaagcacccguggcuau

SEQ ID NO: 604459 - RNA, 20 nt, Escherichia coli CFT073
gucuccgguuucccggcaau

SEQ ID NO: 604460 - RNA, 17 nt, Escherichia coli CFT073
gucuccauuuuuuugca

SEQ ID NO: 604461 - RNA, 20 nt, Escherichia coli CFT073
gugaccgccuuauccggccu

SEQ ID NO: 604462 - RNA, 22 nt, Escherichia coli CFT073
gugacggaaauggacgucaaaa

SEQ ID NO: 604463 - RNA, 22 nt, Escherichia coli CFT073
gugacgaccuuuuccaucgcau

SEQ ID NO: 604464 - RNA, 16 nt, Escherichia coli CFT073
gugacugccgccagca

SEQ ID NO: 604465 - RNA, 18 nt, Escherichia coli CFT073
gugaauaccggucaacaa

SEQ ID NO: 604466 - RNA, 12 nt, Escherichia coli CFT073
gugaaugccuga

SEQ ID NO: 604467 - RNA, 22 nt, Escherichia coli CFT073
gugacaccagcacaucaucaaa

SEQ ID NO: 604468 - RNA, 22 nt, Escherichia coli CFT073
gugacacuuugugccaucgcca

SEQ ID NO: 604469 - RNA, 21 nt, Escherichia coli CFT073
gugaccgaaccuguuuucacc

SEQ ID NO: 604470 - RNA, 20 nt, Escherichia coli CFT073
gugaacgcguuauccggcca

SEQ ID NO: 604471 - RNA, 17 nt, Escherichia coli CFT073
gugaacuucgccaggau

SEQ ID NO: 604472 - RNA, 18 nt, Escherichia coli CFT073
gugaagacggccauccca

SEQ ID NO: 604473 - RNA, 20 nt, Escherichia coli CFT073
gugaagagauccaccagcgc

SEQ ID NO: 604474 - RNA, 20 nt, Escherichia coli CFT073
gugaacgccuuauccggucu

SEQ ID NO: 604475 - RNA, 22 nt, Escherichia coli CFT073
gugaaauaaaaucagcaaggaa

SEQ ID NO: 604476 - RNA, 21 nt, Escherichia coli CFT073
gugaaauaaucccguucagcg

SEQ ID NO: 604477 - RNA, 20 nt, Escherichia coli CFT073
gugaaaucagccguuucacc

SEQ ID NO: 604478 - RNA, 20 nt, Escherichia coli CFT073
gugaacaccuuauccggccu

SEQ ID NO: 604479 - RNA, 22 nt, Escherichia coli CFT073
gguacuucaaucgccaccacgu

SEQ ID NO: 604480 - RNA, 21 nt, Escherichia coli CFT073
gguacucaugcccacgcaaac

SEQ ID NO: 604481 - RNA, 23 nt, Escherichia coli CFT073
gguacgcgcaccgcgugaugcgg

SEQ ID NO: 604482 - RNA, 15 nt, Escherichia coli CFT073
gguagagcugaaaau

SEQ ID NO: 604483 - RNA, 20 nt, Escherichia coli CFT073
gguagaauuuguaggccgga

SEQ ID NO: 604484 - RNA, 16 nt, Escherichia coli CFT073
ggguuuuauuauucca

SEQ ID NO: 604485 - RNA, 22 nt, Escherichia coli CFT073
ggguuacgcgcaguuucccaag

SEQ ID NO: 604486 - RNA, 15 nt, Escherichia coli CFT073
ggguuagccagaaca

SEQ ID NO: 604487 - RNA, 13 nt, Escherichia coli CFT073
gguacaaagccaa

SEQ ID NO: 604488 - RNA, 20 nt, Escherichia coli CFT073
gguaaaaccccgcguacuga

SEQ ID NO: 604489 - RNA, 22 nt, Escherichia coli CFT073
gguaaaacgacuggcccggcga

SEQ ID NO: 604490 - RNA, 23 nt, Escherichia coli CFT073
gguaaaaucauccugcugcacgc

SEQ ID NO: 604491 - RNA, 20 nt, Escherichia coli CFT073
gguaauugaguuuauagcaa

SEQ ID NO: 604492 - RNA, 13 nt, Escherichia coli CFT073
ggguggcaaaugc

SEQ ID NO: 604493 - RNA, 21 nt, Escherichia coli CFT073
gggaagcucucuuccaguucg

SEQ ID NO: 604494 - RNA, 14 nt, Escherichia coli CFT073
gggaagaaaccauu

SEQ ID NO: 604495 - RNA, 18 nt, Escherichia coli CFT073
ggguagcuuccugcuguu

SEQ ID NO: 604496 - RNA, 18 nt, Escherichia coli CFT073
gggguuucucuuucagcg

SEQ ID NO: 604497 - RNA, 22 nt, Escherichia coli CFT073
gggguuucucuuucagcgccag

SEQ ID NO: 604498 - RNA, 17 nt, Escherichia coli CFT073
ggguaaacaccaccgaa

SEQ ID NO: 604499 - RNA, 23 nt, Escherichia coli CFT073
gggucgcaaacaacgccacacgc

SEQ ID NO: 604500 - RNA, 12 nt, Escherichia coli CFT073
ggugauaaaccc

SEQ ID NO: 604501 - RNA, 19 nt, Escherichia coli CFT073
ggugauaaccgcgcgugcc

SEQ ID NO: 604502 - RNA, 14 nt, Escherichia coli CFT073
ggugaguggcgcga

SEQ ID NO: 604503 - RNA, 15 nt, Escherichia coli CFT073
ggugauacugaucgu

SEQ ID NO: 604504 - RNA, 14 nt, Escherichia coli CFT073
ggugacuagcagca

SEQ ID NO: 604505 - RNA, 20 nt, Escherichia coli CFT073
ggugacgccacaacgauaau

SEQ ID NO: 604506 - RNA, 19 nt, Escherichia coli CFT073
ggucgucaccgccagguga

SEQ ID NO: 604507 - RNA, 16 nt, Escherichia coli CFT073
ggucggauaagacgcg

SEQ ID NO: 604508 - RNA, 17 nt, Escherichia coli CFT073
ggucggaaucccaucgc

SEQ ID NO: 604509 - RNA, 20 nt, Escherichia coli CFT073
ggucauuggccggaauacca

SEQ ID NO: 604510 - RNA, 14 nt, Escherichia coli CFT073
ggucaggaauagcg

SEQ ID NO: 604511 - RNA, 15 nt, Escherichia coli CFT073
gguagggcgaaacca

SEQ ID NO: 604512 - RNA, 18 nt, Escherichia coli CFT073
ggucgcgacugccagcau

SEQ ID NO: 604513 - RNA, 15 nt, Escherichia coli CFT073
ggucgccccggaacg

SEQ ID NO: 604514 - RNA, 14 nt, Escherichia coli CFT073
ggucgaaaauaauc

SEQ ID NO: 604515 - RNA, 17 nt, Escherichia coli CFT073
gguggucggcucgucga

SEQ ID NO: 604516 - RNA, 15 nt, Escherichia coli CFT073
gguggucgcaucauc

SEQ ID NO: 604517 - RNA, 14 nt, Escherichia coli CFT073
ggugguuaccagua

SEQ ID NO: 604518 - RNA, 13 nt, Escherichia coli CFT073
ggugucaucgaca

SEQ ID NO: 604519 - RNA, 21 nt, Escherichia coli CFT073
ggugucuaacgaugccagcgc

SEQ ID NO: 604520 - RNA, 15 nt, Escherichia coli CFT073
ggugcucauuagccc

SEQ ID NO: 604521 - RNA, 12 nt, Escherichia coli CFT073
ggugaugaugcu

SEQ ID NO: 604522 - RNA, 16 nt, Escherichia coli CFT073
gguugugugcuggcca

SEQ ID NO: 604523 - RNA, 15 nt, Escherichia coli CFT073
gguuucaaccagcag

SEQ ID NO: 604524 - RNA, 19 nt, Escherichia coli CFT073
gguuguugaggucugaccg

SEQ ID NO: 604525 - RNA, 15 nt, Escherichia coli CFT073
gguuuaauaaucgca

SEQ ID NO: 604526 - RNA, 14 nt, Escherichia coli CFT073
gguuguaauccacc

SEQ ID NO: 604527 - RNA, 20 nt, Escherichia coli CFT073
gguuggagcacaaugccuga

SEQ ID NO: 604528 - RNA, 12 nt, Escherichia coli CFT073
gguuggcgcugu

SEQ ID NO: 604529 - RNA, 18 nt, Escherichia coli CFT073
gguugccguccagcgccu

SEQ ID NO: 604530 - RNA, 11 nt, Escherichia coli CFT073
gguugccagcg

SEQ ID NO: 604531 - RNA, 14 nt, Escherichia coli CFT073
gguugccagcgaca

SEQ ID NO: 604532 - RNA, 20 nt, Escherichia coli CFT073
gguugcacggaauaaucggg

SEQ ID NO: 604533 - RNA, 23 nt, Escherichia coli CFT073
gguucugcacagcuuaaaaugcu

SEQ ID NO: 604534 - RNA, 14 nt, Escherichia coli CFT073
gguucugcugccgc

SEQ ID NO: 604535 - RNA, 15 nt, Escherichia coli CFT073
gguugaaauaaacca

SEQ ID NO: 604536 - RNA, 13 nt, Escherichia coli CFT073
gguugaacgccaa

SEQ ID NO: 604537 - RNA, 17 nt, Escherichia coli CFT073
gguuaccaguaaccaga

SEQ ID NO: 604538 - RNA, 15 nt, Escherichia coli CFT073
gguuacacgggagaa

SEQ ID NO: 604539 - RNA, 17 nt, Escherichia coli CFT073
gguguugguaaacgcau

SEQ ID NO: 604540 - RNA, 21 nt, Escherichia coli CFT073
ggugugcgggaacauaucaaa

SEQ ID NO: 604541 - RNA, 12 nt, Escherichia coli CFT073
gguguucacgcc

SEQ ID NO: 604542 - RNA, 22 nt, Escherichia coli CFT073
gguguuauaggccccagccuca

SEQ ID NO: 604543 - RNA, 15 nt, Escherichia coli CFT073
gguucggcgucgccg

SEQ ID NO: 604544 - RNA, 22 nt, Escherichia coli CFT073
gguucggacauguuuuccagca

SEQ ID NO: 604545 - RNA, 19 nt, Escherichia coli CFT073
gguucgccaaaugucacca

SEQ ID NO: 604546 - RNA, 23 nt, Escherichia coli CFT073
gguucgccaaaugucaccagccg

SEQ ID NO: 604547 - RNA, 23 nt, Escherichia coli CFT073
gguuauagccuuuauuaaugaca

SEQ ID NO: 604548 - RNA, 20 nt, Escherichia coli CFT073
gguuagcaaccgccgcugcu

SEQ ID NO: 604549 - RNA, 18 nt, Escherichia coli CFT073
gguuaucccaaaucgcaa

SEQ ID NO: 604550 - RNA, 19 nt, Escherichia coli CFT073
gguuccagauauucauaga

SEQ ID NO: 604551 - RNA, 20 nt, Escherichia coli CFT073
gguuccauuucugcggguga

SEQ ID NO: 604552 - RNA, 18 nt, Escherichia coli CFT073
gguucccaacaacagcgc

SEQ ID NO: 604553 - RNA, 23 nt, Escherichia coli CFT073
gguuccccccacaaucagccaga

SEQ ID NO: 604554 - RNA, 17 nt, Escherichia coli CFT073
guagccgauccgcguca

SEQ ID NO: 604555 - RNA, 14 nt, Escherichia coli CFT073
guagaguccagcgc

SEQ ID NO: 604556 - RNA, 22 nt, Escherichia coli CFT073
guagacaccaaggaacugugca

SEQ ID NO: 604557 - RNA, 22 nt, Escherichia coli CFT073
guagaaccgguugccgguagcu

SEQ ID NO: 604558 - RNA, 21 nt, Escherichia coli CFT073
guaguugcgcugguggcaggc

SEQ ID NO: 604559 - RNA, 18 nt, Escherichia coli CFT073
guauaccgaaaucgccau

SEQ ID NO: 604560 - RNA, 21 nt, Escherichia coli CFT073
guauacgacugaugcgacgca

SEQ ID NO: 604561 - RNA, 16 nt, Escherichia coli CFT073
guauaguccgccagaa

SEQ ID NO: 604562 - RNA, 20 nt, Escherichia coli CFT073
guauccgacguuacgcgcca

SEQ ID NO: 604563 - RNA, 15 nt, Escherichia coli CFT073
guauccgggcaucca

SEQ ID NO: 604564 - RNA, 22 nt, Escherichia coli CFT073
guaggucauaucgaccagcgca

SEQ ID NO: 604565 - RNA, 19 nt, Escherichia coli CFT073
guaggucggauaaggcguu

SEQ ID NO: 604566 - RNA, 16 nt, Escherichia coli CFT073
guaggcugacggcguu

SEQ ID NO: 604567 - RNA, 16 nt, Escherichia coli CFT073
aagucucaagagugaa

SEQ ID NO: 604568 - RNA, 22 nt, Escherichia coli CFT073
aagucugcgucaucggcagcau

SEQ ID NO: 604569 - RNA, 12 nt, Escherichia coli CFT073
guaggccugaua

SEQ ID NO: 604570 - RNA, 19 nt, Escherichia coli CFT073
guaggccugauaagacgcg

SEQ ID NO: 604571 - RNA, 19 nt, Escherichia coli CFT073
guaggccugauaagcguag

SEQ ID NO: 604572 - RNA, 19 nt, Escherichia coli CFT073
guaggccggauaaggcguu

SEQ ID NO: 604573 - RNA, 19 nt, Escherichia coli CFT073
guaggccgaauaaggcguu

SEQ ID NO: 604574 - RNA, 22 nt, Escherichia coli CFT073
guaggccagauaagacgcguca

SEQ ID NO: 604575 - RNA, 19 nt, Escherichia coli CFT073
guaggccagauaaggcguu

SEQ ID NO: 604576 - RNA, 17 nt, Escherichia coli CFT073
aaguccgaugccguuaa

SEQ ID NO: 604577 - RNA, 22 nt, Escherichia coli CFT073
guaggccggauaagacgcguca

SEQ ID NO: 604578 - RNA, 16 nt, Escherichia coli CFT073
guaggccggauaaggc

SEQ ID NO: 604579 - RNA, 16 nt, Escherichia coli CFT073
guaaugggaucgaaag

SEQ ID NO: 604580 - RNA, 16 nt, Escherichia coli CFT073
guaaugcucgacgaga

SEQ ID NO: 604581 - RNA, 18 nt, Escherichia coli CFT073
guaauggaccauauugaa

SEQ ID NO: 604582 - RNA, 13 nt, Escherichia coli CFT073
guaauuaaacagc

SEQ ID NO: 604583 - RNA, 19 nt, Escherichia coli CFT073
guaauuaaauuaucaacua

SEQ ID NO: 604584 - RNA, 14 nt, Escherichia coli CFT073
guaaugaaucagca

SEQ ID NO: 604585 - RNA, 16 nt, Escherichia coli CFT073
guaaugcacuccgccg

SEQ ID NO: 604586 - RNA, 16 nt, Escherichia coli CFT073
guaauucccaguuacu

SEQ ID NO: 604587 - RNA, 22 nt, Escherichia coli CFT073
guaauucccugugccagcggca

SEQ ID NO: 604588 - RNA, 23 nt, Escherichia coli CFT073
guaacgccccacaagcccgccag

SEQ ID NO: 604589 - RNA, 18 nt, Escherichia coli CFT073
guaacgccuuucaggugg

SEQ ID NO: 604590 - RNA, 17 nt, Escherichia coli CFT073
guaacgcgcuaccaacc

SEQ ID NO: 604591 - RNA, 15 nt, Escherichia coli CFT073
guaacgacaggccug

SEQ ID NO: 604592 - RNA, 17 nt, Escherichia coli CFT073
guaacgacaggccugau

SEQ ID NO: 604593 - RNA, 22 nt, Escherichia coli CFT073
guaacgaucgcccggcaccagc

SEQ ID NO: 604594 - RNA, 20 nt, Escherichia coli CFT073
guaacgauggcgauucagca

SEQ ID NO: 604595 - RNA, 17 nt, Escherichia coli CFT073
guaacgacugacuuucg

SEQ ID NO: 604596 - RNA, 15 nt, Escherichia coli CFT073
guaaccgaggcggac

SEQ ID NO: 604597 - RNA, 16 nt, Escherichia coli CFT073
guaacccagcaccaac

SEQ ID NO: 604598 - RNA, 21 nt, Escherichia coli CFT073
guaacaguaguuacgcggaga

SEQ ID NO: 604599 - RNA, 15 nt, Escherichia coli CFT073
guaacauaacagcca

SEQ ID NO: 604600 - RNA, 13 nt, Escherichia coli CFT073
guaacaauaaacg

SEQ ID NO: 604601 - RNA, 18 nt, Escherichia coli CFT073
guaacacucgugcgucgc

SEQ ID NO: 604602 - RNA, 16 nt, Escherichia coli CFT073
guaaagagugugaaua

SEQ ID NO: 604603 - RNA, 14 nt, Escherichia coli CFT073
guaaagccagcggc

SEQ ID NO: 604604 - RNA, 19 nt, Escherichia coli CFT073
guaaagcccauaccacagc

SEQ ID NO: 604605 - RNA, 20 nt, Escherichia coli CFT073
guaaagcccaucgccagcgc

SEQ ID NO: 604606 - RNA, 13 nt, Escherichia coli CFT073
guaaagcccgcca

SEQ ID NO: 604607 - RNA, 21 nt, Escherichia coli CFT073
guaaagcccgccaucgcccau

SEQ ID NO: 604608 - RNA, 22 nt, Escherichia coli CFT073
guaaacuuuagcacaaucgcau

SEQ ID NO: 604609 - RNA, 20 nt, Escherichia coli CFT073
guaaacgccuuauccggccu

SEQ ID NO: 604610 - RNA, 12 nt, Escherichia coli CFT073
guaaacaacgag

SEQ ID NO: 604611 - RNA, 16 nt, Escherichia coli CFT073
guaaacacaccacagc

SEQ ID NO: 604612 - RNA, 18 nt, Escherichia coli CFT073
guaaacacccaucgccgu

SEQ ID NO: 604613 - RNA, 13 nt, Escherichia coli CFT073
guaaaccaaccag

SEQ ID NO: 604614 - RNA, 20 nt, Escherichia coli CFT073
guaaaccacccaccagcgcc

SEQ ID NO: 604615 - RNA, 22 nt, Escherichia coli CFT073
guaaaccacccaccagcgccga

SEQ ID NO: 604616 - RNA, 15 nt, Escherichia coli CFT073
guaaacccgcgauga

SEQ ID NO: 604617 - RNA, 14 nt, Escherichia coli CFT073
gguuucucccgccu

SEQ ID NO: 604618 - RNA, 12 nt, Escherichia coli CFT073
gguuucgugcau

SEQ ID NO: 604619 - RNA, 13 nt, Escherichia coli CFT073
gguuucagccagg

SEQ ID NO: 604620 - RNA, 18 nt, Escherichia coli CFT073
gguuucccggcaaucgcc

SEQ ID NO: 604621 - RNA, 16 nt, Escherichia coli CFT073
gguuucccggguaaac

SEQ ID NO: 604622 - RNA, 14 nt, Escherichia coli CFT073
guacucaccaacgc

SEQ ID NO: 604623 - RNA, 17 nt, Escherichia coli CFT073
guacucaccaacgcaga

SEQ ID NO: 604624 - RNA, 21 nt, Escherichia coli CFT073
guacucaccgcucaccugaua

SEQ ID NO: 604625 - RNA, 15 nt, Escherichia coli CFT073
guacguuaacagccu

SEQ ID NO: 604626 - RNA, 18 nt, Escherichia coli CFT073
guacgcuucacgcaccau

SEQ ID NO: 604627 - RNA, 16 nt, Escherichia coli CFT073
guacgcuuucacccgg

SEQ ID NO: 604628 - RNA, 12 nt, Escherichia coli CFT073
guacggaauaag

SEQ ID NO: 604629 - RNA, 13 nt, Escherichia coli CFT073
guacgcaggcggc

SEQ ID NO: 604630 - RNA, 19 nt, Escherichia coli CFT073
guacgcaggcggcuggcau

SEQ ID NO: 604631 - RNA, 18 nt, Escherichia coli CFT073
guacgcauccccagcgca

SEQ ID NO: 604632 - RNA, 14 nt, Escherichia coli CFT073
guacgccagcguca

SEQ ID NO: 604633 - RNA, 23 nt, Escherichia coli CFT073
guaccgggcgcgaggccagcggc

SEQ ID NO: 604634 - RNA, 13 nt, Escherichia coli CFT073
guacgccuucacg

SEQ ID NO: 604635 - RNA, 21 nt, Escherichia coli CFT073
guacgcgcccguagucggugc

SEQ ID NO: 604636 - RNA, 17 nt, Escherichia coli CFT073
guacgcuaugcgccagu

SEQ ID NO: 604637 - RNA, 22 nt, Escherichia coli CFT073
guaccaccagaaucgccagcau

SEQ ID NO: 604638 - RNA, 23 nt, Escherichia coli CFT073
guaccaccagaaucgccagcauc

SEQ ID NO: 604639 - RNA, 14 nt, Escherichia coli CFT073
guacagccgccaga

SEQ ID NO: 604640 - RNA, 15 nt, Escherichia coli CFT073
guaccgcagccggaa

SEQ ID NO: 604641 - RNA, 20 nt, Escherichia coli CFT073
guaccgccagugcagcgaag

SEQ ID NO: 604642 - RNA, 22 nt, Escherichia coli CFT073
guaccaggcauauucaccguca

SEQ ID NO: 604643 - RNA, 14 nt, Escherichia coli CFT073
guaccagcccgccg

SEQ ID NO: 604644 - RNA, 17 nt, Escherichia coli CFT073
guaccaggcaauaaaca

SEQ ID NO: 604645 - RNA, 15 nt, Escherichia coli CFT073
ggcuacgccaccagc

SEQ ID NO: 604646 - RNA, 18 nt, Escherichia coli CFT073
ggcuauaccccaccccga

SEQ ID NO: 604647 - RNA, 14 nt, Escherichia coli CFT073
ggcuauaccgccga

SEQ ID NO: 604648 - RNA, 22 nt, Escherichia coli CFT073
ggcuaauuaaucggucgaugcg

SEQ ID NO: 604649 - RNA, 22 nt, Escherichia coli CFT073
ggcuaccauccgcgcgcguaag

SEQ ID NO: 604650 - RNA, 13 nt, Escherichia coli CFT073
ggcuaugcuggag

SEQ ID NO: 604651 - RNA, 18 nt, Escherichia coli CFT073
ggcucaggcuggcugacc

SEQ ID NO: 604652 - RNA, 12 nt, Escherichia coli CFT073
ggcucauccggu

SEQ ID NO: 604653 - RNA, 12 nt, Escherichia coli CFT073
ggcuccagacgc

SEQ ID NO: 604654 - RNA, 15 nt, Escherichia coli CFT073
ggcguuuuuggcauc

SEQ ID NO: 604655 - RNA, 20 nt, Escherichia coli CFT073
ggcguuuucuuuuucagcaa

SEQ ID NO: 604656 - RNA, 17 nt, Escherichia coli CFT073
ggcuaaccgcuuuuccg

SEQ ID NO: 604657 - RNA, 15 nt, Escherichia coli CFT073
ggcuaagcaggcugg

SEQ ID NO: 604658 - RNA, 18 nt, Escherichia coli CFT073
ggcuaaucgucaucgaca

SEQ ID NO: 604659 - RNA, 16 nt, Escherichia coli CFT073
ggcguuguccgccaga

SEQ ID NO: 604660 - RNA, 17 nt, Escherichia coli CFT073
ggcguugcccaucgcca

SEQ ID NO: 604661 - RNA, 20 nt, Escherichia coli CFT073
ggcguugauugccggaugcg

SEQ ID NO: 604662 - RNA, 21 nt, Escherichia coli CFT073
ggcguugcagaaguugugaaa

SEQ ID NO: 604663 - RNA, 12 nt, Escherichia coli CFT073
ggcguucacgcc

SEQ ID NO: 604664 - RNA, 18 nt, Escherichia coli CFT073
ggcguucacgccgcaucu

SEQ ID NO: 604665 - RNA, 19 nt, Escherichia coli CFT073
ggcguuaugcugcggcauc

SEQ ID NO: 604666 - RNA, 18 nt, Escherichia coli CFT073
ggcguguugcuccacgcc

SEQ ID NO: 604667 - RNA, 15 nt, Escherichia coli CFT073
ggcguuaauauuucc

SEQ ID NO: 604668 - RNA, 15 nt, Escherichia coli CFT073
ggcguggucgguuaa

SEQ ID NO: 604669 - RNA, 13 nt, Escherichia coli CFT073
ggcgugauaaugc

SEQ ID NO: 604670 - RNA, 22 nt, Escherichia coli CFT073
ggcgucuaaucgcuuuauagca

SEQ ID NO: 604671 - RNA, 14 nt, Escherichia coli CFT073
ggcuuauccggcau

SEQ ID NO: 604672 - RNA, 20 nt, Escherichia coli CFT073
ggcuuacgaaguuccugcaa

SEQ ID NO: 604673 - RNA, 22 nt, Escherichia coli CFT073
ggcuguuaccuacgcuugcugc

SEQ ID NO: 604674 - RNA, 20 nt, Escherichia coli CFT073
ggcuguuuuccagcaccacu

SEQ ID NO: 604675 - RNA, 15 nt, Escherichia coli CFT073
ggcugcuucgcgccc

SEQ ID NO: 604676 - RNA, 17 nt, Escherichia coli CFT073
ggcuucaauuuuuuccg

SEQ ID NO: 604677 - RNA, 16 nt, Escherichia coli CFT073
ggcuucauccagcagc

SEQ ID NO: 604678 - RNA, 15 nt, Escherichia coli CFT073
ggcuugcaccagcag

SEQ ID NO: 604679 - RNA, 19 nt, Escherichia coli CFT073
ggcuugcucguuuucaaug

SEQ ID NO: 604680 - RNA, 14 nt, Escherichia coli CFT073
gggaaacuccagcc

SEQ ID NO: 604681 - RNA, 16 nt, Escherichia coli CFT073
gggaacagccacaguu

SEQ ID NO: 604682 - RNA, 14 nt, Escherichia coli CFT073
gggaacugcugacc

SEQ ID NO: 604683 - RNA, 16 nt, Escherichia coli CFT073
ggcuuugaucagcguc

SEQ ID NO: 604684 - RNA, 18 nt, Escherichia coli CFT073
ggcuuucgcgacaucgcc

SEQ ID NO: 604685 - RNA, 20 nt, Escherichia coli CFT073
ggcuuuccgggagcaauuug

SEQ ID NO: 604686 - RNA, 17 nt, Escherichia coli CFT073
ggcucucauuuuucagc

SEQ ID NO: 604687 - RNA, 20 nt, Escherichia coli CFT073
ggcugaccuggaagugucca

SEQ ID NO: 604688 - RNA, 20 nt, Escherichia coli CFT073
ggcugacgauaccaggugug

SEQ ID NO: 604689 - RNA, 14 nt, Escherichia coli CFT073
ggcucgagcgacca

SEQ ID NO: 604690 - RNA, 15 nt, Escherichia coli CFT073
ggcugaguuaccagc

SEQ ID NO: 604691 - RNA, 22 nt, Escherichia coli CFT073
ggcugcguuuuuucacgguuaa

SEQ ID NO: 604692 - RNA, 23 nt, Escherichia coli CFT073
ggcugccggaccaucuuccagcu

SEQ ID NO: 604693 - RNA, 13 nt, Escherichia coli CFT073
ggcugccgccagg

SEQ ID NO: 604694 - RNA, 18 nt, Escherichia coli CFT073
ggccugcuuuguucagcc

SEQ ID NO: 604695 - RNA, 18 nt, Escherichia coli CFT073
ggccugcuuuugccagcg

SEQ ID NO: 604696 - RNA, 21 nt, Escherichia coli CFT073
ggcgauauucugguaaucgca

SEQ ID NO: 604697 - RNA, 15 nt, Escherichia coli CFT073
ggcgauauccagcgc

SEQ ID NO: 604698 - RNA, 21 nt, Escherichia coli CFT073
ggcgauaaucagcgccagcgc

SEQ ID NO: 604699 - RNA, 23 nt, Escherichia coli CFT073
ggcgauagcauccaguuccacac

SEQ ID NO: 604700 - RNA, 15 nt, Escherichia coli CFT073
ggcgaugaugaucug

SEQ ID NO: 604701 - RNA, 21 nt, Escherichia coli CFT073
ggcgaugcagcgcaugaccca

SEQ ID NO: 604702 - RNA, 17 nt, Escherichia coli CFT073
ggcgaucgucgccgugc

SEQ ID NO: 604703 - RNA, 21 nt, Escherichia coli CFT073
ggcgcauccaugauauuggca

SEQ ID NO: 604704 - RNA, 16 nt, Escherichia coli CFT073
ggcgcaccgcauguug

SEQ ID NO: 604705 - RNA, 16 nt, Escherichia coli CFT073
ggcgcgcgucacgaua

SEQ ID NO: 604706 - RNA, 16 nt, Escherichia coli CFT073
ggcgcgggcaauaauc

SEQ ID NO: 604707 - RNA, 21 nt, Escherichia coli CFT073
ggcgcugcuggagcaggugaa

SEQ ID NO: 604708 - RNA, 15 nt, Escherichia coli CFT073
ggcgcugacgacauc

SEQ ID NO: 604709 - RNA, 16 nt, Escherichia coli CFT073
ggcgcugaauguuugc

SEQ ID NO: 604710 - RNA, 19 nt, Escherichia coli CFT073
ggcgcguucggcggaugca

SEQ ID NO: 604711 - RNA, 22 nt, Escherichia coli CFT073
ggcggaucugaucagcacgaua

SEQ ID NO: 604712 - RNA, 20 nt, Escherichia coli CFT073
ggcgcuucggguuccgguaa

SEQ ID NO: 604713 - RNA, 18 nt, Escherichia coli CFT073
ggcgcuguuuccggcggc

SEQ ID NO: 604714 - RNA, 17 nt, Escherichia coli CFT073
ggcgcuguuuggugcau

SEQ ID NO: 604715 - RNA, 20 nt, Escherichia coli CFT073
ggcgcugguaaucaccaccc

SEQ ID NO: 604716 - RNA, 16 nt, Escherichia coli CFT073
ggccggauaaggcguu

SEQ ID NO: 604717 - RNA, 23 nt, Escherichia coli CFT073
ggccgcuguuuuucauugcguaa

SEQ ID NO: 604718 - RNA, 21 nt, Escherichia coli CFT073
ggccugcugaauuuccugcgc

SEQ ID NO: 604719 - RNA, 19 nt, Escherichia coli CFT073
ggccuccagcacuuccuga

SEQ ID NO: 604720 - RNA, 14 nt, Escherichia coli CFT073
ggccugauaaggca

SEQ ID NO: 604721 - RNA, 21 nt, Escherichia coli CFT073
ggccugaugcggcguaaacgc

SEQ ID NO: 604722 - RNA, 20 nt, Escherichia coli CFT073
ggccugauuaagaucgugca

SEQ ID NO: 604723 - RNA, 20 nt, Escherichia coli CFT073
ggccugauaagacgcgaaca

SEQ ID NO: 604724 - RNA, 19 nt, Escherichia coli CFT073
ggccugauaagacgcguaa

SEQ ID NO: 604725 - RNA, 20 nt, Escherichia coli CFT073
ggccugauaagaugcguuaa

SEQ ID NO: 604726 - RNA, 21 nt, Escherichia coli CFT073
ggccuacaaguccguugaaau

SEQ ID NO: 604727 - RNA, 22 nt, Escherichia coli CFT073
ggccuacaaucccguugaaaau

SEQ ID NO: 604728 - RNA, 22 nt, Escherichia coli CFT073
ggccguuuucguuacuccgcca

SEQ ID NO: 604729 - RNA, 16 nt, Escherichia coli CFT073
ggccuacaaaacauua

SEQ ID NO: 604730 - RNA, 15 nt, Escherichia coli CFT073
ggccuacaaaagcaa

SEQ ID NO: 604731 - RNA, 20 nt, Escherichia coli CFT073
ggccuacaaguccguugaaa

SEQ ID NO: 604732 - RNA, 11 nt, Escherichia coli CFT073
ggcccgccagc

SEQ ID NO: 604733 - RNA, 21 nt, Escherichia coli CFT073
ggcccguacugaacccgggua

SEQ ID NO: 604734 - RNA, 12 nt, Escherichia coli CFT073
ggcccgcgcagc

SEQ ID NO: 604735 - RNA, 14 nt, Escherichia coli CFT073
ggaugauuccgcag

SEQ ID NO: 604736 - RNA, 14 nt, Escherichia coli CFT073
ggaugacgccucag

SEQ ID NO: 604737 - RNA, 17 nt, Escherichia coli CFT073
ggaugacccagcgccag

SEQ ID NO: 604738 - RNA, 14 nt, Escherichia coli CFT073
ggaugagcgcgagg

SEQ ID NO: 604739 - RNA, 14 nt, Escherichia coli CFT073
ggaugaaauccaua

SEQ ID NO: 604740 - RNA, 14 nt, Escherichia coli CFT073
ggaugaccgacaga

SEQ ID NO: 604741 - RNA, 23 nt, Escherichia coli CFT073
ggaucuuccagcgcaucgccaaa

SEQ ID NO: 604742 - RNA, 20 nt, Escherichia coli CFT073
ggaucuuccaguucuuccgc

SEQ ID NO: 604743 - RNA, 21 nt, Escherichia coli CFT073
ggaucugccauauccagccag

SEQ ID NO: 604744 - RNA, 13 nt, Escherichia coli CFT073
ggaucuccuccag

SEQ ID NO: 604745 - RNA, 19 nt, Escherichia coli CFT073
ggaaauuauggaucaccau

SEQ ID NO: 604746 - RNA, 18 nt, Escherichia coli CFT073
ggaaauuuugcugauacu

SEQ ID NO: 604747 - RNA, 16 nt, Escherichia coli CFT073
ggaucgauacggaucg

SEQ ID NO: 604748 - RNA, 16 nt, Escherichia coli CFT073
ggaucgauaucaccaa

SEQ ID NO: 604749 - RNA, 15 nt, Escherichia coli CFT073
ggauucucuuuguua

SEQ ID NO: 604750 - RNA, 15 nt, Escherichia coli CFT073
ggauugccggaugcg

SEQ ID NO: 604751 - RNA, 16 nt, Escherichia coli CFT073
ggauugcuauuuaaca

SEQ ID NO: 604752 - RNA, 20 nt, Escherichia coli CFT073
ggauucacgccaaccagcug

SEQ ID NO: 604753 - RNA, 14 nt, Escherichia coli CFT073
ggauucauacuguu

SEQ ID NO: 604754 - RNA, 13 nt, Escherichia coli CFT073
ggauucauccggc

SEQ ID NO: 604755 - RNA, 23 nt, Escherichia coli CFT073
ggauguuugcaguaaaccacauc

SEQ ID NO: 604756 - RNA, 18 nt, Escherichia coli CFT073
ggauuaagucuaaugaca

SEQ ID NO: 604757 - RNA, 16 nt, Escherichia coli CFT073
ggauuacgcucaccaa

SEQ ID NO: 604758 - RNA, 17 nt, Escherichia coli CFT073
ggauuaucccccgguuu

SEQ ID NO: 604759 - RNA, 18 nt, Escherichia coli CFT073
ggaugguguucacucauc

SEQ ID NO: 604760 - RNA, 16 nt, Escherichia coli CFT073
ggauggcgcugcugca

SEQ ID NO: 604761 - RNA, 16 nt, Escherichia coli CFT073
ggaugccaucgcauga

SEQ ID NO: 604762 - RNA, 11 nt, Escherichia coli CFT073
ggaugcggcgc

SEQ ID NO: 604763 - RNA, 11 nt, Escherichia coli CFT073
ggaugcggcgu

SEQ ID NO: 604764 - RNA, 18 nt, Escherichia coli CFT073
ggaugcgguuuauacggc

SEQ ID NO: 604765 - RNA, 23 nt, Escherichia coli CFT073
ggauuguauugagauccugccag

SEQ ID NO: 604766 - RNA, 17 nt, Escherichia coli CFT073
ggauuuuauucagcaga

SEQ ID NO: 604767 - RNA, 20 nt, Escherichia coli CFT073
ggcaaaaacaaggaucgcga

SEQ ID NO: 604768 - RNA, 20 nt, Escherichia coli CFT073
ggcaaaaauaaggcggaugg

SEQ ID NO: 604769 - RNA, 23 nt, Escherichia coli CFT073
ggauuuucuacgcugaucgacga

SEQ ID NO: 604770 - RNA, 15 nt, Escherichia coli CFT073
ggauuuuuaugacgc

SEQ ID NO: 604771 - RNA, 16 nt, Escherichia coli CFT073
ggauuuguaauuucag

SEQ ID NO: 604772 - RNA, 20 nt, Escherichia coli CFT073
ggcaaaagaugucggaugcg

SEQ ID NO: 604773 - RNA, 17 nt, Escherichia coli CFT073
ggcaaaauccagaaaaa

SEQ ID NO: 604774 - RNA, 14 nt, Escherichia coli CFT073
ggcaaagccgucca

SEQ ID NO: 604775 - RNA, 14 nt, Escherichia coli CFT073
ggcaagaucgcgau

SEQ ID NO: 604776 - RNA, 18 nt, Escherichia coli CFT073
ggcaagccgcuaacagca

SEQ ID NO: 604777 - RNA, 21 nt, Escherichia coli CFT073
ggcaagccgcuaacagcagca

SEQ ID NO: 604778 - RNA, 15 nt, Escherichia coli CFT073
ggcaagccuaccggc

SEQ ID NO: 604779 - RNA, 16 nt, Escherichia coli CFT073
ggcaaugcguagcugg

SEQ ID NO: 604780 - RNA, 14 nt, Escherichia coli CFT073
ggcaaugccccaga

SEQ ID NO: 604781 - RNA, 18 nt, Escherichia coli CFT073
ggcaaugacaucgcccuc

SEQ ID NO: 604782 - RNA, 14 nt, Escherichia coli CFT073
ggcaauuaaaaauu

SEQ ID NO: 604783 - RNA, 23 nt, Escherichia coli CFT073
ggcaccaaaaaucaccgcgacca

SEQ ID NO: 604784 - RNA, 12 nt, Escherichia coli CFT073
ggcacccaucgc

SEQ ID NO: 604785 - RNA, 14 nt, Escherichia coli CFT073
ggcacccaucgcca

SEQ ID NO: 604786 - RNA, 17 nt, Escherichia coli CFT073
ggcaccguuagugauuu

SEQ ID NO: 604787 - RNA, 13 nt, Escherichia coli CFT073
ggcacgacacaau

SEQ ID NO: 604788 - RNA, 18 nt, Escherichia coli CFT073
ggcacgacacaaugccau

SEQ ID NO: 604789 - RNA, 16 nt, Escherichia coli CFT073
ggcacucuuccagacc

SEQ ID NO: 604790 - RNA, 14 nt, Escherichia coli CFT073
ggcacugaccacca

SEQ ID NO: 604791 - RNA, 21 nt, Escherichia coli CFT073
ggcacugacgcgcuuuucacc

SEQ ID NO: 604792 - RNA, 19 nt, Escherichia coli CFT073
ggcacucuccggcagacca

SEQ ID NO: 604793 - RNA, 17 nt, Escherichia coli CFT073
ggcacucaaucgccaaa

SEQ ID NO: 604794 - RNA, 20 nt, Escherichia coli CFT073
ggcagauccaguuacccagc

SEQ ID NO: 604795 - RNA, 17 nt, Escherichia coli CFT073
ggcagauugagcgucaa

SEQ ID NO: 604796 - RNA, 13 nt, Escherichia coli CFT073
ggcagaucgguua

SEQ ID NO: 604797 - RNA, 14 nt, Escherichia coli CFT073
ggcagaugggcugg

SEQ ID NO: 604798 - RNA, 15 nt, Escherichia coli CFT073
ggcaggccccgucag

SEQ ID NO: 604799 - RNA, 21 nt, Escherichia coli CFT073
ggcaggaaguaaaacgguggc

SEQ ID NO: 604800 - RNA, 20 nt, Escherichia coli CFT073
ggcaggaaaauagguguaaa

SEQ ID NO: 604801 - RNA, 19 nt, Escherichia coli CFT073
ggcaggaaaucgaguaaca

SEQ ID NO: 604802 - RNA, 20 nt, Escherichia coli CFT073
ggcagcucuuucucgcucag

SEQ ID NO: 604803 - RNA, 23 nt, Escherichia coli CFT073
ggcauacuuugauuaaccguuau

SEQ ID NO: 604804 - RNA, 13 nt, Escherichia coli CFT073
ggcauacaacgcc

SEQ ID NO: 604805 - RNA, 16 nt, Escherichia coli CFT073
ggcaucuggugccagc

SEQ ID NO: 604806 - RNA, 15 nt, Escherichia coli CFT073
ggcaguuuauccagc

SEQ ID NO: 604807 - RNA, 21 nt, Escherichia coli CFT073
ggcauaaacgccuuauccggc

SEQ ID NO: 604808 - RNA, 19 nt, Escherichia coli CFT073
ggcagguuuaaccaucagg

SEQ ID NO: 604809 - RNA, 17 nt, Escherichia coli CFT073
ggcauuggcaaucacau

SEQ ID NO: 604810 - RNA, 22 nt, Escherichia coli CFT073
ggcauugaugaacggcggucag

SEQ ID NO: 604811 - RNA, 15 nt, Escherichia coli CFT073
ggccaaaaccacagu

SEQ ID NO: 604812 - RNA, 17 nt, Escherichia coli CFT073
ggccaaaagcuaacagc

SEQ ID NO: 604813 - RNA, 15 nt, Escherichia coli CFT073
ggccaaagccgccga

SEQ ID NO: 604814 - RNA, 14 nt, Escherichia coli CFT073
ggcauuuccagacc

SEQ ID NO: 604815 - RNA, 12 nt, Escherichia coli CFT073
ggcauuugcaac

SEQ ID NO: 604816 - RNA, 12 nt, Escherichia coli CFT073
ggcaugaccguu

SEQ ID NO: 604817 - RNA, 19 nt, Escherichia coli CFT073
ggcaugaccguuugccccg

SEQ ID NO: 604818 - RNA, 13 nt, Escherichia coli CFT073
ggcauuacgcccg

SEQ ID NO: 604819 - RNA, 19 nt, Escherichia coli CFT073
ggcauuauuuacgcgucag

SEQ ID NO: 604820 - RNA, 18 nt, Escherichia coli CFT073
ggcauucaauuaacggcu

SEQ ID NO: 604821 - RNA, 15 nt, Escherichia coli CFT073
ggccacagcgccaga

SEQ ID NO: 604822 - RNA, 20 nt, Escherichia coli CFT073
ggccacgaaucagcaccgua

SEQ ID NO: 604823 - RNA, 17 nt, Escherichia coli CFT073
ggccagcaauccccaga

SEQ ID NO: 604824 - RNA, 21 nt, Escherichia coli CFT073
ggccagauacugccgaccaga

SEQ ID NO: 604825 - RNA, 16 nt, Escherichia coli CFT073
ggccagcguguugccg

SEQ ID NO: 604826 - RNA, 13 nt, Escherichia coli CFT073
cggcgacagcaaa

SEQ ID NO: 604827 - RNA, 18 nt, Escherichia coli CFT073
cggcgaagagagcgccag

SEQ ID NO: 604828 - RNA, 20 nt, Escherichia coli CFT073
cggcgaagagagcgccagua

SEQ ID NO: 604829 - RNA, 19 nt, Escherichia coli CFT073
cggcgaacauucccgguuu

SEQ ID NO: 604830 - RNA, 15 nt, Escherichia coli CFT073
cggcgaaccagccgu

SEQ ID NO: 604831 - RNA, 18 nt, Escherichia coli CFT073
cggcgaggaaucguucau

SEQ ID NO: 604832 - RNA, 15 nt, Escherichia coli CFT073
cggcgauaauaccca

SEQ ID NO: 604833 - RNA, 14 nt, Escherichia coli CFT073
cggcgacuggcuga

SEQ ID NO: 604834 - RNA, 19 nt, Escherichia coli CFT073
cggcgauuuucaucgcuua

SEQ ID NO: 604835 - RNA, 20 nt, Escherichia coli CFT073
cggcgcaaaauugccggaug

SEQ ID NO: 604836 - RNA, 21 nt, Escherichia coli CFT073
cggcgauuaaucucaccaaua

SEQ ID NO: 604837 - RNA, 16 nt, Escherichia coli CFT073
cggcgcaaccaucagu

SEQ ID NO: 604838 - RNA, 22 nt, Escherichia coli CFT073
cggcgcaaugauaucgcuggca

SEQ ID NO: 604839 - RNA, 21 nt, Escherichia coli CFT073
cggcgcggaaggugccauacg

SEQ ID NO: 604840 - RNA, 17 nt, Escherichia coli CFT073
cggcgcuaauucaacgc

SEQ ID NO: 604841 - RNA, 20 nt, Escherichia coli CFT073
cggcgcuacggcguuucacu

SEQ ID NO: 604842 - RNA, 17 nt, Escherichia coli CFT073
cggcgcucuugcggcau

SEQ ID NO: 604843 - RNA, 12 nt, Escherichia coli CFT073
aacaucaaauca

SEQ ID NO: 604844 - RNA, 15 nt, Escherichia coli CFT073
aacaucaacagaccu

SEQ ID NO: 604845 - RNA, 15 nt, Escherichia coli CFT073
aacaucaauccaaac

SEQ ID NO: 604846 - RNA, 22 nt, Escherichia coli CFT073
aacauauugcuccauaauugcc

SEQ ID NO: 604847 - RNA, 23 nt, Escherichia coli CFT073
aacaguucacguccggcagcaga

SEQ ID NO: 604848 - RNA, 18 nt, Escherichia coli CFT073
aacaguucaugguuagcc

SEQ ID NO: 604849 - RNA, 16 nt, Escherichia coli CFT073
cggcagcaaucgacca

SEQ ID NO: 604850 - RNA, 21 nt, Escherichia coli CFT073
cggcagcaaucgaccaggcca

SEQ ID NO: 604851 - RNA, 22 nt, Escherichia coli CFT073
cggcagacagcgccaggcuguu

SEQ ID NO: 604852 - RNA, 21 nt, Escherichia coli CFT073
cggcagagaaaaugccgcaca

SEQ ID NO: 604853 - RNA, 21 nt, Escherichia coli CFT073
cggcagagaggacucugccgg

SEQ ID NO: 604854 - RNA, 12 nt, Escherichia coli CFT073
cggcacguuacu

SEQ ID NO: 604855 - RNA, 17 nt, Escherichia coli CFT073
cggcacguuuugcggau

SEQ ID NO: 604856 - RNA, 22 nt, Escherichia coli CFT073
cggcacuagucccuccgcacaa

SEQ ID NO: 604857 - RNA, 14 nt, Escherichia coli CFT073
aacaggcaucacuu

SEQ ID NO: 604858 - RNA, 22 nt, Escherichia coli CFT073
cggacacgaucuugauguggac

SEQ ID NO: 604859 - RNA, 22 nt, Escherichia coli CFT073
cggcacguaggcgaucccagcg

SEQ ID NO: 604860 - RNA, 19 nt, Escherichia coli CFT073
aacaucacgccuucaauau

SEQ ID NO: 604861 - RNA, 20 nt, Escherichia coli CFT073
cggcagccugcgucgccauc

SEQ ID NO: 604862 - RNA, 17 nt, Escherichia coli CFT073
cggcaggccuaacacau

SEQ ID NO: 604863 - RNA, 13 nt, Escherichia coli CFT073
cggcagcgggauu

SEQ ID NO: 604864 - RNA, 22 nt, Escherichia coli CFT073
cggcagugauuuucccuuccgc

SEQ ID NO: 604865 - RNA, 19 nt, Escherichia coli CFT073
cggcagugcuuucauuuca

SEQ ID NO: 604866 - RNA, 17 nt, Escherichia coli CFT073
cggcaguuuuaccgccg

SEQ ID NO: 604867 - RNA, 18 nt, Escherichia coli CFT073
cggcaguggcuaagcagg

SEQ ID NO: 604868 - RNA, 19 nt, Escherichia coli CFT073
cggcaugauauguaacaua

SEQ ID NO: 604869 - RNA, 21 nt, Escherichia coli CFT073
cggcaucgccuucgcaaaaaa

SEQ ID NO: 604870 - RNA, 18 nt, Escherichia coli CFT073
cggcauuucuggcggcgu

SEQ ID NO: 604871 - RNA, 15 nt, Escherichia coli CFT073
cggccaaauauccgc

SEQ ID NO: 604872 - RNA, 18 nt, Escherichia coli CFT073
cggcauggaucgccgcgg

SEQ ID NO: 604873 - RNA, 23 nt, Escherichia coli CFT073
cggcauuuuuuauggagaaaaca

SEQ ID NO: 604874 - RNA, 23 nt, Escherichia coli CFT073
cggccaaaaccuuucaccucagu

SEQ ID NO: 604875 - RNA, 21 nt, Escherichia coli CFT073
cggccaaaagcacaauccgcc

SEQ ID NO: 604876 - RNA, 14 nt, Escherichia coli CFT073
cggccagcgcaccu

SEQ ID NO: 604877 - RNA, 23 nt, Escherichia coli CFT073
cggcccauaacccacaccauaau

SEQ ID NO: 604878 - RNA, 15 nt, Escherichia coli CFT073
cggcccacaggucgu

SEQ ID NO: 604879 - RNA, 18 nt, Escherichia coli CFT073
cggccauugcccgaggau

SEQ ID NO: 604880 - RNA, 16 nt, Escherichia coli CFT073
cggccaugggcgugau

SEQ ID NO: 604881 - RNA, 21 nt, Escherichia coli CFT073
aacaucuuaauagcugccagc

SEQ ID NO: 604882 - RNA, 14 nt, Escherichia coli CFT073
aacaucuuuacuca

SEQ ID NO: 604883 - RNA, 22 nt, Escherichia coli CFT073
aacaucauaauaauugcggcgg

SEQ ID NO: 604884 - RNA, 14 nt, Escherichia coli CFT073
aacaucaucacgca

SEQ ID NO: 604885 - RNA, 20 nt, Escherichia coli CFT073
aacaucauaauaauugcggc

SEQ ID NO: 604886 - RNA, 22 nt, Escherichia coli CFT073
aacauccagcucgcguucuguc

SEQ ID NO: 604887 - RNA, 18 nt, Escherichia coli CFT073
aacauccgguuucaucag

SEQ ID NO: 604888 - RNA, 21 nt, Escherichia coli CFT073
aacaucgagugcggcgagcau

SEQ ID NO: 604889 - RNA, 22 nt, Escherichia coli CFT073
cgggcuaacuucuuuuucgaca

SEQ ID NO: 604890 - RNA, 18 nt, Escherichia coli CFT073
cgggcgugcugccuuuuu

SEQ ID NO: 604891 - RNA, 14 nt, Escherichia coli CFT073
cgggcgucagcgca

SEQ ID NO: 604892 - RNA, 17 nt, Escherichia coli CFT073
cgggccucgcagcggca

SEQ ID NO: 604893 - RNA, 15 nt, Escherichia coli CFT073
cgggccguugucgac

SEQ ID NO: 604894 - RNA, 17 nt, Escherichia coli CFT073
cggcuugcaccagcagc

SEQ ID NO: 604895 - RNA, 20 nt, Escherichia coli CFT073
cggcuucugccaguacugca

SEQ ID NO: 604896 - RNA, 23 nt, Escherichia coli CFT073
cgggauccaguuauugucgaggu

SEQ ID NO: 604897 - RNA, 14 nt, Escherichia coli CFT073
cgggcaaccacagu

SEQ ID NO: 604898 - RNA, 19 nt, Escherichia coli CFT073
cgggaucuuauccugcguu

SEQ ID NO: 604899 - RNA, 14 nt, Escherichia coli CFT073
cgggaucuccucca

SEQ ID NO: 604900 - RNA, 19 nt, Escherichia coli CFT073
aacauugauuucuuauuca

SEQ ID NO: 604901 - RNA, 22 nt, Escherichia coli CFT073
aacauugccggaagcgccacca

SEQ ID NO: 604902 - RNA, 14 nt, Escherichia coli CFT073
cgggcauugaugaa

SEQ ID NO: 604903 - RNA, 16 nt, Escherichia coli CFT073
cgggcaggguagcgca

SEQ ID NO: 604904 - RNA, 16 nt, Escherichia coli CFT073
cgggcaggcuucaaca

SEQ ID NO: 604905 - RNA, 23 nt, Escherichia coli CFT073
cggcuucuaccuuauccagcaga

SEQ ID NO: 604906 - RNA, 17 nt, Escherichia coli CFT073
cggcuucgucgccagcu

SEQ ID NO: 604907 - RNA, 19 nt, Escherichia coli CFT073
cggcuuccuuaagccgcug

SEQ ID NO: 604908 - RNA, 17 nt, Escherichia coli CFT073
cggcuuccccaacacag

SEQ ID NO: 604909 - RNA, 23 nt, Escherichia coli CFT073
cggcucgucgagaauauacagcg

SEQ ID NO: 604910 - RNA, 21 nt, Escherichia coli CFT073
cggcuccagauagagccgguu

SEQ ID NO: 604911 - RNA, 12 nt, Escherichia coli CFT073
cggcuccagauu

SEQ ID NO: 604912 - RNA, 15 nt, Escherichia coli CFT073
cggcucauuuuccgg

SEQ ID NO: 604913 - RNA, 14 nt, Escherichia coli CFT073
cggcuauauugcag

SEQ ID NO: 604914 - RNA, 22 nt, Escherichia coli CFT073
cggcuacugauguucgccagau

SEQ ID NO: 604915 - RNA, 16 nt, Escherichia coli CFT073
cggcucaacaucgcgc

SEQ ID NO: 604916 - RNA, 20 nt, Escherichia coli CFT073
cggcucacuuuguaggccug

SEQ ID NO: 604917 - RNA, 21 nt, Escherichia coli CFT073
cggcuccaguuaacgccgcgc

SEQ ID NO: 604918 - RNA, 17 nt, Escherichia coli CFT073
cggcgucagcggcuguu

SEQ ID NO: 604919 - RNA, 14 nt, Escherichia coli CFT073
cggcgucagcgcca

SEQ ID NO: 604920 - RNA, 15 nt, Escherichia coli CFT073
cggcgucagcgccau

SEQ ID NO: 604921 - RNA, 23 nt, Escherichia coli CFT073
cggcgucagauucggauccagca

SEQ ID NO: 604922 - RNA, 16 nt, Escherichia coli CFT073
cggcguacccagcgug

SEQ ID NO: 604923 - RNA, 23 nt, Escherichia coli CFT073
cggcguaccaauacguuucuucc

SEQ ID NO: 604924 - RNA, 14 nt, Escherichia coli CFT073
cggcguuuucugac

SEQ ID NO: 604925 - RNA, 17 nt, Escherichia coli CFT073
cggcguuuuggcuguga

SEQ ID NO: 604926 - RNA, 23 nt, Escherichia coli CFT073
cggcguuuuuauugccguuaacu

SEQ ID NO: 604927 - RNA, 17 nt, Escherichia coli CFT073
cggcuaaaucguucaau

SEQ ID NO: 604928 - RNA, 15 nt, Escherichia coli CFT073
cggcuaacuccugau

SEQ ID NO: 604929 - RNA, 17 nt, Escherichia coli CFT073
cggcguuucgccaucgu

SEQ ID NO: 604930 - RNA, 21 nt, Escherichia coli CFT073
cggcguugcccaucgccacgc

SEQ ID NO: 604931 - RNA, 12 nt, Escherichia coli CFT073
cggcguugccga

SEQ ID NO: 604932 - RNA, 19 nt, Escherichia coli CFT073
aacauuuucuucugccagg

SEQ ID NO: 604933 - RNA, 14 nt, Escherichia coli CFT073
aaccaaaccagccg

SEQ ID NO: 604934 - RNA, 20 nt, Escherichia coli CFT073
aaccaaacguggucgccagc

SEQ ID NO: 604935 - RNA, 13 nt, Escherichia coli CFT073
aaccaaccgcaau

SEQ ID NO: 604936 - RNA, 22 nt, Escherichia coli CFT073
aaccaaccgcaauaaccaucag

SEQ ID NO: 604937 - RNA, 20 nt, Escherichia coli CFT073
aaccaacgcauagacagcca

SEQ ID NO: 604938 - RNA, 15 nt, Escherichia coli CFT073
aaccaccgaccacgg

SEQ ID NO: 604939 - RNA, 14 nt, Escherichia coli CFT073
aaccaccuccacgc

SEQ ID NO: 604940 - RNA, 16 nt, Escherichia coli CFT073
aaccacuaauuccugc

SEQ ID NO: 604941 - RNA, 20 nt, Escherichia coli CFT073
aaccacggccaaaucgccau

SEQ ID NO: 604942 - RNA, 23 nt, Escherichia coli CFT073
aaccacucccgcgcuucgcggac

SEQ ID NO: 604943 - RNA, 17 nt, Escherichia coli CFT073
aaccagauucggcgcaa

SEQ ID NO: 604944 - RNA, 17 nt, Escherichia coli CFT073
aaccagcaaugccagcg

SEQ ID NO: 604945 - RNA, 13 nt, Escherichia coli CFT073
aaccagcaccagc

SEQ ID NO: 604946 - RNA, 18 nt, Escherichia coli CFT073
aaccagcagcaucaccac

SEQ ID NO: 604947 - RNA, 15 nt, Escherichia coli CFT073
cgggucaaucggcgc

SEQ ID NO: 604948 - RNA, 14 nt, Escherichia coli CFT073
cgggucagcgccac

SEQ ID NO: 604949 - RNA, 12 nt, Escherichia coli CFT073
aaccagcgcaca

SEQ ID NO: 604950 - RNA, 14 nt, Escherichia coli CFT073
aaccagcggcgcau

SEQ ID NO: 604951 - RNA, 23 nt, Escherichia coli CFT073
aaccagcguguuaggaucacgcc

SEQ ID NO: 604952 - RNA, 22 nt, Escherichia coli CFT073
aaccagcguuuccagcaccagu

SEQ ID NO: 604953 - RNA, 23 nt, Escherichia coli CFT073
aaccagugcuccaccuugcggaa

SEQ ID NO: 604954 - RNA, 11 nt, Escherichia coli CFT073
aaccagcugcc

SEQ ID NO: 604955 - RNA, 17 nt, Escherichia coli CFT073
aaccagggaaaaaagcc

SEQ ID NO: 604956 - RNA, 14 nt, Escherichia coli CFT073
cgggugaacgcguu

SEQ ID NO: 604957 - RNA, 15 nt, Escherichia coli CFT073
cggguucagugaauc

SEQ ID NO: 604958 - RNA, 19 nt, Escherichia coli CFT073
cgggugcgaugcauccggc

SEQ ID NO: 604959 - RNA, 19 nt, Escherichia coli CFT073
cgguacuucucaccgguaa

SEQ ID NO: 604960 - RNA, 22 nt, Escherichia coli CFT073
cgguaccuaccgguggcgugaa

SEQ ID NO: 604961 - RNA, 13 nt, Escherichia coli CFT073
cgguaccugccgg

SEQ ID NO: 604962 - RNA, 14 nt, Escherichia coli CFT073
cgguauaacuugcc

SEQ ID NO: 604963 - RNA, 18 nt, Escherichia coli CFT073
cgguauaaggcaucagcc

SEQ ID NO: 604964 - RNA, 14 nt, Escherichia coli CFT073
cgguaugguaaagc

SEQ ID NO: 604965 - RNA, 21 nt, Escherichia coli CFT073
cgguauguucagaaagcgcca

SEQ ID NO: 604966 - RNA, 18 nt, Escherichia coli CFT073
cgguauuaauuugccagc

SEQ ID NO: 604967 - RNA, 21 nt, Escherichia coli CFT073
cgguauuaauuugccagcgua

SEQ ID NO: 604968 - RNA, 16 nt, Escherichia coli CFT073
cgguaucuuuccagcc

SEQ ID NO: 604969 - RNA, 14 nt, Escherichia coli CFT073
cgguauucuccugc

SEQ ID NO: 604970 - RNA, 22 nt, Escherichia coli CFT073
cgguaaucaggcaaacgcccuu

SEQ ID NO: 604971 - RNA, 14 nt, Escherichia coli CFT073
cgguaacuccggca

SEQ ID NO: 604972 - RNA, 20 nt, Escherichia coli CFT073
cgguaacagaauacugccgu

SEQ ID NO: 604973 - RNA, 14 nt, Escherichia coli CFT073
cgguaaaucggcga

SEQ ID NO: 604974 - RNA, 16 nt, Escherichia coli CFT073
cgguacaauaaaaguu

SEQ ID NO: 604975 - RNA, 13 nt, Escherichia coli CFT073
cgguacacaaaaa

SEQ ID NO: 604976 - RNA, 18 nt, Escherichia coli CFT073
cgguaauuccagcgguug

SEQ ID NO: 604977 - RNA, 15 nt, Escherichia coli CFT073
aaccauauuuaugca

SEQ ID NO: 604978 - RNA, 14 nt, Escherichia coli CFT073
aaccaucagcagua

SEQ ID NO: 604979 - RNA, 21 nt, Escherichia coli CFT073
aaccaugcaaucacugccacc

SEQ ID NO: 604980 - RNA, 19 nt, Escherichia coli CFT073
aaccaugcaggaucgcucc

SEQ ID NO: 604981 - RNA, 17 nt, Escherichia coli CFT073
cggguuuucuacuuuuu

SEQ ID NO: 604982 - RNA, 14 nt, Escherichia coli CFT073
cggguuuucucgcu

SEQ ID NO: 604983 - RNA, 14 nt, Escherichia coli CFT073
aacccacgaccagu

SEQ ID NO: 604984 - RNA, 16 nt, Escherichia coli CFT073
aaccaugucaucaauu

SEQ ID NO: 604985 - RNA, 16 nt, Escherichia coli CFT073
aaccauucccggcuuu

SEQ ID NO: 604986 - RNA, 14 nt, Escherichia coli CFT073
aacccaaccugcca

SEQ ID NO: 604987 - RNA, 12 nt, Escherichia coli CFT073
aacccaacggca

SEQ ID NO: 604988 - RNA, 15 nt, Escherichia coli CFT073
aacccaacuggugau

SEQ ID NO: 604989 - RNA, 11 nt, Escherichia coli CFT073
cggucccuucu

SEQ ID NO: 604990 - RNA, 15 nt, Escherichia coli CFT073
cgguccaugcgaaga

SEQ ID NO: 604991 - RNA, 13 nt, Escherichia coli CFT073
cggucgaugcgga

SEQ ID NO: 604992 - RNA, 22 nt, Escherichia coli CFT073
cggucgaggcaaccagcacgcc

SEQ ID NO: 604993 - RNA, 20 nt, Escherichia coli CFT073
cggucagcugcuguucgguu

SEQ ID NO: 604994 - RNA, 14 nt, Escherichia coli CFT073
cggucagcgcaauc

SEQ ID NO: 604995 - RNA, 20 nt, Escherichia coli CFT073
cggucagccaucgccaccgc

SEQ ID NO: 604996 - RNA, 15 nt, Escherichia coli CFT073
cggucagcagcacca

SEQ ID NO: 604997 - RNA, 17 nt, Escherichia coli CFT073
cgccgguaauuccagcg

SEQ ID NO: 604998 - RNA, 20 nt, Escherichia coli CFT073
aacaccuuauccggccuacg

SEQ ID NO: 604999 - RNA, 15 nt, Escherichia coli CFT073
aacaccuucguccag

SEQ ID NO: 605000 - RNA, 15 nt, Escherichia coli CFT073
aacacgccgauaauc

SEQ ID NO: 605001 - RNA, 16 nt, Escherichia coli CFT073
cgccgggcuaaccgcu

SEQ ID NO: 605002 - RNA, 13 nt, Escherichia coli CFT073
cgccguaaacauc

SEQ ID NO: 605003 - RNA, 22 nt, Escherichia coli CFT073
cgccguaaacaucauccagacg

SEQ ID NO: 605004 - RNA, 18 nt, Escherichia coli CFT073
cgccguaauguugcgcca

SEQ ID NO: 605005 - RNA, 18 nt, Escherichia coli CFT073
cgccguccacaaaccguu

SEQ ID NO: 605006 - RNA, 20 nt, Escherichia coli CFT073
cgccggaauaucaccacuga

SEQ ID NO: 605007 - RNA, 17 nt, Escherichia coli CFT073
cgccggaaucaacgguu

SEQ ID NO: 605008 - RNA, 23 nt, Escherichia coli CFT073
aacaccguaccaucauaagcgcc

SEQ ID NO: 605009 - RNA, 19 nt, Escherichia coli CFT073
aacaccgugaucgacccau

SEQ ID NO: 605010 - RNA, 13 nt, Escherichia coli CFT073
cgccgcaacaaua

SEQ ID NO: 605011 - RNA, 14 nt, Escherichia coli CFT073
cgccgcaaucagcg

SEQ ID NO: 605012 - RNA, 16 nt, Escherichia coli CFT073
cgccgcaaucagcguu

SEQ ID NO: 605013 - RNA, 22 nt, Escherichia coli CFT073
cgccgcaaucagcguuucgcca

SEQ ID NO: 605014 - RNA, 17 nt, Escherichia coli CFT073
cgccgauuucucaucaa

SEQ ID NO: 605015 - RNA, 16 nt, Escherichia coli CFT073
cgccgcaaaacccagg

SEQ ID NO: 605016 - RNA, 15 nt, Escherichia coli CFT073
cgccgauugccugau

SEQ ID NO: 605017 - RNA, 18 nt, Escherichia coli CFT073
cgccgcaucgucacugau

SEQ ID NO: 605018 - RNA, 16 nt, Escherichia coli CFT073
cgccgcauccgacaaa

SEQ ID NO: 605019 - RNA, 18 nt, Escherichia coli CFT073
cgccgcauaauaucuuuc

SEQ ID NO: 605020 - RNA, 21 nt, Escherichia coli CFT073
cgccgcagagaucagauaaua

SEQ ID NO: 605021 - RNA, 20 nt, Escherichia coli CFT073
cgccgcacuauuuaccgcca

SEQ ID NO: 605022 - RNA, 13 nt, Escherichia coli CFT073
cgccgcacccgcc

SEQ ID NO: 605023 - RNA, 15 nt, Escherichia coli CFT073
cgccgauaucguuga

SEQ ID NO: 605024 - RNA, 23 nt, Escherichia coli CFT073
cgccgauaaucaacgcgccgcca

SEQ ID NO: 605025 - RNA, 19 nt, Escherichia coli CFT073
cgccgagaucaacagcaua

SEQ ID NO: 605026 - RNA, 20 nt, Escherichia coli CFT073
cgccgagauuugccagauua

SEQ ID NO: 605027 - RNA, 16 nt, Escherichia coli CFT073
cgcccagaccgugcgc

SEQ ID NO: 605028 - RNA, 20 nt, Escherichia coli CFT073
cgcccagaccgugcgcagca

SEQ ID NO: 605029 - RNA, 14 nt, Escherichia coli CFT073
cgccgccgccagcg

SEQ ID NO: 605030 - RNA, 19 nt, Escherichia coli CFT073
cgccgccagauagccgcca

SEQ ID NO: 605031 - RNA, 22 nt, Escherichia coli CFT073
cgccgcauugguaaaaccgguu

SEQ ID NO: 605032 - RNA, 13 nt, Escherichia coli CFT073
cgcgaccaauacg

SEQ ID NO: 605033 - RNA, 19 nt, Escherichia coli CFT073
cgcgacauaaagcgcaaua

SEQ ID NO: 605034 - RNA, 15 nt, Escherichia coli CFT073
cgcgacauaucgcca

SEQ ID NO: 605035 - RNA, 14 nt, Escherichia coli CFT073
cgcgaagcacacau

SEQ ID NO: 605036 - RNA, 14 nt, Escherichia coli CFT073
cgcgaagccugcgg

SEQ ID NO: 605037 - RNA, 19 nt, Escherichia coli CFT073
cgcgaacuaaacaacgccg

SEQ ID NO: 605038 - RNA, 22 nt, Escherichia coli CFT073
cgcgaacuaaacaacgccgcca

SEQ ID NO: 605039 - RNA, 14 nt, Escherichia coli CFT073
cgcgaaggccagca

SEQ ID NO: 605040 - RNA, 16 nt, Escherichia coli CFT073
cgcgaaggacugccgc

SEQ ID NO: 605041 - RNA, 21 nt, Escherichia coli CFT073
cgcgaauauggcggcggcuuu

SEQ ID NO: 605042 - RNA, 21 nt, Escherichia coli CFT073
cgcgaaugguaaucagcgacu

SEQ ID NO: 605043 - RNA, 23 nt, Escherichia coli CFT073
cgccuuuuugcgcgaagaaacga

SEQ ID NO: 605044 - RNA, 15 nt, Escherichia coli CFT073
cgccuuucacgccgg

SEQ ID NO: 605045 - RNA, 15 nt, Escherichia coli CFT073
cgccuuuuaaugcgc

SEQ ID NO: 605046 - RNA, 19 nt, Escherichia coli CFT073
cgccuuuuuaagcgcguug

SEQ ID NO: 605047 - RNA, 20 nt, Escherichia coli CFT073
cgccuuuuuaauuugccaga

SEQ ID NO: 605048 - RNA, 17 nt, Escherichia coli CFT073
cgcgaaccagaccagca

SEQ ID NO: 605049 - RNA, 16 nt, Escherichia coli CFT073
cgcgaacagccgcggu

SEQ ID NO: 605050 - RNA, 23 nt, Escherichia coli CFT073
cgccuuguaucacuggccucuuc

SEQ ID NO: 605051 - RNA, 20 nt, Escherichia coli CFT073
cgccugauucggccuacaaa

SEQ ID NO: 605052 - RNA, 16 nt, Escherichia coli CFT073
cgccugcaaauaaaua

SEQ ID NO: 605053 - RNA, 16 nt, Escherichia coli CFT073
cgccugcgccaccaca

SEQ ID NO: 605054 - RNA, 18 nt, Escherichia coli CFT073
cgccugcgaguuuuaccu

SEQ ID NO: 605055 - RNA, 16 nt, Escherichia coli CFT073
cgccugagcagcgaua

SEQ ID NO: 605056 - RNA, 17 nt, Escherichia coli CFT073
cgccugagcagcgauau

SEQ ID NO: 605057 - RNA, 14 nt, Escherichia coli CFT073
cgccugaucgagca

SEQ ID NO: 605058 - RNA, 14 nt, Escherichia coli CFT073
cgccugaucgcgca

SEQ ID NO: 605059 - RNA, 16 nt, Escherichia coli CFT073
cgccugaucgcgcagu

SEQ ID NO: 605060 - RNA, 22 nt, Escherichia coli CFT073
cgccuguugugucggcugcgua

SEQ ID NO: 605061 - RNA, 22 nt, Escherichia coli CFT073
cgccugguuuugccaugcaaua

SEQ ID NO: 605062 - RNA, 14 nt, Escherichia coli CFT073
cgccuuccagcagc

SEQ ID NO: 605063 - RNA, 15 nt, Escherichia coli CFT073
cgccuuccagcagcu

SEQ ID NO: 605064 - RNA, 20 nt, Escherichia coli CFT073
cgccuuauccggccuacaua

SEQ ID NO: 605065 - RNA, 16 nt, Escherichia coli CFT073
cgccuucacuuccggc

SEQ ID NO: 605066 - RNA, 19 nt, Escherichia coli CFT073
cgccuuauccgaccuacag

SEQ ID NO: 605067 - RNA, 12 nt, Escherichia coli CFT073
cgccuuauccgg

SEQ ID NO: 605068 - RNA, 20 nt, Escherichia coli CFT073
cgccuuauccggccuaccgg

SEQ ID NO: 605069 - RNA, 20 nt, Escherichia coli CFT073
cgccuuauccggccuacgaa

SEQ ID NO: 605070 - RNA, 22 nt, Escherichia coli CFT073
cgccuuauccggccuacgggaa

SEQ ID NO: 605071 - RNA, 18 nt, Escherichia coli CFT073
cgccuuauccggccugca

SEQ ID NO: 605072 - RNA, 14 nt, Escherichia coli CFT073
cgccugcuuaacau

SEQ ID NO: 605073 - RNA, 12 nt, Escherichia coli CFT073
cgccugcgccau

SEQ ID NO: 605074 - RNA, 21 nt, Escherichia coli CFT073
cgcgacgguagagcugaaaau

SEQ ID NO: 605075 - RNA, 12 nt, Escherichia coli CFT073
cgcgacgcgcuu

SEQ ID NO: 605076 - RNA, 13 nt, Escherichia coli CFT073
cgcgacgaccacc

SEQ ID NO: 605077 - RNA, 16 nt, Escherichia coli CFT073
cgcgauguuuggcgga

SEQ ID NO: 605078 - RNA, 17 nt, Escherichia coli CFT073
cgcgauguuuggcggau

SEQ ID NO: 605079 - RNA, 16 nt, Escherichia coli CFT073
cgcgauuagcgguaaa

SEQ ID NO: 605080 - RNA, 17 nt, Escherichia coli CFT073
cgcgauuuuucugguga

SEQ ID NO: 605081 - RNA, 14 nt, Escherichia coli CFT073
cgcgaucucgucag

SEQ ID NO: 605082 - RNA, 20 nt, Escherichia coli CFT073
cgcgaucauuaacaccacgc

SEQ ID NO: 605083 - RNA, 22 nt, Escherichia coli CFT073
cgcgcaguucgcacaccgcuga

SEQ ID NO: 605084 - RNA, 13 nt, Escherichia coli CFT073
cgcgcaguuucuu

SEQ ID NO: 605085 - RNA, 16 nt, Escherichia coli CFT073
cgcgcauaucguagcc

SEQ ID NO: 605086 - RNA, 22 nt, Escherichia coli CFT073
cgcgccacuggcggaugcggcg

SEQ ID NO: 605087 - RNA, 12 nt, Escherichia coli CFT073
cgcgccagcagc

SEQ ID NO: 605088 - RNA, 17 nt, Escherichia coli CFT073
cgcgcccaaccagcagg

SEQ ID NO: 605089 - RNA, 15 nt, Escherichia coli CFT073
cgcgcccgccgccau

SEQ ID NO: 605090 - RNA, 18 nt, Escherichia coli CFT073
cgcgucaucggcgcggua

SEQ ID NO: 605091 - RNA, 20 nt, Escherichia coli CFT073
cgcgggcaaucgccagacuc

SEQ ID NO: 605092 - RNA, 13 nt, Escherichia coli CFT073
cgcucccagcagu

SEQ ID NO: 605093 - RNA, 19 nt, Escherichia coli CFT073
cgcuaccauuugcgcggau

SEQ ID NO: 605094 - RNA, 13 nt, Escherichia coli CFT073
cgcuacauaacgc

SEQ ID NO: 605095 - RNA, 19 nt, Escherichia coli CFT073
cgcuaccagaaagcgaccc

SEQ ID NO: 605096 - RNA, 13 nt, Escherichia coli CFT073
cgcuaccagcaaa

SEQ ID NO: 605097 - RNA, 17 nt, Escherichia coli CFT073
cgcuaaugcgacccacg

SEQ ID NO: 605098 - RNA, 14 nt, Escherichia coli CFT073
cgcuaacagcagca

SEQ ID NO: 605099 - RNA, 12 nt, Escherichia coli CFT073
cgcucagcaauc

SEQ ID NO: 605100 - RNA, 20 nt, Escherichia coli CFT073
cgcucacggcggcaguauuu

SEQ ID NO: 605101 - RNA, 15 nt, Escherichia coli CFT073
cgcuacgccuuccgu

SEQ ID NO: 605102 - RNA, 18 nt, Escherichia coli CFT073
cgcuaaaaagcgccguuu

SEQ ID NO: 605103 - RNA, 14 nt, Escherichia coli CFT073
cgcuaaaauuucuu

SEQ ID NO: 605104 - RNA, 17 nt, Escherichia coli CFT073
cgcguuugcccgcaacg

SEQ ID NO: 605105 - RNA, 21 nt, Escherichia coli CFT073
cgcguuugcguuccggcggca

SEQ ID NO: 605106 - RNA, 14 nt, Escherichia coli CFT073
cgcguuugucagca

SEQ ID NO: 605107 - RNA, 23 nt, Escherichia coli CFT073
cgcguuucgaugccaaaaaugga

SEQ ID NO: 605108 - RNA, 18 nt, Escherichia coli CFT073
cgcguuuagcaguucauc

SEQ ID NO: 605109 - RNA, 21 nt, Escherichia coli CFT073
cgcguuuaucgacagacgcca

SEQ ID NO: 605110 - RNA, 22 nt, Escherichia coli CFT073
cgcguuggcaagauacgcaucg

SEQ ID NO: 605111 - RNA, 15 nt, Escherichia coli CFT073
cgcguuccaggccgu

SEQ ID NO: 605112 - RNA, 19 nt, Escherichia coli CFT073
cgcguuccugacgaucaag

SEQ ID NO: 605113 - RNA, 18 nt, Escherichia coli CFT073
cgcguucggaccaaugcc

SEQ ID NO: 605114 - RNA, 14 nt, Escherichia coli CFT073
cgcguucggcggau

SEQ ID NO: 605115 - RNA, 22 nt, Escherichia coli CFT073
cgcgugcgccaccgcuuccggc

SEQ ID NO: 605116 - RNA, 15 nt, Escherichia coli CFT073
cgcgugaucccuaac

SEQ ID NO: 605117 - RNA, 13 nt, Escherichia coli CFT073
cgcgugacaccau

SEQ ID NO: 605118 - RNA, 22 nt, Escherichia coli CFT073
cgcggaucgccaaucugguugc

SEQ ID NO: 605119 - RNA, 16 nt, Escherichia coli CFT073
cgcggaucuccggcga

SEQ ID NO: 605120 - RNA, 22 nt, Escherichia coli CFT073
cgcggaugcguuguaccagcuu

SEQ ID NO: 605121 - RNA, 23 nt, Escherichia coli CFT073
cgcggauggccucugccagcugc

SEQ ID NO: 605122 - RNA, 20 nt, Escherichia coli CFT073
cgcggcaaaacccugcgcca

SEQ ID NO: 605123 - RNA, 23 nt, Escherichia coli CFT073
cgcggcaaaacccugcgccagcg

SEQ ID NO: 605124 - RNA, 17 nt, Escherichia coli CFT073
cgcggauagccagcauc

SEQ ID NO: 605125 - RNA, 20 nt, Escherichia coli CFT073
cgcggacaauaauaucuuuc

SEQ ID NO: 605126 - RNA, 20 nt, Escherichia coli CFT073
cgcgcuugcggaagcaaccg

SEQ ID NO: 605127 - RNA, 14 nt, Escherichia coli CFT073
cgcgcuugccgccg

SEQ ID NO: 605128 - RNA, 21 nt, Escherichia coli CFT073
cgcgcugugguguccuucuca

SEQ ID NO: 605129 - RNA, 16 nt, Escherichia coli CFT073
aacagccagaagcccg

SEQ ID NO: 605130 - RNA, 18 nt, Escherichia coli CFT073
cgcggcuguugccaccau

SEQ ID NO: 605131 - RNA, 22 nt, Escherichia coli CFT073
cgcugauacgcggaucuccggc

SEQ ID NO: 605132 - RNA, 21 nt, Escherichia coli CFT073
cgcuccugaucaagcuggcgc

SEQ ID NO: 605133 - RNA, 21 nt, Escherichia coli CFT073
cgcugcaccagguuuucgucg

SEQ ID NO: 605134 - RNA, 17 nt, Escherichia coli CFT073
cgcugccaugaucaaau

SEQ ID NO: 605135 - RNA, 15 nt, Escherichia coli CFT073
cgcugcucacaccau

SEQ ID NO: 605136 - RNA, 18 nt, Escherichia coli CFT073
cgcugcgcgaccaucgga

SEQ ID NO: 605137 - RNA, 20 nt, Escherichia coli CFT073
cgcuggcauggcgaaaaucu

SEQ ID NO: 605138 - RNA, 13 nt, Escherichia coli CFT073
cgcuggaucgaac

SEQ ID NO: 605139 - RNA, 22 nt, Escherichia coli CFT073
cgcuggcaagaagaucagcaaa

SEQ ID NO: 605140 - RNA, 22 nt, Escherichia coli CFT073
cgcuggcgguuugccauuuucu

SEQ ID NO: 605141 - RNA, 18 nt, Escherichia coli CFT073
cgcuggcguuguccgcca

SEQ ID NO: 605142 - RNA, 13 nt, Escherichia coli CFT073
cgcuggcgcagca

SEQ ID NO: 605143 - RNA, 23 nt, Escherichia coli CFT073
cgcuguuuuucauugcguaacca

SEQ ID NO: 605144 - RNA, 13 nt, Escherichia coli CFT073
cgcuuaacagaac

SEQ ID NO: 605145 - RNA, 20 nt, Escherichia coli CFT073
cgcuuaacgcgggcuucuuc

SEQ ID NO: 605146 - RNA, 17 nt, Escherichia coli CFT073
cgcuguugccagcagca

SEQ ID NO: 605147 - RNA, 16 nt, Escherichia coli CFT073
cgcuguuccagguuuu

SEQ ID NO: 605148 - RNA, 22 nt, Escherichia coli CFT073
cgcuguguguaggccagcgaua

SEQ ID NO: 605149 - RNA, 16 nt, Escherichia coli CFT073
cgcugucuuucaacag

SEQ ID NO: 605150 - RNA, 16 nt, Escherichia coli CFT073
cgcugugacauccaga

SEQ ID NO: 605151 - RNA, 16 nt, Escherichia coli CFT073
cgcugugagcaggcgu

SEQ ID NO: 605152 - RNA, 22 nt, Escherichia coli CFT073
cgcuguaagccacgauucagcg

SEQ ID NO: 605153 - RNA, 19 nt, Escherichia coli CFT073
cgcuguaagccgccgccau

SEQ ID NO: 605154 - RNA, 17 nt, Escherichia coli CFT073
cgcuguaauuaccagcg

SEQ ID NO: 605155 - RNA, 21 nt, Escherichia coli CFT073
cgcuguaauuucacaccauca

SEQ ID NO: 605156 - RNA, 19 nt, Escherichia coli CFT073
cgcuggugauucagggcag

SEQ ID NO: 605157 - RNA, 14 nt, Escherichia coli CFT073
cgcuggugaaauca

SEQ ID NO: 605158 - RNA, 16 nt, Escherichia coli CFT073
cgcuucaagcauugau

SEQ ID NO: 605159 - RNA, 14 nt, Escherichia coli CFT073
cgcuucaaucagcg

SEQ ID NO: 605160 - RNA, 17 nt, Escherichia coli CFT073
cgcuucagcccgcgaua

SEQ ID NO: 605161 - RNA, 17 nt, Escherichia coli CFT073
cgcuuaccaugccaacg

SEQ ID NO: 605162 - RNA, 18 nt, Escherichia coli CFT073
cgcuuaucaggccuacaa

SEQ ID NO: 605163 - RNA, 14 nt, Escherichia coli CFT073
cgcuuaucaggcuu

SEQ ID NO: 605164 - RNA, 18 nt, Escherichia coli CFT073
cgcuuaucgccagcgcga

SEQ ID NO: 605165 - RNA, 18 nt, Escherichia coli CFT073
cgcuucggaauaguucug

SEQ ID NO: 605166 - RNA, 14 nt, Escherichia coli CFT073
cgcuucgccaguga

SEQ ID NO: 605167 - RNA, 16 nt, Escherichia coli CFT073
cgcuucgauucccagc

SEQ ID NO: 605168 - RNA, 14 nt, Escherichia coli CFT073
cgcuucagcguauc

SEQ ID NO: 605169 - RNA, 20 nt, Escherichia coli CFT073
cgcuucaucgguuaacccgu

SEQ ID NO: 605170 - RNA, 23 nt, Escherichia coli CFT073
cgcuucauuugcggguucuggcg

SEQ ID NO: 605171 - RNA, 16 nt, Escherichia coli CFT073
cgcuucccaaagacga

SEQ ID NO: 605172 - RNA, 17 nt, Escherichia coli CFT073
cgcuucguugaucagcg

SEQ ID NO: 605173 - RNA, 14 nt, Escherichia coli CFT073
cgcuucuucagccu

SEQ ID NO: 605174 - RNA, 12 nt, Escherichia coli CFT073
cgcuucugccgg

SEQ ID NO: 605175 - RNA, 22 nt, Escherichia coli CFT073
cgcuugcgauauggcugcgcuu

SEQ ID NO: 605176 - RNA, 20 nt, Escherichia coli CFT073
cgcuugcauccggcaugaua

SEQ ID NO: 605177 - RNA, 17 nt, Escherichia coli CFT073
cggaauuggccgcgcaa

SEQ ID NO: 605178 - RNA, 19 nt, Escherichia coli CFT073
cggaauuuacccgccaggu

SEQ ID NO: 605179 - RNA, 20 nt, Escherichia coli CFT073
cggacaaauaacccgccaug

SEQ ID NO: 605180 - RNA, 15 nt, Escherichia coli CFT073
cggaauggcaucuuc

SEQ ID NO: 605181 - RNA, 18 nt, Escherichia coli CFT073
cggaaugcagucacgcca

SEQ ID NO: 605182 - RNA, 21 nt, Escherichia coli CFT073
cggaaugcagucacgccagua

SEQ ID NO: 605183 - RNA, 13 nt, Escherichia coli CFT073
cggaaugccggaa

SEQ ID NO: 605184 - RNA, 19 nt, Escherichia coli CFT073
cggaaugcacagccugaua

SEQ ID NO: 605185 - RNA, 17 nt, Escherichia coli CFT073
cggaauauucuuccggc

SEQ ID NO: 605186 - RNA, 23 nt, Escherichia coli CFT073
cggaauaaucuguaccuucugca

SEQ ID NO: 605187 - RNA, 16 nt, Escherichia coli CFT073
cggaaucaccggcaaa

SEQ ID NO: 605188 - RNA, 18 nt, Escherichia coli CFT073
cggaagcgccaccagcgc

SEQ ID NO: 605189 - RNA, 20 nt, Escherichia coli CFT073
cggaagcgccaccagcgcca

SEQ ID NO: 605190 - RNA, 15 nt, Escherichia coli CFT073
cggaagaugaaaaac

SEQ ID NO: 605191 - RNA, 20 nt, Escherichia coli CFT073
cggaaccuggucagaaacgu

SEQ ID NO: 605192 - RNA, 17 nt, Escherichia coli CFT073
cggaacggcguugcugc

SEQ ID NO: 605193 - RNA, 19 nt, Escherichia coli CFT073
cggaacaucgaugccgccu

SEQ ID NO: 605194 - RNA, 13 nt, Escherichia coli CFT073
cggaaccaaccgc

SEQ ID NO: 605195 - RNA, 16 nt, Escherichia coli CFT073
cggaaccaccagaucc

SEQ ID NO: 605196 - RNA, 14 nt, Escherichia coli CFT073
cggaaccagcgccu

SEQ ID NO: 605197 - RNA, 14 nt, Escherichia coli CFT073
cgcuuuaacgcccu

SEQ ID NO: 605198 - RNA, 14 nt, Escherichia coli CFT073
cgcuuuaccgcugc

SEQ ID NO: 605199 - RNA, 16 nt, Escherichia coli CFT073
cgcuugucaggccugu

SEQ ID NO: 605200 - RNA, 14 nt, Escherichia coli CFT073
cgcuugcugcgauc

SEQ ID NO: 605201 - RNA, 17 nt, Escherichia coli CFT073
cgcuugcgggcuggcgg

SEQ ID NO: 605202 - RNA, 16 nt, Escherichia coli CFT073
cgcuugcggccagcac

SEQ ID NO: 605203 - RNA, 17 nt, Escherichia coli CFT073
cgcuugcggccagcaca

SEQ ID NO: 605204 - RNA, 18 nt, Escherichia coli CFT073
cgcuuugauccgccagau

SEQ ID NO: 605205 - RNA, 18 nt, Escherichia coli CFT073
cgcuuugaugcguucuuc

SEQ ID NO: 605206 - RNA, 21 nt, Escherichia coli CFT073
cgcuuucucuucggcuucuac

SEQ ID NO: 605207 - RNA, 19 nt, Escherichia coli CFT073
cgcuuucuggcgcgcggcu

SEQ ID NO: 605208 - RNA, 13 nt, Escherichia coli CFT073
cgcuuucuucuuc

SEQ ID NO: 605209 - RNA, 20 nt, Escherichia coli CFT073
cgcuuuauagcauagcguug

SEQ ID NO: 605210 - RNA, 16 nt, Escherichia coli CFT073
cgcuuuauccagcaua

SEQ ID NO: 605211 - RNA, 19 nt, Escherichia coli CFT073
cgcuuucaaaagccccuga

SEQ ID NO: 605212 - RNA, 20 nt, Escherichia coli CFT073
cgcuuuugguuuuucaacca

SEQ ID NO: 605213 - RNA, 13 nt, Escherichia coli CFT073
cgcuuuuucuugc

SEQ ID NO: 605214 - RNA, 18 nt, Escherichia coli CFT073
cgcuuuuuucagcgccag

SEQ ID NO: 605215 - RNA, 14 nt, Escherichia coli CFT073
cggaaaccaaacuu

SEQ ID NO: 605216 - RNA, 22 nt, Escherichia coli CFT073
cggaaaaacguuucaaacaggc

SEQ ID NO: 605217 - RNA, 12 nt, Escherichia coli CFT073
cgcuuugcugcc

SEQ ID NO: 605218 - RNA, 22 nt, Escherichia coli CFT073
cgcuuugcugccuuccuccggc

SEQ ID NO: 605219 - RNA, 19 nt, Escherichia coli CFT073
cgcuuuuaauucacuucug

SEQ ID NO: 605220 - RNA, 22 nt, Escherichia coli CFT073
cggaaaguuuacgucgccaguu

SEQ ID NO: 605221 - RNA, 19 nt, Escherichia coli CFT073
cggaaaucauccagcacgu

SEQ ID NO: 605222 - RNA, 20 nt, Escherichia coli CFT073
cggaaagcagauaacccagc

SEQ ID NO: 605223 - RNA, 13 nt, Escherichia coli CFT073
aaaugcgaaaaaa

SEQ ID NO: 605224 - RNA, 20 nt, Escherichia coli CFT073
aaaugcccgacaaaaauuau

SEQ ID NO: 605225 - RNA, 12 nt, Escherichia coli CFT073
aaaugcaggcag

SEQ ID NO: 605226 - RNA, 17 nt, Escherichia coli CFT073
aaaugcacgcugccugg

SEQ ID NO: 605227 - RNA, 12 nt, Escherichia coli CFT073
aaaugccagccc

SEQ ID NO: 605228 - RNA, 18 nt, Escherichia coli CFT073
ccgcgaaacugcguggcg

SEQ ID NO: 605229 - RNA, 16 nt, Escherichia coli CFT073
ccgccuggugcaggcg

SEQ ID NO: 605230 - RNA, 23 nt, Escherichia coli CFT073
ccgccuguaaacggaugacuucg

SEQ ID NO: 605231 - RNA, 12 nt, Escherichia coli CFT073
ccgccugcugcg

SEQ ID NO: 605232 - RNA, 13 nt, Escherichia coli CFT073
ccgcgaaccagac

SEQ ID NO: 605233 - RNA, 11 nt, Escherichia coli CFT073
ccgcgccagau

SEQ ID NO: 605234 - RNA, 13 nt, Escherichia coli CFT073
ccgcgccaagccu

SEQ ID NO: 605235 - RNA, 22 nt, Escherichia coli CFT073
ccgcgcccuuuugcuaagguca

SEQ ID NO: 605236 - RNA, 24 nt, Escherichia coli CFT073
ccgcgcgugccggaacgccgcugg

SEQ ID NO: 605237 - RNA, 15 nt, Escherichia coli CFT073
ccgcgcggguaaaac

SEQ ID NO: 605238 - RNA, 12 nt, Escherichia coli CFT073
ccgcagccgcca

SEQ ID NO: 605239 - RNA, 15 nt, Escherichia coli CFT073
ccgcauauagccaaa

SEQ ID NO: 605240 - RNA, 19 nt, Escherichia coli CFT073
ccgcaucaggccgccagca

SEQ ID NO: 605241 - RNA, 12 nt, Escherichia coli CFT073
ccgcaggucgga

SEQ ID NO: 605242 - RNA, 22 nt, Escherichia coli CFT073
ccgcagguaaacucaauucacg

SEQ ID NO: 605243 - RNA, 21 nt, Escherichia coli CFT073
ccgcagguagcagcagcgcca

SEQ ID NO: 605244 - RNA, 14 nt, Escherichia coli CFT073
ccgcauccggcaaa

SEQ ID NO: 605245 - RNA, 14 nt, Escherichia coli CFT073
ccgcauccggcaag

SEQ ID NO: 605246 - RNA, 15 nt, Escherichia coli CFT073
ccgccaccagcguca

SEQ ID NO: 605247 - RNA, 21 nt, Escherichia coli CFT073
ccgccagacaauccagcgaaa

SEQ ID NO: 605248 - RNA, 13 nt, Escherichia coli CFT073
ccgccagauugcu

SEQ ID NO: 605249 - RNA, 23 nt, Escherichia coli CFT073
ccgccagaauacccgaagcgcca

SEQ ID NO: 605250 - RNA, 14 nt, Escherichia coli CFT073
ccgccaccgccaga

SEQ ID NO: 605251 - RNA, 15 nt, Escherichia coli CFT073
ccgccagcgccaucu

SEQ ID NO: 605252 - RNA, 13 nt, Escherichia coli CFT073
ccgccagugcaua

SEQ ID NO: 605253 - RNA, 22 nt, Escherichia coli CFT073
ccgcccgucaaacguaccgcca

SEQ ID NO: 605254 - RNA, 12 nt, Escherichia coli CFT073
ccgccgccgcca

SEQ ID NO: 605255 - RNA, 18 nt, Escherichia coli CFT073
ccgccgcccggcaaaacg

SEQ ID NO: 605256 - RNA, 13 nt, Escherichia coli CFT073
ccgccgccauccu

SEQ ID NO: 605257 - RNA, 14 nt, Escherichia coli CFT073
ccgccgacgcgaag

SEQ ID NO: 605258 - RNA, 17 nt, Escherichia coli CFT073
ccgcugagaaaaagcga

SEQ ID NO: 605259 - RNA, 18 nt, Escherichia coli CFT073
ccgcugaccguugcucau

SEQ ID NO: 605260 - RNA, 24 nt, Escherichia coli CFT073
ccgcugcaacacuuccgcuuccag

SEQ ID NO: 605261 - RNA, 12 nt, Escherichia coli CFT073
ccgcuaccgccc

SEQ ID NO: 605262 - RNA, 13 nt, Escherichia coli CFT073
ccgcuacaucacc

SEQ ID NO: 605263 - RNA, 14 nt, Escherichia coli CFT073
ccgcuacaucaccg

SEQ ID NO: 605264 - RNA, 19 nt, Escherichia coli CFT073
ccgcuaaugcgacccacgc

SEQ ID NO: 605265 - RNA, 21 nt, Escherichia coli CFT073
ccgcgucuuaucaggccuacg

SEQ ID NO: 605266 - RNA, 15 nt, Escherichia coli CFT073
ccgcuaaauccgccg

SEQ ID NO: 605267 - RNA, 22 nt, Escherichia coli CFT073
ccgcuaaauccgccgccacuug

SEQ ID NO: 605268 - RNA, 21 nt, Escherichia coli CFT073
ccgcgucguugaaaugcggcg

SEQ ID NO: 605269 - RNA, 20 nt, Escherichia coli CFT073
ccgcgucauugacgcuggcu

SEQ ID NO: 605270 - RNA, 14 nt, Escherichia coli CFT073
ccgcguaacuuuug

SEQ ID NO: 605271 - RNA, 15 nt, Escherichia coli CFT073
ccgcggggaucugga

SEQ ID NO: 605272 - RNA, 18 nt, Escherichia coli CFT073
ccggaggagugcgccagu

SEQ ID NO: 605273 - RNA, 17 nt, Escherichia coli CFT073
ccggauauccacccgca

SEQ ID NO: 605274 - RNA, 21 nt, Escherichia coli CFT073
ccggauauccacccgcagcca

SEQ ID NO: 605275 - RNA, 13 nt, Escherichia coli CFT073
ccggaucgccaaa

SEQ ID NO: 605276 - RNA, 17 nt, Escherichia coli CFT073
ccggacuggcauugauu

SEQ ID NO: 605277 - RNA, 17 nt, Escherichia coli CFT073
ccggacgacggcaucgc

SEQ ID NO: 605278 - RNA, 15 nt, Escherichia coli CFT073
ccggacggcaauucc

SEQ ID NO: 605279 - RNA, 19 nt, Escherichia coli CFT073
ccggacacucggcgcggau

SEQ ID NO: 605280 - RNA, 19 nt, Escherichia coli CFT073
ccggaagcgccaccagcgc

SEQ ID NO: 605281 - RNA, 18 nt, Escherichia coli CFT073
ccggaagcgugcaucggc

SEQ ID NO: 605282 - RNA, 11 nt, Escherichia coli CFT073
ccggaacgugc

SEQ ID NO: 605283 - RNA, 14 nt, Escherichia coli CFT073
ccggaacgugcaua

SEQ ID NO: 605284 - RNA, 21 nt, Escherichia coli CFT073
ccgcugcuggcguugucaucg

SEQ ID NO: 605285 - RNA, 23 nt, Escherichia coli CFT073
ccggaugcggcgagaacgccuua

SEQ ID NO: 605286 - RNA, 14 nt, Escherichia coli CFT073
ccggaugcggcgcg

SEQ ID NO: 605287 - RNA, 23 nt, Escherichia coli CFT073
ccggaugcggcguaaacgccuua

SEQ ID NO: 605288 - RNA, 23 nt, Escherichia coli CFT073
ccggaugcggcgugaacgccuua

SEQ ID NO: 605289 - RNA, 23 nt, Escherichia coli CFT073
ccggaugcggcauaaacgccuua

SEQ ID NO: 605290 - RNA, 16 nt, Escherichia coli CFT073
ccggaugcgacgcaaa

SEQ ID NO: 605291 - RNA, 17 nt, Escherichia coli CFT073
ccggaugcgacgcacga

SEQ ID NO: 605292 - RNA, 21 nt, Escherichia coli CFT073
ccggaugcgaugcugacacau

SEQ ID NO: 605293 - RNA, 23 nt, Escherichia coli CFT073
ccggaugacuuuucauccggcga

SEQ ID NO: 605294 - RNA, 21 nt, Escherichia coli CFT073
ccggauuacgcaucaguuuca

SEQ ID NO: 605295 - RNA, 16 nt, Escherichia coli CFT073
ccggauuauccagcca

SEQ ID NO: 605296 - RNA, 19 nt, Escherichia coli CFT073
ccggauggcacaugacuuc

SEQ ID NO: 605297 - RNA, 16 nt, Escherichia coli CFT073
ccggauguguugcauc

SEQ ID NO: 605298 - RNA, 14 nt, Escherichia coli CFT073
ccggcaccauucca

SEQ ID NO: 605299 - RNA, 21 nt, Escherichia coli CFT073
ccggcaauucucacugauuac

SEQ ID NO: 605300 - RNA, 19 nt, Escherichia coli CFT073
ccggcaauuuugcgccgau

SEQ ID NO: 605301 - RNA, 12 nt, Escherichia coli CFT073
ccggcaauaucc

SEQ ID NO: 605302 - RNA, 21 nt, Escherichia coli CFT073
ccggcaaucaccgccagcggc

SEQ ID NO: 605303 - RNA, 18 nt, Escherichia coli CFT073
ccggcaaucgcgccagaa

SEQ ID NO: 605304 - RNA, 16 nt, Escherichia coli CFT073
ccggcaaugcgccgaa

SEQ ID NO: 605305 - RNA, 11 nt, Escherichia coli CFT073
ccggcaauggu

SEQ ID NO: 605306 - RNA, 18 nt, Escherichia coli CFT073
ccggcaacaacagggcaa

SEQ ID NO: 605307 - RNA, 14 nt, Escherichia coli CFT073
ccggcaaccagcac

SEQ ID NO: 605308 - RNA, 15 nt, Escherichia coli CFT073
ccggcaaccggaucg

SEQ ID NO: 605309 - RNA, 16 nt, Escherichia coli CFT073
ccggcacuaacgcaaa

SEQ ID NO: 605310 - RNA, 15 nt, Escherichia coli CFT073
ccggcacuggaaaac

SEQ ID NO: 605311 - RNA, 18 nt, Escherichia coli CFT073
ccggcauaaacaaagcgc

SEQ ID NO: 605312 - RNA, 13 nt, Escherichia coli CFT073
ccggcauaacaug

SEQ ID NO: 605313 - RNA, 20 nt, Escherichia coli CFT073
ccggcagugcuuucauuuca

SEQ ID NO: 605314 - RNA, 15 nt, Escherichia coli CFT073
ccggcauauuaacca

SEQ ID NO: 605315 - RNA, 23 nt, Escherichia coli CFT073
ccggcauaauaagcccggccugg

SEQ ID NO: 605316 - RNA, 13 nt, Escherichia coli CFT073
ccggcaucaguaa

SEQ ID NO: 605317 - RNA, 16 nt, Escherichia coli CFT073
ccggcauccagccaaa

SEQ ID NO: 605318 - RNA, 17 nt, Escherichia coli CFT073
ccggcaucgcaaaccag

SEQ ID NO: 605319 - RNA, 16 nt, Escherichia coli CFT073
ccggccauuuucauuu

SEQ ID NO: 605320 - RNA, 19 nt, Escherichia coli CFT073
ccguagcggcuuaagaaga

SEQ ID NO: 605321 - RNA, 22 nt, Escherichia coli CFT073
ccguagcguuugcuguacugcc

SEQ ID NO: 605322 - RNA, 17 nt, Escherichia coli CFT073
ccgucaaaaggcgugau

SEQ ID NO: 605323 - RNA, 20 nt, Escherichia coli CFT073
ccgucaaacguaccgccaga

SEQ ID NO: 605324 - RNA, 21 nt, Escherichia coli CFT073
ccgucaccagcaucaacaaca

SEQ ID NO: 605325 - RNA, 24 nt, Escherichia coli CFT073
ccgucaauaggcauauagccgcca

SEQ ID NO: 605326 - RNA, 19 nt, Escherichia coli CFT073
ccgucaauccagccgccca

SEQ ID NO: 605327 - RNA, 15 nt, Escherichia coli CFT073
ccgucacgcagucag

SEQ ID NO: 605328 - RNA, 23 nt, Escherichia coli CFT073
ccgucagcaaaguaccaucgucc

SEQ ID NO: 605329 - RNA, 22 nt, Escherichia coli CFT073
ccgucaucauugauggcaaaau

SEQ ID NO: 605330 - RNA, 15 nt, Escherichia coli CFT073
ccguggcaaaaucca

SEQ ID NO: 605331 - RNA, 17 nt, Escherichia coli CFT073
ccguggagugguucggu

SEQ ID NO: 605332 - RNA, 15 nt, Escherichia coli CFT073
ccgugcuguacagca

SEQ ID NO: 605333 - RNA, 14 nt, Escherichia coli CFT073
ccgugcagcgcaau

SEQ ID NO: 605334 - RNA, 18 nt, Escherichia coli CFT073
ccgugaugcggucgcugc

SEQ ID NO: 605335 - RNA, 16 nt, Escherichia coli CFT073
ccgucuggccaguucg

SEQ ID NO: 605336 - RNA, 18 nt, Escherichia coli CFT073
ccgucuucccgcagccac

SEQ ID NO: 605337 - RNA, 20 nt, Escherichia coli CFT073
ccgucuuccgucacaggcac

SEQ ID NO: 605338 - RNA, 18 nt, Escherichia coli CFT073
ccgucguuaaucugcccg

SEQ ID NO: 605339 - RNA, 19 nt, Escherichia coli CFT073
ccgucguuaaugcgcccag

SEQ ID NO: 605340 - RNA, 10 nt, Escherichia coli CFT073
ccgucgcaug

SEQ ID NO: 605341 - RNA, 19 nt, Escherichia coli CFT073
ccgucgccauugcagccgc

SEQ ID NO: 605342 - RNA, 23 nt, Escherichia coli CFT073
ccguccagaucaucccggcaaac

SEQ ID NO: 605343 - RNA, 19 nt, Escherichia coli CFT073
ccggcgauugauagcgacg

SEQ ID NO: 605344 - RNA, 15 nt, Escherichia coli CFT073
ccggcuuuuuuacau

SEQ ID NO: 605345 - RNA, 20 nt, Escherichia coli CFT073
ccggcuuuuuuacaucauca

SEQ ID NO: 605346 - RNA, 20 nt, Escherichia coli CFT073
ccgggucgcgacugccagca

SEQ ID NO: 605347 - RNA, 14 nt, Escherichia coli CFT073
ccgguagccauuuu

SEQ ID NO: 605348 - RNA, 19 nt, Escherichia coli CFT073
ccgguagcuggugaacauu

SEQ ID NO: 605349 - RNA, 14 nt, Escherichia coli CFT073
ccgguaaucaccag

SEQ ID NO: 605350 - RNA, 16 nt, Escherichia coli CFT073
ccgguaaucaccagca

SEQ ID NO: 605351 - RNA, 17 nt, Escherichia coli CFT073
ccgguaauuccagcggu

SEQ ID NO: 605352 - RNA, 23 nt, Escherichia coli CFT073
ccgguaauugcacguccaguggc

SEQ ID NO: 605353 - RNA, 20 nt, Escherichia coli CFT073
ccggguuugccgcuggcauc

SEQ ID NO: 605354 - RNA, 15 nt, Escherichia coli CFT073
ccgguaaagcaauga

SEQ ID NO: 605355 - RNA, 21 nt, Escherichia coli CFT073
ccgguaacccuucauauuccu

SEQ ID NO: 605356 - RNA, 13 nt, Escherichia coli CFT073
ccggguucucgca

SEQ ID NO: 605357 - RNA, 19 nt, Escherichia coli CFT073
ccggguguucuuucucgcc

SEQ ID NO: 605358 - RNA, 14 nt, Escherichia coli CFT073
ccggguuacggaaa

SEQ ID NO: 605359 - RNA, 16 nt, Escherichia coli CFT073
ccggguuacggaaacu

SEQ ID NO: 605360 - RNA, 22 nt, Escherichia coli CFT073
ccggguuauugguuucgucgug

SEQ ID NO: 605361 - RNA, 16 nt, Escherichia coli CFT073
ccugcgcgaugcgucg

SEQ ID NO: 605362 - RNA, 24 nt, Escherichia coli CFT073
ccugcgccgauacgcauaaacauc

SEQ ID NO: 605363 - RNA, 14 nt, Escherichia coli CFT073
ccugcgauugugac

SEQ ID NO: 605364 - RNA, 14 nt, Escherichia coli CFT073
ccugcgccagcguu

SEQ ID NO: 605365 - RNA, 18 nt, Escherichia coli CFT073
ccugccgcgccugcgcca

SEQ ID NO: 605366 - RNA, 13 nt, Escherichia coli CFT073
ccugccauuguuc

SEQ ID NO: 605367 - RNA, 18 nt, Escherichia coli CFT073
ccugccaguuauagcgca

SEQ ID NO: 605368 - RNA, 16 nt, Escherichia coli CFT073
ccugccaugcgcaauc

SEQ ID NO: 605369 - RNA, 12 nt, Escherichia coli CFT073
ccugccagcguu

SEQ ID NO: 605370 - RNA, 19 nt, Escherichia coli CFT073
ccugcauuugcgcagcguu

SEQ ID NO: 605371 - RNA, 21 nt, Escherichia coli CFT073
ccugcugugucucuucuuugc

SEQ ID NO: 605372 - RNA, 14 nt, Escherichia coli CFT073
ccugcugcgucgcg

SEQ ID NO: 605373 - RNA, 19 nt, Escherichia coli CFT073
ccugcugaauuuccugcgc

SEQ ID NO: 605374 - RNA, 17 nt, Escherichia coli CFT073
ccugcucgucauccgcu

SEQ ID NO: 605375 - RNA, 15 nt, Escherichia coli CFT073
ccugcucgcgcagau

SEQ ID NO: 605376 - RNA, 18 nt, Escherichia coli CFT073
ccugcguaacuguucgag

SEQ ID NO: 605377 - RNA, 20 nt, Escherichia coli CFT073
ccugcgggagcgcuuuuucc

SEQ ID NO: 605378 - RNA, 15 nt, Escherichia coli CFT073
ccuggcgcugcucag

SEQ ID NO: 605379 - RNA, 22 nt, Escherichia coli CFT073
ccuggcaugauugagcugcccg

SEQ ID NO: 605380 - RNA, 23 nt, Escherichia coli CFT073
ccuggauaaggccaccagcggca

SEQ ID NO: 605381 - RNA, 22 nt, Escherichia coli CFT073
ccugguacauugcgaacaggua

SEQ ID NO: 605382 - RNA, 14 nt, Escherichia coli CFT073
ccuggguauaaauc

SEQ ID NO: 605383 - RNA, 16 nt, Escherichia coli CFT073
ccuggggucaucagca

SEQ ID NO: 605384 - RNA, 18 nt, Escherichia coli CFT073
ccugggcuucauccagca

SEQ ID NO: 605385 - RNA, 15 nt, Escherichia coli CFT073
ccugggccagcacca

SEQ ID NO: 605386 - RNA, 16 nt, Escherichia coli CFT073
ccugggccagcaccau

SEQ ID NO: 605387 - RNA, 20 nt, Escherichia coli CFT073
ccugauaacacagcggcagc

SEQ ID NO: 605388 - RNA, 19 nt, Escherichia coli CFT073
ccugauaagacagcgucac

SEQ ID NO: 605389 - RNA, 21 nt, Escherichia coli CFT073
ccugauaagacgcgccagcgu

SEQ ID NO: 605390 - RNA, 23 nt, Escherichia coli CFT073
ccugacugaguaauagccugaug

SEQ ID NO: 605391 - RNA, 21 nt, Escherichia coli CFT073
ccugacuuaccuccugucuaa

SEQ ID NO: 605392 - RNA, 21 nt, Escherichia coli CFT073
ccugacuuacuuccugucuuc

SEQ ID NO: 605393 - RNA, 19 nt, Escherichia coli CFT073
ccugacguaaggcaucgcu

SEQ ID NO: 605394 - RNA, 23 nt, Escherichia coli CFT073
ccugagcagcaaccacuugcagc

SEQ ID NO: 605395 - RNA, 13 nt, Escherichia coli CFT073
ccugagaggauga

SEQ ID NO: 605396 - RNA, 16 nt, Escherichia coli CFT073
ccugacgcuuaucuuc

SEQ ID NO: 605397 - RNA, 22 nt, Escherichia coli CFT073
ccugaccuuuacggcgcgucaa

SEQ ID NO: 605398 - RNA, 13 nt, Escherichia coli CFT073
ccugacccagcac

SEQ ID NO: 605399 - RNA, 15 nt, Escherichia coli CFT073
ccugacccagcacca

SEQ ID NO: 605400 - RNA, 17 nt, Escherichia coli CFT073
ccugaccguuguugaac

SEQ ID NO: 605401 - RNA, 20 nt, Escherichia coli CFT073
ccugaauaacuggcgcgaca

SEQ ID NO: 605402 - RNA, 17 nt, Escherichia coli CFT073
ccugaaucugagcauuu

SEQ ID NO: 605403 - RNA, 22 nt, Escherichia coli CFT073
ccugacauuaaguguccgccaa

SEQ ID NO: 605404 - RNA, 14 nt, Escherichia coli CFT073
ccugaccauuauca

SEQ ID NO: 605405 - RNA, 23 nt, Escherichia coli CFT073
ccucuccgggggcgauuucagau

SEQ ID NO: 605406 - RNA, 16 nt, Escherichia coli CFT073
ccucuucaauuaacaa

SEQ ID NO: 605407 - RNA, 15 nt, Escherichia coli CFT073
ccugaagcaguuuca

SEQ ID NO: 605408 - RNA, 20 nt, Escherichia coli CFT073
ccugaagcuaaaaccugcac

SEQ ID NO: 605409 - RNA, 22 nt, Escherichia coli CFT073
ccugaacccggaaucgcgucgu

SEQ ID NO: 605410 - RNA, 15 nt, Escherichia coli CFT073
ccugaaagcgacagc

SEQ ID NO: 605411 - RNA, 19 nt, Escherichia coli CFT073
ccucuuuuaccaucagcgu

SEQ ID NO: 605412 - RNA, 12 nt, Escherichia coli CFT073
ccucuuuaccgg

SEQ ID NO: 605413 - RNA, 15 nt, Escherichia coli CFT073
ccucuuuauuuccug

SEQ ID NO: 605414 - RNA, 18 nt, Escherichia coli CFT073
ccugcauauaaucgaucc

SEQ ID NO: 605415 - RNA, 17 nt, Escherichia coli CFT073
ccugcauaaugucgcug

SEQ ID NO: 605416 - RNA, 17 nt, Escherichia coli CFT073
ccugcagucaccugccc

SEQ ID NO: 605417 - RNA, 17 nt, Escherichia coli CFT073
ccugccaauggcaggau

SEQ ID NO: 605418 - RNA, 14 nt, Escherichia coli CFT073
ccugaugcgacgcu

SEQ ID NO: 605419 - RNA, 19 nt, Escherichia coli CFT073
ccugaugcgacgcuggcgc

SEQ ID NO: 605420 - RNA, 19 nt, Escherichia coli CFT073
ccugaugcgaugcuggcgc

SEQ ID NO: 605421 - RNA, 15 nt, Escherichia coli CFT073
ccugaugacgcagau

SEQ ID NO: 605422 - RNA, 14 nt, Escherichia coli CFT073
ccugaugcuucaga

SEQ ID NO: 605423 - RNA, 18 nt, Escherichia coli CFT073
ccugauucgcaccacguu

SEQ ID NO: 605424 - RNA, 22 nt, Escherichia coli CFT073
ccugauuguuuguagccgccaa

SEQ ID NO: 605425 - RNA, 23 nt, Escherichia coli CFT073
ccugaugaaaaaucuccagcguu

SEQ ID NO: 605426 - RNA, 22 nt, Escherichia coli CFT073
ccugaucgcgcaguuuaugcag

SEQ ID NO: 605427 - RNA, 15 nt, Escherichia coli CFT073
ccugauccugcaaca

SEQ ID NO: 605428 - RNA, 13 nt, Escherichia coli CFT073
ccugaucacccac

SEQ ID NO: 605429 - RNA, 19 nt, Escherichia coli CFT073
ccugcacaggcauucagau

SEQ ID NO: 605430 - RNA, 23 nt, Escherichia coli CFT073
ccugcaauauauugaauuagcaa

SEQ ID NO: 605431 - RNA, 17 nt, Escherichia coli CFT073
ccugcaaauaaauaccg

SEQ ID NO: 605432 - RNA, 21 nt, Escherichia coli CFT073
ccuccaacccacaaaaacacc

SEQ ID NO: 605433 - RNA, 23 nt, Escherichia coli CFT073
ccucacgguuuugcucggcaauc

SEQ ID NO: 605434 - RNA, 19 nt, Escherichia coli CFT073
ccguggucggcaaaauaca

SEQ ID NO: 605435 - RNA, 19 nt, Escherichia coli CFT073
ccgugguggcagccagcca

SEQ ID NO: 605436 - RNA, 13 nt, Escherichia coli CFT073
ccucacgaagcgu

SEQ ID NO: 605437 - RNA, 15 nt, Escherichia coli CFT073
ccgugguccagcugu

SEQ ID NO: 605438 - RNA, 16 nt, Escherichia coli CFT073
ccucccguuuuuagau

SEQ ID NO: 605439 - RNA, 18 nt, Escherichia coli CFT073
ccuccuggaacacgcgca

SEQ ID NO: 605440 - RNA, 15 nt, Escherichia coli CFT073
ccucgccguuaauga

SEQ ID NO: 605441 - RNA, 13 nt, Escherichia coli CFT073
ccucgcagcggca

SEQ ID NO: 605442 - RNA, 23 nt, Escherichia coli CFT073
cgcaggggauggaugcccccaga

SEQ ID NO: 605443 - RNA, 22 nt, Escherichia coli CFT073
cgcaggcuggagcguugcgcca

SEQ ID NO: 605444 - RNA, 21 nt, Escherichia coli CFT073
cgcaggcggcuggcaucggca

SEQ ID NO: 605445 - RNA, 12 nt, Escherichia coli CFT073
cgcagcuucucg

SEQ ID NO: 605446 - RNA, 20 nt, Escherichia coli CFT073
cgcagcuucacaaaggcuug

SEQ ID NO: 605447 - RNA, 16 nt, Escherichia coli CFT073
cgcagcugcaguacca

SEQ ID NO: 605448 - RNA, 22 nt, Escherichia coli CFT073
cgcagcucuuuauccagcagcc

SEQ ID NO: 605449 - RNA, 23 nt, Escherichia coli CFT073
cgcagcucuuuauccagcagcca

SEQ ID NO: 605450 - RNA, 14 nt, Escherichia coli CFT073
cgcagcuaucagcg

SEQ ID NO: 605451 - RNA, 24 nt, Escherichia coli CFT073
cgcagcucacuucgauccagugau

SEQ ID NO: 605452 - RNA, 17 nt, Escherichia coli CFT073
cgcagcucauaaccguc

SEQ ID NO: 605453 - RNA, 15 nt, Escherichia coli CFT073
cgcagcggaccgcuu

SEQ ID NO: 605454 - RNA, 22 nt, Escherichia coli CFT073
cgcagcgcguuacgcccaagca

SEQ ID NO: 605455 - RNA, 17 nt, Escherichia coli CFT073
cgcagcggaguuuucgg

SEQ ID NO: 605456 - RNA, 12 nt, Escherichia coli CFT073
cgcagccgccac

SEQ ID NO: 605457 - RNA, 16 nt, Escherichia coli CFT073
cgcagccacgucaccu

SEQ ID NO: 605458 - RNA, 16 nt, Escherichia coli CFT073
cgcagcauuuccucaa

SEQ ID NO: 605459 - RNA, 22 nt, Escherichia coli CFT073
cgcagaagcauaccgaucgcgg

SEQ ID NO: 605460 - RNA, 13 nt, Escherichia coli CFT073
cgcacuuugcugg

SEQ ID NO: 605461 - RNA, 16 nt, Escherichia coli CFT073
cgcagaaaaaagcuug

SEQ ID NO: 605462 - RNA, 21 nt, Escherichia coli CFT073
cgcacuucuucguuuucugcg

SEQ ID NO: 605463 - RNA, 19 nt, Escherichia coli CFT073
cgcaaccuucgccagaaua

SEQ ID NO: 605464 - RNA, 14 nt, Escherichia coli CFT073
cgcaaccuugcugc

SEQ ID NO: 605465 - RNA, 15 nt, Escherichia coli CFT073
cgcaaccuugcugcg

SEQ ID NO: 605466 - RNA, 21 nt, Escherichia coli CFT073
cgcaaccugauguuucugcgc

SEQ ID NO: 605467 - RNA, 13 nt, Escherichia coli CFT073
cgcaacgccgcca

SEQ ID NO: 605468 - RNA, 14 nt, Escherichia coli CFT073
cgcaacgccgccaa

SEQ ID NO: 605469 - RNA, 17 nt, Escherichia coli CFT073
cgcaccaaauccaaccu

SEQ ID NO: 605470 - RNA, 16 nt, Escherichia coli CFT073
cgcaccaaccaucagg

SEQ ID NO: 605471 - RNA, 15 nt, Escherichia coli CFT073
cgcacuuacagcaac

SEQ ID NO: 605472 - RNA, 16 nt, Escherichia coli CFT073
cgcacguucugucgcu

SEQ ID NO: 605473 - RNA, 14 nt, Escherichia coli CFT073
cgcacguugccagc

SEQ ID NO: 605474 - RNA, 15 nt, Escherichia coli CFT073
cgcacguugccagca

SEQ ID NO: 605475 - RNA, 12 nt, Escherichia coli CFT073
cgcacuacgccg

SEQ ID NO: 605476 - RNA, 18 nt, Escherichia coli CFT073
cgcacgguucgccaucac

SEQ ID NO: 605477 - RNA, 15 nt, Escherichia coli CFT073
cgcacgaacuaccgu

SEQ ID NO: 605478 - RNA, 20 nt, Escherichia coli CFT073
cgcacgaggaacagcgcgcu

SEQ ID NO: 605479 - RNA, 12 nt, Escherichia coli CFT073
cgaugcagcgca

SEQ ID NO: 605480 - RNA, 22 nt, Escherichia coli CFT073
cgaugauugucccugccagcgu

SEQ ID NO: 605481 - RNA, 15 nt, Escherichia coli CFT073
cgaugauuuccgcca

SEQ ID NO: 605482 - RNA, 18 nt, Escherichia coli CFT073
cgaugauuuccggcguau

SEQ ID NO: 605483 - RNA, 13 nt, Escherichia coli CFT073
cgaucuucccgcg

SEQ ID NO: 605484 - RNA, 20 nt, Escherichia coli CFT073
cgaucuuccggcgggcaaac

SEQ ID NO: 605485 - RNA, 22 nt, Escherichia coli CFT073
cgauauuaguggcaaccgcaac

SEQ ID NO: 605486 - RNA, 18 nt, Escherichia coli CFT073
cgauauucauuuugcugg

SEQ ID NO: 605487 - RNA, 16 nt, Escherichia coli CFT073
cgauauuugccgcgac

SEQ ID NO: 605488 - RNA, 19 nt, Escherichia coli CFT073
cgaucuguuuaucgcgcaa

SEQ ID NO: 605489 - RNA, 15 nt, Escherichia coli CFT073
cgaugcuggcgcauc

SEQ ID NO: 605490 - RNA, 12 nt, Escherichia coli CFT073
cgauuaacugcg

SEQ ID NO: 605491 - RNA, 21 nt, Escherichia coli CFT073
cgauuaagaaugcgaaaacga

SEQ ID NO: 605492 - RNA, 16 nt, Escherichia coli CFT073
cgauuaaucaccggag

SEQ ID NO: 605493 - RNA, 16 nt, Escherichia coli CFT073
cgauuaaucagugcaa

SEQ ID NO: 605494 - RNA, 22 nt, Escherichia coli CFT073
cgauuaauccaguugcguaaua

SEQ ID NO: 605495 - RNA, 17 nt, Escherichia coli CFT073
cgauuaaucuuccagau

SEQ ID NO: 605496 - RNA, 14 nt, Escherichia coli CFT073
cgauuacagcaucg

SEQ ID NO: 605497 - RNA, 14 nt, Escherichia coli CFT073
cgauuaccacgaua

SEQ ID NO: 605498 - RNA, 21 nt, Escherichia coli CFT073
cgauuauuuauucccgccaga

SEQ ID NO: 605499 - RNA, 22 nt, Escherichia coli CFT073
cgauuauuuauucccgccagau

SEQ ID NO: 605500 - RNA, 13 nt, Escherichia coli CFT073
cgauucagcaaca

SEQ ID NO: 605501 - RNA, 21 nt, Escherichia coli CFT073
cgauucagcaacaucaccaac

SEQ ID NO: 605502 - RNA, 13 nt, Escherichia coli CFT073
cgauuccggcaaa

SEQ ID NO: 605503 - RNA, 20 nt, Escherichia coli CFT073
cgauucgucacuuugcuguc

SEQ ID NO: 605504 - RNA, 14 nt, Escherichia coli CFT073
cgauuuuucaucac

SEQ ID NO: 605505 - RNA, 15 nt, Escherichia coli CFT073
cgauuuuugacuucc

SEQ ID NO: 605506 - RNA, 19 nt, Escherichia coli CFT073
cgcaaaaacauugccggaa

SEQ ID NO: 605507 - RNA, 19 nt, Escherichia coli CFT073
cgcaaagccgauaccuucc

SEQ ID NO: 605508 - RNA, 19 nt, Escherichia coli CFT073
cgcaaacucaucgccgcca

SEQ ID NO: 605509 - RNA, 13 nt, Escherichia coli CFT073
cgcaaacugcugu

SEQ ID NO: 605510 - RNA, 23 nt, Escherichia coli CFT073
cgcaaagagagaagccagguaga

SEQ ID NO: 605511 - RNA, 17 nt, Escherichia coli CFT073
cgcaaagcacgccaggu

SEQ ID NO: 605512 - RNA, 17 nt, Escherichia coli CFT073
cgcaaaccgacgcuguc

SEQ ID NO: 605513 - RNA, 16 nt, Escherichia coli CFT073
cgauguagcgcuguaa

SEQ ID NO: 605514 - RNA, 17 nt, Escherichia coli CFT073
cgauguaauccugaugg

SEQ ID NO: 605515 - RNA, 18 nt, Escherichia coli CFT073
cgauguaauucagccauu

SEQ ID NO: 605516 - RNA, 18 nt, Escherichia coli CFT073
cgauguacuucaacauaa

SEQ ID NO: 605517 - RNA, 19 nt, Escherichia coli CFT073
cgauguacuucaacauaac

SEQ ID NO: 605518 - RNA, 18 nt, Escherichia coli CFT073
cgauggucauauccagca

SEQ ID NO: 605519 - RNA, 20 nt, Escherichia coli CFT073
cgaugggugaucaagcguag

SEQ ID NO: 605520 - RNA, 20 nt, Escherichia coli CFT073
cgaugguacuucaaucgcca

SEQ ID NO: 605521 - RNA, 17 nt, Escherichia coli CFT073
cgauggcuucuggcugc

SEQ ID NO: 605522 - RNA, 22 nt, Escherichia coli CFT073
cgauggcuucuggcugcuccag

SEQ ID NO: 605523 - RNA, 14 nt, Escherichia coli CFT073
cgauggcuccggaa

SEQ ID NO: 605524 - RNA, 13 nt, Escherichia coli CFT073
cgauguuaccguu

SEQ ID NO: 605525 - RNA, 21 nt, Escherichia coli CFT073
cgauguucccccagccagaug

SEQ ID NO: 605526 - RNA, 20 nt, Escherichia coli CFT073
cgcagguagcagcagcgcca

SEQ ID NO: 605527 - RNA, 13 nt, Escherichia coli CFT073
cgcauucguucau

SEQ ID NO: 605528 - RNA, 18 nt, Escherichia coli CFT073
cgcauucugugccggaau

SEQ ID NO: 605529 - RNA, 16 nt, Escherichia coli CFT073
cgccaaaagcgauuau

SEQ ID NO: 605530 - RNA, 20 nt, Escherichia coli CFT073
cgcauuucucgguauuacaa

SEQ ID NO: 605531 - RNA, 19 nt, Escherichia coli CFT073
cgcauuuguaggcaggaua

SEQ ID NO: 605532 - RNA, 14 nt, Escherichia coli CFT073
cgcauugcggcauc

SEQ ID NO: 605533 - RNA, 14 nt, Escherichia coli CFT073
cgccaagcgcaaua

SEQ ID NO: 605534 - RNA, 15 nt, Escherichia coli CFT073
cgccaagcaucggca

SEQ ID NO: 605535 - RNA, 14 nt, Escherichia coli CFT073
cgccaaaucugccg

SEQ ID NO: 605536 - RNA, 21 nt, Escherichia coli CFT073
cgccaaauucuuuaucgauaa

SEQ ID NO: 605537 - RNA, 23 nt, Escherichia coli CFT073
cgccaacaaaaaugcaggcguuu

SEQ ID NO: 605538 - RNA, 21 nt, Escherichia coli CFT073
cgccaacguguugcugcaugu

SEQ ID NO: 605539 - RNA, 13 nt, Escherichia coli CFT073
cgccaaucagcgc

SEQ ID NO: 605540 - RNA, 19 nt, Escherichia coli CFT073
cgccaaucagcgcagcacc

SEQ ID NO: 605541 - RNA, 15 nt, Escherichia coli CFT073
cgccaaucgccacgc

SEQ ID NO: 605542 - RNA, 20 nt, Escherichia coli CFT073
cgccaaucgccacgccaaga

SEQ ID NO: 605543 - RNA, 21 nt, Escherichia coli CFT073
cgccaaguucgaacgccgcca

SEQ ID NO: 605544 - RNA, 14 nt, Escherichia coli CFT073
cgccaauaaucugc

SEQ ID NO: 605545 - RNA, 13 nt, Escherichia coli CFT073
cgccaauaaugaa

SEQ ID NO: 605546 - RNA, 18 nt, Escherichia coli CFT073
cgccaauacgugaucgca

SEQ ID NO: 605547 - RNA, 15 nt, Escherichia coli CFT073
cgccaccaccagacg

SEQ ID NO: 605548 - RNA, 14 nt, Escherichia coli CFT073
cgccaccaccagcg

SEQ ID NO: 605549 - RNA, 22 nt, Escherichia coli CFT073
cgccaccagcgucagaaacagu

SEQ ID NO: 605550 - RNA, 22 nt, Escherichia coli CFT073
cgccaccagauacggcgaucgu

SEQ ID NO: 605551 - RNA, 15 nt, Escherichia coli CFT073
cgccacgacucaaau

SEQ ID NO: 605552 - RNA, 22 nt, Escherichia coli CFT073
cgccacgacucaaaucacgcag

SEQ ID NO: 605553 - RNA, 18 nt, Escherichia coli CFT073
cgccacggaaacauucaa

SEQ ID NO: 605554 - RNA, 11 nt, Escherichia coli CFT073
cgccacgcggg

SEQ ID NO: 605555 - RNA, 16 nt, Escherichia coli CFT073
cgccacgccuuccuga

SEQ ID NO: 605556 - RNA, 14 nt, Escherichia coli CFT073
cgccagauccgcuu

SEQ ID NO: 605557 - RNA, 17 nt, Escherichia coli CFT073
cgccagaggcgacaaac

SEQ ID NO: 605558 - RNA, 20 nt, Escherichia coli CFT073
cgccagauaaauucgaccau

SEQ ID NO: 605559 - RNA, 22 nt, Escherichia coli CFT073
cgccagacgugcacgcagcaaa

SEQ ID NO: 605560 - RNA, 10 nt, Escherichia coli CFT073
cgccagacuc

SEQ ID NO: 605561 - RNA, 20 nt, Escherichia coli CFT073
cgccagacugaucaucgccc

SEQ ID NO: 605562 - RNA, 18 nt, Escherichia coli CFT073
cgccagagagcggagcaa

SEQ ID NO: 605563 - RNA, 23 nt, Escherichia coli CFT073
cgccagaauaacgugaucgaaca

SEQ ID NO: 605564 - RNA, 17 nt, Escherichia coli CFT073
cgccagaauagcgccgc

SEQ ID NO: 605565 - RNA, 18 nt, Escherichia coli CFT073
cgccagaauagcgccgcc

SEQ ID NO: 605566 - RNA, 17 nt, Escherichia coli CFT073
cgccagaauccccggca

SEQ ID NO: 605567 - RNA, 17 nt, Escherichia coli CFT073
cgccagaccacugcgcc

SEQ ID NO: 605568 - RNA, 21 nt, Escherichia coli CFT073
cgccagcaagagcaaauaaaa

SEQ ID NO: 605569 - RNA, 14 nt, Escherichia coli CFT073
cgccagcaccagca

SEQ ID NO: 605570 - RNA, 13 nt, Escherichia coli CFT073
cgccagaugcggc

SEQ ID NO: 605571 - RNA, 22 nt, Escherichia coli CFT073
cgccagaugcggcgugaacgcc

SEQ ID NO: 605572 - RNA, 17 nt, Escherichia coli CFT073
cgccagauguuccgcca

SEQ ID NO: 605573 - RNA, 19 nt, Escherichia coli CFT073
cgccagauguuccgccauu

SEQ ID NO: 605574 - RNA, 15 nt, Escherichia coli CFT073
cgccagauugcugcu

SEQ ID NO: 605575 - RNA, 22 nt, Escherichia coli CFT073
cgccagaaaguuuuucaacacc

SEQ ID NO: 605576 - RNA, 15 nt, Escherichia coli CFT073
cgccagaaauuugca

SEQ ID NO: 605577 - RNA, 23 nt, Escherichia coli CFT073
cgccagaaagacgguuaacgcca

SEQ ID NO: 605578 - RNA, 18 nt, Escherichia coli CFT073
cgccagaacuacccgguu

SEQ ID NO: 605579 - RNA, 15 nt, Escherichia coli CFT073
cgccagaagaaccgc

SEQ ID NO: 605580 - RNA, 19 nt, Escherichia coli CFT073
cgccagaagaaccgccacc

SEQ ID NO: 605581 - RNA, 23 nt, Escherichia coli CFT073
cgccagaagaauaaaacauagcc

SEQ ID NO: 605582 - RNA, 19 nt, Escherichia coli CFT073
cgccacuugagccgccacc

SEQ ID NO: 605583 - RNA, 19 nt, Escherichia coli CFT073
cgccacuuucacgccgcca

SEQ ID NO: 605584 - RNA, 14 nt, Escherichia coli CFT073
cgccacucacugau

SEQ ID NO: 605585 - RNA, 19 nt, Escherichia coli CFT073
cgccacugcgacaccagca

SEQ ID NO: 605586 - RNA, 21 nt, Escherichia coli CFT073
cgccacuggcggaugcggcga

SEQ ID NO: 605587 - RNA, 14 nt, Escherichia coli CFT073
cgccacuaagcagg

SEQ ID NO: 605588 - RNA, 20 nt, Escherichia coli CFT073
cgccacgucguuccccauca

SEQ ID NO: 605589 - RNA, 19 nt, Escherichia coli CFT073
cgccacgucaucagcaauu

SEQ ID NO: 605590 - RNA, 14 nt, Escherichia coli CFT073
cgccagccgccagc

SEQ ID NO: 605591 - RNA, 15 nt, Escherichia coli CFT073
cgccagccgccagca

SEQ ID NO: 605592 - RNA, 12 nt, Escherichia coli CFT073
cgccagcgagaa

SEQ ID NO: 605593 - RNA, 21 nt, Escherichia coli CFT073
cgccagcgagaaauacgcccu

SEQ ID NO: 605594 - RNA, 22 nt, Escherichia coli CFT073
cgccagcgaagguaacaccagu

SEQ ID NO: 605595 - RNA, 14 nt, Escherichia coli CFT073
cgccagcaucggca

SEQ ID NO: 605596 - RNA, 13 nt, Escherichia coli CFT073
cgccagcaguuuu

SEQ ID NO: 605597 - RNA, 19 nt, Escherichia coli CFT073
cgccagcacggcgcagacg

SEQ ID NO: 605598 - RNA, 17 nt, Escherichia coli CFT073
cgccauaaacaccagca

SEQ ID NO: 605599 - RNA, 20 nt, Escherichia coli CFT073
cgccauaaacaccagcagca

SEQ ID NO: 605600 - RNA, 17 nt, Escherichia coli CFT073
cgccauaaccgccagca

SEQ ID NO: 605601 - RNA, 23 nt, Escherichia coli CFT073
cgccaguugacguaacagagcau

SEQ ID NO: 605602 - RNA, 11 nt, Escherichia coli CFT073
cgccaguucuu

SEQ ID NO: 605603 - RNA, 16 nt, Escherichia coli CFT073
cgccauauaccgcggu

SEQ ID NO: 605604 - RNA, 19 nt, Escherichia coli CFT073
cgccaucaauaaccagcgu

SEQ ID NO: 605605 - RNA, 14 nt, Escherichia coli CFT073
cgccaucaaucgac

SEQ ID NO: 605606 - RNA, 18 nt, Escherichia coli CFT073
cgccaucaauuuugauga

SEQ ID NO: 605607 - RNA, 22 nt, Escherichia coli CFT073
cgccaucaccaguugugaugcc

SEQ ID NO: 605608 - RNA, 21 nt, Escherichia coli CFT073
cgccauccccgaagcuuguuc

SEQ ID NO: 605609 - RNA, 16 nt, Escherichia coli CFT073
cgccaucaugaucaga

SEQ ID NO: 605610 - RNA, 17 nt, Escherichia coli CFT073
cgccaucaugaucagaa

SEQ ID NO: 605611 - RNA, 15 nt, Escherichia coli CFT073
cgccaucaguuucag

SEQ ID NO: 605612 - RNA, 16 nt, Escherichia coli CFT073
cgccaucaguuucaga

SEQ ID NO: 605613 - RNA, 14 nt, Escherichia coli CFT073
cgccaucuaccacc

SEQ ID NO: 605614 - RNA, 19 nt, Escherichia coli CFT073
cgccauccgguuaucagaa

SEQ ID NO: 605615 - RNA, 17 nt, Escherichia coli CFT073
cgccauuccagccagaa

SEQ ID NO: 605616 - RNA, 17 nt, Escherichia coli CFT073
cgccauugaaaccgcug

SEQ ID NO: 605617 - RNA, 14 nt, Escherichia coli CFT073
cgccaugcugguua

SEQ ID NO: 605618 - RNA, 19 nt, Escherichia coli CFT073
cgccaugaugauccacacc

SEQ ID NO: 605619 - RNA, 14 nt, Escherichia coli CFT073
cgcccacaccacgc

SEQ ID NO: 605620 - RNA, 20 nt, Escherichia coli CFT073
cgccauugcuaucaacaaua

SEQ ID NO: 605621 - RNA, 14 nt, Escherichia coli CFT073
cgccauuuucugcc

SEQ ID NO: 605622 - RNA, 13 nt, Escherichia coli CFT073
cgcccacgcacca

SEQ ID NO: 605623 - RNA, 16 nt, Escherichia coli CFT073
cgcccacgccagagau

SEQ ID NO: 605624 - RNA, 15 nt, Escherichia coli CFT073
cgccagugacgaccu

SEQ ID NO: 605625 - RNA, 15 nt, Escherichia coli CFT073
cgccagugcgcaaua

SEQ ID NO: 605626 - RNA, 19 nt, Escherichia coli CFT073
cgccagugcgccccaggua

SEQ ID NO: 605627 - RNA, 17 nt, Escherichia coli CFT073
cgccaguccaaucaggc

SEQ ID NO: 605628 - RNA, 22 nt, Escherichia coli CFT073
cgccagguguuuaaccaacaca

SEQ ID NO: 605629 - RNA, 22 nt, Escherichia coli CFT073
cgccaguaagguaacgcugccc

SEQ ID NO: 605630 - RNA, 22 nt, Escherichia coli CFT073
cgccagguacucaugcccacgc

SEQ ID NO: 605631 - RNA, 18 nt, Escherichia coli CFT073
cgccaggcuucauacacc

SEQ ID NO: 605632 - RNA, 20 nt, Escherichia coli CFT073
cgccaggcacuucccagaua

SEQ ID NO: 605633 - RNA, 17 nt, Escherichia coli CFT073
cgccagcuucacgcgcu

SEQ ID NO: 605634 - RNA, 21 nt, Escherichia coli CFT073
cgccagcguuaucccauucca

SEQ ID NO: 605635 - RNA, 19 nt, Escherichia coli CFT073
cgccagcggcagcucgcgu

SEQ ID NO: 605636 - RNA, 20 nt, Escherichia coli CFT073
cgccagcgcgaccgccauga

SEQ ID NO: 605637 - RNA, 23 nt, Escherichia coli CFT073
cgccagcgcgccugaaugccaca

SEQ ID NO: 605638 - RNA, 12 nt, Escherichia coli CFT073
cgccagcgccau

SEQ ID NO: 605639 - RNA, 20 nt, Escherichia coli CFT073
cgacgcuccugaucaagcug

SEQ ID NO: 605640 - RNA, 20 nt, Escherichia coli CFT073
aacaagcggacuucauugac

SEQ ID NO: 605641 - RNA, 22 nt, Escherichia coli CFT073
cgacgucugaucggcaaucacg

SEQ ID NO: 605642 - RNA, 16 nt, Escherichia coli CFT073
cgacuuccaccagcgg

SEQ ID NO: 605643 - RNA, 17 nt, Escherichia coli CFT073
cgacuuccaccagcggc

SEQ ID NO: 605644 - RNA, 20 nt, Escherichia coli CFT073
cgagaaaaucaucugcgccc

SEQ ID NO: 605645 - RNA, 15 nt, Escherichia coli CFT073
cgagauaaugcgcca

SEQ ID NO: 605646 - RNA, 16 nt, Escherichia coli CFT073
cgagauaaaugccaaa

SEQ ID NO: 605647 - RNA, 19 nt, Escherichia coli CFT073
cgagagcgggaaaacauac

SEQ ID NO: 605648 - RNA, 18 nt, Escherichia coli CFT073
aacaccaugggcauccac

SEQ ID NO: 605649 - RNA, 13 nt, Escherichia coli CFT073
aacaccaccgaaa

SEQ ID NO: 605650 - RNA, 14 nt, Escherichia coli CFT073
aacaccacgccagc

SEQ ID NO: 605651 - RNA, 13 nt, Escherichia coli CFT073
aacaccacgcgcc

SEQ ID NO: 605652 - RNA, 15 nt, Escherichia coli CFT073
cgagcagagaaacgc

SEQ ID NO: 605653 - RNA, 23 nt, Escherichia coli CFT073
cgagcagagaaacgccagcagca

SEQ ID NO: 605654 - RNA, 15 nt, Escherichia coli CFT073
aacacaggcagaaca

SEQ ID NO: 605655 - RNA, 20 nt, Escherichia coli CFT073
aacacauuacuuguuucgca

SEQ ID NO: 605656 - RNA, 19 nt, Escherichia coli CFT073
cgagcagcauuccggcauu

SEQ ID NO: 605657 - RNA, 19 nt, Escherichia coli CFT073
cgagcagcaauauagcgca

SEQ ID NO: 605658 - RNA, 18 nt, Escherichia coli CFT073
cgagcagauacugaugaa

SEQ ID NO: 605659 - RNA, 15 nt, Escherichia coli CFT073
cgagaugguaaagca

SEQ ID NO: 605660 - RNA, 19 nt, Escherichia coli CFT073
cgagauucauccaguucca

SEQ ID NO: 605661 - RNA, 21 nt, Escherichia coli CFT073
cgagcagaaucgguccgccac

SEQ ID NO: 605662 - RNA, 18 nt, Escherichia coli CFT073
cgagccaaacgcccagcu

SEQ ID NO: 605663 - RNA, 15 nt, Escherichia coli CFT073
cgagcauccgauccu

SEQ ID NO: 605664 - RNA, 12 nt, Escherichia coli CFT073
cgagcaucgcga

SEQ ID NO: 605665 - RNA, 18 nt, Escherichia coli CFT073
cgagcaguacagccgcca

SEQ ID NO: 605666 - RNA, 12 nt, Escherichia coli CFT073
cgagcaucacua

SEQ ID NO: 605667 - RNA, 12 nt, Escherichia coli CFT073
cgagccagcgca

SEQ ID NO: 605668 - RNA, 18 nt, Escherichia coli CFT073
cgagcauuuucagcguuu

SEQ ID NO: 605669 - RNA, 16 nt, Escherichia coli CFT073
cgauaaaacgccgcug

SEQ ID NO: 605670 - RNA, 18 nt, Escherichia coli CFT073
cgauaaacaguuccgcaa

SEQ ID NO: 605671 - RNA, 23 nt, Escherichia coli CFT073
cgagugucacuggccagcggcga

SEQ ID NO: 605672 - RNA, 24 nt, Escherichia coli CFT073
cgaguuaccgugugcggcgaugau

SEQ ID NO: 605673 - RNA, 21 nt, Escherichia coli CFT073
cgauaccuaacgccagcgcga

SEQ ID NO: 605674 - RNA, 14 nt, Escherichia coli CFT073
cgauaucaccaauu

SEQ ID NO: 605675 - RNA, 19 nt, Escherichia coli CFT073
cgauaucaggcaaacagaa

SEQ ID NO: 605676 - RNA, 23 nt, Escherichia coli CFT073
cgauauccagcgcggcgaaggug

SEQ ID NO: 605677 - RNA, 14 nt, Escherichia coli CFT073
cgauaugccggcau

SEQ ID NO: 605678 - RNA, 18 nt, Escherichia coli CFT073
cgaggcguuuuccagaua

SEQ ID NO: 605679 - RNA, 22 nt, Escherichia coli CFT073
cgaguccuuccuggcuggcgcu

SEQ ID NO: 605680 - RNA, 18 nt, Escherichia coli CFT073
cgagcggccaaagggagc

SEQ ID NO: 605681 - RNA, 13 nt, Escherichia coli CFT073
cgagcgccagcga

SEQ ID NO: 605682 - RNA, 11 nt, Escherichia coli CFT073
cgagcgaucca

SEQ ID NO: 605683 - RNA, 18 nt, Escherichia coli CFT073
cgagcgaauaaaccacac

SEQ ID NO: 605684 - RNA, 20 nt, Escherichia coli CFT073
cgagcgaccaauccgacuua

SEQ ID NO: 605685 - RNA, 18 nt, Escherichia coli CFT073
cgagccgucgcuaucgau

SEQ ID NO: 605686 - RNA, 14 nt, Escherichia coli CFT073
cgagccgccgcauu

SEQ ID NO: 605687 - RNA, 12 nt, Escherichia coli CFT073
aacaacaccggu

SEQ ID NO: 605688 - RNA, 13 nt, Escherichia coli CFT073
aacaaccgccaug

SEQ ID NO: 605689 - RNA, 20 nt, Escherichia coli CFT073
aacaaccugcauuugcgcag

SEQ ID NO: 605690 - RNA, 21 nt, Escherichia coli CFT073
aacaaacggcgguaaaaggga

SEQ ID NO: 605691 - RNA, 16 nt, Escherichia coli CFT073
aacaaacucauuaauc

SEQ ID NO: 605692 - RNA, 21 nt, Escherichia coli CFT073
aacaaacuuaugcugcgccag

SEQ ID NO: 605693 - RNA, 21 nt, Escherichia coli CFT073
aacaagaugugguuagcugga

SEQ ID NO: 605694 - RNA, 17 nt, Escherichia coli CFT073
aacaacugcgcacgagu

SEQ ID NO: 605695 - RNA, 18 nt, Escherichia coli CFT073
cgacaagaauauugcuau

SEQ ID NO: 605696 - RNA, 20 nt, Escherichia coli CFT073
cgacaacguuuucaacaauc

SEQ ID NO: 605697 - RNA, 19 nt, Escherichia coli CFT073
cgacaagcucauuucccaa

SEQ ID NO: 605698 - RNA, 20 nt, Escherichia coli CFT073
cgacaagcucucuucaucgu

SEQ ID NO: 605699 - RNA, 14 nt, Escherichia coli CFT073
cgaauuauucagag

SEQ ID NO: 605700 - RNA, 19 nt, Escherichia coli CFT073
cgaauugagaugacgccac

SEQ ID NO: 605701 - RNA, 15 nt, Escherichia coli CFT073
cgaauugcagaacgc

SEQ ID NO: 605702 - RNA, 19 nt, Escherichia coli CFT073
cgacaauccagucagcggu

SEQ ID NO: 605703 - RNA, 21 nt, Escherichia coli CFT073
cgacaauccagucagcgguuu

SEQ ID NO: 605704 - RNA, 21 nt, Escherichia coli CFT073
cgacaauaaaacguugcccgc

SEQ ID NO: 605705 - RNA, 20 nt, Escherichia coli CFT073
cgacaauaccgguuaugaca

SEQ ID NO: 605706 - RNA, 18 nt, Escherichia coli CFT073
cgacaaucgcccccauca

SEQ ID NO: 605707 - RNA, 24 nt, Escherichia coli CFT073
cgacaaugugaaaacccugcgcau

SEQ ID NO: 605708 - RNA, 18 nt, Escherichia coli CFT073
cgacagcaaauugcgcca

SEQ ID NO: 605709 - RNA, 14 nt, Escherichia coli CFT073
cgacacugugccgg

SEQ ID NO: 605710 - RNA, 15 nt, Escherichia coli CFT073
cgacacgcaucacgc

SEQ ID NO: 605711 - RNA, 14 nt, Escherichia coli CFT073
cgacagccagccca

SEQ ID NO: 605712 - RNA, 11 nt, Escherichia coli CFT073
cgacagccauc

SEQ ID NO: 605713 - RNA, 15 nt, Escherichia coli CFT073
cgacaguaccagcag

SEQ ID NO: 605714 - RNA, 14 nt, Escherichia coli CFT073
cgacaguaucguga

SEQ ID NO: 605715 - RNA, 16 nt, Escherichia coli CFT073
cgaagcuugcgacaua

SEQ ID NO: 605716 - RNA, 20 nt, Escherichia coli CFT073
cgaagcggcugcgccugugg

SEQ ID NO: 605717 - RNA, 15 nt, Escherichia coli CFT073
cgaaggccagcacca

SEQ ID NO: 605718 - RNA, 17 nt, Escherichia coli CFT073
cgaaugcgucgugauaa

SEQ ID NO: 605719 - RNA, 14 nt, Escherichia coli CFT073
cgaauuaacaccac

SEQ ID NO: 605720 - RNA, 19 nt, Escherichia coli CFT073
cgaauccgcggaugauucc

SEQ ID NO: 605721 - RNA, 17 nt, Escherichia coli CFT073
cgaauccggcagcgaac

SEQ ID NO: 605722 - RNA, 19 nt, Escherichia coli CFT073
cgaaucccgcaacuugcga

SEQ ID NO: 605723 - RNA, 23 nt, Escherichia coli CFT073
ccuguaucaugcaguaccagaua

SEQ ID NO: 605724 - RNA, 22 nt, Escherichia coli CFT073
ccugucaguucguuuuacgcac

SEQ ID NO: 605725 - RNA, 23 nt, Escherichia coli CFT073
cgaacgugaucgccccggaagcc

SEQ ID NO: 605726 - RNA, 20 nt, Escherichia coli CFT073
ccuguaccagcggcuuccag

SEQ ID NO: 605727 - RNA, 22 nt, Escherichia coli CFT073
ccuguaaugccuuuuccagcgc

SEQ ID NO: 605728 - RNA, 19 nt, Escherichia coli CFT073
ccuguaaugucaucucugg

SEQ ID NO: 605729 - RNA, 15 nt, Escherichia coli CFT073
ccuguacaagcaacu

SEQ ID NO: 605730 - RNA, 20 nt, Escherichia coli CFT073
ccugguuuugccaugcaaua

SEQ ID NO: 605731 - RNA, 21 nt, Escherichia coli CFT073
ccuguaaagagugugaauauu

SEQ ID NO: 605732 - RNA, 15 nt, Escherichia coli CFT073
cgaacuaaccgcacu

SEQ ID NO: 605733 - RNA, 24 nt, Escherichia coli CFT073
cgaacuaaccgcacucagccagcc

SEQ ID NO: 605734 - RNA, 22 nt, Escherichia coli CFT073
cgaagaaacgaccuccaucgca

SEQ ID NO: 605735 - RNA, 17 nt, Escherichia coli CFT073
cgaagagagcgccagua

SEQ ID NO: 605736 - RNA, 15 nt, Escherichia coli CFT073
cgaacuuuacugccu

SEQ ID NO: 605737 - RNA, 14 nt, Escherichia coli CFT073
cgacaguugcugcg

SEQ ID NO: 605738 - RNA, 17 nt, Escherichia coli CFT073
cgaccagcaccgccagc

SEQ ID NO: 605739 - RNA, 18 nt, Escherichia coli CFT073
cgaccagcaccgccagca

SEQ ID NO: 605740 - RNA, 12 nt, Escherichia coli CFT073
cgaccagcgcaa

SEQ ID NO: 605741 - RNA, 16 nt, Escherichia coli CFT073
cgaccaggccaucagc

SEQ ID NO: 605742 - RNA, 19 nt, Escherichia coli CFT073
cgaccaggccaucagcagc

SEQ ID NO: 605743 - RNA, 23 nt, Escherichia coli CFT073
cgaccaucaaccuucacaaucug

SEQ ID NO: 605744 - RNA, 21 nt, Escherichia coli CFT073
cgaccgguccacuuccugcgc

SEQ ID NO: 605745 - RNA, 16 nt, Escherichia coli CFT073
cgaccgucgguuucgc

SEQ ID NO: 605746 - RNA, 16 nt, Escherichia coli CFT073
cgaccgugcgccagca

SEQ ID NO: 605747 - RNA, 20 nt, Escherichia coli CFT073
cgaccuacaaaaucaugcaa

SEQ ID NO: 605748 - RNA, 17 nt, Escherichia coli CFT073
cgaccuacaaucaacgg

SEQ ID NO: 605749 - RNA, 21 nt, Escherichia coli CFT073
cgaccuacacgcccgcgaagc

SEQ ID NO: 605750 - RNA, 17 nt, Escherichia coli CFT073
cgaccgggagauuugca

SEQ ID NO: 605751 - RNA, 15 nt, Escherichia coli CFT073
cgaccgagcugguga

SEQ ID NO: 605752 - RNA, 19 nt, Escherichia coli CFT073
cgaccgaagccuuuaccgc

SEQ ID NO: 605753 - RNA, 21 nt, Escherichia coli CFT073
cgacgaggcgcuggcgcaugu

SEQ ID NO: 605754 - RNA, 13 nt, Escherichia coli CFT073
cgacgcgcuggca

SEQ ID NO: 605755 - RNA, 15 nt, Escherichia coli CFT073
cgacgcgcuggcaaa

SEQ ID NO: 605756 - RNA, 15 nt, Escherichia coli CFT073
cgacgcgacauccag

SEQ ID NO: 605757 - RNA, 22 nt, Escherichia coli CFT073
aaaugaagaaaaaccguauuca

SEQ ID NO: 605758 - RNA, 22 nt, Escherichia coli CFT073
aaaugaauaacuuccuguaacc

SEQ ID NO: 605759 - RNA, 18 nt, Escherichia coli CFT073
cccguugcuucgccgcau

SEQ ID NO: 605760 - RNA, 21 nt, Escherichia coli CFT073
cccguuuucuccagcgccgcc

SEQ ID NO: 605761 - RNA, 20 nt, Escherichia coli CFT073
cccuaaagcacccagcaauc

SEQ ID NO: 605762 - RNA, 17 nt, Escherichia coli CFT073
cccuaacagggcgcugu

SEQ ID NO: 605763 - RNA, 23 nt, Escherichia coli CFT073
cccguauccaccgacacuacaaa

SEQ ID NO: 605764 - RNA, 22 nt, Escherichia coli CFT073
aaaucucuugcuggcauuacaa

SEQ ID NO: 605765 - RNA, 18 nt, Escherichia coli CFT073
cccggcaagugucgccug

SEQ ID NO: 605766 - RNA, 18 nt, Escherichia coli CFT073
cccggauuuuucagcgcc

SEQ ID NO: 605767 - RNA, 20 nt, Escherichia coli CFT073
cccggauuuuuuugcaguug

SEQ ID NO: 605768 - RNA, 16 nt, Escherichia coli CFT073
cccggcaaacucuacc

SEQ ID NO: 605769 - RNA, 17 nt, Escherichia coli CFT073
cccggcaaccgcaacga

SEQ ID NO: 605770 - RNA, 13 nt, Escherichia coli CFT073
cccggugcgcaga

SEQ ID NO: 605771 - RNA, 18 nt, Escherichia coli CFT073
cccuggcgagcagcaaua

SEQ ID NO: 605772 - RNA, 22 nt, Escherichia coli CFT073
cccuucugccgcaauucgcccu

SEQ ID NO: 605773 - RNA, 14 nt, Escherichia coli CFT073
cccuucccggugcg

SEQ ID NO: 605774 - RNA, 11 nt, Escherichia coli CFT073
cccuuucugcu

SEQ ID NO: 605775 - RNA, 20 nt, Escherichia coli CFT073
cccuuucuuauuuuucugca

SEQ ID NO: 605776 - RNA, 16 nt, Escherichia coli CFT073
cccuuuuucauccccg

SEQ ID NO: 605777 - RNA, 13 nt, Escherichia coli CFT073
cccuugcgcaaug

SEQ ID NO: 605778 - RNA, 23 nt, Escherichia coli CFT073
cccuugauuaacgacacucucuu

SEQ ID NO: 605779 - RNA, 20 nt, Escherichia coli CFT073
cccugccgucugggcaaaau

SEQ ID NO: 605780 - RNA, 16 nt, Escherichia coli CFT073
ccgaagaguaaccaaa

SEQ ID NO: 605781 - RNA, 19 nt, Escherichia coli CFT073
ccgaacgcugacaaacugc

SEQ ID NO: 605782 - RNA, 15 nt, Escherichia coli CFT073
ccgaacagucgcuga

SEQ ID NO: 605783 - RNA, 15 nt, Escherichia coli CFT073
ccgaacaugccgcca

SEQ ID NO: 605784 - RNA, 16 nt, Escherichia coli CFT073
ccgaauagaacauaau

SEQ ID NO: 605785 - RNA, 15 nt, Escherichia coli CFT073
ccgaauaacgcgcag

SEQ ID NO: 605786 - RNA, 22 nt, Escherichia coli CFT073
ccgacaaauguguucagcgaca

SEQ ID NO: 605787 - RNA, 12 nt, Escherichia coli CFT073
ccgaaugcgccu

SEQ ID NO: 605788 - RNA, 13 nt, Escherichia coli CFT073
ccgaauucugcgg

SEQ ID NO: 605789 - RNA, 17 nt, Escherichia coli CFT073
ccgacaaucucuucgag

SEQ ID NO: 605790 - RNA, 13 nt, Escherichia coli CFT073
ccgacaauuccgc

SEQ ID NO: 605791 - RNA, 16 nt, Escherichia coli CFT073
ccgacaucugccaguu

SEQ ID NO: 605792 - RNA, 19 nt, Escherichia coli CFT073
ccgacauuaagacgcagau

SEQ ID NO: 605793 - RNA, 21 nt, Escherichia coli CFT073
ccgacauuaucaccgacaaac

SEQ ID NO: 605794 - RNA, 12 nt, Escherichia coli CFT073
ccgacaucacgg

SEQ ID NO: 605795 - RNA, 19 nt, Escherichia coli CFT073
ccgacaucgacauacuuga

SEQ ID NO: 605796 - RNA, 20 nt, Escherichia coli CFT073
ccgacgacgaccagcggcaa

SEQ ID NO: 605797 - RNA, 16 nt, Escherichia coli CFT073
ccgaccaucgccagcu

SEQ ID NO: 605798 - RNA, 17 nt, Escherichia coli CFT073
ccgacugcgccaauacc

SEQ ID NO: 605799 - RNA, 15 nt, Escherichia coli CFT073
ccgacuuucuuuuug

SEQ ID NO: 605800 - RNA, 17 nt, Escherichia coli CFT073
ccgacucaagcauccag

SEQ ID NO: 605801 - RNA, 14 nt, Escherichia coli CFT073
ccgacguuacgcgc

SEQ ID NO: 605802 - RNA, 11 nt, Escherichia coli CFT073
ccgagcaaacc

SEQ ID NO: 605803 - RNA, 13 nt, Escherichia coli CFT073
ccgagaaugacga

SEQ ID NO: 605804 - RNA, 22 nt, Escherichia coli CFT073
ccgacgcuccugaucaagcugg

SEQ ID NO: 605805 - RNA, 14 nt, Escherichia coli CFT073
ccgacgcgccaggu

SEQ ID NO: 605806 - RNA, 18 nt, Escherichia coli CFT073
ccgacgcgaagcacacau

SEQ ID NO: 605807 - RNA, 24 nt, Escherichia coli CFT073
ccgacgauguuagcggcgacaaua

SEQ ID NO: 605808 - RNA, 18 nt, Escherichia coli CFT073
ccgacgaggcgcuggcgc

SEQ ID NO: 605809 - RNA, 21 nt, Escherichia coli CFT073
ccgacgauauuccgacggcga

SEQ ID NO: 605810 - RNA, 13 nt, Escherichia coli CFT073
cccaaagacgacg

SEQ ID NO: 605811 - RNA, 14 nt, Escherichia coli CFT073
ccauuuuuuugcau

SEQ ID NO: 605812 - RNA, 18 nt, Escherichia coli CFT073
cccaaaaugucggaugcg

SEQ ID NO: 605813 - RNA, 16 nt, Escherichia coli CFT073
cccaacaguuuguuga

SEQ ID NO: 605814 - RNA, 12 nt, Escherichia coli CFT073
cccaaccagcag

SEQ ID NO: 605815 - RNA, 20 nt, Escherichia coli CFT073
ccauuuaaacucaccgcucu

SEQ ID NO: 605816 - RNA, 14 nt, Escherichia coli CFT073
ccauuuugcuggcc

SEQ ID NO: 605817 - RNA, 20 nt, Escherichia coli CFT073
ccauuugccucaguggcugc

SEQ ID NO: 605818 - RNA, 21 nt, Escherichia coli CFT073
cccacauauguuuaaccggca

SEQ ID NO: 605819 - RNA, 11 nt, Escherichia coli CFT073
cccacaucaca

SEQ ID NO: 605820 - RNA, 15 nt, Escherichia coli CFT073
cccacauguugcgcu

SEQ ID NO: 605821 - RNA, 22 nt, Escherichia coli CFT073
cccaacugaaagaacaccagca

SEQ ID NO: 605822 - RNA, 15 nt, Escherichia coli CFT073
cccaccacaaaccag

SEQ ID NO: 605823 - RNA, 14 nt, Escherichia coli CFT073
cccaacgcgcaaug

SEQ ID NO: 605824 - RNA, 21 nt, Escherichia coli CFT073
cccaacguauguacaagcuga

SEQ ID NO: 605825 - RNA, 23 nt, Escherichia coli CFT073
cccagaagggguaaugccaguca

SEQ ID NO: 605826 - RNA, 15 nt, Escherichia coli CFT073
cccagaacgccgaau

SEQ ID NO: 605827 - RNA, 19 nt, Escherichia coli CFT073
cccacgcggcaacggcuuc

SEQ ID NO: 605828 - RNA, 10 nt, Escherichia coli CFT073
cccaccagcg

SEQ ID NO: 605829 - RNA, 23 nt, Escherichia coli CFT073
cccaccagcgacauacucagcgc

SEQ ID NO: 605830 - RNA, 15 nt, Escherichia coli CFT073
cccaccccaauguuu

SEQ ID NO: 605831 - RNA, 18 nt, Escherichia coli CFT073
ccauuaccccugacgcuu

SEQ ID NO: 605832 - RNA, 21 nt, Escherichia coli CFT073
ccauuccccagccgaucagcg

SEQ ID NO: 605833 - RNA, 16 nt, Escherichia coli CFT073
ccauuaaacaccagua

SEQ ID NO: 605834 - RNA, 17 nt, Escherichia coli CFT073
ccauuaaacaccaguac

SEQ ID NO: 605835 - RNA, 15 nt, Escherichia coli CFT073
ccauuaaccagccac

SEQ ID NO: 605836 - RNA, 20 nt, Escherichia coli CFT073
ccauuacacugaaaaaaagu

SEQ ID NO: 605837 - RNA, 21 nt, Escherichia coli CFT073
aaaucgagaagacaauccccg

SEQ ID NO: 605838 - RNA, 19 nt, Escherichia coli CFT073
aaaucgcacguugccagca

SEQ ID NO: 605839 - RNA, 12 nt, Escherichia coli CFT073
aaaucgccauuc

SEQ ID NO: 605840 - RNA, 22 nt, Escherichia coli CFT073
ccauugcgcaaccgcccggccu

SEQ ID NO: 605841 - RNA, 22 nt, Escherichia coli CFT073
ccauucgaugguuuuauagcgg

SEQ ID NO: 605842 - RNA, 21 nt, Escherichia coli CFT073
ccauucuugucagaugcggcg

SEQ ID NO: 605843 - RNA, 21 nt, Escherichia coli CFT073
ccauugacguucccuucuugc

SEQ ID NO: 605844 - RNA, 13 nt, Escherichia coli CFT073
ccauugagcuuuc

SEQ ID NO: 605845 - RNA, 16 nt, Escherichia coli CFT073
ccaugcggcgaggaau

SEQ ID NO: 605846 - RNA, 17 nt, Escherichia coli CFT073
ccaugcgauggcggcag

SEQ ID NO: 605847 - RNA, 14 nt, Escherichia coli CFT073
ccaugcgcucgacg

SEQ ID NO: 605848 - RNA, 22 nt, Escherichia coli CFT073
aaauccucuuuuaccaucagcg

SEQ ID NO: 605849 - RNA, 19 nt, Escherichia coli CFT073
ccaugcuaauaaucagcac

SEQ ID NO: 605850 - RNA, 15 nt, Escherichia coli CFT073
ccaugcuaugcgcca

SEQ ID NO: 605851 - RNA, 20 nt, Escherichia coli CFT073
ccaugcgaaugccaauuucc

SEQ ID NO: 605852 - RNA, 20 nt, Escherichia coli CFT073
ccaguccuacacacgccagu

SEQ ID NO: 605853 - RNA, 23 nt, Escherichia coli CFT073
ccaguccgucguucaacaagcca

SEQ ID NO: 605854 - RNA, 17 nt, Escherichia coli CFT073
ccaguccggcaauguga

SEQ ID NO: 605855 - RNA, 16 nt, Escherichia coli CFT073
ccaguagaacaauuaa

SEQ ID NO: 605856 - RNA, 17 nt, Escherichia coli CFT073
ccaguacgggcagcgca

SEQ ID NO: 605857 - RNA, 14 nt, Escherichia coli CFT073
ccaguacgcgcccg

SEQ ID NO: 605858 - RNA, 19 nt, Escherichia coli CFT073
cccauucucggcgggcaac

SEQ ID NO: 605859 - RNA, 14 nt, Escherichia coli CFT073
cccauucugcgcug

SEQ ID NO: 605860 - RNA, 12 nt, Escherichia coli CFT073
cccaucgccaga

SEQ ID NO: 605861 - RNA, 15 nt, Escherichia coli CFT073
cccaucgugauaaac

SEQ ID NO: 605862 - RNA, 23 nt, Escherichia coli CFT073
cccauacagcgucgguuccugau

SEQ ID NO: 605863 - RNA, 16 nt, Escherichia coli CFT073
cccauaaaaaaacccg

SEQ ID NO: 605864 - RNA, 15 nt, Escherichia coli CFT073
cccaguuucuucagg

SEQ ID NO: 605865 - RNA, 14 nt, Escherichia coli CFT073
cccaguuuuccauc

SEQ ID NO: 605866 - RNA, 23 nt, Escherichia coli CFT073
cccaguuuugcgcguuggcaaga

SEQ ID NO: 605867 - RNA, 24 nt, Escherichia coli CFT073
cccaucagcgguacucgcgcaguu

SEQ ID NO: 605868 - RNA, 16 nt, Escherichia coli CFT073
cccagugcagcaucgc

SEQ ID NO: 605869 - RNA, 17 nt, Escherichia coli CFT073
cccaguccgcucgccgc

SEQ ID NO: 605870 - RNA, 13 nt, Escherichia coli CFT073
cccaguaccgcca

SEQ ID NO: 605871 - RNA, 22 nt, Escherichia coli CFT073
cccagucaagaaaacuuaucuu

SEQ ID NO: 605872 - RNA, 17 nt, Escherichia coli CFT073
cccagggaucaccugcg

SEQ ID NO: 605873 - RNA, 16 nt, Escherichia coli CFT073
cccagcguuugcugcu

SEQ ID NO: 605874 - RNA, 16 nt, Escherichia coli CFT073
cccagcgucagcagca

SEQ ID NO: 605875 - RNA, 18 nt, Escherichia coli CFT073
cccagcgucagcagcaau

SEQ ID NO: 605876 - RNA, 22 nt, Escherichia coli CFT073
cccagcggaaauuaccgcacca

SEQ ID NO: 605877 - RNA, 17 nt, Escherichia coli CFT073
cccagcaggaucaauac

SEQ ID NO: 605878 - RNA, 16 nt, Escherichia coli CFT073
cccagacuuuucagau

SEQ ID NO: 605879 - RNA, 14 nt, Escherichia coli CFT073
cccauuuucagccg

SEQ ID NO: 605880 - RNA, 22 nt, Escherichia coli CFT073
ccccaaccguucauaggcaaug

SEQ ID NO: 605881 - RNA, 20 nt, Escherichia coli CFT073
ccccaauacgauuaacgcca

SEQ ID NO: 605882 - RNA, 12 nt, Escherichia coli CFT073
ccccagcgcaag

SEQ ID NO: 605883 - RNA, 13 nt, Escherichia coli CFT073
ccccaugcuggcu

SEQ ID NO: 605884 - RNA, 13 nt, Escherichia coli CFT073
ccccagcgcaaua

SEQ ID NO: 605885 - RNA, 17 nt, Escherichia coli CFT073
ccccagcgucagcagca

SEQ ID NO: 605886 - RNA, 16 nt, Escherichia coli CFT073
ccccggauaacguuua

SEQ ID NO: 605887 - RNA, 19 nt, Escherichia coli CFT073
ccccgcuuuuuucagcgcc

SEQ ID NO: 605888 - RNA, 21 nt, Escherichia coli CFT073
ccccgccagcguugccagucc

SEQ ID NO: 605889 - RNA, 14 nt, Escherichia coli CFT073
cccgaccacuucau

SEQ ID NO: 605890 - RNA, 20 nt, Escherichia coli CFT073
ccccuuaauaccggcaucca

SEQ ID NO: 605891 - RNA, 23 nt, Escherichia coli CFT073
ccccuucugccgcaauucgcccu

SEQ ID NO: 605892 - RNA, 15 nt, Escherichia coli CFT073
ccccggucagcagca

SEQ ID NO: 605893 - RNA, 21 nt, Escherichia coli CFT073
ccccggucagcagcaccaccg

SEQ ID NO: 605894 - RNA, 21 nt, Escherichia coli CFT073
ccccgguucgcuuuuauuucu

SEQ ID NO: 605895 - RNA, 17 nt, Escherichia coli CFT073
cccgaugaugaucggcg

SEQ ID NO: 605896 - RNA, 13 nt, Escherichia coli CFT073
cccgcagccagca

SEQ ID NO: 605897 - RNA, 21 nt, Escherichia coli CFT073
cccgauggaacaaaauuuuca

SEQ ID NO: 605898 - RNA, 16 nt, Escherichia coli CFT073
cccgcccccgccagcg

SEQ ID NO: 605899 - RNA, 20 nt, Escherichia coli CFT073
cccggaugcgcguacuuacc

SEQ ID NO: 605900 - RNA, 14 nt, Escherichia coli CFT073
cccggauggcaaca

SEQ ID NO: 605901 - RNA, 16 nt, Escherichia coli CFT073
cccggaagccaccacg

SEQ ID NO: 605902 - RNA, 17 nt, Escherichia coli CFT073
cccgcuuuucgccaguu

SEQ ID NO: 605903 - RNA, 20 nt, Escherichia coli CFT073
cccgcucguuuuggugcgua

SEQ ID NO: 605904 - RNA, 12 nt, Escherichia coli CFT073
cccgcgccagcg

SEQ ID NO: 605905 - RNA, 13 nt, Escherichia coli CFT073
ccaggcuccagau

SEQ ID NO: 605906 - RNA, 15 nt, Escherichia coli CFT073
ccaggcacaccagca

SEQ ID NO: 605907 - RNA, 16 nt, Escherichia coli CFT073
ccaggcacaccagcaa

SEQ ID NO: 605908 - RNA, 12 nt, Escherichia coli CFT073
ccaggcauagaa

SEQ ID NO: 605909 - RNA, 16 nt, Escherichia coli CFT073
ccaguacaacgccgau

SEQ ID NO: 605910 - RNA, 14 nt, Escherichia coli CFT073
ccaguaccagcagc

SEQ ID NO: 605911 - RNA, 14 nt, Escherichia coli CFT073
ccaguaccgccagu

SEQ ID NO: 605912 - RNA, 12 nt, Escherichia coli CFT073
ccaguaccugca

SEQ ID NO: 605913 - RNA, 20 nt, Escherichia coli CFT073
ccagguaucguuacgccagu

SEQ ID NO: 605914 - RNA, 13 nt, Escherichia coli CFT073
ccaggucaaugca

SEQ ID NO: 605915 - RNA, 16 nt, Escherichia coli CFT073
ccagggcgaauuuccg

SEQ ID NO: 605916 - RNA, 16 nt, Escherichia coli CFT073
ccaggaagcccgccca

SEQ ID NO: 605917 - RNA, 22 nt, Escherichia coli CFT073
ccaggaaccugugacagcagcg

SEQ ID NO: 605918 - RNA, 14 nt, Escherichia coli CFT073
ccaggaacagugaa

SEQ ID NO: 605919 - RNA, 17 nt, Escherichia coli CFT073
ccaggaacaacgacagg

SEQ ID NO: 605920 - RNA, 18 nt, Escherichia coli CFT073
ccagcuuaacauccccau

SEQ ID NO: 605921 - RNA, 20 nt, Escherichia coli CFT073
ccaggcaaguagcgccagac

SEQ ID NO: 605922 - RNA, 21 nt, Escherichia coli CFT073
ccaggcaaugacaucgcccuc

SEQ ID NO: 605923 - RNA, 15 nt, Escherichia coli CFT073
ccaggcaaaccagua

SEQ ID NO: 605924 - RNA, 19 nt, Escherichia coli CFT073
ccaggaugauauucaucgc

SEQ ID NO: 605925 - RNA, 15 nt, Escherichia coli CFT073
ccaggagggguuuuu

SEQ ID NO: 605926 - RNA, 21 nt, Escherichia coli CFT073
ccaggagucuuucagacugag

SEQ ID NO: 605927 - RNA, 22 nt, Escherichia coli CFT073
ccagcuguaccagcaacugaug

SEQ ID NO: 605928 - RNA, 11 nt, Escherichia coli CFT073
ccagcugccga

SEQ ID NO: 605929 - RNA, 18 nt, Escherichia coli CFT073
ccagcucuuccucgcucu

SEQ ID NO: 605930 - RNA, 19 nt, Escherichia coli CFT073
ccagcguuuaucaauaucc

SEQ ID NO: 605931 - RNA, 16 nt, Escherichia coli CFT073
ccagcguuuccagcac

SEQ ID NO: 605932 - RNA, 17 nt, Escherichia coli CFT073
ccagcguucccacguuc

SEQ ID NO: 605933 - RNA, 17 nt, Escherichia coli CFT073
ccagcguuugcggcgcu

SEQ ID NO: 605934 - RNA, 22 nt, Escherichia coli CFT073
ccagcguuugcugcuuaucgcg

SEQ ID NO: 605935 - RNA, 22 nt, Escherichia coli CFT073
ccagcgucguauccagcguuau

SEQ ID NO: 605936 - RNA, 22 nt, Escherichia coli CFT073
aaaucaucugccgguuccagcu

SEQ ID NO: 605937 - RNA, 22 nt, Escherichia coli CFT073
aaaucagacuuugaauaaagcc

SEQ ID NO: 605938 - RNA, 21 nt, Escherichia coli CFT073
ccagcguuacccagacaaaau

SEQ ID NO: 605939 - RNA, 19 nt, Escherichia coli CFT073
ccagcggugaaaacggcaa

SEQ ID NO: 605940 - RNA, 20 nt, Escherichia coli CFT073
ccagcggugaaaacggcaau

SEQ ID NO: 605941 - RNA, 21 nt, Escherichia coli CFT073
ccagcguaccaugauccugca

SEQ ID NO: 605942 - RNA, 11 nt, Escherichia coli CFT073
ccagcgucagu

SEQ ID NO: 605943 - RNA, 17 nt, Escherichia coli CFT073
ccagcgguaaucauggc

SEQ ID NO: 605944 - RNA, 12 nt, Escherichia coli CFT073
ccagcggcuuuu

SEQ ID NO: 605945 - RNA, 19 nt, Escherichia coli CFT073
ccagcgggaucgccguuaa

SEQ ID NO: 605946 - RNA, 14 nt, Escherichia coli CFT073
ccagcgggcgucaa

SEQ ID NO: 605947 - RNA, 12 nt, Escherichia coli CFT073
ccagcgccgcaa

SEQ ID NO: 605948 - RNA, 16 nt, Escherichia coli CFT073
ccagcggcaccgagga

SEQ ID NO: 605949 - RNA, 12 nt, Escherichia coli CFT073
ccagcggcagcc

SEQ ID NO: 605950 - RNA, 21 nt, Escherichia coli CFT073
ccagcggaugacccagcgcga

SEQ ID NO: 605951 - RNA, 20 nt, Escherichia coli CFT073
ccagccaacaaucgcugcgg

SEQ ID NO: 605952 - RNA, 23 nt, Escherichia coli CFT073
ccagccaaauaaaaucccgguga

SEQ ID NO: 605953 - RNA, 14 nt, Escherichia coli CFT073
ccagcaucgcauca

SEQ ID NO: 605954 - RNA, 14 nt, Escherichia coli CFT073
ccagcaucgcaucc

SEQ ID NO: 605955 - RNA, 17 nt, Escherichia coli CFT073
ccagcccaucgcuagau

SEQ ID NO: 605956 - RNA, 15 nt, Escherichia coli CFT073
ccagccccaccagca

SEQ ID NO: 605957 - RNA, 16 nt, Escherichia coli CFT073
ccagccccaccagcaa

SEQ ID NO: 605958 - RNA, 15 nt, Escherichia coli CFT073
ccagccaugucgcca

SEQ ID NO: 605959 - RNA, 23 nt, Escherichia coli CFT073
ccagccaguagaacaauuaauac

SEQ ID NO: 605960 - RNA, 15 nt, Escherichia coli CFT073
ccagccacugcgcca

SEQ ID NO: 605961 - RNA, 13 nt, Escherichia coli CFT073
ccagcaucgacca

SEQ ID NO: 605962 - RNA, 19 nt, Escherichia coli CFT073
ccagcaucacaucaaaucc

SEQ ID NO: 605963 - RNA, 22 nt, Escherichia coli CFT073
ccagcaucagauggggauggcg

SEQ ID NO: 605964 - RNA, 15 nt, Escherichia coli CFT073
ccagcaucaacaaca

SEQ ID NO: 605965 - RNA, 17 nt, Escherichia coli CFT073
ccagcaucaacaacaau

SEQ ID NO: 605966 - RNA, 22 nt, Escherichia coli CFT073
ccagcaguucgcccgcuucauc

SEQ ID NO: 605967 - RNA, 20 nt, Escherichia coli CFT073
ccagcaggucgauaauuuuc

SEQ ID NO: 605968 - RNA, 12 nt, Escherichia coli CFT073
ccagcaccugaa

SEQ ID NO: 605969 - RNA, 23 nt, Escherichia coli CFT073
ccagcaccugaauccgcgauuau

SEQ ID NO: 605970 - RNA, 22 nt, Escherichia coli CFT073
ccagcgcaacuugugcucgcgu

SEQ ID NO: 605971 - RNA, 20 nt, Escherichia coli CFT073
ccagcgagaagucggcuuuu

SEQ ID NO: 605972 - RNA, 14 nt, Escherichia coli CFT073
ccagcgcaccugaa

SEQ ID NO: 605973 - RNA, 14 nt, Escherichia coli CFT073
ccagccgaucagcg

SEQ ID NO: 605974 - RNA, 17 nt, Escherichia coli CFT073
ccagccgaucagcggcg

SEQ ID NO: 605975 - RNA, 18 nt, Escherichia coli CFT073
aaagguaaggauaaaaaa

SEQ ID NO: 605976 - RNA, 15 nt, Escherichia coli CFT073
aaagguauuauugau

SEQ ID NO: 605977 - RNA, 13 nt, Escherichia coli CFT073
aaaggucaauucc

SEQ ID NO: 605978 - RNA, 22 nt, Escherichia coli CFT073
aaaggucaucacaucccagcag

SEQ ID NO: 605979 - RNA, 23 nt, Escherichia coli CFT073
aaaggcguuaugcugcggcaucg

SEQ ID NO: 605980 - RNA, 14 nt, Escherichia coli CFT073
aaaggugacuggca

SEQ ID NO: 605981 - RNA, 15 nt, Escherichia coli CFT073
aaaggugagucgcaa

SEQ ID NO: 605982 - RNA, 18 nt, Escherichia coli CFT073
aaaggugauuuauuucuc

SEQ ID NO: 605983 - RNA, 17 nt, Escherichia coli CFT073
aaagguuaaaccgccag

SEQ ID NO: 605984 - RNA, 17 nt, Escherichia coli CFT073
ccaccggaauacauagc

SEQ ID NO: 605985 - RNA, 20 nt, Escherichia coli CFT073
aaaguacacauugccauugu

SEQ ID NO: 605986 - RNA, 15 nt, Escherichia coli CFT073
ccacgaaucagcacc

SEQ ID NO: 605987 - RNA, 12 nt, Escherichia coli CFT073
aaagucaccagu

SEQ ID NO: 605988 - RNA, 17 nt, Escherichia coli CFT073
aaagucccuucccagcc

SEQ ID NO: 605989 - RNA, 21 nt, Escherichia coli CFT073
aaaguaaccuuugaacagcca

SEQ ID NO: 605990 - RNA, 18 nt, Escherichia coli CFT073
aaagugaaugucggcggc

SEQ ID NO: 605991 - RNA, 14 nt, Escherichia coli CFT073
ccacgccaccagcg

SEQ ID NO: 605992 - RNA, 15 nt, Escherichia coli CFT073
ccacgccacgcugcc

SEQ ID NO: 605993 - RNA, 20 nt, Escherichia coli CFT073
ccacgccagagauaacccaa

SEQ ID NO: 605994 - RNA, 16 nt, Escherichia coli CFT073
ccacgcccagcgacca

SEQ ID NO: 605995 - RNA, 18 nt, Escherichia coli CFT073
ccacgcacagaacaaaau

SEQ ID NO: 605996 - RNA, 16 nt, Escherichia coli CFT073
ccacgcaccaccagcg

SEQ ID NO: 605997 - RNA, 13 nt, Escherichia coli CFT073
aaaguucaaccuc

SEQ ID NO: 605998 - RNA, 21 nt, Escherichia coli CFT073
ccacgcuuugauccgccagau

SEQ ID NO: 605999 - RNA, 21 nt, Escherichia coli CFT073
ccacgcugcgcuugcugccag

SEQ ID NO: 606000 - RNA, 14 nt, Escherichia coli CFT073
ccacggcauuuccg

SEQ ID NO: 606001 - RNA, 14 nt, Escherichia coli CFT073
ccacuuacauuccg

SEQ ID NO: 606002 - RNA, 18 nt, Escherichia coli CFT073
ccacugcgacaccagcau

SEQ ID NO: 606003 - RNA, 21 nt, Escherichia coli CFT073
ccacugcgccgcucggugcgc

SEQ ID NO: 606004 - RNA, 17 nt, Escherichia coli CFT073
ccacuggauguugcauu

SEQ ID NO: 606005 - RNA, 19 nt, Escherichia coli CFT073
ccacuggcaacacuuuauc

SEQ ID NO: 606006 - RNA, 17 nt, Escherichia coli CFT073
aaauaacugaauaauac

SEQ ID NO: 606007 - RNA, 16 nt, Escherichia coli CFT073
ccacgguacgccagag

SEQ ID NO: 606008 - RNA, 16 nt, Escherichia coli CFT073
ccagacgcaacagaaa

SEQ ID NO: 606009 - RNA, 17 nt, Escherichia coli CFT073
ccagacgcgggcaaucg

SEQ ID NO: 606010 - RNA, 15 nt, Escherichia coli CFT073
ccagacgcgccgcca

SEQ ID NO: 606011 - RNA, 20 nt, Escherichia coli CFT073
ccagacggguaaacggcagg

SEQ ID NO: 606012 - RNA, 14 nt, Escherichia coli CFT073
ccagauccaauacc

SEQ ID NO: 606013 - RNA, 18 nt, Escherichia coli CFT073
ccagauccaauaccgcac

SEQ ID NO: 606014 - RNA, 15 nt, Escherichia coli CFT073
ccagacguccggcgc

SEQ ID NO: 606015 - RNA, 19 nt, Escherichia coli CFT073
ccagacguccggcgcugca

SEQ ID NO: 606016 - RNA, 15 nt, Escherichia coli CFT073
ccagacguuauugcc

SEQ ID NO: 606017 - RNA, 21 nt, Escherichia coli CFT073
ccagacguugauaaccacggc

SEQ ID NO: 606018 - RNA, 19 nt, Escherichia coli CFT073
ccagauccugccauuggca

SEQ ID NO: 606019 - RNA, 16 nt, Escherichia coli CFT073
ccagacucaccagcau

SEQ ID NO: 606020 - RNA, 17 nt, Escherichia coli CFT073
ccagaucugacgauuau

SEQ ID NO: 606021 - RNA, 17 nt, Escherichia coli CFT073
ccagcaacaacaacacg

SEQ ID NO: 606022 - RNA, 19 nt, Escherichia coli CFT073
ccagcaaaaucaccaucac

SEQ ID NO: 606023 - RNA, 23 nt, Escherichia coli CFT073
ccagcaaacgcacuuuuaacgcc

SEQ ID NO: 606024 - RNA, 19 nt, Escherichia coli CFT073
ccagauuccugcgucccua

SEQ ID NO: 606025 - RNA, 18 nt, Escherichia coli CFT073
ccagauucucauauaucc

SEQ ID NO: 606026 - RNA, 21 nt, Escherichia coli CFT073
ccagauuguacuuuccagcca

SEQ ID NO: 606027 - RNA, 13 nt, Escherichia coli CFT073
ccagaugcgggug

SEQ ID NO: 606028 - RNA, 22 nt, Escherichia coli CFT073
ccagaugcgacguuacaaccac

SEQ ID NO: 606029 - RNA, 22 nt, Escherichia coli CFT073
ccagauuaaucagcagauaucc

SEQ ID NO: 606030 - RNA, 11 nt, Escherichia coli CFT073
ccagcaccagu

SEQ ID NO: 606031 - RNA, 16 nt, Escherichia coli CFT073
ccagcaccagcaacaa

SEQ ID NO: 606032 - RNA, 22 nt, Escherichia coli CFT073
aaagcuuuaauauccggugcau

SEQ ID NO: 606033 - RNA, 17 nt, Escherichia coli CFT073
aaaggauauucgucgca

SEQ ID NO: 606034 - RNA, 14 nt, Escherichia coli CFT073
aaagcuuuuuauua

SEQ ID NO: 606035 - RNA, 17 nt, Escherichia coli CFT073
aaaggcaacaucuguau

SEQ ID NO: 606036 - RNA, 17 nt, Escherichia coli CFT073
aaaggcagaaacggcuu

SEQ ID NO: 606037 - RNA, 16 nt, Escherichia coli CFT073
aaaggccagccaggca

SEQ ID NO: 606038 - RNA, 16 nt, Escherichia coli CFT073
aaagcuguacaucgcg

SEQ ID NO: 606039 - RNA, 18 nt, Escherichia coli CFT073
aaagcugcugcuuuuccc

SEQ ID NO: 606040 - RNA, 17 nt, Escherichia coli CFT073
aaagcguuucauuagcc

SEQ ID NO: 606041 - RNA, 24 nt, Escherichia coli CFT073
aaagcguucagugaucgccugcau

SEQ ID NO: 606042 - RNA, 15 nt, Escherichia coli CFT073
ccaccgcccagagaa

SEQ ID NO: 606043 - RNA, 21 nt, Escherichia coli CFT073
ccaccgccagauugcugcuga

SEQ ID NO: 606044 - RNA, 12 nt, Escherichia coli CFT073
ccacagaaacaa

SEQ ID NO: 606045 - RNA, 19 nt, Escherichia coli CFT073
ccacaccugccaccagcac

SEQ ID NO: 606046 - RNA, 20 nt, Escherichia coli CFT073
ccacagcaccccauagccag

SEQ ID NO: 606047 - RNA, 15 nt, Escherichia coli CFT073
ccaccaaaacagcga

SEQ ID NO: 606048 - RNA, 20 nt, Escherichia coli CFT073
ccaccaaauaaaaaaacgcc

SEQ ID NO: 606049 - RNA, 14 nt, Escherichia coli CFT073
ccaccacaccagac

SEQ ID NO: 606050 - RNA, 21 nt, Escherichia coli CFT073
ccaccacaaaagcggugauaa

SEQ ID NO: 606051 - RNA, 20 nt, Escherichia coli CFT073
ccaccauccccaccaaaaca

SEQ ID NO: 606052 - RNA, 14 nt, Escherichia coli CFT073
ccaccagugaauaa

SEQ ID NO: 606053 - RNA, 14 nt, Escherichia coli CFT073
ccaccagcgccauu

SEQ ID NO: 606054 - RNA, 23 nt, Escherichia coli CFT073
ccaaagucaucaauugcaauccg

SEQ ID NO: 606055 - RNA, 18 nt, Escherichia coli CFT073
caugccgucaauccagcc

SEQ ID NO: 606056 - RNA, 21 nt, Escherichia coli CFT073
ccaaauaaaaaaacgccagaa

SEQ ID NO: 606057 - RNA, 20 nt, Escherichia coli CFT073
ccaacagcagccacaccaau

SEQ ID NO: 606058 - RNA, 11 nt, Escherichia coli CFT073
ccaaccagcag

SEQ ID NO: 606059 - RNA, 20 nt, Escherichia coli CFT073
ccaaccaucaggcagaacac

SEQ ID NO: 606060 - RNA, 18 nt, Escherichia coli CFT073
ccaacagugccgaugccg

SEQ ID NO: 606061 - RNA, 15 nt, Escherichia coli CFT073
ccaaccacaacccag

SEQ ID NO: 606062 - RNA, 12 nt, Escherichia coli CFT073
ccaaccaccgga

SEQ ID NO: 606063 - RNA, 23 nt, Escherichia coli CFT073
ccaagagcaaauuuuccccagau

SEQ ID NO: 606064 - RNA, 18 nt, Escherichia coli CFT073
ccaagaagaacgccgguu

SEQ ID NO: 606065 - RNA, 16 nt, Escherichia coli CFT073
ccaagaaacaccagaa

SEQ ID NO: 606066 - RNA, 23 nt, Escherichia coli CFT073
ccaacgcuggcguggagcaacac

SEQ ID NO: 606067 - RNA, 22 nt, Escherichia coli CFT073
ccaacgcgcaauggaccagaac

SEQ ID NO: 606068 - RNA, 14 nt, Escherichia coli CFT073
ccaacgcagcaaca

SEQ ID NO: 606069 - RNA, 22 nt, Escherichia coli CFT073
aaagccugggucagcgccguau

SEQ ID NO: 606070 - RNA, 20 nt, Escherichia coli CFT073
aaagcgaaacagcgccccau

SEQ ID NO: 606071 - RNA, 19 nt, Escherichia coli CFT073
aaagcgccucaagcucgca

SEQ ID NO: 606072 - RNA, 19 nt, Escherichia coli CFT073
ccaaugcaggcaucgguga

SEQ ID NO: 606073 - RNA, 16 nt, Escherichia coli CFT073
ccacaaaccaccgaag

SEQ ID NO: 606074 - RNA, 13 nt, Escherichia coli CFT073
ccacaacagccag

SEQ ID NO: 606075 - RNA, 17 nt, Escherichia coli CFT073
ccacaagcccgccagac

SEQ ID NO: 606076 - RNA, 13 nt, Escherichia coli CFT073
ccacaaucaacgc

SEQ ID NO: 606077 - RNA, 18 nt, Escherichia coli CFT073
ccacaccuacgcccgcca

SEQ ID NO: 606078 - RNA, 20 nt, Escherichia coli CFT073
ccacaccuacgcccgccagu

SEQ ID NO: 606079 - RNA, 17 nt, Escherichia coli CFT073
ccaagaugggccagcac

SEQ ID NO: 606080 - RNA, 20 nt, Escherichia coli CFT073
ccaaggucggggucgcgagu

SEQ ID NO: 606081 - RNA, 15 nt, Escherichia coli CFT073
ccaaggucuccgccc

SEQ ID NO: 606082 - RNA, 13 nt, Escherichia coli CFT073
ccaaucggcagaa

SEQ ID NO: 606083 - RNA, 17 nt, Escherichia coli CFT073
ccaaucggccauugccc

SEQ ID NO: 606084 - RNA, 23 nt, Escherichia coli CFT073
ccaaucgggaagauaucgugcgg

SEQ ID NO: 606085 - RNA, 18 nt, Escherichia coli CFT073
ccaaucuucacaucauca

SEQ ID NO: 606086 - RNA, 20 nt, Escherichia coli CFT073
aaagccggaugaucauccgg

SEQ ID NO: 606087 - RNA, 17 nt, Escherichia coli CFT073
ccaaucgagccacgguc

SEQ ID NO: 606088 - RNA, 15 nt, Escherichia coli CFT073
ccaaucgccacgcca

SEQ ID NO: 606089 - RNA, 18 nt, Escherichia coli CFT073
ccaaucagcccugcccag

SEQ ID NO: 606090 - RNA, 22 nt, Escherichia coli CFT073
ccaaucagcgcagcacccagaa

SEQ ID NO: 606091 - RNA, 19 nt, Escherichia coli CFT073
ccaaucccggaagccacca

SEQ ID NO: 606092 - RNA, 14 nt, Escherichia coli CFT073
caucuuuaacugcu

SEQ ID NO: 606093 - RNA, 16 nt, Escherichia coli CFT073
caugaacaaaacauac

SEQ ID NO: 606094 - RNA, 21 nt, Escherichia coli CFT073
caugaacaaaucgcacguugu

SEQ ID NO: 606095 - RNA, 16 nt, Escherichia coli CFT073
caugaaccgugucgcc

SEQ ID NO: 606096 - RNA, 16 nt, Escherichia coli CFT073
caucuucuuugcgcca

SEQ ID NO: 606097 - RNA, 13 nt, Escherichia coli CFT073
caucuucugccgg

SEQ ID NO: 606098 - RNA, 17 nt, Escherichia coli CFT073
caucuucuucauucccg

SEQ ID NO: 606099 - RNA, 16 nt, Escherichia coli CFT073
caucuucuucuggcug

SEQ ID NO: 606100 - RNA, 20 nt, Escherichia coli CFT073
caucugggauuuuguuuaac

SEQ ID NO: 606101 - RNA, 15 nt, Escherichia coli CFT073
caucugggcugauga

SEQ ID NO: 606102 - RNA, 21 nt, Escherichia coli CFT073
caucugcuguuucuggcacca

SEQ ID NO: 606103 - RNA, 12 nt, Escherichia coli CFT073
caucuuauccgg

SEQ ID NO: 606104 - RNA, 20 nt, Escherichia coli CFT073
caucuuccagcgucgggcca

SEQ ID NO: 606105 - RNA, 14 nt, Escherichia coli CFT073
caucuuccggagcu

SEQ ID NO: 606106 - RNA, 14 nt, Escherichia coli CFT073
caucuuccggguua

SEQ ID NO: 606107 - RNA, 12 nt, Escherichia coli CFT073
caucuucggcgu

SEQ ID NO: 606108 - RNA, 13 nt, Escherichia coli CFT073
caugaaucacgau

SEQ ID NO: 606109 - RNA, 18 nt, Escherichia coli CFT073
caugaauggucauaaagu

SEQ ID NO: 606110 - RNA, 13 nt, Escherichia coli CFT073
caugaauuucacg

SEQ ID NO: 606111 - RNA, 13 nt, Escherichia coli CFT073
caugaagcaauga

SEQ ID NO: 606112 - RNA, 15 nt, Escherichia coli CFT073
caugacaucuccagc

SEQ ID NO: 606113 - RNA, 20 nt, Escherichia coli CFT073
caugaguuggauaauugcgu

SEQ ID NO: 606114 - RNA, 20 nt, Escherichia coli CFT073
caugauaagacgcguggcgu

SEQ ID NO: 606115 - RNA, 16 nt, Escherichia coli CFT073
caugauacaaaacaga

SEQ ID NO: 606116 - RNA, 15 nt, Escherichia coli CFT073
caugacgcaggcgua

SEQ ID NO: 606117 - RNA, 19 nt, Escherichia coli CFT073
caugacgcgcaucacgaca

SEQ ID NO: 606118 - RNA, 16 nt, Escherichia coli CFT073
caugaccuuccagcgc

SEQ ID NO: 606119 - RNA, 11 nt, Escherichia coli CFT073
caugaucgaag

SEQ ID NO: 606120 - RNA, 15 nt, Escherichia coli CFT073
caugauuaucaugcc

SEQ ID NO: 606121 - RNA, 14 nt, Escherichia coli CFT073
caugauucauccgu

SEQ ID NO: 606122 - RNA, 17 nt, Escherichia coli CFT073
caugauuccccagccac

SEQ ID NO: 606123 - RNA, 17 nt, Escherichia coli CFT073
caugaugacgcguaacg

SEQ ID NO: 606124 - RNA, 13 nt, Escherichia coli CFT073
caugcauauaaga

SEQ ID NO: 606125 - RNA, 18 nt, Escherichia coli CFT073
caugccacaguaaaaccg

SEQ ID NO: 606126 - RNA, 16 nt, Escherichia coli CFT073
caugcaaggaaaaacu

SEQ ID NO: 606127 - RNA, 17 nt, Escherichia coli CFT073
caugcaaucacugccac

SEQ ID NO: 606128 - RNA, 14 nt, Escherichia coli CFT073
caugccaucgacga

SEQ ID NO: 606129 - RNA, 13 nt, Escherichia coli CFT073
caugccaucugcc

SEQ ID NO: 606130 - RNA, 16 nt, Escherichia coli CFT073
caugccaucugccagc

SEQ ID NO: 606131 - RNA, 21 nt, Escherichia coli CFT073
caugccccauggacaugcgca

SEQ ID NO: 606132 - RNA, 16 nt, Escherichia coli CFT073
caugccgccaccacca

SEQ ID NO: 606133 - RNA, 14 nt, Escherichia coli CFT073
caucuauaaaaucc

SEQ ID NO: 606134 - RNA, 20 nt, Escherichia coli CFT073
caucuaucgaaucuguucug

SEQ ID NO: 606135 - RNA, 14 nt, Escherichia coli CFT073
caucucaaauugcu

SEQ ID NO: 606136 - RNA, 13 nt, Escherichia coli CFT073
caucuccagcugc

SEQ ID NO: 606137 - RNA, 15 nt, Escherichia coli CFT073
caucuccagcgcauc

SEQ ID NO: 606138 - RNA, 12 nt, Escherichia coli CFT073
caucuccgcagg

SEQ ID NO: 606139 - RNA, 11 nt, Escherichia coli CFT073
caucuccuggu

SEQ ID NO: 606140 - RNA, 13 nt, Escherichia coli CFT073
caucucugcaacg

SEQ ID NO: 606141 - RNA, 21 nt, Escherichia coli CFT073
caucugccaccguguauuucu

SEQ ID NO: 606142 - RNA, 19 nt, Escherichia coli CFT073
caucugcguuuugguggcg

SEQ ID NO: 606143 - RNA, 13 nt, Escherichia coli CFT073
caucguuucugcc

SEQ ID NO: 606144 - RNA, 20 nt, Escherichia coli CFT073
caucguuacucuuaucaaac

SEQ ID NO: 606145 - RNA, 17 nt, Escherichia coli CFT073
caucguucaucuguaac

SEQ ID NO: 606146 - RNA, 17 nt, Escherichia coli CFT073
caucguggaugaaacag

SEQ ID NO: 606147 - RNA, 14 nt, Escherichia coli CFT073
caucgugauuaaac

SEQ ID NO: 606148 - RNA, 15 nt, Escherichia coli CFT073
caucgugauuaaacu

SEQ ID NO: 606149 - RNA, 21 nt, Escherichia coli CFT073
caucguauuggugcauaacac

SEQ ID NO: 606150 - RNA, 14 nt, Escherichia coli CFT073
caucguccagcagc

SEQ ID NO: 606151 - RNA, 18 nt, Escherichia coli CFT073
caucgucaggggcauuuu

SEQ ID NO: 606152 - RNA, 15 nt, Escherichia coli CFT073
caucgcugugcugcu

SEQ ID NO: 606153 - RNA, 18 nt, Escherichia coli CFT073
caucgcuuaguuaaacca

SEQ ID NO: 606154 - RNA, 21 nt, Escherichia coli CFT073
caucgcuucaugcccgccgac

SEQ ID NO: 606155 - RNA, 16 nt, Escherichia coli CFT073
caucggcaacgccagc

SEQ ID NO: 606156 - RNA, 18 nt, Escherichia coli CFT073
caucggcaaaggcgugaa

SEQ ID NO: 606157 - RNA, 15 nt, Escherichia coli CFT073
caucggcaauuuacc

SEQ ID NO: 606158 - RNA, 15 nt, Escherichia coli CFT073
caucggcagcgccaa

SEQ ID NO: 606159 - RNA, 19 nt, Escherichia coli CFT073
caucggcaccgccagcagg

SEQ ID NO: 606160 - RNA, 15 nt, Escherichia coli CFT073
caucggcauacagcg

SEQ ID NO: 606161 - RNA, 18 nt, Escherichia coli CFT073
caucgggacaugauacgc

SEQ ID NO: 606162 - RNA, 21 nt, Escherichia coli CFT073
caucggcgucgguuucgcgca

SEQ ID NO: 606163 - RNA, 17 nt, Escherichia coli CFT073
caucggggaauugugcu

SEQ ID NO: 606164 - RNA, 15 nt, Escherichia coli CFT073
caucgggcaauggcu

SEQ ID NO: 606165 - RNA, 19 nt, Escherichia coli CFT073
caucgguacacauucgcgg

SEQ ID NO: 606166 - RNA, 15 nt, Escherichia coli CFT073
caucggugaucagcg

SEQ ID NO: 606167 - RNA, 16 nt, Escherichia coli CFT073
caucggugaugcucuu

SEQ ID NO: 606168 - RNA, 18 nt, Escherichia coli CFT073
cauauuauucauaaugcc

SEQ ID NO: 606169 - RNA, 19 nt, Escherichia coli CFT073
cauauggaagaaacgcuua

SEQ ID NO: 606170 - RNA, 16 nt, Escherichia coli CFT073
cauauguuuaaccggc

SEQ ID NO: 606171 - RNA, 15 nt, Escherichia coli CFT073
cauagccgaaaaugc

SEQ ID NO: 606172 - RNA, 16 nt, Escherichia coli CFT073
cauagauuaaaaucgc

SEQ ID NO: 606173 - RNA, 19 nt, Escherichia coli CFT073
cauagccagcgaccgcgcc

SEQ ID NO: 606174 - RNA, 17 nt, Escherichia coli CFT073
cauagccaucugccuga

SEQ ID NO: 606175 - RNA, 17 nt, Escherichia coli CFT073
cauagacgccacccgau

SEQ ID NO: 606176 - RNA, 15 nt, Escherichia coli CFT073
caucaaacaccgaac

SEQ ID NO: 606177 - RNA, 16 nt, Escherichia coli CFT073
caucaaacagccccug

SEQ ID NO: 606178 - RNA, 19 nt, Escherichia coli CFT073
cauauugccaucacggcag

SEQ ID NO: 606179 - RNA, 13 nt, Escherichia coli CFT073
caucaaucagcgg

SEQ ID NO: 606180 - RNA, 19 nt, Escherichia coli CFT073
caucaauaugaauuaacgu

SEQ ID NO: 606181 - RNA, 22 nt, Escherichia coli CFT073
caucacaauuccgguacgccag

SEQ ID NO: 606182 - RNA, 17 nt, Escherichia coli CFT073
caucacuaccagcgcca

SEQ ID NO: 606183 - RNA, 20 nt, Escherichia coli CFT073
caucacuaccugauucgcac

SEQ ID NO: 606184 - RNA, 17 nt, Escherichia coli CFT073
caucacgcgcaucugua

SEQ ID NO: 606185 - RNA, 20 nt, Escherichia coli CFT073
caucacuuuuuccggugcca

SEQ ID NO: 606186 - RNA, 22 nt, Escherichia coli CFT073
caucacucuguuuuaacgcaga

SEQ ID NO: 606187 - RNA, 17 nt, Escherichia coli CFT073
caucagaacagccccaa

SEQ ID NO: 606188 - RNA, 14 nt, Escherichia coli CFT073
caucagcagcaaca

SEQ ID NO: 606189 - RNA, 21 nt, Escherichia coli CFT073
caucagccaggguucccggcc

SEQ ID NO: 606190 - RNA, 15 nt, Escherichia coli CFT073
caucagcaugacaaa

SEQ ID NO: 606191 - RNA, 17 nt, Escherichia coli CFT073
caucagacuuugcgcca

SEQ ID NO: 606192 - RNA, 18 nt, Escherichia coli CFT073
caucagaucguugaaccc

SEQ ID NO: 606193 - RNA, 14 nt, Escherichia coli CFT073
caucagcaaauaga

SEQ ID NO: 606194 - RNA, 18 nt, Escherichia coli CFT073
caucacgcaacauuccgg

SEQ ID NO: 606195 - RNA, 15 nt, Escherichia coli CFT073
caucaccaacugccc

SEQ ID NO: 606196 - RNA, 14 nt, Escherichia coli CFT073
caucacgacagcac

SEQ ID NO: 606197 - RNA, 23 nt, Escherichia coli CFT073
caucaccacgccgagagaagcgc

SEQ ID NO: 606198 - RNA, 14 nt, Escherichia coli CFT073
caucaccugacagc

SEQ ID NO: 606199 - RNA, 18 nt, Escherichia coli CFT073
caucaccugacagcagag

SEQ ID NO: 606200 - RNA, 17 nt, Escherichia coli CFT073
cauacuggcggaucccg

SEQ ID NO: 606201 - RNA, 22 nt, Escherichia coli CFT073
cauacuguccugcggcguacca

SEQ ID NO: 606202 - RNA, 17 nt, Escherichia coli CFT073
cauacuccagucgcugc

SEQ ID NO: 606203 - RNA, 22 nt, Escherichia coli CFT073
cauacaaaucgugcaucuccug

SEQ ID NO: 606204 - RNA, 20 nt, Escherichia coli CFT073
cauaauucagaucgcuacca

SEQ ID NO: 606205 - RNA, 13 nt, Escherichia coli CFT073
cauacacagauaa

SEQ ID NO: 606206 - RNA, 15 nt, Escherichia coli CFT073
cauacaccaccacau

SEQ ID NO: 606207 - RNA, 15 nt, Escherichia coli CFT073
cauacagaugcugcu

SEQ ID NO: 606208 - RNA, 13 nt, Escherichia coli CFT073
cauacgccggaug

SEQ ID NO: 606209 - RNA, 14 nt, Escherichia coli CFT073
cauacgccacaucc

SEQ ID NO: 606210 - RNA, 18 nt, Escherichia coli CFT073
cauaccgccgaggaacau

SEQ ID NO: 606211 - RNA, 15 nt, Escherichia coli CFT073
cauaccggacuccag

SEQ ID NO: 606212 - RNA, 15 nt, Escherichia coli CFT073
caguguuguauucag

SEQ ID NO: 606213 - RNA, 22 nt, Escherichia coli CFT073
caguguccagaugcuguaccag

SEQ ID NO: 606214 - RNA, 20 nt, Escherichia coli CFT073
caguguccaguaauggccaa

SEQ ID NO: 606215 - RNA, 23 nt, Escherichia coli CFT073
cagugcuuuuugugggccugaua

SEQ ID NO: 606216 - RNA, 14 nt, Escherichia coli CFT073
cauaacccgcuucc

SEQ ID NO: 606217 - RNA, 19 nt, Escherichia coli CFT073
cauaaccgccagcacagcc

SEQ ID NO: 606218 - RNA, 17 nt, Escherichia coli CFT073
cauaaccagugacggaa

SEQ ID NO: 606219 - RNA, 18 nt, Escherichia coli CFT073
cauaacggcccggcgacg

SEQ ID NO: 606220 - RNA, 21 nt, Escherichia coli CFT073
cauaagcaaauccuuccgcca

SEQ ID NO: 606221 - RNA, 17 nt, Escherichia coli CFT073
cauaacuuugaucgcgu

SEQ ID NO: 606222 - RNA, 16 nt, Escherichia coli CFT073
cauaaugcccagcguu

SEQ ID NO: 606223 - RNA, 19 nt, Escherichia coli CFT073
cauaaugggcgcgggcaau

SEQ ID NO: 606224 - RNA, 16 nt, Escherichia coli CFT073
cauaauguaaacaaga

SEQ ID NO: 606225 - RNA, 14 nt, Escherichia coli CFT073
cauccucauaacgu

SEQ ID NO: 606226 - RNA, 17 nt, Escherichia coli CFT073
caucgagcgcagcaaca

SEQ ID NO: 606227 - RNA, 18 nt, Escherichia coli CFT073
caucgagcgcagcaacau

SEQ ID NO: 606228 - RNA, 15 nt, Escherichia coli CFT073
caucgagaucgacac

SEQ ID NO: 606229 - RNA, 17 nt, Escherichia coli CFT073
caucgccauuaccacca

SEQ ID NO: 606230 - RNA, 15 nt, Escherichia coli CFT073
caucgcccacaccac

SEQ ID NO: 606231 - RNA, 19 nt, Escherichia coli CFT073
caucgcccacaccacgcca

SEQ ID NO: 606232 - RNA, 15 nt, Escherichia coli CFT073
caucgcccagccauc

SEQ ID NO: 606233 - RNA, 13 nt, Escherichia coli CFT073
caucgccagcagc

SEQ ID NO: 606234 - RNA, 16 nt, Escherichia coli CFT073
caucgccagcgcggcg

SEQ ID NO: 606235 - RNA, 21 nt, Escherichia coli CFT073
caucgccaggaacaacgacag

SEQ ID NO: 606236 - RNA, 20 nt, Escherichia coli CFT073
caucgccauaaacaccagca

SEQ ID NO: 606237 - RNA, 22 nt, Escherichia coli CFT073
caucgccauaaacaccagcagc

SEQ ID NO: 606238 - RNA, 18 nt, Escherichia coli CFT073
caucgcggcacacagcac

SEQ ID NO: 606239 - RNA, 22 nt, Escherichia coli CFT073
caucgcuacaggcuaucggcca

SEQ ID NO: 606240 - RNA, 21 nt, Escherichia coli CFT073
caucgcugaacgggccaucca

SEQ ID NO: 606241 - RNA, 15 nt, Escherichia coli CFT073
caucgcgguuaugcc

SEQ ID NO: 606242 - RNA, 20 nt, Escherichia coli CFT073
caucgcgguuaugccgccga

SEQ ID NO: 606243 - RNA, 15 nt, Escherichia coli CFT073
caucgcgcaccagcg

SEQ ID NO: 606244 - RNA, 13 nt, Escherichia coli CFT073
caucgcgccaaac

SEQ ID NO: 606245 - RNA, 12 nt, Escherichia coli CFT073
caucgcgccaac

SEQ ID NO: 606246 - RNA, 16 nt, Escherichia coli CFT073
caucgcgcccgccgcc

SEQ ID NO: 606247 - RNA, 13 nt, Escherichia coli CFT073
caucgcgcacaug

SEQ ID NO: 606248 - RNA, 14 nt, Escherichia coli CFT073
cauccguaacgcaa

SEQ ID NO: 606249 - RNA, 22 nt, Escherichia coli CFT073
cauccguuucagcuuauucauc

SEQ ID NO: 606250 - RNA, 22 nt, Escherichia coli CFT073
cauccuaaaggcaaaaugccag

SEQ ID NO: 606251 - RNA, 19 nt, Escherichia coli CFT073
cauccgguuucaucagcca

SEQ ID NO: 606252 - RNA, 16 nt, Escherichia coli CFT073
cauccggcgacaggaa

SEQ ID NO: 606253 - RNA, 18 nt, Escherichia coli CFT073
caucccugaaaugugcgc

SEQ ID NO: 606254 - RNA, 19 nt, Escherichia coli CFT073
caucccuucguaaacgcga

SEQ ID NO: 606255 - RNA, 15 nt, Escherichia coli CFT073
cauccgacaucaacg

SEQ ID NO: 606256 - RNA, 19 nt, Escherichia coli CFT073
cauccgacaucaacgccug

SEQ ID NO: 606257 - RNA, 13 nt, Escherichia coli CFT073
cauccgacauuug

SEQ ID NO: 606258 - RNA, 13 nt, Escherichia coli CFT073
caucccagcagag

SEQ ID NO: 606259 - RNA, 15 nt, Escherichia coli CFT073
caucccagcagagau

SEQ ID NO: 606260 - RNA, 13 nt, Escherichia coli CFT073
caucccuaacagc

SEQ ID NO: 606261 - RNA, 15 nt, Escherichia coli CFT073
cauccgccagcgccu

SEQ ID NO: 606262 - RNA, 12 nt, Escherichia coli CFT073
cauccggcaacc

SEQ ID NO: 606263 - RNA, 19 nt, Escherichia coli CFT073
cauccggcaaugaaacuca

SEQ ID NO: 606264 - RNA, 19 nt, Escherichia coli CFT073
cauccggcaauuuugcgcc

SEQ ID NO: 606265 - RNA, 16 nt, Escherichia coli CFT073
cauccggcauaaacgc

SEQ ID NO: 606266 - RNA, 15 nt, Escherichia coli CFT073
cauccggcauaaacu

SEQ ID NO: 606267 - RNA, 15 nt, Escherichia coli CFT073
cauccggcaucaacc

SEQ ID NO: 606268 - RNA, 14 nt, Escherichia coli CFT073
cauccggcaugaac

SEQ ID NO: 606269 - RNA, 20 nt, Escherichia coli CFT073
cauccggcacuuucggauua

SEQ ID NO: 606270 - RNA, 15 nt, Escherichia coli CFT073
caucaggccgccagc

SEQ ID NO: 606271 - RNA, 21 nt, Escherichia coli CFT073
caucagcucuguagcaacgau

SEQ ID NO: 606272 - RNA, 17 nt, Escherichia coli CFT073
caucaggcaacccgcac

SEQ ID NO: 606273 - RNA, 18 nt, Escherichia coli CFT073
caucaggcaacccgcaca

SEQ ID NO: 606274 - RNA, 20 nt, Escherichia coli CFT073
caucagcgggccugguugca

SEQ ID NO: 606275 - RNA, 19 nt, Escherichia coli CFT073
caucagcggguuuuucccu

SEQ ID NO: 606276 - RNA, 11 nt, Escherichia coli CFT073
caucagcgccu

SEQ ID NO: 606277 - RNA, 12 nt, Escherichia coli CFT073
caucagcgccaa

SEQ ID NO: 606278 - RNA, 14 nt, Escherichia coli CFT073
caucagcgccaacc

SEQ ID NO: 606279 - RNA, 17 nt, Escherichia coli CFT073
cauccaguacgccuuca

SEQ ID NO: 606280 - RNA, 17 nt, Escherichia coli CFT073
cauccaggugaaaaaua

SEQ ID NO: 606281 - RNA, 16 nt, Escherichia coli CFT073
cauccauuaacagcgg

SEQ ID NO: 606282 - RNA, 19 nt, Escherichia coli CFT073
cauccauuacaucacgacg

SEQ ID NO: 606283 - RNA, 15 nt, Escherichia coli CFT073
cauccaugcacugca

SEQ ID NO: 606284 - RNA, 16 nt, Escherichia coli CFT073
cauccaugcacugcaa

SEQ ID NO: 606285 - RNA, 13 nt, Escherichia coli CFT073
cauccaguugcgc

SEQ ID NO: 606286 - RNA, 14 nt, Escherichia coli CFT073
cauccaucaacgcc

SEQ ID NO: 606287 - RNA, 16 nt, Escherichia coli CFT073
cauccagcucaagugc

SEQ ID NO: 606288 - RNA, 22 nt, Escherichia coli CFT073
caucagguaauaggcaggcauc

SEQ ID NO: 606289 - RNA, 12 nt, Escherichia coli CFT073
cagugaaaaugg

SEQ ID NO: 606290 - RNA, 16 nt, Escherichia coli CFT073
cagucuuuuaaccggc

SEQ ID NO: 606291 - RNA, 20 nt, Escherichia coli CFT073
cagugauuuucccuuccgcc

SEQ ID NO: 606292 - RNA, 21 nt, Escherichia coli CFT073
cagugauuuucccuuccgcca

SEQ ID NO: 606293 - RNA, 14 nt, Escherichia coli CFT073
cagucugcgcccug

SEQ ID NO: 606294 - RNA, 16 nt, Escherichia coli CFT073
cagucuuaaaaagcag

SEQ ID NO: 606295 - RNA, 21 nt, Escherichia coli CFT073
cagucgguucaaccaucagcg

SEQ ID NO: 606296 - RNA, 17 nt, Escherichia coli CFT073
cagucguauccucagaa

SEQ ID NO: 606297 - RNA, 16 nt, Escherichia coli CFT073
cagugcggugccgcga

SEQ ID NO: 606298 - RNA, 17 nt, Escherichia coli CFT073
cagugcggugccgcgaa

SEQ ID NO: 606299 - RNA, 14 nt, Escherichia coli CFT073
cagugcaaucagcg

SEQ ID NO: 606300 - RNA, 23 nt, Escherichia coli CFT073
cagugcaggaugcgacauaaacg

SEQ ID NO: 606301 - RNA, 22 nt, Escherichia coli CFT073
cagucaucacuuucagaccgcc

SEQ ID NO: 606302 - RNA, 14 nt, Escherichia coli CFT073
cagucacgccagua

SEQ ID NO: 606303 - RNA, 20 nt, Escherichia coli CFT073
caguccacggcugcggccaa

SEQ ID NO: 606304 - RNA, 13 nt, Escherichia coli CFT073
caguccagcgccu

SEQ ID NO: 606305 - RNA, 21 nt, Escherichia coli CFT073
caguccagcgccugacgcggg

SEQ ID NO: 606306 - RNA, 13 nt, Escherichia coli CFT073
caguccaucggca

SEQ ID NO: 606307 - RNA, 23 nt, Escherichia coli CFT073
cagucgggugcgacaggagccgc

SEQ ID NO: 606308 - RNA, 21 nt, Escherichia coli CFT073
cagucgcccgaccaucgccag

SEQ ID NO: 606309 - RNA, 21 nt, Escherichia coli CFT073
caguaguuuuugcagauggau

SEQ ID NO: 606310 - RNA, 14 nt, Escherichia coli CFT073
caguauauugcuga

SEQ ID NO: 606311 - RNA, 19 nt, Escherichia coli CFT073
caguagcauccccggcaac

SEQ ID NO: 606312 - RNA, 13 nt, Escherichia coli CFT073
caguagacaauuu

SEQ ID NO: 606313 - RNA, 22 nt, Escherichia coli CFT073
caguacgcacaaugccguaacc

SEQ ID NO: 606314 - RNA, 17 nt, Escherichia coli CFT073
caguacggcagcaaucg

SEQ ID NO: 606315 - RNA, 21 nt, Escherichia coli CFT073
caguacggcuauauacagcgc

SEQ ID NO: 606316 - RNA, 17 nt, Escherichia coli CFT073
caguacgggcagcgcau

SEQ ID NO: 606317 - RNA, 20 nt, Escherichia coli CFT073
cagguuguuuucuggcugac

SEQ ID NO: 606318 - RNA, 14 nt, Escherichia coli CFT073
cagguucgccaaca

SEQ ID NO: 606319 - RNA, 23 nt, Escherichia coli CFT073
caggggcggguuuuuuuauaucu

SEQ ID NO: 606320 - RNA, 16 nt, Escherichia coli CFT073
caggggcaaucagcac

SEQ ID NO: 606321 - RNA, 14 nt, Escherichia coli CFT073
caggucgaaguuga

SEQ ID NO: 606322 - RNA, 17 nt, Escherichia coli CFT073
cagguccuggcuauucu

SEQ ID NO: 606323 - RNA, 21 nt, Escherichia coli CFT073
caggucgacaauccagucagc

SEQ ID NO: 606324 - RNA, 21 nt, Escherichia coli CFT073
cagguccguauagaucagcgg

SEQ ID NO: 606325 - RNA, 13 nt, Escherichia coli CFT073
cagguagcaaaca

SEQ ID NO: 606326 - RNA, 16 nt, Escherichia coli CFT073
cagguagcagcagcgc

SEQ ID NO: 606327 - RNA, 19 nt, Escherichia coli CFT073
cagguagcagcagcgccag

SEQ ID NO: 606328 - RNA, 21 nt, Escherichia coli CFT073
cagguacugguaagcaaagca

SEQ ID NO: 606329 - RNA, 18 nt, Escherichia coli CFT073
caggguaucgguugcugg

SEQ ID NO: 606330 - RNA, 20 nt, Escherichia coli CFT073
caggcaacagauaauaaaaa

SEQ ID NO: 606331 - RNA, 17 nt, Escherichia coli CFT073
caggcagauacaaccaa

SEQ ID NO: 606332 - RNA, 14 nt, Escherichia coli CFT073
caggcagacgauga

SEQ ID NO: 606333 - RNA, 21 nt, Escherichia coli CFT073
caggcagacgaugaugcagau

SEQ ID NO: 606334 - RNA, 20 nt, Escherichia coli CFT073
caggcagaacaccggcagcg

SEQ ID NO: 606335 - RNA, 20 nt, Escherichia coli CFT073
caggcacuucuuccgccagc

SEQ ID NO: 606336 - RNA, 19 nt, Escherichia coli CFT073
caggaucgacugcaagcca

SEQ ID NO: 606337 - RNA, 16 nt, Escherichia coli CFT073
caggauaucugaaagu

SEQ ID NO: 606338 - RNA, 16 nt, Escherichia coli CFT073
caggauaaccuuccac

SEQ ID NO: 606339 - RNA, 18 nt, Escherichia coli CFT073
cagcguguugaggaagcg

SEQ ID NO: 606340 - RNA, 17 nt, Escherichia coli CFT073
cagcguucaaacaccag

SEQ ID NO: 606341 - RNA, 20 nt, Escherichia coli CFT073
cagcguggugcugauacgcg

SEQ ID NO: 606342 - RNA, 18 nt, Escherichia coli CFT073
cagcgugcucucaaauau

SEQ ID NO: 606343 - RNA, 17 nt, Escherichia coli CFT073
aaagauguuuugccuga

SEQ ID NO: 606344 - RNA, 20 nt, Escherichia coli CFT073
aaagaugugucagcaucgca

SEQ ID NO: 606345 - RNA, 16 nt, Escherichia coli CFT073
caggccaucagcagcg

SEQ ID NO: 606346 - RNA, 16 nt, Escherichia coli CFT073
caggcaucagauuguu

SEQ ID NO: 606347 - RNA, 18 nt, Escherichia coli CFT073
caggcauauucaccguca

SEQ ID NO: 606348 - RNA, 13 nt, Escherichia coli CFT073
caggccgcgcagu

SEQ ID NO: 606349 - RNA, 17 nt, Escherichia coli CFT073
caggccgccacuucggu

SEQ ID NO: 606350 - RNA, 14 nt, Escherichia coli CFT073
caggcggcaauggc

SEQ ID NO: 606351 - RNA, 18 nt, Escherichia coli CFT073
caggccugauaagcguag

SEQ ID NO: 606352 - RNA, 21 nt, Escherichia coli CFT073
caggccuacgugauuccugca

SEQ ID NO: 606353 - RNA, 20 nt, Escherichia coli CFT073
caggccucaugugaugguaa

SEQ ID NO: 606354 - RNA, 13 nt, Escherichia coli CFT073
caggccggagcca

SEQ ID NO: 606355 - RNA, 11 nt, Escherichia coli CFT073
caggccggaug

SEQ ID NO: 606356 - RNA, 17 nt, Escherichia coli CFT073
cagggauccccagccgc

SEQ ID NO: 606357 - RNA, 14 nt, Escherichia coli CFT073
cagggcaaucgcgc

SEQ ID NO: 606358 - RNA, 16 nt, Escherichia coli CFT073
cagggauaaagcuuuu

SEQ ID NO: 606359 - RNA, 23 nt, Escherichia coli CFT073
caggcuuccuggcuugccagcca

SEQ ID NO: 606360 - RNA, 18 nt, Escherichia coli CFT073
caggcugauggagauuuu

SEQ ID NO: 606361 - RNA, 11 nt, Escherichia coli CFT073
caggcgucgca

SEQ ID NO: 606362 - RNA, 23 nt, Escherichia coli CFT073
caggcgguggaacaagucagcgc

SEQ ID NO: 606363 - RNA, 14 nt, Escherichia coli CFT073
caggcggucgccgu

SEQ ID NO: 606364 - RNA, 23 nt, Escherichia coli CFT073
cagccggagcuucacccgcagca

SEQ ID NO: 606365 - RNA, 16 nt, Escherichia coli CFT073
cagccgcccagcgaac

SEQ ID NO: 606366 - RNA, 19 nt, Escherichia coli CFT073
cagccgccaucgcugacga

SEQ ID NO: 606367 - RNA, 18 nt, Escherichia coli CFT073
cagccgauguuauugcag

SEQ ID NO: 606368 - RNA, 22 nt, Escherichia coli CFT073
cagccgcaaacuuugccacaau

SEQ ID NO: 606369 - RNA, 14 nt, Escherichia coli CFT073
cagcccuucucgcu

SEQ ID NO: 606370 - RNA, 17 nt, Escherichia coli CFT073
cagccacgcguucggac

SEQ ID NO: 606371 - RNA, 19 nt, Escherichia coli CFT073
cagccccugugccagcucg

SEQ ID NO: 606372 - RNA, 21 nt, Escherichia coli CFT073
cagccaaacaugacgcgcauc

SEQ ID NO: 606373 - RNA, 15 nt, Escherichia coli CFT073
cagcgaaucagccca

SEQ ID NO: 606374 - RNA, 14 nt, Escherichia coli CFT073
cagcgacaccagcc

SEQ ID NO: 606375 - RNA, 18 nt, Escherichia coli CFT073
cagcgacaccuuccgcgu

SEQ ID NO: 606376 - RNA, 20 nt, Escherichia coli CFT073
cagcgaacggucgccgcgca

SEQ ID NO: 606377 - RNA, 16 nt, Escherichia coli CFT073
cagcgaagcgcaucag

SEQ ID NO: 606378 - RNA, 23 nt, Escherichia coli CFT073
cagccgucgccaguaccagcagc

SEQ ID NO: 606379 - RNA, 17 nt, Escherichia coli CFT073
cagccgucgcccacagu

SEQ ID NO: 606380 - RNA, 19 nt, Escherichia coli CFT073
cagcgcacggcgaaaauua

SEQ ID NO: 606381 - RNA, 19 nt, Escherichia coli CFT073
cagcgcacuacgccgcaaa

SEQ ID NO: 606382 - RNA, 17 nt, Escherichia coli CFT073
cagcgcaccagaaacaa

SEQ ID NO: 606383 - RNA, 17 nt, Escherichia coli CFT073
cagcgcaccagcgucau

SEQ ID NO: 606384 - RNA, 17 nt, Escherichia coli CFT073
cagcgcaaggcgcgaca

SEQ ID NO: 606385 - RNA, 13 nt, Escherichia coli CFT073
cagcgcaaucacc

SEQ ID NO: 606386 - RNA, 22 nt, Escherichia coli CFT073
cagcgccugguccagcucgcga

SEQ ID NO: 606387 - RNA, 21 nt, Escherichia coli CFT073
cagcgccugggaaucaaacca

SEQ ID NO: 606388 - RNA, 16 nt, Escherichia coli CFT073
cagcgccugcgcggca

SEQ ID NO: 606389 - RNA, 13 nt, Escherichia coli CFT073
cagcgccugcagc

SEQ ID NO: 606390 - RNA, 23 nt, Escherichia coli CFT073
cagcgccucuuccaguaaaccaa

SEQ ID NO: 606391 - RNA, 23 nt, Escherichia coli CFT073
cagcgcccguuugcgagacggcg

SEQ ID NO: 606392 - RNA, 15 nt, Escherichia coli CFT073
cagcgccagcgcgga

SEQ ID NO: 606393 - RNA, 15 nt, Escherichia coli CFT073
cagcgccagcauaug

SEQ ID NO: 606394 - RNA, 16 nt, Escherichia coli CFT073
cagcgcgcggcuggca

SEQ ID NO: 606395 - RNA, 21 nt, Escherichia coli CFT073
cagcgcgaggguaaacaacau

SEQ ID NO: 606396 - RNA, 15 nt, Escherichia coli CFT073
cagcgcgggcuggcg

SEQ ID NO: 606397 - RNA, 16 nt, Escherichia coli CFT073
cagcgcgggcuggcgu

SEQ ID NO: 606398 - RNA, 15 nt, Escherichia coli CFT073
cagcgcggcagcggc

SEQ ID NO: 606399 - RNA, 21 nt, Escherichia coli CFT073
cagcgcuucuucuaucguuuu

SEQ ID NO: 606400 - RNA, 16 nt, Escherichia coli CFT073
cagcgcuuuaucaucg

SEQ ID NO: 606401 - RNA, 20 nt, Escherichia coli CFT073
cagcgcuuuaucaucgguca

SEQ ID NO: 606402 - RNA, 22 nt, Escherichia coli CFT073
cagcgcuuccagaaugacgccg

SEQ ID NO: 606403 - RNA, 15 nt, Escherichia coli CFT073
cagcgcuaccagagc

SEQ ID NO: 606404 - RNA, 23 nt, Escherichia coli CFT073
cagcgcgucuucaucguccagcg

SEQ ID NO: 606405 - RNA, 14 nt, Escherichia coli CFT073
cagcgcgugcgcca

SEQ ID NO: 606406 - RNA, 13 nt, Escherichia coli CFT073
cagcgguuuaccg

SEQ ID NO: 606407 - RNA, 15 nt, Escherichia coli CFT073
cagcggugccgcgau

SEQ ID NO: 606408 - RNA, 14 nt, Escherichia coli CFT073
cagcgguuccccgc

SEQ ID NO: 606409 - RNA, 15 nt, Escherichia coli CFT073
cagcgguccguugau

SEQ ID NO: 606410 - RNA, 21 nt, Escherichia coli CFT073
cagcgucuccagacaauccgc

SEQ ID NO: 606411 - RNA, 23 nt, Escherichia coli CFT073
cagcgucggugucaucgacauca

SEQ ID NO: 606412 - RNA, 16 nt, Escherichia coli CFT073
cagcgucgguuccuga

SEQ ID NO: 606413 - RNA, 17 nt, Escherichia coli CFT073
cagcgucguauccagcg

SEQ ID NO: 606414 - RNA, 19 nt, Escherichia coli CFT073
cagcgucguauccagcguu

SEQ ID NO: 606415 - RNA, 22 nt, Escherichia coli CFT073
cagcgucgcggucagacgcgau

SEQ ID NO: 606416 - RNA, 20 nt, Escherichia coli CFT073
cagcgggcgaaucaacucca

SEQ ID NO: 606417 - RNA, 22 nt, Escherichia coli CFT073
cagcggcuguuccggcacaccu

SEQ ID NO: 606418 - RNA, 15 nt, Escherichia coli CFT073
cagcgguaaaauggu

SEQ ID NO: 606419 - RNA, 13 nt, Escherichia coli CFT073
cagcgguaaauca

SEQ ID NO: 606420 - RNA, 16 nt, Escherichia coli CFT073
cagcgggacaacaaac

SEQ ID NO: 606421 - RNA, 13 nt, Escherichia coli CFT073
cagcggcgcaucc

SEQ ID NO: 606422 - RNA, 17 nt, Escherichia coli CFT073
cagcggcgcauccgcca

SEQ ID NO: 606423 - RNA, 22 nt, Escherichia coli CFT073
cagcggcgcauccgccagcagc

SEQ ID NO: 606424 - RNA, 21 nt, Escherichia coli CFT073
cagcggccagacgcgccgcca

SEQ ID NO: 606425 - RNA, 17 nt, Escherichia coli CFT073
cagcggcagaaugguaa

SEQ ID NO: 606426 - RNA, 21 nt, Escherichia coli CFT073
cagcggaugacccagcgcgau

SEQ ID NO: 606427 - RNA, 22 nt, Escherichia coli CFT073
cagcggcaacaucaucacgcag

SEQ ID NO: 606428 - RNA, 17 nt, Escherichia coli CFT073
cagcggcaagcuggcga

SEQ ID NO: 606429 - RNA, 23 nt, Escherichia coli CFT073
cagcacuucacccaucgccagau

SEQ ID NO: 606430 - RNA, 16 nt, Escherichia coli CFT073
cagcagacgguuggca

SEQ ID NO: 606431 - RNA, 19 nt, Escherichia coli CFT073
cagcacuuuucgcacugca

SEQ ID NO: 606432 - RNA, 24 nt, Escherichia coli CFT073
cagcagcacccgaugcggcagucg

SEQ ID NO: 606433 - RNA, 15 nt, Escherichia coli CFT073
cagcagcagcgccaa

SEQ ID NO: 606434 - RNA, 14 nt, Escherichia coli CFT073
cagcagcagcgaau

SEQ ID NO: 606435 - RNA, 17 nt, Escherichia coli CFT073
cagcagcuugcgccgcc

SEQ ID NO: 606436 - RNA, 21 nt, Escherichia coli CFT073
cagcagcuugcgccgcccgcc

SEQ ID NO: 606437 - RNA, 17 nt, Escherichia coli CFT073
cagcaggaacgagaacu

SEQ ID NO: 606438 - RNA, 18 nt, Escherichia coli CFT073
cagcagcuucgucaccug

SEQ ID NO: 606439 - RNA, 15 nt, Escherichia coli CFT073
cagcagcucacgcag

SEQ ID NO: 606440 - RNA, 17 nt, Escherichia coli CFT073
cagcagcucacgcagcu

SEQ ID NO: 606441 - RNA, 23 nt, Escherichia coli CFT073
cagcauuagcauuaacaguagag

SEQ ID NO: 606442 - RNA, 19 nt, Escherichia coli CFT073
cagcauucaucacaaaaua

SEQ ID NO: 606443 - RNA, 13 nt, Escherichia coli CFT073
cagcauucccgcc

SEQ ID NO: 606444 - RNA, 21 nt, Escherichia coli CFT073
cagcauuuguugguacaccug

SEQ ID NO: 606445 - RNA, 16 nt, Escherichia coli CFT073
cagccaaauccagcgc

SEQ ID NO: 606446 - RNA, 22 nt, Escherichia coli CFT073
cagccaaaucccgugaugcggu

SEQ ID NO: 606447 - RNA, 15 nt, Escherichia coli CFT073
cagccaaaucgcccc

SEQ ID NO: 606448 - RNA, 23 nt, Escherichia coli CFT073
cagccaaaucgccccgcagccga

SEQ ID NO: 606449 - RNA, 20 nt, Escherichia coli CFT073
cagcaugugguuaccaucaa

SEQ ID NO: 606450 - RNA, 13 nt, Escherichia coli CFT073
cagcaugccgcca

SEQ ID NO: 606451 - RNA, 14 nt, Escherichia coli CFT073
cagcaugccgccaa

SEQ ID NO: 606452 - RNA, 15 nt, Escherichia coli CFT073
cagcaucgcuuccau

SEQ ID NO: 606453 - RNA, 16 nt, Escherichia coli CFT073
cagcaucggcaacgcc

SEQ ID NO: 606454 - RNA, 16 nt, Escherichia coli CFT073
cagcaucgacauucaa

SEQ ID NO: 606455 - RNA, 13 nt, Escherichia coli CFT073
cagcauccgcgca

SEQ ID NO: 606456 - RNA, 17 nt, Escherichia coli CFT073
cagcaucgcaucgauaa

SEQ ID NO: 606457 - RNA, 14 nt, Escherichia coli CFT073
cagcaucgccacgg

SEQ ID NO: 606458 - RNA, 19 nt, Escherichia coli CFT073
cagcaucgcccccaucgcc

SEQ ID NO: 606459 - RNA, 23 nt, Escherichia coli CFT073
cagcaguuuuuccccugccagau

SEQ ID NO: 606460 - RNA, 15 nt, Escherichia coli CFT073
cagcaguuccagcau

SEQ ID NO: 606461 - RNA, 19 nt, Escherichia coli CFT073
cagcaguguuuccggcauu

SEQ ID NO: 606462 - RNA, 23 nt, Escherichia coli CFT073
cagcaguucgcccgcuucaucgu

SEQ ID NO: 606463 - RNA, 16 nt, Escherichia coli CFT073
cagcaguucacagcgc

SEQ ID NO: 606464 - RNA, 14 nt, Escherichia coli CFT073
cagcagugcugcau

SEQ ID NO: 606465 - RNA, 22 nt, Escherichia coli CFT073
cagcagggcaaucgcgccaacc

SEQ ID NO: 606466 - RNA, 21 nt, Escherichia coli CFT073
cagcaagagcaaauaaaacau

SEQ ID NO: 606467 - RNA, 14 nt, Escherichia coli CFT073
cagcaaucugagca

SEQ ID NO: 606468 - RNA, 19 nt, Escherichia coli CFT073
cagcaaugcagguaccugu

SEQ ID NO: 606469 - RNA, 12 nt, Escherichia coli CFT073
cagcaaugccag

SEQ ID NO: 606470 - RNA, 23 nt, Escherichia coli CFT073
cagcaaugacauacagcaccgcc

SEQ ID NO: 606471 - RNA, 12 nt, Escherichia coli CFT073
cagcaauaaaaa

SEQ ID NO: 606472 - RNA, 18 nt, Escherichia coli CFT073
cagcaauaaugccagucc

SEQ ID NO: 606473 - RNA, 14 nt, Escherichia coli CFT073
cagcaauauagcgc

SEQ ID NO: 606474 - RNA, 13 nt, Escherichia coli CFT073
cagcaaucgacca

SEQ ID NO: 606475 - RNA, 14 nt, Escherichia coli CFT073
cagcaaucgaccag

SEQ ID NO: 606476 - RNA, 13 nt, Escherichia coli CFT073
cagcaaaucagcc

SEQ ID NO: 606477 - RNA, 21 nt, Escherichia coli CFT073
cagcaaaucguaggaguaauc

SEQ ID NO: 606478 - RNA, 14 nt, Escherichia coli CFT073
cagcaaaacacccc

SEQ ID NO: 606479 - RNA, 22 nt, Escherichia coli CFT073
cagcaaaaugguacucggcacg

SEQ ID NO: 606480 - RNA, 14 nt, Escherichia coli CFT073
cagauuuugcaggc

SEQ ID NO: 606481 - RNA, 16 nt, Escherichia coli CFT073
cagauggaucagcguu

SEQ ID NO: 606482 - RNA, 17 nt, Escherichia coli CFT073
cagauggcagugcgcca

SEQ ID NO: 606483 - RNA, 16 nt, Escherichia coli CFT073
cagauggcauccagcg

SEQ ID NO: 606484 - RNA, 23 nt, Escherichia coli CFT073
cagaugcugcucuucacgcccgc

SEQ ID NO: 606485 - RNA, 22 nt, Escherichia coli CFT073
cagaugccacaaucucgcccgc

SEQ ID NO: 606486 - RNA, 23 nt, Escherichia coli CFT073
cagaugaucuaccaguuccagcg

SEQ ID NO: 606487 - RNA, 19 nt, Escherichia coli CFT073
cagauugagaauaaugccu

SEQ ID NO: 606488 - RNA, 20 nt, Escherichia coli CFT073
cagauugugugacacuucuu

SEQ ID NO: 606489 - RNA, 12 nt, Escherichia coli CFT073
cagauuguugau

SEQ ID NO: 606490 - RNA, 17 nt, Escherichia coli CFT073
cagauucggauccagca

SEQ ID NO: 606491 - RNA, 18 nt, Escherichia coli CFT073
cagauugaacgcuggcgg

SEQ ID NO: 606492 - RNA, 17 nt, Escherichia coli CFT073
cagauuaccguugcggc

SEQ ID NO: 606493 - RNA, 14 nt, Escherichia coli CFT073
cagauuagccggua

SEQ ID NO: 606494 - RNA, 20 nt, Escherichia coli CFT073
cagauuauucaaaaacagau

SEQ ID NO: 606495 - RNA, 14 nt, Escherichia coli CFT073
cagauguuccgcca

SEQ ID NO: 606496 - RNA, 17 nt, Escherichia coli CFT073
cagauggcggcuggcgc

SEQ ID NO: 606497 - RNA, 18 nt, Escherichia coli CFT073
cagcaaugguucgugcaa

SEQ ID NO: 606498 - RNA, 21 nt, Escherichia coli CFT073
cagcacaaacgcaauccagug

SEQ ID NO: 606499 - RNA, 21 nt, Escherichia coli CFT073
cagcaccccgacagcaugcgu

SEQ ID NO: 606500 - RNA, 13 nt, Escherichia coli CFT073
cagcaccgcagag

SEQ ID NO: 606501 - RNA, 21 nt, Escherichia coli CFT073
cagcaccgaaguuaugccagu

SEQ ID NO: 606502 - RNA, 19 nt, Escherichia coli CFT073
cagcaccugaauccgcgau

SEQ ID NO: 606503 - RNA, 17 nt, Escherichia coli CFT073
cagcaccugcaucacgc

SEQ ID NO: 606504 - RNA, 17 nt, Escherichia coli CFT073
cagcacuggcggcagca

SEQ ID NO: 606505 - RNA, 18 nt, Escherichia coli CFT073
cagcacuuaucucuuccg

SEQ ID NO: 606506 - RNA, 21 nt, Escherichia coli CFT073
cagcacgcuuuuaacacguug

SEQ ID NO: 606507 - RNA, 16 nt, Escherichia coli CFT073
aaagacuauccgccau

SEQ ID NO: 606508 - RNA, 22 nt, Escherichia coli CFT073
aaagagaugaaugaauuuccgg

SEQ ID NO: 606509 - RNA, 18 nt, Escherichia coli CFT073
aaagacgguuaacgccag

SEQ ID NO: 606510 - RNA, 19 nt, Escherichia coli CFT073
cagagagcaaaccgccgau

SEQ ID NO: 606511 - RNA, 20 nt, Escherichia coli CFT073
cagagagccagccccacagc

SEQ ID NO: 606512 - RNA, 23 nt, Escherichia coli CFT073
cagagagacauuggcaaaaccaa

SEQ ID NO: 606513 - RNA, 13 nt, Escherichia coli CFT073
cagacgugcaccg

SEQ ID NO: 606514 - RNA, 21 nt, Escherichia coli CFT073
cagacguugauaaccacggcg

SEQ ID NO: 606515 - RNA, 19 nt, Escherichia coli CFT073
cagacguuugcaauuugca

SEQ ID NO: 606516 - RNA, 23 nt, Escherichia coli CFT073
cagacucaccugauuaccuacca

SEQ ID NO: 606517 - RNA, 24 nt, Escherichia coli CFT073
cagacucagcaacagguaacccag

SEQ ID NO: 606518 - RNA, 12 nt, Escherichia coli CFT073
cagacaauugcc

SEQ ID NO: 606519 - RNA, 15 nt, Escherichia coli CFT073
cagacaauccagcga

SEQ ID NO: 606520 - RNA, 11 nt, Escherichia coli CFT073
cagacaccacc

SEQ ID NO: 606521 - RNA, 17 nt, Escherichia coli CFT073
cagacacgccgccagac

SEQ ID NO: 606522 - RNA, 15 nt, Escherichia coli CFT073
cagacagaacgauga

SEQ ID NO: 606523 - RNA, 16 nt, Escherichia coli CFT073
cagacagaacgaugaa

SEQ ID NO: 606524 - RNA, 20 nt, Escherichia coli CFT073
cagaaugccucaaucagcgg

SEQ ID NO: 606525 - RNA, 16 nt, Escherichia coli CFT073
cagaauuugaggaagc

SEQ ID NO: 606526 - RNA, 17 nt, Escherichia coli CFT073
cagaauuugaggaagcu

SEQ ID NO: 606527 - RNA, 14 nt, Escherichia coli CFT073
cagaaucgcgcccc

SEQ ID NO: 606528 - RNA, 16 nt, Escherichia coli CFT073
cagaaucgguccgcca

SEQ ID NO: 606529 - RNA, 22 nt, Escherichia coli CFT073
cagaaucuaagaucccugccau

SEQ ID NO: 606530 - RNA, 16 nt, Escherichia coli CFT073
cagaaugaugcgguaa

SEQ ID NO: 606531 - RNA, 23 nt, Escherichia coli CFT073
cagacaaaauccugccagcguga

SEQ ID NO: 606532 - RNA, 14 nt, Escherichia coli CFT073
cagaauugccgccu

SEQ ID NO: 606533 - RNA, 22 nt, Escherichia coli CFT073
cagacaaaugucagaaagaaau

SEQ ID NO: 606534 - RNA, 14 nt, Escherichia coli CFT073
cagacgcaacagaa

SEQ ID NO: 606535 - RNA, 13 nt, Escherichia coli CFT073
cagaccaaaacgu

SEQ ID NO: 606536 - RNA, 17 nt, Escherichia coli CFT073
cagacgauccuguucga

SEQ ID NO: 606537 - RNA, 14 nt, Escherichia coli CFT073
cagauaaaagcuuu

SEQ ID NO: 606538 - RNA, 21 nt, Escherichia coli CFT073
cagaguugagcaguccccaca

SEQ ID NO: 606539 - RNA, 17 nt, Escherichia coli CFT073
cagaguugcaccagcaa

SEQ ID NO: 606540 - RNA, 22 nt, Escherichia coli CFT073
cagauaaauggcacagugguca

SEQ ID NO: 606541 - RNA, 17 nt, Escherichia coli CFT073
cagauaggcaucagcaa

SEQ ID NO: 606542 - RNA, 20 nt, Escherichia coli CFT073
cagauagggcgagaaauuga

SEQ ID NO: 606543 - RNA, 16 nt, Escherichia coli CFT073
cagauaucccgccagc

SEQ ID NO: 606544 - RNA, 16 nt, Escherichia coli CFT073
cagauauguaucuacc

SEQ ID NO: 606545 - RNA, 19 nt, Escherichia coli CFT073
cagauauguaucuacccca

SEQ ID NO: 606546 - RNA, 19 nt, Escherichia coli CFT073
cagauaguucgcaaucgcg

SEQ ID NO: 606547 - RNA, 18 nt, Escherichia coli CFT073
cagaucacgcagcaagcc

SEQ ID NO: 606548 - RNA, 15 nt, Escherichia coli CFT073
cagaggauauucugc

SEQ ID NO: 606549 - RNA, 13 nt, Escherichia coli CFT073
cagaggaucugga

SEQ ID NO: 606550 - RNA, 11 nt, Escherichia coli CFT073
cagaguaucgc

SEQ ID NO: 606551 - RNA, 18 nt, Escherichia coli CFT073
cagaguauuuccagcuca

SEQ ID NO: 606552 - RNA, 15 nt, Escherichia coli CFT073
cagaggucuuuucuc

SEQ ID NO: 606553 - RNA, 19 nt, Escherichia coli CFT073
cagaguacgcaguugcuga

SEQ ID NO: 606554 - RNA, 17 nt, Escherichia coli CFT073
cagaucggcaaucgccu

SEQ ID NO: 606555 - RNA, 16 nt, Escherichia coli CFT073
cagaucgcucaucugc

SEQ ID NO: 606556 - RNA, 16 nt, Escherichia coli CFT073
cagaucuuccagcggc

SEQ ID NO: 606557 - RNA, 13 nt, Escherichia coli CFT073
cagaucguuaaug

SEQ ID NO: 606558 - RNA, 17 nt, Escherichia coli CFT073
cagaucaucaaagaaca

SEQ ID NO: 606559 - RNA, 22 nt, Escherichia coli CFT073
cagauccaaaccgacugccugc

SEQ ID NO: 606560 - RNA, 19 nt, Escherichia coli CFT073
cagauccaguuacccagcg

SEQ ID NO: 606561 - RNA, 21 nt, Escherichia coli CFT073
cagauccaguuacccagcgga

SEQ ID NO: 606562 - RNA, 13 nt, Escherichia coli CFT073
cagaucgcgaccg

SEQ ID NO: 606563 - RNA, 12 nt, Escherichia coli CFT073
cacuuugcuggu

SEQ ID NO: 606564 - RNA, 14 nt, Escherichia coli CFT073
cacuuuguaggccu

SEQ ID NO: 606565 - RNA, 16 nt, Escherichia coli CFT073
cagaaauaaucaccug

SEQ ID NO: 606566 - RNA, 18 nt, Escherichia coli CFT073
cagaaauaccccgccagc

SEQ ID NO: 606567 - RNA, 23 nt, Escherichia coli CFT073
cagaaauagaccggagaaaagac

SEQ ID NO: 606568 - RNA, 20 nt, Escherichia coli CFT073
cagaaauagagaaagagugc

SEQ ID NO: 606569 - RNA, 22 nt, Escherichia coli CFT073
cagaaauagagaaagagugcgc

SEQ ID NO: 606570 - RNA, 17 nt, Escherichia coli CFT073
cacuuuaugauccagcu

SEQ ID NO: 606571 - RNA, 16 nt, Escherichia coli CFT073
cacuuuauuaacaagc

SEQ ID NO: 606572 - RNA, 17 nt, Escherichia coli CFT073
cacuuucaaauccagcc

SEQ ID NO: 606573 - RNA, 13 nt, Escherichia coli CFT073
cacuuucaccggu

SEQ ID NO: 606574 - RNA, 23 nt, Escherichia coli CFT073
cacuuucaucgcggucagcugcu

SEQ ID NO: 606575 - RNA, 13 nt, Escherichia coli CFT073
cacuuuccaggcg

SEQ ID NO: 606576 - RNA, 12 nt, Escherichia coli CFT073
cacuuuccugcu

SEQ ID NO: 606577 - RNA, 15 nt, Escherichia coli CFT073
cagaacaggcgcgaa

SEQ ID NO: 606578 - RNA, 18 nt, Escherichia coli CFT073
cagaaaucggccuuccau

SEQ ID NO: 606579 - RNA, 19 nt, Escherichia coli CFT073
cagaacaaugaucgacagg

SEQ ID NO: 606580 - RNA, 20 nt, Escherichia coli CFT073
cagaauccccacaaaccacc

SEQ ID NO: 606581 - RNA, 17 nt, Escherichia coli CFT073
cagaagaaagccggaug

SEQ ID NO: 606582 - RNA, 18 nt, Escherichia coli CFT073
cagaagaaagccggauga

SEQ ID NO: 606583 - RNA, 19 nt, Escherichia coli CFT073
cagaacugcugcgccagcg

SEQ ID NO: 606584 - RNA, 19 nt, Escherichia coli CFT073
cagaacggugagcgugcgg

SEQ ID NO: 606585 - RNA, 16 nt, Escherichia coli CFT073
cagaacggugcgacca

SEQ ID NO: 606586 - RNA, 14 nt, Escherichia coli CFT073
cagaacgcgugcgc

SEQ ID NO: 606587 - RNA, 20 nt, Escherichia coli CFT073
cagaaccgcccagaccugcg

SEQ ID NO: 606588 - RNA, 19 nt, Escherichia coli CFT073
cagaaccggagucaguccc

SEQ ID NO: 606589 - RNA, 14 nt, Escherichia coli CFT073
cagaacgccaugcc

SEQ ID NO: 606590 - RNA, 23 nt, Escherichia coli CFT073
cagaacgccgaauaacgcgcagc

SEQ ID NO: 606591 - RNA, 14 nt, Escherichia coli CFT073
cacuggcaccgcag

SEQ ID NO: 606592 - RNA, 23 nt, Escherichia coli CFT073
cacuggcaacacuuuaucugcca

SEQ ID NO: 606593 - RNA, 15 nt, Escherichia coli CFT073
cacuucaucgucaua

SEQ ID NO: 606594 - RNA, 14 nt, Escherichia coli CFT073
cacuucaugcccca

SEQ ID NO: 606595 - RNA, 20 nt, Escherichia coli CFT073
cacuucaugggcuuucucgc

SEQ ID NO: 606596 - RNA, 19 nt, Escherichia coli CFT073
cacuuccugauccgcuuua

SEQ ID NO: 606597 - RNA, 21 nt, Escherichia coli CFT073
cacuuccgcguaguugcgcug

SEQ ID NO: 606598 - RNA, 13 nt, Escherichia coli CFT073
cacuuccggcaac

SEQ ID NO: 606599 - RNA, 13 nt, Escherichia coli CFT073
cacuuccagcagu

SEQ ID NO: 606600 - RNA, 13 nt, Escherichia coli CFT073
cacuuccagcaga

SEQ ID NO: 606601 - RNA, 16 nt, Escherichia coli CFT073
cacuugcaggaacaau

SEQ ID NO: 606602 - RNA, 16 nt, Escherichia coli CFT073
cacuugguuugcuggu

SEQ ID NO: 606603 - RNA, 14 nt, Escherichia coli CFT073
cacuugccugcugu

SEQ ID NO: 606604 - RNA, 17 nt, Escherichia coli CFT073
cacuugccugcugugaa

SEQ ID NO: 606605 - RNA, 19 nt, Escherichia coli CFT073
cacuugaguaauuaauacg

SEQ ID NO: 606606 - RNA, 18 nt, Escherichia coli CFT073
cacuucgcugacgccugc

SEQ ID NO: 606607 - RNA, 20 nt, Escherichia coli CFT073
cacuucuucuuguucaucau

SEQ ID NO: 606608 - RNA, 20 nt, Escherichia coli CFT073
cacuucuuucacgcccgcgu

SEQ ID NO: 606609 - RNA, 16 nt, Escherichia coli CFT073
cacuaucgccgagaua

SEQ ID NO: 606610 - RNA, 14 nt, Escherichia coli CFT073
cacuauuuaccgcc

SEQ ID NO: 606611 - RNA, 15 nt, Escherichia coli CFT073
cacucaccgccguua

SEQ ID NO: 606612 - RNA, 13 nt, Escherichia coli CFT073
cacucacgcugcg

SEQ ID NO: 606613 - RNA, 15 nt, Escherichia coli CFT073
cacucagcccauacc

SEQ ID NO: 606614 - RNA, 17 nt, Escherichia coli CFT073
cacucagccagccgaac

SEQ ID NO: 606615 - RNA, 18 nt, Escherichia coli CFT073
cacucaucacuccccgca

SEQ ID NO: 606616 - RNA, 18 nt, Escherichia coli CFT073
cacguugcaucacccgcu

SEQ ID NO: 606617 - RNA, 15 nt, Escherichia coli CFT073
cacguugccagcaac

SEQ ID NO: 606618 - RNA, 17 nt, Escherichia coli CFT073
cacguugcgacaaacca

SEQ ID NO: 606619 - RNA, 18 nt, Escherichia coli CFT073
cacuagucccuccgcaca

SEQ ID NO: 606620 - RNA, 20 nt, Escherichia coli CFT073
cacuauacaaccagauaacc

SEQ ID NO: 606621 - RNA, 21 nt, Escherichia coli CFT073
cacuaucaaccacggcaacgc

SEQ ID NO: 606622 - RNA, 23 nt, Escherichia coli CFT073
cacgcgaccgucuuuauccagca

SEQ ID NO: 606623 - RNA, 16 nt, Escherichia coli CFT073
cacugccagcccggca

SEQ ID NO: 606624 - RNA, 21 nt, Escherichia coli CFT073
cacugcagaauauccgccgua

SEQ ID NO: 606625 - RNA, 23 nt, Escherichia coli CFT073
cacugcauucggcgaccagcgca

SEQ ID NO: 606626 - RNA, 22 nt, Escherichia coli CFT073
cacugcacgaugccucaucaca

SEQ ID NO: 606627 - RNA, 19 nt, Escherichia coli CFT073
cacugaugcggugacagag

SEQ ID NO: 606628 - RNA, 17 nt, Escherichia coli CFT073
cacugauuguucagucg

SEQ ID NO: 606629 - RNA, 21 nt, Escherichia coli CFT073
cacugcgccauuaaugccgca

SEQ ID NO: 606630 - RNA, 16 nt, Escherichia coli CFT073
cacugcgcccgccagc

SEQ ID NO: 606631 - RNA, 19 nt, Escherichia coli CFT073
cacugcgcccgccagcauc

SEQ ID NO: 606632 - RNA, 22 nt, Escherichia coli CFT073
cacuccacugcgcauaauccac

SEQ ID NO: 606633 - RNA, 14 nt, Escherichia coli CFT073
cacuccaguccacc

SEQ ID NO: 606634 - RNA, 14 nt, Escherichia coli CFT073
cacucccgcgcuuc

SEQ ID NO: 606635 - RNA, 17 nt, Escherichia coli CFT073
cacugauagugcugcca

SEQ ID NO: 606636 - RNA, 13 nt, Escherichia coli CFT073
cacgaugcagcgu

SEQ ID NO: 606637 - RNA, 19 nt, Escherichia coli CFT073
cacgauuggguaacgcacg

SEQ ID NO: 606638 - RNA, 20 nt, Escherichia coli CFT073
cacgauuugcguaaaaccug

SEQ ID NO: 606639 - RNA, 16 nt, Escherichia coli CFT073
cacgcagagcaucauu

SEQ ID NO: 606640 - RNA, 18 nt, Escherichia coli CFT073
cacgcagaucgguugcca

SEQ ID NO: 606641 - RNA, 12 nt, Escherichia coli CFT073
cacgcaaagcac

SEQ ID NO: 606642 - RNA, 20 nt, Escherichia coli CFT073
cacgauuccaacgaaaauga

SEQ ID NO: 606643 - RNA, 15 nt, Escherichia coli CFT073
cacgcaacaugucag

SEQ ID NO: 606644 - RNA, 19 nt, Escherichia coli CFT073
cacgcccgcacugucgcca

SEQ ID NO: 606645 - RNA, 20 nt, Escherichia coli CFT073
cacgccaguguuucgacaau

SEQ ID NO: 606646 - RNA, 14 nt, Escherichia coli CFT073
cacgcaucugcaca

SEQ ID NO: 606647 - RNA, 21 nt, Escherichia coli CFT073
cacgccaacguguugcugcau

SEQ ID NO: 606648 - RNA, 13 nt, Escherichia coli CFT073
cacgcaucacgac

SEQ ID NO: 606649 - RNA, 23 nt, Escherichia coli CFT073
cacgcaucacgacaaccgggauc

SEQ ID NO: 606650 - RNA, 14 nt, Escherichia coli CFT073
cacgccaauuacgc

SEQ ID NO: 606651 - RNA, 13 nt, Escherichia coli CFT073
cacgccgcaucag

SEQ ID NO: 606652 - RNA, 15 nt, Escherichia coli CFT073
cacgccgccagacca

SEQ ID NO: 606653 - RNA, 16 nt, Escherichia coli CFT073
cacgccuucuuccagc

SEQ ID NO: 606654 - RNA, 13 nt, Escherichia coli CFT073
cacgccgcuggca

SEQ ID NO: 606655 - RNA, 19 nt, Escherichia coli CFT073
cacgauaucgauaugacca

SEQ ID NO: 606656 - RNA, 17 nt, Escherichia coli CFT073
cacgacucaaaucacgc

SEQ ID NO: 606657 - RNA, 20 nt, Escherichia coli CFT073
cacgacguuucuuucgauug

SEQ ID NO: 606658 - RNA, 15 nt, Escherichia coli CFT073
cacgagguugcagau

SEQ ID NO: 606659 - RNA, 23 nt, Escherichia coli CFT073
cacgacaugacccggcguaugcc

SEQ ID NO: 606660 - RNA, 14 nt, Escherichia coli CFT073
cacgaauuccgccu

SEQ ID NO: 606661 - RNA, 20 nt, Escherichia coli CFT073
cacgacaaaugcgccgccaa

SEQ ID NO: 606662 - RNA, 23 nt, Escherichia coli CFT073
cacgaauacguaaugucggugaa

SEQ ID NO: 606663 - RNA, 13 nt, Escherichia coli CFT073
cacgaaucgauaa

SEQ ID NO: 606664 - RNA, 19 nt, Escherichia coli CFT073
cacgacggaauuucauaug

SEQ ID NO: 606665 - RNA, 18 nt, Escherichia coli CFT073
cacgaccaggaacgccau

SEQ ID NO: 606666 - RNA, 15 nt, Escherichia coli CFT073
cacgacgccagccaa

SEQ ID NO: 606667 - RNA, 15 nt, Escherichia coli CFT073
caccuguucacgacc

SEQ ID NO: 606668 - RNA, 19 nt, Escherichia coli CFT073
caccuucaaaauuuaacau

SEQ ID NO: 606669 - RNA, 13 nt, Escherichia coli CFT073
caccuucauucag

SEQ ID NO: 606670 - RNA, 20 nt, Escherichia coli CFT073
caccuggcggcguguuaucc

SEQ ID NO: 606671 - RNA, 23 nt, Escherichia coli CFT073
caccugccaguuuacccagugaa

SEQ ID NO: 606672 - RNA, 19 nt, Escherichia coli CFT073
caccuucuccggccuacaa

SEQ ID NO: 606673 - RNA, 17 nt, Escherichia coli CFT073
caccuuucaccagcgcc

SEQ ID NO: 606674 - RNA, 22 nt, Escherichia coli CFT073
caccuuuccccggcagcaucag

SEQ ID NO: 606675 - RNA, 14 nt, Escherichia coli CFT073
cacgaaaacccuca

SEQ ID NO: 606676 - RNA, 14 nt, Escherichia coli CFT073
cacgaaaucuucca

SEQ ID NO: 606677 - RNA, 16 nt, Escherichia coli CFT073
cacgaagcccauuuca

SEQ ID NO: 606678 - RNA, 12 nt, Escherichia coli CFT073
caccguaaccac

SEQ ID NO: 606679 - RNA, 14 nt, Escherichia coli CFT073
caccguauccagug

SEQ ID NO: 606680 - RNA, 17 nt, Escherichia coli CFT073
caccguacuccugugca

SEQ ID NO: 606681 - RNA, 15 nt, Escherichia coli CFT073
caccgucaacguuuu

SEQ ID NO: 606682 - RNA, 13 nt, Escherichia coli CFT073
caccggucagaca

SEQ ID NO: 606683 - RNA, 18 nt, Escherichia coli CFT073
caccggugaccaucagca

SEQ ID NO: 606684 - RNA, 15 nt, Escherichia coli CFT073
caccgguaucugcca

SEQ ID NO: 606685 - RNA, 17 nt, Escherichia coli CFT073
caccggcguaacgccgc

SEQ ID NO: 606686 - RNA, 19 nt, Escherichia coli CFT073
caccgcuucgcucacauca

SEQ ID NO: 606687 - RNA, 14 nt, Escherichia coli CFT073
caccggaaauugcu

SEQ ID NO: 606688 - RNA, 19 nt, Escherichia coli CFT073
caccggaacuuucaccacg

SEQ ID NO: 606689 - RNA, 14 nt, Escherichia coli CFT073
caccugccaccagc

SEQ ID NO: 606690 - RNA, 15 nt, Escherichia coli CFT073
caccugauaacggcc

SEQ ID NO: 606691 - RNA, 18 nt, Escherichia coli CFT073
caccugauuaguggcaca

SEQ ID NO: 606692 - RNA, 17 nt, Escherichia coli CFT073
caccugauugaccgcca

SEQ ID NO: 606693 - RNA, 17 nt, Escherichia coli CFT073
caccucuuccugaguaa

SEQ ID NO: 606694 - RNA, 16 nt, Escherichia coli CFT073
caccugaagaaaaucc

SEQ ID NO: 606695 - RNA, 12 nt, Escherichia coli CFT073
caccucgugcgc

SEQ ID NO: 606696 - RNA, 18 nt, Escherichia coli CFT073
caccgcagcaucgucauc

SEQ ID NO: 606697 - RNA, 19 nt, Escherichia coli CFT073
caccgcagccgccacaaua

SEQ ID NO: 606698 - RNA, 16 nt, Escherichia coli CFT073
caccgcaaagucggca

SEQ ID NO: 606699 - RNA, 13 nt, Escherichia coli CFT073
caccgccagcagc

SEQ ID NO: 606700 - RNA, 13 nt, Escherichia coli CFT073
caccgcaaaacgc

SEQ ID NO: 606701 - RNA, 22 nt, Escherichia coli CFT073
caccgcuuuaaaauuauccagc

SEQ ID NO: 606702 - RNA, 23 nt, Escherichia coli CFT073
caccgcuuuaaaauuauccagcg

SEQ ID NO: 606703 - RNA, 14 nt, Escherichia coli CFT073
caccgccgccgcca

SEQ ID NO: 606704 - RNA, 15 nt, Escherichia coli CFT073
caccgcccauccagg

SEQ ID NO: 606705 - RNA, 16 nt, Escherichia coli CFT073
caccgcccaccauaau

SEQ ID NO: 606706 - RNA, 21 nt, Escherichia coli CFT073
caccgcccaccauaaucagcg

SEQ ID NO: 606707 - RNA, 13 nt, Escherichia coli CFT073
cacagcaaaacgc

SEQ ID NO: 606708 - RNA, 21 nt, Escherichia coli CFT073
cacagcggacaucuggucgag

SEQ ID NO: 606709 - RNA, 20 nt, Escherichia coli CFT073
cacagcgccagacacuggaa

SEQ ID NO: 606710 - RNA, 16 nt, Escherichia coli CFT073
cacagaaugugaugcc

SEQ ID NO: 606711 - RNA, 19 nt, Escherichia coli CFT073
cacacugccagugucggau

SEQ ID NO: 606712 - RNA, 15 nt, Escherichia coli CFT073
cacacugcggccagc

SEQ ID NO: 606713 - RNA, 18 nt, Escherichia coli CFT073
cacacuguaagccaccga

SEQ ID NO: 606714 - RNA, 12 nt, Escherichia coli CFT073
cacacucaauga

SEQ ID NO: 606715 - RNA, 18 nt, Escherichia coli CFT073
cacacugacuuuaccugc

SEQ ID NO: 606716 - RNA, 23 nt, Escherichia coli CFT073
cacacugacuuuaccugccugac

SEQ ID NO: 606717 - RNA, 20 nt, Escherichia coli CFT073
cacacgacgcgccagcagcg

SEQ ID NO: 606718 - RNA, 18 nt, Escherichia coli CFT073
cacacggauauugcuaug

SEQ ID NO: 606719 - RNA, 14 nt, Escherichia coli CFT073
cacacggccaucac

SEQ ID NO: 606720 - RNA, 22 nt, Escherichia coli CFT073
cacaccgucagccagcacugac

SEQ ID NO: 606721 - RNA, 22 nt, Escherichia coli CFT073
cacaccagucagcgaacaccag

SEQ ID NO: 606722 - RNA, 19 nt, Escherichia coli CFT073
cacaccauacuguucggac

SEQ ID NO: 606723 - RNA, 21 nt, Escherichia coli CFT073
cacaccccggauuacgcauca

SEQ ID NO: 606724 - RNA, 22 nt, Escherichia coli CFT073
cacacccggccuaucaacgucg

SEQ ID NO: 606725 - RNA, 13 nt, Escherichia coli CFT073
cacacccugaugg

SEQ ID NO: 606726 - RNA, 13 nt, Escherichia coli CFT073
cacaccgcggaac

SEQ ID NO: 606727 - RNA, 20 nt, Escherichia coli CFT073
caccaacgauuuuuuccgca

SEQ ID NO: 606728 - RNA, 22 nt, Escherichia coli CFT073
cacauccgguaagcgauaacgc

SEQ ID NO: 606729 - RNA, 11 nt, Escherichia coli CFT073
cacauccgucc

SEQ ID NO: 606730 - RNA, 13 nt, Escherichia coli CFT073
cacaggcuggcgu

SEQ ID NO: 606731 - RNA, 13 nt, Escherichia coli CFT073
cacagcggcagca

SEQ ID NO: 606732 - RNA, 12 nt, Escherichia coli CFT073
caccacccaaca

SEQ ID NO: 606733 - RNA, 19 nt, Escherichia coli CFT073
caccacaucgguuugcgca

SEQ ID NO: 606734 - RNA, 16 nt, Escherichia coli CFT073
caccacaucgccgacc

SEQ ID NO: 606735 - RNA, 14 nt, Escherichia coli CFT073
caccaccgcaaaau

SEQ ID NO: 606736 - RNA, 14 nt, Escherichia coli CFT073
caccacaaaugcgc

SEQ ID NO: 606737 - RNA, 20 nt, Escherichia coli CFT073
caccacaacaccuuucacgc

SEQ ID NO: 606738 - RNA, 20 nt, Escherichia coli CFT073
caccacacgacgcgccagca

SEQ ID NO: 606739 - RNA, 15 nt, Escherichia coli CFT073
caccaaugacuauuu

SEQ ID NO: 606740 - RNA, 19 nt, Escherichia coli CFT073
caccaauuaaucccggauc

SEQ ID NO: 606741 - RNA, 16 nt, Escherichia coli CFT073
caccaaucaccgccaa

SEQ ID NO: 606742 - RNA, 13 nt, Escherichia coli CFT073
caccaaucagcgg

SEQ ID NO: 606743 - RNA, 15 nt, Escherichia coli CFT073
caccaacuuucacgc

SEQ ID NO: 606744 - RNA, 12 nt, Escherichia coli CFT073
caccagaaccgc

SEQ ID NO: 606745 - RNA, 23 nt, Escherichia coli CFT073
caccagaacgacgaccgccgcuc

SEQ ID NO: 606746 - RNA, 16 nt, Escherichia coli CFT073
caccagaaucgccagc

SEQ ID NO: 606747 - RNA, 17 nt, Escherichia coli CFT073
caccagaaucgccagca

SEQ ID NO: 606748 - RNA, 12 nt, Escherichia coli CFT073
caccagaaacag

SEQ ID NO: 606749 - RNA, 15 nt, Escherichia coli CFT073
caccacuuuaucggc

SEQ ID NO: 606750 - RNA, 14 nt, Escherichia coli CFT073
caccacuuccugcu

SEQ ID NO: 606751 - RNA, 17 nt, Escherichia coli CFT073
caccagcaccagcaaca

SEQ ID NO: 606752 - RNA, 13 nt, Escherichia coli CFT073
caccagcaauaau

SEQ ID NO: 606753 - RNA, 20 nt, Escherichia coli CFT073
caccagaugguuaguauugc

SEQ ID NO: 606754 - RNA, 12 nt, Escherichia coli CFT073
caccagcaacac

SEQ ID NO: 606755 - RNA, 19 nt, Escherichia coli CFT073
caccacugacaaucgccag

SEQ ID NO: 606756 - RNA, 15 nt, Escherichia coli CFT073
caccaccucacccgc

SEQ ID NO: 606757 - RNA, 18 nt, Escherichia coli CFT073
caccaccgucaucacgca

SEQ ID NO: 606758 - RNA, 16 nt, Escherichia coli CFT073
caccagcgccugcgcg

SEQ ID NO: 606759 - RNA, 15 nt, Escherichia coli CFT073
caccagcgccgccca

SEQ ID NO: 606760 - RNA, 19 nt, Escherichia coli CFT073
caccagccaguagaacaau

SEQ ID NO: 606761 - RNA, 18 nt, Escherichia coli CFT073
caccagccaguagcaccu

SEQ ID NO: 606762 - RNA, 20 nt, Escherichia coli CFT073
caccagcauuccuaaaccau

SEQ ID NO: 606763 - RNA, 19 nt, Escherichia coli CFT073
caccagcaucaacaacaau

SEQ ID NO: 606764 - RNA, 14 nt, Escherichia coli CFT073
caccagcagcagcg

SEQ ID NO: 606765 - RNA, 13 nt, Escherichia coli CFT073
cacccaucgccgu

SEQ ID NO: 606766 - RNA, 14 nt, Escherichia coli CFT073
cacccacaccaccg

SEQ ID NO: 606767 - RNA, 17 nt, Escherichia coli CFT073
cacccaccagcgccgaa

SEQ ID NO: 606768 - RNA, 17 nt, Escherichia coli CFT073
caccaucgaaauuagcg

SEQ ID NO: 606769 - RNA, 14 nt, Escherichia coli CFT073
caccaucaucggca

SEQ ID NO: 606770 - RNA, 14 nt, Escherichia coli CFT073
caccauccagcaac

SEQ ID NO: 606771 - RNA, 14 nt, Escherichia coli CFT073
caccauccccacca

SEQ ID NO: 606772 - RNA, 15 nt, Escherichia coli CFT073
caccaguaccgccgc

SEQ ID NO: 606773 - RNA, 23 nt, Escherichia coli CFT073
caccagucagaauguguuagcgc

SEQ ID NO: 606774 - RNA, 18 nt, Escherichia coli CFT073
caccagguucaacagcgu

SEQ ID NO: 606775 - RNA, 21 nt, Escherichia coli CFT073
caccaggcaagaauccgcccc

SEQ ID NO: 606776 - RNA, 20 nt, Escherichia coli CFT073
caaucaucaacccgcgcgcu

SEQ ID NO: 606777 - RNA, 19 nt, Escherichia coli CFT073
caaucauugauaauaacgu

SEQ ID NO: 606778 - RNA, 18 nt, Escherichia coli CFT073
caauccaguacaugaagc

SEQ ID NO: 606779 - RNA, 20 nt, Escherichia coli CFT073
caaucagguaagcgaaggug

SEQ ID NO: 606780 - RNA, 15 nt, Escherichia coli CFT073
caaucaguaaucgcg

SEQ ID NO: 606781 - RNA, 17 nt, Escherichia coli CFT073
caaucaguaaucgcgcc

SEQ ID NO: 606782 - RNA, 13 nt, Escherichia coli CFT073
caaucauaaacgc

SEQ ID NO: 606783 - RNA, 20 nt, Escherichia coli CFT073
caaucccguaggauuucuuc

SEQ ID NO: 606784 - RNA, 23 nt, Escherichia coli CFT073
caaucccguugaaaaugcugguu

SEQ ID NO: 606785 - RNA, 20 nt, Escherichia coli CFT073
caauccaguacaugaagcac

SEQ ID NO: 606786 - RNA, 14 nt, Escherichia coli CFT073
caauccccgccagc

SEQ ID NO: 606787 - RNA, 12 nt, Escherichia coli CFT073
caaucgccagaa

SEQ ID NO: 606788 - RNA, 12 nt, Escherichia coli CFT073
caaucgccagag

SEQ ID NO: 606789 - RNA, 12 nt, Escherichia coli CFT073
caaucgccagau

SEQ ID NO: 606790 - RNA, 22 nt, Escherichia coli CFT073
caaucgccgccaguuccaggca

SEQ ID NO: 606791 - RNA, 14 nt, Escherichia coli CFT073
caaucgcgccagaa

SEQ ID NO: 606792 - RNA, 14 nt, Escherichia coli CFT073
caaucgcggcagcg

SEQ ID NO: 606793 - RNA, 19 nt, Escherichia coli CFT073
caaucgcggugguuaccag

SEQ ID NO: 606794 - RNA, 23 nt, Escherichia coli CFT073
caauacccguacgguuuagugcc

SEQ ID NO: 606795 - RNA, 20 nt, Escherichia coli CFT073
caauacaaaauaggcaaaaa

SEQ ID NO: 606796 - RNA, 12 nt, Escherichia coli CFT073
caauacauagaa

SEQ ID NO: 606797 - RNA, 20 nt, Escherichia coli CFT073
caauacauagccaucugccu

SEQ ID NO: 606798 - RNA, 16 nt, Escherichia coli CFT073
caauaccuucugcgcc

SEQ ID NO: 606799 - RNA, 20 nt, Escherichia coli CFT073
caauacgauuaacgccagac

SEQ ID NO: 606800 - RNA, 13 nt, Escherichia coli CFT073
caaucagcggcgu

SEQ ID NO: 606801 - RNA, 17 nt, Escherichia coli CFT073
caaucagcggcucaugu

SEQ ID NO: 606802 - RNA, 20 nt, Escherichia coli CFT073
caaucagcggugccgcgaua

SEQ ID NO: 606803 - RNA, 21 nt, Escherichia coli CFT073
caaucagcguaaaggccggaa

SEQ ID NO: 606804 - RNA, 14 nt, Escherichia coli CFT073
caaucagcgucgcg

SEQ ID NO: 606805 - RNA, 15 nt, Escherichia coli CFT073
caaucagcgucgcgu

SEQ ID NO: 606806 - RNA, 18 nt, Escherichia coli CFT073
caaugagcugaacgucgc

SEQ ID NO: 606807 - RNA, 13 nt, Escherichia coli CFT073
caaugcccuguga

SEQ ID NO: 606808 - RNA, 14 nt, Escherichia coli CFT073
caaugccgcgcugu

SEQ ID NO: 606809 - RNA, 18 nt, Escherichia coli CFT073
caaugccgcuucgagcug

SEQ ID NO: 606810 - RNA, 19 nt, Escherichia coli CFT073
caaugccguaaccagcgca

SEQ ID NO: 606811 - RNA, 22 nt, Escherichia coli CFT073
caaugccguaaccagcgcagac

SEQ ID NO: 606812 - RNA, 23 nt, Escherichia coli CFT073
caaugccgucaccagcaucaaca

SEQ ID NO: 606813 - RNA, 19 nt, Escherichia coli CFT073
caaugcgcgccccugaugg

SEQ ID NO: 606814 - RNA, 12 nt, Escherichia coli CFT073
caaugcgccaac

SEQ ID NO: 606815 - RNA, 13 nt, Escherichia coli CFT073
caaugaauuaaaa

SEQ ID NO: 606816 - RNA, 21 nt, Escherichia coli CFT073
caaugacagccccaccagcaa

SEQ ID NO: 606817 - RNA, 15 nt, Escherichia coli CFT073
caaucgcucccagcc

SEQ ID NO: 606818 - RNA, 17 nt, Escherichia coli CFT073
caaucgcuuaauccgcg

SEQ ID NO: 606819 - RNA, 15 nt, Escherichia coli CFT073
caaucggcccgccca

SEQ ID NO: 606820 - RNA, 18 nt, Escherichia coli CFT073
caaucggcguaccgcaca

SEQ ID NO: 606821 - RNA, 16 nt, Escherichia coli CFT073
caaucgguaacgcuug

SEQ ID NO: 606822 - RNA, 17 nt, Escherichia coli CFT073
caauuguauccaugcgc

SEQ ID NO: 606823 - RNA, 19 nt, Escherichia coli CFT073
cacaacgagucgccuacca

SEQ ID NO: 606824 - RNA, 22 nt, Escherichia coli CFT073
cacaaccugaguaaaucaccug

SEQ ID NO: 606825 - RNA, 13 nt, Escherichia coli CFT073
cacaaccgccauc

SEQ ID NO: 606826 - RNA, 17 nt, Escherichia coli CFT073
cacaaccgccggaugcg

SEQ ID NO: 606827 - RNA, 21 nt, Escherichia coli CFT073
cacaaccgccggaugcggcgu

SEQ ID NO: 606828 - RNA, 18 nt, Escherichia coli CFT073
cacaacauucccaucagu

SEQ ID NO: 606829 - RNA, 18 nt, Escherichia coli CFT073
cacaaccaauggccaaug

SEQ ID NO: 606830 - RNA, 23 nt, Escherichia coli CFT073
caauguuaacuguuuaucgucac

SEQ ID NO: 606831 - RNA, 13 nt, Escherichia coli CFT073
caauugccggaug

SEQ ID NO: 606832 - RNA, 22 nt, Escherichia coli CFT073
caaugugcucuaacccuuccag

SEQ ID NO: 606833 - RNA, 15 nt, Escherichia coli CFT073
caauguggagagcaa

SEQ ID NO: 606834 - RNA, 16 nt, Escherichia coli CFT073
caauguccguaacaua

SEQ ID NO: 606835 - RNA, 21 nt, Escherichia coli CFT073
caauguagccacggaucacac

SEQ ID NO: 606836 - RNA, 16 nt, Escherichia coli CFT073
caauguaggccugaua

SEQ ID NO: 606837 - RNA, 20 nt, Escherichia coli CFT073
caauggugguggucugguaa

SEQ ID NO: 606838 - RNA, 12 nt, Escherichia coli CFT073
cacaauggucaa

SEQ ID NO: 606839 - RNA, 18 nt, Escherichia coli CFT073
cacacaaaauugccgcua

SEQ ID NO: 606840 - RNA, 15 nt, Escherichia coli CFT073
cacacacgcccaguu

SEQ ID NO: 606841 - RNA, 23 nt, Escherichia coli CFT073
cacacacgcccaguucaaacggc

SEQ ID NO: 606842 - RNA, 18 nt, Escherichia coli CFT073
cacacacuaccgccgagc

SEQ ID NO: 606843 - RNA, 18 nt, Escherichia coli CFT073
cacaaucggcguaccgca

SEQ ID NO: 606844 - RNA, 14 nt, Escherichia coli CFT073
cacaauccgccagg

SEQ ID NO: 606845 - RNA, 13 nt, Escherichia coli CFT073
cacaauccgcgag

SEQ ID NO: 606846 - RNA, 18 nt, Escherichia coli CFT073
cacaccagcaauagcgca

SEQ ID NO: 606847 - RNA, 16 nt, Escherichia coli CFT073
cacaacguacaccgca

SEQ ID NO: 606848 - RNA, 19 nt, Escherichia coli CFT073
cacaacguacaccgcagcc

SEQ ID NO: 606849 - RNA, 22 nt, Escherichia coli CFT073
cacaacugcgaccguacaacca

SEQ ID NO: 606850 - RNA, 20 nt, Escherichia coli CFT073
cacaacuucgcaaacacccg

SEQ ID NO: 606851 - RNA, 17 nt, Escherichia coli CFT073
cacaauaccuucugcgc

SEQ ID NO: 606852 - RNA, 23 nt, Escherichia coli CFT073
cacaauaccuucugcgcccgccc

SEQ ID NO: 606853 - RNA, 22 nt, Escherichia coli CFT073
cacaauaaucagcccaaccacg

SEQ ID NO: 606854 - RNA, 15 nt, Escherichia coli CFT073
caacuucagcagcag

SEQ ID NO: 606855 - RNA, 17 nt, Escherichia coli CFT073
caacugugccgcgacca

SEQ ID NO: 606856 - RNA, 11 nt, Escherichia coli CFT073
caacugugcgg

SEQ ID NO: 606857 - RNA, 22 nt, Escherichia coli CFT073
caacugugcggcaauuagcggc

SEQ ID NO: 606858 - RNA, 19 nt, Escherichia coli CFT073
caacuuaucgggauggugu

SEQ ID NO: 606859 - RNA, 15 nt, Escherichia coli CFT073
caacuccaucaagcu

SEQ ID NO: 606860 - RNA, 16 nt, Escherichia coli CFT073
caagcaccauaaacac

SEQ ID NO: 606861 - RNA, 17 nt, Escherichia coli CFT073
caagcacccaaugccau

SEQ ID NO: 606862 - RNA, 22 nt, Escherichia coli CFT073
caagcagagagacgaucgccac

SEQ ID NO: 606863 - RNA, 22 nt, Escherichia coli CFT073
caagcagcugccagacccggca

SEQ ID NO: 606864 - RNA, 16 nt, Escherichia coli CFT073
caagccaaauccagca

SEQ ID NO: 606865 - RNA, 23 nt, Escherichia coli CFT073
caagcauauggauaugaucugca

SEQ ID NO: 606866 - RNA, 13 nt, Escherichia coli CFT073
caagcccgccaga

SEQ ID NO: 606867 - RNA, 20 nt, Escherichia coli CFT073
caagcccgccagaccagcua

SEQ ID NO: 606868 - RNA, 22 nt, Escherichia coli CFT073
caagaaucacuucaucgccgcu

SEQ ID NO: 606869 - RNA, 21 nt, Escherichia coli CFT073
caagaaccaugcaaucacugc

SEQ ID NO: 606870 - RNA, 17 nt, Escherichia coli CFT073
caacuuggagacgccgu

SEQ ID NO: 606871 - RNA, 22 nt, Escherichia coli CFT073
caagauuaaagcagguagcgcc

SEQ ID NO: 606872 - RNA, 21 nt, Escherichia coli CFT073
caaguucgaacgccgccagua

SEQ ID NO: 606873 - RNA, 13 nt, Escherichia coli CFT073
caaguuucaauau

SEQ ID NO: 606874 - RNA, 16 nt, Escherichia coli CFT073
caaguuucaauauccg

SEQ ID NO: 606875 - RNA, 21 nt, Escherichia coli CFT073
caauaaaaaaucccgccgaug

SEQ ID NO: 606876 - RNA, 21 nt, Escherichia coli CFT073
caagucucaagagugaacacg

SEQ ID NO: 606877 - RNA, 21 nt, Escherichia coli CFT073
  misc_feature (10)..(10): n is a, c, g or u
caagucucangagugaacacg

SEQ ID NO: 606878 - RNA, 19 nt, Escherichia coli CFT073
caauaagcacucuggcgaa

SEQ ID NO: 606879 - RNA, 17 nt, Escherichia coli CFT073
caauaacgguaguggca

SEQ ID NO: 606880 - RNA, 20 nt, Escherichia coli CFT073
caauaaucagcccaaccacg

SEQ ID NO: 606881 - RNA, 21 nt, Escherichia coli CFT073
caauaaucaugcagcgcagac

SEQ ID NO: 606882 - RNA, 16 nt, Escherichia coli CFT073
caauaaucauucgccc

SEQ ID NO: 606883 - RNA, 13 nt, Escherichia coli CFT073
caauaauccacgg

SEQ ID NO: 606884 - RNA, 15 nt, Escherichia coli CFT073
caauaauaucuuucu

SEQ ID NO: 606885 - RNA, 16 nt, Escherichia coli CFT073
caauaaucgccuuacc

SEQ ID NO: 606886 - RNA, 12 nt, Escherichia coli CFT073
caauaaucugcc

SEQ ID NO: 606887 - RNA, 16 nt, Escherichia coli CFT073
caauaauggaaccuaa

SEQ ID NO: 606888 - RNA, 21 nt, Escherichia coli CFT073
caauaaccagcguuuccagca

SEQ ID NO: 606889 - RNA, 18 nt, Escherichia coli CFT073
caauaaccaucagcuccg

SEQ ID NO: 606890 - RNA, 17 nt, Escherichia coli CFT073
caauaacaucggcuguu

SEQ ID NO: 606891 - RNA, 14 nt, Escherichia coli CFT073
caagcgcaauauca

SEQ ID NO: 606892 - RNA, 23 nt, Escherichia coli CFT073
caagcccaggccaucgccaccgg

SEQ ID NO: 606893 - RNA, 14 nt, Escherichia coli CFT073
caagcggcgcaugc

SEQ ID NO: 606894 - RNA, 17 nt, Escherichia coli CFT073
caagcgcugugaaacac

SEQ ID NO: 606895 - RNA, 14 nt, Escherichia coli CFT073
caagcgucgcauca

SEQ ID NO: 606896 - RNA, 23 nt, Escherichia coli CFT073
caaggucaugaugcuccgccagc

SEQ ID NO: 606897 - RNA, 15 nt, Escherichia coli CFT073
caaggguugccggau

SEQ ID NO: 606898 - RNA, 17 nt, Escherichia coli CFT073
auuuguacucuuccggu

SEQ ID NO: 606899 - RNA, 14 nt, Escherichia coli CFT073
auuuguggcgaugg

SEQ ID NO: 606900 - RNA, 14 nt, Escherichia coli CFT073
auuuguugccggau

SEQ ID NO: 606901 - RNA, 21 nt, Escherichia coli CFT073
auuuguuuuucaggaaauaaa

SEQ ID NO: 606902 - RNA, 14 nt, Escherichia coli CFT073
auuuuaaaauugua

SEQ ID NO: 606903 - RNA, 15 nt, Escherichia coli CFT073
auuugcgaguccgcu

SEQ ID NO: 606904 - RNA, 12 nt, Escherichia coli CFT073
auuugcggcaga

SEQ ID NO: 606905 - RNA, 13 nt, Escherichia coli CFT073
auuugcuccgcca

SEQ ID NO: 606906 - RNA, 14 nt, Escherichia coli CFT073
auuugcuugccgga

SEQ ID NO: 606907 - RNA, 17 nt, Escherichia coli CFT073
auuuggcggggauuuuu

SEQ ID NO: 606908 - RNA, 13 nt, Escherichia coli CFT073
auuucuucggcug

SEQ ID NO: 606909 - RNA, 13 nt, Escherichia coli CFT073
auuucuuuaucac

SEQ ID NO: 606910 - RNA, 13 nt, Escherichia coli CFT073
auuucuccuguuc

SEQ ID NO: 606911 - RNA, 14 nt, Escherichia coli CFT073
auuucuccuguucc

SEQ ID NO: 606912 - RNA, 18 nt, Escherichia coli CFT073
auuucuacuuauucacca

SEQ ID NO: 606913 - RNA, 19 nt, Escherichia coli CFT073
auuucucauuuugauuaau

SEQ ID NO: 606914 - RNA, 17 nt, Escherichia coli CFT073
auuucuuuuuuucauug

SEQ ID NO: 606915 - RNA, 14 nt, Escherichia coli CFT073
auuugaaaugacgc

SEQ ID NO: 606916 - RNA, 14 nt, Escherichia coli CFT073
auuugaacuggaaa

SEQ ID NO: 606917 - RNA, 22 nt, Escherichia coli CFT073
auuuucaccgugaauugcacuu

SEQ ID NO: 606918 - RNA, 23 nt, Escherichia coli CFT073
auuuucccugcguauuuuugcug

SEQ ID NO: 606919 - RNA, 16 nt, Escherichia coli CFT073
auuuucaggucguuca

SEQ ID NO: 606920 - RNA, 16 nt, Escherichia coli CFT073
auuuuccuugaaaaag

SEQ ID NO: 606921 - RNA, 13 nt, Escherichia coli CFT073
auuuucgccgccg

SEQ ID NO: 606922 - RNA, 16 nt, Escherichia coli CFT073
auuuucgccgccgcgg

SEQ ID NO: 606923 - RNA, 22 nt, Escherichia coli CFT073
auuuucguuccaggacuggcga

SEQ ID NO: 606924 - RNA, 21 nt, Escherichia coli CFT073
auuuucuugccggaugcggcg

SEQ ID NO: 606925 - RNA, 14 nt, Escherichia coli CFT073
auuuugaacagaac

SEQ ID NO: 606926 - RNA, 14 nt, Escherichia coli CFT073
caaaaauaucgccu

SEQ ID NO: 606927 - RNA, 21 nt, Escherichia coli CFT073
caaaaaguaguuccagcauga

SEQ ID NO: 606928 - RNA, 16 nt, Escherichia coli CFT073
caaaacauacuuucuc

SEQ ID NO: 606929 - RNA, 22 nt, Escherichia coli CFT073
caaaacauaucccaccagcgcc

SEQ ID NO: 606930 - RNA, 23 nt, Escherichia coli CFT073
caaaacauguggauuaaauugcg

SEQ ID NO: 606931 - RNA, 22 nt, Escherichia coli CFT073
caaaaccacauggagcuuuaaa

SEQ ID NO: 606932 - RNA, 12 nt, Escherichia coli CFT073
caaaaauaaaug

SEQ ID NO: 606933 - RNA, 15 nt, Escherichia coli CFT073
caaaaauaaucaucu

SEQ ID NO: 606934 - RNA, 17 nt, Escherichia coli CFT073
caaaaagaauaaauauc

SEQ ID NO: 606935 - RNA, 22 nt, Escherichia coli CFT073
caaaaagagaguuacuggcgag

SEQ ID NO: 606936 - RNA, 16 nt, Escherichia coli CFT073
caaaaaacacgacaug

SEQ ID NO: 606937 - RNA, 18 nt, Escherichia coli CFT073
caaaagcacaauccgcca

SEQ ID NO: 606938 - RNA, 18 nt, Escherichia coli CFT073
caaaagcaggcaccgcgc

SEQ ID NO: 606939 - RNA, 22 nt, Escherichia coli CFT073
caaaacuuuucaccagcgucag

SEQ ID NO: 606940 - RNA, 20 nt, Escherichia coli CFT073
caaaagcggugauaaaccca

SEQ ID NO: 606941 - RNA, 13 nt, Escherichia coli CFT073
caaaagcggcgcg

SEQ ID NO: 606942 - RNA, 15 nt, Escherichia coli CFT073
caaaacgucgccagc

SEQ ID NO: 606943 - RNA, 19 nt, Escherichia coli CFT073
caaaacguuauuuugcuaa

SEQ ID NO: 606944 - RNA, 16 nt, Escherichia coli CFT073
caaaacgcgcucacug

SEQ ID NO: 606945 - RNA, 23 nt, Escherichia coli CFT073
caaaaccaucaauccacuucgcc

SEQ ID NO: 606946 - RNA, 16 nt, Escherichia coli CFT073
auuuuucgcucuuucg

SEQ ID NO: 606947 - RNA, 22 nt, Escherichia coli CFT073
auuuuugcauaugcgauacggu

SEQ ID NO: 606948 - RNA, 13 nt, Escherichia coli CFT073
auuuugccaguua

SEQ ID NO: 606949 - RNA, 20 nt, Escherichia coli CFT073
auuuugcgacccguuuacgg

SEQ ID NO: 606950 - RNA, 21 nt, Escherichia coli CFT073
auuuugccucgcccaccgggc

SEQ ID NO: 606951 - RNA, 15 nt, Escherichia coli CFT073
auuuugcucaccggc

SEQ ID NO: 606952 - RNA, 20 nt, Escherichia coli CFT073
auuuugcugaugcagcgaug

SEQ ID NO: 606953 - RNA, 21 nt, Escherichia coli CFT073
auuuugcuuuaaguucagcca

SEQ ID NO: 606954 - RNA, 19 nt, Escherichia coli CFT073
auuuuguaugcggcgaagg

SEQ ID NO: 606955 - RNA, 23 nt, Escherichia coli CFT073
auuuuuacucuucuuuaauuaau

SEQ ID NO: 606956 - RNA, 17 nt, Escherichia coli CFT073
caaaauaucgacauuca

SEQ ID NO: 606957 - RNA, 16 nt, Escherichia coli CFT073
caaaaucagaaacaaa

SEQ ID NO: 606958 - RNA, 16 nt, Escherichia coli CFT073
caaaaucauccgucgg

SEQ ID NO: 606959 - RNA, 16 nt, Escherichia coli CFT073
caaaauccagaaaaaa

SEQ ID NO: 606960 - RNA, 12 nt, Escherichia coli CFT073
caaaauccgcca

SEQ ID NO: 606961 - RNA, 21 nt, Escherichia coli CFT073
caaaauggguauauuugccaa

SEQ ID NO: 606962 - RNA, 23 nt, Escherichia coli CFT073
caaaaugaucgaagguuccugca

SEQ ID NO: 606963 - RNA, 16 nt, Escherichia coli CFT073
caaaaugucggaugcg

SEQ ID NO: 606964 - RNA, 18 nt, Escherichia coli CFT073
caaaauugacuaucugac

SEQ ID NO: 606965 - RNA, 15 nt, Escherichia coli CFT073
caaaauugccggaug

SEQ ID NO: 606966 - RNA, 16 nt, Escherichia coli CFT073
caaacagaauauugug

SEQ ID NO: 606967 - RNA, 23 nt, Escherichia coli CFT073
caaacagaauauugugcucacua

SEQ ID NO: 606968 - RNA, 15 nt, Escherichia coli CFT073
caaacagcagaacga

SEQ ID NO: 606969 - RNA, 16 nt, Escherichia coli CFT073
caaacagcgagaacac

SEQ ID NO: 606970 - RNA, 13 nt, Escherichia coli CFT073
caaacagcgccag

SEQ ID NO: 606971 - RNA, 15 nt, Escherichia coli CFT073
caaacagcgccagau

SEQ ID NO: 606972 - RNA, 14 nt, Escherichia coli CFT073
caaacaguaaccca

SEQ ID NO: 606973 - RNA, 16 nt, Escherichia coli CFT073
caaacagucgcccgac

SEQ ID NO: 606974 - RNA, 18 nt, Escherichia coli CFT073
caaacauaaagccugaua

SEQ ID NO: 606975 - RNA, 21 nt, Escherichia coli CFT073
caaacugaagauugaacagca

SEQ ID NO: 606976 - RNA, 15 nt, Escherichia coli CFT073
caaacugauauugug

SEQ ID NO: 606977 - RNA, 22 nt, Escherichia coli CFT073
caaacugauuuagcaucagcgc

SEQ ID NO: 606978 - RNA, 19 nt, Escherichia coli CFT073
caaacuggaauagcgccac

SEQ ID NO: 606979 - RNA, 18 nt, Escherichia coli CFT073
caaacugugcaccgcccu

SEQ ID NO: 606980 - RNA, 13 nt, Escherichia coli CFT073
caaacuucacgca

SEQ ID NO: 606981 - RNA, 17 nt, Escherichia coli CFT073
caaacguggucgccagc

SEQ ID NO: 606982 - RNA, 15 nt, Escherichia coli CFT073
caaacguucauacgc

SEQ ID NO: 606983 - RNA, 16 nt, Escherichia coli CFT073
caaacucacugccagc

SEQ ID NO: 606984 - RNA, 22 nt, Escherichia coli CFT073
caaacggaucgcguaaggcuuc

SEQ ID NO: 606985 - RNA, 19 nt, Escherichia coli CFT073
caaacgguucgcggugcuc

SEQ ID NO: 606986 - RNA, 12 nt, Escherichia coli CFT073
caaacgccagau

SEQ ID NO: 606987 - RNA, 15 nt, Escherichia coli CFT073
caaaccagacaacag

SEQ ID NO: 606988 - RNA, 19 nt, Escherichia coli CFT073
caaaccauagaauacgcca

SEQ ID NO: 606989 - RNA, 23 nt, Escherichia coli CFT073
caaacgagguagcgauagaaauc

SEQ ID NO: 606990 - RNA, 15 nt, Escherichia coli CFT073
caaacgaaugcaggc

SEQ ID NO: 606991 - RNA, 19 nt, Escherichia coli CFT073
caaaccguuaauccgcccu

SEQ ID NO: 606992 - RNA, 13 nt, Escherichia coli CFT073
caaaccuuucgcc

SEQ ID NO: 606993 - RNA, 17 nt, Escherichia coli CFT073
caaaccgacugccugca

SEQ ID NO: 606994 - RNA, 23 nt, Escherichia coli CFT073
caaaccgcccagcagcgccgcgc

SEQ ID NO: 606995 - RNA, 14 nt, Escherichia coli CFT073
caaagggagcagac

SEQ ID NO: 606996 - RNA, 17 nt, Escherichia coli CFT073
caaagggcuaacgugca

SEQ ID NO: 606997 - RNA, 19 nt, Escherichia coli CFT073
caaauccacguuccagauc

SEQ ID NO: 606998 - RNA, 22 nt, Escherichia coli CFT073
caaauccagccagcgccgcgcg

SEQ ID NO: 606999 - RNA, 16 nt, Escherichia coli CFT073
caaaucgaaaucaaca

SEQ ID NO: 607000 - RNA, 16 nt, Escherichia coli CFT073
caaaucaaaucauccu

SEQ ID NO: 607001 - RNA, 15 nt, Escherichia coli CFT073
caaaucaacaaccug

SEQ ID NO: 607002 - RNA, 22 nt, Escherichia coli CFT073
caaaucaccauauucagcagca

SEQ ID NO: 607003 - RNA, 14 nt, Escherichia coli CFT073
caaaucagcggcag

SEQ ID NO: 607004 - RNA, 17 nt, Escherichia coli CFT073
caaagcaaaggcgacaa

SEQ ID NO: 607005 - RNA, 23 nt, Escherichia coli CFT073
caaagcaaaggcgacaauaaaua

SEQ ID NO: 607006 - RNA, 18 nt, Escherichia coli CFT073
caaaggcacaacugcgac

SEQ ID NO: 607007 - RNA, 14 nt, Escherichia coli CFT073
caaagaaugccaua

SEQ ID NO: 607008 - RNA, 20 nt, Escherichia coli CFT073
caaagaacguaaucaacgcc

SEQ ID NO: 607009 - RNA, 12 nt, Escherichia coli CFT073
caaacuugcgua

SEQ ID NO: 607010 - RNA, 18 nt, Escherichia coli CFT073
caaagaaaucaacaaauu

SEQ ID NO: 607011 - RNA, 24 nt, Escherichia coli CFT073
caaagagagaagccagguagauau

SEQ ID NO: 607012 - RNA, 20 nt, Escherichia coli CFT073
caaagagcaagaaccccagc

SEQ ID NO: 607013 - RNA, 16 nt, Escherichia coli CFT073
caaaucgccccgcagc

SEQ ID NO: 607014 - RNA, 16 nt, Escherichia coli CFT073
caacagaaacgccauc

SEQ ID NO: 607015 - RNA, 22 nt, Escherichia coli CFT073
caacaauuuccgcagcuccagc

SEQ ID NO: 607016 - RNA, 14 nt, Escherichia coli CFT073
caacacauaaccgu

SEQ ID NO: 607017 - RNA, 18 nt, Escherichia coli CFT073
caacaccacgcgguagcg

SEQ ID NO: 607018 - RNA, 18 nt, Escherichia coli CFT073
auugucaauauccagcag

SEQ ID NO: 607019 - RNA, 16 nt, Escherichia coli CFT073
auuggcguauuuccgg

SEQ ID NO: 607020 - RNA, 13 nt, Escherichia coli CFT073
auugucugcgccg

SEQ ID NO: 607021 - RNA, 13 nt, Escherichia coli CFT073
auugucugcguug

SEQ ID NO: 607022 - RNA, 20 nt, Escherichia coli CFT073
auugugcauuuaagagaaac

SEQ ID NO: 607023 - RNA, 14 nt, Escherichia coli CFT073
auugcgccgccgcc

SEQ ID NO: 607024 - RNA, 17 nt, Escherichia coli CFT073
auugcgccgaacaacag

SEQ ID NO: 607025 - RNA, 22 nt, Escherichia coli CFT073
auugcguuauagcgauuuuuca

SEQ ID NO: 607026 - RNA, 18 nt, Escherichia coli CFT073
auugcguucaaucugucc

SEQ ID NO: 607027 - RNA, 19 nt, Escherichia coli CFT073
auugcguuuaagcugcucg

SEQ ID NO: 607028 - RNA, 16 nt, Escherichia coli CFT073
auuggcaauuuugcug

SEQ ID NO: 607029 - RNA, 18 nt, Escherichia coli CFT073
auucguugcaguaaaauu

SEQ ID NO: 607030 - RNA, 15 nt, Escherichia coli CFT073
auucguugcuggcgu

SEQ ID NO: 607031 - RNA, 19 nt, Escherichia coli CFT073
auucgugugguaaaaccuu

SEQ ID NO: 607032 - RNA, 15 nt, Escherichia coli CFT073
auucguacaaacgcu

SEQ ID NO: 607033 - RNA, 16 nt, Escherichia coli CFT073
auugcgccagcgagaa

SEQ ID NO: 607034 - RNA, 18 nt, Escherichia coli CFT073
auugccgaagaccagauu

SEQ ID NO: 607035 - RNA, 14 nt, Escherichia coli CFT073
auugccaucacggc

SEQ ID NO: 607036 - RNA, 20 nt, Escherichia coli CFT073
auugcaucuacgcucucuuc

SEQ ID NO: 607037 - RNA, 14 nt, Escherichia coli CFT073
auugccacgccgua

SEQ ID NO: 607038 - RNA, 20 nt, Escherichia coli CFT073
auugccagcauuggcguuug

SEQ ID NO: 607039 - RNA, 21 nt, Escherichia coli CFT073
auugccaaucguuaucggaaa

SEQ ID NO: 607040 - RNA, 17 nt, Escherichia coli CFT073
auugcauaggugcccgc

SEQ ID NO: 607041 - RNA, 13 nt, Escherichia coli CFT073
auucucgccagug

SEQ ID NO: 607042 - RNA, 22 nt, Escherichia coli CFT073
auugcagaggcucaaccgccgu

SEQ ID NO: 607043 - RNA, 18 nt, Escherichia coli CFT073
auuuaaccgcuuucaccg

SEQ ID NO: 607044 - RNA, 19 nt, Escherichia coli CFT073
auugugcgguccaugcgaa

SEQ ID NO: 607045 - RNA, 20 nt, Escherichia coli CFT073
auuguuaaagcccugcucgc

SEQ ID NO: 607046 - RNA, 12 nt, Escherichia coli CFT073
auuuaaugccaa

SEQ ID NO: 607047 - RNA, 13 nt, Escherichia coli CFT073
auuucaccagcgc

SEQ ID NO: 607048 - RNA, 19 nt, Escherichia coli CFT073
auuucaaaacggucacggc

SEQ ID NO: 607049 - RNA, 15 nt, Escherichia coli CFT073
auuucaaaucaccaa

SEQ ID NO: 607050 - RNA, 14 nt, Escherichia coli CFT073
auuucaaccacuca

SEQ ID NO: 607051 - RNA, 21 nt, Escherichia coli CFT073
auuuauccagcggcagccauu

SEQ ID NO: 607052 - RNA, 15 nt, Escherichia coli CFT073
auuucgauauguucc

SEQ ID NO: 607053 - RNA, 14 nt, Escherichia coli CFT073
auuucgcugcggau

SEQ ID NO: 607054 - RNA, 18 nt, Escherichia coli CFT073
auuucggcacuuuuggug

SEQ ID NO: 607055 - RNA, 21 nt, Escherichia coli CFT073
auuucgucaaacguuuaccuu

SEQ ID NO: 607056 - RNA, 18 nt, Escherichia coli CFT073
auuucguuaaguucagaa

SEQ ID NO: 607057 - RNA, 19 nt, Escherichia coli CFT073
auuuccccuaacucuuuca

SEQ ID NO: 607058 - RNA, 19 nt, Escherichia coli CFT073
auuucccuguugccugcac

SEQ ID NO: 607059 - RNA, 15 nt, Escherichia coli CFT073
auuucccggauggca

SEQ ID NO: 607060 - RNA, 14 nt, Escherichia coli CFT073
auuuccggcaccgu

SEQ ID NO: 607061 - RNA, 15 nt, Escherichia coli CFT073
auuucauaugcgcca

SEQ ID NO: 607062 - RNA, 15 nt, Escherichia coli CFT073
auuucagcaucgcca

SEQ ID NO: 607063 - RNA, 16 nt, Escherichia coli CFT073
auuucaucaucacgaa

SEQ ID NO: 607064 - RNA, 21 nt, Escherichia coli CFT073
auuucaucgcuacaccaaucg

SEQ ID NO: 607065 - RNA, 17 nt, Escherichia coli CFT073
auuucaugaagcugaca

SEQ ID NO: 607066 - RNA, 21 nt, Escherichia coli CFT073
auuucauuaucaauugcuuca

SEQ ID NO: 607067 - RNA, 22 nt, Escherichia coli CFT073
auuucauucacgccguuaacuu

SEQ ID NO: 607068 - RNA, 15 nt, Escherichia coli CFT073
auuucauucagcgua

SEQ ID NO: 607069 - RNA, 20 nt, Escherichia coli CFT073
auuaauguaugugcgaaaau

SEQ ID NO: 607070 - RNA, 20 nt, Escherichia coli CFT073
auuaaucugcucggcgagca

SEQ ID NO: 607071 - RNA, 14 nt, Escherichia coli CFT073
auuaauugccgcca

SEQ ID NO: 607072 - RNA, 13 nt, Escherichia coli CFT073
auuaauuugccag

SEQ ID NO: 607073 - RNA, 15 nt, Escherichia coli CFT073
auuacaggaugcggc

SEQ ID NO: 607074 - RNA, 15 nt, Escherichia coli CFT073
auuacaucacgacga

SEQ ID NO: 607075 - RNA, 14 nt, Escherichia coli CFT073
auuaccagcaucac

SEQ ID NO: 607076 - RNA, 16 nt, Escherichia coli CFT073
auuaccagcaucaccg

SEQ ID NO: 607077 - RNA, 22 nt, Escherichia coli CFT073
auuacauugggaagauaaaaac

SEQ ID NO: 607078 - RNA, 14 nt, Escherichia coli CFT073
auuacccaguuuac

SEQ ID NO: 607079 - RNA, 16 nt, Escherichia coli CFT073
auuacccucaaacgcc

SEQ ID NO: 607080 - RNA, 14 nt, Escherichia coli CFT073
augucgcugcacuu

SEQ ID NO: 607081 - RNA, 21 nt, Escherichia coli CFT073
augucgcugcacuuucucgac

SEQ ID NO: 607082 - RNA, 12 nt, Escherichia coli CFT073
augucgcggaaa

SEQ ID NO: 607083 - RNA, 20 nt, Escherichia coli CFT073
augucgcggaaauucacuuc

SEQ ID NO: 607084 - RNA, 22 nt, Escherichia coli CFT073
auuacgggcaaucaucaccggu

SEQ ID NO: 607085 - RNA, 15 nt, Escherichia coli CFT073
auuacgcuucggcaa

SEQ ID NO: 607086 - RNA, 15 nt, Escherichia coli CFT073
auuaccuaccaacgc

SEQ ID NO: 607087 - RNA, 13 nt, Escherichia coli CFT073
auuacgaaaucgg

SEQ ID NO: 607088 - RNA, 21 nt, Escherichia coli CFT073
auuacgcaguuguucggcgcu

SEQ ID NO: 607089 - RNA, 12 nt, Escherichia coli CFT073
auuacgcaucag

SEQ ID NO: 607090 - RNA, 15 nt, Escherichia coli CFT073
auuacguaccagaua

SEQ ID NO: 607091 - RNA, 14 nt, Escherichia coli CFT073
auuacucauuaaug

SEQ ID NO: 607092 - RNA, 21 nt, Escherichia coli CFT073
auuacugccagcucaccucac

SEQ ID NO: 607093 - RNA, 18 nt, Escherichia coli CFT073
auuacuuuccaucuuucc

SEQ ID NO: 607094 - RNA, 20 nt, Escherichia coli CFT073
auuauuccauccugcucaag

SEQ ID NO: 607095 - RNA, 21 nt, Escherichia coli CFT073
auuaucuucuuucucggccac

SEQ ID NO: 607096 - RNA, 19 nt, Escherichia coli CFT073
auuaugcagccuucauuca

SEQ ID NO: 607097 - RNA, 19 nt, Escherichia coli CFT073
auuccguagcguuuuuuca

SEQ ID NO: 607098 - RNA, 20 nt, Escherichia coli CFT073
auuccgggccaccaugccca

SEQ ID NO: 607099 - RNA, 19 nt, Escherichia coli CFT073
auuccgcucuguaacccug

SEQ ID NO: 607100 - RNA, 19 nt, Escherichia coli CFT073
auucgccagcacggcgcag

SEQ ID NO: 607101 - RNA, 21 nt, Escherichia coli CFT073
auucgagagaauuaaccagaa

SEQ ID NO: 607102 - RNA, 13 nt, Escherichia coli CFT073
auucgauagagaa

SEQ ID NO: 607103 - RNA, 13 nt, Escherichia coli CFT073
auucccgugcugc

SEQ ID NO: 607104 - RNA, 14 nt, Escherichia coli CFT073
auucccuugucgca

SEQ ID NO: 607105 - RNA, 17 nt, Escherichia coli CFT073
auuccgcaacgccgcca

SEQ ID NO: 607106 - RNA, 18 nt, Escherichia coli CFT073
auuccgcaacgccgccaa

SEQ ID NO: 607107 - RNA, 22 nt, Escherichia coli CFT073
auuccgcaccugccagcgccga

SEQ ID NO: 607108 - RNA, 16 nt, Escherichia coli CFT073
auucccggucaccgga

SEQ ID NO: 607109 - RNA, 15 nt, Escherichia coli CFT073
aaacucaccgcgcac

SEQ ID NO: 607110 - RNA, 19 nt, Escherichia coli CFT073
aaacucgccaaaccauugc

SEQ ID NO: 607111 - RNA, 17 nt, Escherichia coli CFT073
aaacucgccuuugucuu

SEQ ID NO: 607112 - RNA, 11 nt, Escherichia coli CFT073
aaacucgcggc

SEQ ID NO: 607113 - RNA, 12 nt, Escherichia coli CFT073
aaacucauccac

SEQ ID NO: 607114 - RNA, 18 nt, Escherichia coli CFT073
aaacucgcuaaccacugu

SEQ ID NO: 607115 - RNA, 21 nt, Escherichia coli CFT073
aaacucggucacgcggucauc

SEQ ID NO: 607116 - RNA, 16 nt, Escherichia coli CFT073
auucccgcaagcggcc

SEQ ID NO: 607117 - RNA, 15 nt, Escherichia coli CFT073
aaacuacacuccgua

SEQ ID NO: 607118 - RNA, 17 nt, Escherichia coli CFT073
aaacuacgcugcggcga

SEQ ID NO: 607119 - RNA, 13 nt, Escherichia coli CFT073
auuccauccugcu

SEQ ID NO: 607120 - RNA, 16 nt, Escherichia coli CFT073
auucccacuuuucagu

SEQ ID NO: 607121 - RNA, 12 nt, Escherichia coli CFT073
auucccaguacc

SEQ ID NO: 607122 - RNA, 16 nt, Escherichia coli CFT073
auucccccaccgccgc

SEQ ID NO: 607123 - RNA, 18 nt, Escherichia coli CFT073
auucauuuugcuggaaaa

SEQ ID NO: 607124 - RNA, 16 nt, Escherichia coli CFT073
auucacuucaucccug

SEQ ID NO: 607125 - RNA, 19 nt, Escherichia coli CFT073
auucacuucgcucuuauca

SEQ ID NO: 607126 - RNA, 19 nt, Escherichia coli CFT073
auucagaauuuuuaaccgu

SEQ ID NO: 607127 - RNA, 17 nt, Escherichia coli CFT073
auucagcaacaucacca

SEQ ID NO: 607128 - RNA, 21 nt, Escherichia coli CFT073
auucaggaggcguucugcggg

SEQ ID NO: 607129 - RNA, 23 nt, Escherichia coli CFT073
augcccauuccccagccgaucag

SEQ ID NO: 607130 - RNA, 18 nt, Escherichia coli CFT073
augccccagaauaacgcg

SEQ ID NO: 607131 - RNA, 19 nt, Escherichia coli CFT073
augccccagcccgccaaua

SEQ ID NO: 607132 - RNA, 22 nt, Escherichia coli CFT073
augccauucacaaaaacaguaa

SEQ ID NO: 607133 - RNA, 18 nt, Escherichia coli CFT073
augccaguucaguaaaac

SEQ ID NO: 607134 - RNA, 16 nt, Escherichia coli CFT073
augccauccgcaucgg

SEQ ID NO: 607135 - RNA, 16 nt, Escherichia coli CFT073
augccaucgccagcag

SEQ ID NO: 607136 - RNA, 17 nt, Escherichia coli CFT073
augccaucugccagcaa

SEQ ID NO: 607137 - RNA, 19 nt, Escherichia coli CFT073
augccaaauguauccauca

SEQ ID NO: 607138 - RNA, 22 nt, Escherichia coli CFT073
augccaaccgcgacaauaucau

SEQ ID NO: 607139 - RNA, 14 nt, Escherichia coli CFT073
augccacaguaaaa

SEQ ID NO: 607140 - RNA, 14 nt, Escherichia coli CFT073
augccaccaggcag

SEQ ID NO: 607141 - RNA, 18 nt, Escherichia coli CFT073
augccaccaggcagcaca

SEQ ID NO: 607142 - RNA, 21 nt, Escherichia coli CFT073
augccaggaccacuggcgacg

SEQ ID NO: 607143 - RNA, 18 nt, Escherichia coli CFT073
augccaggcuccagauaa

SEQ ID NO: 607144 - RNA, 14 nt, Escherichia coli CFT073
augccagcagcacc

SEQ ID NO: 607145 - RNA, 16 nt, Escherichia coli CFT073
augccagcauaccgcc

SEQ ID NO: 607146 - RNA, 13 nt, Escherichia coli CFT073
augccagcgcccc

SEQ ID NO: 607147 - RNA, 15 nt, Escherichia coli CFT073
augccagaaucccca

SEQ ID NO: 607148 - RNA, 17 nt, Escherichia coli CFT073
augccgaagugguucca

SEQ ID NO: 607149 - RNA, 19 nt, Escherichia coli CFT073
augccgaaaucaaggcgga

SEQ ID NO: 607150 - RNA, 21 nt, Escherichia coli CFT073
augcccggcgaaccgggcgga

SEQ ID NO: 607151 - RNA, 15 nt, Escherichia coli CFT073
augcuccccagacca

SEQ ID NO: 607152 - RNA, 13 nt, Escherichia coli CFT073
augcuaugcgcca

SEQ ID NO: 607153 - RNA, 13 nt, Escherichia coli CFT073
augcggcgugacc

SEQ ID NO: 607154 - RNA, 15 nt, Escherichia coli CFT073
augcggcgugauaaa

SEQ ID NO: 607155 - RNA, 20 nt, Escherichia coli CFT073
augcggcgugccuucacggg

SEQ ID NO: 607156 - RNA, 21 nt, Escherichia coli CFT073
augcggcgaaggcaucggcaa

SEQ ID NO: 607157 - RNA, 15 nt, Escherichia coli CFT073
augcgccgccaaacg

SEQ ID NO: 607158 - RNA, 15 nt, Escherichia coli CFT073
augcgccauaccaug

SEQ ID NO: 607159 - RNA, 16 nt, Escherichia coli CFT073
augcgccauaccaugc

SEQ ID NO: 607160 - RNA, 17 nt, Escherichia coli CFT073
augcgccauaccaugca

SEQ ID NO: 607161 - RNA, 21 nt, Escherichia coli CFT073
augcgacguuuaccgcauccg

SEQ ID NO: 607162 - RNA, 13 nt, Escherichia coli CFT073
augcgaccgccgc

SEQ ID NO: 607163 - RNA, 20 nt, Escherichia coli CFT073
augcgacgcagguuucgauu

SEQ ID NO: 607164 - RNA, 21 nt, Escherichia coli CFT073
augcgacgcagguuucgauua

SEQ ID NO: 607165 - RNA, 14 nt, Escherichia coli CFT073
augcgacgcgggcc

SEQ ID NO: 607166 - RNA, 17 nt, Escherichia coli CFT073
augccggccagcgccac

SEQ ID NO: 607167 - RNA, 23 nt, Escherichia coli CFT073
augccggccagcgccaccaccag

SEQ ID NO: 607168 - RNA, 20 nt, Escherichia coli CFT073
augguuuuguaggccggaua

SEQ ID NO: 607169 - RNA, 19 nt, Escherichia coli CFT073
augucaguaauugccgcgu

SEQ ID NO: 607170 - RNA, 20 nt, Escherichia coli CFT073
augucacaaucccuuccacc

SEQ ID NO: 607171 - RNA, 13 nt, Escherichia coli CFT073
augucaccagcau

SEQ ID NO: 607172 - RNA, 20 nt, Escherichia coli CFT073
augucaccuaauuuaaaauu

SEQ ID NO: 607173 - RNA, 14 nt, Escherichia coli CFT073
augguuauuaccaa

SEQ ID NO: 607174 - RNA, 21 nt, Escherichia coli CFT073
augguucccggaccggcggua

SEQ ID NO: 607175 - RNA, 22 nt, Escherichia coli CFT073
augguugagaggggaacacggc

SEQ ID NO: 607176 - RNA, 17 nt, Escherichia coli CFT073
augguuguaauccaccu

SEQ ID NO: 607177 - RNA, 17 nt, Escherichia coli CFT073
augguuugccagcagag

SEQ ID NO: 607178 - RNA, 22 nt, Escherichia coli CFT073
augggcgaccguaaauucuccc

SEQ ID NO: 607179 - RNA, 16 nt, Escherichia coli CFT073
auggcguaugccggau

SEQ ID NO: 607180 - RNA, 22 nt, Escherichia coli CFT073
auggcggucgcagggacgcgca

SEQ ID NO: 607181 - RNA, 14 nt, Escherichia coli CFT073
auggcgcgccaccu

SEQ ID NO: 607182 - RNA, 20 nt, Escherichia coli CFT073
auggcgcgccaccucuuuca

SEQ ID NO: 607183 - RNA, 14 nt, Escherichia coli CFT073
augggcgugauaau

SEQ ID NO: 607184 - RNA, 15 nt, Escherichia coli CFT073
augggcuuaaugaga

SEQ ID NO: 607185 - RNA, 19 nt, Escherichia coli CFT073
augggcuuaaugagauaau

SEQ ID NO: 607186 - RNA, 14 nt, Escherichia coli CFT073
augggggaguaugu

SEQ ID NO: 607187 - RNA, 14 nt, Escherichia coli CFT073
augguaaagcaccu

SEQ ID NO: 607188 - RNA, 14 nt, Escherichia coli CFT073
augguagcgugaug

SEQ ID NO: 607189 - RNA, 14 nt, Escherichia coli CFT073
augguaucuaucac

SEQ ID NO: 607190 - RNA, 17 nt, Escherichia coli CFT073
auggcgcaguugccgga

SEQ ID NO: 607191 - RNA, 15 nt, Escherichia coli CFT073
auggcgauucagcaa

SEQ ID NO: 607192 - RNA, 15 nt, Escherichia coli CFT073
auggcgaucgugaua

SEQ ID NO: 607193 - RNA, 21 nt, Escherichia coli CFT073
auggccgggcgaugcagcgca

SEQ ID NO: 607194 - RNA, 23 nt, Escherichia coli CFT073
auggccgggugauuuuucagcau

SEQ ID NO: 607195 - RNA, 13 nt, Escherichia coli CFT073
auggcgauaaucg

SEQ ID NO: 607196 - RNA, 18 nt, Escherichia coli CFT073
auggcgauacugccgccc

SEQ ID NO: 607197 - RNA, 16 nt, Escherichia coli CFT073
auggcaaaauccagaa

SEQ ID NO: 607198 - RNA, 15 nt, Escherichia coli CFT073
auggcaaaugcaaca

SEQ ID NO: 607199 - RNA, 18 nt, Escherichia coli CFT073
auggcacgcauccggcaa

SEQ ID NO: 607200 - RNA, 20 nt, Escherichia coli CFT073
auggcagugcgccauauaag

SEQ ID NO: 607201 - RNA, 19 nt, Escherichia coli CFT073
auggcauccuugcuaacca

SEQ ID NO: 607202 - RNA, 16 nt, Escherichia coli CFT073
auggcauacaacgcca

SEQ ID NO: 607203 - RNA, 20 nt, Escherichia coli CFT073
auggauggugcuaauugcac

SEQ ID NO: 607204 - RNA, 17 nt, Escherichia coli CFT073
auggauauaauucauca

SEQ ID NO: 607205 - RNA, 14 nt, Escherichia coli CFT073
auggaucaccaucg

SEQ ID NO: 607206 - RNA, 21 nt, Escherichia coli CFT073
augcuggcuuuuggaccgcca

SEQ ID NO: 607207 - RNA, 22 nt, Escherichia coli CFT073
augcuggaggagauauugcgca

SEQ ID NO: 607208 - RNA, 21 nt, Escherichia coli CFT073
augcugcgggcgaucauaucc

SEQ ID NO: 607209 - RNA, 14 nt, Escherichia coli CFT073
augcuggaaccaca

SEQ ID NO: 607210 - RNA, 18 nt, Escherichia coli CFT073
augcuggaaccacagcgc

SEQ ID NO: 607211 - RNA, 22 nt, Escherichia coli CFT073
augcugacuacuuucaugcuca

SEQ ID NO: 607212 - RNA, 23 nt, Escherichia coli CFT073
augcugccgguuuauggaaaagu

SEQ ID NO: 607213 - RNA, 16 nt, Escherichia coli CFT073
augcucugccagcgua

SEQ ID NO: 607214 - RNA, 19 nt, Escherichia coli CFT073
augcugacacaucuuuucc

SEQ ID NO: 607215 - RNA, 20 nt, Escherichia coli CFT073
augcugagcuucuucaaaaa

SEQ ID NO: 607216 - RNA, 22 nt, Escherichia coli CFT073
augcugagcuucuucaaaaaag

SEQ ID NO: 607217 - RNA, 14 nt, Escherichia coli CFT073
augaaagcagcagc

SEQ ID NO: 607218 - RNA, 20 nt, Escherichia coli CFT073
augaaauauugccucaugcg

SEQ ID NO: 607219 - RNA, 23 nt, Escherichia coli CFT073
augaaauguaggguuacgcgcag

SEQ ID NO: 607220 - RNA, 22 nt, Escherichia coli CFT073
aucuuguugaagacuaaccaac

SEQ ID NO: 607221 - RNA, 15 nt, Escherichia coli CFT073
augaaaaacguugcc

SEQ ID NO: 607222 - RNA, 20 nt, Escherichia coli CFT073
aucuucuuugcgccagcggg

SEQ ID NO: 607223 - RNA, 14 nt, Escherichia coli CFT073
augaccaccgcagc

SEQ ID NO: 607224 - RNA, 13 nt, Escherichia coli CFT073
augacagcggcgu

SEQ ID NO: 607225 - RNA, 23 nt, Escherichia coli CFT073
augacgaauaccguauucaacga

SEQ ID NO: 607226 - RNA, 17 nt, Escherichia coli CFT073
augacagaaucagcagc

SEQ ID NO: 607227 - RNA, 18 nt, Escherichia coli CFT073
augacagaaucagcagcg

SEQ ID NO: 607228 - RNA, 19 nt, Escherichia coli CFT073
augacaaacgcaaaacugc

SEQ ID NO: 607229 - RNA, 14 nt, Escherichia coli CFT073
augacaccaagcac

SEQ ID NO: 607230 - RNA, 16 nt, Escherichia coli CFT073
augacacuuucagcgc

SEQ ID NO: 607231 - RNA, 13 nt, Escherichia coli CFT073
augacaucgcccu

SEQ ID NO: 607232 - RNA, 19 nt, Escherichia coli CFT073
augacaucgcccucuuuca

SEQ ID NO: 607233 - RNA, 13 nt, Escherichia coli CFT073
augacauccccau

SEQ ID NO: 607234 - RNA, 19 nt, Escherichia coli CFT073
augacauuaaguaacaaua

SEQ ID NO: 607235 - RNA, 16 nt, Escherichia coli CFT073
augaagucugccguug

SEQ ID NO: 607236 - RNA, 21 nt, Escherichia coli CFT073
augaagucauugauaauaucc

SEQ ID NO: 607237 - RNA, 18 nt, Escherichia coli CFT073
augaacggcgguaaagaa

SEQ ID NO: 607238 - RNA, 13 nt, Escherichia coli CFT073
augaacgcgcaga

SEQ ID NO: 607239 - RNA, 19 nt, Escherichia coli CFT073
augaagagauaaacgacca

SEQ ID NO: 607240 - RNA, 22 nt, Escherichia coli CFT073
augaagccaaccgggccgcaga

SEQ ID NO: 607241 - RNA, 19 nt, Escherichia coli CFT073
augcacuuauaugccggau

SEQ ID NO: 607242 - RNA, 16 nt, Escherichia coli CFT073
augcacuuccagcggc

SEQ ID NO: 607243 - RNA, 17 nt, Escherichia coli CFT073
augcacuccgccgcaca

SEQ ID NO: 607244 - RNA, 21 nt, Escherichia coli CFT073
augcaccuuuaccagacgggc

SEQ ID NO: 607245 - RNA, 19 nt, Escherichia coli CFT073
augcaauuaucauugcucu

SEQ ID NO: 607246 - RNA, 17 nt, Escherichia coli CFT073
augcaauucacacagug

SEQ ID NO: 607247 - RNA, 13 nt, Escherichia coli CFT073
augcacaccaucg

SEQ ID NO: 607248 - RNA, 14 nt, Escherichia coli CFT073
augcauaaagcggu

SEQ ID NO: 607249 - RNA, 18 nt, Escherichia coli CFT073
augcauagcguucuucca

SEQ ID NO: 607250 - RNA, 20 nt, Escherichia coli CFT073
augcagccccauaugcagca

SEQ ID NO: 607251 - RNA, 17 nt, Escherichia coli CFT073
augcaggcaugcaauau

SEQ ID NO: 607252 - RNA, 23 nt, Escherichia coli CFT073
augagcgugagguuaucgcccug

SEQ ID NO: 607253 - RNA, 22 nt, Escherichia coli CFT073
augacgcgcucaccgcucuuca

SEQ ID NO: 607254 - RNA, 18 nt, Escherichia coli CFT073
augagaacaucaucccca

SEQ ID NO: 607255 - RNA, 15 nt, Escherichia coli CFT073
augauugcgccgccg

SEQ ID NO: 607256 - RNA, 19 nt, Escherichia coli CFT073
augauugcgccgccgccca

SEQ ID NO: 607257 - RNA, 24 nt, Escherichia coli CFT073
augauugaccauauuaacgcagca

SEQ ID NO: 607258 - RNA, 13 nt, Escherichia coli CFT073
augauuaccagca

SEQ ID NO: 607259 - RNA, 20 nt, Escherichia coli CFT073
augaggcguuaacagcgcau

SEQ ID NO: 607260 - RNA, 20 nt, Escherichia coli CFT073
augaggcguuuucgccgcau

SEQ ID NO: 607261 - RNA, 21 nt, Escherichia coli CFT073
aucgguuuuaacaccacucuu

SEQ ID NO: 607262 - RNA, 14 nt, Escherichia coli CFT073
aucguaauacccuu

SEQ ID NO: 607263 - RNA, 16 nt, Escherichia coli CFT073
aucguacucaaucccu

SEQ ID NO: 607264 - RNA, 19 nt, Escherichia coli CFT073
aucguagauuucauccggc

SEQ ID NO: 607265 - RNA, 22 nt, Escherichia coli CFT073
aucgggcuauuuuuauugugcc

SEQ ID NO: 607266 - RNA, 14 nt, Escherichia coli CFT073
aucgggaugagcau

SEQ ID NO: 607267 - RNA, 16 nt, Escherichia coli CFT073
aucgggauauugcccu

SEQ ID NO: 607268 - RNA, 19 nt, Escherichia coli CFT073
aucgggccgacaaaaucag

SEQ ID NO: 607269 - RNA, 20 nt, Escherichia coli CFT073
aucgacaaaacuuuuaucaa

SEQ ID NO: 607270 - RNA, 22 nt, Escherichia coli CFT073
aucucagcgauauagaucauau

SEQ ID NO: 607271 - RNA, 16 nt, Escherichia coli CFT073
aucguuaaagagauca

SEQ ID NO: 607272 - RNA, 19 nt, Escherichia coli CFT073
aucguuaaagagaucaaag

SEQ ID NO: 607273 - RNA, 13 nt, Escherichia coli CFT073
aucucauccauca

SEQ ID NO: 607274 - RNA, 13 nt, Escherichia coli CFT073
aucucaucggcgu

SEQ ID NO: 607275 - RNA, 23 nt, Escherichia coli CFT073
aucguggccaugaccaccgcagc

SEQ ID NO: 607276 - RNA, 20 nt, Escherichia coli CFT073
aucgugcgggaccagcacgg

SEQ ID NO: 607277 - RNA, 22 nt, Escherichia coli CFT073
aucguguggauaauccaucccg

SEQ ID NO: 607278 - RNA, 15 nt, Escherichia coli CFT073
aucucggucaccagg

SEQ ID NO: 607279 - RNA, 15 nt, Escherichia coli CFT073
aucucgguggaaaau

SEQ ID NO: 607280 - RNA, 19 nt, Escherichia coli CFT073
aucucuggcacgagaucgu

SEQ ID NO: 607281 - RNA, 15 nt, Escherichia coli CFT073
aucucuauuacccua

SEQ ID NO: 607282 - RNA, 18 nt, Escherichia coli CFT073
aucucuccgggcaugaac

SEQ ID NO: 607283 - RNA, 22 nt, Escherichia coli CFT073
aucugaugauauuuuucccuga

SEQ ID NO: 607284 - RNA, 21 nt, Escherichia coli CFT073
aucucuuccagcgucuccaga

SEQ ID NO: 607285 - RNA, 14 nt, Escherichia coli CFT073
aucucuucaccaua

SEQ ID NO: 607286 - RNA, 17 nt, Escherichia coli CFT073
aucucuuccagcgacac

SEQ ID NO: 607287 - RNA, 22 nt, Escherichia coli CFT073
aucugaaguaaagaaacugguu

SEQ ID NO: 607288 - RNA, 19 nt, Escherichia coli CFT073
aucugcuuuucauacaauc

SEQ ID NO: 607289 - RNA, 19 nt, Escherichia coli CFT073
aucuggcaagccugaaaac

SEQ ID NO: 607290 - RNA, 19 nt, Escherichia coli CFT073
aucugauuccgggccacca

SEQ ID NO: 607291 - RNA, 23 nt, Escherichia coli CFT073
aucugauuuaaaaaugccagccu

SEQ ID NO: 607292 - RNA, 18 nt, Escherichia coli CFT073
aucugcacagcauucagc

SEQ ID NO: 607293 - RNA, 14 nt, Escherichia coli CFT073
aucugccagccagu

SEQ ID NO: 607294 - RNA, 21 nt, Escherichia coli CFT073
auccgcaauuucuggccaugc

SEQ ID NO: 607295 - RNA, 23 nt, Escherichia coli CFT073
auccgcacucaacuuauugauca

SEQ ID NO: 607296 - RNA, 21 nt, Escherichia coli CFT073
auccgacaaauguguucagcg

SEQ ID NO: 607297 - RNA, 14 nt, Escherichia coli CFT073
auccgacacuggca

SEQ ID NO: 607298 - RNA, 20 nt, Escherichia coli CFT073
auccgaccugcggggaugaa

SEQ ID NO: 607299 - RNA, 13 nt, Escherichia coli CFT073
auccgccaguuug

SEQ ID NO: 607300 - RNA, 17 nt, Escherichia coli CFT073
auccgcugaaaaacgaa

SEQ ID NO: 607301 - RNA, 22 nt, Escherichia coli CFT073
auccggauuuuucgcgcgggca

SEQ ID NO: 607302 - RNA, 21 nt, Escherichia coli CFT073
auccggcauaaacuacgcucg

SEQ ID NO: 607303 - RNA, 17 nt, Escherichia coli CFT073
auccggcacguaucaac

SEQ ID NO: 607304 - RNA, 15 nt, Escherichia coli CFT073
auccggcaaucaacc

SEQ ID NO: 607305 - RNA, 20 nt, Escherichia coli CFT073
auccggcaaucaacgccuga

SEQ ID NO: 607306 - RNA, 18 nt, Escherichia coli CFT073
auccggcaaugcgcacgg

SEQ ID NO: 607307 - RNA, 13 nt, Escherichia coli CFT073
auccggcaccaau

SEQ ID NO: 607308 - RNA, 19 nt, Escherichia coli CFT073
auccggcacgcauugccgc

SEQ ID NO: 607309 - RNA, 18 nt, Escherichia coli CFT073
auccggcgcucaucaggc

SEQ ID NO: 607310 - RNA, 20 nt, Escherichia coli CFT073
auccggcgaguuucguuaaa

SEQ ID NO: 607311 - RNA, 18 nt, Escherichia coli CFT073
auccggccuacauauuca

SEQ ID NO: 607312 - RNA, 15 nt, Escherichia coli CFT073
auccggccuacggga

SEQ ID NO: 607313 - RNA, 22 nt, Escherichia coli CFT073
auccggccuacgggaacagugc

SEQ ID NO: 607314 - RNA, 20 nt, Escherichia coli CFT073
auccggcagcaaaucaaaua

SEQ ID NO: 607315 - RNA, 22 nt, Escherichia coli CFT073
auccgucucaaugguaccguga

SEQ ID NO: 607316 - RNA, 12 nt, Escherichia coli CFT073
auccguccgacg

SEQ ID NO: 607317 - RNA, 19 nt, Escherichia coli CFT073
auccgguuucaucagccaa

SEQ ID NO: 607318 - RNA, 13 nt, Escherichia coli CFT073
auccgguuuucca

SEQ ID NO: 607319 - RNA, 22 nt, Escherichia coli CFT073
auccgguuuuccagaaccugag

SEQ ID NO: 607320 - RNA, 17 nt, Escherichia coli CFT073
auccguacgcuuuucca

SEQ ID NO: 607321 - RNA, 20 nt, Escherichia coli CFT073
auccucagaaaucagauaaa

SEQ ID NO: 607322 - RNA, 21 nt, Escherichia coli CFT073
auccgugcauuccagcauuug

SEQ ID NO: 607323 - RNA, 17 nt, Escherichia coli CFT073
auccguucuucggcgcu

SEQ ID NO: 607324 - RNA, 13 nt, Escherichia coli CFT073
auccguugaucgc

SEQ ID NO: 607325 - RNA, 18 nt, Escherichia coli CFT073
auccguugaucgcucaua

SEQ ID NO: 607326 - RNA, 17 nt, Escherichia coli CFT073
auccggguucggauaaa

SEQ ID NO: 607327 - RNA, 16 nt, Escherichia coli CFT073
auccggcguagauucg

SEQ ID NO: 607328 - RNA, 21 nt, Escherichia coli CFT073
auccggcuuuuuuacaucauc

SEQ ID NO: 607329 - RNA, 12 nt, Escherichia coli CFT073
aucgaaaaugcc

SEQ ID NO: 607330 - RNA, 14 nt, Escherichia coli CFT073
aucgaaaccuucag

SEQ ID NO: 607331 - RNA, 20 nt, Escherichia coli CFT073
aucgaaaccuucagcaucga

SEQ ID NO: 607332 - RNA, 21 nt, Escherichia coli CFT073
auccuguucgaacauuagcgc

SEQ ID NO: 607333 - RNA, 21 nt, Escherichia coli CFT073
auccuucccccaccaccaucu

SEQ ID NO: 607334 - RNA, 16 nt, Escherichia coli CFT073
auccuucccugcagua

SEQ ID NO: 607335 - RNA, 15 nt, Escherichia coli CFT073
auccuuccgccaguc

SEQ ID NO: 607336 - RNA, 16 nt, Escherichia coli CFT073
auccugugcuccagua

SEQ ID NO: 607337 - RNA, 18 nt, Escherichia coli CFT073
auccucuaaaccccaacc

SEQ ID NO: 607338 - RNA, 19 nt, Escherichia coli CFT073
auccugaguuaaucgccgc

SEQ ID NO: 607339 - RNA, 23 nt, Escherichia coli CFT073
auccugauacagaccgcgcagua

SEQ ID NO: 607340 - RNA, 21 nt, Escherichia coli CFT073
auccugacaaggugcgaaaaa

SEQ ID NO: 607341 - RNA, 21 nt, Escherichia coli CFT073
auccucuuuuaccaucagcgu

SEQ ID NO: 607342 - RNA, 20 nt, Escherichia coli CFT073
auccugaaagcugagaaaau

SEQ ID NO: 607343 - RNA, 15 nt, Escherichia coli CFT073
auccugcaacaacac

SEQ ID NO: 607344 - RNA, 19 nt, Escherichia coli CFT073
auccugagcaaacagucgc

SEQ ID NO: 607345 - RNA, 22 nt, Escherichia coli CFT073
auccugccauuggcaggcucug

SEQ ID NO: 607346 - RNA, 16 nt, Escherichia coli CFT073
auccuggacgcagaau

SEQ ID NO: 607347 - RNA, 21 nt, Escherichia coli CFT073
auccacauuagucauuacuca

SEQ ID NO: 607348 - RNA, 15 nt, Escherichia coli CFT073
auccaacaacugcgc

SEQ ID NO: 607349 - RNA, 23 nt, Escherichia coli CFT073
aucauuucauuuggauggaaaau

SEQ ID NO: 607350 - RNA, 19 nt, Escherichia coli CFT073
aucauuuucagcuuucgca

SEQ ID NO: 607351 - RNA, 17 nt, Escherichia coli CFT073
aucauuuucaugcuguu

SEQ ID NO: 607352 - RNA, 21 nt, Escherichia coli CFT073
aucauuagcccuauaaucacc

SEQ ID NO: 607353 - RNA, 21 nt, Escherichia coli CFT073
aucauuagucacaaaucuccc

SEQ ID NO: 607354 - RNA, 15 nt, Escherichia coli CFT073
aucauuacaacgcaa

SEQ ID NO: 607355 - RNA, 16 nt, Escherichia coli CFT073
aucauuaccggcacug

SEQ ID NO: 607356 - RNA, 20 nt, Escherichia coli CFT073
aucauugacaaucgccgcca

SEQ ID NO: 607357 - RNA, 13 nt, Escherichia coli CFT073
aucauggcgugaa

SEQ ID NO: 607358 - RNA, 23 nt, Escherichia coli CFT073
aucauggcgggcgucgaucucuu

SEQ ID NO: 607359 - RNA, 13 nt, Escherichia coli CFT073
auccagacggcgc

SEQ ID NO: 607360 - RNA, 14 nt, Escherichia coli CFT073
auccagacugcgca

SEQ ID NO: 607361 - RNA, 16 nt, Escherichia coli CFT073
auccagaucacgcagc

SEQ ID NO: 607362 - RNA, 22 nt, Escherichia coli CFT073
auccagcaccacuacagcggaa

SEQ ID NO: 607363 - RNA, 14 nt, Escherichia coli CFT073
auccagcagaugcu

SEQ ID NO: 607364 - RNA, 14 nt, Escherichia coli CFT073
auccagcaugcuca

SEQ ID NO: 607365 - RNA, 18 nt, Escherichia coli CFT073
auccagccagcgccgcgc

SEQ ID NO: 607366 - RNA, 17 nt, Escherichia coli CFT073
auccagguagcaaacaa

SEQ ID NO: 607367 - RNA, 22 nt, Escherichia coli CFT073
auccagcgguuggagcacaaug

SEQ ID NO: 607368 - RNA, 13 nt, Escherichia coli CFT073
auccagcgucgcc

SEQ ID NO: 607369 - RNA, 22 nt, Escherichia coli CFT073
auccagcuucgccagcgcgcgg

SEQ ID NO: 607370 - RNA, 23 nt, Escherichia coli CFT073
auccagcggcgagcuuuucugga

SEQ ID NO: 607371 - RNA, 22 nt, Escherichia coli CFT073
auccagcgcggcgaaggugccu

SEQ ID NO: 607372 - RNA, 11 nt, Escherichia coli CFT073
auccagcgccc

SEQ ID NO: 607373 - RNA, 22 nt, Escherichia coli CFT073
auccagccuacagaacgcugca

SEQ ID NO: 607374 - RNA, 18 nt, Escherichia coli CFT073
auccagcgcaguuuuucc

SEQ ID NO: 607375 - RNA, 19 nt, Escherichia coli CFT073
auccauauuuuuugaaaaa

SEQ ID NO: 607376 - RNA, 13 nt, Escherichia coli CFT073
auccauaccacag

SEQ ID NO: 607377 - RNA, 19 nt, Escherichia coli CFT073
auccauaccagcacauaac

SEQ ID NO: 607378 - RNA, 14 nt, Escherichia coli CFT073
auccauaucgccau

SEQ ID NO: 607379 - RNA, 14 nt, Escherichia coli CFT073
auccagugccgccg

SEQ ID NO: 607380 - RNA, 14 nt, Escherichia coli CFT073
auccaguaacgcgu

SEQ ID NO: 607381 - RNA, 18 nt, Escherichia coli CFT073
aucccaccagcgccgccc

SEQ ID NO: 607382 - RNA, 20 nt, Escherichia coli CFT073
auccauucgaugagagcggu

SEQ ID NO: 607383 - RNA, 21 nt, Escherichia coli CFT073
auccaucagacuuugcgccau

SEQ ID NO: 607384 - RNA, 23 nt, Escherichia coli CFT073
auccaugcggcagagaucgccgc

SEQ ID NO: 607385 - RNA, 23 nt, Escherichia coli CFT073
auccaugauauuggcaucgccag

SEQ ID NO: 607386 - RNA, 23 nt, Escherichia coli CFT073
auccccaauacgauuaacgccag

SEQ ID NO: 607387 - RNA, 13 nt, Escherichia coli CFT073
auccccgauggug

SEQ ID NO: 607388 - RNA, 14 nt, Escherichia coli CFT073
auccccguaucuuc

SEQ ID NO: 607389 - RNA, 16 nt, Escherichia coli CFT073
aucccauuucuccacu

SEQ ID NO: 607390 - RNA, 20 nt, Escherichia coli CFT073
aucccgccgaccaacgcaga

SEQ ID NO: 607391 - RNA, 20 nt, Escherichia coli CFT073
aucccggaagccaccacgcc

SEQ ID NO: 607392 - RNA, 22 nt, Escherichia coli CFT073
aucccggaagccaccacgccaa

SEQ ID NO: 607393 - RNA, 20 nt, Escherichia coli CFT073
auccccuucucaaucccuuu

SEQ ID NO: 607394 - RNA, 17 nt, Escherichia coli CFT073
auccccugcccgauaaa

SEQ ID NO: 607395 - RNA, 16 nt, Escherichia coli CFT073
aucccgccaaccggaa

SEQ ID NO: 607396 - RNA, 22 nt, Escherichia coli CFT073
aucccguugccacucaggcaaa

SEQ ID NO: 607397 - RNA, 22 nt, Escherichia coli CFT073
aucccugcgaacugcgcagauu

SEQ ID NO: 607398 - RNA, 22 nt, Escherichia coli CFT073
aucccuuccugcccuuuuaaua

SEQ ID NO: 607399 - RNA, 14 nt, Escherichia coli CFT073
aucccuucuccaca

SEQ ID NO: 607400 - RNA, 16 nt, Escherichia coli CFT073
aucccggcaaccgcaa

SEQ ID NO: 607401 - RNA, 23 nt, Escherichia coli CFT073
aucccggcaccaaucaccgccaa

SEQ ID NO: 607402 - RNA, 22 nt, Escherichia coli CFT073
aucccggcagagaaaaugccgc

SEQ ID NO: 607403 - RNA, 17 nt, Escherichia coli CFT073
aucccgcuguuuguuca

SEQ ID NO: 607404 - RNA, 21 nt, Escherichia coli CFT073
aucccggucaugauacagccg

SEQ ID NO: 607405 - RNA, 18 nt, Escherichia coli CFT073
aucauaaaacaccacgcg

SEQ ID NO: 607406 - RNA, 16 nt, Escherichia coli CFT073
aucauaugcacaauca

SEQ ID NO: 607407 - RNA, 17 nt, Escherichia coli CFT073
aucauauuguccuguac

SEQ ID NO: 607408 - RNA, 14 nt, Escherichia coli CFT073
aucaucaaagccaa

SEQ ID NO: 607409 - RNA, 19 nt, Escherichia coli CFT073
aucauagcgaauaaucccg

SEQ ID NO: 607410 - RNA, 19 nt, Escherichia coli CFT073
aucaucaagacccggcgca

SEQ ID NO: 607411 - RNA, 22 nt, Escherichia coli CFT073
aucauccgcaauaacuaaacgc

SEQ ID NO: 607412 - RNA, 19 nt, Escherichia coli CFT073
aucauccggcacuuuuuca

SEQ ID NO: 607413 - RNA, 20 nt, Escherichia coli CFT073
aucauccucuucaccgguac

SEQ ID NO: 607414 - RNA, 15 nt, Escherichia coli CFT073
aucaucccggcaaac

SEQ ID NO: 607415 - RNA, 20 nt, Escherichia coli CFT073
aucaucauccagcacgguga

SEQ ID NO: 607416 - RNA, 14 nt, Escherichia coli CFT073
aucauccacccgca

SEQ ID NO: 607417 - RNA, 16 nt, Escherichia coli CFT073
aucauccaggugaaaa

SEQ ID NO: 607418 - RNA, 19 nt, Escherichia coli CFT073
aucaugccggccagcgcca

SEQ ID NO: 607419 - RNA, 19 nt, Escherichia coli CFT073
aucaugcagcgcagaccau

SEQ ID NO: 607420 - RNA, 23 nt, Escherichia coli CFT073
aucaucuguugugccacauccag

SEQ ID NO: 607421 - RNA, 15 nt, Escherichia coli CFT073
aucaugaaacgccca

SEQ ID NO: 607422 - RNA, 15 nt, Escherichia coli CFT073
aucaucuaccagcau

SEQ ID NO: 607423 - RNA, 16 nt, Escherichia coli CFT073
aucaucucaacaaacg

SEQ ID NO: 607424 - RNA, 17 nt, Escherichia coli CFT073
aucaucuggcugugauc

SEQ ID NO: 607425 - RNA, 22 nt, Escherichia coli CFT073
aucaucugguuccuaaauaacc

SEQ ID NO: 607426 - RNA, 18 nt, Escherichia coli CFT073
aucaucggguugcugauu

SEQ ID NO: 607427 - RNA, 13 nt, Escherichia coli CFT073
aucaucgggaaga

SEQ ID NO: 607428 - RNA, 18 nt, Escherichia coli CFT073
aucagugcaaucagcggc

SEQ ID NO: 607429 - RNA, 18 nt, Escherichia coli CFT073
aucaguguuggcggcaga

SEQ ID NO: 607430 - RNA, 15 nt, Escherichia coli CFT073
aucaguccguugucu

SEQ ID NO: 607431 - RNA, 17 nt, Escherichia coli CFT073
aucagcuacaccgauca

SEQ ID NO: 607432 - RNA, 22 nt, Escherichia coli CFT073
aucagcuccgggcuaacacccg

SEQ ID NO: 607433 - RNA, 16 nt, Escherichia coli CFT073
aucagcguuucgccau

SEQ ID NO: 607434 - RNA, 22 nt, Escherichia coli CFT073
aucagcggcggcgcaaccauca

SEQ ID NO: 607435 - RNA, 19 nt, Escherichia coli CFT073
aucagcguaaaggccggaa

SEQ ID NO: 607436 - RNA, 14 nt, Escherichia coli CFT073
aucagguaagcgaa

SEQ ID NO: 607437 - RNA, 18 nt, Escherichia coli CFT073
aucagggccaaucaacga

SEQ ID NO: 607438 - RNA, 14 nt, Escherichia coli CFT073
aucagcuuauccag

SEQ ID NO: 607439 - RNA, 14 nt, Escherichia coli CFT073
aucaaguuacgaua

SEQ ID NO: 607440 - RNA, 14 nt, Escherichia coli CFT073
aucaacggcgucag

SEQ ID NO: 607441 - RNA, 18 nt, Escherichia coli CFT073
aucaaucgaccgacuuua

SEQ ID NO: 607442 - RNA, 22 nt, Escherichia coli CFT073
aucaauaacagcgcaaucaccg

SEQ ID NO: 607443 - RNA, 14 nt, Escherichia coli CFT073
aucaauaacauacc

SEQ ID NO: 607444 - RNA, 18 nt, Escherichia coli CFT073
aucaauauuccagucagc

SEQ ID NO: 607445 - RNA, 19 nt, Escherichia coli CFT073
aucaccggcaucugcuguu

SEQ ID NO: 607446 - RNA, 20 nt, Escherichia coli CFT073
aucaccggaugcccggucaa

SEQ ID NO: 607447 - RNA, 13 nt, Escherichia coli CFT073
aucaccggucgac

SEQ ID NO: 607448 - RNA, 21 nt, Escherichia coli CFT073
aucaccgucguuaaugcgccc

SEQ ID NO: 607449 - RNA, 12 nt, Escherichia coli CFT073
aucaccggaucg

SEQ ID NO: 607450 - RNA, 17 nt, Escherichia coli CFT073
aucaccucaucaccaca

SEQ ID NO: 607451 - RNA, 23 nt, Escherichia coli CFT073
aucaccucaucaccacagacaaa

SEQ ID NO: 607452 - RNA, 15 nt, Escherichia coli CFT073
aucacgcaacauucc

SEQ ID NO: 607453 - RNA, 18 nt, Escherichia coli CFT073
aucacgcaacauuccggc

SEQ ID NO: 607454 - RNA, 17 nt, Escherichia coli CFT073
aucacgcaguuucgcgu

SEQ ID NO: 607455 - RNA, 16 nt, Escherichia coli CFT073
aucacgccgcuggcau

SEQ ID NO: 607456 - RNA, 20 nt, Escherichia coli CFT073
aucacggcuuugaucagcgu

SEQ ID NO: 607457 - RNA, 16 nt, Escherichia coli CFT073
aucacuggcagggaaa

SEQ ID NO: 607458 - RNA, 12 nt, Escherichia coli CFT073
aucacuuucugc

SEQ ID NO: 607459 - RNA, 15 nt, Escherichia coli CFT073
aucagaacaucgcca

SEQ ID NO: 607460 - RNA, 15 nt, Escherichia coli CFT073
aucacuuucaccggu

SEQ ID NO: 607461 - RNA, 17 nt, Escherichia coli CFT073
aucagcaguucacagcg

SEQ ID NO: 607462 - RNA, 20 nt, Escherichia coli CFT073
aucagcauccauaucgccau

SEQ ID NO: 607463 - RNA, 20 nt, Escherichia coli CFT073
aucagccacuucaaccagcg

SEQ ID NO: 607464 - RNA, 23 nt, Escherichia coli CFT073
aucagccacuucaaccagcggcg

SEQ ID NO: 607465 - RNA, 19 nt, Escherichia coli CFT073
aucagcaucucauccauca

SEQ ID NO: 607466 - RNA, 22 nt, Escherichia coli CFT073
aucagcccagcccugaaccauc

SEQ ID NO: 607467 - RNA, 14 nt, Escherichia coli CFT073
auaugacucauaaa

SEQ ID NO: 607468 - RNA, 12 nt, Escherichia coli CFT073
auaugacaccaa

SEQ ID NO: 607469 - RNA, 17 nt, Escherichia coli CFT073
auaucuuuuaaaucauc

SEQ ID NO: 607470 - RNA, 16 nt, Escherichia coli CFT073
auaugaauauugcuga

SEQ ID NO: 607471 - RNA, 16 nt, Escherichia coli CFT073
auaugcacaaucagcg

SEQ ID NO: 607472 - RNA, 15 nt, Escherichia coli CFT073
auaugccaucgccag

SEQ ID NO: 607473 - RNA, 18 nt, Escherichia coli CFT073
auaugccccagcccgcca

SEQ ID NO: 607474 - RNA, 14 nt, Escherichia coli CFT073
auaugaucugcaca

SEQ ID NO: 607475 - RNA, 18 nt, Escherichia coli CFT073
auaucccauuucuccacu

SEQ ID NO: 607476 - RNA, 21 nt, Escherichia coli CFT073
auauccauagucacuaccugu

SEQ ID NO: 607477 - RNA, 20 nt, Escherichia coli CFT073
auaucccgccagcaccagca

SEQ ID NO: 607478 - RNA, 20 nt, Escherichia coli CFT073
auaucccggagaauagcgcc

SEQ ID NO: 607479 - RNA, 14 nt, Escherichia coli CFT073
auaucuuucucagu

SEQ ID NO: 607480 - RNA, 22 nt, Escherichia coli CFT073
auauugcccguuauucccacuu

SEQ ID NO: 607481 - RNA, 18 nt, Escherichia coli CFT073
auauugccgcgauagcaa

SEQ ID NO: 607482 - RNA, 19 nt, Escherichia coli CFT073
auauucauuuccggcggcg

SEQ ID NO: 607483 - RNA, 16 nt, Escherichia coli CFT073
auauucaccgucacaa

SEQ ID NO: 607484 - RNA, 21 nt, Escherichia coli CFT073
auauucacguuuuucauccag

SEQ ID NO: 607485 - RNA, 21 nt, Escherichia coli CFT073
auauucagucccuguuccacu

SEQ ID NO: 607486 - RNA, 17 nt, Escherichia coli CFT073
auauuccgcaacgccgc

SEQ ID NO: 607487 - RNA, 19 nt, Escherichia coli CFT073
auauuccgcaacgccgcca

SEQ ID NO: 607488 - RNA, 22 nt, Escherichia coli CFT073
auauuccgccaccugcgaacug

SEQ ID NO: 607489 - RNA, 19 nt, Escherichia coli CFT073
auauuccgucuccggaaug

SEQ ID NO: 607490 - RNA, 15 nt, Escherichia coli CFT073
auauuccugacccag

SEQ ID NO: 607491 - RNA, 14 nt, Escherichia coli CFT073
auauucgacacauu

SEQ ID NO: 607492 - RNA, 22 nt, Escherichia coli CFT073
aucaacgacaaaaauaccacca

SEQ ID NO: 607493 - RNA, 12 nt, Escherichia coli CFT073
aucaaccgccgg

SEQ ID NO: 607494 - RNA, 15 nt, Escherichia coli CFT073
aucaacgccaccauc

SEQ ID NO: 607495 - RNA, 14 nt, Escherichia coli CFT073
aucaaccacggcaa

SEQ ID NO: 607496 - RNA, 11 nt, Escherichia coli CFT073
aucaaccagca

SEQ ID NO: 607497 - RNA, 22 nt, Escherichia coli CFT073
aucaaccaguugugcaccacca

SEQ ID NO: 607498 - RNA, 18 nt, Escherichia coli CFT073
aucaacauaaugccgaca

SEQ ID NO: 607499 - RNA, 20 nt, Escherichia coli CFT073
aucaaacagccccugacugg

SEQ ID NO: 607500 - RNA, 21 nt, Escherichia coli CFT073
aucaaaaucaccgaugacaga

SEQ ID NO: 607501 - RNA, 18 nt, Escherichia coli CFT073
aucaaaauuccauuuuca

SEQ ID NO: 607502 - RNA, 21 nt, Escherichia coli CFT073
auauuuuuuauagucagugaa

SEQ ID NO: 607503 - RNA, 21 nt, Escherichia coli CFT073
auauuucuuuaucaccaauga

SEQ ID NO: 607504 - RNA, 17 nt, Escherichia coli CFT073
auauuuguuauaaacgc

SEQ ID NO: 607505 - RNA, 18 nt, Escherichia coli CFT073
auauuuguuuucauccac

SEQ ID NO: 607506 - RNA, 16 nt, Escherichia coli CFT073
auauuggcaacagcca

SEQ ID NO: 607507 - RNA, 13 nt, Escherichia coli CFT073
auauuuaacauca

SEQ ID NO: 607508 - RNA, 14 nt, Escherichia coli CFT073
auauuuauucauca

SEQ ID NO: 607509 - RNA, 18 nt, Escherichia coli CFT073
auauuucacauaacugcc

SEQ ID NO: 607510 - RNA, 19 nt, Escherichia coli CFT073
auagguguaaauaucagga

SEQ ID NO: 607511 - RNA, 20 nt, Escherichia coli CFT073
auagguguaaauaucaggau

SEQ ID NO: 607512 - RNA, 16 nt, Escherichia coli CFT073
auagcugauaucaccu

SEQ ID NO: 607513 - RNA, 16 nt, Escherichia coli CFT073
auagcucaguugguag

SEQ ID NO: 607514 - RNA, 16 nt, Escherichia coli CFT073
auagcgggaaauacug

SEQ ID NO: 607515 - RNA, 21 nt, Escherichia coli CFT073
auagcggguacagccggaacg

SEQ ID NO: 607516 - RNA, 17 nt, Escherichia coli CFT073
auagcgguaagcaugaa

SEQ ID NO: 607517 - RNA, 23 nt, Escherichia coli CFT073
auacccgcacaaauagccagcag

SEQ ID NO: 607518 - RNA, 17 nt, Escherichia coli CFT073
auacccagcaaugccag

SEQ ID NO: 607519 - RNA, 14 nt, Escherichia coli CFT073
auaccccgcaucgu

SEQ ID NO: 607520 - RNA, 18 nt, Escherichia coli CFT073
auagcgugacaccagcac

SEQ ID NO: 607521 - RNA, 17 nt, Escherichia coli CFT073
auagcgggcaaucagcg

SEQ ID NO: 607522 - RNA, 16 nt, Escherichia coli CFT073
auagcuaaaaauaauc

SEQ ID NO: 607523 - RNA, 22 nt, Escherichia coli CFT073
auagcuaaaaauaaucaggcga

SEQ ID NO: 607524 - RNA, 18 nt, Escherichia coli CFT073
auaccauccggccauuuu

SEQ ID NO: 607525 - RNA, 15 nt, Escherichia coli CFT073
auaccccaccgccga

SEQ ID NO: 607526 - RNA, 15 nt, Escherichia coli CFT073
auaccccagcggcaa

SEQ ID NO: 607527 - RNA, 17 nt, Escherichia coli CFT073
auaccccagcggcaacc

SEQ ID NO: 607528 - RNA, 22 nt, Escherichia coli CFT073
auaccccagcggcaaccagcag

SEQ ID NO: 607529 - RNA, 15 nt, Escherichia coli CFT073
auaccccaucagcgu

SEQ ID NO: 607530 - RNA, 16 nt, Escherichia coli CFT073
auaccacuuucagcaa

SEQ ID NO: 607531 - RNA, 14 nt, Escherichia coli CFT073
auaccagcaucagg

SEQ ID NO: 607532 - RNA, 23 nt, Escherichia coli CFT073
auaccagguaccgagauaacguu

SEQ ID NO: 607533 - RNA, 12 nt, Escherichia coli CFT073
auaccacaucaa

SEQ ID NO: 607534 - RNA, 20 nt, Escherichia coli CFT073
auacagcuuaaucaccagcg

SEQ ID NO: 607535 - RNA, 21 nt, Escherichia coli CFT073
auacagcuuaaucaccagcgc

SEQ ID NO: 607536 - RNA, 22 nt, Escherichia coli CFT073
auacagcuuaaucaccagcgca

SEQ ID NO: 607537 - RNA, 14 nt, Escherichia coli CFT073
auacagagcacgca

SEQ ID NO: 607538 - RNA, 13 nt, Escherichia coli CFT073
auauauaacagaa

SEQ ID NO: 607539 - RNA, 12 nt, Escherichia coli CFT073
auauaucagcgc

SEQ ID NO: 607540 - RNA, 15 nt, Escherichia coli CFT073
auagugaucagccuc

SEQ ID NO: 607541 - RNA, 13 nt, Escherichia coli CFT073
auagugcccggca

SEQ ID NO: 607542 - RNA, 14 nt, Escherichia coli CFT073
auaguccgccagaa

SEQ ID NO: 607543 - RNA, 23 nt, Escherichia coli CFT073
auaguauauuucgggaugaccga

SEQ ID NO: 607544 - RNA, 23 nt, Escherichia coli CFT073
auaguauuauucuugacuaucac

SEQ ID NO: 607545 - RNA, 16 nt, Escherichia coli CFT073
auaguaagaaccacag

SEQ ID NO: 607546 - RNA, 23 nt, Escherichia coli CFT073
auauauuauaucuucacgauuau

SEQ ID NO: 607547 - RNA, 12 nt, Escherichia coli CFT073
auaucaagcaug

SEQ ID NO: 607548 - RNA, 23 nt, Escherichia coli CFT073
auaucaauuagaauuauuagcaa

SEQ ID NO: 607549 - RNA, 20 nt, Escherichia coli CFT073
auauauuuaguucauauaau

SEQ ID NO: 607550 - RNA, 13 nt, Escherichia coli CFT073
auauauauuauau

SEQ ID NO: 607551 - RNA, 16 nt, Escherichia coli CFT073
auauaugucaccagca

SEQ ID NO: 607552 - RNA, 21 nt, Escherichia coli CFT073
auaucaacgcccauacucauc

SEQ ID NO: 607553 - RNA, 22 nt, Escherichia coli CFT073
auaucauccauuaacgucagcg

SEQ ID NO: 607554 - RNA, 18 nt, Escherichia coli CFT073
auauccaccgucaaaucc

SEQ ID NO: 607555 - RNA, 15 nt, Escherichia coli CFT073
auauccacccgcagc

SEQ ID NO: 607556 - RNA, 14 nt, Escherichia coli CFT073
auaucagccugcaa

SEQ ID NO: 607557 - RNA, 21 nt, Escherichia coli CFT073
auaaaucagaucgacgccgau

SEQ ID NO: 607558 - RNA, 16 nt, Escherichia coli CFT073
auaaaucagcgugaug

SEQ ID NO: 607559 - RNA, 14 nt, Escherichia coli CFT073
auaaaggguaauau

SEQ ID NO: 607560 - RNA, 12 nt, Escherichia coli CFT073
auaaauaacauc

SEQ ID NO: 607561 - RNA, 20 nt, Escherichia coli CFT073
auaaacugcgaccagggaua

SEQ ID NO: 607562 - RNA, 19 nt, Escherichia coli CFT073
auaaagcccccacaacauu

SEQ ID NO: 607563 - RNA, 15 nt, Escherichia coli CFT073
auaaagcgaccaacc

SEQ ID NO: 607564 - RNA, 21 nt, Escherichia coli CFT073
auaaagcugaucgcauaaccc

SEQ ID NO: 607565 - RNA, 15 nt, Escherichia coli CFT073
auaaaaugcgaaaaa

SEQ ID NO: 607566 - RNA, 15 nt, Escherichia coli CFT073
auaaacacggcgaac

SEQ ID NO: 607567 - RNA, 18 nt, Escherichia coli CFT073
auaaacccaacggcaaac

SEQ ID NO: 607568 - RNA, 21 nt, Escherichia coli CFT073
auaaacgccaauaaucugccc

SEQ ID NO: 607569 - RNA, 14 nt, Escherichia coli CFT073
auaaacgccgucgc

SEQ ID NO: 607570 - RNA, 20 nt, Escherichia coli CFT073
auaaacaucgggacaugaua

SEQ ID NO: 607571 - RNA, 17 nt, Escherichia coli CFT073
auaaacauuacgcuucg

SEQ ID NO: 607572 - RNA, 17 nt, Escherichia coli CFT073
aguuacugcccgcacac

SEQ ID NO: 607573 - RNA, 18 nt, Escherichia coli CFT073
aguuauagagcugaauaa

SEQ ID NO: 607574 - RNA, 19 nt, Escherichia coli CFT073
aguuaucgccgaacgccac

SEQ ID NO: 607575 - RNA, 16 nt, Escherichia coli CFT073
aguuauuaaaaauggg

SEQ ID NO: 607576 - RNA, 19 nt, Escherichia coli CFT073
aguugcucggcaaggccaa

SEQ ID NO: 607577 - RNA, 23 nt, Escherichia coli CFT073
aguugcucuucguuaauuucugc

SEQ ID NO: 607578 - RNA, 13 nt, Escherichia coli CFT073
aguucaggauaau

SEQ ID NO: 607579 - RNA, 21 nt, Escherichia coli CFT073
aguugcuccacugcucaccgc

SEQ ID NO: 607580 - RNA, 19 nt, Escherichia coli CFT073
aguucacgcgauuuuucau

SEQ ID NO: 607581 - RNA, 14 nt, Escherichia coli CFT073
auaaaagcauaccg

SEQ ID NO: 607582 - RNA, 20 nt, Escherichia coli CFT073
auaaaagcuuuccggaaaaa

SEQ ID NO: 607583 - RNA, 16 nt, Escherichia coli CFT073
auaaaacuucugcaac

SEQ ID NO: 607584 - RNA, 21 nt, Escherichia coli CFT073
auaaaacggcgcauugccuga

SEQ ID NO: 607585 - RNA, 17 nt, Escherichia coli CFT073
auaaaacucgauggcgu

SEQ ID NO: 607586 - RNA, 15 nt, Escherichia coli CFT073
auaaaaacucaaaaa

SEQ ID NO: 607587 - RNA, 21 nt, Escherichia coli CFT073
aguuuaaacagaauacccagc

SEQ ID NO: 607588 - RNA, 20 nt, Escherichia coli CFT073
aguugguagagcacgaccuu

SEQ ID NO: 607589 - RNA, 14 nt, Escherichia coli CFT073
aguuggcagcaagc

SEQ ID NO: 607590 - RNA, 15 nt, Escherichia coli CFT073
auaaggccaccagcg

SEQ ID NO: 607591 - RNA, 16 nt, Escherichia coli CFT073
auaaggcgguuacgcc

SEQ ID NO: 607592 - RNA, 20 nt, Escherichia coli CFT073
auaaggcguucaagccgcau

SEQ ID NO: 607593 - RNA, 19 nt, Escherichia coli CFT073
auaaggcguuuacgccgca

SEQ ID NO: 607594 - RNA, 20 nt, Escherichia coli CFT073
auaaggcguuuacgccgcau

SEQ ID NO: 607595 - RNA, 17 nt, Escherichia coli CFT073
auaauauucggcguaau

SEQ ID NO: 607596 - RNA, 13 nt, Escherichia coli CFT073
auaauauuucccc

SEQ ID NO: 607597 - RNA, 16 nt, Escherichia coli CFT073
auaaucaacaggaaca

SEQ ID NO: 607598 - RNA, 13 nt, Escherichia coli CFT073
auaaucaccagua

SEQ ID NO: 607599 - RNA, 19 nt, Escherichia coli CFT073
auaaucggucgacugcgcu

SEQ ID NO: 607600 - RNA, 15 nt, Escherichia coli CFT073
auaauccguuagcga

SEQ ID NO: 607601 - RNA, 18 nt, Escherichia coli CFT073
auaauccugccgagauac

SEQ ID NO: 607602 - RNA, 18 nt, Escherichia coli CFT073
auaaucgaaaacaucaug

SEQ ID NO: 607603 - RNA, 18 nt, Escherichia coli CFT073
auaaucgaaaccuucagc

SEQ ID NO: 607604 - RNA, 19 nt, Escherichia coli CFT073
auaaucaccaguaccgccg

SEQ ID NO: 607605 - RNA, 19 nt, Escherichia coli CFT073
auaaucaucagacuggcgu

SEQ ID NO: 607606 - RNA, 13 nt, Escherichia coli CFT073
auaauccaugcca

SEQ ID NO: 607607 - RNA, 16 nt, Escherichia coli CFT073
auaauccccaauacga

SEQ ID NO: 607608 - RNA, 11 nt, Escherichia coli CFT073
auaaaugccaa

SEQ ID NO: 607609 - RNA, 18 nt, Escherichia coli CFT073
auaaaugaguggugauga

SEQ ID NO: 607610 - RNA, 18 nt, Escherichia coli CFT073
auaacaaucaccaaacca

SEQ ID NO: 607611 - RNA, 14 nt, Escherichia coli CFT073
auaacaaucaucaa

SEQ ID NO: 607612 - RNA, 17 nt, Escherichia coli CFT073
auaagcgaacauccggc

SEQ ID NO: 607613 - RNA, 20 nt, Escherichia coli CFT073
auaagcguagcgcaucaggc

SEQ ID NO: 607614 - RNA, 15 nt, Escherichia coli CFT073
auaagcugagcacaa

SEQ ID NO: 607615 - RNA, 16 nt, Escherichia coli CFT073
auaauuccucccguua

SEQ ID NO: 607616 - RNA, 21 nt, Escherichia coli CFT073
auaauuagugcugcuggaaaa

SEQ ID NO: 607617 - RNA, 17 nt, Escherichia coli CFT073
auacaccggcaucaacg

SEQ ID NO: 607618 - RNA, 18 nt, Escherichia coli CFT073
auacaccggcaucaacgg

SEQ ID NO: 607619 - RNA, 19 nt, Escherichia coli CFT073
auaaugaaugcguuccagu

SEQ ID NO: 607620 - RNA, 18 nt, Escherichia coli CFT073
auaaucugcccggcauua

SEQ ID NO: 607621 - RNA, 16 nt, Escherichia coli CFT073
auaaucucaccauuuu

SEQ ID NO: 607622 - RNA, 15 nt, Escherichia coli CFT073
auaaucucaucggcg

SEQ ID NO: 607623 - RNA, 17 nt, Escherichia coli CFT073
auaaugggaauuggcgu

SEQ ID NO: 607624 - RNA, 20 nt, Escherichia coli CFT073
auaaugucgcugguaacauc

SEQ ID NO: 607625 - RNA, 16 nt, Escherichia coli CFT073
auaaugccaccagugc

SEQ ID NO: 607626 - RNA, 14 nt, Escherichia coli CFT073
auaaugcgccacca

SEQ ID NO: 607627 - RNA, 23 nt, Escherichia coli CFT073
auaaugacuuccgccaccacgcc

SEQ ID NO: 607628 - RNA, 13 nt, Escherichia coli CFT073
aguccugccagaa

SEQ ID NO: 607629 - RNA, 23 nt, Escherichia coli CFT073
aguccgucguucaacaagccacg

SEQ ID NO: 607630 - RNA, 19 nt, Escherichia coli CFT073
aguccgccauuauuaccga

SEQ ID NO: 607631 - RNA, 12 nt, Escherichia coli CFT073
aguccgccagaa

SEQ ID NO: 607632 - RNA, 23 nt, Escherichia coli CFT073
agucgcgguccgggccgcaaacc

SEQ ID NO: 607633 - RNA, 16 nt, Escherichia coli CFT073
agucgcugaucaccgu

SEQ ID NO: 607634 - RNA, 18 nt, Escherichia coli CFT073
agucgcgcucaucagcgg

SEQ ID NO: 607635 - RNA, 20 nt, Escherichia coli CFT073
agucgcugugacauccagau

SEQ ID NO: 607636 - RNA, 16 nt, Escherichia coli CFT073
agugauggcacaccau

SEQ ID NO: 607637 - RNA, 12 nt, Escherichia coli CFT073
agugauuccggg

SEQ ID NO: 607638 - RNA, 16 nt, Escherichia coli CFT073
agucguugccggaucu

SEQ ID NO: 607639 - RNA, 19 nt, Escherichia coli CFT073
agugccagugccgagauau

SEQ ID NO: 607640 - RNA, 22 nt, Escherichia coli CFT073
agugcauccaguugcgccgcau

SEQ ID NO: 607641 - RNA, 22 nt, Escherichia coli CFT073
agugcaggaugcgacauaaacg

SEQ ID NO: 607642 - RNA, 20 nt, Escherichia coli CFT073
agugcagauaccaccagcgc

SEQ ID NO: 607643 - RNA, 20 nt, Escherichia coli CFT073
agugcagcgcaugauuuuca

SEQ ID NO: 607644 - RNA, 20 nt, Escherichia coli CFT073
agucguauccucagaaauca

SEQ ID NO: 607645 - RNA, 17 nt, Escherichia coli CFT073
agucggugccauggcug

SEQ ID NO: 607646 - RNA, 21 nt, Escherichia coli CFT073
agugccggaugaugugaauca

SEQ ID NO: 607647 - RNA, 17 nt, Escherichia coli CFT073
agugccggaugauucac

SEQ ID NO: 607648 - RNA, 18 nt, Escherichia coli CFT073
agugccggaugauucaca

SEQ ID NO: 607649 - RNA, 16 nt, Escherichia coli CFT073
agugccgaaaucauca

SEQ ID NO: 607650 - RNA, 17 nt, Escherichia coli CFT073
agugccgccugcgccag

SEQ ID NO: 607651 - RNA, 14 nt, Escherichia coli CFT073
agugccgcgcauag

SEQ ID NO: 607652 - RNA, 16 nt, Escherichia coli CFT073
agugccugaugcgacg

SEQ ID NO: 607653 - RNA, 12 nt, Escherichia coli CFT073
aguggcugacca

SEQ ID NO: 607654 - RNA, 21 nt, Escherichia coli CFT073
aguguuuuauaccaacaaaaa

SEQ ID NO: 607655 - RNA, 15 nt, Escherichia coli CFT073
aguuaacaccaccgc

SEQ ID NO: 607656 - RNA, 14 nt, Escherichia coli CFT073
aguuaauccacagc

SEQ ID NO: 607657 - RNA, 18 nt, Escherichia coli CFT073
aguggucgacaaccagca

SEQ ID NO: 607658 - RNA, 20 nt, Escherichia coli CFT073
aguguggggaaugauauuuu

SEQ ID NO: 607659 - RNA, 18 nt, Escherichia coli CFT073
aguagcucaccagcaggc

SEQ ID NO: 607660 - RNA, 14 nt, Escherichia coli CFT073
aguagcgccagacu

SEQ ID NO: 607661 - RNA, 22 nt, Escherichia coli CFT073
aguagccucugcguuauuuuca

SEQ ID NO: 607662 - RNA, 14 nt, Escherichia coli CFT073
aguaggucauaucg

SEQ ID NO: 607663 - RNA, 20 nt, Escherichia coli CFT073
agucaucacuuucagaccgc

SEQ ID NO: 607664 - RNA, 15 nt, Escherichia coli CFT073
agucaguacggcaaa

SEQ ID NO: 607665 - RNA, 23 nt, Escherichia coli CFT073
agucccuccgcacaaacgccacc

SEQ ID NO: 607666 - RNA, 14 nt, Escherichia coli CFT073
aguccaggccugau

SEQ ID NO: 607667 - RNA, 16 nt, Escherichia coli CFT073
aguccacaucaaccag

SEQ ID NO: 607668 - RNA, 16 nt, Escherichia coli CFT073
aguaauuaaacugaug

SEQ ID NO: 607669 - RNA, 13 nt, Escherichia coli CFT073
aguacaggcggca

SEQ ID NO: 607670 - RNA, 21 nt, Escherichia coli CFT073
aguagcaugaacauugcugcu

SEQ ID NO: 607671 - RNA, 17 nt, Escherichia coli CFT073
aguacgaugauugccac

SEQ ID NO: 607672 - RNA, 18 nt, Escherichia coli CFT073
aguagcaaccggauuuuu

SEQ ID NO: 607673 - RNA, 18 nt, Escherichia coli CFT073
aguagcagcaggaauaau

SEQ ID NO: 607674 - RNA, 21 nt, Escherichia coli CFT073
aguacaugaagcacggcauca

SEQ ID NO: 607675 - RNA, 13 nt, Escherichia coli CFT073
aguacauuucuuc

SEQ ID NO: 607676 - RNA, 13 nt, Escherichia coli CFT073
agguucagccgag

SEQ ID NO: 607677 - RNA, 18 nt, Escherichia coli CFT073
agguucugaccagccagc

SEQ ID NO: 607678 - RNA, 20 nt, Escherichia coli CFT073
agguuaucgcccugccagcg

SEQ ID NO: 607679 - RNA, 22 nt, Escherichia coli CFT073
agguuaggcugagaaccgcaca

SEQ ID NO: 607680 - RNA, 13 nt, Escherichia coli CFT073
agguuauaaaccc

SEQ ID NO: 607681 - RNA, 22 nt, Escherichia coli CFT073
agguuagaaacgccccagcggc

SEQ ID NO: 607682 - RNA, 13 nt, Escherichia coli CFT073
agguuaacccaca

SEQ ID NO: 607683 - RNA, 15 nt, Escherichia coli CFT073
agguaguugccagca

SEQ ID NO: 607684 - RNA, 22 nt, Escherichia coli CFT073
agguagacaccaaggaacugug

SEQ ID NO: 607685 - RNA, 20 nt, Escherichia coli CFT073
agguaaugcgcgagccauaa

SEQ ID NO: 607686 - RNA, 12 nt, Escherichia coli CFT073
agguauccagac

SEQ ID NO: 607687 - RNA, 15 nt, Escherichia coli CFT073
agguggggcuuuucu

SEQ ID NO: 607688 - RNA, 22 nt, Escherichia coli CFT073
aggugguauagaaugcagcagc

SEQ ID NO: 607689 - RNA, 18 nt, Escherichia coli CFT073
agguggcaaacgccaccu

SEQ ID NO: 607690 - RNA, 16 nt, Escherichia coli CFT073
agggcggcuaucccaa

SEQ ID NO: 607691 - RNA, 14 nt, Escherichia coli CFT073
agguaaagaccaua

SEQ ID NO: 607692 - RNA, 21 nt, Escherichia coli CFT073
agggcgagaaauugagauaag

SEQ ID NO: 607693 - RNA, 17 nt, Escherichia coli CFT073
agggcgaacgagauaau

SEQ ID NO: 607694 - RNA, 15 nt, Escherichia coli CFT073
agggcgaauuccuga

SEQ ID NO: 607695 - RNA, 14 nt, Escherichia coli CFT073
agggauuguuuaaa

SEQ ID NO: 607696 - RNA, 16 nt, Escherichia coli CFT073
agggaucaacauucag

SEQ ID NO: 607697 - RNA, 13 nt, Escherichia coli CFT073
agggagcaggcca

SEQ ID NO: 607698 - RNA, 16 nt, Escherichia coli CFT073
agggaauuggcguaua

SEQ ID NO: 607699 - RNA, 13 nt, Escherichia coli CFT073
agggaaauaaucg

SEQ ID NO: 607700 - RNA, 20 nt, Escherichia coli CFT073
agggaagcgaguuaccacgc

SEQ ID NO: 607701 - RNA, 15 nt, Escherichia coli CFT073
aggcuucccacggua

SEQ ID NO: 607702 - RNA, 14 nt, Escherichia coli CFT073
aggcuggagcaaac

SEQ ID NO: 607703 - RNA, 17 nt, Escherichia coli CFT073
aggcuuugcuuauaacc

SEQ ID NO: 607704 - RNA, 22 nt, Escherichia coli CFT073
aggccgcaggcuguuaccccug

SEQ ID NO: 607705 - RNA, 18 nt, Escherichia coli CFT073
aggcguucacgccgcauc

SEQ ID NO: 607706 - RNA, 20 nt, Escherichia coli CFT073
aggcguucacgccgcaucug

SEQ ID NO: 607707 - RNA, 18 nt, Escherichia coli CFT073
aggcguucaagccgcauc

SEQ ID NO: 607708 - RNA, 20 nt, Escherichia coli CFT073
aggcgugaagccccaacgua

SEQ ID NO: 607709 - RNA, 20 nt, Escherichia coli CFT073
agccaugguuuaaucgccgu

SEQ ID NO: 607710 - RNA, 15 nt, Escherichia coli CFT073
agccauucuggcgca

SEQ ID NO: 607711 - RNA, 19 nt, Escherichia coli CFT073
agccauugcccgaugcgca

SEQ ID NO: 607712 - RNA, 19 nt, Escherichia coli CFT073
agccaucgacaccagccag

SEQ ID NO: 607713 - RNA, 14 nt, Escherichia coli CFT073
agccaucgccaccg

SEQ ID NO: 607714 - RNA, 17 nt, Escherichia coli CFT073
agccaucaccggcaucu

SEQ ID NO: 607715 - RNA, 23 nt, Escherichia coli CFT073
agccaugcggcaucuucuccacg

SEQ ID NO: 607716 - RNA, 19 nt, Escherichia coli CFT073
agcccgacgauaccgccgc

SEQ ID NO: 607717 - RNA, 15 nt, Escherichia coli CFT073
agccccagcgcaaua

SEQ ID NO: 607718 - RNA, 14 nt, Escherichia coli CFT073
agccccagcgcaga

SEQ ID NO: 607719 - RNA, 17 nt, Escherichia coli CFT073
agccccaucagcgccau

SEQ ID NO: 607720 - RNA, 17 nt, Escherichia coli CFT073
agcccccacgccauacc

SEQ ID NO: 607721 - RNA, 16 nt, Escherichia coli CFT073
agcccuacaaaccauc

SEQ ID NO: 607722 - RNA, 20 nt, Escherichia coli CFT073
agcccuaucaucgcggcaca

SEQ ID NO: 607723 - RNA, 11 nt, Escherichia coli CFT073
agcccugcucg

SEQ ID NO: 607724 - RNA, 22 nt, Escherichia coli CFT073
agccgaacagugccagacaaac

SEQ ID NO: 607725 - RNA, 19 nt, Escherichia coli CFT073
agcccuugcuucgccaguu

SEQ ID NO: 607726 - RNA, 21 nt, Escherichia coli CFT073
agcccugucgaggccaauuug

SEQ ID NO: 607727 - RNA, 20 nt, Escherichia coli CFT073
agccgcagcuaucagcgaga

SEQ ID NO: 607728 - RNA, 14 nt, Escherichia coli CFT073
agccgcauccgaca

SEQ ID NO: 607729 - RNA, 16 nt, Escherichia coli CFT073
agccgccaaacgccgc

SEQ ID NO: 607730 - RNA, 12 nt, Escherichia coli CFT073
agccgccagaca

SEQ ID NO: 607731 - RNA, 19 nt, Escherichia coli CFT073
agccgccagagaaagcccg

SEQ ID NO: 607732 - RNA, 12 nt, Escherichia coli CFT073
agccgauccgcg

SEQ ID NO: 607733 - RNA, 12 nt, Escherichia coli CFT073
agccgccgccau

SEQ ID NO: 607734 - RNA, 21 nt, Escherichia coli CFT073
agccgcccagcgaaccgccaa

SEQ ID NO: 607735 - RNA, 17 nt, Escherichia coli CFT073
agccgcgcaguuucuua

SEQ ID NO: 607736 - RNA, 20 nt, Escherichia coli CFT073
agcauaguacgggcaauuuc

SEQ ID NO: 607737 - RNA, 13 nt, Escherichia coli CFT073
agcauauacgaaa

SEQ ID NO: 607738 - RNA, 21 nt, Escherichia coli CFT073
agcauggaauagaaucaccgc

SEQ ID NO: 607739 - RNA, 18 nt, Escherichia coli CFT073
agcaugccuguggcgcga

SEQ ID NO: 607740 - RNA, 18 nt, Escherichia coli CFT073
agcauuuugcggaucugc

SEQ ID NO: 607741 - RNA, 21 nt, Escherichia coli CFT073
agccaaacgcccagcuaaucg

SEQ ID NO: 607742 - RNA, 19 nt, Escherichia coli CFT073
agccaaacucauccaccac

SEQ ID NO: 607743 - RNA, 13 nt, Escherichia coli CFT073
agccaaagcgaca

SEQ ID NO: 607744 - RNA, 12 nt, Escherichia coli CFT073
agccaagccaga

SEQ ID NO: 607745 - RNA, 19 nt, Escherichia coli CFT073
agccaacgaucuggcguca

SEQ ID NO: 607746 - RNA, 17 nt, Escherichia coli CFT073
agccaacaaucgcugcg

SEQ ID NO: 607747 - RNA, 23 nt, Escherichia coli CFT073
agccaaccacaugaucauucacc

SEQ ID NO: 607748 - RNA, 14 nt, Escherichia coli CFT073
agccaaauccagca

SEQ ID NO: 607749 - RNA, 22 nt, Escherichia coli CFT073
agccaaccgggccgcagagaua

SEQ ID NO: 607750 - RNA, 13 nt, Escherichia coli CFT073
agccaagcgccgc

SEQ ID NO: 607751 - RNA, 15 nt, Escherichia coli CFT073
agccauaccgggauc

SEQ ID NO: 607752 - RNA, 19 nt, Escherichia coli CFT073
agccauaaaaucacagguc

SEQ ID NO: 607753 - RNA, 15 nt, Escherichia coli CFT073
agccaguucgagaaa

SEQ ID NO: 607754 - RNA, 15 nt, Escherichia coli CFT073
agccaguugcucuuc

SEQ ID NO: 607755 - RNA, 21 nt, Escherichia coli CFT073
agccagcguaccuugcggcgg

SEQ ID NO: 607756 - RNA, 16 nt, Escherichia coli CFT073
agccaguccggcaaug

SEQ ID NO: 607757 - RNA, 16 nt, Escherichia coli CFT073
agccagcggcggcaca

SEQ ID NO: 607758 - RNA, 16 nt, Escherichia coli CFT073
agccagcgccgcgcgg

SEQ ID NO: 607759 - RNA, 18 nt, Escherichia coli CFT073
agccagcgaccgcgccau

SEQ ID NO: 607760 - RNA, 19 nt, Escherichia coli CFT073
agccagcgaccgcgccaua

SEQ ID NO: 607761 - RNA, 19 nt, Escherichia coli CFT073
agccacggcuccagcaaug

SEQ ID NO: 607762 - RNA, 21 nt, Escherichia coli CFT073
agccacgguuuggcgaaaugu

SEQ ID NO: 607763 - RNA, 12 nt, Escherichia coli CFT073
agccacggcagc

SEQ ID NO: 607764 - RNA, 14 nt, Escherichia coli CFT073
agccacggaauaaa

SEQ ID NO: 607765 - RNA, 17 nt, Escherichia coli CFT073
agccacggaauaaaccg

SEQ ID NO: 607766 - RNA, 22 nt, Escherichia coli CFT073
agccacgcguucggaccaaugc

SEQ ID NO: 607767 - RNA, 17 nt, Escherichia coli CFT073
agccacgacguuuggug

SEQ ID NO: 607768 - RNA, 14 nt, Escherichia coli CFT073
agauuccgguuuaa

SEQ ID NO: 607769 - RNA, 17 nt, Escherichia coli CFT073
agauuaaucagcagaua

SEQ ID NO: 607770 - RNA, 15 nt, Escherichia coli CFT073
agauuaaaaucgccc

SEQ ID NO: 607771 - RNA, 18 nt, Escherichia coli CFT073
agauuaaaggcaccaaua

SEQ ID NO: 607772 - RNA, 19 nt, Escherichia coli CFT073
agauuguugaucguaacgg

SEQ ID NO: 607773 - RNA, 19 nt, Escherichia coli CFT073
agauuuaacggcagcaagg

SEQ ID NO: 607774 - RNA, 18 nt, Escherichia coli CFT073
agauucguauuuaaaacc

SEQ ID NO: 607775 - RNA, 20 nt, Escherichia coli CFT073
agauucucauauaucccuuc

SEQ ID NO: 607776 - RNA, 19 nt, Escherichia coli CFT073
agauucuccaccugcggca

SEQ ID NO: 607777 - RNA, 19 nt, Escherichia coli CFT073
agauucaauuuugcagcau

SEQ ID NO: 607778 - RNA, 21 nt, Escherichia coli CFT073
agauugaacgcuggcggcagg

SEQ ID NO: 607779 - RNA, 16 nt, Escherichia coli CFT073
agcagcguguugcggc

SEQ ID NO: 607780 - RNA, 19 nt, Escherichia coli CFT073
agcagcguucccagccagu

SEQ ID NO: 607781 - RNA, 16 nt, Escherichia coli CFT073
agcagcucaaucgccu

SEQ ID NO: 607782 - RNA, 17 nt, Escherichia coli CFT073
agcagcucaaucgccuc

SEQ ID NO: 607783 - RNA, 14 nt, Escherichia coli CFT073
agauuuauaaaauc

SEQ ID NO: 607784 - RNA, 20 nt, Escherichia coli CFT073
agauuucguugugucgccag

SEQ ID NO: 607785 - RNA, 22 nt, Escherichia coli CFT073
agcaguuuuuccccugccagau

SEQ ID NO: 607786 - RNA, 18 nt, Escherichia coli CFT073
agcauaaucaccaucagc

SEQ ID NO: 607787 - RNA, 16 nt, Escherichia coli CFT073
agcaguucugccaggc

SEQ ID NO: 607788 - RNA, 16 nt, Escherichia coli CFT073
agcaguuucaccagca

SEQ ID NO: 607789 - RNA, 14 nt, Escherichia coli CFT073
agcagggcagggaa

SEQ ID NO: 607790 - RNA, 21 nt, Escherichia coli CFT073
agcagcugcucccagcgcauu

SEQ ID NO: 607791 - RNA, 15 nt, Escherichia coli CFT073
agccgcuuuuucugc

SEQ ID NO: 607792 - RNA, 18 nt, Escherichia coli CFT073
agccgcuuuuucugcaca

SEQ ID NO: 607793 - RNA, 12 nt, Escherichia coli CFT073
agccgcuugcga

SEQ ID NO: 607794 - RNA, 15 nt, Escherichia coli CFT073
agccgcuugcgauau

SEQ ID NO: 607795 - RNA, 17 nt, Escherichia coli CFT073
agccggauaagcaaugu

SEQ ID NO: 607796 - RNA, 18 nt, Escherichia coli CFT073
agccggauaaugcgccag

SEQ ID NO: 607797 - RNA, 19 nt, Escherichia coli CFT073
agccggauaaugcgccaga

SEQ ID NO: 607798 - RNA, 15 nt, Escherichia coli CFT073
agccggaugaucauc

SEQ ID NO: 607799 - RNA, 20 nt, Escherichia coli CFT073
agcgaacaggaguagcucug

SEQ ID NO: 607800 - RNA, 22 nt, Escherichia coli CFT073
agcgaaccaccaaacugcgccc

SEQ ID NO: 607801 - RNA, 19 nt, Escherichia coli CFT073
agccuugcugaaucaaaua

SEQ ID NO: 607802 - RNA, 20 nt, Escherichia coli CFT073
agccuugugccucaacccau

SEQ ID NO: 607803 - RNA, 14 nt, Escherichia coli CFT073
agccuucgccaccg

SEQ ID NO: 607804 - RNA, 18 nt, Escherichia coli CFT073
agccugaacgagaaaagc

SEQ ID NO: 607805 - RNA, 20 nt, Escherichia coli CFT073
agccucgcugcucacaccau

SEQ ID NO: 607806 - RNA, 22 nt, Escherichia coli CFT073
agccucgcugcucacaccaugc

SEQ ID NO: 607807 - RNA, 17 nt, Escherichia coli CFT073
agccugcaacuggcaau

SEQ ID NO: 607808 - RNA, 18 nt, Escherichia coli CFT073
agccugauguagcgugau

SEQ ID NO: 607809 - RNA, 15 nt, Escherichia coli CFT073
agccugaauaaacgc

SEQ ID NO: 607810 - RNA, 14 nt, Escherichia coli CFT073
agccugaaugccgc

SEQ ID NO: 607811 - RNA, 15 nt, Escherichia coli CFT073
agccugaaugccgcg

SEQ ID NO: 607812 - RNA, 20 nt, Escherichia coli CFT073
agccugauaacgaauugcug

SEQ ID NO: 607813 - RNA, 23 nt, Escherichia coli CFT073
agccugccaguggagccaucacc

SEQ ID NO: 607814 - RNA, 18 nt, Escherichia coli CFT073
agccugcggauaaucgcg

SEQ ID NO: 607815 - RNA, 23 nt, Escherichia coli CFT073
agccuauaccuaacacgaucagc

SEQ ID NO: 607816 - RNA, 12 nt, Escherichia coli CFT073
agccucauccau

SEQ ID NO: 607817 - RNA, 17 nt, Escherichia coli CFT073
agccuaacacagcaaua

SEQ ID NO: 607818 - RNA, 13 nt, Escherichia coli CFT073
agccucaagcacc

SEQ ID NO: 607819 - RNA, 17 nt, Escherichia coli CFT073
agccuaaguuaugcgaa

SEQ ID NO: 607820 - RNA, 18 nt, Escherichia coli CFT073
agccuaaguuaugcgaaa

SEQ ID NO: 607821 - RNA, 16 nt, Escherichia coli CFT073
agccuacagaacgcug

SEQ ID NO: 607822 - RNA, 15 nt, Escherichia coli CFT073
agcgaagcccacacc

SEQ ID NO: 607823 - RNA, 15 nt, Escherichia coli CFT073
agcgaguuauugaua

SEQ ID NO: 607824 - RNA, 19 nt, Escherichia coli CFT073
agcgagauaaugcgccaga

SEQ ID NO: 607825 - RNA, 21 nt, Escherichia coli CFT073
agcgagauaaugcgccagacg

SEQ ID NO: 607826 - RNA, 16 nt, Escherichia coli CFT073
agcgaugagagaucga

SEQ ID NO: 607827 - RNA, 21 nt, Escherichia coli CFT073
agcgauaaauggcgaacggga

SEQ ID NO: 607828 - RNA, 19 nt, Escherichia coli CFT073
agcgagugccggggccguu

SEQ ID NO: 607829 - RNA, 19 nt, Escherichia coli CFT073
agcgauaugccccagcccg

SEQ ID NO: 607830 - RNA, 15 nt, Escherichia coli CFT073
agcgauacucucgcg

SEQ ID NO: 607831 - RNA, 20 nt, Escherichia coli CFT073
agcgauccggguaauaaacc

SEQ ID NO: 607832 - RNA, 22 nt, Escherichia coli CFT073
agcgcaaaauaccagcaauuug

SEQ ID NO: 607833 - RNA, 19 nt, Escherichia coli CFT073
agcgauuuguaggccugau

SEQ ID NO: 607834 - RNA, 12 nt, Escherichia coli CFT073
agcgcagcagau

SEQ ID NO: 607835 - RNA, 20 nt, Escherichia coli CFT073
agcgcagauuaauugggcga

SEQ ID NO: 607836 - RNA, 17 nt, Escherichia coli CFT073
agcgcacuacgccgcaa

SEQ ID NO: 607837 - RNA, 14 nt, Escherichia coli CFT073
agcgcacgccgcgu

SEQ ID NO: 607838 - RNA, 14 nt, Escherichia coli CFT073
agcgcacugcgcga

SEQ ID NO: 607839 - RNA, 14 nt, Escherichia coli CFT073
agcgcaucaggcaa

SEQ ID NO: 607840 - RNA, 20 nt, Escherichia coli CFT073
agcgcagugacauucaccuc

SEQ ID NO: 607841 - RNA, 22 nt, Escherichia coli CFT073
agcgccacgccaaccaccggaa

SEQ ID NO: 607842 - RNA, 16 nt, Escherichia coli CFT073
agcgccaccagcgcca

SEQ ID NO: 607843 - RNA, 18 nt, Escherichia coli CFT073
agcgccacccauguugau

SEQ ID NO: 607844 - RNA, 19 nt, Escherichia coli CFT073
agcgcauuucauggcggaa

SEQ ID NO: 607845 - RNA, 20 nt, Escherichia coli CFT073
agcgccaacggugaaaaacc

SEQ ID NO: 607846 - RNA, 16 nt, Escherichia coli CFT073
agcgccagcacuuuaa

SEQ ID NO: 607847 - RNA, 14 nt, Escherichia coli CFT073
agcgccaucgccag

SEQ ID NO: 607848 - RNA, 18 nt, Escherichia coli CFT073
agcgcuuuuuccugccgc

SEQ ID NO: 607849 - RNA, 19 nt, Escherichia coli CFT073
agcggaaaaucgggcgaca

SEQ ID NO: 607850 - RNA, 15 nt, Escherichia coli CFT073
agcggaaacagcggc

SEQ ID NO: 607851 - RNA, 23 nt, Escherichia coli CFT073
agcggaacuuuuuucauccagcu

SEQ ID NO: 607852 - RNA, 21 nt, Escherichia coli CFT073
agcggaauaucagaggcgagc

SEQ ID NO: 607853 - RNA, 23 nt, Escherichia coli CFT073
agcgcuggagagcgccgggcaaa

SEQ ID NO: 607854 - RNA, 17 nt, Escherichia coli CFT073
agcgcgucuggaacggc

SEQ ID NO: 607855 - RNA, 22 nt, Escherichia coli CFT073
agcgccgucaguuuuucacccg

SEQ ID NO: 607856 - RNA, 16 nt, Escherichia coli CFT073
agcgccgguugggcga

SEQ ID NO: 607857 - RNA, 12 nt, Escherichia coli CFT073
agcgccgggaau

SEQ ID NO: 607858 - RNA, 19 nt, Escherichia coli CFT073
agcgccgggauguugcugc

SEQ ID NO: 607859 - RNA, 16 nt, Escherichia coli CFT073
agcggcguuaacggau

SEQ ID NO: 607860 - RNA, 14 nt, Escherichia coli CFT073
agcggcguuccggc

SEQ ID NO: 607861 - RNA, 13 nt, Escherichia coli CFT073
agcgggcgcaaug

SEQ ID NO: 607862 - RNA, 23 nt, Escherichia coli CFT073
agcgggauuuccggcaucgccag

SEQ ID NO: 607863 - RNA, 16 nt, Escherichia coli CFT073
agcgggcagacaaaac

SEQ ID NO: 607864 - RNA, 21 nt, Escherichia coli CFT073
agcgggcagacaaaacauacc

SEQ ID NO: 607865 - RNA, 13 nt, Escherichia coli CFT073
agcggcgggcuuu

SEQ ID NO: 607866 - RNA, 21 nt, Escherichia coli CFT073
agcggcgggcuuuaaucaccc

SEQ ID NO: 607867 - RNA, 22 nt, Escherichia coli CFT073
agcggcgaguauucuugcugau

SEQ ID NO: 607868 - RNA, 21 nt, Escherichia coli CFT073
agcggcgaguguguggaaaac

SEQ ID NO: 607869 - RNA, 14 nt, Escherichia coli CFT073
agcggcaaaacggu

SEQ ID NO: 607870 - RNA, 12 nt, Escherichia coli CFT073
agcggcaaaccg

SEQ ID NO: 607871 - RNA, 15 nt, Escherichia coli CFT073
agcggcaacaaugcu

SEQ ID NO: 607872 - RNA, 15 nt, Escherichia coli CFT073
agcggcaacaucauc

SEQ ID NO: 607873 - RNA, 15 nt, Escherichia coli CFT073
agcucauccagcguc

SEQ ID NO: 607874 - RNA, 15 nt, Escherichia coli CFT073
agcucgcagagauca

SEQ ID NO: 607875 - RNA, 17 nt, Escherichia coli CFT073
agcuaacagcgccgcga

SEQ ID NO: 607876 - RNA, 15 nt, Escherichia coli CFT073
agcuaaaaucgccaa

SEQ ID NO: 607877 - RNA, 16 nt, Escherichia coli CFT073
agcuacaccgaucacc

SEQ ID NO: 607878 - RNA, 15 nt, Escherichia coli CFT073
agcuaccacgccgau

SEQ ID NO: 607879 - RNA, 21 nt, Escherichia coli CFT073
agcucaguugguagagcacga

SEQ ID NO: 607880 - RNA, 15 nt, Escherichia coli CFT073
agcugauuuccggga

SEQ ID NO: 607881 - RNA, 15 nt, Escherichia coli CFT073
agcugcaucuggcga

SEQ ID NO: 607882 - RNA, 13 nt, Escherichia coli CFT073
agcugccaguugc

SEQ ID NO: 607883 - RNA, 13 nt, Escherichia coli CFT073
agcugccaguugu

SEQ ID NO: 607884 - RNA, 22 nt, Escherichia coli CFT073
agcugccagccccucagcgguc

SEQ ID NO: 607885 - RNA, 20 nt, Escherichia coli CFT073
agcugcccacgcgguauggu

SEQ ID NO: 607886 - RNA, 20 nt, Escherichia coli CFT073
agcugcgaccaguggcggga

SEQ ID NO: 607887 - RNA, 18 nt, Escherichia coli CFT073
agcguaacggguccccag

SEQ ID NO: 607888 - RNA, 20 nt, Escherichia coli CFT073
agcguaccaugauccugcaa

SEQ ID NO: 607889 - RNA, 14 nt, Escherichia coli CFT073
agcguaccugccgc

SEQ ID NO: 607890 - RNA, 16 nt, Escherichia coli CFT073
agcguaauaggcgcga

SEQ ID NO: 607891 - RNA, 21 nt, Escherichia coli CFT073
agcgguguuucgggcagccuc

SEQ ID NO: 607892 - RNA, 22 nt, Escherichia coli CFT073
agcgucaaacuuuuaaauugaa

SEQ ID NO: 607893 - RNA, 17 nt, Escherichia coli CFT073
agcguauccagcauacc

SEQ ID NO: 607894 - RNA, 15 nt, Escherichia coli CFT073
agcguagcgcaucag

SEQ ID NO: 607895 - RNA, 17 nt, Escherichia coli CFT073
agcguagugaaggcaaa

SEQ ID NO: 607896 - RNA, 17 nt, Escherichia coli CFT073
agcguagugauaccccg

SEQ ID NO: 607897 - RNA, 19 nt, Escherichia coli CFT073
agcguagugauaccccgca

SEQ ID NO: 607898 - RNA, 22 nt, Escherichia coli CFT073
agcguagugauaccccgcaucg

SEQ ID NO: 607899 - RNA, 15 nt, Escherichia coli CFT073
agcguauagagcagc

SEQ ID NO: 607900 - RNA, 20 nt, Escherichia coli CFT073
agcguuucauuacuauaacc

SEQ ID NO: 607901 - RNA, 13 nt, Escherichia coli CFT073
agcguucauaaau

SEQ ID NO: 607902 - RNA, 17 nt, Escherichia coli CFT073
agcguucaaaacggcug

SEQ ID NO: 607903 - RNA, 16 nt, Escherichia coli CFT073
agcguuauagcgcaug

SEQ ID NO: 607904 - RNA, 17 nt, Escherichia coli CFT073
agcgucgccgccgccag

SEQ ID NO: 607905 - RNA, 20 nt, Escherichia coli CFT073
agcgucgccgccgccagcgc

SEQ ID NO: 607906 - RNA, 22 nt, Escherichia coli CFT073
agcgucgggccacgcugcgcuu

SEQ ID NO: 607907 - RNA, 16 nt, Escherichia coli CFT073
agcgucguuaaucgcc

SEQ ID NO: 607908 - RNA, 17 nt, Escherichia coli CFT073
agcgucguuaaucgccu

SEQ ID NO: 607909 - RNA, 21 nt, Escherichia coli CFT073
agcgucguucgcgccaacagc

SEQ ID NO: 607910 - RNA, 19 nt, Escherichia coli CFT073
agcgucucacuaucgccga

SEQ ID NO: 607911 - RNA, 21 nt, Escherichia coli CFT073
aggcacucauuuucucuuuua

SEQ ID NO: 607912 - RNA, 19 nt, Escherichia coli CFT073
aggcacgacacaaugccau

SEQ ID NO: 607913 - RNA, 13 nt, Escherichia coli CFT073
aggcaccaaaaau

SEQ ID NO: 607914 - RNA, 19 nt, Escherichia coli CFT073
aggcaaauucuguuucauu

SEQ ID NO: 607915 - RNA, 15 nt, Escherichia coli CFT073
aggcaaucggcgcaa

SEQ ID NO: 607916 - RNA, 23 nt, Escherichia coli CFT073
aggcaaaagaugucggaugcggc

SEQ ID NO: 607917 - RNA, 19 nt, Escherichia coli CFT073
aggcaaaaucaucacaacu

SEQ ID NO: 607918 - RNA, 20 nt, Escherichia coli CFT073
aggcaaggaugcguuuuucg

SEQ ID NO: 607919 - RNA, 20 nt, Escherichia coli CFT073
aggcaaguaauuguuucauc

SEQ ID NO: 607920 - RNA, 14 nt, Escherichia coli CFT073
aggcaaaguacaca

SEQ ID NO: 607921 - RNA, 16 nt, Escherichia coli CFT073
aggcaacccagaagaa

SEQ ID NO: 607922 - RNA, 19 nt, Escherichia coli CFT073
aggcccgucacgcagucag

SEQ ID NO: 607923 - RNA, 21 nt, Escherichia coli CFT073
aggccauuuuuucgauaauca

SEQ ID NO: 607924 - RNA, 15 nt, Escherichia coli CFT073
aggccaucgccaccg

SEQ ID NO: 607925 - RNA, 20 nt, Escherichia coli CFT073
aggcauuguguagggcagcg

SEQ ID NO: 607926 - RNA, 15 nt, Escherichia coli CFT073
aggccaaaaccacag

SEQ ID NO: 607927 - RNA, 16 nt, Escherichia coli CFT073
aggccaaaagcuaaca

SEQ ID NO: 607928 - RNA, 20 nt, Escherichia coli CFT073
aggccaaacagcgugccgcg

SEQ ID NO: 607929 - RNA, 22 nt, Escherichia coli CFT073
aaacguggccuccaaaaaacaa

SEQ ID NO: 607930 - RNA, 15 nt, Escherichia coli CFT073
aaacguuaacgcccc

SEQ ID NO: 607931 - RNA, 16 nt, Escherichia coli CFT073
aaacguuaugcaccga

SEQ ID NO: 607932 - RNA, 18 nt, Escherichia coli CFT073
aaacguuauuuugcuaau

SEQ ID NO: 607933 - RNA, 13 nt, Escherichia coli CFT073
aaacgguuaugaa

SEQ ID NO: 607934 - RNA, 16 nt, Escherichia coli CFT073
aaacgguucgcggugc

SEQ ID NO: 607935 - RNA, 16 nt, Escherichia coli CFT073
aaacgguuucagcagu

SEQ ID NO: 607936 - RNA, 22 nt, Escherichia coli CFT073
aaacguauuaugugaucaacac

SEQ ID NO: 607937 - RNA, 13 nt, Escherichia coli CFT073
aaacgugaauuuu

SEQ ID NO: 607938 - RNA, 15 nt, Escherichia coli CFT073
aaacggucuuggcuu

SEQ ID NO: 607939 - RNA, 11 nt, Escherichia coli CFT073
aaacggcgcau

SEQ ID NO: 607940 - RNA, 19 nt, Escherichia coli CFT073
aaacggcuaaggcagugau

SEQ ID NO: 607941 - RNA, 13 nt, Escherichia coli CFT073
aaacggcugggaa

SEQ ID NO: 607942 - RNA, 17 nt, Escherichia coli CFT073
aaacgggcaagccagca

SEQ ID NO: 607943 - RNA, 18 nt, Escherichia coli CFT073
aggagcaauaaucagugc

SEQ ID NO: 607944 - RNA, 21 nt, Escherichia coli CFT073
aaacguugcgcggugagcguu

SEQ ID NO: 607945 - RNA, 21 nt, Escherichia coli CFT073
aaacguuggccagugcggcug

SEQ ID NO: 607946 - RNA, 16 nt, Escherichia coli CFT073
aggagguuuccggguc

SEQ ID NO: 607947 - RNA, 15 nt, Escherichia coli CFT073
aggauaaauaaaaua

SEQ ID NO: 607948 - RNA, 21 nt, Escherichia coli CFT073
aggaucagaccgccaaucagc

SEQ ID NO: 607949 - RNA, 13 nt, Escherichia coli CFT073
aggauauaaaaau

SEQ ID NO: 607950 - RNA, 23 nt, Escherichia coli CFT073
aggauauucugcggcuucagcga

SEQ ID NO: 607951 - RNA, 20 nt, Escherichia coli CFT073
aggaugccugaugcgacgcu

SEQ ID NO: 607952 - RNA, 12 nt, Escherichia coli CFT073
agcuuucaacgc

SEQ ID NO: 607953 - RNA, 13 nt, Escherichia coli CFT073
agcuuucaccaga

SEQ ID NO: 607954 - RNA, 17 nt, Escherichia coli CFT073
agcuuucaccugcgcgu

SEQ ID NO: 607955 - RNA, 18 nt, Escherichia coli CFT073
agcuuggcagagcgacau

SEQ ID NO: 607956 - RNA, 23 nt, Escherichia coli CFT073
agcuugcugcaguuguuccugau

SEQ ID NO: 607957 - RNA, 22 nt, Escherichia coli CFT073
agcuugccgucuucuucccaga

SEQ ID NO: 607958 - RNA, 17 nt, Escherichia coli CFT073
agcuuccuugcugauuu

SEQ ID NO: 607959 - RNA, 15 nt, Escherichia coli CFT073
agcuucgaggccgga

SEQ ID NO: 607960 - RNA, 13 nt, Escherichia coli CFT073
agcuuaaucacca

SEQ ID NO: 607961 - RNA, 15 nt, Escherichia coli CFT073
agcuguugcgccagc

SEQ ID NO: 607962 - RNA, 19 nt, Escherichia coli CFT073
agcuguggugcaauccaca

SEQ ID NO: 607963 - RNA, 18 nt, Escherichia coli CFT073
agcuucacccgcagcacg

SEQ ID NO: 607964 - RNA, 22 nt, Escherichia coli CFT073
agcuucagauucagcgucgcca

SEQ ID NO: 607965 - RNA, 15 nt, Escherichia coli CFT073
agcuuacgcgccaga

SEQ ID NO: 607966 - RNA, 16 nt, Escherichia coli CFT073
agcuggcguagccagu

SEQ ID NO: 607967 - RNA, 21 nt, Escherichia coli CFT073
agcugguguaacugcgccaga

SEQ ID NO: 607968 - RNA, 22 nt, Escherichia coli CFT073
aggaagcgcaacagcgcgcccg

SEQ ID NO: 607969 - RNA, 21 nt, Escherichia coli CFT073
aggaagcugauuuuauuucaa

SEQ ID NO: 607970 - RNA, 19 nt, Escherichia coli CFT073
aggaacuuaaccugcgaau

SEQ ID NO: 607971 - RNA, 20 nt, Escherichia coli CFT073
aggaacuuaguaggccugau

SEQ ID NO: 607972 - RNA, 19 nt, Escherichia coli CFT073
aggaacugcauacucgcgu

SEQ ID NO: 607973 - RNA, 11 nt, Escherichia coli CFT073
aggaacgccau

SEQ ID NO: 607974 - RNA, 16 nt, Escherichia coli CFT073
aggaacagugaaaucg

SEQ ID NO: 607975 - RNA, 18 nt, Escherichia coli CFT073
agcuuucgaccagccagg

SEQ ID NO: 607976 - RNA, 19 nt, Escherichia coli CFT073
agcuuugcccgaucaucaa

SEQ ID NO: 607977 - RNA, 15 nt, Escherichia coli CFT073
agcuuuggcggccuu

SEQ ID NO: 607978 - RNA, 20 nt, Escherichia coli CFT073
agcuuuggugccagauuuaa

SEQ ID NO: 607979 - RNA, 13 nt, Escherichia coli CFT073
aggaaaauaggug

SEQ ID NO: 607980 - RNA, 16 nt, Escherichia coli CFT073
aggaauauaccuuccg

SEQ ID NO: 607981 - RNA, 20 nt, Escherichia coli CFT073
aggaauagcgaaccgguaug

SEQ ID NO: 607982 - RNA, 14 nt, Escherichia coli CFT073
aggacgauaaacca

SEQ ID NO: 607983 - RNA, 17 nt, Escherichia coli CFT073
aggacgauuccggcaaa

SEQ ID NO: 607984 - RNA, 14 nt, Escherichia coli CFT073
uuuuucaguuugcu

SEQ ID NO: 607985 - RNA, 16 nt, Escherichia coli CFT073
uuuuuugaaaaaugca

SEQ ID NO: 607986 - RNA, 21 nt, Escherichia coli CFT073
uuuuuugagaacauucaucau

SEQ ID NO: 607987 - RNA, 22 nt, Escherichia coli CFT073
uuuugggcgggaucuccacaag

SEQ ID NO: 607988 - RNA, 20 nt, Escherichia coli CFT073
uuuugguaaagcaauaaacc

SEQ ID NO: 607989 - RNA, 11 nt, Escherichia coli CFT073
uuuugcugccg

SEQ ID NO: 607990 - RNA, 19 nt, Escherichia coli CFT073
uuuugcuaccaaaccucau

SEQ ID NO: 607991 - RNA, 14 nt, Escherichia coli CFT073
uuuugcuacgccac

SEQ ID NO: 607992 - RNA, 18 nt, Escherichia coli CFT073
uuuugcuauucaccugau

SEQ ID NO: 607993 - RNA, 18 nt, Escherichia coli CFT073
uuuugcucggcaaucucu

SEQ ID NO: 607994 - RNA, 21 nt, Escherichia coli CFT073
uuuugccgcccagucacggcu

SEQ ID NO: 607995 - RNA, 13 nt, Escherichia coli CFT073
uuuugccugugca

SEQ ID NO: 607996 - RNA, 16 nt, Escherichia coli CFT073
uuuugcggaucugcuc

SEQ ID NO: 607997 - RNA, 16 nt, Escherichia coli CFT073
uuuugcgauauauuuu

SEQ ID NO: 607998 - RNA, 19 nt, Escherichia coli CFT073
uuuugcgccguccacaaac

SEQ ID NO: 607999 - RNA, 13 nt, Escherichia coli CFT073
uuuugucucugca

SEQ ID NO: 608000 - RNA, 18 nt, Escherichia coli CFT073
uuuuguaucgaacaagau

SEQ ID NO: 608001 - RNA, 12 nt, Escherichia coli CFT073
uuuuguuuuguc

SEQ ID NO: 608002 - RNA, 17 nt, Escherichia coli CFT073
uuuuuauagcuuauucu

SEQ ID NO: 608003 - RNA, 23 nt, Escherichia coli CFT073
uuuuuauagucagugaagccauu

SEQ ID NO: 608004 - RNA, 11 nt, Escherichia coli CFT073
uuuuuaugaug

SEQ ID NO: 608005 - RNA, 12 nt, Escherichia coli CFT073
uuuuuaucuuca

SEQ ID NO: 608006 - RNA, 14 nt, Escherichia coli CFT073
uuuuucaauuucca

SEQ ID NO: 608007 - RNA, 21 nt, Escherichia coli CFT073
uuuuucaccgggauccaguua

SEQ ID NO: 608008 - RNA, 19 nt, Escherichia coli CFT073
uuuuucacugcggcaagaa

SEQ ID NO: 608009 - RNA, 22 nt, Escherichia coli CFT073
uuuuuaacgccgcuauacgccu

SEQ ID NO: 608010 - RNA, 20 nt, Escherichia coli CFT073
uuuuuacucucguuccacuc

SEQ ID NO: 608011 - RNA, 13 nt, Escherichia coli CFT073
uuuuuacccagca

SEQ ID NO: 608012 - RNA, 20 nt, Escherichia coli CFT073
uuuuuacgaugcaauuauca

SEQ ID NO: 608013 - RNA, 23 nt, Escherichia coli CFT073
uuuuccggguucucgcaaaacgu

SEQ ID NO: 608014 - RNA, 18 nt, Escherichia coli CFT073
uuuuccggugccaucucc

SEQ ID NO: 608015 - RNA, 14 nt, Escherichia coli CFT073
uuuucagcaucuca

SEQ ID NO: 608016 - RNA, 17 nt, Escherichia coli CFT073
uuuucaggggagcuuug

SEQ ID NO: 608017 - RNA, 12 nt, Escherichia coli CFT073
uuuucaucuuuu

SEQ ID NO: 608018 - RNA, 23 nt, Escherichia coli CFT073
uuuaccggucaggauuuccagcu

SEQ ID NO: 608019 - RNA, 20 nt, Escherichia coli CFT073
uuuaccugcuuaaucauauu

SEQ ID NO: 608020 - RNA, 17 nt, Escherichia coli CFT073
uuuaccuugcucaucca

SEQ ID NO: 608021 - RNA, 18 nt, Escherichia coli CFT073
uuuaccuuuaaacuguuu

SEQ ID NO: 608022 - RNA, 18 nt, Escherichia coli CFT073
uuuaccuuuccagucucc

SEQ ID NO: 608023 - RNA, 15 nt, Escherichia coli CFT073
uuuucaaaugcgccu

SEQ ID NO: 608024 - RNA, 12 nt, Escherichia coli CFT073
uuuucaccaguu

SEQ ID NO: 608025 - RNA, 19 nt, Escherichia coli CFT073
uuuucaccuucaaaauuua

SEQ ID NO: 608026 - RNA, 19 nt, Escherichia coli CFT073
uuuucacccacacuucaau

SEQ ID NO: 608027 - RNA, 21 nt, Escherichia coli CFT073
uuuucgcuugaucuuccugau

SEQ ID NO: 608028 - RNA, 19 nt, Escherichia coli CFT073
uuuucggcaaccgcaucca

SEQ ID NO: 608029 - RNA, 14 nt, Escherichia coli CFT073
uuuucugccugguc

SEQ ID NO: 608030 - RNA, 16 nt, Escherichia coli CFT073
uuuucuggaugccauc

SEQ ID NO: 608031 - RNA, 16 nt, Escherichia coli CFT073
uuuugcauaauuucca

SEQ ID NO: 608032 - RNA, 14 nt, Escherichia coli CFT073
uuuugcauagugau

SEQ ID NO: 608033 - RNA, 23 nt, Escherichia coli CFT073
uuuugccagcaguugcugacuuu

SEQ ID NO: 608034 - RNA, 11 nt, Escherichia coli CFT073
uuuugccaggc

SEQ ID NO: 608035 - RNA, 17 nt, Escherichia coli CFT073
uuuugcaacgcuuugcu

SEQ ID NO: 608036 - RNA, 18 nt, Escherichia coli CFT073
uuuugcagcauucaucac

SEQ ID NO: 608037 - RNA, 15 nt, Escherichia coli CFT073
uuuugagcgguacac

SEQ ID NO: 608038 - RNA, 19 nt, Escherichia coli CFT073
ugaaaugauuacucccuug

SEQ ID NO: 608039 - RNA, 22 nt, Escherichia coli CFT073
ugaaaugauuacucccuugccu

SEQ ID NO: 608040 - RNA, 20 nt, Escherichia coli CFT073
ugaaaucccgcugaauuccc

SEQ ID NO: 608041 - RNA, 21 nt, Escherichia coli CFT073
ugaaaucccgcugaauucccc

SEQ ID NO: 608042 - RNA, 16 nt, Escherichia coli CFT073
ugaaaucgaacagguu

SEQ ID NO: 608043 - RNA, 22 nt, Escherichia coli CFT073
ugaaauaguugcauuccagucc

SEQ ID NO: 608044 - RNA, 11 nt, Escherichia coli CFT073
ugaaauauuau

SEQ ID NO: 608045 - RNA, 15 nt, Escherichia coli CFT073
ugaaauauuucuuua

SEQ ID NO: 608046 - RNA, 18 nt, Escherichia coli CFT073
ugaaaucaacguuaccaa

SEQ ID NO: 608047 - RNA, 15 nt, Escherichia coli CFT073
ugaaauacuaaauau

SEQ ID NO: 608048 - RNA, 17 nt, Escherichia coli CFT073
ugaaauacuaaauauga

SEQ ID NO: 608049 - RNA, 18 nt, Escherichia coli CFT073
ugaaauacuaaauaugaa

SEQ ID NO: 608050 - RNA, 13 nt, Escherichia coli CFT073
ugaaauacaguua

SEQ ID NO: 608051 - RNA, 20 nt, Escherichia coli CFT073
ugaaauaauacguagcacca

SEQ ID NO: 608052 - RNA, 12 nt, Escherichia coli CFT073
ugaacaaaacau

SEQ ID NO: 608053 - RNA, 15 nt, Escherichia coli CFT073
ugaaauugauggguu

SEQ ID NO: 608054 - RNA, 15 nt, Escherichia coli CFT073
ugaaauuguaggccu

SEQ ID NO: 608055 - RNA, 19 nt, Escherichia coli CFT073
ugaaauuacuuuccaucuu

SEQ ID NO: 608056 - RNA, 19 nt, Escherichia coli CFT073
ugaacagaccacauuccag

SEQ ID NO: 608057 - RNA, 19 nt, Escherichia coli CFT073
ugaacaccagaaccagcaa

SEQ ID NO: 608058 - RNA, 13 nt, Escherichia coli CFT073
ugaacaagcaaga

SEQ ID NO: 608059 - RNA, 16 nt, Escherichia coli CFT073
ugaacacacccggaga

SEQ ID NO: 608060 - RNA, 21 nt, Escherichia coli CFT073
ugaaccgugucgccaucaaag

SEQ ID NO: 608061 - RNA, 23 nt, Escherichia coli CFT073
ugaaccgccccggguuuccugga

SEQ ID NO: 608062 - RNA, 22 nt, Escherichia coli CFT073
ugaaccucacagaggucuuuuc

SEQ ID NO: 608063 - RNA, 22 nt, Escherichia coli CFT073
ugaacgagaaaagccaaccugc

SEQ ID NO: 608064 - RNA, 17 nt, Escherichia coli CFT073
ugaacgccaaauucuuu

SEQ ID NO: 608065 - RNA, 20 nt, Escherichia coli CFT073
ugaacgccaaauucuuuauc

SEQ ID NO: 608066 - RNA, 14 nt, Escherichia coli CFT073
ugaacgccaccaac

SEQ ID NO: 608067 - RNA, 16 nt, Escherichia coli CFT073
ugaacgcaaaugguga

SEQ ID NO: 608068 - RNA, 19 nt, Escherichia coli CFT073
ugaacccggcgauugauag

SEQ ID NO: 608069 - RNA, 13 nt, Escherichia coli CFT073
ugaacauuuucuu

SEQ ID NO: 608070 - RNA, 18 nt, Escherichia coli CFT073
ugaacauuuucuucugcc

SEQ ID NO: 608071 - RNA, 16 nt, Escherichia coli CFT073
ugaacauugcugcuga

SEQ ID NO: 608072 - RNA, 12 nt, Escherichia coli CFT073
ugaacauugaca

SEQ ID NO: 608073 - RNA, 14 nt, Escherichia coli CFT073
ugaacauugacagu

SEQ ID NO: 608074 - RNA, 14 nt, Escherichia coli CFT073
ugaaaaaccaaucu

SEQ ID NO: 608075 - RNA, 14 nt, Escherichia coli CFT073
ugaaaaacgaacau

SEQ ID NO: 608076 - RNA, 16 nt, Escherichia coli CFT073
ugaaaaccauaaugau

SEQ ID NO: 608077 - RNA, 22 nt, Escherichia coli CFT073
ugaaaacccuauuuuuggaggu

SEQ ID NO: 608078 - RNA, 14 nt, Escherichia coli CFT073
ugaaaaaucuccag

SEQ ID NO: 608079 - RNA, 16 nt, Escherichia coli CFT073
ugaaaaggcuaaaauu

SEQ ID NO: 608080 - RNA, 19 nt, Escherichia coli CFT073
ugaaaagugcuguaaagca

SEQ ID NO: 608081 - RNA, 15 nt, Escherichia coli CFT073
ugaaaaugaaauaaa

SEQ ID NO: 608082 - RNA, 13 nt, Escherichia coli CFT073
ugaaaauauuccc

SEQ ID NO: 608083 - RNA, 14 nt, Escherichia coli CFT073
ugaaaaugcugguu

SEQ ID NO: 608084 - RNA, 14 nt, Escherichia coli CFT073
ugaaaauugucuuu

SEQ ID NO: 608085 - RNA, 23 nt, Escherichia coli CFT073
ugaaaccaccauuuuuauuugcc

SEQ ID NO: 608086 - RNA, 13 nt, Escherichia coli CFT073
ugaaacagaaggu

SEQ ID NO: 608087 - RNA, 12 nt, Escherichia coli CFT073
ugaaacucaagc

SEQ ID NO: 608088 - RNA, 20 nt, Escherichia coli CFT073
ugaaacucaagcuaaaccaa

SEQ ID NO: 608089 - RNA, 14 nt, Escherichia coli CFT073
ugaaagaaaaugag

SEQ ID NO: 608090 - RNA, 16 nt, Escherichia coli CFT073
ugaaaccuuuaugcag

SEQ ID NO: 608091 - RNA, 19 nt, Escherichia coli CFT073
ugaaaccgaauccuuugga

SEQ ID NO: 608092 - RNA, 21 nt, Escherichia coli CFT073
ugaaacgauggcguaaccaau

SEQ ID NO: 608093 - RNA, 19 nt, Escherichia coli CFT073
ugaaacgcaaauacugacu

SEQ ID NO: 608094 - RNA, 14 nt, Escherichia coli CFT073
ugaaacgaaaucuu

SEQ ID NO: 608095 - RNA, 15 nt, Escherichia coli CFT073
ugaaacgaaaucuug

SEQ ID NO: 608096 - RNA, 15 nt, Escherichia coli CFT073
ugaaauaaaaucagc

SEQ ID NO: 608097 - RNA, 15 nt, Escherichia coli CFT073
ugaaaguuguccauu

SEQ ID NO: 608098 - RNA, 16 nt, Escherichia coli CFT073
ugaaaguuguccauug

SEQ ID NO: 608099 - RNA, 22 nt, Escherichia coli CFT073
ugaaagugcuguaaagcacaga

SEQ ID NO: 608100 - RNA, 15 nt, Escherichia coli CFT073
ugaaaguggaaacac

SEQ ID NO: 608101 - RNA, 19 nt, Escherichia coli CFT073
ugaaaguggaaacacgcuc

SEQ ID NO: 608102 - RNA, 21 nt, Escherichia coli CFT073
ugaaagaggcggagguuuuuu

SEQ ID NO: 608103 - RNA, 18 nt, Escherichia coli CFT073
ugaaagagaucaaaguga

SEQ ID NO: 608104 - RNA, 15 nt, Escherichia coli CFT073
ugaaagcaaaaaaag

SEQ ID NO: 608105 - RNA, 16 nt, Escherichia coli CFT073
ugaaagcaaaaaagaa

SEQ ID NO: 608106 - RNA, 18 nt, Escherichia coli CFT073
ugaaagcgggcuuuuuua

SEQ ID NO: 608107 - RNA, 22 nt, Escherichia coli CFT073
ugaaaggcacucauuuucucuu

SEQ ID NO: 608108 - RNA, 15 nt, Escherichia coli CFT073
ugaaaggucaucauc

SEQ ID NO: 608109 - RNA, 19 nt, Escherichia coli CFT073
ugaaagcugagaaaaugua

SEQ ID NO: 608110 - RNA, 18 nt, Escherichia coli CFT073
ucuuuuggcauaugcaaa

SEQ ID NO: 608111 - RNA, 13 nt, Escherichia coli CFT073
ucuuuuucaaucc

SEQ ID NO: 608112 - RNA, 14 nt, Escherichia coli CFT073
ucuuuuucagcaac

SEQ ID NO: 608113 - RNA, 19 nt, Escherichia coli CFT073
ucuuuuuacugccgcgaug

SEQ ID NO: 608114 - RNA, 14 nt, Escherichia coli CFT073
ucuuuuuugagaau

SEQ ID NO: 608115 - RNA, 15 nt, Escherichia coli CFT073
ugaaaaaaagugcau

SEQ ID NO: 608116 - RNA, 13 nt, Escherichia coli CFT073
ucuuuuuuucauu

SEQ ID NO: 608117 - RNA, 16 nt, Escherichia coli CFT073
ucuuuuuuuucacaug

SEQ ID NO: 608118 - RNA, 19 nt, Escherichia coli CFT073
ucuuuuaccaccgcaaaac

SEQ ID NO: 608119 - RNA, 14 nt, Escherichia coli CFT073
ucuuuucacgcaau

SEQ ID NO: 608120 - RNA, 20 nt, Escherichia coli CFT073
ucuuugugacaaacuaacca

SEQ ID NO: 608121 - RNA, 17 nt, Escherichia coli CFT073
ucuuuguaggccugaua

SEQ ID NO: 608122 - RNA, 20 nt, Escherichia coli CFT073
ucuuuguaggccugauaaga

SEQ ID NO: 608123 - RNA, 22 nt, Escherichia coli CFT073
ucuuugggcagaaaauccagca

SEQ ID NO: 608124 - RNA, 17 nt, Escherichia coli CFT073
ucuuugggcucacccau

SEQ ID NO: 608125 - RNA, 19 nt, Escherichia coli CFT073
ucuuugcugccuucgcagu

SEQ ID NO: 608126 - RNA, 15 nt, Escherichia coli CFT073
ucuuugagucaacau

SEQ ID NO: 608127 - RNA, 18 nt, Escherichia coli CFT073
ucuuugcgguuaaagcag

SEQ ID NO: 608128 - RNA, 20 nt, Escherichia coli CFT073
ucuuugagcaucaaacuuuu

SEQ ID NO: 608129 - RNA, 21 nt, Escherichia coli CFT073
ucuuugaaugacgaucaaccc

SEQ ID NO: 608130 - RNA, 19 nt, Escherichia coli CFT073
ucuuucuuugaaugacgau

SEQ ID NO: 608131 - RNA, 18 nt, Escherichia coli CFT073
ucuuggcuuugauauuca

SEQ ID NO: 608132 - RNA, 16 nt, Escherichia coli CFT073
ucuuuaaccaggcaag

SEQ ID NO: 608133 - RNA, 21 nt, Escherichia coli CFT073
ucuuuaacaucgcaaaauaca

SEQ ID NO: 608134 - RNA, 23 nt, Escherichia coli CFT073
ucuugcuggcauuacaagaauca

SEQ ID NO: 608135 - RNA, 18 nt, Escherichia coli CFT073
ucuugcugauacuauuca

SEQ ID NO: 608136 - RNA, 20 nt, Escherichia coli CFT073
ucuugcugauacuauucauu

SEQ ID NO: 608137 - RNA, 19 nt, Escherichia coli CFT073
ucuucccgagacaucccuu

SEQ ID NO: 608138 - RNA, 19 nt, Escherichia coli CFT073
ucuucccgaggcauuccuu

SEQ ID NO: 608139 - RNA, 20 nt, Escherichia coli CFT073
ucuucccgaggcauuccuuu

SEQ ID NO: 608140 - RNA, 22 nt, Escherichia coli CFT073
ucuucccgaggcauuccuuuac

SEQ ID NO: 608141 - RNA, 23 nt, Escherichia coli CFT073
ucuucccgaggcauuccuuuacu

SEQ ID NO: 608142 - RNA, 14 nt, Escherichia coli CFT073
ucuugcucuaccag

SEQ ID NO: 608143 - RNA, 15 nt, Escherichia coli CFT073
ucuugcucuaccagc

SEQ ID NO: 608144 - RNA, 15 nt, Escherichia coli CFT073
ucuucccgccuguca

SEQ ID NO: 608145 - RNA, 13 nt, Escherichia coli CFT073
ucuucccgcucaa

SEQ ID NO: 608146 - RNA, 17 nt, Escherichia coli CFT073
ucuucccauacccacca

SEQ ID NO: 608147 - RNA, 15 nt, Escherichia coli CFT073
ucuuccaucacaaag

SEQ ID NO: 608148 - RNA, 20 nt, Escherichia coli CFT073
ucuuccaguggcauuuucug

SEQ ID NO: 608149 - RNA, 13 nt, Escherichia coli CFT073
ucuuccagagagg

SEQ ID NO: 608150 - RNA, 21 nt, Escherichia coli CFT073
ucuuccagaucaccgcagaag

SEQ ID NO: 608151 - RNA, 14 nt, Escherichia coli CFT073
ucuuccagcaucag

SEQ ID NO: 608152 - RNA, 17 nt, Escherichia coli CFT073
ucuuccagggugacaaa

SEQ ID NO: 608153 - RNA, 18 nt, Escherichia coli CFT073
ucuuccaguaaaccaacc

SEQ ID NO: 608154 - RNA, 16 nt, Escherichia coli CFT073
ucuuccagcggccaga

SEQ ID NO: 608155 - RNA, 19 nt, Escherichia coli CFT073
ucuuuauguaauaaaccug

SEQ ID NO: 608156 - RNA, 16 nt, Escherichia coli CFT073
ucuuucagacugagau

SEQ ID NO: 608157 - RNA, 17 nt, Escherichia coli CFT073
ucuuucagcaccagccc

SEQ ID NO: 608158 - RNA, 17 nt, Escherichia coli CFT073
ucuuucagcaccgcgaa

SEQ ID NO: 608159 - RNA, 13 nt, Escherichia coli CFT073
ucuuuaucaauca

SEQ ID NO: 608160 - RNA, 16 nt, Escherichia coli CFT073
ucuuuaucaccaauga

SEQ ID NO: 608161 - RNA, 13 nt, Escherichia coli CFT073
ucuuuauccagca

SEQ ID NO: 608162 - RNA, 14 nt, Escherichia coli CFT073
ucuuuccugcacaa

SEQ ID NO: 608163 - RNA, 14 nt, Escherichia coli CFT073
ucuuucgcaucgcu

SEQ ID NO: 608164 - RNA, 20 nt, Escherichia coli CFT073
ucuuucgcuugacaaaaaga

SEQ ID NO: 608165 - RNA, 19 nt, Escherichia coli CFT073
ucuuucagcgccagaaagg

SEQ ID NO: 608166 - RNA, 23 nt, Escherichia coli CFT073
ucuuucaguucgccuuccagcag

SEQ ID NO: 608167 - RNA, 20 nt, Escherichia coli CFT073
ucuuucucgccuuucuuaaa

SEQ ID NO: 608168 - RNA, 20 nt, Escherichia coli CFT073
ucuuucugugcaaucacaaa

SEQ ID NO: 608169 - RNA, 20 nt, Escherichia coli CFT073
ucuuucugacgaauuaccaa

SEQ ID NO: 608170 - RNA, 22 nt, Escherichia coli CFT073
ucuuucugacgaauuaccaaca

SEQ ID NO: 608171 - RNA, 15 nt, Escherichia coli CFT073
ucuuucucuucuagu

SEQ ID NO: 608172 - RNA, 12 nt, Escherichia coli CFT073
ucuuucugaaau

SEQ ID NO: 608173 - RNA, 13 nt, Escherichia coli CFT073
ucuuaccucuuga

SEQ ID NO: 608174 - RNA, 16 nt, Escherichia coli CFT073
ucuuacauucugucuc

SEQ ID NO: 608175 - RNA, 18 nt, Escherichia coli CFT073
ucuguuauauauuacccu

SEQ ID NO: 608176 - RNA, 20 nt, Escherichia coli CFT073
ucuuacuucaacacauaacc

SEQ ID NO: 608177 - RNA, 20 nt, Escherichia coli CFT073
ucuuauccugcguuuguccg

SEQ ID NO: 608178 - RNA, 19 nt, Escherichia coli CFT073
ucuuaucagcauacgccac

SEQ ID NO: 608179 - RNA, 23 nt, Escherichia coli CFT073
ucuuaucaggccuacaaucccgu

SEQ ID NO: 608180 - RNA, 21 nt, Escherichia coli CFT073
ucuuaucaggccuacaggugc

SEQ ID NO: 608181 - RNA, 17 nt, Escherichia coli CFT073
ucuuaucaggccuacau

SEQ ID NO: 608182 - RNA, 13 nt, Escherichia coli CFT073
ucuucaacacacu

SEQ ID NO: 608183 - RNA, 13 nt, Escherichia coli CFT073
ucuucaacuucag

SEQ ID NO: 608184 - RNA, 18 nt, Escherichia coli CFT073
ucuucaacuucagcagca

SEQ ID NO: 608185 - RNA, 16 nt, Escherichia coli CFT073
ucuucacacacaucaa

SEQ ID NO: 608186 - RNA, 13 nt, Escherichia coli CFT073
ucuucacaucaau

SEQ ID NO: 608187 - RNA, 21 nt, Escherichia coli CFT073
ucuucacaucaauauuccagu

SEQ ID NO: 608188 - RNA, 21 nt, Escherichia coli CFT073
ucuucaaaaaagucagaucgu

SEQ ID NO: 608189 - RNA, 18 nt, Escherichia coli CFT073
ucuuauugaaagaucaca

SEQ ID NO: 608190 - RNA, 16 nt, Escherichia coli CFT073
ucuuauuuaauguaaa

SEQ ID NO: 608191 - RNA, 18 nt, Escherichia coli CFT073
ucuucaacaauugaagaa

SEQ ID NO: 608192 - RNA, 12 nt, Escherichia coli CFT073
ucuucaacacca

SEQ ID NO: 608193 - RNA, 12 nt, Escherichia coli CFT073
ucuucaaagcca

SEQ ID NO: 608194 - RNA, 14 nt, Escherichia coli CFT073
ucuucaaacuggcg

SEQ ID NO: 608195 - RNA, 14 nt, Escherichia coli CFT073
ucuucaaauaaacg

SEQ ID NO: 608196 - RNA, 14 nt, Escherichia coli CFT073
ucuuccacuuuguc

SEQ ID NO: 608197 - RNA, 20 nt, Escherichia coli CFT073
ucuuccacaauaccaaucgc

SEQ ID NO: 608198 - RNA, 15 nt, Escherichia coli CFT073
ucuucacgcccgccc

SEQ ID NO: 608199 - RNA, 18 nt, Escherichia coli CFT073
ucuucacgcgcagaucgu

SEQ ID NO: 608200 - RNA, 22 nt, Escherichia coli CFT073
ucuucacgauaaaucagauugu

SEQ ID NO: 608201 - RNA, 16 nt, Escherichia coli CFT073
ucuucaccaaaugccu

SEQ ID NO: 608202 - RNA, 24 nt, Escherichia coli CFT073
ucuucaccgguaguaagcguuuuc

SEQ ID NO: 608203 - RNA, 16 nt, Escherichia coli CFT073
ucuucaccugccugca

SEQ ID NO: 608204 - RNA, 17 nt, Escherichia coli CFT073
ucuucaccugccugcag

SEQ ID NO: 608205 - RNA, 16 nt, Escherichia coli CFT073
ucuucagcaaucucuu

SEQ ID NO: 608206 - RNA, 14 nt, Escherichia coli CFT073
ucuucagcaguuca

SEQ ID NO: 608207 - RNA, 14 nt, Escherichia coli CFT073
ucuucagcaucaau

SEQ ID NO: 608208 - RNA, 22 nt, Escherichia coli CFT073
ucugucacgcuggcaucaaucg

SEQ ID NO: 608209 - RNA, 16 nt, Escherichia coli CFT073
ucugucaguuggcugu

SEQ ID NO: 608210 - RNA, 18 nt, Escherichia coli CFT073
ucugucagacuaucuuug

SEQ ID NO: 608211 - RNA, 15 nt, Escherichia coli CFT073
ucugucagaaaugau

SEQ ID NO: 608212 - RNA, 14 nt, Escherichia coli CFT073
ucuguccuuccagu

SEQ ID NO: 608213 - RNA, 15 nt, Escherichia coli CFT073
ucugugugguuuugu

SEQ ID NO: 608214 - RNA, 18 nt, Escherichia coli CFT073
ucugugucgcuuucacgc

SEQ ID NO: 608215 - RNA, 17 nt, Escherichia coli CFT073
ucugugucugauauuuu

SEQ ID NO: 608216 - RNA, 14 nt, Escherichia coli CFT073
ucugucgcucugcu

SEQ ID NO: 608217 - RNA, 21 nt, Escherichia coli CFT073
ucuguaacaggucaauuucaa

SEQ ID NO: 608218 - RNA, 14 nt, Escherichia coli CFT073
ucuguaacucgaau

SEQ ID NO: 608219 - RNA, 15 nt, Escherichia coli CFT073
ucuguaccaccagaa

SEQ ID NO: 608220 - RNA, 12 nt, Escherichia coli CFT073
ucuguaauccau

SEQ ID NO: 608221 - RNA, 14 nt, Escherichia coli CFT073
ucuggcggaucuga

SEQ ID NO: 608222 - RNA, 14 nt, Escherichia coli CFT073
ucuggcgcgugaug

SEQ ID NO: 608223 - RNA, 15 nt, Escherichia coli CFT073
ucuggcggcgugaug

SEQ ID NO: 608224 - RNA, 17 nt, Escherichia coli CFT073
ucuggcguacagagggc

SEQ ID NO: 608225 - RNA, 12 nt, Escherichia coli CFT073
ucuggagucgga

SEQ ID NO: 608226 - RNA, 15 nt, Escherichia coli CFT073
ucuggaguguaaaaa

SEQ ID NO: 608227 - RNA, 21 nt, Escherichia coli CFT073
ucuggagaugggugugcugac

SEQ ID NO: 608228 - RNA, 17 nt, Escherichia coli CFT073
ucuggacuuccccugcc

SEQ ID NO: 608229 - RNA, 23 nt, Escherichia coli CFT073
ucuggaauggaaacagcaccauc

SEQ ID NO: 608230 - RNA, 19 nt, Escherichia coli CFT073
ucugguguggagugcagca

SEQ ID NO: 608231 - RNA, 22 nt, Escherichia coli CFT073
ucugguucgccaaaugucacca

SEQ ID NO: 608232 - RNA, 21 nt, Escherichia coli CFT073
ucugguugacgcguaaaucca

SEQ ID NO: 608233 - RNA, 23 nt, Escherichia coli CFT073
ucugguugacgcguaaauccagc

SEQ ID NO: 608234 - RNA, 13 nt, Escherichia coli CFT073
ucugguugagcag

SEQ ID NO: 608235 - RNA, 15 nt, Escherichia coli CFT073
ucuggcuguuucgcu

SEQ ID NO: 608236 - RNA, 16 nt, Escherichia coli CFT073
ucuggcuguuucgcuu

SEQ ID NO: 608237 - RNA, 19 nt, Escherichia coli CFT073
ucuggugccagcgccagca

SEQ ID NO: 608238 - RNA, 16 nt, Escherichia coli CFT073
ucugcuagauaagcaa

SEQ ID NO: 608239 - RNA, 19 nt, Escherichia coli CFT073
ucugcuccaucgcaugcca

SEQ ID NO: 608240 - RNA, 20 nt, Escherichia coli CFT073
ucuggaaccucgcgaaugcu

SEQ ID NO: 608241 - RNA, 22 nt, Escherichia coli CFT073
ucugcggcguaacgcaccaggc

SEQ ID NO: 608242 - RNA, 14 nt, Escherichia coli CFT073
ucugcggcaucaua

SEQ ID NO: 608243 - RNA, 16 nt, Escherichia coli CFT073
ucugcgcuucugccac

SEQ ID NO: 608244 - RNA, 20 nt, Escherichia coli CFT073
ucugcgccuuugaugccacc

SEQ ID NO: 608245 - RNA, 21 nt, Escherichia coli CFT073
ucugcgcggauagccagcauc

SEQ ID NO: 608246 - RNA, 18 nt, Escherichia coli CFT073
ucugcagcgcggcgagag

SEQ ID NO: 608247 - RNA, 15 nt, Escherichia coli CFT073
ucugcacagcauuca

SEQ ID NO: 608248 - RNA, 18 nt, Escherichia coli CFT073
ucugcaaucgucugcuga

SEQ ID NO: 608249 - RNA, 19 nt, Escherichia coli CFT073
ucugcacuaacccucuguc

SEQ ID NO: 608250 - RNA, 23 nt, Escherichia coli CFT073
ucugcacugcucauuaauauacu

SEQ ID NO: 608251 - RNA, 16 nt, Escherichia coli CFT073
ucucguuaccagcgcc

SEQ ID NO: 608252 - RNA, 13 nt, Escherichia coli CFT073
ucucgucuugcgu

SEQ ID NO: 608253 - RNA, 18 nt, Escherichia coli CFT073
ucucguccagcuugccuu

SEQ ID NO: 608254 - RNA, 17 nt, Escherichia coli CFT073
ucucgguagagaaaacc

SEQ ID NO: 608255 - RNA, 15 nt, Escherichia coli CFT073
ucucggcgcggcccu

SEQ ID NO: 608256 - RNA, 17 nt, Escherichia coli CFT073
ucucgggaaggcccuuu

SEQ ID NO: 608257 - RNA, 23 nt, Escherichia coli CFT073
ucucgcugacaucaacaauucgu

SEQ ID NO: 608258 - RNA, 14 nt, Escherichia coli CFT073
ucucgacuuuuucc

SEQ ID NO: 608259 - RNA, 15 nt, Escherichia coli CFT073
ucuccugcgccuguc

SEQ ID NO: 608260 - RNA, 17 nt, Escherichia coli CFT073
ucuccagcgcaucgauc

SEQ ID NO: 608261 - RNA, 18 nt, Escherichia coli CFT073
ucuccagcgcaucgaucu

SEQ ID NO: 608262 - RNA, 21 nt, Escherichia coli CFT073
ucuccagcaucgaaaaugcca

SEQ ID NO: 608263 - RNA, 17 nt, Escherichia coli CFT073
ucuccauacagaacagg

SEQ ID NO: 608264 - RNA, 18 nt, Escherichia coli CFT073
ucuccacucugccaggca

SEQ ID NO: 608265 - RNA, 21 nt, Escherichia coli CFT073
ucuccacucugccaggcagcg

SEQ ID NO: 608266 - RNA, 16 nt, Escherichia coli CFT073
ucuccagauaauuaug

SEQ ID NO: 608267 - RNA, 13 nt, Escherichia coli CFT073
ucucaugcuucau

SEQ ID NO: 608268 - RNA, 17 nt, Escherichia coli CFT073
ucucauggguauaaccg

SEQ ID NO: 608269 - RNA, 20 nt, Escherichia coli CFT073
ucuccgcucuucaucuucca

SEQ ID NO: 608270 - RNA, 18 nt, Escherichia coli CFT073
ucuccggccuacaaaaca

SEQ ID NO: 608271 - RNA, 11 nt, Escherichia coli CFT073
ucuccggcguu

SEQ ID NO: 608272 - RNA, 14 nt, Escherichia coli CFT073
ucucccgccugcug

SEQ ID NO: 608273 - RNA, 15 nt, Escherichia coli CFT073
ucucccucagguaua

SEQ ID NO: 608274 - RNA, 23 nt, Escherichia coli CFT073
ucucuugcuggcauuacaagaau

SEQ ID NO: 608275 - RNA, 15 nt, Escherichia coli CFT073
ucucuucguuuucaa

SEQ ID NO: 608276 - RNA, 13 nt, Escherichia coli CFT073
ucucuucuccuug

SEQ ID NO: 608277 - RNA, 13 nt, Escherichia coli CFT073
ucucuucugcuuu

SEQ ID NO: 608278 - RNA, 20 nt, Escherichia coli CFT073
ucucuuuauguaauaaaccu

SEQ ID NO: 608279 - RNA, 16 nt, Escherichia coli CFT073
ucucuuauauuucauu

SEQ ID NO: 608280 - RNA, 13 nt, Escherichia coli CFT073
ucucuuaucaucc

SEQ ID NO: 608281 - RNA, 20 nt, Escherichia coli CFT073
ucucuucacagacauccuga

SEQ ID NO: 608282 - RNA, 15 nt, Escherichia coli CFT073
ucucuucaccugccu

SEQ ID NO: 608283 - RNA, 19 nt, Escherichia coli CFT073
ucucuucaccugccugcag

SEQ ID NO: 608284 - RNA, 15 nt, Escherichia coli CFT073
ucucuuccggcuccc

SEQ ID NO: 608285 - RNA, 23 nt, Escherichia coli CFT073
ucucucuguagaacaccugucuu

SEQ ID NO: 608286 - RNA, 14 nt, Escherichia coli CFT073
ucucuccuuucggc

SEQ ID NO: 608287 - RNA, 14 nt, Escherichia coli CFT073
ucucugcaacgucu

SEQ ID NO: 608288 - RNA, 22 nt, Escherichia coli CFT073
ucucugcaagagauaaagcugu

SEQ ID NO: 608289 - RNA, 16 nt, Escherichia coli CFT073
ucucugacauaaaaaa

SEQ ID NO: 608290 - RNA, 21 nt, Escherichia coli CFT073
ucucugcaaauuaugccugau

SEQ ID NO: 608291 - RNA, 18 nt, Escherichia coli CFT073
ucucugcgcuauccagcg

SEQ ID NO: 608292 - RNA, 21 nt, Escherichia coli CFT073
ucucugucugccuuucgguga

SEQ ID NO: 608293 - RNA, 18 nt, Escherichia coli CFT073
ucucuggcuguuucgcuu

SEQ ID NO: 608294 - RNA, 20 nt, Escherichia coli CFT073
ucugaaaacuaaccuuacaa

SEQ ID NO: 608295 - RNA, 14 nt, Escherichia coli CFT073
ucugaaucaguccc

SEQ ID NO: 608296 - RNA, 22 nt, Escherichia coli CFT073
ucugaccgggaauauaaguacu

SEQ ID NO: 608297 - RNA, 18 nt, Escherichia coli CFT073
ucugacgcugaauacgca

SEQ ID NO: 608298 - RNA, 11 nt, Escherichia coli CFT073
ucugaauaaac

SEQ ID NO: 608299 - RNA, 17 nt, Escherichia coli CFT073
ucugaauaacacccaua

SEQ ID NO: 608300 - RNA, 19 nt, Escherichia coli CFT073
ucugaauaucaucacccug

SEQ ID NO: 608301 - RNA, 20 nt, Escherichia coli CFT073
ucugaauaucaucacccugc

SEQ ID NO: 608302 - RNA, 23 nt, Escherichia coli CFT073
ucugaauaucaucacccugcgau

SEQ ID NO: 608303 - RNA, 20 nt, Escherichia coli CFT073
ucugaaguuuguuaaccacc

SEQ ID NO: 608304 - RNA, 17 nt, Escherichia coli CFT073
ucugaaguaaagaaacu

SEQ ID NO: 608305 - RNA, 23 nt, Escherichia coli CFT073
ucugaaguaaagaaacugguugc

SEQ ID NO: 608306 - RNA, 22 nt, Escherichia coli CFT073
ucugacgugcacaaacuucuuc

SEQ ID NO: 608307 - RNA, 15 nt, Escherichia coli CFT073
ucugacgcacugugg

SEQ ID NO: 608308 - RNA, 18 nt, Escherichia coli CFT073
ucugauauuaauuuguau

SEQ ID NO: 608309 - RNA, 14 nt, Escherichia coli CFT073
ucugauauucagga

SEQ ID NO: 608310 - RNA, 21 nt, Escherichia coli CFT073
ucugauauuuagccagcagcu

SEQ ID NO: 608311 - RNA, 15 nt, Escherichia coli CFT073
ucugauauuuuauug

SEQ ID NO: 608312 - RNA, 17 nt, Escherichia coli CFT073
ucugauauuuuauugau

SEQ ID NO: 608313 - RNA, 21 nt, Escherichia coli CFT073
ucugaugauauuuuucccuga

SEQ ID NO: 608314 - RNA, 14 nt, Escherichia coli CFT073
ucugaugauauuuu

SEQ ID NO: 608315 - RNA, 19 nt, Escherichia coli CFT073
ucugcaacgucuucccgag

SEQ ID NO: 608316 - RNA, 14 nt, Escherichia coli CFT073
ucugcaaacaagaa

SEQ ID NO: 608317 - RNA, 12 nt, Escherichia coli CFT073
ucugcaaaaaua

SEQ ID NO: 608318 - RNA, 21 nt, Escherichia coli CFT073
ucguuaacggcauuuuccagc

SEQ ID NO: 608319 - RNA, 19 nt, Escherichia coli CFT073
ucgugacugccgccagcau

SEQ ID NO: 608320 - RNA, 22 nt, Escherichia coli CFT073
ucgugaauuuuaggaugcugca

SEQ ID NO: 608321 - RNA, 15 nt, Escherichia coli CFT073
ucguuaauuucugcu

SEQ ID NO: 608322 - RNA, 15 nt, Escherichia coli CFT073
ucguuaccacuuugg

SEQ ID NO: 608323 - RNA, 18 nt, Escherichia coli CFT073
ucguucgcaccaaaucca

SEQ ID NO: 608324 - RNA, 13 nt, Escherichia coli CFT073
ucguucgccgcau

SEQ ID NO: 608325 - RNA, 21 nt, Escherichia coli CFT073
ucguugugggccgaaaugaga

SEQ ID NO: 608326 - RNA, 16 nt, Escherichia coli CFT073
ucuaacucuucugaaa

SEQ ID NO: 608327 - RNA, 14 nt, Escherichia coli CFT073
ucuaauaaacauug

SEQ ID NO: 608328 - RNA, 12 nt, Escherichia coli CFT073
ucgucccagucg

SEQ ID NO: 608329 - RNA, 14 nt, Escherichia coli CFT073
ucgucgccagacca

SEQ ID NO: 608330 - RNA, 16 nt, Escherichia coli CFT073
ucgucgcucacuucac

SEQ ID NO: 608331 - RNA, 12 nt, Escherichia coli CFT073
ucguauccagcg

SEQ ID NO: 608332 - RNA, 20 nt, Escherichia coli CFT073
ucguauccagcguuauaaaa

SEQ ID NO: 608333 - RNA, 12 nt, Escherichia coli CFT073
ucgucccaggca

SEQ ID NO: 608334 - RNA, 16 nt, Escherichia coli CFT073
ucgucccaaaagcucg

SEQ ID NO: 608335 - RNA, 13 nt, Escherichia coli CFT073
ucguccagcugcc

SEQ ID NO: 608336 - RNA, 15 nt, Escherichia coli CFT073
ucguccagcugccug

SEQ ID NO: 608337 - RNA, 18 nt, Escherichia coli CFT073
ucguccagauguucuuca

SEQ ID NO: 608338 - RNA, 16 nt, Escherichia coli CFT073
ucguccaacaguucca

SEQ ID NO: 608339 - RNA, 22 nt, Escherichia coli CFT073
ucguaccagugcagaugcacaa

SEQ ID NO: 608340 - RNA, 21 nt, Escherichia coli CFT073
ucguaccauacugauccgcuu

SEQ ID NO: 608341 - RNA, 20 nt, Escherichia coli CFT073
ucguacagucacccgcugcg

SEQ ID NO: 608342 - RNA, 20 nt, Escherichia coli CFT073
ucguacaaacgcuuuacuca

SEQ ID NO: 608343 - RNA, 23 nt, Escherichia coli CFT073
ucguaaugaaucagcagauccau

SEQ ID NO: 608344 - RNA, 15 nt, Escherichia coli CFT073
ucguaaugaauguuu

SEQ ID NO: 608345 - RNA, 14 nt, Escherichia coli CFT073
ucguaauuuuucgg

SEQ ID NO: 608346 - RNA, 14 nt, Escherichia coli CFT073
ucggguucgccauc

SEQ ID NO: 608347 - RNA, 19 nt, Escherichia coli CFT073
ucggguucgccaucccugc

SEQ ID NO: 608348 - RNA, 20 nt, Escherichia coli CFT073
ucgguaaacggcacaaaucc

SEQ ID NO: 608349 - RNA, 16 nt, Escherichia coli CFT073
ucggucaguaagaggc

SEQ ID NO: 608350 - RNA, 22 nt, Escherichia coli CFT073
ucgguccgccacauaccacggc

SEQ ID NO: 608351 - RNA, 13 nt, Escherichia coli CFT073
ucggucagcgcaa

SEQ ID NO: 608352 - RNA, 15 nt, Escherichia coli CFT073
ucggucaguuugccc

SEQ ID NO: 608353 - RNA, 11 nt, Escherichia coli CFT073
ucggucacagu

SEQ ID NO: 608354 - RNA, 14 nt, Escherichia coli CFT073
ucggucagcacgcg

SEQ ID NO: 608355 - RNA, 16 nt, Escherichia coli CFT073
ucgguuuugcgccauc

SEQ ID NO: 608356 - RNA, 18 nt, Escherichia coli CFT073
ucgguuuuaacaccacuc

SEQ ID NO: 608357 - RNA, 18 nt, Escherichia coli CFT073
ucguaagucaccgcuuuu

SEQ ID NO: 608358 - RNA, 14 nt, Escherichia coli CFT073
ucguaagccugaua

SEQ ID NO: 608359 - RNA, 19 nt, Escherichia coli CFT073
ucggugauauacgccacuu

SEQ ID NO: 608360 - RNA, 17 nt, Escherichia coli CFT073
ucggugaugaauccggu

SEQ ID NO: 608361 - RNA, 15 nt, Escherichia coli CFT073
ucggugccgucaauc

SEQ ID NO: 608362 - RNA, 20 nt, Escherichia coli CFT073
ucgggcaacguugaccaguc

SEQ ID NO: 608363 - RNA, 21 nt, Escherichia coli CFT073
ucgggcaacguugaccaguca

SEQ ID NO: 608364 - RNA, 15 nt, Escherichia coli CFT073
ucgggcauuuccauu

SEQ ID NO: 608365 - RNA, 22 nt, Escherichia coli CFT073
ucgggaaggcccuuucccuucu

SEQ ID NO: 608366 - RNA, 14 nt, Escherichia coli CFT073
ucgggauauugccc

SEQ ID NO: 608367 - RNA, 16 nt, Escherichia coli CFT073
ucggcuuuuuucucaa

SEQ ID NO: 608368 - RNA, 18 nt, Escherichia coli CFT073
ucgggaacgcuuuugcau

SEQ ID NO: 608369 - RNA, 15 nt, Escherichia coli CFT073
ucgggaagaucacca

SEQ ID NO: 608370 - RNA, 17 nt, Escherichia coli CFT073
ucgggaagaucaccaca

SEQ ID NO: 608371 - RNA, 18 nt, Escherichia coli CFT073
ucgggugcgacaggagcc

SEQ ID NO: 608372 - RNA, 22 nt, Escherichia coli CFT073
ucggguccgggcaucaacagca

SEQ ID NO: 608373 - RNA, 23 nt, Escherichia coli CFT073
ucggggcgaucgcgccaaucagc

SEQ ID NO: 608374 - RNA, 22 nt, Escherichia coli CFT073
ucggggucgcgaguucgagucu

SEQ ID NO: 608375 - RNA, 18 nt, Escherichia coli CFT073
ucggggagaaaguuucaa

SEQ ID NO: 608376 - RNA, 14 nt, Escherichia coli CFT073
ucgggcggaaaacu

SEQ ID NO: 608377 - RNA, 21 nt, Escherichia coli CFT073
ucggcguuaacaauaacucuu

SEQ ID NO: 608378 - RNA, 17 nt, Escherichia coli CFT073
ucggcuccguuauucaa

SEQ ID NO: 608379 - RNA, 15 nt, Escherichia coli CFT073
ucggcuucacgccca

SEQ ID NO: 608380 - RNA, 18 nt, Escherichia coli CFT073
ucggcuuccagaagcauc

SEQ ID NO: 608381 - RNA, 21 nt, Escherichia coli CFT073
ucggcugcgcuucuuccagca

SEQ ID NO: 608382 - RNA, 17 nt, Escherichia coli CFT073
ucggcgugcaucucuuc

SEQ ID NO: 608383 - RNA, 22 nt, Escherichia coli CFT073
ucggcgugaacgcgcucgacuu

SEQ ID NO: 608384 - RNA, 20 nt, Escherichia coli CFT073
ucggcgguuuuuuauugccu

SEQ ID NO: 608385 - RNA, 19 nt, Escherichia coli CFT073
ucggcguaauccugaaagc

SEQ ID NO: 608386 - RNA, 22 nt, Escherichia coli CFT073
ucggcgcggcgguugacgcccc

SEQ ID NO: 608387 - RNA, 13 nt, Escherichia coli CFT073
ucggcggcgugcc

SEQ ID NO: 608388 - RNA, 13 nt, Escherichia coli CFT073
ucggcgcaaucgc

SEQ ID NO: 608389 - RNA, 21 nt, Escherichia coli CFT073
ucggccuaccaugaucugcaa

SEQ ID NO: 608390 - RNA, 22 nt, Escherichia coli CFT073
ucggccuaccaugaucugcaaa

SEQ ID NO: 608391 - RNA, 16 nt, Escherichia coli CFT073
ucggcaaaaauaaucu

SEQ ID NO: 608392 - RNA, 14 nt, Escherichia coli CFT073
ucggcaaaauacau

SEQ ID NO: 608393 - RNA, 16 nt, Escherichia coli CFT073
ucggauuacccggcau

SEQ ID NO: 608394 - RNA, 16 nt, Escherichia coli CFT073
ucggcaacaucaaaua

SEQ ID NO: 608395 - RNA, 17 nt, Escherichia coli CFT073
ucgcuguguaaacccag

SEQ ID NO: 608396 - RNA, 19 nt, Escherichia coli CFT073
ucgcugucgccaccccagu

SEQ ID NO: 608397 - RNA, 19 nt, Escherichia coli CFT073
ucgcuggccuccagcacuu

SEQ ID NO: 608398 - RNA, 16 nt, Escherichia coli CFT073
ucgcgcagcucaucaa

SEQ ID NO: 608399 - RNA, 14 nt, Escherichia coli CFT073
ucgcgcacggugca

SEQ ID NO: 608400 - RNA, 14 nt, Escherichia coli CFT073
ucgcugcugccugc

SEQ ID NO: 608401 - RNA, 19 nt, Escherichia coli CFT073
ucgcugcgaaguuuuuccg

SEQ ID NO: 608402 - RNA, 17 nt, Escherichia coli CFT073
ucggauaggcaccgcca

SEQ ID NO: 608403 - RNA, 19 nt, Escherichia coli CFT073
ucggauauuuuccagcaac

SEQ ID NO: 608404 - RNA, 18 nt, Escherichia coli CFT073
ucggaucgaggcgauacg

SEQ ID NO: 608405 - RNA, 18 nt, Escherichia coli CFT073
ucggagcucccccucuuc

SEQ ID NO: 608406 - RNA, 20 nt, Escherichia coli CFT073
ucggagcucccccucuuccg

SEQ ID NO: 608407 - RNA, 18 nt, Escherichia coli CFT073
ucgcuuugugcucuuccu

SEQ ID NO: 608408 - RNA, 13 nt, Escherichia coli CFT073
ucgcuuucucuuc

SEQ ID NO: 608409 - RNA, 18 nt, Escherichia coli CFT073
ucgcuuuuauuucugcuu

SEQ ID NO: 608410 - RNA, 13 nt, Escherichia coli CFT073
ucgcuuuccaggu

SEQ ID NO: 608411 - RNA, 16 nt, Escherichia coli CFT073
ucgcuuaacaguucca

SEQ ID NO: 608412 - RNA, 15 nt, Escherichia coli CFT073
ucgcuuucagauucg

SEQ ID NO: 608413 - RNA, 20 nt, Escherichia coli CFT073
ucgccugcgaaucuaaauca

SEQ ID NO: 608414 - RNA, 18 nt, Escherichia coli CFT073
ucgccguuaccagcaccg

SEQ ID NO: 608415 - RNA, 20 nt, Escherichia coli CFT073
ucgccuuccggcaguuucau

SEQ ID NO: 608416 - RNA, 19 nt, Escherichia coli CFT073
ucgccuucagguuuuucag

SEQ ID NO: 608417 - RNA, 16 nt, Escherichia coli CFT073
ucgccuuccagcagcu

SEQ ID NO: 608418 - RNA, 21 nt, Escherichia coli CFT073
ucgccuuaugcugcuucauug

SEQ ID NO: 608419 - RNA, 14 nt, Escherichia coli CFT073
ucgcccuguuccug

SEQ ID NO: 608420 - RNA, 18 nt, Escherichia coli CFT073
ucgcccuuaccauuccca

SEQ ID NO: 608421 - RNA, 21 nt, Escherichia coli CFT073
ucgcccuuaccauucccagac

SEQ ID NO: 608422 - RNA, 17 nt, Escherichia coli CFT073
ucgccgaagcagcugcu

SEQ ID NO: 608423 - RNA, 19 nt, Escherichia coli CFT073
ucgccgcaaaacccaggcu

SEQ ID NO: 608424 - RNA, 18 nt, Escherichia coli CFT073
ucgccgcgcuccaucaug

SEQ ID NO: 608425 - RNA, 15 nt, Escherichia coli CFT073
ucgcauaccauccag

SEQ ID NO: 608426 - RNA, 15 nt, Escherichia coli CFT073
ucgcagggacgcgca

SEQ ID NO: 608427 - RNA, 17 nt, Escherichia coli CFT073
ucgccaaauggcaggca

SEQ ID NO: 608428 - RNA, 21 nt, Escherichia coli CFT073
ucgccaaauuuggugcucagu

SEQ ID NO: 608429 - RNA, 15 nt, Escherichia coli CFT073
ucgcaucaggcauua

SEQ ID NO: 608430 - RNA, 12 nt, Escherichia coli CFT073
ucgcaucauccg

SEQ ID NO: 608431 - RNA, 19 nt, Escherichia coli CFT073
ucgccauuuucugccgcau

SEQ ID NO: 608432 - RNA, 19 nt, Escherichia coli CFT073
ucgccaugcgguaaguuuu

SEQ ID NO: 608433 - RNA, 23 nt, Escherichia coli CFT073
ucgccaucguuaaaaaacagugc

SEQ ID NO: 608434 - RNA, 18 nt, Escherichia coli CFT073
ucgcccccggcagugauc

SEQ ID NO: 608435 - RNA, 17 nt, Escherichia coli CFT073
ucgccccugcccuuuca

SEQ ID NO: 608436 - RNA, 15 nt, Escherichia coli CFT073
ucgcccacaccagau

SEQ ID NO: 608437 - RNA, 17 nt, Escherichia coli CFT073
ucgcccacgccagagau

SEQ ID NO: 608438 - RNA, 20 nt, Escherichia coli CFT073
ucgcccggcguggugcagcc

SEQ ID NO: 608439 - RNA, 22 nt, Escherichia coli CFT073
ucgcccuggacaacauuccugu

SEQ ID NO: 608440 - RNA, 15 nt, Escherichia coli CFT073
ucgcccgucuuccag

SEQ ID NO: 608441 - RNA, 15 nt, Escherichia coli CFT073
ucgcccguucauccg

SEQ ID NO: 608442 - RNA, 22 nt, Escherichia coli CFT073
ucgcccucuuucaccagaucgc

SEQ ID NO: 608443 - RNA, 21 nt, Escherichia coli CFT073
ucgcaauacugccgagaauga

SEQ ID NO: 608444 - RNA, 20 nt, Escherichia coli CFT073
ucgcaauacccugacccaga

SEQ ID NO: 608445 - RNA, 14 nt, Escherichia coli CFT073
ucgcacaggcaaug

SEQ ID NO: 608446 - RNA, 18 nt, Escherichia coli CFT073
ucgcacguugccagcaac

SEQ ID NO: 608447 - RNA, 19 nt, Escherichia coli CFT073
ucgcacguugccagcaacu

SEQ ID NO: 608448 - RNA, 21 nt, Escherichia coli CFT073
ucgcacuguguuggguucacu

SEQ ID NO: 608449 - RNA, 16 nt, Escherichia coli CFT073
ucgcagaaacgacacc

SEQ ID NO: 608450 - RNA, 18 nt, Escherichia coli CFT073
ucgcacugguuugcaggc

SEQ ID NO: 608451 - RNA, 19 nt, Escherichia coli CFT073
ucgauuuagaacugaucaa

SEQ ID NO: 608452 - RNA, 15 nt, Escherichia coli CFT073
ucgauuuucaaaaua

SEQ ID NO: 608453 - RNA, 18 nt, Escherichia coli CFT073
ucgauuuugcaauaaugg

SEQ ID NO: 608454 - RNA, 23 nt, Escherichia coli CFT073
ucgauuuugcaauaauggaaccu

SEQ ID NO: 608455 - RNA, 19 nt, Escherichia coli CFT073
ucgcaagacgaaaaaugaa

SEQ ID NO: 608456 - RNA, 20 nt, Escherichia coli CFT073
ucgcaagacgaaaaaugaau

SEQ ID NO: 608457 - RNA, 16 nt, Escherichia coli CFT073
ucgcaacgcaucuuuu

SEQ ID NO: 608458 - RNA, 21 nt, Escherichia coli CFT073
ucgcaauaaucaucucuccuu

SEQ ID NO: 608459 - RNA, 18 nt, Escherichia coli CFT073
ucgcaauacccugaccca

SEQ ID NO: 608460 - RNA, 14 nt, Escherichia coli CFT073
ucgagucucguuuc

SEQ ID NO: 608461 - RNA, 16 nt, Escherichia coli CFT073
ucgaguaacauuugca

SEQ ID NO: 608462 - RNA, 23 nt, Escherichia coli CFT073
ucgaguaaggcaaggaugcguuu

SEQ ID NO: 608463 - RNA, 16 nt, Escherichia coli CFT073
ucgaucagaccgugcg

SEQ ID NO: 608464 - RNA, 12 nt, Escherichia coli CFT073
ucgaucacuuuu

SEQ ID NO: 608465 - RNA, 18 nt, Escherichia coli CFT073
ucgaguuugccgcugucc

SEQ ID NO: 608466 - RNA, 13 nt, Escherichia coli CFT073
ucgauaucaccaa

SEQ ID NO: 608467 - RNA, 14 nt, Escherichia coli CFT073
ucgauaucaccaau

SEQ ID NO: 608468 - RNA, 21 nt, Escherichia coli CFT073
ucgauaucaggcaaacagaau

SEQ ID NO: 608469 - RNA, 22 nt, Escherichia coli CFT073
ucgacgcgugcagagucaucag

SEQ ID NO: 608470 - RNA, 19 nt, Escherichia coli CFT073
ucgacggaauaaacccaca

SEQ ID NO: 608471 - RNA, 13 nt, Escherichia coli CFT073
ucgaaguuuuccu

SEQ ID NO: 608472 - RNA, 14 nt, Escherichia coli CFT073
ucgaaguuuuccuc

SEQ ID NO: 608473 - RNA, 12 nt, Escherichia coli CFT073
ucgaagaaaaac

SEQ ID NO: 608474 - RNA, 19 nt, Escherichia coli CFT073
ucgaagguuccugcaaagc

SEQ ID NO: 608475 - RNA, 17 nt, Escherichia coli CFT073
ucgaacgguaacaggaa

SEQ ID NO: 608476 - RNA, 19 nt, Escherichia coli CFT073
ucgaaauggcgggacagaa

SEQ ID NO: 608477 - RNA, 20 nt, Escherichia coli CFT073
ucgaaccaucggcuuuggca

SEQ ID NO: 608478 - RNA, 19 nt, Escherichia coli CFT073
ucgaaccaaacagcgccag

SEQ ID NO: 608479 - RNA, 21 nt, Escherichia coli CFT073
ucgaacauccccacagaaaca

SEQ ID NO: 608480 - RNA, 23 nt, Escherichia coli CFT073
ucgaaucaaacauggagaguuuu

SEQ ID NO: 608481 - RNA, 14 nt, Escherichia coli CFT073
ucgacaauaaucaa

SEQ ID NO: 608482 - RNA, 15 nt, Escherichia coli CFT073
ucgacagacgccagc

SEQ ID NO: 608483 - RNA, 14 nt, Escherichia coli CFT073
ucgacacuacaguc

SEQ ID NO: 608484 - RNA, 13 nt, Escherichia coli CFT073
ucgacaccuucag

SEQ ID NO: 608485 - RNA, 17 nt, Escherichia coli CFT073
ucgacaccagccagacu

SEQ ID NO: 608486 - RNA, 21 nt, Escherichia coli CFT073
ucgacagacgccagcgcuuuu

SEQ ID NO: 608487 - RNA, 17 nt, Escherichia coli CFT073
uccuuuccuuaagccag

SEQ ID NO: 608488 - RNA, 22 nt, Escherichia coli CFT073
uccuuuagaagcacuaccuugc

SEQ ID NO: 608489 - RNA, 23 nt, Escherichia coli CFT073
uccuuuagaagcacuaccuugcu

SEQ ID NO: 608490 - RNA, 21 nt, Escherichia coli CFT073
uccuuuguacaggauauauuu

SEQ ID NO: 608491 - RNA, 14 nt, Escherichia coli CFT073
uccuuuaccacucu

SEQ ID NO: 608492 - RNA, 23 nt, Escherichia coli CFT073
uccuuuucgcauguaacugccuu

SEQ ID NO: 608493 - RNA, 24 nt, Escherichia coli CFT073
uccuuuucgcauguaacugccuuu

SEQ ID NO: 608494 - RNA, 22 nt, Escherichia coli CFT073
ucgaaaaaccugacgcugcuca

SEQ ID NO: 608495 - RNA, 10 nt, Escherichia coli CFT073
ucgaaaauau

SEQ ID NO: 608496 - RNA, 16 nt, Escherichia coli CFT073
ucgaaauaucacugau

SEQ ID NO: 608497 - RNA, 15 nt, Escherichia coli CFT073
ucgaaaucaaaguac

SEQ ID NO: 608498 - RNA, 17 nt, Escherichia coli CFT073
ucgaaaucaacauguuc

SEQ ID NO: 608499 - RNA, 18 nt, Escherichia coli CFT073
ucgaaaucauucgcagcu

SEQ ID NO: 608500 - RNA, 21 nt, Escherichia coli CFT073
ucgaaaucauucgcagcugca

SEQ ID NO: 608501 - RNA, 22 nt, Escherichia coli CFT073
uccuugccgcagacaaaauccu

SEQ ID NO: 608502 - RNA, 23 nt, Escherichia coli CFT073
uccuucuugcucgaagaguucca

SEQ ID NO: 608503 - RNA, 14 nt, Escherichia coli CFT073
uccuucucaucuuu

SEQ ID NO: 608504 - RNA, 20 nt, Escherichia coli CFT073
uccuucuaaagcaacuccau

SEQ ID NO: 608505 - RNA, 19 nt, Escherichia coli CFT073
uccuuagcagacguuugca

SEQ ID NO: 608506 - RNA, 13 nt, Escherichia coli CFT073
uccuucaacccgc

SEQ ID NO: 608507 - RNA, 20 nt, Escherichia coli CFT073
uccuucaucuucaacggcca

SEQ ID NO: 608508 - RNA, 12 nt, Escherichia coli CFT073
uccuggcaccau

SEQ ID NO: 608509 - RNA, 20 nt, Escherichia coli CFT073
uccuguagauauucuuccag

SEQ ID NO: 608510 - RNA, 17 nt, Escherichia coli CFT073
uccuguaaccaccguuu

SEQ ID NO: 608511 - RNA, 14 nt, Escherichia coli CFT073
uccuguaacgcagg

SEQ ID NO: 608512 - RNA, 20 nt, Escherichia coli CFT073
uccuguggacgcagcucaua

SEQ ID NO: 608513 - RNA, 14 nt, Escherichia coli CFT073
uccugcacuguccc

SEQ ID NO: 608514 - RNA, 16 nt, Escherichia coli CFT073
uccugcacugucccaa

SEQ ID NO: 608515 - RNA, 15 nt, Escherichia coli CFT073
uccugcacuucaaau

SEQ ID NO: 608516 - RNA, 20 nt, Escherichia coli CFT073
uccugcacuucaaauuucau

SEQ ID NO: 608517 - RNA, 14 nt, Escherichia coli CFT073
ucagcgcaaagagu

SEQ ID NO: 608518 - RNA, 16 nt, Escherichia coli CFT073
ucagcgaucagcauuu

SEQ ID NO: 608519 - RNA, 19 nt, Escherichia coli CFT073
ucagcgaucguuuuuaacc

SEQ ID NO: 608520 - RNA, 22 nt, Escherichia coli CFT073
ucagcgagacgugcguaccauu

SEQ ID NO: 608521 - RNA, 18 nt, Escherichia coli CFT073
uccugcggugcgguugau

SEQ ID NO: 608522 - RNA, 23 nt, Escherichia coli CFT073
uccugcggcagacgcucgccauu

SEQ ID NO: 608523 - RNA, 16 nt, Escherichia coli CFT073
uccugcggcuucaacu

SEQ ID NO: 608524 - RNA, 20 nt, Escherichia coli CFT073
uccugcgguuugucaucauu

SEQ ID NO: 608525 - RNA, 18 nt, Escherichia coli CFT073
uccugcauaucggcauaa

SEQ ID NO: 608526 - RNA, 14 nt, Escherichia coli CFT073
uccugcauaccauu

SEQ ID NO: 608527 - RNA, 19 nt, Escherichia coli CFT073
uccugcauuagccaggcac

SEQ ID NO: 608528 - RNA, 20 nt, Escherichia coli CFT073
uccugcauugcuucccaugu

SEQ ID NO: 608529 - RNA, 18 nt, Escherichia coli CFT073
uccugcggagcaaccugc

SEQ ID NO: 608530 - RNA, 17 nt, Escherichia coli CFT073
ugaauauugcugaaaag

SEQ ID NO: 608531 - RNA, 17 nt, Escherichia coli CFT073
ugaauauugccgcugac

SEQ ID NO: 608532 - RNA, 22 nt, Escherichia coli CFT073
ugaauaacgccgacaguggauc

SEQ ID NO: 608533 - RNA, 15 nt, Escherichia coli CFT073
ugaauaauacacaca

SEQ ID NO: 608534 - RNA, 19 nt, Escherichia coli CFT073
ugaauaaacgguacacgac

SEQ ID NO: 608535 - RNA, 20 nt, Escherichia coli CFT073
ugaauaaaguuuuaguugcc

SEQ ID NO: 608536 - RNA, 19 nt, Escherichia coli CFT073
ugaauaaauuggcuggggu

SEQ ID NO: 608537 - RNA, 13 nt, Escherichia coli CFT073
ugaauaaaagaaa

SEQ ID NO: 608538 - RNA, 20 nt, Escherichia coli CFT073
ugaaguucucgucaaacuca

SEQ ID NO: 608539 - RNA, 23 nt, Escherichia coli CFT073
ugaaguugccggauguguugcau

SEQ ID NO: 608540 - RNA, 23 nt, Escherichia coli CFT073
ugaagugugcaaacgauaaaagu

SEQ ID NO: 608541 - RNA, 17 nt, Escherichia coli CFT073
ugaagguaagcaacaga

SEQ ID NO: 608542 - RNA, 15 nt, Escherichia coli CFT073
ugaaguaguaacugu

SEQ ID NO: 608543 - RNA, 15 nt, Escherichia coli CFT073
ugaaguauuuaaaaa

SEQ ID NO: 608544 - RNA, 16 nt, Escherichia coli CFT073
ugaagucagcacaucc

SEQ ID NO: 608545 - RNA, 20 nt, Escherichia coli CFT073
ugaagucaggggcuuccagc

SEQ ID NO: 608546 - RNA, 17 nt, Escherichia coli CFT073
ugaagucaggugaaauu

SEQ ID NO: 608547 - RNA, 13 nt, Escherichia coli CFT073
ugaagugguugag

SEQ ID NO: 608548 - RNA, 20 nt, Escherichia coli CFT073
ugaauggcgucuucuucaaa

SEQ ID NO: 608549 - RNA, 19 nt, Escherichia coli CFT073
ugaaugccguaggcccagc

SEQ ID NO: 608550 - RNA, 20 nt, Escherichia coli CFT073
ugaauagugccgcaccagcu

SEQ ID NO: 608551 - RNA, 12 nt, Escherichia coli CFT073
ugaaucagcaga

SEQ ID NO: 608552 - RNA, 13 nt, Escherichia coli CFT073
ugaaucagcagau

SEQ ID NO: 608553 - RNA, 20 nt, Escherichia coli CFT073
ugaaucaccugauugaccgc

SEQ ID NO: 608554 - RNA, 21 nt, Escherichia coli CFT073
ugaaucaccugauugaccgcc

SEQ ID NO: 608555 - RNA, 20 nt, Escherichia coli CFT073
ugaaucccaguacuguacaa

SEQ ID NO: 608556 - RNA, 15 nt, Escherichia coli CFT073
ugaaucauggcguga

SEQ ID NO: 608557 - RNA, 15 nt, Escherichia coli CFT073
ugaauccacuggcug

SEQ ID NO: 608558 - RNA, 21 nt, Escherichia coli CFT073
ugaauuaaacacgggguuaaa

SEQ ID NO: 608559 - RNA, 14 nt, Escherichia coli CFT073
ugaauuaaugccuc

SEQ ID NO: 608560 - RNA, 15 nt, Escherichia coli CFT073
ugaauuaaguuuucc

SEQ ID NO: 608561 - RNA, 18 nt, Escherichia coli CFT073
ugaauuugugaacagccu

SEQ ID NO: 608562 - RNA, 22 nt, Escherichia coli CFT073
ugacaauccuucccugcaguaa

SEQ ID NO: 608563 - RNA, 18 nt, Escherichia coli CFT073
ugaauuuugaaggaaaaa

SEQ ID NO: 608564 - RNA, 19 nt, Escherichia coli CFT073
ugaauuuuuacuucuucac

SEQ ID NO: 608565 - RNA, 16 nt, Escherichia coli CFT073
ugaagcgaccaccacc

SEQ ID NO: 608566 - RNA, 18 nt, Escherichia coli CFT073
ugaagcauauucccuagu

SEQ ID NO: 608567 - RNA, 17 nt, Escherichia coli CFT073
ugaagcaguuucaccag

SEQ ID NO: 608568 - RNA, 21 nt, Escherichia coli CFT073
ugaagauggucuguaccacca

SEQ ID NO: 608569 - RNA, 19 nt, Escherichia coli CFT073
ugaaggaauuaaucccuua

SEQ ID NO: 608570 - RNA, 14 nt, Escherichia coli CFT073
ugaaggauaagacg

SEQ ID NO: 608571 - RNA, 19 nt, Escherichia coli CFT073
ugaaggcaaacuucucacc

SEQ ID NO: 608572 - RNA, 19 nt, Escherichia coli CFT073
ugaaggcaauugcauuuga

SEQ ID NO: 608573 - RNA, 16 nt, Escherichia coli CFT073
ugaagcugaacagucg

SEQ ID NO: 608574 - RNA, 14 nt, Escherichia coli CFT073
ugaagcggcagagg

SEQ ID NO: 608575 - RNA, 14 nt, Escherichia coli CFT073
ugaaguaauaauca

SEQ ID NO: 608576 - RNA, 16 nt, Escherichia coli CFT073
ugaaggugauucccag

SEQ ID NO: 608577 - RNA, 21 nt, Escherichia coli CFT073
ugaaggugguuaccgccagca

SEQ ID NO: 608578 - RNA, 23 nt, Escherichia coli CFT073
ugaagguccuuuacuucaccauu

SEQ ID NO: 608579 - RNA, 17 nt, Escherichia coli CFT073
ugaagaguuugaucaug

SEQ ID NO: 608580 - RNA, 18 nt, Escherichia coli CFT073
ugaagacucaacuuuaaa

SEQ ID NO: 608581 - RNA, 20 nt, Escherichia coli CFT073
ugaacuuguuuacaaauaau

SEQ ID NO: 608582 - RNA, 14 nt, Escherichia coli CFT073
ugaacuucagguga

SEQ ID NO: 608583 - RNA, 16 nt, Escherichia coli CFT073
ugaacuucgccaggau

SEQ ID NO: 608584 - RNA, 19 nt, Escherichia coli CFT073
ugaacuucuucgccagguu

SEQ ID NO: 608585 - RNA, 12 nt, Escherichia coli CFT073
ugaagaaaucag

SEQ ID NO: 608586 - RNA, 19 nt, Escherichia coli CFT073
ugaagaaccaagccugcug

SEQ ID NO: 608587 - RNA, 18 nt, Escherichia coli CFT073
ugaagaaccgcaccaggc

SEQ ID NO: 608588 - RNA, 19 nt, Escherichia coli CFT073
ugaacgugcaaaaucaaac

SEQ ID NO: 608589 - RNA, 20 nt, Escherichia coli CFT073
ugaacgucgcguaauuccag

SEQ ID NO: 608590 - RNA, 23 nt, Escherichia coli CFT073
ugaacgucuuugcgcuccaucag

SEQ ID NO: 608591 - RNA, 14 nt, Escherichia coli CFT073
ugaacgugcaaaau

SEQ ID NO: 608592 - RNA, 21 nt, Escherichia coli CFT073
ugaacgcgaaggccagcacca

SEQ ID NO: 608593 - RNA, 20 nt, Escherichia coli CFT073
ugaacgccuuauccggccua

SEQ ID NO: 608594 - RNA, 14 nt, Escherichia coli CFT073
ugaacgccuuaucc

SEQ ID NO: 608595 - RNA, 17 nt, Escherichia coli CFT073
ugaacggcgguaaagaa

SEQ ID NO: 608596 - RNA, 22 nt, Escherichia coli CFT073
ugaacgcuaucggcauaaccaa

SEQ ID NO: 608597 - RNA, 20 nt, Escherichia coli CFT073
ugaacucaacgccuucuucg

SEQ ID NO: 608598 - RNA, 19 nt, Escherichia coli CFT073
ugaacucggugaccgagcg

SEQ ID NO: 608599 - RNA, 17 nt, Escherichia coli CFT073
ugaacugguuaaauuua

SEQ ID NO: 608600 - RNA, 13 nt, Escherichia coli CFT073
ugaacuggaaaaa

SEQ ID NO: 608601 - RNA, 19 nt, Escherichia coli CFT073
ugaacugggccugcauauc

SEQ ID NO: 608602 - RNA, 20 nt, Escherichia coli CFT073
ugaacugggcuauggcaaca

SEQ ID NO: 608603 - RNA, 23 nt, Escherichia coli CFT073
ugaccgccacgguaucaagcccg

SEQ ID NO: 608604 - RNA, 19 nt, Escherichia coli CFT073
ugaccaguaauauccccag

SEQ ID NO: 608605 - RNA, 19 nt, Escherichia coli CFT073
ugacauggcaauagcuucu

SEQ ID NO: 608606 - RNA, 18 nt, Escherichia coli CFT073
ugacauuaaagcuuuacu

SEQ ID NO: 608607 - RNA, 11 nt, Escherichia coli CFT073
ugaccaaaucu

SEQ ID NO: 608608 - RNA, 14 nt, Escherichia coli CFT073
ugacauuuuuucau

SEQ ID NO: 608609 - RNA, 19 nt, Escherichia coli CFT073
ugacauuuuuucaucuguu

SEQ ID NO: 608610 - RNA, 20 nt, Escherichia coli CFT073
ugacauuuccguaauaucuu

SEQ ID NO: 608611 - RNA, 21 nt, Escherichia coli CFT073
ugacauuuccguaauaucuuc

SEQ ID NO: 608612 - RNA, 14 nt, Escherichia coli CFT073
ugacaucuccagcg

SEQ ID NO: 608613 - RNA, 17 nt, Escherichia coli CFT073
ugacaucuccagcgcau

SEQ ID NO: 608614 - RNA, 23 nt, Escherichia coli CFT073
ugacaucgucaggggcauuuucc

SEQ ID NO: 608615 - RNA, 16 nt, Escherichia coli CFT073
ugacauccagaucacg

SEQ ID NO: 608616 - RNA, 14 nt, Escherichia coli CFT073
ugacaauuacaaaa

SEQ ID NO: 608617 - RNA, 21 nt, Escherichia coli CFT073
ugacgcgcauacucuccucca

SEQ ID NO: 608618 - RNA, 16 nt, Escherichia coli CFT073
ugacgccugcagcauc

SEQ ID NO: 608619 - RNA, 17 nt, Escherichia coli CFT073
ugacgccugcagcaucg

SEQ ID NO: 608620 - RNA, 14 nt, Escherichia coli CFT073
ugacgccugccagc

SEQ ID NO: 608621 - RNA, 16 nt, Escherichia coli CFT073
ugacgauuauuuuccg

SEQ ID NO: 608622 - RNA, 16 nt, Escherichia coli CFT073
ugacgaaggugccgga

SEQ ID NO: 608623 - RNA, 16 nt, Escherichia coli CFT073
ugacgaauauguuuuu

SEQ ID NO: 608624 - RNA, 12 nt, Escherichia coli CFT073
ugacgaccaugc

SEQ ID NO: 608625 - RNA, 13 nt, Escherichia coli CFT073
ugaccuucuucag

SEQ ID NO: 608626 - RNA, 15 nt, Escherichia coli CFT073
ugaccuuccagcgcu

SEQ ID NO: 608627 - RNA, 16 nt, Escherichia coli CFT073
ugaccuuaccaccuua

SEQ ID NO: 608628 - RNA, 14 nt, Escherichia coli CFT073
ugaccgccuaauac

SEQ ID NO: 608629 - RNA, 21 nt, Escherichia coli CFT073
ugagauaaucaaauacaccac

SEQ ID NO: 608630 - RNA, 13 nt, Escherichia coli CFT073
ugagcacauauuc

SEQ ID NO: 608631 - RNA, 23 nt, Escherichia coli CFT073
ugagcaccacacgacgcgccagc

SEQ ID NO: 608632 - RNA, 22 nt, Escherichia coli CFT073
ugagcagggugaauaaaagaaa

SEQ ID NO: 608633 - RNA, 13 nt, Escherichia coli CFT073
ugagagaagaaac

SEQ ID NO: 608634 - RNA, 14 nt, Escherichia coli CFT073
ugagacgcacccuc

SEQ ID NO: 608635 - RNA, 23 nt, Escherichia coli CFT073
ugagacgguuaaaaacagccagc

SEQ ID NO: 608636 - RNA, 16 nt, Escherichia coli CFT073
ugagagcaaacaccgc

SEQ ID NO: 608637 - RNA, 14 nt, Escherichia coli CFT073
ugagagcaaccagc

SEQ ID NO: 608638 - RNA, 20 nt, Escherichia coli CFT073
ugagagcaaccagcaaugcc

SEQ ID NO: 608639 - RNA, 14 nt, Escherichia coli CFT073
ugagacuuuacccg

SEQ ID NO: 608640 - RNA, 17 nt, Escherichia coli CFT073
ugacuuaccuccugucu

SEQ ID NO: 608641 - RNA, 15 nt, Escherichia coli CFT073
ugacuuauaagucuc

SEQ ID NO: 608642 - RNA, 19 nt, Escherichia coli CFT073
ugacuucaaucugagcgaa

SEQ ID NO: 608643 - RNA, 14 nt, Escherichia coli CFT073
ugacuuccacuucc

SEQ ID NO: 608644 - RNA, 15 nt, Escherichia coli CFT073
ugacuuccacuuccu

SEQ ID NO: 608645 - RNA, 13 nt, Escherichia coli CFT073
ugacuuccgccac

SEQ ID NO: 608646 - RNA, 21 nt, Escherichia coli CFT073
ugagaaauuagcgucaccauc

SEQ ID NO: 608647 - RNA, 19 nt, Escherichia coli CFT073
ugagaacauaaacacccac

SEQ ID NO: 608648 - RNA, 23 nt, Escherichia coli CFT073
ugagaacauucaucauuucauuu

SEQ ID NO: 608649 - RNA, 17 nt, Escherichia coli CFT073
ugagaaccgcacagguu

SEQ ID NO: 608650 - RNA, 21 nt, Escherichia coli CFT073
ugacgugauugguuucaaccu

SEQ ID NO: 608651 - RNA, 14 nt, Escherichia coli CFT073
ugacguuaagaaaa

SEQ ID NO: 608652 - RNA, 14 nt, Escherichia coli CFT073
ugacguucaguuca

SEQ ID NO: 608653 - RNA, 14 nt, Escherichia coli CFT073
ugacguuuaauugc

SEQ ID NO: 608654 - RNA, 19 nt, Escherichia coli CFT073
ugacguuuuuacagacuaa

SEQ ID NO: 608655 - RNA, 21 nt, Escherichia coli CFT073
ugacguaaacccguugcuuca

SEQ ID NO: 608656 - RNA, 15 nt, Escherichia coli CFT073
ugacguaaucaugaa

SEQ ID NO: 608657 - RNA, 16 nt, Escherichia coli CFT073
ugacguccggcauacu

SEQ ID NO: 608658 - RNA, 18 nt, Escherichia coli CFT073
ugacgucgaaacugacau

SEQ ID NO: 608659 - RNA, 22 nt, Escherichia coli CFT073
ugacguagcagcuccgccagcu

SEQ ID NO: 608660 - RNA, 15 nt, Escherichia coli CFT073
ugacgggcaaggcug

SEQ ID NO: 608661 - RNA, 16 nt, Escherichia coli CFT073
ugacggugauaaucau

SEQ ID NO: 608662 - RNA, 16 nt, Escherichia coli CFT073
ugacugauauccagcc

SEQ ID NO: 608663 - RNA, 18 nt, Escherichia coli CFT073
ugacugaugcuuuccgcc

SEQ ID NO: 608664 - RNA, 21 nt, Escherichia coli CFT073
ugacuauccuggacuuuaaac

SEQ ID NO: 608665 - RNA, 15 nt, Escherichia coli CFT073
ugacuaucacagaaa

SEQ ID NO: 608666 - RNA, 14 nt, Escherichia coli CFT073
ugacuacaaaaaaa

SEQ ID NO: 608667 - RNA, 15 nt, Escherichia coli CFT073
ugacuaaugccgcca

SEQ ID NO: 608668 - RNA, 20 nt, Escherichia coli CFT073
ugacuaagcguuuucugcca

SEQ ID NO: 608669 - RNA, 14 nt, Escherichia coli CFT073
ugcaaccuuuucca

SEQ ID NO: 608670 - RNA, 21 nt, Escherichia coli CFT073
ugcaaccuuuuccauugccgc

SEQ ID NO: 608671 - RNA, 17 nt, Escherichia coli CFT073
ugcaacgaaccaaucac

SEQ ID NO: 608672 - RNA, 20 nt, Escherichia coli CFT073
ugcaaccgacgacgaccagc

SEQ ID NO: 608673 - RNA, 15 nt, Escherichia coli CFT073
ugcaaauucggucag

SEQ ID NO: 608674 - RNA, 22 nt, Escherichia coli CFT073
ugcaaauuuuaacgcauaauaa

SEQ ID NO: 608675 - RNA, 18 nt, Escherichia coli CFT073
ugcaacaacaccagcagg

SEQ ID NO: 608676 - RNA, 15 nt, Escherichia coli CFT073
ugcaacacaagccaa

SEQ ID NO: 608677 - RNA, 17 nt, Escherichia coli CFT073
ugcaacacuaccgguca

SEQ ID NO: 608678 - RNA, 14 nt, Escherichia coli CFT073
ugcaacacuuccgc

SEQ ID NO: 608679 - RNA, 21 nt, Escherichia coli CFT073
ugcaacguuuuaagcaaauaa

SEQ ID NO: 608680 - RNA, 24 nt, Escherichia coli CFT073
ugcaacguuuuaagcaaauaauuc

SEQ ID NO: 608681 - RNA, 13 nt, Escherichia coli CFT073
ugcaacugcccag

SEQ ID NO: 608682 - RNA, 23 nt, Escherichia coli CFT073
ugcaacugcccaggcaaaaaggc

SEQ ID NO: 608683 - RNA, 14 nt, Escherichia coli CFT073
ugcaacugaugacu

SEQ ID NO: 608684 - RNA, 18 nt, Escherichia coli CFT073
ugcaacuggcggcggcga

SEQ ID NO: 608685 - RNA, 12 nt, Escherichia coli CFT073
ugcaacuugaag

SEQ ID NO: 608686 - RNA, 16 nt, Escherichia coli CFT073
ugcaaucacuuccuca

SEQ ID NO: 608687 - RNA, 12 nt, Escherichia coli CFT073
ugcaaucagcgg

SEQ ID NO: 608688 - RNA, 20 nt, Escherichia coli CFT073
ugcaaucagcggugccgcga

SEQ ID NO: 608689 - RNA, 19 nt, Escherichia coli CFT073
ugcacgcgaccgucuuuau

SEQ ID NO: 608690 - RNA, 20 nt, Escherichia coli CFT073
ugcacgcgaccgucuuuauc

SEQ ID NO: 608691 - RNA, 23 nt, Escherichia coli CFT073
ugcacgcccugauaaaucaccug

SEQ ID NO: 608692 - RNA, 15 nt, Escherichia coli CFT073
ugcacgcagaucggu

SEQ ID NO: 608693 - RNA, 14 nt, Escherichia coli CFT073
ugcaccugauccag

SEQ ID NO: 608694 - RNA, 16 nt, Escherichia coli CFT073
ugcaccgucacuucuu

SEQ ID NO: 608695 - RNA, 17 nt, Escherichia coli CFT073
ugcaccugcguugccgc

SEQ ID NO: 608696 - RNA, 20 nt, Escherichia coli CFT073
ugcaccggcgauaucccagg

SEQ ID NO: 608697 - RNA, 16 nt, Escherichia coli CFT073
ugcaccgcgccacugg

SEQ ID NO: 608698 - RNA, 18 nt, Escherichia coli CFT073
ugcaccgcgccacuggcg

SEQ ID NO: 608699 - RNA, 15 nt, Escherichia coli CFT073
ugcaccgauuucgag

SEQ ID NO: 608700 - RNA, 13 nt, Escherichia coli CFT073
ugcaccagcagcg

SEQ ID NO: 608701 - RNA, 20 nt, Escherichia coli CFT073
ugcaccagcuuguuguccgg

SEQ ID NO: 608702 - RNA, 16 nt, Escherichia coli CFT073
ugcaccagguuuucgu

SEQ ID NO: 608703 - RNA, 16 nt, Escherichia coli CFT073
ugcaccccacaaacag

SEQ ID NO: 608704 - RNA, 22 nt, Escherichia coli CFT073
ugcaauuacgcuauacaaccac

SEQ ID NO: 608705 - RNA, 17 nt, Escherichia coli CFT073
ugcaccagaucuuccag

SEQ ID NO: 608706 - RNA, 12 nt, Escherichia coli CFT073
ugcaccagcaau

SEQ ID NO: 608707 - RNA, 15 nt, Escherichia coli CFT073
ugcaccagaacuccc

SEQ ID NO: 608708 - RNA, 18 nt, Escherichia coli CFT073
ugcaauuuccgcuuucaa

SEQ ID NO: 608709 - RNA, 21 nt, Escherichia coli CFT073
ugauuaacgcuuguaaaugaa

SEQ ID NO: 608710 - RNA, 16 nt, Escherichia coli CFT073
ugaugccuucaguuuc

SEQ ID NO: 608711 - RNA, 22 nt, Escherichia coli CFT073
ugaugcgcgagguaacaauaaa

SEQ ID NO: 608712 - RNA, 13 nt, Escherichia coli CFT073
ugauuaauauuga

SEQ ID NO: 608713 - RNA, 20 nt, Escherichia coli CFT073
ugauuacacaaguccagcac

SEQ ID NO: 608714 - RNA, 17 nt, Escherichia coli CFT073
ugauuaccgcaaaucac

SEQ ID NO: 608715 - RNA, 20 nt, Escherichia coli CFT073
ugauuaccggagcugcagcc

SEQ ID NO: 608716 - RNA, 14 nt, Escherichia coli CFT073
ugauugauuuuucc

SEQ ID NO: 608717 - RNA, 16 nt, Escherichia coli CFT073
ugauugaccauauuaa

SEQ ID NO: 608718 - RNA, 15 nt, Escherichia coli CFT073
ugauuccgcagauau

SEQ ID NO: 608719 - RNA, 21 nt, Escherichia coli CFT073
ugauucauggcauuuucucgu

SEQ ID NO: 608720 - RNA, 11 nt, Escherichia coli CFT073
ugauucuuccc

SEQ ID NO: 608721 - RNA, 18 nt, Escherichia coli CFT073
ugauucauaaacaauaca

SEQ ID NO: 608722 - RNA, 19 nt, Escherichia coli CFT073
ugauucaucucuucuuccg

SEQ ID NO: 608723 - RNA, 19 nt, Escherichia coli CFT073
ugauucauggcauuuucuc

SEQ ID NO: 608724 - RNA, 18 nt, Escherichia coli CFT073
ugcaaauacccaaaaaau

SEQ ID NO: 608725 - RNA, 15 nt, Escherichia coli CFT073
ugcaaacaacgcuuc

SEQ ID NO: 608726 - RNA, 19 nt, Escherichia coli CFT073
ugcaaacaacgcuucaaac

SEQ ID NO: 608727 - RNA, 18 nt, Escherichia coli CFT073
ugcaaacaguaacccagc

SEQ ID NO: 608728 - RNA, 16 nt, Escherichia coli CFT073
ugcaaaauaccaauaa

SEQ ID NO: 608729 - RNA, 22 nt, Escherichia coli CFT073
ugauuggcgcgaaccaucaccu

SEQ ID NO: 608730 - RNA, 15 nt, Escherichia coli CFT073
ugauugccuuccacc

SEQ ID NO: 608731 - RNA, 16 nt, Escherichia coli CFT073
ugauuuucuuccagua

SEQ ID NO: 608732 - RNA, 20 nt, Escherichia coli CFT073
ugauuuugccugugcaaccu

SEQ ID NO: 608733 - RNA, 19 nt, Escherichia coli CFT073
ugauuucaggauaauuaug

SEQ ID NO: 608734 - RNA, 14 nt, Escherichia coli CFT073
ugauuuauuucuca

SEQ ID NO: 608735 - RNA, 21 nt, Escherichia coli CFT073
ugauuuauuucucauuuugau

SEQ ID NO: 608736 - RNA, 13 nt, Escherichia coli CFT073
ugauuuauuuucc

SEQ ID NO: 608737 - RNA, 23 nt, Escherichia coli CFT073
ugauuucaaaauuaaagccgcga

SEQ ID NO: 608738 - RNA, 15 nt, Escherichia coli CFT073
ugauuucaaccggua

SEQ ID NO: 608739 - RNA, 17 nt, Escherichia coli CFT073
ugaucauuaucacccug

SEQ ID NO: 608740 - RNA, 16 nt, Escherichia coli CFT073
ugaucauucaccagcc

SEQ ID NO: 608741 - RNA, 19 nt, Escherichia coli CFT073
ugaucauagcgaauaaucc

SEQ ID NO: 608742 - RNA, 21 nt, Escherichia coli CFT073
ugaucugcgucgcuuuccagu

SEQ ID NO: 608743 - RNA, 14 nt, Escherichia coli CFT073
ugaucugcacagca

SEQ ID NO: 608744 - RNA, 19 nt, Escherichia coli CFT073
ugaucugaucaaacucgcu

SEQ ID NO: 608745 - RNA, 17 nt, Escherichia coli CFT073
ugaucugugugguuuug

SEQ ID NO: 608746 - RNA, 13 nt, Escherichia coli CFT073
ugaucucuuucca

SEQ ID NO: 608747 - RNA, 18 nt, Escherichia coli CFT073
ugaucuccuuuguaccag

SEQ ID NO: 608748 - RNA, 16 nt, Escherichia coli CFT073
ugaugaguaucuuauu

SEQ ID NO: 608749 - RNA, 23 nt, Escherichia coli CFT073
ugaugcccgguugugaagugcaa

SEQ ID NO: 608750 - RNA, 18 nt, Escherichia coli CFT073
ugaugauuaaaucgaagc

SEQ ID NO: 608751 - RNA, 22 nt, Escherichia coli CFT073
ugaucuuuaucaagcaccaacu

SEQ ID NO: 608752 - RNA, 22 nt, Escherichia coli CFT073
ugaucuucucuuauauuucauu

SEQ ID NO: 608753 - RNA, 20 nt, Escherichia coli CFT073
ugaugaaaaacguugccgga

SEQ ID NO: 608754 - RNA, 14 nt, Escherichia coli CFT073
ugaucuuuuuuauu

SEQ ID NO: 608755 - RNA, 13 nt, Escherichia coli CFT073
ugaugaaaaaacc

SEQ ID NO: 608756 - RNA, 20 nt, Escherichia coli CFT073
ugaugaacgguugcaauauc

SEQ ID NO: 608757 - RNA, 21 nt, Escherichia coli CFT073
ugaucacaucaucuaccagca

SEQ ID NO: 608758 - RNA, 16 nt, Escherichia coli CFT073
ugaucacccacaccac

SEQ ID NO: 608759 - RNA, 23 nt, Escherichia coli CFT073
ugaucaggugauggcagccauuu

SEQ ID NO: 608760 - RNA, 17 nt, Escherichia coli CFT073
ugaucagugcacugacg

SEQ ID NO: 608761 - RNA, 14 nt, Escherichia coli CFT073
ugaucaauaauuaa

SEQ ID NO: 608762 - RNA, 16 nt, Escherichia coli CFT073
ugaucaagcuggcgcu

SEQ ID NO: 608763 - RNA, 20 nt, Escherichia coli CFT073
ugaucaagcuggcgcuggcg

SEQ ID NO: 608764 - RNA, 17 nt, Escherichia coli CFT073
ugaucaacgaccagaaa

SEQ ID NO: 608765 - RNA, 20 nt, Escherichia coli CFT073
ugauauguuuauuagcccag

SEQ ID NO: 608766 - RNA, 16 nt, Escherichia coli CFT073
ugauauuaauuuguau

SEQ ID NO: 608767 - RNA, 23 nt, Escherichia coli CFT073
ugauaugggcaaacaaaaaaccu

SEQ ID NO: 608768 - RNA, 14 nt, Escherichia coli CFT073
ugauauguauuaua

SEQ ID NO: 608769 - RNA, 18 nt, Escherichia coli CFT073
ugauauguucucuaaucu

SEQ ID NO: 608770 - RNA, 15 nt, Escherichia coli CFT073
ugauauguuuauuag

SEQ ID NO: 608771 - RNA, 17 nt, Escherichia coli CFT073
ugauagagcucaucagg

SEQ ID NO: 608772 - RNA, 23 nt, Escherichia coli CFT073
ugauagcgcacaauaaugugguc

SEQ ID NO: 608773 - RNA, 23 nt, Escherichia coli CFT073
ugauagcaaugccaucaccaacg

SEQ ID NO: 608774 - RNA, 12 nt, Escherichia coli CFT073
ugauacagaaag

SEQ ID NO: 608775 - RNA, 17 nt, Escherichia coli CFT073
ugauacaucaagucaga

SEQ ID NO: 608776 - RNA, 18 nt, Escherichia coli CFT073
ugauacguuauaucugua

SEQ ID NO: 608777 - RNA, 15 nt, Escherichia coli CFT073
ugauaccgugcagca

SEQ ID NO: 608778 - RNA, 20 nt, Escherichia coli CFT073
ugauaagacgcguuaagcgu

SEQ ID NO: 608779 - RNA, 15 nt, Escherichia coli CFT073
ugauaagagagcaac

SEQ ID NO: 608780 - RNA, 20 nt, Escherichia coli CFT073
ugauaagaugcguuaagcgu

SEQ ID NO: 608781 - RNA, 15 nt, Escherichia coli CFT073
ugauaaccuuccagc

SEQ ID NO: 608782 - RNA, 18 nt, Escherichia coli CFT073
ugauaacgaauugcugcg

SEQ ID NO: 608783 - RNA, 20 nt, Escherichia coli CFT073
ugauaaccccgcaauuucau

SEQ ID NO: 608784 - RNA, 20 nt, Escherichia coli CFT073
ugauaaccgcgcgugccgga

SEQ ID NO: 608785 - RNA, 22 nt, Escherichia coli CFT073
ugauaaccguagcguuccugga

SEQ ID NO: 608786 - RNA, 18 nt, Escherichia coli CFT073
ugauaaucaacaggaaca

SEQ ID NO: 608787 - RNA, 19 nt, Escherichia coli CFT073
ugauaaaccuccagcauca

SEQ ID NO: 608788 - RNA, 18 nt, Escherichia coli CFT073
ugauaaaugaagaaaaac

SEQ ID NO: 608789 - RNA, 19 nt, Escherichia coli CFT073
ugauaaaugaagaaaaacc

SEQ ID NO: 608790 - RNA, 13 nt, Escherichia coli CFT073
ugaguuuuucauc

SEQ ID NO: 608791 - RNA, 20 nt, Escherichia coli CFT073
ugaguucaaauuccacaccu

SEQ ID NO: 608792 - RNA, 14 nt, Escherichia coli CFT073
ugaguucacugccg

SEQ ID NO: 608793 - RNA, 15 nt, Escherichia coli CFT073
ugaguucacugccgu

SEQ ID NO: 608794 - RNA, 15 nt, Escherichia coli CFT073
ugagucuggaagaau

SEQ ID NO: 608795 - RNA, 19 nt, Escherichia coli CFT073
ugagucgccgcaaucagcc

SEQ ID NO: 608796 - RNA, 21 nt, Escherichia coli CFT073
ugagcaugugcaauuucguug

SEQ ID NO: 608797 - RNA, 15 nt, Escherichia coli CFT073
ugagccaaaaugcuu

SEQ ID NO: 608798 - RNA, 13 nt, Escherichia coli CFT073
ugagucagcagcg

SEQ ID NO: 608799 - RNA, 16 nt, Escherichia coli CFT073
ugagcagguugaggug

SEQ ID NO: 608800 - RNA, 15 nt, Escherichia coli CFT073
ugcuucaagaugcca

SEQ ID NO: 608801 - RNA, 23 nt, Escherichia coli CFT073
ugcuuaucgcccugcuccagcag

SEQ ID NO: 608802 - RNA, 21 nt, Escherichia coli CFT073
ugcuucagugagcugucuguc

SEQ ID NO: 608803 - RNA, 22 nt, Escherichia coli CFT073
ugcuucagcuugagguuggaga

SEQ ID NO: 608804 - RNA, 15 nt, Escherichia coli CFT073
ugcuucagauaccaa

SEQ ID NO: 608805 - RNA, 15 nt, Escherichia coli CFT073
ugcuugccagagcag

SEQ ID NO: 608806 - RNA, 15 nt, Escherichia coli CFT073
ugcuuuaaucagcac

SEQ ID NO: 608807 - RNA, 15 nt, Escherichia coli CFT073
ugcuuuaaguucagc

SEQ ID NO: 608808 - RNA, 18 nt, Escherichia coli CFT073
ugcuuuucccuuucagau

SEQ ID NO: 608809 - RNA, 17 nt, Escherichia coli CFT073
ugcuuuucauacaaucg

SEQ ID NO: 608810 - RNA, 12 nt, Escherichia coli CFT073
ugcuuuuauuca

SEQ ID NO: 608811 - RNA, 16 nt, Escherichia coli CFT073
ugcuuuggcuuucuga

SEQ ID NO: 608812 - RNA, 21 nt, Escherichia coli CFT073
ugcuuuuaaaugcccgacaaa

SEQ ID NO: 608813 - RNA, 14 nt, Escherichia coli CFT073
ugcugcuucauugc

SEQ ID NO: 608814 - RNA, 18 nt, Escherichia coli CFT073
ugcuggaaccacagcgcc

SEQ ID NO: 608815 - RNA, 16 nt, Escherichia coli CFT073
ugcugggauaauugcg

SEQ ID NO: 608816 - RNA, 15 nt, Escherichia coli CFT073
ugcuggcgggcuggu

SEQ ID NO: 608817 - RNA, 22 nt, Escherichia coli CFT073
ugcuggcugcgggaguugcucc

SEQ ID NO: 608818 - RNA, 15 nt, Escherichia coli CFT073
ugcuggcgcauuaac

SEQ ID NO: 608819 - RNA, 16 nt, Escherichia coli CFT073
ugcugccuuuuuuauu

SEQ ID NO: 608820 - RNA, 21 nt, Escherichia coli CFT073
ugcugcugauaaccgccgcca

SEQ ID NO: 608821 - RNA, 15 nt, Escherichia coli CFT073
ugcugcuggcaucac

SEQ ID NO: 608822 - RNA, 13 nt, Escherichia coli CFT073
ugcugccgcgcca

SEQ ID NO: 608823 - RNA, 21 nt, Escherichia coli CFT073
ugcuguaaacaacaugguccu

SEQ ID NO: 608824 - RNA, 15 nt, Escherichia coli CFT073
ugcuguaaagcacag

SEQ ID NO: 608825 - RNA, 11 nt, Escherichia coli CFT073
ugcugguuuug

SEQ ID NO: 608826 - RNA, 20 nt, Escherichia coli CFT073
ugcugggcaacuucagcuuc

SEQ ID NO: 608827 - RNA, 20 nt, Escherichia coli CFT073
ugcuguuguuccagcuucca

SEQ ID NO: 608828 - RNA, 23 nt, Escherichia coli CFT073
ugcuguuucgccaguuuuuucgc

SEQ ID NO: 608829 - RNA, 13 nt, Escherichia coli CFT073
ugcuguuccagca

SEQ ID NO: 608830 - RNA, 19 nt, Escherichia coli CFT073
ugcuguuccagcaucacau

SEQ ID NO: 608831 - RNA, 16 nt, Escherichia coli CFT073
ugcuguggcgucucga

SEQ ID NO: 608832 - RNA, 19 nt, Escherichia coli CFT073
ugcucauuacaguagcuau

SEQ ID NO: 608833 - RNA, 23 nt, Escherichia coli CFT073
ugcucauagaccauugcaucauc

SEQ ID NO: 608834 - RNA, 11 nt, Escherichia coli CFT073
ugcucaccaau

SEQ ID NO: 608835 - RNA, 22 nt, Escherichia coli CFT073
ugcucacagaguauuuccagcu

SEQ ID NO: 608836 - RNA, 15 nt, Escherichia coli CFT073
ugcucacaccaugcc

SEQ ID NO: 608837 - RNA, 22 nt, Escherichia coli CFT073
ugcguuguagcuuuuuccucag

SEQ ID NO: 608838 - RNA, 22 nt, Escherichia coli CFT073
ugcguugucaucgaauaaauug

SEQ ID NO: 608839 - RNA, 22 nt, Escherichia coli CFT073
ugcucaaucgaacgcagcaaca

SEQ ID NO: 608840 - RNA, 16 nt, Escherichia coli CFT073
ugcucguaaguuaacu

SEQ ID NO: 608841 - RNA, 20 nt, Escherichia coli CFT073
ugcucguaaagcaucagacu

SEQ ID NO: 608842 - RNA, 20 nt, Escherichia coli CFT073
ugcucgccacgucacucuuu

SEQ ID NO: 608843 - RNA, 23 nt, Escherichia coli CFT073
ugcuccgccgcagccgcauuuuu

SEQ ID NO: 608844 - RNA, 18 nt, Escherichia coli CFT073
ugcucgaagaguuccagc

SEQ ID NO: 608845 - RNA, 16 nt, Escherichia coli CFT073
ugcugaaacgcucgca

SEQ ID NO: 608846 - RNA, 15 nt, Escherichia coli CFT073
ugcugaaaaggcuaa

SEQ ID NO: 608847 - RNA, 20 nt, Escherichia coli CFT073
ugcucgucaaaaccgggcug

SEQ ID NO: 608848 - RNA, 20 nt, Escherichia coli CFT073
ugcugagcggcguacccucc

SEQ ID NO: 608849 - RNA, 19 nt, Escherichia coli CFT073
ugcugacucggcugcugcc

SEQ ID NO: 608850 - RNA, 12 nt, Escherichia coli CFT073
ugcugacugcgc

SEQ ID NO: 608851 - RNA, 19 nt, Escherichia coli CFT073
ugcugaacagcuuuuuccu

SEQ ID NO: 608852 - RNA, 12 nt, Escherichia coli CFT073
ugcugcaacagc

SEQ ID NO: 608853 - RNA, 15 nt, Escherichia coli CFT073
ugcugcaaugccauu

SEQ ID NO: 608854 - RNA, 17 nt, Escherichia coli CFT073
ugcugcaccccacaaac

SEQ ID NO: 608855 - RNA, 14 nt, Escherichia coli CFT073
ugcugccgagcgca

SEQ ID NO: 608856 - RNA, 15 nt, Escherichia coli CFT073
ugcugccgagcgcaa

SEQ ID NO: 608857 - RNA, 14 nt, Escherichia coli CFT073
ugcgcgguguugau

SEQ ID NO: 608858 - RNA, 16 nt, Escherichia coli CFT073
ugcgcgcuuucuccag

SEQ ID NO: 608859 - RNA, 19 nt, Escherichia coli CFT073
ugcgcggauggccucugcc

SEQ ID NO: 608860 - RNA, 15 nt, Escherichia coli CFT073
ugcgcgcgaaaacau

SEQ ID NO: 608861 - RNA, 19 nt, Escherichia coli CFT073
ugcgcgauaaucucaucag

SEQ ID NO: 608862 - RNA, 18 nt, Escherichia coli CFT073
ugcgcgcaaucagcaccg

SEQ ID NO: 608863 - RNA, 21 nt, Escherichia coli CFT073
ugcgcgacggcggucaaguaa

SEQ ID NO: 608864 - RNA, 17 nt, Escherichia coli CFT073
ugcgcgacguugcuucu

SEQ ID NO: 608865 - RNA, 16 nt, Escherichia coli CFT073
ugcgccgugcgaauaa

SEQ ID NO: 608866 - RNA, 21 nt, Escherichia coli CFT073
ugcgccguacaaguccugaau

SEQ ID NO: 608867 - RNA, 22 nt, Escherichia coli CFT073
ugcgccucaagaaucacuucau

SEQ ID NO: 608868 - RNA, 22 nt, Escherichia coli CFT073
ugcgccagaaaguuuuucaaca

SEQ ID NO: 608869 - RNA, 19 nt, Escherichia coli CFT073
ugcgccacuccacugcgca

SEQ ID NO: 608870 - RNA, 18 nt, Escherichia coli CFT073
ugcgccacgaaaacccuc

SEQ ID NO: 608871 - RNA, 12 nt, Escherichia coli CFT073
ugcgccagcucg

SEQ ID NO: 608872 - RNA, 17 nt, Escherichia coli CFT073
ugcgccagcgagaaaua

SEQ ID NO: 608873 - RNA, 16 nt, Escherichia coli CFT073
ugccuucgaagguaaa

SEQ ID NO: 608874 - RNA, 13 nt, Escherichia coli CFT073
ugccuucccuucu

SEQ ID NO: 608875 - RNA, 21 nt, Escherichia coli CFT073
ugcgccccuggucauaggcug

SEQ ID NO: 608876 - RNA, 16 nt, Escherichia coli CFT073
ugcgcccgguuauuuu

SEQ ID NO: 608877 - RNA, 22 nt, Escherichia coli CFT073
ugcgcccaguagugcgcagaac

SEQ ID NO: 608878 - RNA, 16 nt, Escherichia coli CFT073
ugcgccagcaaaucag

SEQ ID NO: 608879 - RNA, 17 nt, Escherichia coli CFT073
ugcgccaguucauccag

SEQ ID NO: 608880 - RNA, 21 nt, Escherichia coli CFT073
ugcgccauuuuuuugccugcu

SEQ ID NO: 608881 - RNA, 15 nt, Escherichia coli CFT073
ugcgccgccgcccau

SEQ ID NO: 608882 - RNA, 16 nt, Escherichia coli CFT073
ugcgccgcauucaggg

SEQ ID NO: 608883 - RNA, 15 nt, Escherichia coli CFT073
ugcgcccugggcuuc

SEQ ID NO: 608884 - RNA, 21 nt, Escherichia coli CFT073
ugcgcccugggcuucauccag

SEQ ID NO: 608885 - RNA, 18 nt, Escherichia coli CFT073
ugcgccgaacaacagugc

SEQ ID NO: 608886 - RNA, 14 nt, Escherichia coli CFT073
ugcggaaagagcau

SEQ ID NO: 608887 - RNA, 19 nt, Escherichia coli CFT073
ugcgcuacgaccgaucacc

SEQ ID NO: 608888 - RNA, 15 nt, Escherichia coli CFT073
ugcgcguggcaauug

SEQ ID NO: 608889 - RNA, 13 nt, Escherichia coli CFT073
ugcgcguuauuug

SEQ ID NO: 608890 - RNA, 20 nt, Escherichia coli CFT073
ugcggauuaauaaggaugca

SEQ ID NO: 608891 - RNA, 21 nt, Escherichia coli CFT073
ugcggauccccugaaauauug

SEQ ID NO: 608892 - RNA, 17 nt, Escherichia coli CFT073
ugcggaucggcuggcgg

SEQ ID NO: 608893 - RNA, 22 nt, Escherichia coli CFT073
ugcggacagucacguagcggcg

SEQ ID NO: 608894 - RNA, 15 nt, Escherichia coli CFT073
ugcggauaggacaag

SEQ ID NO: 608895 - RNA, 14 nt, Escherichia coli CFT073
ugcggauaaacaua

SEQ ID NO: 608896 - RNA, 17 nt, Escherichia coli CFT073
ugcggcaucuucuccac

SEQ ID NO: 608897 - RNA, 15 nt, Escherichia coli CFT073
ugcggcauucccagc

SEQ ID NO: 608898 - RNA, 22 nt, Escherichia coli CFT073
ugcggccaaaaaggggaaaaau

SEQ ID NO: 608899 - RNA, 14 nt, Escherichia coli CFT073
ugcggccagcagcu

SEQ ID NO: 608900 - RNA, 23 nt, Escherichia coli CFT073
ugcggccuccaacaacccugcau

SEQ ID NO: 608901 - RNA, 22 nt, Escherichia coli CFT073
ugcggcgaaaacgccucauccg

SEQ ID NO: 608902 - RNA, 21 nt, Escherichia coli CFT073
ugcggcgagaacgccuuaucc

SEQ ID NO: 608903 - RNA, 14 nt, Escherichia coli CFT073
ugcggcgaggaauc

SEQ ID NO: 608904 - RNA, 17 nt, Escherichia coli CFT073
ugcgucuuccacuucau

SEQ ID NO: 608905 - RNA, 15 nt, Escherichia coli CFT073
ugcgucuuccgugcc

SEQ ID NO: 608906 - RNA, 17 nt, Escherichia coli CFT073
ugcgugacgccugcucc

SEQ ID NO: 608907 - RNA, 21 nt, Escherichia coli CFT073
ugcgugauauuacauaccagc

SEQ ID NO: 608908 - RNA, 16 nt, Escherichia coli CFT073
ugcgugaguuuuuguc

SEQ ID NO: 608909 - RNA, 12 nt, Escherichia coli CFT073
ugcguucugucg

SEQ ID NO: 608910 - RNA, 22 nt, Escherichia coli CFT073
ugcguugcagcaaauaaaacug

SEQ ID NO: 608911 - RNA, 16 nt, Escherichia coli CFT073
ugcgguggauuuaaug

SEQ ID NO: 608912 - RNA, 16 nt, Escherichia coli CFT073
ugcgguguaaaccagc

SEQ ID NO: 608913 - RNA, 16 nt, Escherichia coli CFT073
ugcgguuugucaucau

SEQ ID NO: 608914 - RNA, 16 nt, Escherichia coli CFT073
ugcguaaagccugcug

SEQ ID NO: 608915 - RNA, 16 nt, Escherichia coli CFT073
ugcguaaucgccgaac

SEQ ID NO: 608916 - RNA, 15 nt, Escherichia coli CFT073
ugcguaaucuuuuca

SEQ ID NO: 608917 - RNA, 21 nt, Escherichia coli CFT073
ugcgggcguggccccaggcau

SEQ ID NO: 608918 - RNA, 19 nt, Escherichia coli CFT073
ugcgggcgaucauauccag

SEQ ID NO: 608919 - RNA, 21 nt, Escherichia coli CFT073
ugcggcgcgagcgccuuaucc

SEQ ID NO: 608920 - RNA, 18 nt, Escherichia coli CFT073
ugcggcgcaccagcaggc

SEQ ID NO: 608921 - RNA, 18 nt, Escherichia coli CFT073
ugcggggagaaugccagc

SEQ ID NO: 608922 - RNA, 17 nt, Escherichia coli CFT073
ugcgggcugggaucuga

SEQ ID NO: 608923 - RNA, 17 nt, Escherichia coli CFT073
ugcggucagcgcagcaa

SEQ ID NO: 608924 - RNA, 15 nt, Escherichia coli CFT073
ugcggugcagcagcu

SEQ ID NO: 608925 - RNA, 19 nt, Escherichia coli CFT073
ugcggugccauuaaaccaa

SEQ ID NO: 608926 - RNA, 14 nt, Escherichia coli CFT073
ugccgcgucuuauc

SEQ ID NO: 608927 - RNA, 16 nt, Escherichia coli CFT073
ugccgcuacugcuugc

SEQ ID NO: 608928 - RNA, 14 nt, Escherichia coli CFT073
ugccgcuacaucac

SEQ ID NO: 608929 - RNA, 22 nt, Escherichia coli CFT073
ugccgcuguucugauuuugaau

SEQ ID NO: 608930 - RNA, 22 nt, Escherichia coli CFT073
ugccgcuggcaucgagcauaaa

SEQ ID NO: 608931 - RNA, 18 nt, Escherichia coli CFT073
ugccgcuccagauauugc

SEQ ID NO: 608932 - RNA, 13 nt, Escherichia coli CFT073
ugccgcucccggc

SEQ ID NO: 608933 - RNA, 15 nt, Escherichia coli CFT073
ugccgcucccggcau

SEQ ID NO: 608934 - RNA, 19 nt, Escherichia coli CFT073
ugccgcucccggcauaaca

SEQ ID NO: 608935 - RNA, 14 nt, Escherichia coli CFT073
ugccgcgccccauc

SEQ ID NO: 608936 - RNA, 23 nt, Escherichia coli CFT073
ugccgcggcgcggcggguuaacc

SEQ ID NO: 608937 - RNA, 18 nt, Escherichia coli CFT073
ugccgcgccugcgccauc

SEQ ID NO: 608938 - RNA, 17 nt, Escherichia coli CFT073
ugccggaacgccgcugg

SEQ ID NO: 608939 - RNA, 18 nt, Escherichia coli CFT073
ugccggaagacacauugu

SEQ ID NO: 608940 - RNA, 15 nt, Escherichia coli CFT073
ugccggaagcagcaa

SEQ ID NO: 608941 - RNA, 13 nt, Escherichia coli CFT073
ugccggaauaauc

SEQ ID NO: 608942 - RNA, 23 nt, Escherichia coli CFT073
ugccggaauuaauaauccggcau

SEQ ID NO: 608943 - RNA, 16 nt, Escherichia coli CFT073
ugccggccagcgccac

SEQ ID NO: 608944 - RNA, 21 nt, Escherichia coli CFT073
ugccggggagauauuccccag

SEQ ID NO: 608945 - RNA, 16 nt, Escherichia coli CFT073
ugccugcugugccagc

SEQ ID NO: 608946 - RNA, 20 nt, Escherichia coli CFT073
ugccugcugugccagcucca

SEQ ID NO: 608947 - RNA, 23 nt, Escherichia coli CFT073
ugccugcgugcauaucgcuguug

SEQ ID NO: 608948 - RNA, 22 nt, Escherichia coli CFT073
ugccuacacaaugccugaugcg

SEQ ID NO: 608949 - RNA, 21 nt, Escherichia coli CFT073
ugccuacagagcugauuuccg

SEQ ID NO: 608950 - RNA, 21 nt, Escherichia coli CFT073
ugccuaaagugcugggcuggg

SEQ ID NO: 608951 - RNA, 21 nt, Escherichia coli CFT073
ugccucuccccagcggaaaau

SEQ ID NO: 608952 - RNA, 21 nt, Escherichia coli CFT073
ugccucgucccuuugccugcc

SEQ ID NO: 608953 - RNA, 17 nt, Escherichia coli CFT073
ugccucguuggucagcu

SEQ ID NO: 608954 - RNA, 13 nt, Escherichia coli CFT073
ugccucccauuca

SEQ ID NO: 608955 - RNA, 19 nt, Escherichia coli CFT073
ugccguuauacaucgcuuu

SEQ ID NO: 608956 - RNA, 22 nt, Escherichia coli CFT073
ugccguuggcggcgugacgcca

SEQ ID NO: 608957 - RNA, 19 nt, Escherichia coli CFT073
ugccguugugcugauguca

SEQ ID NO: 608958 - RNA, 21 nt, Escherichia coli CFT073
ugccguuuguaggccugauaa

SEQ ID NO: 608959 - RNA, 19 nt, Escherichia coli CFT073
ugccguuccuggcaccauc

SEQ ID NO: 608960 - RNA, 24 nt, Escherichia coli CFT073
ugccgggugcgaugcauccggcac

SEQ ID NO: 608961 - RNA, 21 nt, Escherichia coli CFT073
ugccggguuuaagcccggcau

SEQ ID NO: 608962 - RNA, 16 nt, Escherichia coli CFT073
ugccgguaaagcaaug

SEQ ID NO: 608963 - RNA, 13 nt, Escherichia coli CFT073
ugccgguuauuuu

SEQ ID NO: 608964 - RNA, 16 nt, Escherichia coli CFT073
ugccggugggaugaag

SEQ ID NO: 608965 - RNA, 15 nt, Escherichia coli CFT073
ugccguaaccagcgc

SEQ ID NO: 608966 - RNA, 14 nt, Escherichia coli CFT073
ugccguacaggcag

SEQ ID NO: 608967 - RNA, 16 nt, Escherichia coli CFT073
ugccgcccguuuucuc

SEQ ID NO: 608968 - RNA, 20 nt, Escherichia coli CFT073
ugccgcauggaaccaguuca

SEQ ID NO: 608969 - RNA, 12 nt, Escherichia coli CFT073
ugccgcaggcaa

SEQ ID NO: 608970 - RNA, 13 nt, Escherichia coli CFT073
ugccgccucugcc

SEQ ID NO: 608971 - RNA, 16 nt, Escherichia coli CFT073
ugccgccucugccgca

SEQ ID NO: 608972 - RNA, 18 nt, Escherichia coli CFT073
ugccgcacuuaaaaugcg

SEQ ID NO: 608973 - RNA, 16 nt, Escherichia coli CFT073
ugccgaucucuuuauu

SEQ ID NO: 608974 - RNA, 23 nt, Escherichia coli CFT073
ugcccuggaucguggcugaguga

SEQ ID NO: 608975 - RNA, 19 nt, Escherichia coli CFT073
ugcccugacgcucaucacg

SEQ ID NO: 608976 - RNA, 16 nt, Escherichia coli CFT073
ugcccugaucacccac

SEQ ID NO: 608977 - RNA, 22 nt, Escherichia coli CFT073
ugcccugccaucacuauucaga

SEQ ID NO: 608978 - RNA, 16 nt, Escherichia coli CFT073
ugccauuugaugaauu

SEQ ID NO: 608979 - RNA, 14 nt, Escherichia coli CFT073
ugccccauauggcc

SEQ ID NO: 608980 - RNA, 21 nt, Escherichia coli CFT073
ugccauuccacaaaaaccacu

SEQ ID NO: 608981 - RNA, 16 nt, Escherichia coli CFT073
ugccauuucauaaauu

SEQ ID NO: 608982 - RNA, 16 nt, Escherichia coli CFT073
ugccauucacuucaua

SEQ ID NO: 608983 - RNA, 13 nt, Escherichia coli CFT073
ugccauucaguuu

SEQ ID NO: 608984 - RNA, 16 nt, Escherichia coli CFT073
ugccauucaguuugca

SEQ ID NO: 608985 - RNA, 17 nt, Escherichia coli CFT073
ugccauuaaaccaacaa

SEQ ID NO: 608986 - RNA, 21 nt, Escherichia coli CFT073
ugccauuacuacaaacaaugc

SEQ ID NO: 608987 - RNA, 22 nt, Escherichia coli CFT073
ugccaugguuuggaucuguugc

SEQ ID NO: 608988 - RNA, 16 nt, Escherichia coli CFT073
ugccauuaacaucccu

SEQ ID NO: 608989 - RNA, 17 nt, Escherichia coli CFT073
ugccauuaacuccacca

SEQ ID NO: 608990 - RNA, 13 nt, Escherichia coli CFT073
ugcccgucugcug

SEQ ID NO: 608991 - RNA, 16 nt, Escherichia coli CFT073
ugcccguuauucccac

SEQ ID NO: 608992 - RNA, 22 nt, Escherichia coli CFT073
ugcccggaucucuccgggcaug

SEQ ID NO: 608993 - RNA, 16 nt, Escherichia coli CFT073
ugcccgaccacuucau

SEQ ID NO: 608994 - RNA, 19 nt, Escherichia coli CFT073
ugcauugcuucccauguca

SEQ ID NO: 608995 - RNA, 18 nt, Escherichia coli CFT073
ugcauugauggaguaguu

SEQ ID NO: 608996 - RNA, 15 nt, Escherichia coli CFT073
ugcauuucauugagc

SEQ ID NO: 608997 - RNA, 22 nt, Escherichia coli CFT073
ugcauuguguaauuaauuugcu

SEQ ID NO: 608998 - RNA, 13 nt, Escherichia coli CFT073
ugcauuuuucgcu

SEQ ID NO: 608999 - RNA, 15 nt, Escherichia coli CFT073
ugcauuucuggaaug

SEQ ID NO: 609000 - RNA, 12 nt, Escherichia coli CFT073
ugccaaaaugca

SEQ ID NO: 609001 - RNA, 21 nt, Escherichia coli CFT073
ugccaaaccagcuaauaaaac

SEQ ID NO: 609002 - RNA, 16 nt, Escherichia coli CFT073
ugccaaagaaugcagu

SEQ ID NO: 609003 - RNA, 14 nt, Escherichia coli CFT073
ugccaaagucauca

SEQ ID NO: 609004 - RNA, 18 nt, Escherichia coli CFT073
ugccaaacgcguccauca

SEQ ID NO: 609005 - RNA, 21 nt, Escherichia coli CFT073
ugccaauguugauaaucaccg

SEQ ID NO: 609006 - RNA, 23 nt, Escherichia coli CFT073
ugccaauguugauaaucaccgaa

SEQ ID NO: 609007 - RNA, 22 nt, Escherichia coli CFT073
ugccacaaucgggaaaaucugc

SEQ ID NO: 609008 - RNA, 16 nt, Escherichia coli CFT073
ugccacacaggccauu

SEQ ID NO: 609009 - RNA, 14 nt, Escherichia coli CFT073
ugccaaauauuucu

SEQ ID NO: 609010 - RNA, 20 nt, Escherichia coli CFT073
ugccaaauauuucuuuauca

SEQ ID NO: 609011 - RNA, 19 nt, Escherichia coli CFT073
ugccaaauccggcaaauaa

SEQ ID NO: 609012 - RNA, 17 nt, Escherichia coli CFT073
ugccaaauccuucacuc

SEQ ID NO: 609013 - RNA, 15 nt, Escherichia coli CFT073
ugccacacgacgcca

SEQ ID NO: 609014 - RNA, 22 nt, Escherichia coli CFT073
ugccacgguaugacccagcgcg

SEQ ID NO: 609015 - RNA, 15 nt, Escherichia coli CFT073
ugccaccugugcaau

SEQ ID NO: 609016 - RNA, 21 nt, Escherichia coli CFT073
ugccagauaaauauuauuggc

SEQ ID NO: 609017 - RNA, 15 nt, Escherichia coli CFT073
ugccagagcacugca

SEQ ID NO: 609018 - RNA, 20 nt, Escherichia coli CFT073
ugccagauucuccagcaucg

SEQ ID NO: 609019 - RNA, 20 nt, Escherichia coli CFT073
ugccagauuuaacggcagca

SEQ ID NO: 609020 - RNA, 18 nt, Escherichia coli CFT073
ugccagccccucagcggu

SEQ ID NO: 609021 - RNA, 14 nt, Escherichia coli CFT073
ugccagauucucca

SEQ ID NO: 609022 - RNA, 23 nt, Escherichia coli CFT073
ugccagaauuaacgcugacaccc

SEQ ID NO: 609023 - RNA, 15 nt, Escherichia coli CFT073
ugccagacaaaccac

SEQ ID NO: 609024 - RNA, 23 nt, Escherichia coli CFT073
ugccaggcuggcagaugcgucuu

SEQ ID NO: 609025 - RNA, 15 nt, Escherichia coli CFT073
ugccagguagcguuu

SEQ ID NO: 609026 - RNA, 20 nt, Escherichia coli CFT073
ugccagguagcguuucaccu

SEQ ID NO: 609027 - RNA, 22 nt, Escherichia coli CFT073
ugccagccuucgggcuggcauu

SEQ ID NO: 609028 - RNA, 21 nt, Escherichia coli CFT073
ugccagcgacugugaaguauu

SEQ ID NO: 609029 - RNA, 14 nt, Escherichia coli CFT073
ugccagcgccccug

SEQ ID NO: 609030 - RNA, 16 nt, Escherichia coli CFT073
ugccaugcugagcuuc

SEQ ID NO: 609031 - RNA, 20 nt, Escherichia coli CFT073
ugccaucucggauaaggcuu

SEQ ID NO: 609032 - RNA, 14 nt, Escherichia coli CFT073
ugccaucucugcaa

SEQ ID NO: 609033 - RNA, 13 nt, Escherichia coli CFT073
ugccaugcauauc

SEQ ID NO: 609034 - RNA, 15 nt, Escherichia coli CFT073
ugccaugccaaacag

SEQ ID NO: 609035 - RNA, 17 nt, Escherichia coli CFT073
ugccaucgccacaccag

SEQ ID NO: 609036 - RNA, 16 nt, Escherichia coli CFT073
ugccaucgccagcagc

SEQ ID NO: 609037 - RNA, 14 nt, Escherichia coli CFT073
ugccaucucacuuu

SEQ ID NO: 609038 - RNA, 16 nt, Escherichia coli CFT073
ugccaucucacuuuga

SEQ ID NO: 609039 - RNA, 18 nt, Escherichia coli CFT073
ugccaucucacuuugaga

SEQ ID NO: 609040 - RNA, 19 nt, Escherichia coli CFT073
ugccaucugaacucacaca

SEQ ID NO: 609041 - RNA, 14 nt, Escherichia coli CFT073
ugccauccagcuuu

SEQ ID NO: 609042 - RNA, 22 nt, Escherichia coli CFT073
ugccauccggcucgcaucaauu

SEQ ID NO: 609043 - RNA, 19 nt, Escherichia coli CFT073
ugccaucgacgaaauggug

SEQ ID NO: 609044 - RNA, 15 nt, Escherichia coli CFT073
ugccaguaaagcagc

SEQ ID NO: 609045 - RNA, 21 nt, Escherichia coli CFT073
ugccaguaaugcgcaggguaa

SEQ ID NO: 609046 - RNA, 20 nt, Escherichia coli CFT073
ugccaguaauuccacaccaa

SEQ ID NO: 609047 - RNA, 13 nt, Escherichia coli CFT073
ugccaucaccaac

SEQ ID NO: 609048 - RNA, 20 nt, Escherichia coli CFT073
ugcauuacuggcuguauaua

SEQ ID NO: 609049 - RNA, 22 nt, Escherichia coli CFT073
ugcauuagcauagcgguaaaug

SEQ ID NO: 609050 - RNA, 19 nt, Escherichia coli CFT073
ugcaugggcaaauuguuca

SEQ ID NO: 609051 - RNA, 20 nt, Escherichia coli CFT073
ugcauguaaaucaagcgccg

SEQ ID NO: 609052 - RNA, 16 nt, Escherichia coli CFT073
ugcauguaaaucaagc

SEQ ID NO: 609053 - RNA, 16 nt, Escherichia coli CFT073
ugcauggcaacuuuaa

SEQ ID NO: 609054 - RNA, 22 nt, Escherichia coli CFT073
ugcauggcaacuuuaauaaucu

SEQ ID NO: 609055 - RNA, 18 nt, Escherichia coli CFT073
ugcaucgccaugaugagc

SEQ ID NO: 609056 - RNA, 18 nt, Escherichia coli CFT073
ugcaucgcgaccaaucac

SEQ ID NO: 609057 - RNA, 14 nt, Escherichia coli CFT073
ugcaucgccugauu

SEQ ID NO: 609058 - RNA, 21 nt, Escherichia coli CFT073
ugcaucgccugauucaaugag

SEQ ID NO: 609059 - RNA, 19 nt, Escherichia coli CFT073
ugcaucggggaauugugcu

SEQ ID NO: 609060 - RNA, 17 nt, Escherichia coli CFT073
ugcaucuucacacugau

SEQ ID NO: 609061 - RNA, 14 nt, Escherichia coli CFT073
ugcaucucuucaaa

SEQ ID NO: 609062 - RNA, 15 nt, Escherichia coli CFT073
ugcaucucuucaaau

SEQ ID NO: 609063 - RNA, 15 nt, Escherichia coli CFT073
ugcaucuccugacac

SEQ ID NO: 609064 - RNA, 21 nt, Escherichia coli CFT073
ugcauccaacuucguuacuua

SEQ ID NO: 609065 - RNA, 19 nt, Escherichia coli CFT073
ugcauccacuuugguuaca

SEQ ID NO: 609066 - RNA, 22 nt, Escherichia coli CFT073
ugcaucaggcaaacuucacgca

SEQ ID NO: 609067 - RNA, 13 nt, Escherichia coli CFT073
ugcauccagugcc

SEQ ID NO: 609068 - RNA, 16 nt, Escherichia coli CFT073
ugcauccaguugcgcc

SEQ ID NO: 609069 - RNA, 21 nt, Escherichia coli CFT073
ugcaucgagcgcagcaacauc

SEQ ID NO: 609070 - RNA, 17 nt, Escherichia coli CFT073
ugcacucgccaguugac

SEQ ID NO: 609071 - RNA, 16 nt, Escherichia coli CFT073
ugcacuaccguaaaua

SEQ ID NO: 609072 - RNA, 19 nt, Escherichia coli CFT073
ugcauaaccaacaucuuua

SEQ ID NO: 609073 - RNA, 18 nt, Escherichia coli CFT073
ugcauaaaggcaaaacag

SEQ ID NO: 609074 - RNA, 21 nt, Escherichia coli CFT073
ugcauaaaccgggucagcccc

SEQ ID NO: 609075 - RNA, 14 nt, Escherichia coli CFT073
ugcauaauccugcc

SEQ ID NO: 609076 - RNA, 16 nt, Escherichia coli CFT073
ugcauacaguacgugu

SEQ ID NO: 609077 - RNA, 16 nt, Escherichia coli CFT073
ugcauaaugguggagu

SEQ ID NO: 609078 - RNA, 17 nt, Escherichia coli CFT073
ugcauaaugguggagug

SEQ ID NO: 609079 - RNA, 16 nt, Escherichia coli CFT073
ugcauaccauucacga

SEQ ID NO: 609080 - RNA, 14 nt, Escherichia coli CFT073
ugcauaggccaucg

SEQ ID NO: 609081 - RNA, 17 nt, Escherichia coli CFT073
ugcaucaacaucauuaa

SEQ ID NO: 609082 - RNA, 18 nt, Escherichia coli CFT073
ugcaucaaguugauuuuu

SEQ ID NO: 609083 - RNA, 12 nt, Escherichia coli CFT073
ugcaucacgagc

SEQ ID NO: 609084 - RNA, 17 nt, Escherichia coli CFT073
ugcaucacugacaucac

SEQ ID NO: 609085 - RNA, 22 nt, Escherichia coli CFT073
ugcauaucucccaguaagccua

SEQ ID NO: 609086 - RNA, 12 nt, Escherichia coli CFT073
uuauugccuguu

SEQ ID NO: 609087 - RNA, 22 nt, Escherichia coli CFT073
uuauugauuguuuuaaauauug

SEQ ID NO: 609088 - RNA, 17 nt, Escherichia coli CFT073
uuauuguuuagcguuau

SEQ ID NO: 609089 - RNA, 23 nt, Escherichia coli CFT073
uuauuuccggcaauuguuagcca

SEQ ID NO: 609090 - RNA, 12 nt, Escherichia coli CFT073
uuauuugcuauc

SEQ ID NO: 609091 - RNA, 14 nt, Escherichia coli CFT073
uuauuucucacuuu

SEQ ID NO: 609092 - RNA, 14 nt, Escherichia coli CFT073
uuauuugacauuuu

SEQ ID NO: 609093 - RNA, 23 nt, Escherichia coli CFT073
uuauuuuaccauauaaacauauc

SEQ ID NO: 609094 - RNA, 16 nt, Escherichia coli CFT073
uuauucacauagauaa

SEQ ID NO: 609095 - RNA, 18 nt, Escherichia coli CFT073
uuauucaccaccaucaaa

SEQ ID NO: 609096 - RNA, 13 nt, Escherichia coli CFT073
uuauucagaaaac

SEQ ID NO: 609097 - RNA, 20 nt, Escherichia coli CFT073
uuauucagaguauauauucg

SEQ ID NO: 609098 - RNA, 15 nt, Escherichia coli CFT073
uuauucagcagacca

SEQ ID NO: 609099 - RNA, 23 nt, Escherichia coli CFT073
uuauucccgcgcuaccacuuccc

SEQ ID NO: 609100 - RNA, 12 nt, Escherichia coli CFT073
uuauugauaacc

SEQ ID NO: 609101 - RNA, 22 nt, Escherichia coli CFT073
uuauucuuuuuugauuccagua

SEQ ID NO: 609102 - RNA, 23 nt, Escherichia coli CFT073
uuauucuuuuuugauuccaguaa

SEQ ID NO: 609103 - RNA, 17 nt, Escherichia coli CFT073
uuauuaaagguauuauu

SEQ ID NO: 609104 - RNA, 18 nt, Escherichia coli CFT073
uuauuacugcgaauuucc

SEQ ID NO: 609105 - RNA, 18 nt, Escherichia coli CFT073
uuauuauaaguucaagua

SEQ ID NO: 609106 - RNA, 14 nt, Escherichia coli CFT073
uuauuuuucuaucu

SEQ ID NO: 609107 - RNA, 11 nt, Escherichia coli CFT073
uucaaaaacag

SEQ ID NO: 609108 - RNA, 16 nt, Escherichia coli CFT073
uucaaacggcguuuuu

SEQ ID NO: 609109 - RNA, 12 nt, Escherichia coli CFT073
uucaaagcgauu

SEQ ID NO: 609110 - RNA, 23 nt, Escherichia coli CFT073
uucaaaugugggagcuauuuacc

SEQ ID NO: 609111 - RNA, 16 nt, Escherichia coli CFT073
uucaacauuuccagcg

SEQ ID NO: 609112 - RNA, 16 nt, Escherichia coli CFT073
uucaacaguaaacucg

SEQ ID NO: 609113 - RNA, 18 nt, Escherichia coli CFT073
uucaacacacugaauaaa

SEQ ID NO: 609114 - RNA, 22 nt, Escherichia coli CFT073
uucaaauugcucgaagacauau

SEQ ID NO: 609115 - RNA, 19 nt, Escherichia coli CFT073
uucaacaauugaagaauau

SEQ ID NO: 609116 - RNA, 13 nt, Escherichia coli CFT073
uucaacagauuuc

SEQ ID NO: 609117 - RNA, 17 nt, Escherichia coli CFT073
uucaacagcgugaacug

SEQ ID NO: 609118 - RNA, 12 nt, Escherichia coli CFT073
uucaaccucaaa

SEQ ID NO: 609119 - RNA, 20 nt, Escherichia coli CFT073
uucaacuuaagucuccauuu

SEQ ID NO: 609120 - RNA, 13 nt, Escherichia coli CFT073
uuaucaacaauaa

SEQ ID NO: 609121 - RNA, 18 nt, Escherichia coli CFT073
uuaucaggccuacaaucc

SEQ ID NO: 609122 - RNA, 21 nt, Escherichia coli CFT073
uuaucaggccuacauuggugc

SEQ ID NO: 609123 - RNA, 20 nt, Escherichia coli CFT073
uuaucaggccuacgacuuuc

SEQ ID NO: 609124 - RNA, 15 nt, Escherichia coli CFT073
uuaucaggccugcaa

SEQ ID NO: 609125 - RNA, 18 nt, Escherichia coli CFT073
uuaucaggccugcaaaau

SEQ ID NO: 609126 - RNA, 15 nt, Escherichia coli CFT073
uuaucaagcaccaac

SEQ ID NO: 609127 - RNA, 21 nt, Escherichia coli CFT073
uuaucaauuaacugugccagc

SEQ ID NO: 609128 - RNA, 12 nt, Escherichia coli CFT073
uuaucaauuccu

SEQ ID NO: 609129 - RNA, 19 nt, Escherichia coli CFT073
uuaucaauuccuauuuugu

SEQ ID NO: 609130 - RNA, 17 nt, Escherichia coli CFT073
uuauccagccuacagaa

SEQ ID NO: 609131 - RNA, 22 nt, Escherichia coli CFT073
uuauccauauuuuuugaaaaau

SEQ ID NO: 609132 - RNA, 23 nt, Escherichia coli CFT073
uuauccgccagcgccaaagccag

SEQ ID NO: 609133 - RNA, 17 nt, Escherichia coli CFT073
uuauccgguaaugccau

SEQ ID NO: 609134 - RNA, 21 nt, Escherichia coli CFT073
uuauccggccuacauuagucc

SEQ ID NO: 609135 - RNA, 21 nt, Escherichia coli CFT073
uuaucccccgauaaaacauua

SEQ ID NO: 609136 - RNA, 22 nt, Escherichia coli CFT073
uuaucccccgauaaaacauuac

SEQ ID NO: 609137 - RNA, 21 nt, Escherichia coli CFT073
uuaucccgauuaaucagugca

SEQ ID NO: 609138 - RNA, 18 nt, Escherichia coli CFT073
uuaucccggcaaaaaaca

SEQ ID NO: 609139 - RNA, 21 nt, Escherichia coli CFT073
uuauccgaguagcucaccagc

SEQ ID NO: 609140 - RNA, 16 nt, Escherichia coli CFT073
uuauaaguucaaguaa

SEQ ID NO: 609141 - RNA, 19 nt, Escherichia coli CFT073
uuauaaguucaaguaaaac

SEQ ID NO: 609142 - RNA, 15 nt, Escherichia coli CFT073
uuauaauaaauauua

SEQ ID NO: 609143 - RNA, 17 nt, Escherichia coli CFT073
uuauaauaaauauuauu

SEQ ID NO: 609144 - RNA, 21 nt, Escherichia coli CFT073
uuauaauaaauauuauuguuu

SEQ ID NO: 609145 - RNA, 17 nt, Escherichia coli CFT073
uuauaaucaucuguauc

SEQ ID NO: 609146 - RNA, 17 nt, Escherichia coli CFT073
uuauagagcugaauaag

SEQ ID NO: 609147 - RNA, 15 nt, Escherichia coli CFT073
uuauacaucgcuuuc

SEQ ID NO: 609148 - RNA, 16 nt, Escherichia coli CFT073
uuauagcgauuuuuca

SEQ ID NO: 609149 - RNA, 16 nt, Escherichia coli CFT073
uuauagcgcaugacau

SEQ ID NO: 609150 - RNA, 17 nt, Escherichia coli CFT073
uuauagcucaacgcugc

SEQ ID NO: 609151 - RNA, 15 nt, Escherichia coli CFT073
uuauagcugauauca

SEQ ID NO: 609152 - RNA, 12 nt, Escherichia coli CFT073
uuagaauuauua

SEQ ID NO: 609153 - RNA, 14 nt, Escherichia coli CFT073
uuagagcacagaua

SEQ ID NO: 609154 - RNA, 17 nt, Escherichia coli CFT073
uuauaaaguaaaacccc

SEQ ID NO: 609155 - RNA, 12 nt, Escherichia coli CFT073
uuauaagccaua

SEQ ID NO: 609156 - RNA, 12 nt, Escherichia coli CFT073
uuaucuuucagc

SEQ ID NO: 609157 - RNA, 21 nt, Escherichia coli CFT073
uuaugaauauucuguucaugc

SEQ ID NO: 609158 - RNA, 21 nt, Escherichia coli CFT073
uuaugaugcacuucagggcgc

SEQ ID NO: 609159 - RNA, 23 nt, Escherichia coli CFT073
uuaugcaauagcgccugcugcug

SEQ ID NO: 609160 - RNA, 18 nt, Escherichia coli CFT073
uuaugcccucagccuucu

SEQ ID NO: 609161 - RNA, 23 nt, Escherichia coli CFT073
uuaugccgaucaucauccagcac

SEQ ID NO: 609162 - RNA, 21 nt, Escherichia coli CFT073
uuaugcacaccccgcgccgcu

SEQ ID NO: 609163 - RNA, 22 nt, Escherichia coli CFT073
uuaugcacacgcggagccaguu

SEQ ID NO: 609164 - RNA, 20 nt, Escherichia coli CFT073
uuaugcaccgacaauccagu

SEQ ID NO: 609165 - RNA, 13 nt, Escherichia coli CFT073
uuauggagaaaac

SEQ ID NO: 609166 - RNA, 17 nt, Escherichia coli CFT073
uuaugcgucaacgccgc

SEQ ID NO: 609167 - RNA, 15 nt, Escherichia coli CFT073
uuaugucauugaaug

SEQ ID NO: 609168 - RNA, 15 nt, Escherichia coli CFT073
uuaugucgcauccug

SEQ ID NO: 609169 - RNA, 16 nt, Escherichia coli CFT073
uuauguaauaaaccug

SEQ ID NO: 609170 - RNA, 18 nt, Escherichia coli CFT073
uuauuaaaccaggaacag

SEQ ID NO: 609171 - RNA, 21 nt, Escherichia coli CFT073
uuaucuggcuaaaacugauaa

SEQ ID NO: 609172 - RNA, 17 nt, Escherichia coli CFT073
uuaucugccagccaguc

SEQ ID NO: 609173 - RNA, 18 nt, Escherichia coli CFT073
uuaucuucaccaaaugcc

SEQ ID NO: 609174 - RNA, 17 nt, Escherichia coli CFT073
uuaucuucgcacuuacc

SEQ ID NO: 609175 - RNA, 15 nt, Escherichia coli CFT073
uuaucuacuacccag

SEQ ID NO: 609176 - RNA, 20 nt, Escherichia coli CFT073
uuaucuauauuuauucauca

SEQ ID NO: 609177 - RNA, 21 nt, Escherichia coli CFT073
uuaucggguccgggcaucaac

SEQ ID NO: 609178 - RNA, 13 nt, Escherichia coli CFT073
uuaucgccaucca

SEQ ID NO: 609179 - RNA, 16 nt, Escherichia coli CFT073
uuaucgcgccaucaaa

SEQ ID NO: 609180 - RNA, 12 nt, Escherichia coli CFT073
uuaucgcuauca

SEQ ID NO: 609181 - RNA, 16 nt, Escherichia coli CFT073
uuaucgcuauccaguu

SEQ ID NO: 609182 - RNA, 17 nt, Escherichia coli CFT073
uuaucggaaaagaguac

SEQ ID NO: 609183 - RNA, 23 nt, Escherichia coli CFT073
uuaucggauaggccauaaucaaa

SEQ ID NO: 609184 - RNA, 20 nt, Escherichia coli CFT073
uuauccguucuggacuuccc

SEQ ID NO: 609185 - RNA, 22 nt, Escherichia coli CFT073
uuauccguucuggacuuccccu

SEQ ID NO: 609186 - RNA, 15 nt, Escherichia coli CFT073
uuauccugcaaauaa

SEQ ID NO: 609187 - RNA, 14 nt, Escherichia coli CFT073
uuauccucuucaag

SEQ ID NO: 609188 - RNA, 19 nt, Escherichia coli CFT073
uuaucgaucacauccagua

SEQ ID NO: 609189 - RNA, 11 nt, Escherichia coli CFT073
uuaucgagcug

SEQ ID NO: 609190 - RNA, 19 nt, Escherichia coli CFT073
uuaucgauuuucaaaauau

SEQ ID NO: 609191 - RNA, 16 nt, Escherichia coli CFT073
uuaauaaaauuaucca

SEQ ID NO: 609192 - RNA, 21 nt, Escherichia coli CFT073
uuaagcuaacgcguuaucaga

SEQ ID NO: 609193 - RNA, 18 nt, Escherichia coli CFT073
uuaagccugcaucacgag

SEQ ID NO: 609194 - RNA, 22 nt, Escherichia coli CFT073
uuaaguucauuuuuagugauca

SEQ ID NO: 609195 - RNA, 13 nt, Escherichia coli CFT073
uuaauaaaucacg

SEQ ID NO: 609196 - RNA, 20 nt, Escherichia coli CFT073
uuaagaaaacggaagcucag

SEQ ID NO: 609197 - RNA, 16 nt, Escherichia coli CFT073
uuaagaugaagaaaau

SEQ ID NO: 609198 - RNA, 13 nt, Escherichia coli CFT073
uuaagaucgugca

SEQ ID NO: 609199 - RNA, 18 nt, Escherichia coli CFT073
uuaagccaguucucacca

SEQ ID NO: 609200 - RNA, 22 nt, Escherichia coli CFT073
uuaaccucaggaaauugcacca

SEQ ID NO: 609201 - RNA, 18 nt, Escherichia coli CFT073
uuaacccauuuaaaaauc

SEQ ID NO: 609202 - RNA, 13 nt, Escherichia coli CFT073
uuaaccaggcaag

SEQ ID NO: 609203 - RNA, 19 nt, Escherichia coli CFT073
uuaaccaggcaaguucuuu

SEQ ID NO: 609204 - RNA, 12 nt, Escherichia coli CFT073
uuaaccauaauc

SEQ ID NO: 609205 - RNA, 20 nt, Escherichia coli CFT073
uuaacgcgaaauaaucaaau

SEQ ID NO: 609206 - RNA, 19 nt, Escherichia coli CFT073
uuaacggaggagagugcaa

SEQ ID NO: 609207 - RNA, 20 nt, Escherichia coli CFT073
uuaacggccacgaugcacag

SEQ ID NO: 609208 - RNA, 20 nt, Escherichia coli CFT073
uuaacgcccugaugcaucaa

SEQ ID NO: 609209 - RNA, 17 nt, Escherichia coli CFT073
uuaacgucaaccacuca

SEQ ID NO: 609210 - RNA, 17 nt, Escherichia coli CFT073
uuaacuaaaugaaauau

SEQ ID NO: 609211 - RNA, 19 nt, Escherichia coli CFT073
uuaacuaaaugaaauauuu

SEQ ID NO: 609212 - RNA, 20 nt, Escherichia coli CFT073
uuaaccagcacguugaacug

SEQ ID NO: 609213 - RNA, 17 nt, Escherichia coli CFT073
uuaaccacuucagaacc

SEQ ID NO: 609214 - RNA, 15 nt, Escherichia coli CFT073
uuaaccagcaccagc

SEQ ID NO: 609215 - RNA, 18 nt, Escherichia coli CFT073
uuaacaucuuaauagcug

SEQ ID NO: 609216 - RNA, 15 nt, Escherichia coli CFT073
uuaacauaucugauu

SEQ ID NO: 609217 - RNA, 14 nt, Escherichia coli CFT073
uuaacaucccuuca

SEQ ID NO: 609218 - RNA, 20 nt, Escherichia coli CFT073
uuaacaucccuucaauuaug

SEQ ID NO: 609219 - RNA, 21 nt, Escherichia coli CFT073
uuaacaucccuucaauuaugc

SEQ ID NO: 609220 - RNA, 15 nt, Escherichia coli CFT073
uuaacagcaaaacac

SEQ ID NO: 609221 - RNA, 15 nt, Escherichia coli CFT073
uuaacaguuccagca

SEQ ID NO: 609222 - RNA, 17 nt, Escherichia coli CFT073
uuaacaguuccagcaaa

SEQ ID NO: 609223 - RNA, 16 nt, Escherichia coli CFT073
uuaacacacaauuacc

SEQ ID NO: 609224 - RNA, 18 nt, Escherichia coli CFT073
uuaacacaguuguaauaa

SEQ ID NO: 609225 - RNA, 19 nt, Escherichia coli CFT073
uuaacacacaauuaccuuc

SEQ ID NO: 609226 - RNA, 22 nt, Escherichia coli CFT073
uuaaauugcgacugaaccagcg

SEQ ID NO: 609227 - RNA, 12 nt, Escherichia coli CFT073
uuaaauucagca

SEQ ID NO: 609228 - RNA, 14 nt, Escherichia coli CFT073
uuaaauucaggccg

SEQ ID NO: 609229 - RNA, 12 nt, Escherichia coli CFT073
uuaaauaguuuu

SEQ ID NO: 609230 - RNA, 19 nt, Escherichia coli CFT073
uuaaauauuguuuuuauug

SEQ ID NO: 609231 - RNA, 20 nt, Escherichia coli CFT073
uuaaauauuguuuuuauugu

SEQ ID NO: 609232 - RNA, 19 nt, Escherichia coli CFT073
uuaaacggcauaaauuuca

SEQ ID NO: 609233 - RNA, 17 nt, Escherichia coli CFT073
uuaaacgggucaucaaa

SEQ ID NO: 609234 - RNA, 18 nt, Escherichia coli CFT073
uuaaacgggucaucaaaa

SEQ ID NO: 609235 - RNA, 16 nt, Escherichia coli CFT073
uuaaauaauauuuccc

SEQ ID NO: 609236 - RNA, 17 nt, Escherichia coli CFT073
uuaaaggugucaauaau

SEQ ID NO: 609237 - RNA, 18 nt, Escherichia coli CFT073
uuaaaggugucaauaaua

SEQ ID NO: 609238 - RNA, 19 nt, Escherichia coli CFT073
uuaaagcucuucuuacgug

SEQ ID NO: 609239 - RNA, 23 nt, Escherichia coli CFT073
uuaaagcuacccgcgcagugcag

SEQ ID NO: 609240 - RNA, 19 nt, Escherichia coli CFT073
uuaaagcuuuacuccuaau

SEQ ID NO: 609241 - RNA, 18 nt, Escherichia coli CFT073
uuaaaccuuguuuaaucu

SEQ ID NO: 609242 - RNA, 22 nt, Escherichia coli CFT073
uuaaaccagugcccgaccacuu

SEQ ID NO: 609243 - RNA, 21 nt, Escherichia coli CFT073
uuaaaccaacuucauacauug

SEQ ID NO: 609244 - RNA, 19 nt, Escherichia coli CFT073
uuaaacagcacagccagug

SEQ ID NO: 609245 - RNA, 20 nt, Escherichia coli CFT073
uuaaacagaauacccagcaa

SEQ ID NO: 609246 - RNA, 22 nt, Escherichia coli CFT073
uguugccgccgcgugcaauauc

SEQ ID NO: 609247 - RNA, 18 nt, Escherichia coli CFT073
uguugcgcugaaacuuca

SEQ ID NO: 609248 - RNA, 21 nt, Escherichia coli CFT073
uguugcggaaagagcauccga

SEQ ID NO: 609249 - RNA, 21 nt, Escherichia coli CFT073
uguugcgaacuucaggcagga

SEQ ID NO: 609250 - RNA, 22 nt, Escherichia coli CFT073
uguugcgccagcacacccagcg

SEQ ID NO: 609251 - RNA, 21 nt, Escherichia coli CFT073
uuaaugcacggcagauaaaca

SEQ ID NO: 609252 - RNA, 23 nt, Escherichia coli CFT073
uuaaugcacggcagauaaacaac

SEQ ID NO: 609253 - RNA, 11 nt, Escherichia coli CFT073
uuaaugcaaua

SEQ ID NO: 609254 - RNA, 13 nt, Escherichia coli CFT073
uuaaugcaauaaa

SEQ ID NO: 609255 - RNA, 15 nt, Escherichia coli CFT073
uuaaugagauaauca

SEQ ID NO: 609256 - RNA, 16 nt, Escherichia coli CFT073
uuaaugauuuccagga

SEQ ID NO: 609257 - RNA, 15 nt, Escherichia coli CFT073
uuaaugacaauuaca

SEQ ID NO: 609258 - RNA, 13 nt, Escherichia coli CFT073
uuaaucugguauc

SEQ ID NO: 609259 - RNA, 12 nt, Escherichia coli CFT073
uuaaucuucacu

SEQ ID NO: 609260 - RNA, 18 nt, Escherichia coli CFT073
uuaauaccgagcguucaa

SEQ ID NO: 609261 - RNA, 23 nt, Escherichia coli CFT073
uuaauaagcaggccauuugcucu

SEQ ID NO: 609262 - RNA, 22 nt, Escherichia coli CFT073
uuaauaccaucggcagcgccaa

SEQ ID NO: 609263 - RNA, 23 nt, Escherichia coli CFT073
uuaauaccggcauccagaccgcu

SEQ ID NO: 609264 - RNA, 14 nt, Escherichia coli CFT073
uuaaucuauauaug

SEQ ID NO: 609265 - RNA, 22 nt, Escherichia coli CFT073
uuaaucucgacagccucuucca

SEQ ID NO: 609266 - RNA, 15 nt, Escherichia coli CFT073
uuaauguaaauauug

SEQ ID NO: 609267 - RNA, 16 nt, Escherichia coli CFT073
uuaaugcuacccggcg

SEQ ID NO: 609268 - RNA, 21 nt, Escherichia coli CFT073
uuaaugcuccccuuucuuauu

SEQ ID NO: 609269 - RNA, 20 nt, Escherichia coli CFT073
uuaauggcgauaaucgaacc

SEQ ID NO: 609270 - RNA, 20 nt, Escherichia coli CFT073
uuaaugcuucgcacuguguu

SEQ ID NO: 609271 - RNA, 13 nt, Escherichia coli CFT073
uuacaaaaugaca

SEQ ID NO: 609272 - RNA, 22 nt, Escherichia coli CFT073
uuacaaaauuacagccggguga

SEQ ID NO: 609273 - RNA, 15 nt, Escherichia coli CFT073
uuacacugaaaaaaa

SEQ ID NO: 609274 - RNA, 23 nt, Escherichia coli CFT073
uuacauugauagcccaacgaucc

SEQ ID NO: 609275 - RNA, 16 nt, Escherichia coli CFT073
uuacaucgauuucgcu

SEQ ID NO: 609276 - RNA, 20 nt, Escherichia coli CFT073
uuaccaaaggugacuggcag

SEQ ID NO: 609277 - RNA, 17 nt, Escherichia coli CFT073
uuaccaaccgcaauugc

SEQ ID NO: 609278 - RNA, 15 nt, Escherichia coli CFT073
uuaccaagaaagaua

SEQ ID NO: 609279 - RNA, 14 nt, Escherichia coli CFT073
uuacagcucucacu

SEQ ID NO: 609280 - RNA, 14 nt, Escherichia coli CFT073
uuacagauuuccca

SEQ ID NO: 609281 - RNA, 21 nt, Escherichia coli CFT073
uuacagcaacgggcugaagaa

SEQ ID NO: 609282 - RNA, 20 nt, Escherichia coli CFT073
uuacaucagaguacagauuc

SEQ ID NO: 609283 - RNA, 15 nt, Escherichia coli CFT073
uuacaucaucagaaa

SEQ ID NO: 609284 - RNA, 16 nt, Escherichia coli CFT073
uuacaucaucagaaau

SEQ ID NO: 609285 - RNA, 15 nt, Escherichia coli CFT073
uuacguuacccagca

SEQ ID NO: 609286 - RNA, 16 nt, Escherichia coli CFT073
uuacuaaaaagugaua

SEQ ID NO: 609287 - RNA, 22 nt, Escherichia coli CFT073
uuacuaauagcaaaauauaaac

SEQ ID NO: 609288 - RNA, 17 nt, Escherichia coli CFT073
uuacgggcguauucaau

SEQ ID NO: 609289 - RNA, 18 nt, Escherichia coli CFT073
uuacgggcguauucaaua

SEQ ID NO: 609290 - RNA, 17 nt, Escherichia coli CFT073
uuacgggucacaaacau

SEQ ID NO: 609291 - RNA, 18 nt, Escherichia coli CFT073
uuacguccaucacaauca

SEQ ID NO: 609292 - RNA, 17 nt, Escherichia coli CFT073
uuacgcgcgcaggcaac

SEQ ID NO: 609293 - RNA, 18 nt, Escherichia coli CFT073
uuacgcguccuuguaacg

SEQ ID NO: 609294 - RNA, 16 nt, Escherichia coli CFT073
uuacgcucuuccacgc

SEQ ID NO: 609295 - RNA, 17 nt, Escherichia coli CFT073
uuacgcugauuggcccc

SEQ ID NO: 609296 - RNA, 17 nt, Escherichia coli CFT073
uuacgcucccacggaau

SEQ ID NO: 609297 - RNA, 14 nt, Escherichia coli CFT073
uuacggauuucccg

SEQ ID NO: 609298 - RNA, 19 nt, Escherichia coli CFT073
uuacggauguacucaucca

SEQ ID NO: 609299 - RNA, 23 nt, Escherichia coli CFT073
uuacggauguacucauccaucuc

SEQ ID NO: 609300 - RNA, 19 nt, Escherichia coli CFT073
uuacggaaaucaugcuccg

SEQ ID NO: 609301 - RNA, 13 nt, Escherichia coli CFT073
uuacgcuguaagc

SEQ ID NO: 609302 - RNA, 14 nt, Escherichia coli CFT073
uuacccaacucuuu

SEQ ID NO: 609303 - RNA, 18 nt, Escherichia coli CFT073
uuaccaucgcgaucauca

SEQ ID NO: 609304 - RNA, 13 nt, Escherichia coli CFT073
uuacccacuguau

SEQ ID NO: 609305 - RNA, 13 nt, Escherichia coli CFT073
uuacccagcagca

SEQ ID NO: 609306 - RNA, 19 nt, Escherichia coli CFT073
uuacgagugcgcucuucaa

SEQ ID NO: 609307 - RNA, 19 nt, Escherichia coli CFT073
uuaccccgcccgauaaaac

SEQ ID NO: 609308 - RNA, 17 nt, Escherichia coli CFT073
uuacccggacacucggc

SEQ ID NO: 609309 - RNA, 15 nt, Escherichia coli CFT073
uuacccggccccugg

SEQ ID NO: 609310 - RNA, 23 nt, Escherichia coli CFT073
uuacccagcggauaaagcagggc

SEQ ID NO: 609311 - RNA, 13 nt, Escherichia coli CFT073
uuacccagugaau

SEQ ID NO: 609312 - RNA, 23 nt, Escherichia coli CFT073
uuacccccguguuuuugugccag

SEQ ID NO: 609313 - RNA, 17 nt, Escherichia coli CFT073
uuacgaugaacaugcag

SEQ ID NO: 609314 - RNA, 16 nt, Escherichia coli CFT073
uuacgcaagccaggua

SEQ ID NO: 609315 - RNA, 23 nt, Escherichia coli CFT073
uuacgcaccggaaauugcugccg

SEQ ID NO: 609316 - RNA, 14 nt, Escherichia coli CFT073
uuacgcccggacua

SEQ ID NO: 609317 - RNA, 21 nt, Escherichia coli CFT073
uuacgccgcauccgacaucaa

SEQ ID NO: 609318 - RNA, 23 nt, Escherichia coli CFT073
uuacgcaucaccccuuccugaac

SEQ ID NO: 609319 - RNA, 20 nt, Escherichia coli CFT073
uuacgccccgguuucucuuc

SEQ ID NO: 609320 - RNA, 19 nt, Escherichia coli CFT073
uuacucaacaaccaggcca

SEQ ID NO: 609321 - RNA, 20 nt, Escherichia coli CFT073
uuacuacugacuccagguga

SEQ ID NO: 609322 - RNA, 14 nt, Escherichia coli CFT073
uuacuaauuaauaa

SEQ ID NO: 609323 - RNA, 18 nt, Escherichia coli CFT073
uuacuauauaaaccuucu

SEQ ID NO: 609324 - RNA, 21 nt, Escherichia coli CFT073
uuacucuucuuuaauuaauca

SEQ ID NO: 609325 - RNA, 16 nt, Escherichia coli CFT073
uuacucuaacuuauug

SEQ ID NO: 609326 - RNA, 13 nt, Escherichia coli CFT073
uuacugacaucaa

SEQ ID NO: 609327 - RNA, 19 nt, Escherichia coli CFT073
uuacugacaucaaacccuu

SEQ ID NO: 609328 - RNA, 15 nt, Escherichia coli CFT073
uuacugcagccagcg

SEQ ID NO: 609329 - RNA, 22 nt, Escherichia coli CFT073
uuacugcgaauuuccugccaga

SEQ ID NO: 609330 - RNA, 16 nt, Escherichia coli CFT073
uuacuggcauacauca

SEQ ID NO: 609331 - RNA, 15 nt, Escherichia coli CFT073
uuacuguaggccagu

SEQ ID NO: 609332 - RNA, 15 nt, Escherichia coli CFT073
uguucucuucauuac

SEQ ID NO: 609333 - RNA, 23 nt, Escherichia coli CFT073
uguucugaggugagcauaucacc

SEQ ID NO: 609334 - RNA, 16 nt, Escherichia coli CFT073
uguucgcuuaacucac

SEQ ID NO: 609335 - RNA, 19 nt, Escherichia coli CFT073
uguucugcgccugguuuug

SEQ ID NO: 609336 - RNA, 22 nt, Escherichia coli CFT073
uguucuggccguacccagcggu

SEQ ID NO: 609337 - RNA, 17 nt, Escherichia coli CFT073
uguucuggcguaucucc

SEQ ID NO: 609338 - RNA, 13 nt, Escherichia coli CFT073
uguucauaucaaa

SEQ ID NO: 609339 - RNA, 23 nt, Escherichia coli CFT073
uguucgccgcagguagcagcagc

SEQ ID NO: 609340 - RNA, 14 nt, Escherichia coli CFT073
uguucgccagugca

SEQ ID NO: 609341 - RNA, 21 nt, Escherichia coli CFT073
uguucgcaaccuaaccaaaca

SEQ ID NO: 609342 - RNA, 16 nt, Escherichia coli CFT073
uguucuucuguuaaau

SEQ ID NO: 609343 - RNA, 17 nt, Escherichia coli CFT073
uguugaaauacaaacac

SEQ ID NO: 609344 - RNA, 21 nt, Escherichia coli CFT073
uguugaauuccgaauuucauc

SEQ ID NO: 609345 - RNA, 22 nt, Escherichia coli CFT073
uguugauaaucaacaggaacau

SEQ ID NO: 609346 - RNA, 15 nt, Escherichia coli CFT073
uguugacgcuaugug

SEQ ID NO: 609347 - RNA, 21 nt, Escherichia coli CFT073
uguugaucaggugauggcagc

SEQ ID NO: 609348 - RNA, 23 nt, Escherichia coli CFT073
uguugaucucaauaccaaugaau

SEQ ID NO: 609349 - RNA, 20 nt, Escherichia coli CFT073
uguugaugacgaccgccuuc

SEQ ID NO: 609350 - RNA, 15 nt, Escherichia coli CFT073
uguuaauucucccug

SEQ ID NO: 609351 - RNA, 17 nt, Escherichia coli CFT073
uguuaauucucccugcg

SEQ ID NO: 609352 - RNA, 20 nt, Escherichia coli CFT073
uguuaaugcgaaugaaagau

SEQ ID NO: 609353 - RNA, 15 nt, Escherichia coli CFT073
uguguuuaugagguu

SEQ ID NO: 609354 - RNA, 11 nt, Escherichia coli CFT073
uguguuuauaa

SEQ ID NO: 609355 - RNA, 22 nt, Escherichia coli CFT073
uguguugagcgaugaaguaaca

SEQ ID NO: 609356 - RNA, 22 nt, Escherichia coli CFT073
uguuacuacagaggguuuuuua

SEQ ID NO: 609357 - RNA, 11 nt, Escherichia coli CFT073
uguuacugauu

SEQ ID NO: 609358 - RNA, 17 nt, Escherichia coli CFT073
uguuaccguaccaggca

SEQ ID NO: 609359 - RNA, 23 nt, Escherichia coli CFT073
uguuaccuacgcuugcugcgauc

SEQ ID NO: 609360 - RNA, 15 nt, Escherichia coli CFT073
uguucaacaauucgu

SEQ ID NO: 609361 - RNA, 16 nt, Escherichia coli CFT073
uguucaaaggcagaaa

SEQ ID NO: 609362 - RNA, 22 nt, Escherichia coli CFT073
uguuagcaugcugacugcgcuc

SEQ ID NO: 609363 - RNA, 20 nt, Escherichia coli CFT073
uguuagccacauccaugcuu

SEQ ID NO: 609364 - RNA, 16 nt, Escherichia coli CFT073
uguuagcgugcaggac

SEQ ID NO: 609365 - RNA, 14 nt, Escherichia coli CFT073
uguuauaauguugg

SEQ ID NO: 609366 - RNA, 22 nt, Escherichia coli CFT073
uguuauauucacuugccugcug

SEQ ID NO: 609367 - RNA, 18 nt, Escherichia coli CFT073
ugugauuucuuuauugau

SEQ ID NO: 609368 - RNA, 19 nt, Escherichia coli CFT073
ugugauuugucauaugcaa

SEQ ID NO: 609369 - RNA, 22 nt, Escherichia coli CFT073
ugugauuacagccaggcgcugc

SEQ ID NO: 609370 - RNA, 19 nt, Escherichia coli CFT073
ugugauugcgcaguaccag

SEQ ID NO: 609371 - RNA, 17 nt, Escherichia coli CFT073
ugugccacauccagcgg

SEQ ID NO: 609372 - RNA, 19 nt, Escherichia coli CFT073
ugugccaccagcauuccua

SEQ ID NO: 609373 - RNA, 19 nt, Escherichia coli CFT073
ugugccagcucgugcagaa

SEQ ID NO: 609374 - RNA, 18 nt, Escherichia coli CFT073
ugugccgcgaccaccucg

SEQ ID NO: 609375 - RNA, 17 nt, Escherichia coli CFT073
ugugccauucuugucag

SEQ ID NO: 609376 - RNA, 17 nt, Escherichia coli CFT073
ugugccgaauccaauaa

SEQ ID NO: 609377 - RNA, 15 nt, Escherichia coli CFT073
ugugcucuaaccaac

SEQ ID NO: 609378 - RNA, 18 nt, Escherichia coli CFT073
uguggcagguaauccgca

SEQ ID NO: 609379 - RNA, 19 nt, Escherichia coli CFT073
uguguaaugcggcugacaa

SEQ ID NO: 609380 - RNA, 18 nt, Escherichia coli CFT073
uguguaauuugcguuuuc

SEQ ID NO: 609381 - RNA, 13 nt, Escherichia coli CFT073
uguguuaauaaug

SEQ ID NO: 609382 - RNA, 17 nt, Escherichia coli CFT073
uguguggcgcuuuuugg

SEQ ID NO: 609383 - RNA, 17 nt, Escherichia coli CFT073
uguggaaagccccagcc

SEQ ID NO: 609384 - RNA, 19 nt, Escherichia coli CFT073
uguggauuaaauugcgcca

SEQ ID NO: 609385 - RNA, 22 nt, Escherichia coli CFT073
uguggaggccgagcuaauaauc

SEQ ID NO: 609386 - RNA, 18 nt, Escherichia coli CFT073
uguggauaucugggaugc

SEQ ID NO: 609387 - RNA, 17 nt, Escherichia coli CFT073
ugucugccacaccugcc

SEQ ID NO: 609388 - RNA, 16 nt, Escherichia coli CFT073
ugucugccauaugucc

SEQ ID NO: 609389 - RNA, 13 nt, Escherichia coli CFT073
ugucugcaagagg

SEQ ID NO: 609390 - RNA, 16 nt, Escherichia coli CFT073
ugucuguaauguccau

SEQ ID NO: 609391 - RNA, 16 nt, Escherichia coli CFT073
ugucuuaucaggucaa

SEQ ID NO: 609392 - RNA, 14 nt, Escherichia coli CFT073
ugucuuuuauuaua

SEQ ID NO: 609393 - RNA, 23 nt, Escherichia coli CFT073
ugucuuuaaauugcguaaagccu

SEQ ID NO: 609394 - RNA, 22 nt, Escherichia coli CFT073
ugucuuuaucgacauaaaucau

SEQ ID NO: 609395 - RNA, 14 nt, Escherichia coli CFT073
ugucuuucaacaga

SEQ ID NO: 609396 - RNA, 15 nt, Escherichia coli CFT073
ugucuugccucccug

SEQ ID NO: 609397 - RNA, 16 nt, Escherichia coli CFT073
ugucuugccucccugc

SEQ ID NO: 609398 - RNA, 19 nt, Escherichia coli CFT073
ugucuucguugugaauacc

SEQ ID NO: 609399 - RNA, 16 nt, Escherichia coli CFT073
ugugauccacugcaga

SEQ ID NO: 609400 - RNA, 20 nt, Escherichia coli CFT073
ugugaauguucaauaagcuu

SEQ ID NO: 609401 - RNA, 20 nt, Escherichia coli CFT073
ugugaauuguccagaucuuu

SEQ ID NO: 609402 - RNA, 14 nt, Escherichia coli CFT073
ugugacaacaacau

SEQ ID NO: 609403 - RNA, 15 nt, Escherichia coli CFT073
ugugacaacaacauc

SEQ ID NO: 609404 - RNA, 17 nt, Escherichia coli CFT073
ugugacaacaacaucac

SEQ ID NO: 609405 - RNA, 20 nt, Escherichia coli CFT073
ugugaguacccuuucacuuu

SEQ ID NO: 609406 - RNA, 23 nt, Escherichia coli CFT073
ugugagucagaugcugugcaauc

SEQ ID NO: 609407 - RNA, 22 nt, Escherichia coli CFT073
ugugaagcaccugcguugcuca

SEQ ID NO: 609408 - RNA, 18 nt, Escherichia coli CFT073
ugugaaauaaaaucagca

SEQ ID NO: 609409 - RNA, 20 nt, Escherichia coli CFT073
ugucggacuucaguuucuuc

SEQ ID NO: 609410 - RNA, 15 nt, Escherichia coli CFT073
ugucggcaagauacu

SEQ ID NO: 609411 - RNA, 20 nt, Escherichia coli CFT073
ugucggcacugaccaccacc

SEQ ID NO: 609412 - RNA, 21 nt, Escherichia coli CFT073
ugucgcugucggucaaauuca

SEQ ID NO: 609413 - RNA, 23 nt, Escherichia coli CFT073
ugucgggcaggagcugagugcga

SEQ ID NO: 609414 - RNA, 12 nt, Escherichia coli CFT073
ugucucuuuuuu

SEQ ID NO: 609415 - RNA, 15 nt, Escherichia coli CFT073
ugucucuuuuuucag

SEQ ID NO: 609416 - RNA, 11 nt, Escherichia coli CFT073
ugucucugcaa

SEQ ID NO: 609417 - RNA, 21 nt, Escherichia coli CFT073
ugucgccaucguuaaaaaaca

SEQ ID NO: 609418 - RNA, 22 nt, Escherichia coli CFT073
ugucgcauccggcaauuggugc

SEQ ID NO: 609419 - RNA, 12 nt, Escherichia coli CFT073
ugucgccugcag

SEQ ID NO: 609420 - RNA, 21 nt, Escherichia coli CFT073
ugucgcgcagcacuugcagcc

SEQ ID NO: 609421 - RNA, 15 nt, Escherichia coli CFT073
ugucgcauccggcaa

SEQ ID NO: 609422 - RNA, 14 nt, Escherichia coli CFT073
ugucgcaucaggca

SEQ ID NO: 609423 - RNA, 16 nt, Escherichia coli CFT073
ugucgcaucaggcauc

SEQ ID NO: 609424 - RNA, 21 nt, Escherichia coli CFT073
uguccgccagggcggacugau

SEQ ID NO: 609425 - RNA, 21 nt, Escherichia coli CFT073
uguccgauuuguucucuucug

SEQ ID NO: 609426 - RNA, 23 nt, Escherichia coli CFT073
uguccggcagagaggacucugcc

SEQ ID NO: 609427 - RNA, 18 nt, Escherichia coli CFT073
uguccggcgcacuggugc

SEQ ID NO: 609428 - RNA, 13 nt, Escherichia coli CFT073
uguccuucucauc

SEQ ID NO: 609429 - RNA, 20 nt, Escherichia coli CFT073
uguccugcggcguaccaaua

SEQ ID NO: 609430 - RNA, 17 nt, Escherichia coli CFT073
ugucauaugcaaugcau

SEQ ID NO: 609431 - RNA, 14 nt, Escherichia coli CFT073
ugucaucauugguu

SEQ ID NO: 609432 - RNA, 21 nt, Escherichia coli CFT073
ugucaucauugguuaacucca

SEQ ID NO: 609433 - RNA, 18 nt, Escherichia coli CFT073
ugucaucccuuccugccc

SEQ ID NO: 609434 - RNA, 15 nt, Escherichia coli CFT073
uguccaaaugcagca

SEQ ID NO: 609435 - RNA, 19 nt, Escherichia coli CFT073
ugucauuuugccuuugguc

SEQ ID NO: 609436 - RNA, 16 nt, Escherichia coli CFT073
ugucauuaccacaaca

SEQ ID NO: 609437 - RNA, 22 nt, Escherichia coli CFT073
ugucauucgccugacgcaauaa

SEQ ID NO: 609438 - RNA, 13 nt, Escherichia coli CFT073
ugucauuguuaua

SEQ ID NO: 609439 - RNA, 23 nt, Escherichia coli CFT073
uguccauuaauacccgggucauc

SEQ ID NO: 609440 - RNA, 18 nt, Escherichia coli CFT073
uguccagaucgggccugg

SEQ ID NO: 609441 - RNA, 13 nt, Escherichia coli CFT073
uguccagaucuuu

SEQ ID NO: 609442 - RNA, 12 nt, Escherichia coli CFT073
uguccacuuccg

SEQ ID NO: 609443 - RNA, 17 nt, Escherichia coli CFT073
uguccauaccggacucc

SEQ ID NO: 609444 - RNA, 18 nt, Escherichia coli CFT073
uguccagcuuaauucugu

SEQ ID NO: 609445 - RNA, 23 nt, Escherichia coli CFT073
ugucauaccacauacauaauaau

SEQ ID NO: 609446 - RNA, 23 nt, Escherichia coli CFT073
ugucagugcccggcccggaggau

SEQ ID NO: 609447 - RNA, 16 nt, Escherichia coli CFT073
ugucagcucauccagc

SEQ ID NO: 609448 - RNA, 12 nt, Escherichia coli CFT073
uguauuuacccg

SEQ ID NO: 609449 - RNA, 12 nt, Escherichia coli CFT073
ugucaauaauau

SEQ ID NO: 609450 - RNA, 20 nt, Escherichia coli CFT073
ugucaacagcguuucuucga

SEQ ID NO: 609451 - RNA, 19 nt, Escherichia coli CFT073
uguaugcacacggaucuga

SEQ ID NO: 609452 - RNA, 14 nt, Escherichia coli CFT073
uguaugacaaaaga

SEQ ID NO: 609453 - RNA, 16 nt, Escherichia coli CFT073
uguaucuuucaucauu

SEQ ID NO: 609454 - RNA, 18 nt, Escherichia coli CFT073
uguacauccuuguacaug

SEQ ID NO: 609455 - RNA, 14 nt, Escherichia coli CFT073
uguacaucgcgcca

SEQ ID NO: 609456 - RNA, 20 nt, Escherichia coli CFT073
uguacaggauauauuucauc

SEQ ID NO: 609457 - RNA, 11 nt, Escherichia coli CFT073
uguacacuucc

SEQ ID NO: 609458 - RNA, 21 nt, Escherichia coli CFT073
uguaaucacgcucaacuuccu

SEQ ID NO: 609459 - RNA, 19 nt, Escherichia coli CFT073
uguaaucaacuccgccagc

SEQ ID NO: 609460 - RNA, 12 nt, Escherichia coli CFT073
uguaauaugcag

SEQ ID NO: 609461 - RNA, 14 nt, Escherichia coli CFT073
uguaaucaacaaaa

SEQ ID NO: 609462 - RNA, 20 nt, Escherichia coli CFT073
uguaaguuacuaaaaguaaa

SEQ ID NO: 609463 - RNA, 12 nt, Escherichia coli CFT073
uguaagucugaa

SEQ ID NO: 609464 - RNA, 22 nt, Escherichia coli CFT073
uguaagucugaaucagucccug

SEQ ID NO: 609465 - RNA, 12 nt, Escherichia coli CFT073
uguaauccugcc

SEQ ID NO: 609466 - RNA, 14 nt, Escherichia coli CFT073
uguaaugacaacau

SEQ ID NO: 609467 - RNA, 15 nt, Escherichia coli CFT073
uguaaugacaacauu

SEQ ID NO: 609468 - RNA, 16 nt, Escherichia coli CFT073
uguaaugacaacauuu

SEQ ID NO: 609469 - RNA, 21 nt, Escherichia coli CFT073
uguaauucgccgucgucgauu

SEQ ID NO: 609470 - RNA, 17 nt, Escherichia coli CFT073
uguaaugcagguccacg

SEQ ID NO: 609471 - RNA, 17 nt, Escherichia coli CFT073
uguaaugccuuuuccag

SEQ ID NO: 609472 - RNA, 22 nt, Escherichia coli CFT073
uguaauuaaauuaucaacuauc

SEQ ID NO: 609473 - RNA, 17 nt, Escherichia coli CFT073
ugguuuugcuuuauuaa

SEQ ID NO: 609474 - RNA, 16 nt, Escherichia coli CFT073
ugguuuugguaaagca

SEQ ID NO: 609475 - RNA, 15 nt, Escherichia coli CFT073
ugguuuuguaggcug

SEQ ID NO: 609476 - RNA, 14 nt, Escherichia coli CFT073
uguaaaugcaaauu

SEQ ID NO: 609477 - RNA, 19 nt, Escherichia coli CFT073
uguaaaugcugcuccagcg

SEQ ID NO: 609478 - RNA, 22 nt, Escherichia coli CFT073
uguaaaaacgcuuugcugccuu

SEQ ID NO: 609479 - RNA, 22 nt, Escherichia coli CFT073
uguaacaguugcaguuauuaua

SEQ ID NO: 609480 - RNA, 13 nt, Escherichia coli CFT073
uguaagcagggcc

SEQ ID NO: 609481 - RNA, 19 nt, Escherichia coli CFT073
ugguucgugcaacuuucaa

SEQ ID NO: 609482 - RNA, 20 nt, Escherichia coli CFT073
ugguugaaauaaaccaguaa

SEQ ID NO: 609483 - RNA, 22 nt, Escherichia coli CFT073
ugguucggcaaaaucuuccaga

SEQ ID NO: 609484 - RNA, 16 nt, Escherichia coli CFT073
ugguucccgaugcugu

SEQ ID NO: 609485 - RNA, 18 nt, Escherichia coli CFT073
ugguucccugaccugcca

SEQ ID NO: 609486 - RNA, 23 nt, Escherichia coli CFT073
ugguucccugaccugccauccac

SEQ ID NO: 609487 - RNA, 12 nt, Escherichia coli CFT073
ugguuacacggg

SEQ ID NO: 609488 - RNA, 15 nt, Escherichia coli CFT073
ugguuaccaucaacc

SEQ ID NO: 609489 - RNA, 21 nt, Escherichia coli CFT073
ugguuacgcaagccagguaaa

SEQ ID NO: 609490 - RNA, 19 nt, Escherichia coli CFT073
ugguuagccggauaagcaa

SEQ ID NO: 609491 - RNA, 22 nt, Escherichia coli CFT073
ugguuagcaaccgccgcugcuu

SEQ ID NO: 609492 - RNA, 17 nt, Escherichia coli CFT073
ugguuaguuagcagauu

SEQ ID NO: 609493 - RNA, 16 nt, Escherichia coli CFT073
ugguucccaacaacag

SEQ ID NO: 609494 - RNA, 17 nt, Escherichia coli CFT073
ugguuaaauaauauuuc

SEQ ID NO: 609495 - RNA, 15 nt, Escherichia coli CFT073
ugguuguaauccacc

SEQ ID NO: 609496 - RNA, 22 nt, Escherichia coli CFT073
ugguuuuaacgaaucgggcaac

SEQ ID NO: 609497 - RNA, 14 nt, Escherichia coli CFT073
ugguuucaauacuc

SEQ ID NO: 609498 - RNA, 17 nt, Escherichia coli CFT073
ugguuucacccaguccc

SEQ ID NO: 609499 - RNA, 17 nt, Escherichia coli CFT073
ugguaauucgccagcca

SEQ ID NO: 609500 - RNA, 17 nt, Escherichia coli CFT073
ugguaacuuucuccggu

SEQ ID NO: 609501 - RNA, 15 nt, Escherichia coli CFT073
ugguagagcacgacc

SEQ ID NO: 609502 - RNA, 22 nt, Escherichia coli CFT073
ugguagagcacgaccuugccaa

SEQ ID NO: 609503 - RNA, 15 nt, Escherichia coli CFT073
uggggcuuuucucug

SEQ ID NO: 609504 - RNA, 22 nt, Escherichia coli CFT073
uggguaaccaucgauuuugcaa

SEQ ID NO: 609505 - RNA, 22 nt, Escherichia coli CFT073
ugguaaauggcugaccggaauu

SEQ ID NO: 609506 - RNA, 14 nt, Escherichia coli CFT073
uggucauuuuauug

SEQ ID NO: 609507 - RNA, 21 nt, Escherichia coli CFT073
ugguccacacgcgcccagccu

SEQ ID NO: 609508 - RNA, 12 nt, Escherichia coli CFT073
uggucaucauca

SEQ ID NO: 609509 - RNA, 18 nt, Escherichia coli CFT073
uggucaucaucaggaaca

SEQ ID NO: 609510 - RNA, 13 nt, Escherichia coli CFT073
uggucaucaucau

SEQ ID NO: 609511 - RNA, 14 nt, Escherichia coli CFT073
uggucaucaucauu

SEQ ID NO: 609512 - RNA, 16 nt, Escherichia coli CFT073
ugguauugcagcucug

SEQ ID NO: 609513 - RNA, 18 nt, Escherichia coli CFT073
ugguauuugccuuaugga

SEQ ID NO: 609514 - RNA, 22 nt, Escherichia coli CFT073
uggucuucauagauagccagca

SEQ ID NO: 609515 - RNA, 18 nt, Escherichia coli CFT073
uggugaacgacacacagu

SEQ ID NO: 609516 - RNA, 20 nt, Escherichia coli CFT073
uggugcaauccacaagcaca

SEQ ID NO: 609517 - RNA, 19 nt, Escherichia coli CFT073
uggugaugagcugaccaga

SEQ ID NO: 609518 - RNA, 13 nt, Escherichia coli CFT073
uggugauugcaaa

SEQ ID NO: 609519 - RNA, 23 nt, Escherichia coli CFT073
uggucugacgcugaauacgcacc

SEQ ID NO: 609520 - RNA, 13 nt, Escherichia coli CFT073
uggucugccauca

SEQ ID NO: 609521 - RNA, 14 nt, Escherichia coli CFT073
uggucgcaucaucc

SEQ ID NO: 609522 - RNA, 22 nt, Escherichia coli CFT073
uggugccagauuuaacggcagc

SEQ ID NO: 609523 - RNA, 16 nt, Escherichia coli CFT073
uggugccagcgccagc

SEQ ID NO: 609524 - RNA, 15 nt, Escherichia coli CFT073
uggugcauaacacaa

SEQ ID NO: 609525 - RNA, 20 nt, Escherichia coli CFT073
uggugcgaaacggaaucacc

SEQ ID NO: 609526 - RNA, 17 nt, Escherichia coli CFT073
uggugcuaauuugaaau

SEQ ID NO: 609527 - RNA, 18 nt, Escherichia coli CFT073
uggugcuaauuugaaaug

SEQ ID NO: 609528 - RNA, 17 nt, Escherichia coli CFT073
uggugcuguuuucuccc

SEQ ID NO: 609529 - RNA, 20 nt, Escherichia coli CFT073
uggugcuugccagagcagca

SEQ ID NO: 609530 - RNA, 22 nt, Escherichia coli CFT073
uggugccugcacugguggcacc

SEQ ID NO: 609531 - RNA, 22 nt, Escherichia coli CFT073
uggugcuuuauguaauccugua

SEQ ID NO: 609532 - RNA, 19 nt, Escherichia coli CFT073
uggggauggcgcugcugca

SEQ ID NO: 609533 - RNA, 20 nt, Escherichia coli CFT073
uggggaauuugcgaguccgc

SEQ ID NO: 609534 - RNA, 18 nt, Escherichia coli CFT073
ugggcuucgauacugccu

SEQ ID NO: 609535 - RNA, 21 nt, Escherichia coli CFT073
ugggccaccucuuuugcgauu

SEQ ID NO: 609536 - RNA, 18 nt, Escherichia coli CFT073
ugggacacauaaccaggu

SEQ ID NO: 609537 - RNA, 17 nt, Escherichia coli CFT073
ugggcgcaccugaaucg

SEQ ID NO: 609538 - RNA, 15 nt, Escherichia coli CFT073
ugggcgauaaaauca

SEQ ID NO: 609539 - RNA, 17 nt, Escherichia coli CFT073
ugggccauccaccagug

SEQ ID NO: 609540 - RNA, 19 nt, Escherichia coli CFT073
uggcuguauuuuuccagcu

SEQ ID NO: 609541 - RNA, 19 nt, Escherichia coli CFT073
uggcuguuuucagcaccag

SEQ ID NO: 609542 - RNA, 16 nt, Escherichia coli CFT073
uggcugugcguuaccc

SEQ ID NO: 609543 - RNA, 23 nt, Escherichia coli CFT073
uggcugagcaaacaguucugcag

SEQ ID NO: 609544 - RNA, 16 nt, Escherichia coli CFT073
uggcugauaaucauac

SEQ ID NO: 609545 - RNA, 21 nt, Escherichia coli CFT073
uggcugauuaacguuuccauu

SEQ ID NO: 609546 - RNA, 20 nt, Escherichia coli CFT073
uggcugacauaaacaccagc

SEQ ID NO: 609547 - RNA, 22 nt, Escherichia coli CFT073
uggcugaacgccugcaccagcc

SEQ ID NO: 609548 - RNA, 22 nt, Escherichia coli CFT073
uggcugacacuauucgccagca

SEQ ID NO: 609549 - RNA, 21 nt, Escherichia coli CFT073
uggcugccgagcaaaucgcgg

SEQ ID NO: 609550 - RNA, 16 nt, Escherichia coli CFT073
uggcugccaugguuug

SEQ ID NO: 609551 - RNA, 14 nt, Escherichia coli CFT073
uggcugcaguggua

SEQ ID NO: 609552 - RNA, 20 nt, Escherichia coli CFT073
uggcuucuuccccggaugag

SEQ ID NO: 609553 - RNA, 17 nt, Escherichia coli CFT073
uggcuucgagaaugaag

SEQ ID NO: 609554 - RNA, 16 nt, Escherichia coli CFT073
uggcuuaucuuccugu

SEQ ID NO: 609555 - RNA, 15 nt, Escherichia coli CFT073
uggcuuuccaccugc

SEQ ID NO: 609556 - RNA, 15 nt, Escherichia coli CFT073
uggcuuuauaaauug

SEQ ID NO: 609557 - RNA, 13 nt, Escherichia coli CFT073
ugggaaauggcug

SEQ ID NO: 609558 - RNA, 22 nt, Escherichia coli CFT073
ugggaauuggcgucaguaaaug

SEQ ID NO: 609559 - RNA, 12 nt, Escherichia coli CFT073
uggcgcugcuca

SEQ ID NO: 609560 - RNA, 14 nt, Escherichia coli CFT073
uggcgcgccgauaa

SEQ ID NO: 609561 - RNA, 19 nt, Escherichia coli CFT073
uggcgcgaccaaugucagg

SEQ ID NO: 609562 - RNA, 22 nt, Escherichia coli CFT073
uggaaaaccgcacucacgcgcc

SEQ ID NO: 609563 - RNA, 12 nt, Escherichia coli CFT073
uggaaaacaaca

SEQ ID NO: 609564 - RNA, 20 nt, Escherichia coli CFT073
uggaaaacagcgccugcaaa

SEQ ID NO: 609565 - RNA, 18 nt, Escherichia coli CFT073
uggcgguaguuccaccag

SEQ ID NO: 609566 - RNA, 16 nt, Escherichia coli CFT073
uggcguaucuccagua

SEQ ID NO: 609567 - RNA, 21 nt, Escherichia coli CFT073
uggcgucacgccgaccagacc

SEQ ID NO: 609568 - RNA, 14 nt, Escherichia coli CFT073
uggcguacagcugg

SEQ ID NO: 609569 - RNA, 16 nt, Escherichia coli CFT073
uggcggggaucacucc

SEQ ID NO: 609570 - RNA, 21 nt, Escherichia coli CFT073
uggcggaacggcguugcugcc

SEQ ID NO: 609571 - RNA, 12 nt, Escherichia coli CFT073
uggcgucuccuc

SEQ ID NO: 609572 - RNA, 17 nt, Escherichia coli CFT073
uggcgucgauaucaacc

SEQ ID NO: 609573 - RNA, 20 nt, Escherichia coli CFT073
uggcguuuccagcaguucca

SEQ ID NO: 609574 - RNA, 21 nt, Escherichia coli CFT073
uggcgugguaucacguagcca

SEQ ID NO: 609575 - RNA, 15 nt, Escherichia coli CFT073
uggcguucacugccg

SEQ ID NO: 609576 - RNA, 16 nt, Escherichia coli CFT073
uggcguucacugccgu

SEQ ID NO: 609577 - RNA, 11 nt, Escherichia coli CFT073
uggcucaucaa

SEQ ID NO: 609578 - RNA, 12 nt, Escherichia coli CFT073
uggcucaucaau

SEQ ID NO: 609579 - RNA, 15 nt, Escherichia coli CFT073
uggcucaucaauacg

SEQ ID NO: 609580 - RNA, 13 nt, Escherichia coli CFT073
uggcucucaucca

SEQ ID NO: 609581 - RNA, 14 nt, Escherichia coli CFT073
uggcucucauccaa

SEQ ID NO: 609582 - RNA, 19 nt, Escherichia coli CFT073
uggcucugaauaaagcguu

SEQ ID NO: 609583 - RNA, 15 nt, Escherichia coli CFT073
uggcuacucagcugg

SEQ ID NO: 609584 - RNA, 12 nt, Escherichia coli CFT073
uucagaauaaug

SEQ ID NO: 609585 - RNA, 15 nt, Escherichia coli CFT073
uucagaauugccgcc

SEQ ID NO: 609586 - RNA, 17 nt, Escherichia coli CFT073
uucagaauuugagcuug

SEQ ID NO: 609587 - RNA, 12 nt, Escherichia coli CFT073
uucagacgcugc

SEQ ID NO: 609588 - RNA, 21 nt, Escherichia coli CFT073
uucagagcgaauuaagaauuu

SEQ ID NO: 609589 - RNA, 16 nt, Escherichia coli CFT073
uucagacguucuuccu

SEQ ID NO: 609590 - RNA, 18 nt, Escherichia coli CFT073
uucacuucaguaaauacu

SEQ ID NO: 609591 - RNA, 19 nt, Escherichia coli CFT073
uucacuuucugaccaugca

SEQ ID NO: 609592 - RNA, 17 nt, Escherichia coli CFT073
uucacuuuucuucugaa

SEQ ID NO: 609593 - RNA, 20 nt, Escherichia coli CFT073
uucacuuuugccagacgaau

SEQ ID NO: 609594 - RNA, 18 nt, Escherichia coli CFT073
uucagaacacaaaaccga

SEQ ID NO: 609595 - RNA, 23 nt, Escherichia coli CFT073
uucagaacacuucuucuguuucu

SEQ ID NO: 609596 - RNA, 13 nt, Escherichia coli CFT073
uucagauaaaagc

SEQ ID NO: 609597 - RNA, 16 nt, Escherichia coli CFT073
uucagauaauagguaa

SEQ ID NO: 609598 - RNA, 23 nt, Escherichia coli CFT073
uucagauaauagguaaacauccg

SEQ ID NO: 609599 - RNA, 13 nt, Escherichia coli CFT073
uucagauucaguc

SEQ ID NO: 609600 - RNA, 18 nt, Escherichia coli CFT073
uucagcaacggaaaagca

SEQ ID NO: 609601 - RNA, 21 nt, Escherichia coli CFT073
uucagcaaaccacugauaagc

SEQ ID NO: 609602 - RNA, 20 nt, Escherichia coli CFT073
uucagcacuggcggcagcag

SEQ ID NO: 609603 - RNA, 11 nt, Escherichia coli CFT073
uucagcaccag

SEQ ID NO: 609604 - RNA, 18 nt, Escherichia coli CFT073
uucagcaguggcacacaa

SEQ ID NO: 609605 - RNA, 15 nt, Escherichia coli CFT073
uucagcaguucaguc

SEQ ID NO: 609606 - RNA, 17 nt, Escherichia coli CFT073
uucagcaguucugccag

SEQ ID NO: 609607 - RNA, 20 nt, Escherichia coli CFT073
uucagcaucccaggcaucca

SEQ ID NO: 609608 - RNA, 21 nt, Escherichia coli CFT073
uucagcaucgacauucaacau

SEQ ID NO: 609609 - RNA, 20 nt, Escherichia coli CFT073
uucagccaaugccugagaca

SEQ ID NO: 609610 - RNA, 15 nt, Escherichia coli CFT073
uucacgcagugcugc

SEQ ID NO: 609611 - RNA, 18 nt, Escherichia coli CFT073
uucacgccaaaagcgauu

SEQ ID NO: 609612 - RNA, 16 nt, Escherichia coli CFT073
uucacgcccagaucca

SEQ ID NO: 609613 - RNA, 19 nt, Escherichia coli CFT073
uucacgccgcauccggcaa

SEQ ID NO: 609614 - RNA, 18 nt, Escherichia coli CFT073
uucacgccgcaucuggca

SEQ ID NO: 609615 - RNA, 15 nt, Escherichia coli CFT073
uucacgcucacccau

SEQ ID NO: 609616 - RNA, 20 nt, Escherichia coli CFT073
uucaccugguucagucguau

SEQ ID NO: 609617 - RNA, 13 nt, Escherichia coli CFT073
uucaccugccugc

SEQ ID NO: 609618 - RNA, 21 nt, Escherichia coli CFT073
uucacgacccggcguuuucag

SEQ ID NO: 609619 - RNA, 23 nt, Escherichia coli CFT073
uucacgaagauauucaucagcau

SEQ ID NO: 609620 - RNA, 15 nt, Escherichia coli CFT073
uucacgaucuucacg

SEQ ID NO: 609621 - RNA, 14 nt, Escherichia coli CFT073
uucaccguccaucc

SEQ ID NO: 609622 - RNA, 17 nt, Escherichia coli CFT073
uucacccugacuguuuu

SEQ ID NO: 609623 - RNA, 21 nt, Escherichia coli CFT073
uucaccgcacgacgaaucuga

SEQ ID NO: 609624 - RNA, 22 nt, Escherichia coli CFT073
uucacugcgaccagcagcguuu

SEQ ID NO: 609625 - RNA, 21 nt, Escherichia coli CFT073
uucacuguucgccgcagguag

SEQ ID NO: 609626 - RNA, 17 nt, Escherichia coli CFT073
uucacugaaaaucaccu

SEQ ID NO: 609627 - RNA, 14 nt, Escherichia coli CFT073
uucacugaaacaga

SEQ ID NO: 609628 - RNA, 21 nt, Escherichia coli CFT073
uucacugaaacagauaaaagu

SEQ ID NO: 609629 - RNA, 15 nt, Escherichia coli CFT073
uucacuacugguugc

SEQ ID NO: 609630 - RNA, 16 nt, Escherichia coli CFT073
uucacggaugauuacc

SEQ ID NO: 609631 - RNA, 21 nt, Escherichia coli CFT073
uucacggucggccaguauuug

SEQ ID NO: 609632 - RNA, 14 nt, Escherichia coli CFT073
uucaaggauguguu

SEQ ID NO: 609633 - RNA, 23 nt, Escherichia coli CFT073
uucaaggugauauccaccgcguu

SEQ ID NO: 609634 - RNA, 22 nt, Escherichia coli CFT073
uucaauacgcuccaguaccugc

SEQ ID NO: 609635 - RNA, 18 nt, Escherichia coli CFT073
uucaauaccgccugcaaa

SEQ ID NO: 609636 - RNA, 23 nt, Escherichia coli CFT073
uucaauaauuccgcccucgauau

SEQ ID NO: 609637 - RNA, 23 nt, Escherichia coli CFT073
uucaauauggaacgcuugcggcu

SEQ ID NO: 609638 - RNA, 22 nt, Escherichia coli CFT073
uucaauaucuuccuggcguugg

SEQ ID NO: 609639 - RNA, 20 nt, Escherichia coli CFT073
uucaauccacugcaucagua

SEQ ID NO: 609640 - RNA, 13 nt, Escherichia coli CFT073
uucaaucugguga

SEQ ID NO: 609641 - RNA, 20 nt, Escherichia coli CFT073
uucaaugauaaaggucauca

SEQ ID NO: 609642 - RNA, 15 nt, Escherichia coli CFT073
uucaaugaucgucau

SEQ ID NO: 609643 - RNA, 22 nt, Escherichia coli CFT073
uucaaugaucgucauaucauca

SEQ ID NO: 609644 - RNA, 20 nt, Escherichia coli CFT073
uucaaugcguuguagcuuuu

SEQ ID NO: 609645 - RNA, 20 nt, Escherichia coli CFT073
uucaaugccuuucuuuguuc

SEQ ID NO: 609646 - RNA, 11 nt, Escherichia coli CFT073
uucaaugcaau

SEQ ID NO: 609647 - RNA, 19 nt, Escherichia coli CFT073
uucaauucuagaaacuguu

SEQ ID NO: 609648 - RNA, 12 nt, Escherichia coli CFT073
uucacaaucuga

SEQ ID NO: 609649 - RNA, 14 nt, Escherichia coli CFT073
uucacacucugcca

SEQ ID NO: 609650 - RNA, 20 nt, Escherichia coli CFT073
uucacacugaugacaggcua

SEQ ID NO: 609651 - RNA, 22 nt, Escherichia coli CFT073
uucacaaccgccauccagguag

SEQ ID NO: 609652 - RNA, 21 nt, Escherichia coli CFT073
uucacaaagacgccaucaauu

SEQ ID NO: 609653 - RNA, 15 nt, Escherichia coli CFT073
uucacaaaaacagua

SEQ ID NO: 609654 - RNA, 12 nt, Escherichia coli CFT073
uucacaaaaaca

SEQ ID NO: 609655 - RNA, 18 nt, Escherichia coli CFT073
uucacaggccgccaggca

SEQ ID NO: 609656 - RNA, 12 nt, Escherichia coli CFT073
uucacaucauca

SEQ ID NO: 609657 - RNA, 12 nt, Escherichia coli CFT073
uucacauacuca

SEQ ID NO: 609658 - RNA, 18 nt, Escherichia coli CFT073
uucacaugauaauaaaaa

SEQ ID NO: 609659 - RNA, 19 nt, Escherichia coli CFT073
uucacauccugccaggguc

SEQ ID NO: 609660 - RNA, 18 nt, Escherichia coli CFT073
uucaccaccgcaaagaaa

SEQ ID NO: 609661 - RNA, 15 nt, Escherichia coli CFT073
uucaccagguuuuug

SEQ ID NO: 609662 - RNA, 21 nt, Escherichia coli CFT073
uucaccagguuuuuggguuaa

SEQ ID NO: 609663 - RNA, 15 nt, Escherichia coli CFT073
uucacccaccggaau

SEQ ID NO: 609664 - RNA, 16 nt, Escherichia coli CFT073
uucaccagcaucgccg

SEQ ID NO: 609665 - RNA, 14 nt, Escherichia coli CFT073
uucaccagcgcacg

SEQ ID NO: 609666 - RNA, 16 nt, Escherichia coli CFT073
uucaugauacuccaca

SEQ ID NO: 609667 - RNA, 21 nt, Escherichia coli CFT073
uucaugauacuccacaucauu

SEQ ID NO: 609668 - RNA, 12 nt, Escherichia coli CFT073
uucaugaauaac

SEQ ID NO: 609669 - RNA, 14 nt, Escherichia coli CFT073
uucaucuuuaucaa

SEQ ID NO: 609670 - RNA, 20 nt, Escherichia coli CFT073
uucaucuuuauucauaauca

SEQ ID NO: 609671 - RNA, 13 nt, Escherichia coli CFT073
uucaucuucaucc

SEQ ID NO: 609672 - RNA, 19 nt, Escherichia coli CFT073
uucaucuucgucaaagaua

SEQ ID NO: 609673 - RNA, 17 nt, Escherichia coli CFT073
uucaucggcguuuucug

SEQ ID NO: 609674 - RNA, 18 nt, Escherichia coli CFT073
uucaucgcgcaaaauuuc

SEQ ID NO: 609675 - RNA, 15 nt, Escherichia coli CFT073
uucaucguaaucucu

SEQ ID NO: 609676 - RNA, 20 nt, Escherichia coli CFT073
uucaucguaguaguucaucc

SEQ ID NO: 609677 - RNA, 17 nt, Escherichia coli CFT073
uucaucggaaugcacag

SEQ ID NO: 609678 - RNA, 17 nt, Escherichia coli CFT073
uucaucgugcucgcuuu

SEQ ID NO: 609679 - RNA, 15 nt, Escherichia coli CFT073
uucaucucaucaaug

SEQ ID NO: 609680 - RNA, 20 nt, Escherichia coli CFT073
uucaucuacuacuggagaca

SEQ ID NO: 609681 - RNA, 16 nt, Escherichia coli CFT073
uucauccgauccucac

SEQ ID NO: 609682 - RNA, 17 nt, Escherichia coli CFT073
uucauccaggcacuggc

SEQ ID NO: 609683 - RNA, 17 nt, Escherichia coli CFT073
uucaucccucucaucca

SEQ ID NO: 609684 - RNA, 22 nt, Escherichia coli CFT073
uucauccccgcgcggaacauga

SEQ ID NO: 609685 - RNA, 20 nt, Escherichia coli CFT073
uucaucccgguuauuaaaac

SEQ ID NO: 609686 - RNA, 13 nt, Escherichia coli CFT073
uucaucgcccaca

SEQ ID NO: 609687 - RNA, 22 nt, Escherichia coli CFT073
uucauccuguaugacaaaagaa

SEQ ID NO: 609688 - RNA, 23 nt, Escherichia coli CFT073
uucaucgaacgggugauuucccc

SEQ ID NO: 609689 - RNA, 17 nt, Escherichia coli CFT073
uucauccuggcacagca

SEQ ID NO: 609690 - RNA, 18 nt, Escherichia coli CFT073
uucaucauuucauuugga

SEQ ID NO: 609691 - RNA, 16 nt, Escherichia coli CFT073
uucaucauacugauaa

SEQ ID NO: 609692 - RNA, 20 nt, Escherichia coli CFT073
uucaucaucgcuuucaaauc

SEQ ID NO: 609693 - RNA, 16 nt, Escherichia coli CFT073
uucaucaccagcucca

SEQ ID NO: 609694 - RNA, 17 nt, Escherichia coli CFT073
uucaucacgcacugcaa

SEQ ID NO: 609695 - RNA, 15 nt, Escherichia coli CFT073
uucauuaucuucuuu

SEQ ID NO: 609696 - RNA, 20 nt, Escherichia coli CFT073
uucauuaagaacuccugaaa

SEQ ID NO: 609697 - RNA, 14 nt, Escherichia coli CFT073
uucauuaauaacca

SEQ ID NO: 609698 - RNA, 15 nt, Escherichia coli CFT073
uucauuaaagccgcc

SEQ ID NO: 609699 - RNA, 16 nt, Escherichia coli CFT073
uucaugccauccgcau

SEQ ID NO: 609700 - RNA, 15 nt, Escherichia coli CFT073
uucaugcaaggaaaa

SEQ ID NO: 609701 - RNA, 23 nt, Escherichia coli CFT073
uucaugucgguuacuauccugaa

SEQ ID NO: 609702 - RNA, 15 nt, Escherichia coli CFT073
uucauguaacgcugc

SEQ ID NO: 609703 - RNA, 17 nt, Escherichia coli CFT073
uucaugcuauuccuuga

SEQ ID NO: 609704 - RNA, 15 nt, Escherichia coli CFT073
uucauggucagaaca

SEQ ID NO: 609705 - RNA, 23 nt, Escherichia coli CFT073
uucauugccggaggcgcugguaa

SEQ ID NO: 609706 - RNA, 22 nt, Escherichia coli CFT073
uucauugcguaaccaaauauca

SEQ ID NO: 609707 - RNA, 18 nt, Escherichia coli CFT073
uucauuguaaauaauuga

SEQ ID NO: 609708 - RNA, 13 nt, Escherichia coli CFT073
uucauuauucauu

SEQ ID NO: 609709 - RNA, 15 nt, Escherichia coli CFT073
uucauuccagucaau

SEQ ID NO: 609710 - RNA, 12 nt, Escherichia coli CFT073
uucauuuggaug

SEQ ID NO: 609711 - RNA, 22 nt, Escherichia coli CFT073
uucauuuggcguaguugcugcg

SEQ ID NO: 609712 - RNA, 16 nt, Escherichia coli CFT073
uucauuucacgcagcg

SEQ ID NO: 609713 - RNA, 22 nt, Escherichia coli CFT073
uucauuucgcgaaacugacagg

SEQ ID NO: 609714 - RNA, 21 nt, Escherichia coli CFT073
uucauuguucucccauaggau

SEQ ID NO: 609715 - RNA, 19 nt, Escherichia coli CFT073
uucaguucgucacaguuaa

SEQ ID NO: 609716 - RNA, 15 nt, Escherichia coli CFT073
uucaguccacaucuc

SEQ ID NO: 609717 - RNA, 20 nt, Escherichia coli CFT073
uucagugaaucucaggcaaa

SEQ ID NO: 609718 - RNA, 22 nt, Escherichia coli CFT073
uucagugaccgaaccuguuuuc

SEQ ID NO: 609719 - RNA, 14 nt, Escherichia coli CFT073
uucagucuuaaaaa

SEQ ID NO: 609720 - RNA, 14 nt, Escherichia coli CFT073
uucagugagcuguc

SEQ ID NO: 609721 - RNA, 18 nt, Escherichia coli CFT073
uucaguggguuaugaaac

SEQ ID NO: 609722 - RNA, 23 nt, Escherichia coli CFT073
uucauaaacacgguuuuucauug

SEQ ID NO: 609723 - RNA, 16 nt, Escherichia coli CFT073
uucauaaacacucaca

SEQ ID NO: 609724 - RNA, 15 nt, Escherichia coli CFT073
uucauaaagauauug

SEQ ID NO: 609725 - RNA, 15 nt, Escherichia coli CFT073
uucauaaagcuauua

SEQ ID NO: 609726 - RNA, 20 nt, Escherichia coli CFT073
uucauaaauuaccaccagcg

SEQ ID NO: 609727 - RNA, 21 nt, Escherichia coli CFT073
uucauacgcaaugugcagcag

SEQ ID NO: 609728 - RNA, 18 nt, Escherichia coli CFT073
uucauagcacauccugau

SEQ ID NO: 609729 - RNA, 22 nt, Escherichia coli CFT073
uucaucaagcugugccugaaua

SEQ ID NO: 609730 - RNA, 18 nt, Escherichia coli CFT073
uucauaugauaggcuuca

SEQ ID NO: 609731 - RNA, 22 nt, Escherichia coli CFT073
uucauauggcacuuucaucgcg

SEQ ID NO: 609732 - RNA, 19 nt, Escherichia coli CFT073
uucauauccggcauuuuuu

SEQ ID NO: 609733 - RNA, 16 nt, Escherichia coli CFT073
uucauauccgucauau

SEQ ID NO: 609734 - RNA, 15 nt, Escherichia coli CFT073
uucaguacguuuuua

SEQ ID NO: 609735 - RNA, 14 nt, Escherichia coli CFT073
uucaggugaccaaa

SEQ ID NO: 609736 - RNA, 16 nt, Escherichia coli CFT073
uucaggugaccaaaga

SEQ ID NO: 609737 - RNA, 22 nt, Escherichia coli CFT073
uucagguggccaaauucagugu

SEQ ID NO: 609738 - RNA, 22 nt, Escherichia coli CFT073
uucaguaaaaccauuaccaauc

SEQ ID NO: 609739 - RNA, 18 nt, Escherichia coli CFT073
uucaguaaauacugcgca

SEQ ID NO: 609740 - RNA, 21 nt, Escherichia coli CFT073
uucaggauauuuauauuuugc

SEQ ID NO: 609741 - RNA, 22 nt, Escherichia coli CFT073
uucagggcagcaauagcaaagc

SEQ ID NO: 609742 - RNA, 23 nt, Escherichia coli CFT073
uucagggcagcaauagcaaagcc

SEQ ID NO: 609743 - RNA, 15 nt, Escherichia coli CFT073
uucagggcagugcca

SEQ ID NO: 609744 - RNA, 18 nt, Escherichia coli CFT073
uucaggcaacaaaaaacc

SEQ ID NO: 609745 - RNA, 17 nt, Escherichia coli CFT073
uucaggccaauucacuu

SEQ ID NO: 609746 - RNA, 20 nt, Escherichia coli CFT073
uucagcggugucugccaguc

SEQ ID NO: 609747 - RNA, 20 nt, Escherichia coli CFT073
uucagcgcccugccgaucuc

SEQ ID NO: 609748 - RNA, 21 nt, Escherichia coli CFT073
uucagcggcgcaacccccaca

SEQ ID NO: 609749 - RNA, 16 nt, Escherichia coli CFT073
uucagcgaaaaagucc

SEQ ID NO: 609750 - RNA, 16 nt, Escherichia coli CFT073
uucagcgccauaauca

SEQ ID NO: 609751 - RNA, 14 nt, Escherichia coli CFT073
uucagcgccagaaa

SEQ ID NO: 609752 - RNA, 22 nt, Escherichia coli CFT073
uucagcgauaccccuucucguc

SEQ ID NO: 609753 - RNA, 16 nt, Escherichia coli CFT073
uucagcgaucguuuuu

SEQ ID NO: 609754 - RNA, 20 nt, Escherichia coli CFT073
uucagcuuuuuagcgaucuc

SEQ ID NO: 609755 - RNA, 15 nt, Escherichia coli CFT073
uucagcuuccagaau

SEQ ID NO: 609756 - RNA, 17 nt, Escherichia coli CFT073
uucagcuuccagaaucc

SEQ ID NO: 609757 - RNA, 16 nt, Escherichia coli CFT073
uucaggaaauaaauaa

SEQ ID NO: 609758 - RNA, 16 nt, Escherichia coli CFT073
uucagcucaagaaucu

SEQ ID NO: 609759 - RNA, 17 nt, Escherichia coli CFT073
uucagcucagucgcaau

SEQ ID NO: 609760 - RNA, 14 nt, Escherichia coli CFT073
uuccaauaaauccc

SEQ ID NO: 609761 - RNA, 20 nt, Escherichia coli CFT073
uuccaagauuaaaggcacca

SEQ ID NO: 609762 - RNA, 13 nt, Escherichia coli CFT073
uuccaauauuaaa

SEQ ID NO: 609763 - RNA, 17 nt, Escherichia coli CFT073
uuccacauaaaguagcc

SEQ ID NO: 609764 - RNA, 17 nt, Escherichia coli CFT073
uuccacaccacuucauu

SEQ ID NO: 609765 - RNA, 21 nt, Escherichia coli CFT073
uuccagaaccugaggcaauaa

SEQ ID NO: 609766 - RNA, 17 nt, Escherichia coli CFT073
uuccacuuugcuuucag

SEQ ID NO: 609767 - RNA, 18 nt, Escherichia coli CFT073
uuccacggaauauuucac

SEQ ID NO: 609768 - RNA, 23 nt, Escherichia coli CFT073
uuccacgaaacgguguugagcaa

SEQ ID NO: 609769 - RNA, 20 nt, Escherichia coli CFT073
uuccaccagcggcugaauau

SEQ ID NO: 609770 - RNA, 16 nt, Escherichia coli CFT073
uuccagcagaccagca

SEQ ID NO: 609771 - RNA, 20 nt, Escherichia coli CFT073
uuccagcagaccagcaauaa

SEQ ID NO: 609772 - RNA, 22 nt, Escherichia coli CFT073
uuccagcagaccagcaauaacu

SEQ ID NO: 609773 - RNA, 16 nt, Escherichia coli CFT073
uuccagcauuucuucc

SEQ ID NO: 609774 - RNA, 13 nt, Escherichia coli CFT073
uuccagcauuugu

SEQ ID NO: 609775 - RNA, 16 nt, Escherichia coli CFT073
uuccagaccuaaaaau

SEQ ID NO: 609776 - RNA, 18 nt, Escherichia coli CFT073
uuccagacggaugacaaa

SEQ ID NO: 609777 - RNA, 20 nt, Escherichia coli CFT073
uuccagaauauguucgcuua

SEQ ID NO: 609778 - RNA, 22 nt, Escherichia coli CFT073
uuccagaaugccucaaucagcg

SEQ ID NO: 609779 - RNA, 19 nt, Escherichia coli CFT073
uuccagcaaacgcacuuuu

SEQ ID NO: 609780 - RNA, 12 nt, Escherichia coli CFT073
uuccaggcagcc

SEQ ID NO: 609781 - RNA, 13 nt, Escherichia coli CFT073
uuccaggcagcca

SEQ ID NO: 609782 - RNA, 20 nt, Escherichia coli CFT073
uuccagcuucgcuaccugag

SEQ ID NO: 609783 - RNA, 12 nt, Escherichia coli CFT073
uuccagcucuua

SEQ ID NO: 609784 - RNA, 21 nt, Escherichia coli CFT073
uuccagcucuucuacauuucu

SEQ ID NO: 609785 - RNA, 17 nt, Escherichia coli CFT073
uuccagcugcacgccac

SEQ ID NO: 609786 - RNA, 21 nt, Escherichia coli CFT073
uuccagcuguaccagcaacug

SEQ ID NO: 609787 - RNA, 14 nt, Escherichia coli CFT073
uuccagcugugcca

SEQ ID NO: 609788 - RNA, 12 nt, Escherichia coli CFT073
uuccagcuucag

SEQ ID NO: 609789 - RNA, 14 nt, Escherichia coli CFT073
uuccagccagaaau

SEQ ID NO: 609790 - RNA, 22 nt, Escherichia coli CFT073
uuccagcguuaauuuccucuuc

SEQ ID NO: 609791 - RNA, 12 nt, Escherichia coli CFT073
uuccagcggcag

SEQ ID NO: 609792 - RNA, 15 nt, Escherichia coli CFT073
uuccagcggcaggcc

SEQ ID NO: 609793 - RNA, 12 nt, Escherichia coli CFT073
uuccagcggcau

SEQ ID NO: 609794 - RNA, 23 nt, Escherichia coli CFT073
uuccauaaucgacucccgcgccg

SEQ ID NO: 609795 - RNA, 16 nt, Escherichia coli CFT073
uuccauaaucgccuga

SEQ ID NO: 609796 - RNA, 18 nt, Escherichia coli CFT073
uuccauaccaaccaugua

SEQ ID NO: 609797 - RNA, 18 nt, Escherichia coli CFT073
uuccauauguucccuuaa

SEQ ID NO: 609798 - RNA, 18 nt, Escherichia coli CFT073
uuccaucgcgcuuagcaa

SEQ ID NO: 609799 - RNA, 23 nt, Escherichia coli CFT073
uuccaguuaccgccggcuucauc

SEQ ID NO: 609800 - RNA, 23 nt, Escherichia coli CFT073
uuccaguggcauuuucugcccgu

SEQ ID NO: 609801 - RNA, 22 nt, Escherichia coli CFT073
uuccaguguuuccggaauuaaa

SEQ ID NO: 609802 - RNA, 18 nt, Escherichia coli CFT073
uuccaguuccggcauuaa

SEQ ID NO: 609803 - RNA, 22 nt, Escherichia coli CFT073
uuccaguucgcuggcauugcca

SEQ ID NO: 609804 - RNA, 20 nt, Escherichia coli CFT073
uuccaguuugcguucaauac

SEQ ID NO: 609805 - RNA, 18 nt, Escherichia coli CFT073
uuccaguuugcucaaauc

SEQ ID NO: 609806 - RNA, 22 nt, Escherichia coli CFT073
uuccaggcuggcaggccucaug

SEQ ID NO: 609807 - RNA, 14 nt, Escherichia coli CFT073
uuccagguaagcaa

SEQ ID NO: 609808 - RNA, 21 nt, Escherichia coli CFT073
uuccagguuaugguugaacac

SEQ ID NO: 609809 - RNA, 22 nt, Escherichia coli CFT073
uuccagggccucuccuuuacca

SEQ ID NO: 609810 - RNA, 17 nt, Escherichia coli CFT073
uuccaggucaaucccag

SEQ ID NO: 609811 - RNA, 21 nt, Escherichia coli CFT073
uuccaguagcacaaucaaauc

SEQ ID NO: 609812 - RNA, 19 nt, Escherichia coli CFT073
uuccaguaaguuauguauu

SEQ ID NO: 609813 - RNA, 16 nt, Escherichia coli CFT073
uucccuuguugugcca

SEQ ID NO: 609814 - RNA, 15 nt, Escherichia coli CFT073
uucccuuucagauau

SEQ ID NO: 609815 - RNA, 19 nt, Escherichia coli CFT073
uucccugccugacagacca

SEQ ID NO: 609816 - RNA, 18 nt, Escherichia coli CFT073
uucccuacgccuaccacc

SEQ ID NO: 609817 - RNA, 21 nt, Escherichia coli CFT073
uucccuacgcgauaaaaaacc

SEQ ID NO: 609818 - RNA, 17 nt, Escherichia coli CFT073
uucccuacucucgcaug

SEQ ID NO: 609819 - RNA, 20 nt, Escherichia coli CFT073
uucccguccacugcgagaaa

SEQ ID NO: 609820 - RNA, 13 nt, Escherichia coli CFT073
uucccgugcugcu

SEQ ID NO: 609821 - RNA, 21 nt, Escherichia coli CFT073
uucccgggucgcgacugccag

SEQ ID NO: 609822 - RNA, 22 nt, Escherichia coli CFT073
uucccggucaguagaauaaucu

SEQ ID NO: 609823 - RNA, 17 nt, Escherichia coli CFT073
uucccggauggcaacag

SEQ ID NO: 609824 - RNA, 18 nt, Escherichia coli CFT073
uucccggauggcaacagc

SEQ ID NO: 609825 - RNA, 14 nt, Escherichia coli CFT073
uucccggccaaagc

SEQ ID NO: 609826 - RNA, 17 nt, Escherichia coli CFT073
uucccgcuccaaaauuu

SEQ ID NO: 609827 - RNA, 23 nt, Escherichia coli CFT073
uucccggaacaaaugaaagcagc

SEQ ID NO: 609828 - RNA, 14 nt, Escherichia coli CFT073
uucccggaauaauu

SEQ ID NO: 609829 - RNA, 13 nt, Escherichia coli CFT073
uuccgccuccgcu

SEQ ID NO: 609830 - RNA, 19 nt, Escherichia coli CFT073
uuccgcgucaaucugcccg

SEQ ID NO: 609831 - RNA, 20 nt, Escherichia coli CFT073
uuccgcgucaaucugcccga

SEQ ID NO: 609832 - RNA, 20 nt, Escherichia coli CFT073
uuccggaguaaugaaaccga

SEQ ID NO: 609833 - RNA, 22 nt, Escherichia coli CFT073
uuccgacugggccuuucgcuua

SEQ ID NO: 609834 - RNA, 13 nt, Escherichia coli CFT073
uuccgacaccgcc

SEQ ID NO: 609835 - RNA, 14 nt, Escherichia coli CFT073
uuccgacaccgccu

SEQ ID NO: 609836 - RNA, 19 nt, Escherichia coli CFT073
uuccgcaauagucauuaaa

SEQ ID NO: 609837 - RNA, 23 nt, Escherichia coli CFT073
uuccgcaaacaggcgcagaacuu

SEQ ID NO: 609838 - RNA, 23 nt, Escherichia coli CFT073
uuccgcaaagcccaucaccgcca

SEQ ID NO: 609839 - RNA, 19 nt, Escherichia coli CFT073
uucccagagcuuuugccau

SEQ ID NO: 609840 - RNA, 12 nt, Escherichia coli CFT073
uucccauaccuu

SEQ ID NO: 609841 - RNA, 17 nt, Escherichia coli CFT073
uuccccggaugaguaca

SEQ ID NO: 609842 - RNA, 23 nt, Escherichia coli CFT073
uuccccuguaacgagaaguuuuu

SEQ ID NO: 609843 - RNA, 12 nt, Escherichia coli CFT073
uucccccacagc

SEQ ID NO: 609844 - RNA, 14 nt, Escherichia coli CFT073
uucccccaccgccg

SEQ ID NO: 609845 - RNA, 17 nt, Escherichia coli CFT073
uuccccccacaaucagc

SEQ ID NO: 609846 - RNA, 19 nt, Escherichia coli CFT073
uucccgacacacugcgccg

SEQ ID NO: 609847 - RNA, 11 nt, Escherichia coli CFT073
uucccgagcgg

SEQ ID NO: 609848 - RNA, 17 nt, Escherichia coli CFT073
uucccgauaagggagca

SEQ ID NO: 609849 - RNA, 23 nt, Escherichia coli CFT073
uucccgagcggccaaagggagca

SEQ ID NO: 609850 - RNA, 16 nt, Escherichia coli CFT073
uucccaacugaaagaa

SEQ ID NO: 609851 - RNA, 23 nt, Escherichia coli CFT073
uucccaaagaucaacugccgccu

SEQ ID NO: 609852 - RNA, 14 nt, Escherichia coli CFT073
uucccaacaacagc

SEQ ID NO: 609853 - RNA, 17 nt, Escherichia coli CFT073
uucccaacaacagcgcg

SEQ ID NO: 609854 - RNA, 15 nt, Escherichia coli CFT073
uuccauuucaucgcc

SEQ ID NO: 609855 - RNA, 13 nt, Escherichia coli CFT073
uuccauucgcugc

SEQ ID NO: 609856 - RNA, 18 nt, Escherichia coli CFT073
uuccauucuccgcucuuc

SEQ ID NO: 609857 - RNA, 21 nt, Escherichia coli CFT073
uuccauucuccgcucuucauc

SEQ ID NO: 609858 - RNA, 14 nt, Escherichia coli CFT073
uuccauucaaggac

SEQ ID NO: 609859 - RNA, 16 nt, Escherichia coli CFT073
uuccauucaaggacaa

SEQ ID NO: 609860 - RNA, 13 nt, Escherichia coli CFT073
uuccauugagaaa

SEQ ID NO: 609861 - RNA, 17 nt, Escherichia coli CFT073
uuccaucuuuccucacu

SEQ ID NO: 609862 - RNA, 19 nt, Escherichia coli CFT073
uuccaucucgccauccuua

SEQ ID NO: 609863 - RNA, 19 nt, Escherichia coli CFT073
uuccaugcuaugcgccacg

SEQ ID NO: 609864 - RNA, 18 nt, Escherichia coli CFT073
uucgagcuggaagccaca

SEQ ID NO: 609865 - RNA, 15 nt, Escherichia coli CFT073
uucgagguaauccag

SEQ ID NO: 609866 - RNA, 12 nt, Escherichia coli CFT073
uucgacuucauc

SEQ ID NO: 609867 - RNA, 16 nt, Escherichia coli CFT073
uucgagagaauuaacc

SEQ ID NO: 609868 - RNA, 23 nt, Escherichia coli CFT073
uucgagagaauuaaccagaaaua

SEQ ID NO: 609869 - RNA, 19 nt, Escherichia coli CFT073
uucgacgcgugcagaguca

SEQ ID NO: 609870 - RNA, 17 nt, Escherichia coli CFT073
uucgacggcaccaaaaa

SEQ ID NO: 609871 - RNA, 11 nt, Escherichia coli CFT073
uucgaagcugu

SEQ ID NO: 609872 - RNA, 12 nt, Escherichia coli CFT073
uucgaagaaaaa

SEQ ID NO: 609873 - RNA, 14 nt, Escherichia coli CFT073
uucgaagguaaaag

SEQ ID NO: 609874 - RNA, 18 nt, Escherichia coli CFT073
uucgaaucuucugaagca

SEQ ID NO: 609875 - RNA, 14 nt, Escherichia coli CFT073
uucgacaauaauca

SEQ ID NO: 609876 - RNA, 20 nt, Escherichia coli CFT073
uucgacagcguuucgccgcc

SEQ ID NO: 609877 - RNA, 20 nt, Escherichia coli CFT073
uucgaccaggucgccagugg

SEQ ID NO: 609878 - RNA, 17 nt, Escherichia coli CFT073
uucgauuuguucuggug

SEQ ID NO: 609879 - RNA, 15 nt, Escherichia coli CFT073
uucgcaaaaaaccau

SEQ ID NO: 609880 - RNA, 16 nt, Escherichia coli CFT073
uucgauucccagcuuu

SEQ ID NO: 609881 - RNA, 14 nt, Escherichia coli CFT073
uucgauugcacaaa

SEQ ID NO: 609882 - RNA, 20 nt, Escherichia coli CFT073
uucgcacaccgcugacuuuc

SEQ ID NO: 609883 - RNA, 23 nt, Escherichia coli CFT073
uucgauaaacucaaucaggcuau

SEQ ID NO: 609884 - RNA, 19 nt, Escherichia coli CFT073
uucgauaacuguuaaauaa

SEQ ID NO: 609885 - RNA, 14 nt, Escherichia coli CFT073
uucgauuaacuaaa

SEQ ID NO: 609886 - RNA, 16 nt, Escherichia coli CFT073
uucgauggugaugagc

SEQ ID NO: 609887 - RNA, 20 nt, Escherichia coli CFT073
uucgaugcguaccauuucuu

SEQ ID NO: 609888 - RNA, 23 nt, Escherichia coli CFT073
uucgaugaugccggaaucaacca

SEQ ID NO: 609889 - RNA, 19 nt, Escherichia coli CFT073
uucgaugaugccggaauca

SEQ ID NO: 609890 - RNA, 13 nt, Escherichia coli CFT073
uucgccagcucca

SEQ ID NO: 609891 - RNA, 19 nt, Escherichia coli CFT073
uucgccaggucagagagcc

SEQ ID NO: 609892 - RNA, 12 nt, Escherichia coli CFT073
uucgccagucuc

SEQ ID NO: 609893 - RNA, 13 nt, Escherichia coli CFT073
uucgccaguuuuu

SEQ ID NO: 609894 - RNA, 20 nt, Escherichia coli CFT073
uucgccaaaugucaccagcc

SEQ ID NO: 609895 - RNA, 12 nt, Escherichia coli CFT073
uucgccacagcg

SEQ ID NO: 609896 - RNA, 14 nt, Escherichia coli CFT073
uucgcaucgcuuuu

SEQ ID NO: 609897 - RNA, 13 nt, Escherichia coli CFT073
uucgcagcugcag

SEQ ID NO: 609898 - RNA, 18 nt, Escherichia coli CFT073
uucgccauaaaacagcag

SEQ ID NO: 609899 - RNA, 21 nt, Escherichia coli CFT073
uucgccauguuuggcaaaaga

SEQ ID NO: 609900 - RNA, 15 nt, Escherichia coli CFT073
uucgcccgccagcgu

SEQ ID NO: 609901 - RNA, 14 nt, Escherichia coli CFT073
uucgccucgcuuuu

SEQ ID NO: 609902 - RNA, 13 nt, Escherichia coli CFT073
uucgccgguuuuu

SEQ ID NO: 609903 - RNA, 23 nt, Escherichia coli CFT073
uucgccgcagcaucgucaucauu

SEQ ID NO: 609904 - RNA, 12 nt, Escherichia coli CFT073
uucgcccugcag

SEQ ID NO: 609905 - RNA, 19 nt, Escherichia coli CFT073
uucgccgccagauccuggc

SEQ ID NO: 609906 - RNA, 15 nt, Escherichia coli CFT073
uucgcuuaacucacc

SEQ ID NO: 609907 - RNA, 14 nt, Escherichia coli CFT073
uucgcugccacacc

SEQ ID NO: 609908 - RNA, 16 nt, Escherichia coli CFT073
uucgcugguaccuguc

SEQ ID NO: 609909 - RNA, 23 nt, Escherichia coli CFT073
uucgcuccagccugcgucagcua

SEQ ID NO: 609910 - RNA, 20 nt, Escherichia coli CFT073
uucggacauguuuuccagca

SEQ ID NO: 609911 - RNA, 17 nt, Escherichia coli CFT073
uucggacguuugccaug

SEQ ID NO: 609912 - RNA, 11 nt, Escherichia coli CFT073
uucgcuuuuau

SEQ ID NO: 609913 - RNA, 17 nt, Escherichia coli CFT073
uucgcuuuucaccgccu

SEQ ID NO: 609914 - RNA, 17 nt, Escherichia coli CFT073
uucgcuuucacucagug

SEQ ID NO: 609915 - RNA, 18 nt, Escherichia coli CFT073
uucgcuugaucuuccuga

SEQ ID NO: 609916 - RNA, 15 nt, Escherichia coli CFT073
uucgcuuucaagcuu

SEQ ID NO: 609917 - RNA, 14 nt, Escherichia coli CFT073
uucgcuuucacuca

SEQ ID NO: 609918 - RNA, 16 nt, Escherichia coli CFT073
uucgccuuucaguuca

SEQ ID NO: 609919 - RNA, 18 nt, Escherichia coli CFT073
uucgccuuugauuuucag

SEQ ID NO: 609920 - RNA, 22 nt, Escherichia coli CFT073
uucgcgcagucgggugcugccg

SEQ ID NO: 609921 - RNA, 15 nt, Escherichia coli CFT073
uucgcgacaucgccc

SEQ ID NO: 609922 - RNA, 13 nt, Escherichia coli CFT073
uucgcgaggagcg

SEQ ID NO: 609923 - RNA, 21 nt, Escherichia coli CFT073
uucgcguuuaaacucugcgcu

SEQ ID NO: 609924 - RNA, 20 nt, Escherichia coli CFT073
uucgcgucaaucacacugac

SEQ ID NO: 609925 - RNA, 14 nt, Escherichia coli CFT073
uucgcggcaaacug

SEQ ID NO: 609926 - RNA, 20 nt, Escherichia coli CFT073
uuccuuuucgcauguaacug

SEQ ID NO: 609927 - RNA, 18 nt, Escherichia coli CFT073
uucgaaacagaaauacca

SEQ ID NO: 609928 - RNA, 13 nt, Escherichia coli CFT073
uuccuucaacccg

SEQ ID NO: 609929 - RNA, 15 nt, Escherichia coli CFT073
uuccuucacauccau

SEQ ID NO: 609930 - RNA, 15 nt, Escherichia coli CFT073
uuccuucagcagcag

SEQ ID NO: 609931 - RNA, 16 nt, Escherichia coli CFT073
uuccuucgggaagccu

SEQ ID NO: 609932 - RNA, 17 nt, Escherichia coli CFT073
uuccuucgggaagccuu

SEQ ID NO: 609933 - RNA, 13 nt, Escherichia coli CFT073
uuccuuccagaaa

SEQ ID NO: 609934 - RNA, 16 nt, Escherichia coli CFT073
uuccuucgcugaauau

SEQ ID NO: 609935 - RNA, 15 nt, Escherichia coli CFT073
uuccuugaaaaagag

SEQ ID NO: 609936 - RNA, 17 nt, Escherichia coli CFT073
uuccuuguuuaaggaaa

SEQ ID NO: 609937 - RNA, 18 nt, Escherichia coli CFT073
uuccuuaugcugcuuaca

SEQ ID NO: 609938 - RNA, 21 nt, Escherichia coli CFT073
uuccuuaagccagcgcccguu

SEQ ID NO: 609939 - RNA, 17 nt, Escherichia coli CFT073
uuccuguuucacgccca

SEQ ID NO: 609940 - RNA, 15 nt, Escherichia coli CFT073
uuccugcacaaugcc

SEQ ID NO: 609941 - RNA, 23 nt, Escherichia coli CFT073
uuccugauaaggaucuggauaaa

SEQ ID NO: 609942 - RNA, 21 nt, Escherichia coli CFT073
uuccugcuggcuguaaaauua

SEQ ID NO: 609943 - RNA, 22 nt, Escherichia coli CFT073
uuccugcggagcaaccugcacg

SEQ ID NO: 609944 - RNA, 15 nt, Escherichia coli CFT073
uuccuacaagagguc

SEQ ID NO: 609945 - RNA, 17 nt, Escherichia coli CFT073
uuccuacaagaggucaa

SEQ ID NO: 609946 - RNA, 12 nt, Escherichia coli CFT073
uuccucugcccu

SEQ ID NO: 609947 - RNA, 22 nt, Escherichia coli CFT073
uuccugaacguguguuucgaua

SEQ ID NO: 609948 - RNA, 21 nt, Escherichia coli CFT073
uuccgugguuugcgcauucag

SEQ ID NO: 609949 - RNA, 20 nt, Escherichia coli CFT073
uuccgggguaaauuucuucc

SEQ ID NO: 609950 - RNA, 17 nt, Escherichia coli CFT073
uuccggguuuucaacug

SEQ ID NO: 609951 - RNA, 20 nt, Escherichia coli CFT073
uuccgguuugcguugccuga

SEQ ID NO: 609952 - RNA, 15 nt, Escherichia coli CFT073
uuccguagcguuuuu

SEQ ID NO: 609953 - RNA, 16 nt, Escherichia coli CFT073
uuccgggcuauacacc

SEQ ID NO: 609954 - RNA, 19 nt, Escherichia coli CFT073
uuccgggcugccaucuuuu

SEQ ID NO: 609955 - RNA, 22 nt, Escherichia coli CFT073
uuccggaguaaugaaaccgaau

SEQ ID NO: 609956 - RNA, 17 nt, Escherichia coli CFT073
uuccggauacgguuuuu

SEQ ID NO: 609957 - RNA, 15 nt, Escherichia coli CFT073
uuccggcagaagcag

SEQ ID NO: 609958 - RNA, 17 nt, Escherichia coli CFT073
uuccggcggcacagcca

SEQ ID NO: 609959 - RNA, 17 nt, Escherichia coli CFT073
uuccggcguccaccugc

SEQ ID NO: 609960 - RNA, 21 nt, Escherichia coli CFT073
uuccggcuuaaugcacggcag

SEQ ID NO: 609961 - RNA, 14 nt, Escherichia coli CFT073
uuuaaaaaaauuaa

SEQ ID NO: 609962 - RNA, 18 nt, Escherichia coli CFT073
uuguuuuuuuaacauauc

SEQ ID NO: 609963 - RNA, 13 nt, Escherichia coli CFT073
uuuaaaaaugcca

SEQ ID NO: 609964 - RNA, 19 nt, Escherichia coli CFT073
uuuaaaaucuuugaaauaa

SEQ ID NO: 609965 - RNA, 12 nt, Escherichia coli CFT073
uuuaaacagaau

SEQ ID NO: 609966 - RNA, 14 nt, Escherichia coli CFT073
uuuaacuuuaauuu

SEQ ID NO: 609967 - RNA, 13 nt, Escherichia coli CFT073
uuuaagccauuaa

SEQ ID NO: 609968 - RNA, 18 nt, Escherichia coli CFT073
uuuaaugauuuccaggau

SEQ ID NO: 609969 - RNA, 15 nt, Escherichia coli CFT073
uuuaaugcugucuca

SEQ ID NO: 609970 - RNA, 12 nt, Escherichia coli CFT073
uuuaaucaccug

SEQ ID NO: 609971 - RNA, 17 nt, Escherichia coli CFT073
uuuaaucccgugccugc

SEQ ID NO: 609972 - RNA, 11 nt, Escherichia coli CFT073
uuuaauauuac

SEQ ID NO: 609973 - RNA, 18 nt, Escherichia coli CFT073
uuuacauggcagaccaaa

SEQ ID NO: 609974 - RNA, 19 nt, Escherichia coli CFT073
uuuaccaccgucaauaaaa

SEQ ID NO: 609975 - RNA, 22 nt, Escherichia coli CFT073
uuuaccaccgucaauaaaaacg

SEQ ID NO: 609976 - RNA, 17 nt, Escherichia coli CFT073
uuuaccaaaggugacug

SEQ ID NO: 609977 - RNA, 20 nt, Escherichia coli CFT073
uuuacccaacucuuuacaga

SEQ ID NO: 609978 - RNA, 14 nt, Escherichia coli CFT073
uuuacccagcagca

SEQ ID NO: 609979 - RNA, 22 nt, Escherichia coli CFT073
uuuaccgaguccgccauuauua

SEQ ID NO: 609980 - RNA, 13 nt, Escherichia coli CFT073
uugugaugccacu

SEQ ID NO: 609981 - RNA, 14 nt, Escherichia coli CFT073
uugugggccugaua

SEQ ID NO: 609982 - RNA, 15 nt, Escherichia coli CFT073
uugugagcaugugca

SEQ ID NO: 609983 - RNA, 13 nt, Escherichia coli CFT073
uugugacaaacug

SEQ ID NO: 609984 - RNA, 21 nt, Escherichia coli CFT073
uugugacauggcuaugcguug

SEQ ID NO: 609985 - RNA, 17 nt, Escherichia coli CFT073
uuguuauaacucuuccc

SEQ ID NO: 609986 - RNA, 12 nt, Escherichia coli CFT073
uuguuauccauc

SEQ ID NO: 609987 - RNA, 12 nt, Escherichia coli CFT073
uugugguuuucu

SEQ ID NO: 609988 - RNA, 21 nt, Escherichia coli CFT073
uugugguccgcauucguucau

SEQ ID NO: 609989 - RNA, 20 nt, Escherichia coli CFT073
uugugucugauugccggaug

SEQ ID NO: 609990 - RNA, 13 nt, Escherichia coli CFT073
uuguugaacagac

SEQ ID NO: 609991 - RNA, 23 nt, Escherichia coli CFT073
uuguuaugcgaaauagcgccaua

SEQ ID NO: 609992 - RNA, 12 nt, Escherichia coli CFT073
uuguuauuuccg

SEQ ID NO: 609993 - RNA, 16 nt, Escherichia coli CFT073
uuguuuaugccagaug

SEQ ID NO: 609994 - RNA, 19 nt, Escherichia coli CFT073
uuguuuagauccauaucca

SEQ ID NO: 609995 - RNA, 18 nt, Escherichia coli CFT073
uuguugcgcugaaauaau

SEQ ID NO: 609996 - RNA, 19 nt, Escherichia coli CFT073
uuguagccacgucugccac

SEQ ID NO: 609997 - RNA, 14 nt, Escherichia coli CFT073
uuguagauuuugca

SEQ ID NO: 609998 - RNA, 17 nt, Escherichia coli CFT073
uuguaggccugauaaga

SEQ ID NO: 609999 - RNA, 19 nt, Escherichia coli CFT073
uuguagugauccugcauac

SEQ ID NO: 610000 - RNA, 16 nt, Escherichia coli CFT073
uuguaggucagguucu

SEQ ID NO: 610001 - RNA, 18 nt, Escherichia coli CFT073
uuguauucagacguccac

SEQ ID NO: 610002 - RNA, 12 nt, Escherichia coli CFT073
uuguauucaguu

SEQ ID NO: 610003 - RNA, 13 nt, Escherichia coli CFT073
uuguagaccagga

SEQ ID NO: 610004 - RNA, 22 nt, Escherichia coli CFT073
uuguaacgucgcaucuggucag

SEQ ID NO: 610005 - RNA, 19 nt, Escherichia coli CFT073
uuguaaaugcugcuccagc

SEQ ID NO: 610006 - RNA, 15 nt, Escherichia coli CFT073
uuguaaauugcagua

SEQ ID NO: 610007 - RNA, 19 nt, Escherichia coli CFT073
uuguaaagaccauugaugc

SEQ ID NO: 610008 - RNA, 17 nt, Escherichia coli CFT073
uuguccgucugaaaacu

SEQ ID NO: 610009 - RNA, 20 nt, Escherichia coli CFT073
uugucgcccuguaauucgua

SEQ ID NO: 610010 - RNA, 14 nt, Escherichia coli CFT073
uugucgauuuccau

SEQ ID NO: 610011 - RNA, 23 nt, Escherichia coli CFT073
uugucuggcauaaaagggcagca

SEQ ID NO: 610012 - RNA, 16 nt, Escherichia coli CFT073
uugucugaacguucug

SEQ ID NO: 610013 - RNA, 14 nt, Escherichia coli CFT073
uugugaaaauaacg

SEQ ID NO: 610014 - RNA, 19 nt, Escherichia coli CFT073
uugguaaagcaauaaacca

SEQ ID NO: 610015 - RNA, 18 nt, Escherichia coli CFT073
uugguaaaugcgaauagc

SEQ ID NO: 610016 - RNA, 17 nt, Escherichia coli CFT073
uugguccgaucccugca

SEQ ID NO: 610017 - RNA, 11 nt, Escherichia coli CFT073
uuggugcauag

SEQ ID NO: 610018 - RNA, 15 nt, Escherichia coli CFT073
uugguuuuauccagu

SEQ ID NO: 610019 - RNA, 17 nt, Escherichia coli CFT073
uuggugaaugccugauc

SEQ ID NO: 610020 - RNA, 15 nt, Escherichia coli CFT073
uuggcuuuauaaauu

SEQ ID NO: 610021 - RNA, 12 nt, Escherichia coli CFT073
uuggcuggcccu

SEQ ID NO: 610022 - RNA, 20 nt, Escherichia coli CFT073
uuggcugggguacgaggauu

SEQ ID NO: 610023 - RNA, 18 nt, Escherichia coli CFT073
uuggccugaauacacauc

SEQ ID NO: 610024 - RNA, 23 nt, Escherichia coli CFT073
uuggccccauaaucaaugccagg

SEQ ID NO: 610025 - RNA, 14 nt, Escherichia coli CFT073
uuggcaccaucccu

SEQ ID NO: 610026 - RNA, 14 nt, Escherichia coli CFT073
uugcuucuguuuuc

SEQ ID NO: 610027 - RNA, 18 nt, Escherichia coli CFT073
uugcuucuuacuauauaa

SEQ ID NO: 610028 - RNA, 22 nt, Escherichia coli CFT073
uugcuucuuacuauauaaaccu

SEQ ID NO: 610029 - RNA, 12 nt, Escherichia coli CFT073
uugcuucuuugc

SEQ ID NO: 610030 - RNA, 15 nt, Escherichia coli CFT073
uugcuugcaauauac

SEQ ID NO: 610031 - RNA, 14 nt, Escherichia coli CFT073
uugcugguuuugua

SEQ ID NO: 610032 - RNA, 20 nt, Escherichia coli CFT073
uugcugaaaaggcuaaaauu

SEQ ID NO: 610033 - RNA, 19 nt, Escherichia coli CFT073
uugcugcgcggaauuuguc

SEQ ID NO: 610034 - RNA, 12 nt, Escherichia coli CFT073
uugcugcugccg

SEQ ID NO: 610035 - RNA, 22 nt, Escherichia coli CFT073
uugcuggcaaucaccucuuugu

SEQ ID NO: 610036 - RNA, 20 nt, Escherichia coli CFT073
uuggcaccaucccuaugcau

SEQ ID NO: 610037 - RNA, 18 nt, Escherichia coli CFT073
uuggcaaucacaucacca

SEQ ID NO: 610038 - RNA, 19 nt, Escherichia coli CFT073
uugcucgaagaguuccagc

SEQ ID NO: 610039 - RNA, 20 nt, Escherichia coli CFT073
uugcucgaagaguuccagcg

SEQ ID NO: 610040 - RNA, 21 nt, Escherichia coli CFT073
uugcucggcaaggccaauacc

SEQ ID NO: 610041 - RNA, 15 nt, Escherichia coli CFT073
uugcuaagcucucag

SEQ ID NO: 610042 - RNA, 19 nt, Escherichia coli CFT073
uugcuauagcucauaaccu

SEQ ID NO: 610043 - RNA, 23 nt, Escherichia coli CFT073
uugcuaugguccguucucaccaa

SEQ ID NO: 610044 - RNA, 19 nt, Escherichia coli CFT073
uugcggaaacugucaauaa

SEQ ID NO: 610045 - RNA, 19 nt, Escherichia coli CFT073
uugcgccaucaugaucaga

SEQ ID NO: 610046 - RNA, 20 nt, Escherichia coli CFT073
uugcggaauaugcugaauua

SEQ ID NO: 610047 - RNA, 15 nt, Escherichia coli CFT073
uugcgccacgcucug

SEQ ID NO: 610048 - RNA, 12 nt, Escherichia coli CFT073
uugcgccagcgc

SEQ ID NO: 610049 - RNA, 18 nt, Escherichia coli CFT073
uugcgggccaaagaccag

SEQ ID NO: 610050 - RNA, 15 nt, Escherichia coli CFT073
uugccugugcaaccu

SEQ ID NO: 610051 - RNA, 18 nt, Escherichia coli CFT073
uugccugugcaaccuuuu

SEQ ID NO: 610052 - RNA, 19 nt, Escherichia coli CFT073
uugccugugcaaccuuuuc

SEQ ID NO: 610053 - RNA, 19 nt, Escherichia coli CFT073
uugccugaucgcgcaaaca

SEQ ID NO: 610054 - RNA, 10 nt, Escherichia coli CFT073
uugccugaug

SEQ ID NO: 610055 - RNA, 19 nt, Escherichia coli CFT073
uugccugaugcgcugcgcu

SEQ ID NO: 610056 - RNA, 22 nt, Escherichia coli CFT073
uugccuggcauguuaugaauau

SEQ ID NO: 610057 - RNA, 14 nt, Escherichia coli CFT073
uugcgcaugacaca

SEQ ID NO: 610058 - RNA, 16 nt, Escherichia coli CFT073
uugcgccaaucccguc

SEQ ID NO: 610059 - RNA, 12 nt, Escherichia coli CFT073
uugccauaucuu

SEQ ID NO: 610060 - RNA, 21 nt, Escherichia coli CFT073
uugccaugcauauccaggcua

SEQ ID NO: 610061 - RNA, 18 nt, Escherichia coli CFT073
uugccauuacuacaaaca

SEQ ID NO: 610062 - RNA, 19 nt, Escherichia coli CFT073
uugccauuacuacaaacaa

SEQ ID NO: 610063 - RNA, 18 nt, Escherichia coli CFT073
uugccgggcgugcugccu

SEQ ID NO: 610064 - RNA, 14 nt, Escherichia coli CFT073
uugccggucuuucu

SEQ ID NO: 610065 - RNA, 15 nt, Escherichia coli CFT073
uugccgucugccacu

SEQ ID NO: 610066 - RNA, 19 nt, Escherichia coli CFT073
uugccgucgaaaucggcaa

SEQ ID NO: 610067 - RNA, 18 nt, Escherichia coli CFT073
uugccguaaucgccucca

SEQ ID NO: 610068 - RNA, 13 nt, Escherichia coli CFT073
uugccucccugca

SEQ ID NO: 610069 - RNA, 13 nt, Escherichia coli CFT073
uugccugaaaaau

SEQ ID NO: 610070 - RNA, 14 nt, Escherichia coli CFT073
uugccugaaaaaug

SEQ ID NO: 610071 - RNA, 13 nt, Escherichia coli CFT073
uugccugaauaca

SEQ ID NO: 610072 - RNA, 14 nt, Escherichia coli CFT073
uugcaguuguaauc

SEQ ID NO: 610073 - RNA, 22 nt, Escherichia coli CFT073
uugcagucucaugcgucaugag

SEQ ID NO: 610074 - RNA, 16 nt, Escherichia coli CFT073
uugcagguucugcucg

SEQ ID NO: 610075 - RNA, 14 nt, Escherichia coli CFT073
uugcagucccaucu

SEQ ID NO: 610076 - RNA, 22 nt, Escherichia coli CFT073
uugcauaaaugccgcaaugugc

SEQ ID NO: 610077 - RNA, 22 nt, Escherichia coli CFT073
uugcauaaugguggaguggccc

SEQ ID NO: 610078 - RNA, 18 nt, Escherichia coli CFT073
uugcaguauguaauuaaa

SEQ ID NO: 610079 - RNA, 19 nt, Escherichia coli CFT073
uugcaggucguccugcaaa

SEQ ID NO: 610080 - RNA, 14 nt, Escherichia coli CFT073
uugcaggaaaaacu

SEQ ID NO: 610081 - RNA, 17 nt, Escherichia coli CFT073
uugcaggcaaaucgcuc

SEQ ID NO: 610082 - RNA, 18 nt, Escherichia coli CFT073
uugcaggccauaugacac

SEQ ID NO: 610083 - RNA, 18 nt, Escherichia coli CFT073
uugcauagcggcgacuug

SEQ ID NO: 610084 - RNA, 20 nt, Escherichia coli CFT073
uugccaccgguacaaacauc

SEQ ID NO: 610085 - RNA, 16 nt, Escherichia coli CFT073
uugccacucaggcaaa

SEQ ID NO: 610086 - RNA, 14 nt, Escherichia coli CFT073
uugccagaacugcu

SEQ ID NO: 610087 - RNA, 13 nt, Escherichia coli CFT073
uugccagcaacug

SEQ ID NO: 610088 - RNA, 19 nt, Escherichia coli CFT073
uugccaggucgcuugccgc

SEQ ID NO: 610089 - RNA, 15 nt, Escherichia coli CFT073
uugccagccacacca

SEQ ID NO: 610090 - RNA, 19 nt, Escherichia coli CFT073
uugccagccaucgccugcu

SEQ ID NO: 610091 - RNA, 19 nt, Escherichia coli CFT073
uugccagcccuaaaaacag

SEQ ID NO: 610092 - RNA, 17 nt, Escherichia coli CFT073
uugccagcgagaagucg

SEQ ID NO: 610093 - RNA, 12 nt, Escherichia coli CFT073
uugccagcgcca

SEQ ID NO: 610094 - RNA, 21 nt, Escherichia coli CFT073
uugccagagcagcaacaagcc

SEQ ID NO: 610095 - RNA, 20 nt, Escherichia coli CFT073
uugcaaggaacgcugcauac

SEQ ID NO: 610096 - RNA, 18 nt, Escherichia coli CFT073
uugauuuuuuugauaaac

SEQ ID NO: 610097 - RNA, 21 nt, Escherichia coli CFT073
uugcaauaugguuauuaccaa

SEQ ID NO: 610098 - RNA, 13 nt, Escherichia coli CFT073
uugcaauuuuuau

SEQ ID NO: 610099 - RNA, 14 nt, Escherichia coli CFT073
uugcagcauucauc

SEQ ID NO: 610100 - RNA, 23 nt, Escherichia coli CFT073
uugcagccgucgcccacagucug

SEQ ID NO: 610101 - RNA, 22 nt, Escherichia coli CFT073
uugcagccguuuguucugcauc

SEQ ID NO: 610102 - RNA, 20 nt, Escherichia coli CFT073
uugcagcuccccacaccacc

SEQ ID NO: 610103 - RNA, 15 nt, Escherichia coli CFT073
uugaucuucucuuau

SEQ ID NO: 610104 - RNA, 20 nt, Escherichia coli CFT073
uugaugaagcuugagccgua

SEQ ID NO: 610105 - RNA, 14 nt, Escherichia coli CFT073
uugaugcacaccau

SEQ ID NO: 610106 - RNA, 22 nt, Escherichia coli CFT073
uugauuccccacgggacgcugc

SEQ ID NO: 610107 - RNA, 14 nt, Escherichia coli CFT073
uugaugccguucca

SEQ ID NO: 610108 - RNA, 16 nt, Escherichia coli CFT073
uugauucuguucagua

SEQ ID NO: 610109 - RNA, 22 nt, Escherichia coli CFT073
uugauuccugccugauucagca

SEQ ID NO: 610110 - RNA, 19 nt, Escherichia coli CFT073
uugauuguuuuaaauauug

SEQ ID NO: 610111 - RNA, 20 nt, Escherichia coli CFT073
uugagcaguuucgucaacuu

SEQ ID NO: 610112 - RNA, 13 nt, Escherichia coli CFT073
uugaguauuaaau

SEQ ID NO: 610113 - RNA, 21 nt, Escherichia coli CFT073
uugaucaagcaccgccauauu

SEQ ID NO: 610114 - RNA, 14 nt, Escherichia coli CFT073
uugauaaaaagacg

SEQ ID NO: 610115 - RNA, 23 nt, Escherichia coli CFT073
uugaguuugauuccugccugauu

SEQ ID NO: 610116 - RNA, 17 nt, Escherichia coli CFT073
uugaaacguuaugcacc

SEQ ID NO: 610117 - RNA, 19 nt, Escherichia coli CFT073
uugaacauaucagcgcaaa

SEQ ID NO: 610118 - RNA, 22 nt, Escherichia coli CFT073
uugaaauaauauugcuuauccc

SEQ ID NO: 610119 - RNA, 23 nt, Escherichia coli CFT073
uugaaacgaaaucuuguuuuuuu

SEQ ID NO: 610120 - RNA, 23 nt, Escherichia coli CFT073
uugaaacgaguggugucgucaaa

SEQ ID NO: 610121 - RNA, 17 nt, Escherichia coli CFT073
uucuuuguucuucuguu

SEQ ID NO: 610122 - RNA, 21 nt, Escherichia coli CFT073
uucuuugaaugacgaucaacc

SEQ ID NO: 610123 - RNA, 16 nt, Escherichia coli CFT073
uucuugcgucacaaau

SEQ ID NO: 610124 - RNA, 18 nt, Escherichia coli CFT073
uugaauuugguagaauuu

SEQ ID NO: 610125 - RNA, 16 nt, Escherichia coli CFT073
uugaauuuaaugcacu

SEQ ID NO: 610126 - RNA, 19 nt, Escherichia coli CFT073
uugaccuguacaagcaacu

SEQ ID NO: 610127 - RNA, 15 nt, Escherichia coli CFT073
uugacgccaaggagu

SEQ ID NO: 610128 - RNA, 18 nt, Escherichia coli CFT073
uugacgcgucuuaucagg

SEQ ID NO: 610129 - RNA, 21 nt, Escherichia coli CFT073
uugacgcgucuuaucaggccu

SEQ ID NO: 610130 - RNA, 14 nt, Escherichia coli CFT073
uugacuuuuaauuu

SEQ ID NO: 610131 - RNA, 18 nt, Escherichia coli CFT073
uugaauuccgaauuucau

SEQ ID NO: 610132 - RNA, 14 nt, Escherichia coli CFT073
uugaauugguccau

SEQ ID NO: 610133 - RNA, 12 nt, Escherichia coli CFT073
uugaacugguua

SEQ ID NO: 610134 - RNA, 15 nt, Escherichia coli CFT073
uugaacucugaaucg

SEQ ID NO: 610135 - RNA, 23 nt, Escherichia coli CFT073
uucuuacuauauaaaccuucugu

SEQ ID NO: 610136 - RNA, 17 nt, Escherichia coli CFT073
uucuggcuucccguagc

SEQ ID NO: 610137 - RNA, 15 nt, Escherichia coli CFT073
uucuguaauccauug

SEQ ID NO: 610138 - RNA, 15 nt, Escherichia coli CFT073
uucuucacccuuuuc

SEQ ID NO: 610139 - RNA, 23 nt, Escherichia coli CFT073
uucuucaaguguggccgccagug

SEQ ID NO: 610140 - RNA, 21 nt, Escherichia coli CFT073
uucuucaagccaggcuuuaaa

SEQ ID NO: 610141 - RNA, 17 nt, Escherichia coli CFT073
uucuucaagccaggcuu

SEQ ID NO: 610142 - RNA, 15 nt, Escherichia coli CFT073
uucuucaacaauuga

SEQ ID NO: 610143 - RNA, 24 nt, Escherichia coli CFT073
uucuucaacaccaacugccucguc

SEQ ID NO: 610144 - RNA, 13 nt, Escherichia coli CFT073
uucuucaaaaaua

SEQ ID NO: 610145 - RNA, 13 nt, Escherichia coli CFT073
uucuucaaaaaag

SEQ ID NO: 610146 - RNA, 12 nt, Escherichia coli CFT073
uucuucacugac

SEQ ID NO: 610147 - RNA, 14 nt, Escherichia coli CFT073
uucuucacugacgc

SEQ ID NO: 610148 - RNA, 22 nt, Escherichia coli CFT073
uucuucagcguccgggaaaucc

SEQ ID NO: 610149 - RNA, 12 nt, Escherichia coli CFT073
uucuucagcuuu

SEQ ID NO: 610150 - RNA, 15 nt, Escherichia coli CFT073
uucuuccacaccacu

SEQ ID NO: 610151 - RNA, 12 nt, Escherichia coli CFT073
uucuuccagcau

SEQ ID NO: 610152 - RNA, 21 nt, Escherichia coli CFT073
uucuuccagcaucgcccccau

SEQ ID NO: 610153 - RNA, 15 nt, Escherichia coli CFT073
uucuucaugcgucaa

SEQ ID NO: 610154 - RNA, 13 nt, Escherichia coli CFT073
uucuuccagcuuu

SEQ ID NO: 610155 - RNA, 20 nt, Escherichia coli CFT073
uucuggccaugcggcgagga

SEQ ID NO: 610156 - RNA, 14 nt, Escherichia coli CFT073
uucuggaugccauc

SEQ ID NO: 610157 - RNA, 12 nt, Escherichia coli CFT073
uucuggcuacac

SEQ ID NO: 610158 - RNA, 21 nt, Escherichia coli CFT073
uucuggcugacauaaacacca

SEQ ID NO: 610159 - RNA, 16 nt, Escherichia coli CFT073
uucuggccgcuucaga

SEQ ID NO: 610160 - RNA, 15 nt, Escherichia coli CFT073
uucugcugcuuuauc

SEQ ID NO: 610161 - RNA, 15 nt, Escherichia coli CFT073
uucugauucccugcc

SEQ ID NO: 610162 - RNA, 18 nt, Escherichia coli CFT073
uucugauaaaugaagaaa

SEQ ID NO: 610163 - RNA, 16 nt, Escherichia coli CFT073
uucugaccaaacugcg

SEQ ID NO: 610164 - RNA, 23 nt, Escherichia coli CFT073
uucugaccgggauuuucaacauc

SEQ ID NO: 610165 - RNA, 16 nt, Escherichia coli CFT073
uucucgaauuaauggu

SEQ ID NO: 610166 - RNA, 13 nt, Escherichia coli CFT073
uucucgccaccgg

SEQ ID NO: 610167 - RNA, 18 nt, Escherichia coli CFT073
uucucgccguggcuguug

SEQ ID NO: 610168 - RNA, 13 nt, Escherichia coli CFT073
uucucgucaauac

SEQ ID NO: 610169 - RNA, 21 nt, Escherichia coli CFT073
uucucgucaauacgacagcua

SEQ ID NO: 610170 - RNA, 16 nt, Escherichia coli CFT073
uucucguaaauucccc

SEQ ID NO: 610171 - RNA, 18 nt, Escherichia coli CFT073
uucucguaaauuccccac

SEQ ID NO: 610172 - RNA, 22 nt, Escherichia coli CFT073
uucucgugcuucgaaacagaaa

SEQ ID NO: 610173 - RNA, 17 nt, Escherichia coli CFT073
uucucguuggguugcca

SEQ ID NO: 610174 - RNA, 19 nt, Escherichia coli CFT073
uucugacacugccacuuuu

SEQ ID NO: 610175 - RNA, 21 nt, Escherichia coli CFT073
uucugacacugccacuuuuuc

SEQ ID NO: 610176 - RNA, 18 nt, Escherichia coli CFT073
uucggcaguuuuaccgcc

SEQ ID NO: 610177 - RNA, 16 nt, Escherichia coli CFT073
uucggcaggcuuugcu

SEQ ID NO: 610178 - RNA, 18 nt, Escherichia coli CFT073
uucggcagucacuuuuuu

SEQ ID NO: 610179 - RNA, 21 nt, Escherichia coli CFT073
uucgucccagucgucauccca

SEQ ID NO: 610180 - RNA, 16 nt, Escherichia coli CFT073
uucguccccaccagug

SEQ ID NO: 610181 - RNA, 19 nt, Escherichia coli CFT073
uucguccccaguuuuccau

SEQ ID NO: 610182 - RNA, 13 nt, Escherichia coli CFT073
uucgucuugcagg

SEQ ID NO: 610183 - RNA, 13 nt, Escherichia coli CFT073
uucgucgccauca

SEQ ID NO: 610184 - RNA, 17 nt, Escherichia coli CFT073
uucgucguaaucauaaa

SEQ ID NO: 610185 - RNA, 14 nt, Escherichia coli CFT073
uucguuccaggacu

SEQ ID NO: 610186 - RNA, 22 nt, Escherichia coli CFT073
uucguuaacaacaacuucuaau

SEQ ID NO: 610187 - RNA, 14 nt, Escherichia coli CFT073
uucuaggcuguguu

SEQ ID NO: 610188 - RNA, 20 nt, Escherichia coli CFT073
uucuaguucauguauuuuuu

SEQ ID NO: 610189 - RNA, 22 nt, Escherichia coli CFT073
uucuccuacaccccagccgguc

SEQ ID NO: 610190 - RNA, 13 nt, Escherichia coli CFT073
uucuccugucaug

SEQ ID NO: 610191 - RNA, 19 nt, Escherichia coli CFT073
uucuccacaccguugccgc

SEQ ID NO: 610192 - RNA, 19 nt, Escherichia coli CFT073
gcacguaggcgaucccagc

SEQ ID NO: 610193 - RNA, 18 nt, Escherichia coli CFT073
gcacgguuuuuccagcuc

SEQ ID NO: 610194 - RNA, 15 nt, Escherichia coli CFT073
gcacguaagcuggaa

SEQ ID NO: 610195 - RNA, 17 nt, Escherichia coli CFT073
gcacggaggcuccgccu

SEQ ID NO: 610196 - RNA, 18 nt, Escherichia coli CFT073
gcacggauaccgcacgcu

SEQ ID NO: 610197 - RNA, 22 nt, Escherichia coli CFT073
gcacggauucacaauuggcgca

SEQ ID NO: 610198 - RNA, 22 nt, Escherichia coli CFT073
gcacggaaagcagcauacccac

SEQ ID NO: 610199 - RNA, 20 nt, Escherichia coli CFT073
gcacgcucuguucugcgccu

SEQ ID NO: 610200 - RNA, 14 nt, Escherichia coli CFT073
gcacugacugacag

SEQ ID NO: 610201 - RNA, 20 nt, Escherichia coli CFT073
gcacugaaagagucgccagc

SEQ ID NO: 610202 - RNA, 21 nt, Escherichia coli CFT073
gcacucugaccgggaauauaa

SEQ ID NO: 610203 - RNA, 12 nt, Escherichia coli CFT073
gcacuccgccgc

SEQ ID NO: 610204 - RNA, 22 nt, Escherichia coli CFT073
gcacugcgcccgccagcaucgg

SEQ ID NO: 610205 - RNA, 21 nt, Escherichia coli CFT073
gcacugcgcgauaaucccaac

SEQ ID NO: 610206 - RNA, 17 nt, Escherichia coli CFT073
gcacuggcaaucgcccg

SEQ ID NO: 610207 - RNA, 23 nt, Escherichia coli CFT073
gcacugauuuuuuccaacaggcg

SEQ ID NO: 610208 - RNA, 17 nt, Escherichia coli CFT073
gcacugcaggcugaugg

SEQ ID NO: 610209 - RNA, 17 nt, Escherichia coli CFT073
gcacugccagccacagg

SEQ ID NO: 610210 - RNA, 14 nt, Escherichia coli CFT073
gcacuaccgcccga

SEQ ID NO: 610211 - RNA, 20 nt, Escherichia coli CFT073
gcacuaccuugcuucuuacu

SEQ ID NO: 610212 - RNA, 16 nt, Escherichia coli CFT073
gcacuauaucccucac

SEQ ID NO: 610213 - RNA, 14 nt, Escherichia coli CFT073
gcacguuuugcugg

SEQ ID NO: 610214 - RNA, 21 nt, Escherichia coli CFT073
gcacgucuuugccgcgcucuu

SEQ ID NO: 610215 - RNA, 16 nt, Escherichia coli CFT073
gcacguuacccgccgu

SEQ ID NO: 610216 - RNA, 16 nt, Escherichia coli CFT073
gcaccuuuaaccccag

SEQ ID NO: 610217 - RNA, 16 nt, Escherichia coli CFT073
gcacgaccggguuuuc

SEQ ID NO: 610218 - RNA, 14 nt, Escherichia coli CFT073
gcacgaccuugcca

SEQ ID NO: 610219 - RNA, 22 nt, Escherichia coli CFT073
gcacgaccuugccaaggucggg

SEQ ID NO: 610220 - RNA, 17 nt, Escherichia coli CFT073
gcaccuguguuguucug

SEQ ID NO: 610221 - RNA, 14 nt, Escherichia coli CFT073
gcacgaggugccac

SEQ ID NO: 610222 - RNA, 16 nt, Escherichia coli CFT073
gcacgaggugccacca

SEQ ID NO: 610223 - RNA, 23 nt, Escherichia coli CFT073
gcacgagugaguuaauuuuccug

SEQ ID NO: 610224 - RNA, 23 nt, Escherichia coli CFT073
gcacgaguguuacgccugccgca

SEQ ID NO: 610225 - RNA, 18 nt, Escherichia coli CFT073
gcacgcccaucgcgcccg

SEQ ID NO: 610226 - RNA, 18 nt, Escherichia coli CFT073
gcaccgugaccacccaug

SEQ ID NO: 610227 - RNA, 21 nt, Escherichia coli CFT073
gcaccgucaccgguucggaca

SEQ ID NO: 610228 - RNA, 22 nt, Escherichia coli CFT073
gcaccgguacacaaccgccgga

SEQ ID NO: 610229 - RNA, 21 nt, Escherichia coli CFT073
gcaccgggggguugccgccac

SEQ ID NO: 610230 - RNA, 13 nt, Escherichia coli CFT073
gcaccagcaacaa

SEQ ID NO: 610231 - RNA, 16 nt, Escherichia coli CFT073
gcaccagcggaaugca

SEQ ID NO: 610232 - RNA, 15 nt, Escherichia coli CFT073
gcaccagcuccggca

SEQ ID NO: 610233 - RNA, 18 nt, Escherichia coli CFT073
gcaccacgguuuuuugca

SEQ ID NO: 610234 - RNA, 21 nt, Escherichia coli CFT073
gcaccacuuguagaccaggau

SEQ ID NO: 610235 - RNA, 16 nt, Escherichia coli CFT073
gcaccagaacucccug

SEQ ID NO: 610236 - RNA, 21 nt, Escherichia coli CFT073
gcaccagaacucccuguuccu

SEQ ID NO: 610237 - RNA, 15 nt, Escherichia coli CFT073
gcaccagaucuucca

SEQ ID NO: 610238 - RNA, 16 nt, Escherichia coli CFT073
gcaccagaucuuccag

SEQ ID NO: 610239 - RNA, 14 nt, Escherichia coli CFT073
gcaccgccagcagc

SEQ ID NO: 610240 - RNA, 16 nt, Escherichia coli CFT073
gcaccgccagcaggaa

SEQ ID NO: 610241 - RNA, 16 nt, Escherichia coli CFT073
gcaccgccaaccagcg

SEQ ID NO: 610242 - RNA, 14 nt, Escherichia coli CFT073
gcaccgccgccagg

SEQ ID NO: 610243 - RNA, 18 nt, Escherichia coli CFT073
gcaccgcccugcaucaug

SEQ ID NO: 610244 - RNA, 15 nt, Escherichia coli CFT073
gcaaugaaacucaag

SEQ ID NO: 610245 - RNA, 12 nt, Escherichia coli CFT073
gcaaucugcuuc

SEQ ID NO: 610246 - RNA, 18 nt, Escherichia coli CFT073
gcaaucugcuucuuacca

SEQ ID NO: 610247 - RNA, 16 nt, Escherichia coli CFT073
gcaauggaccagaacg

SEQ ID NO: 610248 - RNA, 16 nt, Escherichia coli CFT073
gcaaugcguuccagca

SEQ ID NO: 610249 - RNA, 18 nt, Escherichia coli CFT073
gcaaucaccuuacaucaa

SEQ ID NO: 610250 - RNA, 22 nt, Escherichia coli CFT073
gcaaucuccuguugugaugcaa

SEQ ID NO: 610251 - RNA, 18 nt, Escherichia coli CFT073
gcaaucugauuccgggcc

SEQ ID NO: 610252 - RNA, 11 nt, Escherichia coli CFT073
gcaaucaaauu

SEQ ID NO: 610253 - RNA, 20 nt, Escherichia coli CFT073
gcaaucaaauuugccagcga

SEQ ID NO: 610254 - RNA, 15 nt, Escherichia coli CFT073
gcaaucaacagauaa

SEQ ID NO: 610255 - RNA, 12 nt, Escherichia coli CFT073
gcaaucaacaua

SEQ ID NO: 610256 - RNA, 19 nt, Escherichia coli CFT073
gcaauaugguuauuaccaa

SEQ ID NO: 610257 - RNA, 22 nt, Escherichia coli CFT073
gcaauauguugauaaucaacag

SEQ ID NO: 610258 - RNA, 16 nt, Escherichia coli CFT073
gcaauauucuuuugca

SEQ ID NO: 610259 - RNA, 17 nt, Escherichia coli CFT073
gcaauaugcggugccau

SEQ ID NO: 610260 - RNA, 20 nt, Escherichia coli CFT073
gcaauauccauuaaaacuga

SEQ ID NO: 610261 - RNA, 21 nt, Escherichia coli CFT073
gcaauauagcgcauggcagcc

SEQ ID NO: 610262 - RNA, 20 nt, Escherichia coli CFT073
gcaauauauugaauuagcaa

SEQ ID NO: 610263 - RNA, 19 nt, Escherichia coli CFT073
gcaauauauugaauuugca

SEQ ID NO: 610264 - RNA, 22 nt, Escherichia coli CFT073
gcaauagcuucuuccacauugu

SEQ ID NO: 610265 - RNA, 19 nt, Escherichia coli CFT073
gcaauagcggauacuacca

SEQ ID NO: 610266 - RNA, 21 nt, Escherichia coli CFT073
gcaacuuuacuaaaaagugau

SEQ ID NO: 610267 - RNA, 14 nt, Escherichia coli CFT073
gcaacuucugucac

SEQ ID NO: 610268 - RNA, 16 nt, Escherichia coli CFT073
gcaagauuugcaucac

SEQ ID NO: 610269 - RNA, 13 nt, Escherichia coli CFT073
gcaacuugaagua

SEQ ID NO: 610270 - RNA, 19 nt, Escherichia coli CFT073
gcaaauugcggguaggcac

SEQ ID NO: 610271 - RNA, 17 nt, Escherichia coli CFT073
gcaaauuuuccccagau

SEQ ID NO: 610272 - RNA, 15 nt, Escherichia coli CFT073
gcaacaaaaaaacca

SEQ ID NO: 610273 - RNA, 21 nt, Escherichia coli CFT073
gcaacaaaaaacccaucaacc

SEQ ID NO: 610274 - RNA, 22 nt, Escherichia coli CFT073
gcaacaaaaaacccaucaaccu

SEQ ID NO: 610275 - RNA, 19 nt, Escherichia coli CFT073
gcaagcgcaccgauugcag

SEQ ID NO: 610276 - RNA, 23 nt, Escherichia coli CFT073
gcaaggugagcguggcuggcuga

SEQ ID NO: 610277 - RNA, 16 nt, Escherichia coli CFT073
gcaagguagugcuucu

SEQ ID NO: 610278 - RNA, 16 nt, Escherichia coli CFT073
gcaagcccccaguaau

SEQ ID NO: 610279 - RNA, 16 nt, Escherichia coli CFT073
gcaagccgacaauaaa

SEQ ID NO: 610280 - RNA, 13 nt, Escherichia coli CFT073
gcaagccugaaaa

SEQ ID NO: 610281 - RNA, 14 nt, Escherichia coli CFT073
gcaagccuugcagc

SEQ ID NO: 610282 - RNA, 15 nt, Escherichia coli CFT073
gcaagccuugcagcc

SEQ ID NO: 610283 - RNA, 16 nt, Escherichia coli CFT073
gcaagcaucccgccgu

SEQ ID NO: 610284 - RNA, 16 nt, Escherichia coli CFT073
gcacauacugcaucag

SEQ ID NO: 610285 - RNA, 14 nt, Escherichia coli CFT073
gcacauacuggaca

SEQ ID NO: 610286 - RNA, 20 nt, Escherichia coli CFT073
gcacauagacggugacacuu

SEQ ID NO: 610287 - RNA, 17 nt, Escherichia coli CFT073
gcacaucaucaaagcca

SEQ ID NO: 610288 - RNA, 16 nt, Escherichia coli CFT073
gcacagagauaaaagg

SEQ ID NO: 610289 - RNA, 17 nt, Escherichia coli CFT073
gcacagagcuaugaaua

SEQ ID NO: 610290 - RNA, 11 nt, Escherichia coli CFT073
gcacauaaaau

SEQ ID NO: 610291 - RNA, 15 nt, Escherichia coli CFT073
gcacauaacucauac

SEQ ID NO: 610292 - RNA, 14 nt, Escherichia coli CFT073
gcacagaucgcacu

SEQ ID NO: 610293 - RNA, 16 nt, Escherichia coli CFT073
gcacacuguaagccac

SEQ ID NO: 610294 - RNA, 21 nt, Escherichia coli CFT073
gcacacuguucauuaaagccg

SEQ ID NO: 610295 - RNA, 17 nt, Escherichia coli CFT073
gcacacgcggagccagu

SEQ ID NO: 610296 - RNA, 14 nt, Escherichia coli CFT073
gcacaccauacugu

SEQ ID NO: 610297 - RNA, 20 nt, Escherichia coli CFT073
gcacaccauagaccaugagu

SEQ ID NO: 610298 - RNA, 14 nt, Escherichia coli CFT073
gcacacauaacagc

SEQ ID NO: 610299 - RNA, 15 nt, Escherichia coli CFT073
gcacaccaacuucau

SEQ ID NO: 610300 - RNA, 20 nt, Escherichia coli CFT073
gcaccaaaguuaaucagcgc

SEQ ID NO: 610301 - RNA, 12 nt, Escherichia coli CFT073
gcaccaaccauc

SEQ ID NO: 610302 - RNA, 17 nt, Escherichia coli CFT073
gcaccaacggucagcgc

SEQ ID NO: 610303 - RNA, 15 nt, Escherichia coli CFT073
gcaccaccagcagcu

SEQ ID NO: 610304 - RNA, 17 nt, Escherichia coli CFT073
gcacauagccgaaaaug

SEQ ID NO: 610305 - RNA, 21 nt, Escherichia coli CFT073
gcaccaaacgggcaagccagc

SEQ ID NO: 610306 - RNA, 17 nt, Escherichia coli CFT073
gcaccacgguacgccag

SEQ ID NO: 610307 - RNA, 22 nt, Escherichia coli CFT073
gcaccacgcagaaaaaucccuc

SEQ ID NO: 610308 - RNA, 16 nt, Escherichia coli CFT073
gcaccaccugauugcu

SEQ ID NO: 610309 - RNA, 18 nt, Escherichia coli CFT073
gcaccaccagcagcugcu

SEQ ID NO: 610310 - RNA, 20 nt, Escherichia coli CFT073
gcaccaccagcagcugcucc

SEQ ID NO: 610311 - RNA, 20 nt, Escherichia coli CFT073
gcaauguugcuggcgagugc

SEQ ID NO: 610312 - RNA, 22 nt, Escherichia coli CFT073
gcaauggucgcgcucaucaggu

SEQ ID NO: 610313 - RNA, 20 nt, Escherichia coli CFT073
gcaauggucuugacauccag

SEQ ID NO: 610314 - RNA, 23 nt, Escherichia coli CFT073
gcaauggucuugacauccagcgu

SEQ ID NO: 610315 - RNA, 18 nt, Escherichia coli CFT073
gcaauggugugauauuca

SEQ ID NO: 610316 - RNA, 12 nt, Escherichia coli CFT073
gcaauucuucau

SEQ ID NO: 610317 - RNA, 17 nt, Escherichia coli CFT073
gcaauucuucauuccag

SEQ ID NO: 610318 - RNA, 21 nt, Escherichia coli CFT073
gcaauucuuuccguuuucacc

SEQ ID NO: 610319 - RNA, 17 nt, Escherichia coli CFT073
gcaauugccagacaaca

SEQ ID NO: 610320 - RNA, 13 nt, Escherichia coli CFT073
gcaauucaauuaa

SEQ ID NO: 610321 - RNA, 17 nt, Escherichia coli CFT073
gcaauuccagcgccagu

SEQ ID NO: 610322 - RNA, 15 nt, Escherichia coli CFT073
gcacacaaaauugcc

SEQ ID NO: 610323 - RNA, 20 nt, Escherichia coli CFT073
gcacacaaauaauucagccc

SEQ ID NO: 610324 - RNA, 18 nt, Escherichia coli CFT073
gcacacaagcguaagaga

SEQ ID NO: 610325 - RNA, 19 nt, Escherichia coli CFT073
gcacacaccagauccagca

SEQ ID NO: 610326 - RNA, 23 nt, Escherichia coli CFT073
gcacaaucaaaucgacggccagu

SEQ ID NO: 610327 - RNA, 12 nt, Escherichia coli CFT073
gcacaagacuga

SEQ ID NO: 610328 - RNA, 16 nt, Escherichia coli CFT073
gcacaagcuaccagcc

SEQ ID NO: 610329 - RNA, 17 nt, Escherichia coli CFT073
gcacaauacauagaagc

SEQ ID NO: 610330 - RNA, 15 nt, Escherichia coli CFT073
gcacaauaaucagcc

SEQ ID NO: 610331 - RNA, 15 nt, Escherichia coli CFT073
gcacaaaaacccgcu

SEQ ID NO: 610332 - RNA, 14 nt, Escherichia coli CFT073
gcacaaaacagguc

SEQ ID NO: 610333 - RNA, 14 nt, Escherichia coli CFT073
gcacaaaaccugcc

SEQ ID NO: 610334 - RNA, 15 nt, Escherichia coli CFT073
gcacaaaaccugccg

SEQ ID NO: 610335 - RNA, 14 nt, Escherichia coli CFT073
gcacaaaacuguau

SEQ ID NO: 610336 - RNA, 19 nt, Escherichia coli CFT073
gcacaacgcuuaucaggcu

SEQ ID NO: 610337 - RNA, 14 nt, Escherichia coli CFT073
gcaauuucacgcuc

SEQ ID NO: 610338 - RNA, 13 nt, Escherichia coli CFT073
gcaauuucacucc

SEQ ID NO: 610339 - RNA, 12 nt, Escherichia coli CFT073
gcaauuucauua

SEQ ID NO: 610340 - RNA, 22 nt, Escherichia coli CFT073
gcaauuugugcgucauuuucau

SEQ ID NO: 610341 - RNA, 19 nt, Escherichia coli CFT073
gcauauuguguaugcacac

SEQ ID NO: 610342 - RNA, 22 nt, Escherichia coli CFT073
gcauaugcacacgcagcugaug

SEQ ID NO: 610343 - RNA, 14 nt, Escherichia coli CFT073
gcauaucuucugaa

SEQ ID NO: 610344 - RNA, 17 nt, Escherichia coli CFT073
gcauaucgcccugggua

SEQ ID NO: 610345 - RNA, 18 nt, Escherichia coli CFT073
gcauaucguagccccagu

SEQ ID NO: 610346 - RNA, 22 nt, Escherichia coli CFT073
gcaucacauugcguaaaucuuc

SEQ ID NO: 610347 - RNA, 19 nt, Escherichia coli CFT073
gcaucaaacgguugauaaa

SEQ ID NO: 610348 - RNA, 14 nt, Escherichia coli CFT073
gcaucaacagcacg

SEQ ID NO: 610349 - RNA, 15 nt, Escherichia coli CFT073
gcaucaaccgccgga

SEQ ID NO: 610350 - RNA, 13 nt, Escherichia coli CFT073
gcaucaagaaaaa

SEQ ID NO: 610351 - RNA, 15 nt, Escherichia coli CFT073
gcaucaagaaaaaua

SEQ ID NO: 610352 - RNA, 17 nt, Escherichia coli CFT073
gcaucacgaauccgcac

SEQ ID NO: 610353 - RNA, 18 nt, Escherichia coli CFT073
gcaucagacugcuuuucc

SEQ ID NO: 610354 - RNA, 12 nt, Escherichia coli CFT073
gcaucagcaucg

SEQ ID NO: 610355 - RNA, 16 nt, Escherichia coli CFT073
gcaucauguaaaucaa

SEQ ID NO: 610356 - RNA, 21 nt, Escherichia coli CFT073
gcaucaggcauuuaucgccug

SEQ ID NO: 610357 - RNA, 20 nt, Escherichia coli CFT073
gcaucaggcaacaucgccag

SEQ ID NO: 610358 - RNA, 18 nt, Escherichia coli CFT073
gcaucaggcaacccagaa

SEQ ID NO: 610359 - RNA, 21 nt, Escherichia coli CFT073
gcaucaggcaucggagcaccg

SEQ ID NO: 610360 - RNA, 18 nt, Escherichia coli CFT073
gcaucagcgcuaccagag

SEQ ID NO: 610361 - RNA, 14 nt, Escherichia coli CFT073
gcaucagcuggcgu

SEQ ID NO: 610362 - RNA, 15 nt, Escherichia coli CFT073
gcauccgccagcagc

SEQ ID NO: 610363 - RNA, 19 nt, Escherichia coli CFT073
gcauccgcgcacaggcggc

SEQ ID NO: 610364 - RNA, 14 nt, Escherichia coli CFT073
gcauccgcugaugc

SEQ ID NO: 610365 - RNA, 16 nt, Escherichia coli CFT073
gcauccgacacuggca

SEQ ID NO: 610366 - RNA, 14 nt, Escherichia coli CFT073
gcauccccagcgca

SEQ ID NO: 610367 - RNA, 16 nt, Escherichia coli CFT073
gcauccccugccccau

SEQ ID NO: 610368 - RNA, 12 nt, Escherichia coli CFT073
gcaucccgccgu

SEQ ID NO: 610369 - RNA, 22 nt, Escherichia coli CFT073
gcaucccgguaucaaagcgcca

SEQ ID NO: 610370 - RNA, 22 nt, Escherichia coli CFT073
gcauccagcguguucgugacga

SEQ ID NO: 610371 - RNA, 18 nt, Escherichia coli CFT073
gcauccaggccaaaagcu

SEQ ID NO: 610372 - RNA, 16 nt, Escherichia coli CFT073
gcauccauaucgccau

SEQ ID NO: 610373 - RNA, 20 nt, Escherichia coli CFT073
gcauccauaucgccauugcu

SEQ ID NO: 610374 - RNA, 21 nt, Escherichia coli CFT073
gcauccauaucgccauugcug

SEQ ID NO: 610375 - RNA, 17 nt, Escherichia coli CFT073
gcauccggcgacaggaa

SEQ ID NO: 610376 - RNA, 17 nt, Escherichia coli CFT073
gcauccggcgauuuuca

SEQ ID NO: 610377 - RNA, 14 nt, Escherichia coli CFT073
gcauccggcaucaa

SEQ ID NO: 610378 - RNA, 16 nt, Escherichia coli CFT073
gcauccggcaaaaaaa

SEQ ID NO: 610379 - RNA, 18 nt, Escherichia coli CFT073
gcauccugaucguccugc

SEQ ID NO: 610380 - RNA, 14 nt, Escherichia coli CFT073
gcauccuugcuaac

SEQ ID NO: 610381 - RNA, 18 nt, Escherichia coli CFT073
gcauaaaagggcagcagg

SEQ ID NO: 610382 - RNA, 18 nt, Escherichia coli CFT073
  misc_feature (4)..(4): n is a, c, g or u
gcanuaucgucuggcgcg

SEQ ID NO: 610383 - RNA, 21 nt, Escherichia coli CFT073
gcauaaucaccaucagcagca

SEQ ID NO: 610384 - RNA, 17 nt, Escherichia coli CFT073
gcauaagucccgaccac

SEQ ID NO: 610385 - RNA, 23 nt, Escherichia coli CFT073
gcagugccugccaugccaaacag

SEQ ID NO: 610386 - RNA, 18 nt, Escherichia coli CFT073
gcagugcgcgaaccagag

SEQ ID NO: 610387 - RNA, 20 nt, Escherichia coli CFT073
gcagugcgcgauaaucucau

SEQ ID NO: 610388 - RNA, 23 nt, Escherichia coli CFT073
gcagugcucguagaagccagaga

SEQ ID NO: 610389 - RNA, 17 nt, Escherichia coli CFT073
gcaguuucaccagcagu

SEQ ID NO: 610390 - RNA, 15 nt, Escherichia coli CFT073
gcauagacuuaugcc

SEQ ID NO: 610391 - RNA, 16 nt, Escherichia coli CFT073
gcauaguccaguaaau

SEQ ID NO: 610392 - RNA, 20 nt, Escherichia coli CFT073
gcauauaaaugcgaauagug

SEQ ID NO: 610393 - RNA, 22 nt, Escherichia coli CFT073
gcauaucaccucuguucaggug

SEQ ID NO: 610394 - RNA, 18 nt, Escherichia coli CFT073
gcauauccggccugggua

SEQ ID NO: 610395 - RNA, 15 nt, Escherichia coli CFT073
gcauaaucggcuggg

SEQ ID NO: 610396 - RNA, 15 nt, Escherichia coli CFT073
gcauacgccacaucc

SEQ ID NO: 610397 - RNA, 18 nt, Escherichia coli CFT073
gcauacucuccuccaggu

SEQ ID NO: 610398 - RNA, 20 nt, Escherichia coli CFT073
gcauacucuccuccagguua

SEQ ID NO: 610399 - RNA, 17 nt, Escherichia coli CFT073
gcauacuccggcggcag

SEQ ID NO: 610400 - RNA, 14 nt, Escherichia coli CFT073
gcauagaaaaagaa

SEQ ID NO: 610401 - RNA, 18 nt, Escherichia coli CFT073
gcaguauuaccagaccuu

SEQ ID NO: 610402 - RNA, 22 nt, Escherichia coli CFT073
gcaguauugauagauuucucua

SEQ ID NO: 610403 - RNA, 16 nt, Escherichia coli CFT073
gcaguaaaccacauca

SEQ ID NO: 610404 - RNA, 13 nt, Escherichia coli CFT073
gcaguaaaccacc

SEQ ID NO: 610405 - RNA, 15 nt, Escherichia coli CFT073
gcaguaaaccaccca

SEQ ID NO: 610406 - RNA, 16 nt, Escherichia coli CFT073
gcaguaaaccacccac

SEQ ID NO: 610407 - RNA, 19 nt, Escherichia coli CFT073
gcaguaaaccacccaccag

SEQ ID NO: 610408 - RNA, 13 nt, Escherichia coli CFT073
gcaguaaaccgcu

SEQ ID NO: 610409 - RNA, 23 nt, Escherichia coli CFT073
gcaguccccacaucacaccaucc

SEQ ID NO: 610410 - RNA, 16 nt, Escherichia coli CFT073
gcagugauugccgcga

SEQ ID NO: 610411 - RNA, 17 nt, Escherichia coli CFT073
gcagucaccugcccucc

SEQ ID NO: 610412 - RNA, 19 nt, Escherichia coli CFT073
gcagucaccugcccuccgg

SEQ ID NO: 610413 - RNA, 13 nt, Escherichia coli CFT073
gcagggcaucaag

SEQ ID NO: 610414 - RNA, 20 nt, Escherichia coli CFT073
gcagguugcagagcauccuu

SEQ ID NO: 610415 - RNA, 17 nt, Escherichia coli CFT073
gcagcaucgcucaccca

SEQ ID NO: 610416 - RNA, 13 nt, Escherichia coli CFT073
gcagcaucaccac

SEQ ID NO: 610417 - RNA, 23 nt, Escherichia coli CFT073
gcagcaucaguagcaguaauuua

SEQ ID NO: 610418 - RNA, 18 nt, Escherichia coli CFT073
gcagcagugggauuaagg

SEQ ID NO: 610419 - RNA, 16 nt, Escherichia coli CFT073
gcagcagcgaauaauu

SEQ ID NO: 610420 - RNA, 15 nt, Escherichia coli CFT073
gcagcagcgccaggc

SEQ ID NO: 610421 - RNA, 17 nt, Escherichia coli CFT073
gcagcagcgccaggcac

SEQ ID NO: 610422 - RNA, 20 nt, Escherichia coli CFT073
gcagcagcgccaggcacacc

SEQ ID NO: 610423 - RNA, 19 nt, Escherichia coli CFT073
gcagcaggugcgccagcga

SEQ ID NO: 610424 - RNA, 18 nt, Escherichia coli CFT073
gcagcagcacccgcggcu

SEQ ID NO: 610425 - RNA, 22 nt, Escherichia coli CFT073
gcagcagacgcaucgcccagcc

SEQ ID NO: 610426 - RNA, 15 nt, Escherichia coli CFT073
gcagcacccagaacg

SEQ ID NO: 610427 - RNA, 20 nt, Escherichia coli CFT073
gcagcacccugaguuuucag

SEQ ID NO: 610428 - RNA, 21 nt, Escherichia coli CFT073
gcacuucacgcggaucgccaa

SEQ ID NO: 610429 - RNA, 19 nt, Escherichia coli CFT073
gcagcaaaagcaggcaccg

SEQ ID NO: 610430 - RNA, 12 nt, Escherichia coli CFT073
gcagcaaccacu

SEQ ID NO: 610431 - RNA, 11 nt, Escherichia coli CFT073
gcagcaaccag

SEQ ID NO: 610432 - RNA, 13 nt, Escherichia coli CFT073
gcagcacaugcaa

SEQ ID NO: 610433 - RNA, 22 nt, Escherichia coli CFT073
gcacuucaaauuucauaaucug

SEQ ID NO: 610434 - RNA, 14 nt, Escherichia coli CFT073
gcacuuaauaccac

SEQ ID NO: 610435 - RNA, 23 nt, Escherichia coli CFT073
gcacuuacagcaacgccuaaacu

SEQ ID NO: 610436 - RNA, 18 nt, Escherichia coli CFT073
gcacuguucgccgcagcc

SEQ ID NO: 610437 - RNA, 15 nt, Escherichia coli CFT073
gcacuguuucgccag

SEQ ID NO: 610438 - RNA, 17 nt, Escherichia coli CFT073
gcacuguaaguguaugu

SEQ ID NO: 610439 - RNA, 18 nt, Escherichia coli CFT073
gcacuggguucaucuucc

SEQ ID NO: 610440 - RNA, 21 nt, Escherichia coli CFT073
gcacuggguucaucuuccagc

SEQ ID NO: 610441 - RNA, 15 nt, Escherichia coli CFT073
gcacugguacucaac

SEQ ID NO: 610442 - RNA, 22 nt, Escherichia coli CFT073
gcacuggccuuuucacaacgaa

SEQ ID NO: 610443 - RNA, 17 nt, Escherichia coli CFT073
gcacuggcgaauucugc

SEQ ID NO: 610444 - RNA, 18 nt, Escherichia coli CFT073
gcagcaugauacaaaaca

SEQ ID NO: 610445 - RNA, 20 nt, Escherichia coli CFT073
gcagcaugauacaaaacaga

SEQ ID NO: 610446 - RNA, 14 nt, Escherichia coli CFT073
gcagcaugauuuca

SEQ ID NO: 610447 - RNA, 12 nt, Escherichia coli CFT073
gcagccaaaaau

SEQ ID NO: 610448 - RNA, 19 nt, Escherichia coli CFT073
gcagccaaaaaugacgccc

SEQ ID NO: 610449 - RNA, 20 nt, Escherichia coli CFT073
gcagcauggucgcagcggcu

SEQ ID NO: 610450 - RNA, 16 nt, Escherichia coli CFT073
gcagcccgagcaacag

SEQ ID NO: 610451 - RNA, 18 nt, Escherichia coli CFT073
gcagcgauuaacugcgcg

SEQ ID NO: 610452 - RNA, 20 nt, Escherichia coli CFT073
gcagcgauuaacugcgcggu

SEQ ID NO: 610453 - RNA, 22 nt, Escherichia coli CFT073
gcagcgauagcuucugcguucu

SEQ ID NO: 610454 - RNA, 19 nt, Escherichia coli CFT073
gcagccgcugauuuuuauc

SEQ ID NO: 610455 - RNA, 13 nt, Escherichia coli CFT073
gcaggcuaaaaac

SEQ ID NO: 610456 - RNA, 17 nt, Escherichia coli CFT073
gcaggcgacucgguugc

SEQ ID NO: 610457 - RNA, 17 nt, Escherichia coli CFT073
gcaggccccgucagcaa

SEQ ID NO: 610458 - RNA, 16 nt, Escherichia coli CFT073
gcaggcaucaucagau

SEQ ID NO: 610459 - RNA, 23 nt, Escherichia coli CFT073
gcaggcaaccguucgggaaaaua

SEQ ID NO: 610460 - RNA, 18 nt, Escherichia coli CFT073
gcaggcaccagccccugg

SEQ ID NO: 610461 - RNA, 12 nt, Escherichia coli CFT073
gcaggcaguaaa

SEQ ID NO: 610462 - RNA, 21 nt, Escherichia coli CFT073
gcaggaaagcaagaccaacac

SEQ ID NO: 610463 - RNA, 16 nt, Escherichia coli CFT073
gcaggauuuucuuuaa

SEQ ID NO: 610464 - RNA, 18 nt, Escherichia coli CFT073
gcaggaaaaucagcauca

SEQ ID NO: 610465 - RNA, 19 nt, Escherichia coli CFT073
gcaggaaaaucagcaucaa

SEQ ID NO: 610466 - RNA, 16 nt, Escherichia coli CFT073
gcagcuuuaccggcuu

SEQ ID NO: 610467 - RNA, 16 nt, Escherichia coli CFT073
gcagcuuugugcuuca

SEQ ID NO: 610468 - RNA, 14 nt, Escherichia coli CFT073
gcagcuuugugcuu

SEQ ID NO: 610469 - RNA, 16 nt, Escherichia coli CFT073
gcagcuugcgccgccc

SEQ ID NO: 610470 - RNA, 16 nt, Escherichia coli CFT073
gcagcuugagaaaauc

SEQ ID NO: 610471 - RNA, 18 nt, Escherichia coli CFT073
gcagcucuaucugcacug

SEQ ID NO: 610472 - RNA, 20 nt, Escherichia coli CFT073
gcagcucuuucucgcucagu

SEQ ID NO: 610473 - RNA, 14 nt, Escherichia coli CFT073
gcagcucuguuuug

SEQ ID NO: 610474 - RNA, 17 nt, Escherichia coli CFT073
gcagcgucgcaucaggc

SEQ ID NO: 610475 - RNA, 19 nt, Escherichia coli CFT073
gcagcggucgcugacauua

SEQ ID NO: 610476 - RNA, 17 nt, Escherichia coli CFT073
gcagcggugagccagga

SEQ ID NO: 610477 - RNA, 20 nt, Escherichia coli CFT073
gcagcgguuaugguuucccu

SEQ ID NO: 610478 - RNA, 15 nt, Escherichia coli CFT073
gcagcggccaguagc

SEQ ID NO: 610479 - RNA, 21 nt, Escherichia coli CFT073
gcagcgcggcgagagccuucg

SEQ ID NO: 610480 - RNA, 13 nt, Escherichia coli CFT073
gcagcgcuggaga

SEQ ID NO: 610481 - RNA, 22 nt, Escherichia coli CFT073
gcaaauuauuaauuaaacaaau

SEQ ID NO: 610482 - RNA, 12 nt, Escherichia coli CFT073
gcaaaucgcggc

SEQ ID NO: 610483 - RNA, 13 nt, Escherichia coli CFT073
gcaaaugacccau

SEQ ID NO: 610484 - RNA, 16 nt, Escherichia coli CFT073
gcaaaugaugcaccac

SEQ ID NO: 610485 - RNA, 22 nt, Escherichia coli CFT073
gcaaaugaugcaccaccugauu

SEQ ID NO: 610486 - RNA, 12 nt, Escherichia coli CFT073
gcaaauaauuca

SEQ ID NO: 610487 - RNA, 23 nt, Escherichia coli CFT073
gcaaauaauucaucuuucaucug

SEQ ID NO: 610488 - RNA, 17 nt, Escherichia coli CFT073
gcaaauacccaaaaaau

SEQ ID NO: 610489 - RNA, 18 nt, Escherichia coli CFT073
gcaaauacccaaaaaaua

SEQ ID NO: 610490 - RNA, 22 nt, Escherichia coli CFT073
gcaaauccaucauaugcgccag

SEQ ID NO: 610491 - RNA, 17 nt, Escherichia coli CFT073
gcaaauccacguuccag

SEQ ID NO: 610492 - RNA, 15 nt, Escherichia coli CFT073
gcaaauauugcauug

SEQ ID NO: 610493 - RNA, 21 nt, Escherichia coli CFT073
gcaaaucaauagugaacugac

SEQ ID NO: 610494 - RNA, 20 nt, Escherichia coli CFT073
gcaaaucaaucugaugacug

SEQ ID NO: 610495 - RNA, 21 nt, Escherichia coli CFT073
gcaaauaacgcuucagcuguu

SEQ ID NO: 610496 - RNA, 13 nt, Escherichia coli CFT073
gcaaauaaaacau

SEQ ID NO: 610497 - RNA, 17 nt, Escherichia coli CFT073
gcaaaguuugugaucuu

SEQ ID NO: 610498 - RNA, 19 nt, Escherichia coli CFT073
gcaaagcugucaccaauca

SEQ ID NO: 610499 - RNA, 18 nt, Escherichia coli CFT073
gcaaagcgcugaauaucu

SEQ ID NO: 610500 - RNA, 22 nt, Escherichia coli CFT073
gcaaagcugucaccaaucaggu

SEQ ID NO: 610501 - RNA, 22 nt, Escherichia coli CFT073
gcaaagcuguuaucgauauaca

SEQ ID NO: 610502 - RNA, 14 nt, Escherichia coli CFT073
gcaaaggccagcca

SEQ ID NO: 610503 - RNA, 19 nt, Escherichia coli CFT073
gcaaaggccagccaggcac

SEQ ID NO: 610504 - RNA, 10 nt, Escherichia coli CFT073
gcaaagcgac

SEQ ID NO: 610505 - RNA, 17 nt, Escherichia coli CFT073
gcaaagcccgggcacau

SEQ ID NO: 610506 - RNA, 23 nt, Escherichia coli CFT073
gcaaagcccaucaccgccaggcc

SEQ ID NO: 610507 - RNA, 20 nt, Escherichia coli CFT073
gcaaagcaucauaaccucug

SEQ ID NO: 610508 - RNA, 19 nt, Escherichia coli CFT073
gcaaaccagacaacaguca

SEQ ID NO: 610509 - RNA, 21 nt, Escherichia coli CFT073
gcaaaccauagaauacgccac

SEQ ID NO: 610510 - RNA, 23 nt, Escherichia coli CFT073
gcaaaccauagaauacgccacga

SEQ ID NO: 610511 - RNA, 13 nt, Escherichia coli CFT073
gcaaacccacaga

SEQ ID NO: 610512 - RNA, 12 nt, Escherichia coli CFT073
gcaaacaacuug

SEQ ID NO: 610513 - RNA, 21 nt, Escherichia coli CFT073
gcaaacacccgacgugcagca

SEQ ID NO: 610514 - RNA, 11 nt, Escherichia coli CFT073
gcaaacagcac

SEQ ID NO: 610515 - RNA, 18 nt, Escherichia coli CFT073
gcaaaaucguaagcagga

SEQ ID NO: 610516 - RNA, 19 nt, Escherichia coli CFT073
gcaaaaucguaagcaggag

SEQ ID NO: 610517 - RNA, 13 nt, Escherichia coli CFT073
gcaaaaucaaaca

SEQ ID NO: 610518 - RNA, 13 nt, Escherichia coli CFT073
gcaaaaucaccau

SEQ ID NO: 610519 - RNA, 13 nt, Escherichia coli CFT073
gcaaaaucaucac

SEQ ID NO: 610520 - RNA, 18 nt, Escherichia coli CFT073
gcaaaauccuuccagcuc

SEQ ID NO: 610521 - RNA, 23 nt, Escherichia coli CFT073
gcaaaauccuuccagcuccagcc

SEQ ID NO: 610522 - RNA, 19 nt, Escherichia coli CFT073
gcaaaauaaccggcaagca

SEQ ID NO: 610523 - RNA, 15 nt, Escherichia coli CFT073
gcaaaauacaugacc

SEQ ID NO: 610524 - RNA, 11 nt, Escherichia coli CFT073
gcaaaauaggu

SEQ ID NO: 610525 - RNA, 18 nt, Escherichia coli CFT073
gcaaacucaucgccgcca

SEQ ID NO: 610526 - RNA, 12 nt, Escherichia coli CFT073
gcaaacugcugu

SEQ ID NO: 610527 - RNA, 19 nt, Escherichia coli CFT073
gcaaacugcuguugcugcc

SEQ ID NO: 610528 - RNA, 20 nt, Escherichia coli CFT073
gcaaacugguugaaauaaac

SEQ ID NO: 610529 - RNA, 12 nt, Escherichia coli CFT073
gcaaagauauuc

SEQ ID NO: 610530 - RNA, 17 nt, Escherichia coli CFT073
gcaaagauauucaguac

SEQ ID NO: 610531 - RNA, 15 nt, Escherichia coli CFT073
gcaaagagagcagcg

SEQ ID NO: 610532 - RNA, 15 nt, Escherichia coli CFT073
gcaaagagagaagcc

SEQ ID NO: 610533 - RNA, 14 nt, Escherichia coli CFT073
gcaaagagagaagc

SEQ ID NO: 610534 - RNA, 22 nt, Escherichia coli CFT073
gcaaacugugcaaugaaaaaca

SEQ ID NO: 610535 - RNA, 17 nt, Escherichia coli CFT073
gcaaagaaaucaacaaa

SEQ ID NO: 610536 - RNA, 15 nt, Escherichia coli CFT073
gcaaacguaaaugcc

SEQ ID NO: 610537 - RNA, 15 nt, Escherichia coli CFT073
gcaaacgccaccugu

SEQ ID NO: 610538 - RNA, 17 nt, Escherichia coli CFT073
gcaaacgauuaucaaca

SEQ ID NO: 610539 - RNA, 18 nt, Escherichia coli CFT073
gcaaacgauuaucaacac

SEQ ID NO: 610540 - RNA, 19 nt, Escherichia coli CFT073
gcaaacgauuaucaacaca

SEQ ID NO: 610541 - RNA, 16 nt, Escherichia coli CFT073
gcaaacgcaaaacugc

SEQ ID NO: 610542 - RNA, 22 nt, Escherichia coli CFT073
gauuugcccaucaggccaggcg

SEQ ID NO: 610543 - RNA, 17 nt, Escherichia coli CFT073
gauuugcccuuccauac

SEQ ID NO: 610544 - RNA, 15 nt, Escherichia coli CFT073
gauuuuacuucccag

SEQ ID NO: 610545 - RNA, 22 nt, Escherichia coli CFT073
gauuuuacuucccagucaagaa

SEQ ID NO: 610546 - RNA, 20 nt, Escherichia coli CFT073
gauuuuaacuaucaggucuu

SEQ ID NO: 610547 - RNA, 17 nt, Escherichia coli CFT073
gauuucauauccggcac

SEQ ID NO: 610548 - RNA, 13 nt, Escherichia coli CFT073
gauuucaggcuuu

SEQ ID NO: 610549 - RNA, 21 nt, Escherichia coli CFT073
gauuucaaugcgcaagcugcu

SEQ ID NO: 610550 - RNA, 18 nt, Escherichia coli CFT073
gauuuuucgcgcgggcag

SEQ ID NO: 610551 - RNA, 23 nt, Escherichia coli CFT073
gauuuuucgcgcgggcagaugcc

SEQ ID NO: 610552 - RNA, 11 nt, Escherichia coli CFT073
gauuuucaaca

SEQ ID NO: 610553 - RNA, 16 nt, Escherichia coli CFT073
gcaaaaauaaggcgga

SEQ ID NO: 610554 - RNA, 22 nt, Escherichia coli CFT073
gcaaaaacggcguguagguucc

SEQ ID NO: 610555 - RNA, 20 nt, Escherichia coli CFT073
gcaaaaaucgacagcaggau

SEQ ID NO: 610556 - RNA, 19 nt, Escherichia coli CFT073
gcaaaaaucgacagcagga

SEQ ID NO: 610557 - RNA, 19 nt, Escherichia coli CFT073
gcaaaaaagaaggaaaaua

SEQ ID NO: 610558 - RNA, 19 nt, Escherichia coli CFT073
gcaaaaaaguagcgcagca

SEQ ID NO: 610559 - RNA, 15 nt, Escherichia coli CFT073
gcaaaaaauagaacu

SEQ ID NO: 610560 - RNA, 15 nt, Escherichia coli CFT073
gauuauucaaaaaca

SEQ ID NO: 610561 - RNA, 23 nt, Escherichia coli CFT073
gauuauuucgcugcggauuguca

SEQ ID NO: 610562 - RNA, 13 nt, Escherichia coli CFT073
gauuauuuauuca

SEQ ID NO: 610563 - RNA, 22 nt, Escherichia coli CFT073
gauugagaauaaugccuuuaau

SEQ ID NO: 610564 - RNA, 21 nt, Escherichia coli CFT073
gauugaaaaacaccucaucgc

SEQ ID NO: 610565 - RNA, 13 nt, Escherichia coli CFT073
gauugaagaaauc

SEQ ID NO: 610566 - RNA, 16 nt, Escherichia coli CFT073
gauucuucgaugaugc

SEQ ID NO: 610567 - RNA, 11 nt, Escherichia coli CFT073
gauugcugcug

SEQ ID NO: 610568 - RNA, 13 nt, Escherichia coli CFT073
gauuuaaugccaa

SEQ ID NO: 610569 - RNA, 18 nt, Escherichia coli CFT073
gauugugugacacuucuu

SEQ ID NO: 610570 - RNA, 13 nt, Escherichia coli CFT073
gauguuugcugcg

SEQ ID NO: 610571 - RNA, 17 nt, Escherichia coli CFT073
gaugucgcgcacugggu

SEQ ID NO: 610572 - RNA, 16 nt, Escherichia coli CFT073
gauguccugcggacag

SEQ ID NO: 610573 - RNA, 22 nt, Escherichia coli CFT073
gaugucgagguaugcuccggca

SEQ ID NO: 610574 - RNA, 16 nt, Escherichia coli CFT073
gauuaacgugaccgcu

SEQ ID NO: 610575 - RNA, 23 nt, Escherichia coli CFT073
gauuaacugggcgucaaagugaa

SEQ ID NO: 610576 - RNA, 14 nt, Escherichia coli CFT073
gauuaaagcaggua

SEQ ID NO: 610577 - RNA, 23 nt, Escherichia coli CFT073
gauuaugaaauucagugaacugu

SEQ ID NO: 610578 - RNA, 14 nt, Escherichia coli CFT073
gauuaugaucgcca

SEQ ID NO: 610579 - RNA, 21 nt, Escherichia coli CFT073
gauuaucccauauaccuacuc

SEQ ID NO: 610580 - RNA, 12 nt, Escherichia coli CFT073
gauuaucccccg

SEQ ID NO: 610581 - RNA, 17 nt, Escherichia coli CFT073
gauuauccagccaggcg

SEQ ID NO: 610582 - RNA, 18 nt, Escherichia coli CFT073
gauuaauaaaauuaucca

SEQ ID NO: 610583 - RNA, 17 nt, Escherichia coli CFT073
gauuaagugaaccuuaa

SEQ ID NO: 610584 - RNA, 17 nt, Escherichia coli CFT073
gauuaagauaacguuga

SEQ ID NO: 610585 - RNA, 14 nt, Escherichia coli CFT073
gauuaccauuucac

SEQ ID NO: 610586 - RNA, 15 nt, Escherichia coli CFT073
gauuaccagcaucac

SEQ ID NO: 610587 - RNA, 17 nt, Escherichia coli CFT073
gauuaccuaccaacgca

SEQ ID NO: 610588 - RNA, 17 nt, Escherichia coli CFT073
gauuacgcaucaccccu

SEQ ID NO: 610589 - RNA, 16 nt, Escherichia coli CFT073
gauuacguaccagaua

SEQ ID NO: 610590 - RNA, 19 nt, Escherichia coli CFT073
gauggucgcuugcgggcug

SEQ ID NO: 610591 - RNA, 21 nt, Escherichia coli CFT073
gauggugaaaaauaaugccac

SEQ ID NO: 610592 - RNA, 16 nt, Escherichia coli CFT073
gauggugacgccugga

SEQ ID NO: 610593 - RNA, 14 nt, Escherichia coli CFT073
gaugguuggcccga

SEQ ID NO: 610594 - RNA, 19 nt, Escherichia coli CFT073
gaugguggucgcaucaucc

SEQ ID NO: 610595 - RNA, 14 nt, Escherichia coli CFT073
gauguacuaaccau

SEQ ID NO: 610596 - RNA, 23 nt, Escherichia coli CFT073
gauguaaucaacuccgccagcaa

SEQ ID NO: 610597 - RNA, 17 nt, Escherichia coli CFT073
gauguaauuaagcgcaa

SEQ ID NO: 610598 - RNA, 16 nt, Escherichia coli CFT073
gaugguuuugcuuuau

SEQ ID NO: 610599 - RNA, 13 nt, Escherichia coli CFT073
gauggcagggcag

SEQ ID NO: 610600 - RNA, 21 nt, Escherichia coli CFT073
gauggcagacuuuuccuuugc

SEQ ID NO: 610601 - RNA, 21 nt, Escherichia coli CFT073
gauggcgcaaugccauccagc

SEQ ID NO: 610602 - RNA, 17 nt, Escherichia coli CFT073
gaugguaucuaucacua

SEQ ID NO: 610603 - RNA, 17 nt, Escherichia coli CFT073
gauggguaauaccaucc

SEQ ID NO: 610604 - RNA, 23 nt, Escherichia coli CFT073
gaugggcguuuucuaccagguuu

SEQ ID NO: 610605 - RNA, 15 nt, Escherichia coli CFT073
gaugcuuuccagcug

SEQ ID NO: 610606 - RNA, 22 nt, Escherichia coli CFT073
gauggaucagcguuucuuccag

SEQ ID NO: 610607 - RNA, 22 nt, Escherichia coli CFT073
gauggauguugccaacaaucau

SEQ ID NO: 610608 - RNA, 16 nt, Escherichia coli CFT073
gauggcaauuuucacu

SEQ ID NO: 610609 - RNA, 17 nt, Escherichia coli CFT073
gauggcaauuuucacug

SEQ ID NO: 610610 - RNA, 18 nt, Escherichia coli CFT073
gauggcacaugacuucca

SEQ ID NO: 610611 - RNA, 15 nt, Escherichia coli CFT073
gaugcugugcuccuu

SEQ ID NO: 610612 - RNA, 22 nt, Escherichia coli CFT073
gaugcugugcuccuucucugag

SEQ ID NO: 610613 - RNA, 17 nt, Escherichia coli CFT073
gaugcggugcgccacac

SEQ ID NO: 610614 - RNA, 13 nt, Escherichia coli CFT073
gaugcguucaccu

SEQ ID NO: 610615 - RNA, 17 nt, Escherichia coli CFT073
gaugcgacgcaaacgcc

SEQ ID NO: 610616 - RNA, 19 nt, Escherichia coli CFT073
gaugcgacggcaccacauu

SEQ ID NO: 610617 - RNA, 13 nt, Escherichia coli CFT073
gaugcgaccgccg

SEQ ID NO: 610618 - RNA, 20 nt, Escherichia coli CFT073
gaugcgaacauccggcacuu

SEQ ID NO: 610619 - RNA, 12 nt, Escherichia coli CFT073
gaugcggcugaa

SEQ ID NO: 610620 - RNA, 16 nt, Escherichia coli CFT073
gaugcggggauuuucg

SEQ ID NO: 610621 - RNA, 23 nt, Escherichia coli CFT073
gaugccuugugggccugaaagcu

SEQ ID NO: 610622 - RNA, 22 nt, Escherichia coli CFT073
gaugccgaagugguuccacgcc

SEQ ID NO: 610623 - RNA, 20 nt, Escherichia coli CFT073
gaugccaaaaugcaccggau

SEQ ID NO: 610624 - RNA, 15 nt, Escherichia coli CFT073
gaugccaccaggcag

SEQ ID NO: 610625 - RNA, 18 nt, Escherichia coli CFT073
gaugccaccaggcagcac

SEQ ID NO: 610626 - RNA, 18 nt, Escherichia coli CFT073
gaugaaugcaacugccca

SEQ ID NO: 610627 - RNA, 14 nt, Escherichia coli CFT073
gaugacagaaucag

SEQ ID NO: 610628 - RNA, 16 nt, Escherichia coli CFT073
gaugacaacaccaucg

SEQ ID NO: 610629 - RNA, 13 nt, Escherichia coli CFT073
gaugagaacacca

SEQ ID NO: 610630 - RNA, 21 nt, Escherichia coli CFT073
gaugagaaauauuuucagggg

SEQ ID NO: 610631 - RNA, 15 nt, Escherichia coli CFT073
gaucgucagcacuca

SEQ ID NO: 610632 - RNA, 20 nt, Escherichia coli CFT073
gaugaauauucucggcugcc

SEQ ID NO: 610633 - RNA, 14 nt, Escherichia coli CFT073
gaucgugcucgaca

SEQ ID NO: 610634 - RNA, 12 nt, Escherichia coli CFT073
gaugagcaucgu

SEQ ID NO: 610635 - RNA, 20 nt, Escherichia coli CFT073
gaucgccccggaagcaucaa

SEQ ID NO: 610636 - RNA, 14 nt, Escherichia coli CFT073
gaucgccaucagcg

SEQ ID NO: 610637 - RNA, 20 nt, Escherichia coli CFT073
gaucgcccggcaccagcacc

SEQ ID NO: 610638 - RNA, 15 nt, Escherichia coli CFT073
gaucgcccuuuuuug

SEQ ID NO: 610639 - RNA, 15 nt, Escherichia coli CFT073
gaucgcgaccgccuu

SEQ ID NO: 610640 - RNA, 22 nt, Escherichia coli CFT073
gaucgcgauauuccagaccuac

SEQ ID NO: 610641 - RNA, 17 nt, Escherichia coli CFT073
gaucgacgugggcgugg

SEQ ID NO: 610642 - RNA, 20 nt, Escherichia coli CFT073
gaucgagauugaucccggcu

SEQ ID NO: 610643 - RNA, 18 nt, Escherichia coli CFT073
gaucggcguacuggcaau

SEQ ID NO: 610644 - RNA, 20 nt, Escherichia coli CFT073
gaucgguagguccauaaacc

SEQ ID NO: 610645 - RNA, 18 nt, Escherichia coli CFT073
gaucgggcuuguggcucg

SEQ ID NO: 610646 - RNA, 20 nt, Escherichia coli CFT073
gaucgcugaacgcaccuucc

SEQ ID NO: 610647 - RNA, 23 nt, Escherichia coli CFT073
gaucgcuuccauugccugcaacg

SEQ ID NO: 610648 - RNA, 21 nt, Escherichia coli CFT073
gaucgcggcuauucaccacuu

SEQ ID NO: 610649 - RNA, 17 nt, Escherichia coli CFT073
gaucgcgguaacagaug

SEQ ID NO: 610650 - RNA, 14 nt, Escherichia coli CFT073
gauccuugcggauc

SEQ ID NO: 610651 - RNA, 15 nt, Escherichia coli CFT073
gauccuggcuguauu

SEQ ID NO: 610652 - RNA, 17 nt, Escherichia coli CFT073
gauccuggucaaagugg

SEQ ID NO: 610653 - RNA, 15 nt, Escherichia coli CFT073
gauccugcaacaaca

SEQ ID NO: 610654 - RNA, 18 nt, Escherichia coli CFT073
gauccguccgacggcauu

SEQ ID NO: 610655 - RNA, 12 nt, Escherichia coli CFT073
gauccugaaauu

SEQ ID NO: 610656 - RNA, 17 nt, Escherichia coli CFT073
gauccugagccaguuuu

SEQ ID NO: 610657 - RNA, 18 nt, Escherichia coli CFT073
gauccgggcauauuuccg

SEQ ID NO: 610658 - RNA, 17 nt, Escherichia coli CFT073
gauccggcagagguaca

SEQ ID NO: 610659 - RNA, 16 nt, Escherichia coli CFT073
gaucccugcaacaccc

SEQ ID NO: 610660 - RNA, 20 nt, Escherichia coli CFT073
gauccagaacugcgagauga

SEQ ID NO: 610661 - RNA, 22 nt, Escherichia coli CFT073
gaucccuucgcuggcaaagccg

SEQ ID NO: 610662 - RNA, 17 nt, Escherichia coli CFT073
gaucccggcuuccugca

SEQ ID NO: 610663 - RNA, 21 nt, Escherichia coli CFT073
gauccagcauucccgccacca

SEQ ID NO: 610664 - RNA, 13 nt, Escherichia coli CFT073
gaucauuuccggu

SEQ ID NO: 610665 - RNA, 13 nt, Escherichia coli CFT073
gaucauucaccag

SEQ ID NO: 610666 - RNA, 15 nt, Escherichia coli CFT073
gaucauucaccagcc

SEQ ID NO: 610667 - RNA, 18 nt, Escherichia coli CFT073
gaucauguaguaaugcuu

SEQ ID NO: 610668 - RNA, 16 nt, Escherichia coli CFT073
gaucagcguuucuucc

SEQ ID NO: 610669 - RNA, 15 nt, Escherichia coli CFT073
gaucagcggugguga

SEQ ID NO: 610670 - RNA, 18 nt, Escherichia coli CFT073
gaucagcgguuuugccag

SEQ ID NO: 610671 - RNA, 13 nt, Escherichia coli CFT073
gaucagcgguggu

SEQ ID NO: 610672 - RNA, 14 nt, Escherichia coli CFT073
gaucagcgucaguu

SEQ ID NO: 610673 - RNA, 13 nt, Escherichia coli CFT073
gaucaacugccgc

SEQ ID NO: 610674 - RNA, 21 nt, Escherichia coli CFT073
gaucaaccaccgucgucccuu

SEQ ID NO: 610675 - RNA, 15 nt, Escherichia coli CFT073
gaucaacgaccagaa

SEQ ID NO: 610676 - RNA, 15 nt, Escherichia coli CFT073
gaucaacggugccau

SEQ ID NO: 610677 - RNA, 21 nt, Escherichia coli CFT073
gaucaacggugccaucacgcc

SEQ ID NO: 610678 - RNA, 12 nt, Escherichia coli CFT073
gaucaacagaau

SEQ ID NO: 610679 - RNA, 14 nt, Escherichia coli CFT073
gaucaaauuauuac

SEQ ID NO: 610680 - RNA, 15 nt, Escherichia coli CFT073
gauauuuagccagca

SEQ ID NO: 610681 - RNA, 13 nt, Escherichia coli CFT073
gaucagcauuucg

SEQ ID NO: 610682 - RNA, 19 nt, Escherichia coli CFT073
gaucagcauccauaucgcc

SEQ ID NO: 610683 - RNA, 14 nt, Escherichia coli CFT073
gauaucugaaaguu

SEQ ID NO: 610684 - RNA, 14 nt, Escherichia coli CFT073
gauauccugauauu

SEQ ID NO: 610685 - RNA, 13 nt, Escherichia coli CFT073
gauaucggcagcg

SEQ ID NO: 610686 - RNA, 13 nt, Escherichia coli CFT073
gauagcaaugcca

SEQ ID NO: 610687 - RNA, 19 nt, Escherichia coli CFT073
gauaucaggcaaacagaau

SEQ ID NO: 610688 - RNA, 23 nt, Escherichia coli CFT073
gauaucccgccagcaccagcaac

SEQ ID NO: 610689 - RNA, 22 nt, Escherichia coli CFT073
gauauccacccgcagccaucac

SEQ ID NO: 610690 - RNA, 19 nt, Escherichia coli CFT073
gauauccaccgucaaaucc

SEQ ID NO: 610691 - RNA, 21 nt, Escherichia coli CFT073
gauauccagaccgcgcuugcc

SEQ ID NO: 610692 - RNA, 23 nt, Escherichia coli CFT073
gauaugggcaaacaaaaaaccua

SEQ ID NO: 610693 - RNA, 17 nt, Escherichia coli CFT073
gauaugggcagcucuau

SEQ ID NO: 610694 - RNA, 13 nt, Escherichia coli CFT073
gauaugccagacu

SEQ ID NO: 610695 - RNA, 22 nt, Escherichia coli CFT073
gauaugaucaucaccuuacugg

SEQ ID NO: 610696 - RNA, 16 nt, Escherichia coli CFT073
gauaugcgagcaccug

SEQ ID NO: 610697 - RNA, 20 nt, Escherichia coli CFT073
gauauugucgcccuguaauu

SEQ ID NO: 610698 - RNA, 20 nt, Escherichia coli CFT073
gauauugauaauaaaaagaa

SEQ ID NO: 610699 - RNA, 20 nt, Escherichia coli CFT073
gauauugauucaucucuucu

SEQ ID NO: 610700 - RNA, 21 nt, Escherichia coli CFT073
gauauugauucaucucuucuu

SEQ ID NO: 610701 - RNA, 23 nt, Escherichia coli CFT073
gauauguucaggauauuuauauu

SEQ ID NO: 610702 - RNA, 18 nt, Escherichia coli CFT073
gauauuacauaccagcag

SEQ ID NO: 610703 - RNA, 18 nt, Escherichia coli CFT073
gauaauuaauccuucucc

SEQ ID NO: 610704 - RNA, 23 nt, Escherichia coli CFT073
gauaauuuauaacuuuaguauca

SEQ ID NO: 610705 - RNA, 15 nt, Escherichia coli CFT073
gauaauuuugaaaua

SEQ ID NO: 610706 - RNA, 21 nt, Escherichia coli CFT073
gauaaugggcgguuggccuga

SEQ ID NO: 610707 - RNA, 20 nt, Escherichia coli CFT073
gauaaugugccgaauccaau

SEQ ID NO: 610708 - RNA, 24 nt, Escherichia coli CFT073
gauaaugcgccagacgugcacgca

SEQ ID NO: 610709 - RNA, 20 nt, Escherichia coli CFT073
gauaaucggugcggcaaugc

SEQ ID NO: 610710 - RNA, 16 nt, Escherichia coli CFT073
gauaaucagcgccagc

SEQ ID NO: 610711 - RNA, 14 nt, Escherichia coli CFT073
gauaauacccagca

SEQ ID NO: 610712 - RNA, 15 nt, Escherichia coli CFT073
gauaauacccagcaa

SEQ ID NO: 610713 - RNA, 17 nt, Escherichia coli CFT073
gauaauaaaaaaccgga

SEQ ID NO: 610714 - RNA, 17 nt, Escherichia coli CFT073
gauaauaaaaaaggcac

SEQ ID NO: 610715 - RNA, 14 nt, Escherichia coli CFT073
gauaauaaaaaccu

SEQ ID NO: 610716 - RNA, 17 nt, Escherichia coli CFT073
gauaauaaaaagaauga

SEQ ID NO: 610717 - RNA, 14 nt, Escherichia coli CFT073
gauaauaacgucgc

SEQ ID NO: 610718 - RNA, 15 nt, Escherichia coli CFT073
gauaauaauguguuc

SEQ ID NO: 610719 - RNA, 23 nt, Escherichia coli CFT073
gauaaucaucccacaugaauucg

SEQ ID NO: 610720 - RNA, 22 nt, Escherichia coli CFT073
gauaaucagaucguugaccugg

SEQ ID NO: 610721 - RNA, 23 nt, Escherichia coli CFT073
gauaaucagaucguugaccugga

SEQ ID NO: 610722 - RNA, 17 nt, Escherichia coli CFT073
gauaacgaauugcugcg

SEQ ID NO: 610723 - RNA, 14 nt, Escherichia coli CFT073
gauaaauaaaauaa

SEQ ID NO: 610724 - RNA, 22 nt, Escherichia coli CFT073
gauaaccgguuacggauuuccc

SEQ ID NO: 610725 - RNA, 18 nt, Escherichia coli CFT073
gauaaccucauuaaucac

SEQ ID NO: 610726 - RNA, 21 nt, Escherichia coli CFT073
gauacaggaaaccggcgaaaa

SEQ ID NO: 610727 - RNA, 22 nt, Escherichia coli CFT073
gauacagccgacaauaccacaa

SEQ ID NO: 610728 - RNA, 18 nt, Escherichia coli CFT073
gauacaggccaccaggcc

SEQ ID NO: 610729 - RNA, 23 nt, Escherichia coli CFT073
gauacaacugccgcgccugaauc

SEQ ID NO: 610730 - RNA, 19 nt, Escherichia coli CFT073
gauacaccgcgaagcagcu

SEQ ID NO: 610731 - RNA, 23 nt, Escherichia coli CFT073
gauacaccuucaucguuucugcc

SEQ ID NO: 610732 - RNA, 11 nt, Escherichia coli CFT073
gauacacgaaa

SEQ ID NO: 610733 - RNA, 21 nt, Escherichia coli CFT073
gauacagaugccgcuauccgc

SEQ ID NO: 610734 - RNA, 15 nt, Escherichia coli CFT073
gauaccaccagcgcc

SEQ ID NO: 610735 - RNA, 16 nt, Escherichia coli CFT073
gauacaugauccggca

SEQ ID NO: 610736 - RNA, 13 nt, Escherichia coli CFT073
gauacauugccac

SEQ ID NO: 610737 - RNA, 12 nt, Escherichia coli CFT073
gauacauuucag

SEQ ID NO: 610738 - RNA, 16 nt, Escherichia coli CFT073
gauaccaacccuggug

SEQ ID NO: 610739 - RNA, 23 nt, Escherichia coli CFT073
gauaccccagcuggcgccaggcu

SEQ ID NO: 610740 - RNA, 13 nt, Escherichia coli CFT073
gauaccaguaaaa

SEQ ID NO: 610741 - RNA, 15 nt, Escherichia coli CFT073
gauacgcuucaacca

SEQ ID NO: 610742 - RNA, 20 nt, Escherichia coli CFT073
gauacggaauaucgcuggcc

SEQ ID NO: 610743 - RNA, 23 nt, Escherichia coli CFT073
gauacggaauaucgcuggccucc

SEQ ID NO: 610744 - RNA, 20 nt, Escherichia coli CFT073
gauacggaucgacagcaacu

SEQ ID NO: 610745 - RNA, 21 nt, Escherichia coli CFT073
gauacuggaaaaucuggcgcg

SEQ ID NO: 610746 - RNA, 17 nt, Escherichia coli CFT073
gauacgcuuuauccagc

SEQ ID NO: 610747 - RNA, 12 nt, Escherichia coli CFT073
gauaaagugcuc

SEQ ID NO: 610748 - RNA, 12 nt, Escherichia coli CFT073
gauaaaggucga

SEQ ID NO: 610749 - RNA, 13 nt, Escherichia coli CFT073
gauaaagcugggu

SEQ ID NO: 610750 - RNA, 21 nt, Escherichia coli CFT073
gauaaagcugucaccucugca

SEQ ID NO: 610751 - RNA, 19 nt, Escherichia coli CFT073
gauaaagcccccacaacau

SEQ ID NO: 610752 - RNA, 23 nt, Escherichia coli CFT073
gauaaagcgaccaaccaucaucc

SEQ ID NO: 610753 - RNA, 12 nt, Escherichia coli CFT073
gauaaaauuuug

SEQ ID NO: 610754 - RNA, 21 nt, Escherichia coli CFT073
gauaaaaucccauaagugcgu

SEQ ID NO: 610755 - RNA, 21 nt, Escherichia coli CFT073
gauaaaaauaccgagcagcca

SEQ ID NO: 610756 - RNA, 20 nt, Escherichia coli CFT073
gauaaaacauuacuaauuaa

SEQ ID NO: 610757 - RNA, 14 nt, Escherichia coli CFT073
gauaaaagugcaga

SEQ ID NO: 610758 - RNA, 18 nt, Escherichia coli CFT073
gauaaaagaccacaauca

SEQ ID NO: 610759 - RNA, 18 nt, Escherichia coli CFT073
gaguuagaagccaguaca

SEQ ID NO: 610760 - RNA, 12 nt, Escherichia coli CFT073
gauaaaaaaccc

SEQ ID NO: 610761 - RNA, 14 nt, Escherichia coli CFT073
gagucggaagauua

SEQ ID NO: 610762 - RNA, 17 nt, Escherichia coli CFT073
gagucgccuuuuuccau

SEQ ID NO: 610763 - RNA, 13 nt, Escherichia coli CFT073
gagucagucccug

SEQ ID NO: 610764 - RNA, 23 nt, Escherichia coli CFT073
gagugcgaaacagaaauagagaa

SEQ ID NO: 610765 - RNA, 21 nt, Escherichia coli CFT073
gagugccagauugaagcagau

SEQ ID NO: 610766 - RNA, 16 nt, Escherichia coli CFT073
gagugcauccaguugc

SEQ ID NO: 610767 - RNA, 14 nt, Escherichia coli CFT073
gagugcaauaacgu

SEQ ID NO: 610768 - RNA, 20 nt, Escherichia coli CFT073
gagugcagcacucgauucca

SEQ ID NO: 610769 - RNA, 22 nt, Escherichia coli CFT073
gaguaugugacuggaaaucaaa

SEQ ID NO: 610770 - RNA, 16 nt, Escherichia coli CFT073
gaauuugcuccagaaa

SEQ ID NO: 610771 - RNA, 15 nt, Escherichia coli CFT073
gaauuugcuccgcca

SEQ ID NO: 610772 - RNA, 14 nt, Escherichia coli CFT073
gaauuucuuucagc

SEQ ID NO: 610773 - RNA, 23 nt, Escherichia coli CFT073
gaauuuccugcgcuuucugcuuc

SEQ ID NO: 610774 - RNA, 20 nt, Escherichia coli CFT073
gaauuuccuucgcuuccugu

SEQ ID NO: 610775 - RNA, 17 nt, Escherichia coli CFT073
gaauuucaucaccagcu

SEQ ID NO: 610776 - RNA, 18 nt, Escherichia coli CFT073
gaauuuccagauguggug

SEQ ID NO: 610777 - RNA, 12 nt, Escherichia coli CFT073
gccggagcgcgc

SEQ ID NO: 610778 - RNA, 21 nt, Escherichia coli CFT073
gccggaugcgaugcuggcgca

SEQ ID NO: 610779 - RNA, 22 nt, Escherichia coli CFT073
gccggaugcuguauguuccccu

SEQ ID NO: 610780 - RNA, 21 nt, Escherichia coli CFT073
gccggaggaguauggcccagc

SEQ ID NO: 610781 - RNA, 20 nt, Escherichia coli CFT073
gccggaugcgaacauccggc

SEQ ID NO: 610782 - RNA, 17 nt, Escherichia coli CFT073
gccggauggcacaugac

SEQ ID NO: 610783 - RNA, 19 nt, Escherichia coli CFT073
gccggauguguugcauccg

SEQ ID NO: 610784 - RNA, 21 nt, Escherichia coli CFT073
gccggauguguugcauccggc

SEQ ID NO: 610785 - RNA, 20 nt, Escherichia coli CFT073
gccgcuguguguaggccagc

SEQ ID NO: 610786 - RNA, 13 nt, Escherichia coli CFT073
gccgcuuaaauuu

SEQ ID NO: 610787 - RNA, 17 nt, Escherichia coli CFT073
gccgcuucccgcagacc

SEQ ID NO: 610788 - RNA, 18 nt, Escherichia coli CFT073
gccggaauuucuuucagc

SEQ ID NO: 610789 - RNA, 18 nt, Escherichia coli CFT073
gccggacaaggcgcucgc

SEQ ID NO: 610790 - RNA, 19 nt, Escherichia coli CFT073
gccggaagcgccaccagcg

SEQ ID NO: 610791 - RNA, 19 nt, Escherichia coli CFT073
gccggaauaucaccacuga

SEQ ID NO: 610792 - RNA, 15 nt, Escherichia coli CFT073
gccggaaucagaauc

SEQ ID NO: 610793 - RNA, 17 nt, Escherichia coli CFT073
gccggaaucagaauccg

SEQ ID NO: 610794 - RNA, 17 nt, Escherichia coli CFT073
gccggaaugucuuccuu

SEQ ID NO: 610795 - RNA, 16 nt, Escherichia coli CFT073
gccgcuaucaggccac

SEQ ID NO: 610796 - RNA, 15 nt, Escherichia coli CFT073
gccgcuccuucaccu

SEQ ID NO: 610797 - RNA, 14 nt, Escherichia coli CFT073
gccgcggcgcagcu

SEQ ID NO: 610798 - RNA, 15 nt, Escherichia coli CFT073
gccgcgcuuucuucu

SEQ ID NO: 610799 - RNA, 14 nt, Escherichia coli CFT073
gccgcgcuccauca

SEQ ID NO: 610800 - RNA, 17 nt, Escherichia coli CFT073
gccgcaauauuccggca

SEQ ID NO: 610801 - RNA, 21 nt, Escherichia coli CFT073
gccgcaauggccguuccggca

SEQ ID NO: 610802 - RNA, 19 nt, Escherichia coli CFT073
gccgccgcaaacaucggcu

SEQ ID NO: 610803 - RNA, 17 nt, Escherichia coli CFT073
gccgccgcuuuuaaggu

SEQ ID NO: 610804 - RNA, 22 nt, Escherichia coli CFT073
gccgccugggugcgauuuuuga

SEQ ID NO: 610805 - RNA, 22 nt, Escherichia coli CFT073
gccgcgcaauugcugaaacgcu

SEQ ID NO: 610806 - RNA, 22 nt, Escherichia coli CFT073
gccgccuuuugccuuacgcacc

SEQ ID NO: 610807 - RNA, 17 nt, Escherichia coli CFT073
gccgcgcccuaacaggc

SEQ ID NO: 610808 - RNA, 19 nt, Escherichia coli CFT073
gccggugcccgccagugca

SEQ ID NO: 610809 - RNA, 21 nt, Escherichia coli CFT073
gccgggaagcucucuuccagu

SEQ ID NO: 610810 - RNA, 19 nt, Escherichia coli CFT073
gccgucaucaucggcugcg

SEQ ID NO: 610811 - RNA, 20 nt, Escherichia coli CFT073
gccguccaguaaugcaacac

SEQ ID NO: 610812 - RNA, 17 nt, Escherichia coli CFT073
gccgucagacgcgcggu

SEQ ID NO: 610813 - RNA, 13 nt, Escherichia coli CFT073
gccguauccaggc

SEQ ID NO: 610814 - RNA, 18 nt, Escherichia coli CFT073
gccguaguuccacauaaa

SEQ ID NO: 610815 - RNA, 23 nt, Escherichia coli CFT073
gccgucaacaauccauucaucac

SEQ ID NO: 610816 - RNA, 18 nt, Escherichia coli CFT073
gccguaugcgguacugac

SEQ ID NO: 610817 - RNA, 14 nt, Escherichia coli CFT073
gccgguuccagcuu

SEQ ID NO: 610818 - RNA, 16 nt, Escherichia coli CFT073
gccgguuccagcuuca

SEQ ID NO: 610819 - RNA, 22 nt, Escherichia coli CFT073
gccggugggaugaagcaacugg

SEQ ID NO: 610820 - RNA, 16 nt, Escherichia coli CFT073
gccguaaucgccucca

SEQ ID NO: 610821 - RNA, 16 nt, Escherichia coli CFT073
gccguaaacagguuga

SEQ ID NO: 610822 - RNA, 13 nt, Escherichia coli CFT073
gccgguuugccau

SEQ ID NO: 610823 - RNA, 17 nt, Escherichia coli CFT073
gccgguuuugcaggaaa

SEQ ID NO: 610824 - RNA, 22 nt, Escherichia coli CFT073
gccguuaccuuaccaaccgcaa

SEQ ID NO: 610825 - RNA, 20 nt, Escherichia coli CFT073
gccguuaccuucggccccau

SEQ ID NO: 610826 - RNA, 16 nt, Escherichia coli CFT073
gccguggagauuggcc

SEQ ID NO: 610827 - RNA, 20 nt, Escherichia coli CFT073
gccguggagauuggcccgcc

SEQ ID NO: 610828 - RNA, 12 nt, Escherichia coli CFT073
gccgucugccac

SEQ ID NO: 610829 - RNA, 13 nt, Escherichia coli CFT073
gccgucugccacu

SEQ ID NO: 610830 - RNA, 19 nt, Escherichia coli CFT073
gccgugcugugugccgcga

SEQ ID NO: 610831 - RNA, 16 nt, Escherichia coli CFT073
gcccuugcgcaaugag

SEQ ID NO: 610832 - RNA, 14 nt, Escherichia coli CFT073
gcccuucacuucac

SEQ ID NO: 610833 - RNA, 23 nt, Escherichia coli CFT073
gcccuuccauacgaauugccgcg

SEQ ID NO: 610834 - RNA, 22 nt, Escherichia coli CFT073
gcccuuuguaggccagauaaga

SEQ ID NO: 610835 - RNA, 18 nt, Escherichia coli CFT073
gccgaaacgcaguuuaau

SEQ ID NO: 610836 - RNA, 18 nt, Escherichia coli CFT073
gccgaaccagugcuccac

SEQ ID NO: 610837 - RNA, 15 nt, Escherichia coli CFT073
gccgaaacucuccca

SEQ ID NO: 610838 - RNA, 16 nt, Escherichia coli CFT073
gccgaagugguuccac

SEQ ID NO: 610839 - RNA, 23 nt, Escherichia coli CFT073
gccgacaaaaucaguccacggcu

SEQ ID NO: 610840 - RNA, 14 nt, Escherichia coli CFT073
gccgacaaacagcg

SEQ ID NO: 610841 - RNA, 15 nt, Escherichia coli CFT073
gccgacaaacagcgu

SEQ ID NO: 610842 - RNA, 16 nt, Escherichia coli CFT073
gccgacaaauaccacc

SEQ ID NO: 610843 - RNA, 20 nt, Escherichia coli CFT073
gccgaagaacauaaacagcg

SEQ ID NO: 610844 - RNA, 14 nt, Escherichia coli CFT073
gccgaccagcaccg

SEQ ID NO: 610845 - RNA, 13 nt, Escherichia coli CFT073
gccgaccagaccg

SEQ ID NO: 610846 - RNA, 17 nt, Escherichia coli CFT073
gccgaccaacgcagaaa

SEQ ID NO: 610847 - RNA, 11 nt, Escherichia coli CFT073
gccgacauagg

SEQ ID NO: 610848 - RNA, 18 nt, Escherichia coli CFT073
gccgacaucaaacaggcu

SEQ ID NO: 610849 - RNA, 16 nt, Escherichia coli CFT073
gccgacaauaaacgcg

SEQ ID NO: 610850 - RNA, 21 nt, Escherichia coli CFT073
gccgacaauaccacaaacgcc

SEQ ID NO: 610851 - RNA, 17 nt, Escherichia coli CFT073
gccgauaaaugccacca

SEQ ID NO: 610852 - RNA, 17 nt, Escherichia coli CFT073
gccgaguagccagcugc

SEQ ID NO: 610853 - RNA, 13 nt, Escherichia coli CFT073
gccgaucagcggc

SEQ ID NO: 610854 - RNA, 16 nt, Escherichia coli CFT073
gccgaucaucauccag

SEQ ID NO: 610855 - RNA, 17 nt, Escherichia coli CFT073
gccgcaaaucgccgaga

SEQ ID NO: 610856 - RNA, 18 nt, Escherichia coli CFT073
gccgcaacuaccagcagu

SEQ ID NO: 610857 - RNA, 15 nt, Escherichia coli CFT073
gccgauuucaaccac

SEQ ID NO: 610858 - RNA, 15 nt, Escherichia coli CFT073
gccgcaaaacccagg

SEQ ID NO: 610859 - RNA, 22 nt, Escherichia coli CFT073
gccgaggccgaguagccagcug

SEQ ID NO: 610860 - RNA, 23 nt, Escherichia coli CFT073
gccgaggccgaguagccagcugc

SEQ ID NO: 610861 - RNA, 16 nt, Escherichia coli CFT073
gccgaggcauucagcc

SEQ ID NO: 610862 - RNA, 16 nt, Escherichia coli CFT073
gccgagcgcaagccac

SEQ ID NO: 610863 - RNA, 11 nt, Escherichia coli CFT073
gccgagcgcca

SEQ ID NO: 610864 - RNA, 18 nt, Escherichia coli CFT073
gccgagagaagcgcguuc

SEQ ID NO: 610865 - RNA, 17 nt, Escherichia coli CFT073
gccgagaucaacagcau

SEQ ID NO: 610866 - RNA, 21 nt, Escherichia coli CFT073
gccgagaauaaaacaagcagc

SEQ ID NO: 610867 - RNA, 18 nt, Escherichia coli CFT073
gccgacuggcaucuguua

SEQ ID NO: 610868 - RNA, 13 nt, Escherichia coli CFT073
gcccgaucgagga

SEQ ID NO: 610869 - RNA, 20 nt, Escherichia coli CFT073
gcccgauagacaccaugucc

SEQ ID NO: 610870 - RNA, 21 nt, Escherichia coli CFT073
gccccuuguucaagagcuuca

SEQ ID NO: 610871 - RNA, 15 nt, Escherichia coli CFT073
gccccugaauaaucg

SEQ ID NO: 610872 - RNA, 17 nt, Escherichia coli CFT073
gccccuccggagagggg

SEQ ID NO: 610873 - RNA, 22 nt, Escherichia coli CFT073
gccccucacgcuuuauuuuuga

SEQ ID NO: 610874 - RNA, 15 nt, Escherichia coli CFT073
gccccgguuucucuu

SEQ ID NO: 610875 - RNA, 22 nt, Escherichia coli CFT073
gcccaggacaaucacauccgga

SEQ ID NO: 610876 - RNA, 22 nt, Escherichia coli CFT073
gcccaggaagcccgcccagcuu

SEQ ID NO: 610877 - RNA, 19 nt, Escherichia coli CFT073
gcccgcaaucaacauaaug

SEQ ID NO: 610878 - RNA, 21 nt, Escherichia coli CFT073
gcccgcacaccucacaccccg

SEQ ID NO: 610879 - RNA, 13 nt, Escherichia coli CFT073
gcccgauucacau

SEQ ID NO: 610880 - RNA, 20 nt, Escherichia coli CFT073
gcccgauugguucagacgcc

SEQ ID NO: 610881 - RNA, 20 nt, Escherichia coli CFT073
gcccggcaagugucgccugc

SEQ ID NO: 610882 - RNA, 15 nt, Escherichia coli CFT073
gcccggcaccagcac

SEQ ID NO: 610883 - RNA, 18 nt, Escherichia coli CFT073
gcccggcaccagcaccgu

SEQ ID NO: 610884 - RNA, 19 nt, Escherichia coli CFT073
gcccggagccaucccugca

SEQ ID NO: 610885 - RNA, 13 nt, Escherichia coli CFT073
gcccggaggaugc

SEQ ID NO: 610886 - RNA, 17 nt, Escherichia coli CFT073
gcccucgccuuuuugcg

SEQ ID NO: 610887 - RNA, 22 nt, Escherichia coli CFT073
gcccugucaccgggcaaacgcu

SEQ ID NO: 610888 - RNA, 19 nt, Escherichia coli CFT073
gcccuguuaccgggcuaca

SEQ ID NO: 610889 - RNA, 17 nt, Escherichia coli CFT073
gcccuggaucguggcug

SEQ ID NO: 610890 - RNA, 18 nt, Escherichia coli CFT073
gcccguaaaccugcaauu

SEQ ID NO: 610891 - RNA, 17 nt, Escherichia coli CFT073
gcccgguugcuuuucac

SEQ ID NO: 610892 - RNA, 19 nt, Escherichia coli CFT073
gcccgguuucgccgcggcg

SEQ ID NO: 610893 - RNA, 23 nt, Escherichia coli CFT073
gcccgguuucgccgcggcgcagc

SEQ ID NO: 610894 - RNA, 15 nt, Escherichia coli CFT073
gcccgguuauuuuua

SEQ ID NO: 610895 - RNA, 19 nt, Escherichia coli CFT073
gcccggcaugacgccgggc

SEQ ID NO: 610896 - RNA, 22 nt, Escherichia coli CFT073
gccaguccccucgccccuccgg

SEQ ID NO: 610897 - RNA, 20 nt, Escherichia coli CFT073
gccagucacugccaccaucc

SEQ ID NO: 610898 - RNA, 16 nt, Escherichia coli CFT073
gccagguuaaccagca

SEQ ID NO: 610899 - RNA, 20 nt, Escherichia coli CFT073
gccagguuuucuuucaccuc

SEQ ID NO: 610900 - RNA, 13 nt, Escherichia coli CFT073
gccaucaccaacg

SEQ ID NO: 610901 - RNA, 22 nt, Escherichia coli CFT073
gccaucacuauucagaucuugc

SEQ ID NO: 610902 - RNA, 13 nt, Escherichia coli CFT073
gccaucacacccu

SEQ ID NO: 610903 - RNA, 15 nt, Escherichia coli CFT073
gccaucaaugugcug

SEQ ID NO: 610904 - RNA, 21 nt, Escherichia coli CFT073
gccaucaauugcucacucccg

SEQ ID NO: 610905 - RNA, 16 nt, Escherichia coli CFT073
gccaucaaucccaucu

SEQ ID NO: 610906 - RNA, 17 nt, Escherichia coli CFT073
gccaucaacaauuccca

SEQ ID NO: 610907 - RNA, 14 nt, Escherichia coli CFT073
gccaucaacacuuu

SEQ ID NO: 610908 - RNA, 21 nt, Escherichia coli CFT073
gccaucauuucgauauguucc

SEQ ID NO: 610909 - RNA, 12 nt, Escherichia coli CFT073
gccauccacauu

SEQ ID NO: 610910 - RNA, 11 nt, Escherichia coli CFT073
gccauccggcu

SEQ ID NO: 610911 - RNA, 16 nt, Escherichia coli CFT073
gccauccggcucgcau

SEQ ID NO: 610912 - RNA, 23 nt, Escherichia coli CFT073
gccaucaguauuaucaaaucacc

SEQ ID NO: 610913 - RNA, 12 nt, Escherichia coli CFT073
gccaucagcagc

SEQ ID NO: 610914 - RNA, 16 nt, Escherichia coli CFT073
gccaucgccacaccag

SEQ ID NO: 610915 - RNA, 12 nt, Escherichia coli CFT073
gccaucgccagc

SEQ ID NO: 610916 - RNA, 15 nt, Escherichia coli CFT073
gccaucgccagcagc

SEQ ID NO: 610917 - RNA, 17 nt, Escherichia coli CFT073
gccaucucacuuugaga

SEQ ID NO: 610918 - RNA, 16 nt, Escherichia coli CFT073
gccaucuccaucaucu

SEQ ID NO: 610919 - RNA, 23 nt, Escherichia coli CFT073
gccaucucugcaacgucuucccg

SEQ ID NO: 610920 - RNA, 18 nt, Escherichia coli CFT073
gccauucuggcgcaacac

SEQ ID NO: 610921 - RNA, 18 nt, Escherichia coli CFT073
gccauugaguagccucug

SEQ ID NO: 610922 - RNA, 19 nt, Escherichia coli CFT073
gccauucaguuugcauggg

SEQ ID NO: 610923 - RNA, 22 nt, Escherichia coli CFT073
gccauuaccgauaucaauaaca

SEQ ID NO: 610924 - RNA, 19 nt, Escherichia coli CFT073
gccauuaaugccgcaacuu

SEQ ID NO: 610925 - RNA, 20 nt, Escherichia coli CFT073
gccauuauuaccgaugaagu

SEQ ID NO: 610926 - RNA, 15 nt, Escherichia coli CFT073
gccauguuuuccuuu

SEQ ID NO: 610927 - RNA, 12 nt, Escherichia coli CFT073
gccauuaaacaa

SEQ ID NO: 610928 - RNA, 13 nt, Escherichia coli CFT073
gccauuaaacaac

SEQ ID NO: 610929 - RNA, 19 nt, Escherichia coli CFT073
gccauuaaacgcaguaaac

SEQ ID NO: 610930 - RNA, 17 nt, Escherichia coli CFT073
gccauuaaaucagccuu

SEQ ID NO: 610931 - RNA, 15 nt, Escherichia coli CFT073
gccauuaacaucccu

SEQ ID NO: 610932 - RNA, 16 nt, Escherichia coli CFT073
gccauuaacuccacca

SEQ ID NO: 610933 - RNA, 18 nt, Escherichia coli CFT073
gccaugugcuuuuccuca

SEQ ID NO: 610934 - RNA, 18 nt, Escherichia coli CFT073
gccaucugaacucacaca

SEQ ID NO: 610935 - RNA, 16 nt, Escherichia coli CFT073
gccaugaaaaaguuac

SEQ ID NO: 610936 - RNA, 15 nt, Escherichia coli CFT073
gccaugaccuaaggu

SEQ ID NO: 610937 - RNA, 16 nt, Escherichia coli CFT073
gccaugaccaccgcag

SEQ ID NO: 610938 - RNA, 22 nt, Escherichia coli CFT073
gcccaauaaugaugagauccgc

SEQ ID NO: 610939 - RNA, 23 nt, Escherichia coli CFT073
gcccaaggcuaguacaggcggca

SEQ ID NO: 610940 - RNA, 22 nt, Escherichia coli CFT073
gcccaauauccauagugaagug

SEQ ID NO: 610941 - RNA, 20 nt, Escherichia coli CFT073
gcccacaccgcccagcgagc

SEQ ID NO: 610942 - RNA, 16 nt, Escherichia coli CFT073
gcccacaccagucagc

SEQ ID NO: 610943 - RNA, 20 nt, Escherichia coli CFT073
gcccacaccagucagcgaac

SEQ ID NO: 610944 - RNA, 16 nt, Escherichia coli CFT073
gcccaccaaagaacuu

SEQ ID NO: 610945 - RNA, 18 nt, Escherichia coli CFT073
gcccaccacaaaccagcc

SEQ ID NO: 610946 - RNA, 19 nt, Escherichia coli CFT073
gccauuuuuuuacccagcg

SEQ ID NO: 610947 - RNA, 16 nt, Escherichia coli CFT073
gccauuuugcgcggca

SEQ ID NO: 610948 - RNA, 18 nt, Escherichia coli CFT073
gcccaaaaauugccccca

SEQ ID NO: 610949 - RNA, 15 nt, Escherichia coli CFT073
gcccaaacgcccaga

SEQ ID NO: 610950 - RNA, 21 nt, Escherichia coli CFT073
gcccaaagagcaagaacccca

SEQ ID NO: 610951 - RNA, 18 nt, Escherichia coli CFT073
gcccaacaguagacaauu

SEQ ID NO: 610952 - RNA, 23 nt, Escherichia coli CFT073
gcccaaccacggaguugaccagc

SEQ ID NO: 610953 - RNA, 14 nt, Escherichia coli CFT073
gcccaaccagcagg

SEQ ID NO: 610954 - RNA, 15 nt, Escherichia coli CFT073
gcccaaccagcaggu

SEQ ID NO: 610955 - RNA, 13 nt, Escherichia coli CFT073
gccauugcuuuaa

SEQ ID NO: 610956 - RNA, 20 nt, Escherichia coli CFT073
gccauugcuggugauugcaa

SEQ ID NO: 610957 - RNA, 18 nt, Escherichia coli CFT073
gccauuuugcacauucca

SEQ ID NO: 610958 - RNA, 14 nt, Escherichia coli CFT073
gccauuugaugaau

SEQ ID NO: 610959 - RNA, 18 nt, Escherichia coli CFT073
gcccagaccgugcgcagc

SEQ ID NO: 610960 - RNA, 18 nt, Escherichia coli CFT073
gcccagcgccuggcagca

SEQ ID NO: 610961 - RNA, 19 nt, Escherichia coli CFT073
gcccagcgagcuggcggca

SEQ ID NO: 610962 - RNA, 13 nt, Escherichia coli CFT073
gcccagcgcagga

SEQ ID NO: 610963 - RNA, 15 nt, Escherichia coli CFT073
gcccacgcuacucgc

SEQ ID NO: 610964 - RNA, 14 nt, Escherichia coli CFT073
gcccacgccagccc

SEQ ID NO: 610965 - RNA, 21 nt, Escherichia coli CFT073
gcccaccccaauguuuuucuc

SEQ ID NO: 610966 - RNA, 14 nt, Escherichia coli CFT073
gccagcuaccagaa

SEQ ID NO: 610967 - RNA, 12 nt, Escherichia coli CFT073
gccagcucugcg

SEQ ID NO: 610968 - RNA, 20 nt, Escherichia coli CFT073
gccagcgcuuugauggcacu

SEQ ID NO: 610969 - RNA, 20 nt, Escherichia coli CFT073
gccagcgucugagcaggcgg

SEQ ID NO: 610970 - RNA, 14 nt, Escherichia coli CFT073
gccagcgccgcgcg

SEQ ID NO: 610971 - RNA, 19 nt, Escherichia coli CFT073
gccagcgcccguaaaccaa

SEQ ID NO: 610972 - RNA, 15 nt, Escherichia coli CFT073
gccagcgccgacagu

SEQ ID NO: 610973 - RNA, 16 nt, Escherichia coli CFT073
gccagcgacagaaauc

SEQ ID NO: 610974 - RNA, 14 nt, Escherichia coli CFT073
gccagcgagaaguc

SEQ ID NO: 610975 - RNA, 16 nt, Escherichia coli CFT073
gccaggcaccaaaaau

SEQ ID NO: 610976 - RNA, 20 nt, Escherichia coli CFT073
gccaggcgcgagaagaucca

SEQ ID NO: 610977 - RNA, 14 nt, Escherichia coli CFT073
gccaggcgcugcug

SEQ ID NO: 610978 - RNA, 19 nt, Escherichia coli CFT073
gccaggcgcugcuggagca

SEQ ID NO: 610979 - RNA, 13 nt, Escherichia coli CFT073
gccaggcuggcag

SEQ ID NO: 610980 - RNA, 14 nt, Escherichia coli CFT073
gccaggugcagccc

SEQ ID NO: 610981 - RNA, 17 nt, Escherichia coli CFT073
gccagggugcaggcgcu

SEQ ID NO: 610982 - RNA, 18 nt, Escherichia coli CFT073
gccagccccauaauauaa

SEQ ID NO: 610983 - RNA, 21 nt, Escherichia coli CFT073
gccagccgauccggauggauc

SEQ ID NO: 610984 - RNA, 16 nt, Escherichia coli CFT073
gccagccacaggccgg

SEQ ID NO: 610985 - RNA, 12 nt, Escherichia coli CFT073
gccagccagcca

SEQ ID NO: 610986 - RNA, 23 nt, Escherichia coli CFT073
gccagcauuggcguuugaccgac

SEQ ID NO: 610987 - RNA, 18 nt, Escherichia coli CFT073
gccagcagcgaaucagcc

SEQ ID NO: 610988 - RNA, 22 nt, Escherichia coli CFT073
gccagcagcgaaucagcccagc

SEQ ID NO: 610989 - RNA, 15 nt, Escherichia coli CFT073
gccagcaccgggcca

SEQ ID NO: 610990 - RNA, 17 nt, Escherichia coli CFT073
gccagcaucagacccac

SEQ ID NO: 610991 - RNA, 21 nt, Escherichia coli CFT073
gccagcauaaucaccaucagc

SEQ ID NO: 610992 - RNA, 23 nt, Escherichia coli CFT073
gccagcauaaucaccaucagcag

SEQ ID NO: 610993 - RNA, 17 nt, Escherichia coli CFT073
gccagcagcugacugac

SEQ ID NO: 610994 - RNA, 22 nt, Escherichia coli CFT073
gccagcagcugacugacuucaa

SEQ ID NO: 610995 - RNA, 14 nt, Escherichia coli CFT073
gccagcauggcacc

SEQ ID NO: 610996 - RNA, 23 nt, Escherichia coli CFT073
gccagcaugccuguggcgcgacc

SEQ ID NO: 610997 - RNA, 19 nt, Escherichia coli CFT073
gccagcaucuccauacaga

SEQ ID NO: 610998 - RNA, 21 nt, Escherichia coli CFT073
gccagcaucggcaacgccagc

SEQ ID NO: 610999 - RNA, 12 nt, Escherichia coli CFT073
gccagagcagcg

SEQ ID NO: 611000 - RNA, 15 nt, Escherichia coli CFT073
gccagcaaaucagcc

SEQ ID NO: 611001 - RNA, 17 nt, Escherichia coli CFT073
gccagaaaguggcacac

SEQ ID NO: 611002 - RNA, 12 nt, Escherichia coli CFT073
gccagaaaucag

SEQ ID NO: 611003 - RNA, 19 nt, Escherichia coli CFT073
gccagacucaccagcaucg

SEQ ID NO: 611004 - RNA, 13 nt, Escherichia coli CFT073
gccagacucgcca

SEQ ID NO: 611005 - RNA, 15 nt, Escherichia coli CFT073
gccagagaagcgacu

SEQ ID NO: 611006 - RNA, 23 nt, Escherichia coli CFT073
gccagcacauagccgaaaaugcu

SEQ ID NO: 611007 - RNA, 14 nt, Escherichia coli CFT073
gccagcaauggaca

SEQ ID NO: 611008 - RNA, 15 nt, Escherichia coli CFT073
gccagcaauccccag

SEQ ID NO: 611009 - RNA, 21 nt, Escherichia coli CFT073
gccagcaccacuuuacgggca

SEQ ID NO: 611010 - RNA, 22 nt, Escherichia coli CFT073
gccagcaaccaacgcuagcagc

SEQ ID NO: 611011 - RNA, 18 nt, Escherichia coli CFT073
gccacuuucacgccgcca

SEQ ID NO: 611012 - RNA, 20 nt, Escherichia coli CFT073
gccacuucuuccagcggcag

SEQ ID NO: 611013 - RNA, 20 nt, Escherichia coli CFT073
gccacuuuuuucacccacac

SEQ ID NO: 611014 - RNA, 18 nt, Escherichia coli CFT073
gccagaaaaccuggcgca

SEQ ID NO: 611015 - RNA, 21 nt, Escherichia coli CFT073
gccagaaaaccuggcgcagug

SEQ ID NO: 611016 - RNA, 23 nt, Escherichia coli CFT073
gccacuucuuccagcggcaggcc

SEQ ID NO: 611017 - RNA, 17 nt, Escherichia coli CFT073
gccagaaacaucggcag

SEQ ID NO: 611018 - RNA, 13 nt, Escherichia coli CFT073
gccagaaaccagc

SEQ ID NO: 611019 - RNA, 19 nt, Escherichia coli CFT073
gccagaaaccaucuauaaa

SEQ ID NO: 611020 - RNA, 14 nt, Escherichia coli CFT073
gccagaaaggcuuu

SEQ ID NO: 611021 - RNA, 15 nt, Escherichia coli CFT073
gccagaaagguauuu

SEQ ID NO: 611022 - RNA, 14 nt, Escherichia coli CFT073
gccacuucaaccag

SEQ ID NO: 611023 - RNA, 15 nt, Escherichia coli CFT073
gccacuucaaccagc

SEQ ID NO: 611024 - RNA, 16 nt, Escherichia coli CFT073
gccacugcgccgggca

SEQ ID NO: 611025 - RNA, 20 nt, Escherichia coli CFT073
gccacugcgacaccagcaug

SEQ ID NO: 611026 - RNA, 18 nt, Escherichia coli CFT073
gccaccggcaaucugcug

SEQ ID NO: 611027 - RNA, 22 nt, Escherichia coli CFT073
gccacaaucgcagcgcaagcug

SEQ ID NO: 611028 - RNA, 13 nt, Escherichia coli CFT073
gccacaagggcau

SEQ ID NO: 611029 - RNA, 13 nt, Escherichia coli CFT073
gccacaacuucaa

SEQ ID NO: 611030 - RNA, 13 nt, Escherichia coli CFT073
gccaauuuccgcu

SEQ ID NO: 611031 - RNA, 17 nt, Escherichia coli CFT073
gccaauuugcgccgccg

SEQ ID NO: 611032 - RNA, 22 nt, Escherichia coli CFT073
gccacaacgauaauccagcaga

SEQ ID NO: 611033 - RNA, 20 nt, Escherichia coli CFT073
gccaaucuucacaucaucau

SEQ ID NO: 611034 - RNA, 19 nt, Escherichia coli CFT073
gccaaucuucacaucauca

SEQ ID NO: 611035 - RNA, 18 nt, Escherichia coli CFT073
gccaauuaccacugaggc

SEQ ID NO: 611036 - RNA, 13 nt, Escherichia coli CFT073
gccaauucauucc

SEQ ID NO: 611037 - RNA, 11 nt, Escherichia coli CFT073
gccaauuccca

SEQ ID NO: 611038 - RNA, 11 nt, Escherichia coli CFT073
gccaaugguua

SEQ ID NO: 611039 - RNA, 21 nt, Escherichia coli CFT073
gccaaugguuaaguugaaaac

SEQ ID NO: 611040 - RNA, 18 nt, Escherichia coli CFT073
gccaauguacggaauaag

SEQ ID NO: 611041 - RNA, 19 nt, Escherichia coli CFT073
gccaaucccggaagccacc

SEQ ID NO: 611042 - RNA, 20 nt, Escherichia coli CFT073
gccaaucccggaagccacca

SEQ ID NO: 611043 - RNA, 19 nt, Escherichia coli CFT073
gccaaucagcgcagcaccc

SEQ ID NO: 611044 - RNA, 11 nt, Escherichia coli CFT073
gccaauaaucu

SEQ ID NO: 611045 - RNA, 13 nt, Escherichia coli CFT073
gccaauaaucugc

SEQ ID NO: 611046 - RNA, 21 nt, Escherichia coli CFT073
gccaauaaugcccgcaccacc

SEQ ID NO: 611047 - RNA, 15 nt, Escherichia coli CFT073
gccaauaccgaucag

SEQ ID NO: 611048 - RNA, 19 nt, Escherichia coli CFT073
gccaaguucgaacgccgcc

SEQ ID NO: 611049 - RNA, 20 nt, Escherichia coli CFT073
gccaaguucgaacgccgcca

SEQ ID NO: 611050 - RNA, 15 nt, Escherichia coli CFT073
gccaaggucgggguc

SEQ ID NO: 611051 - RNA, 13 nt, Escherichia coli CFT073
gccaccgcgggca

SEQ ID NO: 611052 - RNA, 14 nt, Escherichia coli CFT073
gccacccagcgagg

SEQ ID NO: 611053 - RNA, 18 nt, Escherichia coli CFT073
gccaccccagucguccag

SEQ ID NO: 611054 - RNA, 13 nt, Escherichia coli CFT073
gccaccaccagcg

SEQ ID NO: 611055 - RNA, 15 nt, Escherichia coli CFT073
gccaccaccaguaca

SEQ ID NO: 611056 - RNA, 16 nt, Escherichia coli CFT073
gccaccaacaguaauu

SEQ ID NO: 611057 - RNA, 15 nt, Escherichia coli CFT073
gccaccaacgcacca

SEQ ID NO: 611058 - RNA, 17 nt, Escherichia coli CFT073
gccacauuucucuguca

SEQ ID NO: 611059 - RNA, 13 nt, Escherichia coli CFT073
gccacagcguucg

SEQ ID NO: 611060 - RNA, 22 nt, Escherichia coli CFT073
gccacagcaauuuugcccagcc

SEQ ID NO: 611061 - RNA, 22 nt, Escherichia coli CFT073
gccacagcaguuagcuuuucuc

SEQ ID NO: 611062 - RNA, 21 nt, Escherichia coli CFT073
gccacagauaauaauguguuc

SEQ ID NO: 611063 - RNA, 15 nt, Escherichia coli CFT073
gccacacgacgccag

SEQ ID NO: 611064 - RNA, 18 nt, Escherichia coli CFT073
gccacacgacgccagcca

SEQ ID NO: 611065 - RNA, 15 nt, Escherichia coli CFT073
gccacagcaagcagc

SEQ ID NO: 611066 - RNA, 16 nt, Escherichia coli CFT073
gccacagcaagcagcc

SEQ ID NO: 611067 - RNA, 21 nt, Escherichia coli CFT073
gccacagcaauuuugcccagc

SEQ ID NO: 611068 - RNA, 22 nt, Escherichia coli CFT073
gccacaccugccgggaauacug

SEQ ID NO: 611069 - RNA, 16 nt, Escherichia coli CFT073
gccaaacauuucacgu

SEQ ID NO: 611070 - RNA, 12 nt, Escherichia coli CFT073
gccaaaccacgg

SEQ ID NO: 611071 - RNA, 12 nt, Escherichia coli CFT073
gccaaaccagcu

SEQ ID NO: 611072 - RNA, 20 nt, Escherichia coli CFT073
gccaaaccauugcuuaaagu

SEQ ID NO: 611073 - RNA, 13 nt, Escherichia coli CFT073
gccaaagaccagg

SEQ ID NO: 611074 - RNA, 17 nt, Escherichia coli CFT073
gccaaagaccaggaaac

SEQ ID NO: 611075 - RNA, 12 nt, Escherichia coli CFT073
gccaaagggagc

SEQ ID NO: 611076 - RNA, 18 nt, Escherichia coli CFT073
gccaaagcggcaguuaaa

SEQ ID NO: 611077 - RNA, 13 nt, Escherichia coli CFT073
gccaaagccgccg

SEQ ID NO: 611078 - RNA, 14 nt, Escherichia coli CFT073
gccaaagccgccga

SEQ ID NO: 611079 - RNA, 16 nt, Escherichia coli CFT073
gccaaagccgccgagc

SEQ ID NO: 611080 - RNA, 17 nt, Escherichia coli CFT073
gccaaagggagcagacu

SEQ ID NO: 611081 - RNA, 15 nt, Escherichia coli CFT073
gcauuuuuucuucag

SEQ ID NO: 611082 - RNA, 14 nt, Escherichia coli CFT073
gccaaaaauggaga

SEQ ID NO: 611083 - RNA, 22 nt, Escherichia coli CFT073
gccaaaaauggagagaaccagc

SEQ ID NO: 611084 - RNA, 22 nt, Escherichia coli CFT073
gcauuuuuuaucacuucuucuu

SEQ ID NO: 611085 - RNA, 21 nt, Escherichia coli CFT073
gcauuuuuuauggagaaaaca

SEQ ID NO: 611086 - RNA, 22 nt, Escherichia coli CFT073
gcauuuuuuauggagaaaacau

SEQ ID NO: 611087 - RNA, 15 nt, Escherichia coli CFT073
gcauuuucugcgcau

SEQ ID NO: 611088 - RNA, 21 nt, Escherichia coli CFT073
gcauuuucuaugcugccacac

SEQ ID NO: 611089 - RNA, 23 nt, Escherichia coli CFT073
gcauuuucucgugccgccaguac

SEQ ID NO: 611090 - RNA, 15 nt, Escherichia coli CFT073
gcauuuugcagcugu

SEQ ID NO: 611091 - RNA, 14 nt, Escherichia coli CFT073
gcauuuucagcguu

SEQ ID NO: 611092 - RNA, 19 nt, Escherichia coli CFT073
gcauuugagcaggaugccu

SEQ ID NO: 611093 - RNA, 17 nt, Escherichia coli CFT073
gcauuuguugguacacc

SEQ ID NO: 611094 - RNA, 19 nt, Escherichia coli CFT073
gcauuuccgccaaucaaga

SEQ ID NO: 611095 - RNA, 17 nt, Escherichia coli CFT073
gcauuuccgcugauuca

SEQ ID NO: 611096 - RNA, 23 nt, Escherichia coli CFT073
gcauuucuuuuauggucaucguu

SEQ ID NO: 611097 - RNA, 13 nt, Escherichia coli CFT073
gcauuucggcuuu

SEQ ID NO: 611098 - RNA, 18 nt, Escherichia coli CFT073
gccaaccgcgacaauauc

SEQ ID NO: 611099 - RNA, 17 nt, Escherichia coli CFT073
gccaaccgcugauugcu

SEQ ID NO: 611100 - RNA, 19 nt, Escherichia coli CFT073
gccaaccucaaaaagaaac

SEQ ID NO: 611101 - RNA, 11 nt, Escherichia coli CFT073
gccaaccugca

SEQ ID NO: 611102 - RNA, 16 nt, Escherichia coli CFT073
gccaaccugcugguca

SEQ ID NO: 611103 - RNA, 15 nt, Escherichia coli CFT073
gccaaccaggaugau

SEQ ID NO: 611104 - RNA, 22 nt, Escherichia coli CFT073
gccaaccaucgccguaaagccg

SEQ ID NO: 611105 - RNA, 13 nt, Escherichia coli CFT073
gccaaccaucggu

SEQ ID NO: 611106 - RNA, 16 nt, Escherichia coli CFT073
gccaaccaugccgccc

SEQ ID NO: 611107 - RNA, 14 nt, Escherichia coli CFT073
gccaaccacaugau

SEQ ID NO: 611108 - RNA, 15 nt, Escherichia coli CFT073
gccaaauccagcgca

SEQ ID NO: 611109 - RNA, 20 nt, Escherichia coli CFT073
gccaaauggcaggcacaggu

SEQ ID NO: 611110 - RNA, 20 nt, Escherichia coli CFT073
gccaaauucggcgguuuuuu

SEQ ID NO: 611111 - RNA, 15 nt, Escherichia coli CFT073
gccaacaaaaaauug

SEQ ID NO: 611112 - RNA, 21 nt, Escherichia coli CFT073
gccaacuccaccaauaaugcc

SEQ ID NO: 611113 - RNA, 13 nt, Escherichia coli CFT073
gccaagaaacacc

SEQ ID NO: 611114 - RNA, 11 nt, Escherichia coli CFT073
gccaagcaggc

SEQ ID NO: 611115 - RNA, 20 nt, Escherichia coli CFT073
gcauuccuuguuuaaggaaa

SEQ ID NO: 611116 - RNA, 14 nt, Escherichia coli CFT073
gcauucaugaacac

SEQ ID NO: 611117 - RNA, 14 nt, Escherichia coli CFT073
gcauuauggugaag

SEQ ID NO: 611118 - RNA, 21 nt, Escherichia coli CFT073
gcauucagacacgccgccaga

SEQ ID NO: 611119 - RNA, 14 nt, Escherichia coli CFT073
gcauugaaaauuac

SEQ ID NO: 611120 - RNA, 16 nt, Escherichia coli CFT073
gcauucgccacugcca

SEQ ID NO: 611121 - RNA, 16 nt, Escherichia coli CFT073
gcauucggcauugaau

SEQ ID NO: 611122 - RNA, 18 nt, Escherichia coli CFT073
gcauugauuuuaauaaau

SEQ ID NO: 611123 - RNA, 17 nt, Escherichia coli CFT073
gcauugaggguauccag

SEQ ID NO: 611124 - RNA, 22 nt, Escherichia coli CFT073
gcauuggcaaucacaucaccau

SEQ ID NO: 611125 - RNA, 17 nt, Escherichia coli CFT073
gcauugcucccugcggc

SEQ ID NO: 611126 - RNA, 17 nt, Escherichia coli CFT073
gcauugcuucccauguc

SEQ ID NO: 611127 - RNA, 17 nt, Escherichia coli CFT073
gcauuucccagcaagaa

SEQ ID NO: 611128 - RNA, 17 nt, Escherichia coli CFT073
gcauuuaaccgccgagc

SEQ ID NO: 611129 - RNA, 22 nt, Escherichia coli CFT073
gcauuuaugccauguucaucaa

SEQ ID NO: 611130 - RNA, 20 nt, Escherichia coli CFT073
gcauugucaggaucaccaau

SEQ ID NO: 611131 - RNA, 22 nt, Escherichia coli CFT073
gcauugucaggaucaccaauac

SEQ ID NO: 611132 - RNA, 19 nt, Escherichia coli CFT073
gcauugucugaacguucug

SEQ ID NO: 611133 - RNA, 20 nt, Escherichia coli CFT073
gcauuaauaagguaauuauu

SEQ ID NO: 611134 - RNA, 22 nt, Escherichia coli CFT073
gcauuaacuccccuuuaaauua

SEQ ID NO: 611135 - RNA, 18 nt, Escherichia coli CFT073
gcauguuuuuuaaguuca

SEQ ID NO: 611136 - RNA, 18 nt, Escherichia coli CFT073
gcauuaaauucagcaaau

SEQ ID NO: 611137 - RNA, 22 nt, Escherichia coli CFT073
gcauuaacgaaacccgaaccac

SEQ ID NO: 611138 - RNA, 21 nt, Escherichia coli CFT073
gcauuacgcucgcugcaaaac

SEQ ID NO: 611139 - RNA, 17 nt, Escherichia coli CFT073
gcauuacggaacugcuc

SEQ ID NO: 611140 - RNA, 16 nt, Escherichia coli CFT073
gcauguuuaaccaagu

SEQ ID NO: 611141 - RNA, 15 nt, Escherichia coli CFT073
gcauggcagccaggu

SEQ ID NO: 611142 - RNA, 16 nt, Escherichia coli CFT073
gcauggcgaauggcac

SEQ ID NO: 611143 - RNA, 14 nt, Escherichia coli CFT073
gcaugguacccaau

SEQ ID NO: 611144 - RNA, 22 nt, Escherichia coli CFT073
gcaugguaacgccccacaagcc

SEQ ID NO: 611145 - RNA, 22 nt, Escherichia coli CFT073
gcauggguaaagcccaucgcca

SEQ ID NO: 611146 - RNA, 12 nt, Escherichia coli CFT073
gcauggggagac

SEQ ID NO: 611147 - RNA, 13 nt, Escherichia coli CFT073
gcauggggagacc

SEQ ID NO: 611148 - RNA, 14 nt, Escherichia coli CFT073
gcauggggagaccc

SEQ ID NO: 611149 - RNA, 14 nt, Escherichia coli CFT073
gcaugcauuuucaa

SEQ ID NO: 611150 - RNA, 20 nt, Escherichia coli CFT073
gcaugauuucaucaucaggc

SEQ ID NO: 611151 - RNA, 12 nt, Escherichia coli CFT073
gcaugauuuuca

SEQ ID NO: 611152 - RNA, 19 nt, Escherichia coli CFT073
gcaugauaccgauuacuca

SEQ ID NO: 611153 - RNA, 20 nt, Escherichia coli CFT073
gcaugauguaagaugaaaua

SEQ ID NO: 611154 - RNA, 16 nt, Escherichia coli CFT073
gcaugaacaaaacaua

SEQ ID NO: 611155 - RNA, 16 nt, Escherichia coli CFT073
gcaugaaagcgaugcu

SEQ ID NO: 611156 - RNA, 19 nt, Escherichia coli CFT073
gcaugaaauagcccacuac

SEQ ID NO: 611157 - RNA, 19 nt, Escherichia coli CFT073
gcaucuuuuucaaugcaua

SEQ ID NO: 611158 - RNA, 19 nt, Escherichia coli CFT073
gcaucuuuuuuuaccugaa

SEQ ID NO: 611159 - RNA, 15 nt, Escherichia coli CFT073
gcaugaacaaagcuc

SEQ ID NO: 611160 - RNA, 17 nt, Escherichia coli CFT073
gcaugaaguaacagaag

SEQ ID NO: 611161 - RNA, 22 nt, Escherichia coli CFT073
gcaugacacacucugaccuguc

SEQ ID NO: 611162 - RNA, 13 nt, Escherichia coli CFT073
gcaugacagcgcc

SEQ ID NO: 611163 - RNA, 14 nt, Escherichia coli CFT073
gcaugacaggcaac

SEQ ID NO: 611164 - RNA, 19 nt, Escherichia coli CFT073
gcaucuucuucuaugccag

SEQ ID NO: 611165 - RNA, 17 nt, Escherichia coli CFT073
gcaucuucgcuuucaag

SEQ ID NO: 611166 - RNA, 20 nt, Escherichia coli CFT073
gcaucuuaaucucucaacac

SEQ ID NO: 611167 - RNA, 16 nt, Escherichia coli CFT073
gcaucuucuucuggcu

SEQ ID NO: 611168 - RNA, 21 nt, Escherichia coli CFT073
gcaucucgcgcucuucuucac

SEQ ID NO: 611169 - RNA, 18 nt, Escherichia coli CFT073
gcaucucgcgcucuucuu

SEQ ID NO: 611170 - RNA, 14 nt, Escherichia coli CFT073
gcaucugaagccug

SEQ ID NO: 611171 - RNA, 14 nt, Escherichia coli CFT073
gcaucugauaagcc

SEQ ID NO: 611172 - RNA, 20 nt, Escherichia coli CFT073
gcaucuggcauaaacaaagc

SEQ ID NO: 611173 - RNA, 19 nt, Escherichia coli CFT073
gcaucugcuguaaagucug

SEQ ID NO: 611174 - RNA, 17 nt, Escherichia coli CFT073
gcaucuggcauuuugcu

SEQ ID NO: 611175 - RNA, 19 nt, Escherichia coli CFT073
gcaucuggugccagcgcca

SEQ ID NO: 611176 - RNA, 22 nt, Escherichia coli CFT073
gcaucuggugccagcgccagca

SEQ ID NO: 611177 - RNA, 23 nt, Escherichia coli CFT073
gcaucuggugccagcgccagcac

SEQ ID NO: 611178 - RNA, 23 nt, Escherichia coli CFT073
gcaucugguuuuuuauauucaug

SEQ ID NO: 611179 - RNA, 17 nt, Escherichia coli CFT073
gcaucuguaugucagua

SEQ ID NO: 611180 - RNA, 20 nt, Escherichia coli CFT073
gcaucugguaacccauccag

SEQ ID NO: 611181 - RNA, 21 nt, Escherichia coli CFT073
gcaucguccgucgaaagccca

SEQ ID NO: 611182 - RNA, 18 nt, Escherichia coli CFT073
gcaucguaguuuuugccc

SEQ ID NO: 611183 - RNA, 23 nt, Escherichia coli CFT073
gcaucguauuggugcauaacaca

SEQ ID NO: 611184 - RNA, 15 nt, Escherichia coli CFT073
gcaucgugaauuuua

SEQ ID NO: 611185 - RNA, 18 nt, Escherichia coli CFT073
gcaucgcgaccaaucaca

SEQ ID NO: 611186 - RNA, 16 nt, Escherichia coli CFT073
gcaucgcgaggaauga

SEQ ID NO: 611187 - RNA, 15 nt, Escherichia coli CFT073
gcaucgccgguuuug

SEQ ID NO: 611188 - RNA, 18 nt, Escherichia coli CFT073
gcaucgccgguuuugcca

SEQ ID NO: 611189 - RNA, 19 nt, Escherichia coli CFT073
gcaucgcuagauauauauu

SEQ ID NO: 611190 - RNA, 20 nt, Escherichia coli CFT073
gcaucgcuagauauauauua

SEQ ID NO: 611191 - RNA, 20 nt, Escherichia coli CFT073
gcaucgccgggcuaaccgcu

SEQ ID NO: 611192 - RNA, 22 nt, Escherichia coli CFT073
gcaucgcccaggcgaccaggcc

SEQ ID NO: 611193 - RNA, 20 nt, Escherichia coli CFT073
gcaucgcaacgcaucuuuuu

SEQ ID NO: 611194 - RNA, 23 nt, Escherichia coli CFT073
gcaucggcaaaacgguaguugaa

SEQ ID NO: 611195 - RNA, 21 nt, Escherichia coli CFT073
gcaucgcuuugugcucuuccu

SEQ ID NO: 611196 - RNA, 18 nt, Escherichia coli CFT073
gcaucgguaucaucccag

SEQ ID NO: 611197 - RNA, 20 nt, Escherichia coli CFT073
gcaucgguaucgaauaaaga

SEQ ID NO: 611198 - RNA, 22 nt, Escherichia coli CFT073
gcaucggugaggaucaccaguc

SEQ ID NO: 611199 - RNA, 22 nt, Escherichia coli CFT073
gcucuacaauugguaaauaagc

SEQ ID NO: 611200 - RNA, 22 nt, Escherichia coli CFT073
gcucuaacccuuccagauucag

SEQ ID NO: 611201 - RNA, 16 nt, Escherichia coli CFT073
gcucuacgcuucucuc

SEQ ID NO: 611202 - RNA, 18 nt, Escherichia coli CFT073
gcucuacgcuucucucug

SEQ ID NO: 611203 - RNA, 22 nt, Escherichia coli CFT073
gcucucacuuauuuguuauuac

SEQ ID NO: 611204 - RNA, 14 nt, Escherichia coli CFT073
gcucucauuuuuca

SEQ ID NO: 611205 - RNA, 17 nt, Escherichia coli CFT073
gcucuaucugcacugcu

SEQ ID NO: 611206 - RNA, 21 nt, Escherichia coli CFT073
gcucucccauuuuauccucuu

SEQ ID NO: 611207 - RNA, 12 nt, Escherichia coli CFT073
gcucucgccagc

SEQ ID NO: 611208 - RNA, 16 nt, Escherichia coli CFT073
gcucuaaaucuucuuc

SEQ ID NO: 611209 - RNA, 17 nt, Escherichia coli CFT073
gcucuaaaaaguuccug

SEQ ID NO: 611210 - RNA, 23 nt, Escherichia coli CFT073
gcucguugguacgaucagaguug

SEQ ID NO: 611211 - RNA, 21 nt, Escherichia coli CFT073
gcucgugcagaacauccagcu

SEQ ID NO: 611212 - RNA, 12 nt, Escherichia coli CFT073
gcucgccgccgc

SEQ ID NO: 611213 - RNA, 19 nt, Escherichia coli CFT073
gcucucuuucaccagcgcg

SEQ ID NO: 611214 - RNA, 21 nt, Escherichia coli CFT073
gcucucuuucaccagcgcgag

SEQ ID NO: 611215 - RNA, 23 nt, Escherichia coli CFT073
gcucucuucguggcccgccagca

SEQ ID NO: 611216 - RNA, 17 nt, Escherichia coli CFT073
gcucugaaagcggccuu

SEQ ID NO: 611217 - RNA, 21 nt, Escherichia coli CFT073
gcucugcaucccggcaggaau

SEQ ID NO: 611218 - RNA, 13 nt, Escherichia coli CFT073
gcucugcgcccug

SEQ ID NO: 611219 - RNA, 15 nt, Escherichia coli CFT073
gcucugcgcccugca

SEQ ID NO: 611220 - RNA, 14 nt, Escherichia coli CFT073
gcucuuaucaccaa

SEQ ID NO: 611221 - RNA, 15 nt, Escherichia coli CFT073
gcucuuaucaccaaa

SEQ ID NO: 611222 - RNA, 17 nt, Escherichia coli CFT073
gcucuguucugcgccug

SEQ ID NO: 611223 - RNA, 13 nt, Escherichia coli CFT073
gcucuguuuucug

SEQ ID NO: 611224 - RNA, 22 nt, Escherichia coli CFT073
gcucuuaacgaaaacugacggu

SEQ ID NO: 611225 - RNA, 14 nt, Escherichia coli CFT073
gcucuggaugaaau

SEQ ID NO: 611226 - RNA, 13 nt, Escherichia coli CFT073
gcucuggcagcac

SEQ ID NO: 611227 - RNA, 20 nt, Escherichia coli CFT073
gcucuggcaggcuucaauuu

SEQ ID NO: 611228 - RNA, 23 nt, Escherichia coli CFT073
gcucuggcaggcuucaauuuuuu

SEQ ID NO: 611229 - RNA, 19 nt, Escherichia coli CFT073
gcucugguuccccauucug

SEQ ID NO: 611230 - RNA, 20 nt, Escherichia coli CFT073
gcucugguuccccauucugc

SEQ ID NO: 611231 - RNA, 18 nt, Escherichia coli CFT073
gcucuguaacccugugga

SEQ ID NO: 611232 - RNA, 17 nt, Escherichia coli CFT073
gcugaaaaggcuaaaau

SEQ ID NO: 611233 - RNA, 20 nt, Escherichia coli CFT073
gcugaaaauauucccgucau

SEQ ID NO: 611234 - RNA, 18 nt, Escherichia coli CFT073
gcucuuucucuucuaguu

SEQ ID NO: 611235 - RNA, 17 nt, Escherichia coli CFT073
gcucuucaucuuccagu

SEQ ID NO: 611236 - RNA, 13 nt, Escherichia coli CFT073
gcucuucuucacg

SEQ ID NO: 611237 - RNA, 20 nt, Escherichia coli CFT073
gcucuugcuuacgcagacaa

SEQ ID NO: 611238 - RNA, 22 nt, Escherichia coli CFT073
gcugauggucagugccugcgcc

SEQ ID NO: 611239 - RNA, 15 nt, Escherichia coli CFT073
gcugauaacaauauc

SEQ ID NO: 611240 - RNA, 18 nt, Escherichia coli CFT073
gcugagugcgaaaaucaa

SEQ ID NO: 611241 - RNA, 21 nt, Escherichia coli CFT073
gcugaucaccguagaaggcga

SEQ ID NO: 611242 - RNA, 21 nt, Escherichia coli CFT073
gcugagcuucuucaaaaaagu

SEQ ID NO: 611243 - RNA, 18 nt, Escherichia coli CFT073
gcugagguuaugcaaacg

SEQ ID NO: 611244 - RNA, 23 nt, Escherichia coli CFT073
gcugagcgugccccugaauaauc

SEQ ID NO: 611245 - RNA, 16 nt, Escherichia coli CFT073
gcugacguagcagcuc

SEQ ID NO: 611246 - RNA, 18 nt, Escherichia coli CFT073
gcugacguuaagaaaacg

SEQ ID NO: 611247 - RNA, 21 nt, Escherichia coli CFT073
gcugagcaaacaguucugcag

SEQ ID NO: 611248 - RNA, 12 nt, Escherichia coli CFT073
gcugagaaaaag

SEQ ID NO: 611249 - RNA, 17 nt, Escherichia coli CFT073
gcugagcaggugugaug

SEQ ID NO: 611250 - RNA, 18 nt, Escherichia coli CFT073
gcugaauacgcaccacac

SEQ ID NO: 611251 - RNA, 15 nt, Escherichia coli CFT073
gcugaauaucuuucu

SEQ ID NO: 611252 - RNA, 16 nt, Escherichia coli CFT073
gcugaauaucuuucuc

SEQ ID NO: 611253 - RNA, 23 nt, Escherichia coli CFT073
gcugaauggauucagucuuaaaa

SEQ ID NO: 611254 - RNA, 19 nt, Escherichia coli CFT073
gcugaauggcgauuucaca

SEQ ID NO: 611255 - RNA, 20 nt, Escherichia coli CFT073
gcugaauuggguucuuuccu

SEQ ID NO: 611256 - RNA, 23 nt, Escherichia coli CFT073
gcugaauuggguucuuuccugcg

SEQ ID NO: 611257 - RNA, 23 nt, Escherichia coli CFT073
gcugaauuuuuuucucgcggcgg

SEQ ID NO: 611258 - RNA, 16 nt, Escherichia coli CFT073
gcugacaacuccuguu

SEQ ID NO: 611259 - RNA, 14 nt, Escherichia coli CFT073
gcugaaauguaaaa

SEQ ID NO: 611260 - RNA, 11 nt, Escherichia coli CFT073
gcugaaaucac

SEQ ID NO: 611261 - RNA, 17 nt, Escherichia coli CFT073
gcugaacgugcucugcg

SEQ ID NO: 611262 - RNA, 22 nt, Escherichia coli CFT073
gcugaacgccugcaccagccuu

SEQ ID NO: 611263 - RNA, 16 nt, Escherichia coli CFT073
gcugacaucaacagaa

SEQ ID NO: 611264 - RNA, 22 nt, Escherichia coli CFT073
gcugacauaaacaccagcaaua

SEQ ID NO: 611265 - RNA, 23 nt, Escherichia coli CFT073
gcugacauaaacaccagcaauaa

SEQ ID NO: 611266 - RNA, 18 nt, Escherichia coli CFT073
gcugacauggcaauagcu

SEQ ID NO: 611267 - RNA, 13 nt, Escherichia coli CFT073
gcugaccaccagc

SEQ ID NO: 611268 - RNA, 16 nt, Escherichia coli CFT073
gcugaccaccagcacg

SEQ ID NO: 611269 - RNA, 12 nt, Escherichia coli CFT073
gcugacacaucu

SEQ ID NO: 611270 - RNA, 22 nt, Escherichia coli CFT073
gcugacacgggaaaccaacucc

SEQ ID NO: 611271 - RNA, 18 nt, Escherichia coli CFT073
gcugacaggcgcugauga

SEQ ID NO: 611272 - RNA, 14 nt, Escherichia coli CFT073
gcugaccgaaauaa

SEQ ID NO: 611273 - RNA, 16 nt, Escherichia coli CFT073
gcugaccagacuggag

SEQ ID NO: 611274 - RNA, 17 nt, Escherichia coli CFT073
gcugacgaucauuccgc

SEQ ID NO: 611275 - RNA, 20 nt, Escherichia coli CFT073
gcugacgcagcgaugguacu

SEQ ID NO: 611276 - RNA, 17 nt, Escherichia coli CFT073
gcugacgcaucuuaucc

SEQ ID NO: 611277 - RNA, 21 nt, Escherichia coli CFT073
gcugaccgucaaagcgccagc

SEQ ID NO: 611278 - RNA, 14 nt, Escherichia coli CFT073
gcugaccuggaagu

SEQ ID NO: 611279 - RNA, 20 nt, Escherichia coli CFT073
gcuccaguaccugcaaaccg

SEQ ID NO: 611280 - RNA, 22 nt, Escherichia coli CFT073
gcuccaguaccuucguccaucc

SEQ ID NO: 611281 - RNA, 15 nt, Escherichia coli CFT073
gcuccccaaaagaaa

SEQ ID NO: 611282 - RNA, 19 nt, Escherichia coli CFT073
gcuccagaauuccgugcca

SEQ ID NO: 611283 - RNA, 21 nt, Escherichia coli CFT073
gcuccagcgggcgaaucaacu

SEQ ID NO: 611284 - RNA, 16 nt, Escherichia coli CFT073
gcuccagcguaccugc

SEQ ID NO: 611285 - RNA, 20 nt, Escherichia coli CFT073
gcuccagcguaccugccgcg

SEQ ID NO: 611286 - RNA, 13 nt, Escherichia coli CFT073
gcuccacgccagc

SEQ ID NO: 611287 - RNA, 17 nt, Escherichia coli CFT073
gcucacggcggcaguau

SEQ ID NO: 611288 - RNA, 21 nt, Escherichia coli CFT073
gcucaucggcauacagcgaca

SEQ ID NO: 611289 - RNA, 18 nt, Escherichia coli CFT073
gcuccacacgcucuucca

SEQ ID NO: 611290 - RNA, 22 nt, Escherichia coli CFT073
gcuccggcacgaauugcuucca

SEQ ID NO: 611291 - RNA, 17 nt, Escherichia coli CFT073
gcuccgccgcagccgca

SEQ ID NO: 611292 - RNA, 19 nt, Escherichia coli CFT073
gcucccccucuuccggaac

SEQ ID NO: 611293 - RNA, 17 nt, Escherichia coli CFT073
gcuccccucagggcggc

SEQ ID NO: 611294 - RNA, 17 nt, Escherichia coli CFT073
gcucccgcagccacucc

SEQ ID NO: 611295 - RNA, 23 nt, Escherichia coli CFT073
gcucccggauaccccagcuggcg

SEQ ID NO: 611296 - RNA, 18 nt, Escherichia coli CFT073
gcucccgcagccacuccu

SEQ ID NO: 611297 - RNA, 18 nt, Escherichia coli CFT073
gcucgaggaaaugcaauu

SEQ ID NO: 611298 - RNA, 15 nt, Escherichia coli CFT073
gcucgccgcagagau

SEQ ID NO: 611299 - RNA, 21 nt, Escherichia coli CFT073
gcuccuuuaaucaacguucgg

SEQ ID NO: 611300 - RNA, 12 nt, Escherichia coli CFT073
gcucgagccgca

SEQ ID NO: 611301 - RNA, 21 nt, Escherichia coli CFT073
gcucgacuagauacugacgau

SEQ ID NO: 611302 - RNA, 16 nt, Escherichia coli CFT073
gcucgagagagaaaau

SEQ ID NO: 611303 - RNA, 18 nt, Escherichia coli CFT073
gcuccuguuugcauuucu

SEQ ID NO: 611304 - RNA, 21 nt, Escherichia coli CFT073
gcucaagcaaucaagcccugg

SEQ ID NO: 611305 - RNA, 13 nt, Escherichia coli CFT073
gcucaacuuccug

SEQ ID NO: 611306 - RNA, 18 nt, Escherichia coli CFT073
gcucaagcguuucaucuu

SEQ ID NO: 611307 - RNA, 23 nt, Escherichia coli CFT073
gcucaagcugaccgauaaccugc

SEQ ID NO: 611308 - RNA, 14 nt, Escherichia coli CFT073
gcucaccugacugu

SEQ ID NO: 611309 - RNA, 13 nt, Escherichia coli CFT073
gcucaccugcaca

SEQ ID NO: 611310 - RNA, 19 nt, Escherichia coli CFT073
gcucacgcgccagcuucac

SEQ ID NO: 611311 - RNA, 17 nt, Escherichia coli CFT073
gcucaacaauaaacugg

SEQ ID NO: 611312 - RNA, 22 nt, Escherichia coli CFT073
gcucaacaauaaacuggcugug

SEQ ID NO: 611313 - RNA, 12 nt, Escherichia coli CFT073
gcucaaccagau

SEQ ID NO: 611314 - RNA, 23 nt, Escherichia coli CFT073
gcucaacaguaaggccugguuca

SEQ ID NO: 611315 - RNA, 22 nt, Escherichia coli CFT073
gcucaaccgccguaacgcggcu

SEQ ID NO: 611316 - RNA, 13 nt, Escherichia coli CFT073
gcucaaagauauu

SEQ ID NO: 611317 - RNA, 20 nt, Escherichia coli CFT073
gcucaaaggcauuaaaugca

SEQ ID NO: 611318 - RNA, 16 nt, Escherichia coli CFT073
gcuaugugccauugca

SEQ ID NO: 611319 - RNA, 21 nt, Escherichia coli CFT073
gcuaugcuggaggagauauug

SEQ ID NO: 611320 - RNA, 13 nt, Escherichia coli CFT073
gcuauucagcagu

SEQ ID NO: 611321 - RNA, 12 nt, Escherichia coli CFT073
gcuauuuaccag

SEQ ID NO: 611322 - RNA, 22 nt, Escherichia coli CFT073
gcuauuuacgguauaacccagu

SEQ ID NO: 611323 - RNA, 16 nt, Escherichia coli CFT073
gcguuucaaguguaca

SEQ ID NO: 611324 - RNA, 15 nt, Escherichia coli CFT073
gcguuuaccugccug

SEQ ID NO: 611325 - RNA, 20 nt, Escherichia coli CFT073
gcguuuaucaauauccaguc

SEQ ID NO: 611326 - RNA, 14 nt, Escherichia coli CFT073
gcguuuauucugga

SEQ ID NO: 611327 - RNA, 18 nt, Escherichia coli CFT073
gcguuucaaaaacaaaga

SEQ ID NO: 611328 - RNA, 13 nt, Escherichia coli CFT073
gcuagauagguca

SEQ ID NO: 611329 - RNA, 11 nt, Escherichia coli CFT073
gcuagcagcag

SEQ ID NO: 611330 - RNA, 11 nt, Escherichia coli CFT073
gcuagccgcca

SEQ ID NO: 611331 - RNA, 15 nt, Escherichia coli CFT073
gcuauacgagcuucg

SEQ ID NO: 611332 - RNA, 16 nt, Escherichia coli CFT073
gcuauacagcagccau

SEQ ID NO: 611333 - RNA, 13 nt, Escherichia coli CFT073
gcuaucaggccac

SEQ ID NO: 611334 - RNA, 15 nt, Escherichia coli CFT073
gcuaucuauugcuga

SEQ ID NO: 611335 - RNA, 17 nt, Escherichia coli CFT073
gcuaucuauugcugaau

SEQ ID NO: 611336 - RNA, 22 nt, Escherichia coli CFT073
gcguuguuuacagcagccagcg

SEQ ID NO: 611337 - RNA, 14 nt, Escherichia coli CFT073
gcguuuaaccaccu

SEQ ID NO: 611338 - RNA, 21 nt, Escherichia coli CFT073
gcguugcggugagucuggaag

SEQ ID NO: 611339 - RNA, 22 nt, Escherichia coli CFT073
gcguucaaucuguccuuccagu

SEQ ID NO: 611340 - RNA, 19 nt, Escherichia coli CFT073
gcguucagcaguucugcca

SEQ ID NO: 611341 - RNA, 13 nt, Escherichia coli CFT073
gcguugcagagag

SEQ ID NO: 611342 - RNA, 13 nt, Escherichia coli CFT073
gcguuccccagaa

SEQ ID NO: 611343 - RNA, 12 nt, Escherichia coli CFT073
gcgugcggcggc

SEQ ID NO: 611344 - RNA, 14 nt, Escherichia coli CFT073
gcgugcggcggcug

SEQ ID NO: 611345 - RNA, 23 nt, Escherichia coli CFT073
gcguggcgauaaucagcgccagc

SEQ ID NO: 611346 - RNA, 13 nt, Escherichia coli CFT073
gcguuaaaauuuc

SEQ ID NO: 611347 - RNA, 13 nt, Escherichia coli CFT073
gcguguuccagag

SEQ ID NO: 611348 - RNA, 21 nt, Escherichia coli CFT073
gcgugugcgagugcauccagu

SEQ ID NO: 611349 - RNA, 17 nt, Escherichia coli CFT073
gcgucucacuaucgccg

SEQ ID NO: 611350 - RNA, 19 nt, Escherichia coli CFT073
gcgucucacuaucgccgag

SEQ ID NO: 611351 - RNA, 23 nt, Escherichia coli CFT073
gcgucuccagacaauccgcagca

SEQ ID NO: 611352 - RNA, 18 nt, Escherichia coli CFT073
gcgucgugguaucgccac

SEQ ID NO: 611353 - RNA, 17 nt, Escherichia coli CFT073
gcgucguuaaucgccug

SEQ ID NO: 611354 - RNA, 15 nt, Escherichia coli CFT073
gcgucguucgccagu

SEQ ID NO: 611355 - RNA, 17 nt, Escherichia coli CFT073
gcgucguucgcgccaac

SEQ ID NO: 611356 - RNA, 20 nt, Escherichia coli CFT073
gcgucuaaaucguaccagga

SEQ ID NO: 611357 - RNA, 17 nt, Escherichia coli CFT073
gcgucuaucagugcaaa

SEQ ID NO: 611358 - RNA, 23 nt, Escherichia coli CFT073
gcgugauauuacauaccagcagc

SEQ ID NO: 611359 - RNA, 20 nt, Escherichia coli CFT073
gcgugagguuaucgcccugc

SEQ ID NO: 611360 - RNA, 22 nt, Escherichia coli CFT073
gcgugacgccugcuccaucauc

SEQ ID NO: 611361 - RNA, 20 nt, Escherichia coli CFT073
gcgugccuaauuccgcgcga

SEQ ID NO: 611362 - RNA, 21 nt, Escherichia coli CFT073
gcgucgcugcucuucuguggu

SEQ ID NO: 611363 - RNA, 13 nt, Escherichia coli CFT073
gcgucaugcucgc

SEQ ID NO: 611364 - RNA, 13 nt, Escherichia coli CFT073
gcgucaucggcag

SEQ ID NO: 611365 - RNA, 21 nt, Escherichia coli CFT073
gcgucgaaaauaucgagcagc

SEQ ID NO: 611366 - RNA, 21 nt, Escherichia coli CFT073
gcguccgcucggucacugaca

SEQ ID NO: 611367 - RNA, 22 nt, Escherichia coli CFT073
gcgucgcaucaggcaaucggcg

SEQ ID NO: 611368 - RNA, 16 nt, Escherichia coli CFT073
gcgucaacagggcaga

SEQ ID NO: 611369 - RNA, 16 nt, Escherichia coli CFT073
gcgucaaauaaagaag

SEQ ID NO: 611370 - RNA, 21 nt, Escherichia coli CFT073
gcgucaaauaaagaaguggug

SEQ ID NO: 611371 - RNA, 13 nt, Escherichia coli CFT073
gcgucagaaacag

SEQ ID NO: 611372 - RNA, 16 nt, Escherichia coli CFT073
gcgucagagauuaagu

SEQ ID NO: 611373 - RNA, 18 nt, Escherichia coli CFT073
gcgucagcgccaucccca

SEQ ID NO: 611374 - RNA, 21 nt, Escherichia coli CFT073
gcgucagcgccgcauccgaca

SEQ ID NO: 611375 - RNA, 15 nt, Escherichia coli CFT073
gcgucagcuuucaga

SEQ ID NO: 611376 - RNA, 17 nt, Escherichia coli CFT073
gcgucagcuuucagaga

SEQ ID NO: 611377 - RNA, 18 nt, Escherichia coli CFT073
gcgucagugucuuaucug

SEQ ID NO: 611378 - RNA, 17 nt, Escherichia coli CFT073
gcgucauauagccgccu

SEQ ID NO: 611379 - RNA, 17 nt, Escherichia coli CFT073
gcguauugucauauaau

SEQ ID NO: 611380 - RNA, 14 nt, Escherichia coli CFT073
gcguaugcccagcg

SEQ ID NO: 611381 - RNA, 17 nt, Escherichia coli CFT073
gcguagcggcguuaaug

SEQ ID NO: 611382 - RNA, 13 nt, Escherichia coli CFT073
gcguagccaggcg

SEQ ID NO: 611383 - RNA, 15 nt, Escherichia coli CFT073
gcguagccgggaagg

SEQ ID NO: 611384 - RNA, 24 nt, Escherichia coli CFT073
gcguagcaccacgguacgccagag

SEQ ID NO: 611385 - RNA, 21 nt, Escherichia coli CFT073
gcggugccauuaaaccaacaa

SEQ ID NO: 611386 - RNA, 21 nt, Escherichia coli CFT073
gcggugaugcggaaauaucgg

SEQ ID NO: 611387 - RNA, 16 nt, Escherichia coli CFT073
gcggugaucaaaacgg

SEQ ID NO: 611388 - RNA, 16 nt, Escherichia coli CFT073
gcggcuggcacuggca

SEQ ID NO: 611389 - RNA, 19 nt, Escherichia coli CFT073
gcggcugcguaauucgcca

SEQ ID NO: 611390 - RNA, 21 nt, Escherichia coli CFT073
gcggcugcguaauucgccacc

SEQ ID NO: 611391 - RNA, 14 nt, Escherichia coli CFT073
gcggcuuucagggc

SEQ ID NO: 611392 - RNA, 20 nt, Escherichia coli CFT073
gcggcuuguacgccgccgca

SEQ ID NO: 611393 - RNA, 21 nt, Escherichia coli CFT073
gcggcuacugauguucgccag

SEQ ID NO: 611394 - RNA, 15 nt, Escherichia coli CFT073
gcggcguagggcagg

SEQ ID NO: 611395 - RNA, 14 nt, Escherichia coli CFT073
gcggcgucagccag

SEQ ID NO: 611396 - RNA, 13 nt, Escherichia coli CFT073
gcggcguccccac

SEQ ID NO: 611397 - RNA, 19 nt, Escherichia coli CFT073
gcggcgcacggcguucagg

SEQ ID NO: 611398 - RNA, 17 nt, Escherichia coli CFT073
gcggcgcauccgccagc

SEQ ID NO: 611399 - RNA, 19 nt, Escherichia coli CFT073
gcggcggguuaaccagcac

SEQ ID NO: 611400 - RNA, 20 nt, Escherichia coli CFT073
gcggcggguuaaccagcacc

SEQ ID NO: 611401 - RNA, 13 nt, Escherichia coli CFT073
gcggcguaaccac

SEQ ID NO: 611402 - RNA, 13 nt, Escherichia coli CFT073
gcgggcuaaacuc

SEQ ID NO: 611403 - RNA, 21 nt, Escherichia coli CFT073
gcgggguaaucgccagcaaaa

SEQ ID NO: 611404 - RNA, 15 nt, Escherichia coli CFT073
gcgggaacagcgacc

SEQ ID NO: 611405 - RNA, 13 nt, Escherichia coli CFT073
gcgggaccagcac

SEQ ID NO: 611406 - RNA, 16 nt, Escherichia coli CFT073
gcgggccgcgucgggc

SEQ ID NO: 611407 - RNA, 17 nt, Escherichia coli CFT073
gcgggccgcgucgggcg

SEQ ID NO: 611408 - RNA, 13 nt, Escherichia coli CFT073
gcgguaucaccac

SEQ ID NO: 611409 - RNA, 15 nt, Escherichia coli CFT073
gcgguaucaccaccc

SEQ ID NO: 611410 - RNA, 14 nt, Escherichia coli CFT073
gcggucuguauuug

SEQ ID NO: 611411 - RNA, 23 nt, Escherichia coli CFT073
gcggucugccaacuuugccguga

SEQ ID NO: 611412 - RNA, 22 nt, Escherichia coli CFT073
gcgguaaucauggcguuuuucc

SEQ ID NO: 611413 - RNA, 14 nt, Escherichia coli CFT073
gcgguaacggcaga

SEQ ID NO: 611414 - RNA, 20 nt, Escherichia coli CFT073
gcgguaaauuuuuugaucaa

SEQ ID NO: 611415 - RNA, 18 nt, Escherichia coli CFT073
gcggguuucgacauuucc

SEQ ID NO: 611416 - RNA, 21 nt, Escherichia coli CFT073
gcgguaaaagccauucuggcg

SEQ ID NO: 611417 - RNA, 15 nt, Escherichia coli CFT073
gcgguaaaaugguca

SEQ ID NO: 611418 - RNA, 22 nt, Escherichia coli CFT073
gcgguaaaauggucagccagcg

SEQ ID NO: 611419 - RNA, 15 nt, Escherichia coli CFT073
gcgguaaaccguuau

SEQ ID NO: 611420 - RNA, 20 nt, Escherichia coli CFT073
gcgguaaucuguugagcgcc

SEQ ID NO: 611421 - RNA, 14 nt, Escherichia coli CFT073
gcgggugcgcaggc

SEQ ID NO: 611422 - RNA, 14 nt, Escherichia coli CFT073
gcgaaaccagcagc

SEQ ID NO: 611423 - RNA, 18 nt, Escherichia coli CFT073
gcgaaaccauauuaaaug

SEQ ID NO: 611424 - RNA, 13 nt, Escherichia coli CFT073
gcgaaacagcgcc

SEQ ID NO: 611425 - RNA, 20 nt, Escherichia coli CFT073
gcgaaaccugaauccacugg

SEQ ID NO: 611426 - RNA, 12 nt, Escherichia coli CFT073
gcgaaaaucaau

SEQ ID NO: 611427 - RNA, 18 nt, Escherichia coli CFT073
gcgaaaaucauuuaucuc

SEQ ID NO: 611428 - RNA, 13 nt, Escherichia coli CFT073
gccuaaagugcug

SEQ ID NO: 611429 - RNA, 18 nt, Escherichia coli CFT073
gccguuuuuauugacggu

SEQ ID NO: 611430 - RNA, 17 nt, Escherichia coli CFT073
gccguuuuuuucuucuc

SEQ ID NO: 611431 - RNA, 21 nt, Escherichia coli CFT073
gccguuccuggcaccaucagc

SEQ ID NO: 611432 - RNA, 20 nt, Escherichia coli CFT073
gccguuuguuagcaugcuga

SEQ ID NO: 611433 - RNA, 13 nt, Escherichia coli CFT073
gccguuucaccac

SEQ ID NO: 611434 - RNA, 19 nt, Escherichia coli CFT073
gcgaauaugcugggcgcgu

SEQ ID NO: 611435 - RNA, 15 nt, Escherichia coli CFT073
gcgaauauggcggcg

SEQ ID NO: 611436 - RNA, 15 nt, Escherichia coli CFT073
gcgaauaccccagcg

SEQ ID NO: 611437 - RNA, 22 nt, Escherichia coli CFT073
gcgaauacggcuaaaucguuca

SEQ ID NO: 611438 - RNA, 18 nt, Escherichia coli CFT073
gcgaauacguuucagcca

SEQ ID NO: 611439 - RNA, 21 nt, Escherichia coli CFT073
gcgaacauaaggaugcgggcg

SEQ ID NO: 611440 - RNA, 21 nt, Escherichia coli CFT073
gcgaacccgcaguccugcagg

SEQ ID NO: 611441 - RNA, 23 nt, Escherichia coli CFT073
gcgaaccaucaccucuucaccgu

SEQ ID NO: 611442 - RNA, 21 nt, Escherichia coli CFT073
gcgaauuaagaauuucucagu

SEQ ID NO: 611443 - RNA, 14 nt, Escherichia coli CFT073
gcgaauuuccugcc

SEQ ID NO: 611444 - RNA, 18 nt, Escherichia coli CFT073
gcgaauugacuagcuuuu

SEQ ID NO: 611445 - RNA, 14 nt, Escherichia coli CFT073
gcgaauugccuguu

SEQ ID NO: 611446 - RNA, 12 nt, Escherichia coli CFT073
gcgaauuccagu

SEQ ID NO: 611447 - RNA, 15 nt, Escherichia coli CFT073
gcgaaucgccuguac

SEQ ID NO: 611448 - RNA, 20 nt, Escherichia coli CFT073
gcgaauccgcggaugauucc

SEQ ID NO: 611449 - RNA, 20 nt, Escherichia coli CFT073
gcgaaucgcuucauuuacau

SEQ ID NO: 611450 - RNA, 14 nt, Escherichia coli CFT073
gcgaaucuaaauca

SEQ ID NO: 611451 - RNA, 18 nt, Escherichia coli CFT073
gcgaaucuucauagucuc

SEQ ID NO: 611452 - RNA, 18 nt, Escherichia coli CFT073
gcgaaugacaugcccggu

SEQ ID NO: 611453 - RNA, 16 nt, Escherichia coli CFT073
gcgacaucgucuccag

SEQ ID NO: 611454 - RNA, 15 nt, Escherichia coli CFT073
gcgacaguugccgcu

SEQ ID NO: 611455 - RNA, 17 nt, Escherichia coli CFT073
gcgacauacuuaaauaa

SEQ ID NO: 611456 - RNA, 13 nt, Escherichia coli CFT073
gcgacauaucauu

SEQ ID NO: 611457 - RNA, 15 nt, Escherichia coli CFT073
gcgacaggaaccaaa

SEQ ID NO: 611458 - RNA, 12 nt, Escherichia coli CFT073
gcgaccaaucac

SEQ ID NO: 611459 - RNA, 20 nt, Escherichia coli CFT073
gcgaccaaucacacaaccau

SEQ ID NO: 611460 - RNA, 15 nt, Escherichia coli CFT073
gcgaccaccacccug

SEQ ID NO: 611461 - RNA, 12 nt, Escherichia coli CFT073
gcgacgcuggcg

SEQ ID NO: 611462 - RNA, 14 nt, Escherichia coli CFT073
gcgacgcuggcgcg

SEQ ID NO: 611463 - RNA, 21 nt, Escherichia coli CFT073
gcgacgucgguuuccagcauc

SEQ ID NO: 611464 - RNA, 20 nt, Escherichia coli CFT073
gcgacgguuuccaggcagcc

SEQ ID NO: 611465 - RNA, 21 nt, Escherichia coli CFT073
gcgacguucguuaacaacaac

SEQ ID NO: 611466 - RNA, 21 nt, Escherichia coli CFT073
gcgagcgccuuauccggccug

SEQ ID NO: 611467 - RNA, 14 nt, Escherichia coli CFT073
gcgagcagcauucc

SEQ ID NO: 611468 - RNA, 16 nt, Escherichia coli CFT073
gcgagcaucgcgagga

SEQ ID NO: 611469 - RNA, 15 nt, Escherichia coli CFT073
gcgacuuuaaucacc

SEQ ID NO: 611470 - RNA, 16 nt, Escherichia coli CFT073
gcgacuugcucaggag

SEQ ID NO: 611471 - RNA, 15 nt, Escherichia coli CFT073
gcgagaauacauaua

SEQ ID NO: 611472 - RNA, 18 nt, Escherichia coli CFT073
gcgaucgggcauuuccau

SEQ ID NO: 611473 - RNA, 14 nt, Escherichia coli CFT073
gcgaucucgucagc

SEQ ID NO: 611474 - RNA, 12 nt, Escherichia coli CFT073
gcgaucuucccg

SEQ ID NO: 611475 - RNA, 17 nt, Escherichia coli CFT073
gcgaucuuugcccauac

SEQ ID NO: 611476 - RNA, 14 nt, Escherichia coli CFT073
gcgauauccgggca

SEQ ID NO: 611477 - RNA, 22 nt, Escherichia coli CFT073
gcgauaucaauauuaagagaac

SEQ ID NO: 611478 - RNA, 13 nt, Escherichia coli CFT073
gcgauauguugug

SEQ ID NO: 611479 - RNA, 16 nt, Escherichia coli CFT073
gcgauauuccagaccu

SEQ ID NO: 611480 - RNA, 22 nt, Escherichia coli CFT073
gcgagcugccaguugcgcuuca

SEQ ID NO: 611481 - RNA, 20 nt, Escherichia coli CFT073
gcgauaaaacgccgcuggug

SEQ ID NO: 611482 - RNA, 16 nt, Escherichia coli CFT073
gcgaguucgagucucg

SEQ ID NO: 611483 - RNA, 21 nt, Escherichia coli CFT073
gcgaguucgguacguacaaug

SEQ ID NO: 611484 - RNA, 18 nt, Escherichia coli CFT073
gcgauaaaccgaucgccg

SEQ ID NO: 611485 - RNA, 15 nt, Escherichia coli CFT073
gcgaguggucuccug

SEQ ID NO: 611486 - RNA, 22 nt, Escherichia coli CFT073
gcgcauuucccagcaagaacca

SEQ ID NO: 611487 - RNA, 13 nt, Escherichia coli CFT073
gcgccaaacauuu

SEQ ID NO: 611488 - RNA, 18 nt, Escherichia coli CFT073
gcgccaaucagcgcagca

SEQ ID NO: 611489 - RNA, 18 nt, Escherichia coli CFT073
gcgccaauagccgcaccg

SEQ ID NO: 611490 - RNA, 16 nt, Escherichia coli CFT073
gcgccaaccaggauga

SEQ ID NO: 611491 - RNA, 17 nt, Escherichia coli CFT073
gcgccaacgucugccug

SEQ ID NO: 611492 - RNA, 17 nt, Escherichia coli CFT073
gcgccaagauagaacca

SEQ ID NO: 611493 - RNA, 14 nt, Escherichia coli CFT073
gcgccaaucgccag

SEQ ID NO: 611494 - RNA, 14 nt, Escherichia coli CFT073
gcgccaaucggcaa

SEQ ID NO: 611495 - RNA, 20 nt, Escherichia coli CFT073
gcgccaaucggcaauucagu

SEQ ID NO: 611496 - RNA, 21 nt, Escherichia coli CFT073
gcgccaaucagcgcagcaccc

SEQ ID NO: 611497 - RNA, 13 nt, Escherichia coli CFT073
gcgccaccagcgc

SEQ ID NO: 611498 - RNA, 21 nt, Escherichia coli CFT073
gcgccaccacgccgauggcag

SEQ ID NO: 611499 - RNA, 14 nt, Escherichia coli CFT073
gcgccaccacccag

SEQ ID NO: 611500 - RNA, 16 nt, Escherichia coli CFT073
gcgcauuucccagcaa

SEQ ID NO: 611501 - RNA, 20 nt, Escherichia coli CFT073
gcgcauucgaucaccgcaga

SEQ ID NO: 611502 - RNA, 22 nt, Escherichia coli CFT073
gcgcauuaaauaccaagccaag

SEQ ID NO: 611503 - RNA, 13 nt, Escherichia coli CFT073
gcgcauucaccag

SEQ ID NO: 611504 - RNA, 18 nt, Escherichia coli CFT073
gcgcaugcaggcaugcaa

SEQ ID NO: 611505 - RNA, 12 nt, Escherichia coli CFT073
gcgcaucgccag

SEQ ID NO: 611506 - RNA, 17 nt, Escherichia coli CFT073
gcgcauccgccagcagc

SEQ ID NO: 611507 - RNA, 17 nt, Escherichia coli CFT073
gcgcaucuuauccggcc

SEQ ID NO: 611508 - RNA, 14 nt, Escherichia coli CFT073
gcgcaucgggcgau

SEQ ID NO: 611509 - RNA, 23 nt, Escherichia coli CFT073
gcgccacgcucuggugagugaca

SEQ ID NO: 611510 - RNA, 17 nt, Escherichia coli CFT073
gcgccagcugcauuuca

SEQ ID NO: 611511 - RNA, 12 nt, Escherichia coli CFT073
gcgccagcagcg

SEQ ID NO: 611512 - RNA, 23 nt, Escherichia coli CFT073
gcgccagcauaugcacacgcagc

SEQ ID NO: 611513 - RNA, 18 nt, Escherichia coli CFT073
gcgccauaaccgccagca

SEQ ID NO: 611514 - RNA, 19 nt, Escherichia coli CFT073
gcgccauaaccgccagcac

SEQ ID NO: 611515 - RNA, 18 nt, Escherichia coli CFT073
gcgccauaccaugcacca

SEQ ID NO: 611516 - RNA, 12 nt, Escherichia coli CFT073
gcgccaggcaca

SEQ ID NO: 611517 - RNA, 18 nt, Escherichia coli CFT073
gcgccaggaaucuggucc

SEQ ID NO: 611518 - RNA, 19 nt, Escherichia coli CFT073
gcgccaucgguagcaccag

SEQ ID NO: 611519 - RNA, 13 nt, Escherichia coli CFT073
gcgccaucgccag

SEQ ID NO: 611520 - RNA, 16 nt, Escherichia coli CFT073
gcgccaucgccaggaa

SEQ ID NO: 611521 - RNA, 18 nt, Escherichia coli CFT073
gcgccaucaaaucugccg

SEQ ID NO: 611522 - RNA, 22 nt, Escherichia coli CFT073
gcgcaacuuuacucauccccug

SEQ ID NO: 611523 - RNA, 15 nt, Escherichia coli CFT073
gcgcaacuuuuucuu

SEQ ID NO: 611524 - RNA, 19 nt, Escherichia coli CFT073
gcgcaacugcgccgcgagc

SEQ ID NO: 611525 - RNA, 13 nt, Escherichia coli CFT073
gcgcaacuugugc

SEQ ID NO: 611526 - RNA, 19 nt, Escherichia coli CFT073
gcgcaacuugugcucgcgu

SEQ ID NO: 611527 - RNA, 14 nt, Escherichia coli CFT073
gcgaugcuggcgca

SEQ ID NO: 611528 - RNA, 18 nt, Escherichia coli CFT073
gcgaugcugacacaucuu

SEQ ID NO: 611529 - RNA, 17 nt, Escherichia coli CFT073
gcgaugcuuuccagcug

SEQ ID NO: 611530 - RNA, 22 nt, Escherichia coli CFT073
gcgcaaggcauugaggguaucc

SEQ ID NO: 611531 - RNA, 15 nt, Escherichia coli CFT073
gcgcacaggcggccc

SEQ ID NO: 611532 - RNA, 23 nt, Escherichia coli CFT073
gcgcaccggucccugaucggcca

SEQ ID NO: 611533 - RNA, 22 nt, Escherichia coli CFT073
gcgcaccgagugguucaucaag

SEQ ID NO: 611534 - RNA, 23 nt, Escherichia coli CFT073
gcgcacugcgcgauaaucccaac

SEQ ID NO: 611535 - RNA, 14 nt, Escherichia coli CFT073
gcgcacuuuauuaa

SEQ ID NO: 611536 - RNA, 12 nt, Escherichia coli CFT073
gcgcacuuugcu

SEQ ID NO: 611537 - RNA, 20 nt, Escherichia coli CFT073
gcgcacgaggugccaccagu

SEQ ID NO: 611538 - RNA, 14 nt, Escherichia coli CFT073
gcgcaccguccagc

SEQ ID NO: 611539 - RNA, 12 nt, Escherichia coli CFT073
gcgcauauugcc

SEQ ID NO: 611540 - RNA, 21 nt, Escherichia coli CFT073
gcgcauagccuccggccacga

SEQ ID NO: 611541 - RNA, 15 nt, Escherichia coli CFT073
gcgcaguugugcaau

SEQ ID NO: 611542 - RNA, 20 nt, Escherichia coli CFT073
gcgcauaccaaaaucuacca

SEQ ID NO: 611543 - RNA, 16 nt, Escherichia coli CFT073
gcgcaguuuaugcagu

SEQ ID NO: 611544 - RNA, 19 nt, Escherichia coli CFT073
gcgcaucaaggccaggcag

SEQ ID NO: 611545 - RNA, 13 nt, Escherichia coli CFT073
gcgcagucaccag

SEQ ID NO: 611546 - RNA, 23 nt, Escherichia coli CFT073
gcgcaguucgucguuugacaaug

SEQ ID NO: 611547 - RNA, 16 nt, Escherichia coli CFT073
gcgcaguucgcacacc

SEQ ID NO: 611548 - RNA, 18 nt, Escherichia coli CFT073
gcgcagguaguuaucugc

SEQ ID NO: 611549 - RNA, 20 nt, Escherichia coli CFT073
gcgcaggguuugcaucgcca

SEQ ID NO: 611550 - RNA, 21 nt, Escherichia coli CFT073
gcgcaggguuugcaucgccau

SEQ ID NO: 611551 - RNA, 19 nt, Escherichia coli CFT073
gcgcagguacugguaagca

SEQ ID NO: 611552 - RNA, 13 nt, Escherichia coli CFT073
gcgcgcaaugacg

SEQ ID NO: 611553 - RNA, 14 nt, Escherichia coli CFT073
gcgcgauggucagu

SEQ ID NO: 611554 - RNA, 20 nt, Escherichia coli CFT073
gcgccuuuuuucgccgcagc

SEQ ID NO: 611555 - RNA, 21 nt, Escherichia coli CFT073
gcgcgcgaauauggcggcggc

SEQ ID NO: 611556 - RNA, 13 nt, Escherichia coli CFT073
gcgcgcgguggcg

SEQ ID NO: 611557 - RNA, 22 nt, Escherichia coli CFT073
gcgcgcgguggcguacagcugg

SEQ ID NO: 611558 - RNA, 18 nt, Escherichia coli CFT073
gcgcgcgggucacugcgg

SEQ ID NO: 611559 - RNA, 13 nt, Escherichia coli CFT073
gcgcgcggcuggc

SEQ ID NO: 611560 - RNA, 14 nt, Escherichia coli CFT073
gcgcgcggcuggca

SEQ ID NO: 611561 - RNA, 21 nt, Escherichia coli CFT073
gcgcggucauaaaauccguaa

SEQ ID NO: 611562 - RNA, 21 nt, Escherichia coli CFT073
gcgcggcgguugacgccccug

SEQ ID NO: 611563 - RNA, 20 nt, Escherichia coli CFT073
gcgccucaaaauaaggcugc

SEQ ID NO: 611564 - RNA, 21 nt, Escherichia coli CFT073
gcgccucaacgccuaaugcca

SEQ ID NO: 611565 - RNA, 22 nt, Escherichia coli CFT073
gcgccugaccauuaucaaacag

SEQ ID NO: 611566 - RNA, 17 nt, Escherichia coli CFT073
gcgccuuauccggccug

SEQ ID NO: 611567 - RNA, 21 nt, Escherichia coli CFT073
gcgccugucaccgccuccacc

SEQ ID NO: 611568 - RNA, 23 nt, Escherichia coli CFT073
gcgccugucaccgccuccaccug

SEQ ID NO: 611569 - RNA, 13 nt, Escherichia coli CFT073
gcgccuggcagca

SEQ ID NO: 611570 - RNA, 19 nt, Escherichia coli CFT073
gcgccugcacaaagcgcca

SEQ ID NO: 611571 - RNA, 20 nt, Escherichia coli CFT073
gcgccugcacaaagcgccag

SEQ ID NO: 611572 - RNA, 23 nt, Escherichia coli CFT073
gcgcccacucggcgaccaguucg

SEQ ID NO: 611573 - RNA, 17 nt, Escherichia coli CFT073
gcgccgcugagaaaaag

SEQ ID NO: 611574 - RNA, 22 nt, Escherichia coli CFT073
gcgcuuuuacugcacucgccag

SEQ ID NO: 611575 - RNA, 18 nt, Escherichia coli CFT073
gcgcuuugaaacgcacgc

SEQ ID NO: 611576 - RNA, 18 nt, Escherichia coli CFT073
gcggaaaaucgggcgaca

SEQ ID NO: 611577 - RNA, 16 nt, Escherichia coli CFT073
gcgcuuuuuccugccg

SEQ ID NO: 611578 - RNA, 21 nt, Escherichia coli CFT073
gcggaacgcacuauacaacca

SEQ ID NO: 611579 - RNA, 16 nt, Escherichia coli CFT073
gcggaaaucacaguau

SEQ ID NO: 611580 - RNA, 14 nt, Escherichia coli CFT073
gcggaacuuuuuuc

SEQ ID NO: 611581 - RNA, 22 nt, Escherichia coli CFT073
gcgcuuaaucaauugcaggaag

SEQ ID NO: 611582 - RNA, 21 nt, Escherichia coli CFT073
gcgcuucguuuuccgccacau

SEQ ID NO: 611583 - RNA, 13 nt, Escherichia coli CFT073
gcgcugaccacuu

SEQ ID NO: 611584 - RNA, 15 nt, Escherichia coli CFT073
gcgcugaaucccgca

SEQ ID NO: 611585 - RNA, 15 nt, Escherichia coli CFT073
gcgcugcugcacaua

SEQ ID NO: 611586 - RNA, 23 nt, Escherichia coli CFT073
gcgcugcuguagcaguuccagca

SEQ ID NO: 611587 - RNA, 14 nt, Escherichia coli CFT073
gcgcugaucgucag

SEQ ID NO: 611588 - RNA, 14 nt, Escherichia coli CFT073
gcgcugcucaggcg

SEQ ID NO: 611589 - RNA, 21 nt, Escherichia coli CFT073
gcgcuggcaucgcaaaauuuc

SEQ ID NO: 611590 - RNA, 20 nt, Escherichia coli CFT073
gcgcucgcgccgcauccggc

SEQ ID NO: 611591 - RNA, 18 nt, Escherichia coli CFT073
gcgcgucaucggcgcggu

SEQ ID NO: 611592 - RNA, 20 nt, Escherichia coli CFT073
gcgcgguggcguacagcugg

SEQ ID NO: 611593 - RNA, 22 nt, Escherichia coli CFT073
gcggaccuuuugccgcccaguc

SEQ ID NO: 611594 - RNA, 16 nt, Escherichia coli CFT073
gcggaccaacaaaaau

SEQ ID NO: 611595 - RNA, 21 nt, Escherichia coli CFT073
gcggacacuuuccugcucggc

SEQ ID NO: 611596 - RNA, 17 nt, Escherichia coli CFT073
gcggaauauccaguaac

SEQ ID NO: 611597 - RNA, 18 nt, Escherichia coli CFT073
gcggaauauccaguaacg

SEQ ID NO: 611598 - RNA, 15 nt, Escherichia coli CFT073
gcggaauaugcugaa

SEQ ID NO: 611599 - RNA, 21 nt, Escherichia coli CFT073
gcggaaucaccggcaaaacca

SEQ ID NO: 611600 - RNA, 13 nt, Escherichia coli CFT073
gcggauaaagcag

SEQ ID NO: 611601 - RNA, 20 nt, Escherichia coli CFT073
gcggacuucauugacgccaa

SEQ ID NO: 611602 - RNA, 17 nt, Escherichia coli CFT073
gcggacgucuguuuaug

SEQ ID NO: 611603 - RNA, 16 nt, Escherichia coli CFT073
gcggauuucggcggcu

SEQ ID NO: 611604 - RNA, 16 nt, Escherichia coli CFT073
gcggcaacaucaucac

SEQ ID NO: 611605 - RNA, 20 nt, Escherichia coli CFT073
gcggcaacaucaucacgcag

SEQ ID NO: 611606 - RNA, 15 nt, Escherichia coli CFT073
gcggcaaccagcagc

SEQ ID NO: 611607 - RNA, 16 nt, Escherichia coli CFT073
gcggcacagaaacgcc

SEQ ID NO: 611608 - RNA, 17 nt, Escherichia coli CFT073
gcggcaaucacauccac

SEQ ID NO: 611609 - RNA, 19 nt, Escherichia coli CFT073
gcggcaauccccgccagca

SEQ ID NO: 611610 - RNA, 17 nt, Escherichia coli CFT073
gcggcaaucgccagaau

SEQ ID NO: 611611 - RNA, 14 nt, Escherichia coli CFT073
gcggcaaucgcugc

SEQ ID NO: 611612 - RNA, 15 nt, Escherichia coli CFT073
gcggaugacccagcg

SEQ ID NO: 611613 - RNA, 20 nt, Escherichia coli CFT073
gcggaucucuucguuuucaa

SEQ ID NO: 611614 - RNA, 13 nt, Escherichia coli CFT073
gcggaucugcucc

SEQ ID NO: 611615 - RNA, 17 nt, Escherichia coli CFT073
gcggaucuggaacggga

SEQ ID NO: 611616 - RNA, 21 nt, Escherichia coli CFT073
gcggauguuggguuagccaac

SEQ ID NO: 611617 - RNA, 18 nt, Escherichia coli CFT073
gcggauucgaugcccagc

SEQ ID NO: 611618 - RNA, 19 nt, Escherichia coli CFT073
gcggauggccucugccagc

SEQ ID NO: 611619 - RNA, 21 nt, Escherichia coli CFT073
gcggauggccucugccagcug

SEQ ID NO: 611620 - RNA, 17 nt, Escherichia coli CFT073
ggcagagucuccgguuu

SEQ ID NO: 611621 - RNA, 15 nt, Escherichia coli CFT073
ggcagauaaaaugcg

SEQ ID NO: 611622 - RNA, 23 nt, Escherichia coli CFT073
ggcagauaaaaugcgaaaaaaac

SEQ ID NO: 611623 - RNA, 21 nt, Escherichia coli CFT073
ggcagauacaaccaaucgcgg

SEQ ID NO: 611624 - RNA, 13 nt, Escherichia coli CFT073
ggcagaugcgucu

SEQ ID NO: 611625 - RNA, 16 nt, Escherichia coli CFT073
ggcagcaacagcaguu

SEQ ID NO: 611626 - RNA, 22 nt, Escherichia coli CFT073
ggcagcaaggcuauucagcagu

SEQ ID NO: 611627 - RNA, 14 nt, Escherichia coli CFT073
ggcagagaucgccg

SEQ ID NO: 611628 - RNA, 15 nt, Escherichia coli CFT073
ggcagagccaaauaa

SEQ ID NO: 611629 - RNA, 16 nt, Escherichia coli CFT073
ggcagacgaugaugca

SEQ ID NO: 611630 - RNA, 22 nt, Escherichia coli CFT073
ggcagacgcucgccauuuuuca

SEQ ID NO: 611631 - RNA, 13 nt, Escherichia coli CFT073
ggcagccauuugu

SEQ ID NO: 611632 - RNA, 22 nt, Escherichia coli CFT073
ggcagccaguucgagaaaaaua

SEQ ID NO: 611633 - RNA, 16 nt, Escherichia coli CFT073
ggcagccagauggcug

SEQ ID NO: 611634 - RNA, 13 nt, Escherichia coli CFT073
ggcagcagaccaa

SEQ ID NO: 611635 - RNA, 22 nt, Escherichia coli CFT073
ggcagcacaaucacgucauauu

SEQ ID NO: 611636 - RNA, 18 nt, Escherichia coli CFT073
ggcagcaaucgaccaggc

SEQ ID NO: 611637 - RNA, 16 nt, Escherichia coli CFT073
ggcaccaaucaccgcc

SEQ ID NO: 611638 - RNA, 19 nt, Escherichia coli CFT073
ggcacagcuuucggguggc

SEQ ID NO: 611639 - RNA, 22 nt, Escherichia coli CFT073
ggcaccagccccuggaaaaaau

SEQ ID NO: 611640 - RNA, 13 nt, Escherichia coli CFT073
ggcacagccagcg

SEQ ID NO: 611641 - RNA, 17 nt, Escherichia coli CFT073
ggcacagccagcgcagg

SEQ ID NO: 611642 - RNA, 21 nt, Escherichia coli CFT073
ggcacagccagcgcaggcagu

SEQ ID NO: 611643 - RNA, 12 nt, Escherichia coli CFT073
ggcaaacgcugg

SEQ ID NO: 611644 - RNA, 13 nt, Escherichia coli CFT073
ggcaaacgcugga

SEQ ID NO: 611645 - RNA, 15 nt, Escherichia coli CFT073
ggcaaacugcaugaa

SEQ ID NO: 611646 - RNA, 13 nt, Escherichia coli CFT073
ggcaaacugcuga

SEQ ID NO: 611647 - RNA, 15 nt, Escherichia coli CFT073
ggcacgaucaagaga

SEQ ID NO: 611648 - RNA, 18 nt, Escherichia coli CFT073
ggcaccgccgccacuucu

SEQ ID NO: 611649 - RNA, 20 nt, Escherichia coli CFT073
ggcauauuccgccaccugcg

SEQ ID NO: 611650 - RNA, 21 nt, Escherichia coli CFT073
ggcauacuccggcggcagcag

SEQ ID NO: 611651 - RNA, 13 nt, Escherichia coli CFT073
ggcauacauuuau

SEQ ID NO: 611652 - RNA, 17 nt, Escherichia coli CFT073
ggcauacagcgacagac

SEQ ID NO: 611653 - RNA, 21 nt, Escherichia coli CFT073
ggcauaauacaugcgaacuuu

SEQ ID NO: 611654 - RNA, 21 nt, Escherichia coli CFT073
ggcauaaauuucaggcaacaa

SEQ ID NO: 611655 - RNA, 16 nt, Escherichia coli CFT073
ggcagugacagcccca

SEQ ID NO: 611656 - RNA, 18 nt, Escherichia coli CFT073
ggcaguaauauggcgacu

SEQ ID NO: 611657 - RNA, 15 nt, Escherichia coli CFT073
ggcaguauuaccaga

SEQ ID NO: 611658 - RNA, 16 nt, Escherichia coli CFT073
ggcaguaaagugaucc

SEQ ID NO: 611659 - RNA, 16 nt, Escherichia coli CFT073
ggcaucgcaaaccaga

SEQ ID NO: 611660 - RNA, 20 nt, Escherichia coli CFT073
ggcaucgccuucgcaaaaaa

SEQ ID NO: 611661 - RNA, 18 nt, Escherichia coli CFT073
ggcaucggcgcacaaccg

SEQ ID NO: 611662 - RNA, 13 nt, Escherichia coli CFT073
ggcaggcaaaaau

SEQ ID NO: 611663 - RNA, 19 nt, Escherichia coli CFT073
ggcaggcaaaguaggccgu

SEQ ID NO: 611664 - RNA, 12 nt, Escherichia coli CFT073
ggcaggccaggg

SEQ ID NO: 611665 - RNA, 16 nt, Escherichia coli CFT073
ggcaggaaaaagcgcu

SEQ ID NO: 611666 - RNA, 13 nt, Escherichia coli CFT073
ggcagcuccagca

SEQ ID NO: 611667 - RNA, 14 nt, Escherichia coli CFT073
ggcagcuccagcag

SEQ ID NO: 611668 - RNA, 15 nt, Escherichia coli CFT073
ggcagcucuaucugc

SEQ ID NO: 611669 - RNA, 19 nt, Escherichia coli CFT073
ggcagcgggauuuccggca

SEQ ID NO: 611670 - RNA, 19 nt, Escherichia coli CFT073
ggcauguguuagcccuguc

SEQ ID NO: 611671 - RNA, 15 nt, Escherichia coli CFT073
ggccagcaaucccca

SEQ ID NO: 611672 - RNA, 22 nt, Escherichia coli CFT073
ggccaguguuuaucaucucggg

SEQ ID NO: 611673 - RNA, 14 nt, Escherichia coli CFT073
ggccauaugacacc

SEQ ID NO: 611674 - RNA, 17 nt, Escherichia coli CFT073
ggccauugaauauuuuu

SEQ ID NO: 611675 - RNA, 23 nt, Escherichia coli CFT073
ggccauugaauauuuuucgucag

SEQ ID NO: 611676 - RNA, 15 nt, Escherichia coli CFT073
ggccaugcggcgagg

SEQ ID NO: 611677 - RNA, 20 nt, Escherichia coli CFT073
ggccaucagcagcggagaaa

SEQ ID NO: 611678 - RNA, 17 nt, Escherichia coli CFT073
ggcccgcgugccggaag

SEQ ID NO: 611679 - RNA, 23 nt, Escherichia coli CFT073
ggcccgcguaagcgggaucaggu

SEQ ID NO: 611680 - RNA, 23 nt, Escherichia coli CFT073
ggccgaguagccagcugccugcc

SEQ ID NO: 611681 - RNA, 16 nt, Escherichia coli CFT073
ggccgagcuaauaauc

SEQ ID NO: 611682 - RNA, 21 nt, Escherichia coli CFT073
ggccgauagacacugccgccg

SEQ ID NO: 611683 - RNA, 21 nt, Escherichia coli CFT073
ggccgcaaaccagcgcauggc

SEQ ID NO: 611684 - RNA, 16 nt, Escherichia coli CFT073
ggccgcaaaccagcgc

SEQ ID NO: 611685 - RNA, 13 nt, Escherichia coli CFT073
ggccccaccugcu

SEQ ID NO: 611686 - RNA, 17 nt, Escherichia coli CFT073
ggcccauugccagcgcu

SEQ ID NO: 611687 - RNA, 18 nt, Escherichia coli CFT073
ggaugcggcgcgagcgcc

SEQ ID NO: 611688 - RNA, 20 nt, Escherichia coli CFT073
ggaugacccagcgccagcau

SEQ ID NO: 611689 - RNA, 16 nt, Escherichia coli CFT073
ggaugccucuccuguu

SEQ ID NO: 611690 - RNA, 16 nt, Escherichia coli CFT073
ggaucuuucaggaaca

SEQ ID NO: 611691 - RNA, 21 nt, Escherichia coli CFT073
ggaucguucacgugagagaaa

SEQ ID NO: 611692 - RNA, 16 nt, Escherichia coli CFT073
ggaucguucgcugccu

SEQ ID NO: 611693 - RNA, 15 nt, Escherichia coli CFT073
ggaucuuccagcgca

SEQ ID NO: 611694 - RNA, 17 nt, Escherichia coli CFT073
ggaucguggcugaguga

SEQ ID NO: 611695 - RNA, 16 nt, Escherichia coli CFT073
ggaucgguagaccgga

SEQ ID NO: 611696 - RNA, 22 nt, Escherichia coli CFT073
ggauucacguugaugguaggcg

SEQ ID NO: 611697 - RNA, 20 nt, Escherichia coli CFT073
ggauuccagcgccgccagaa

SEQ ID NO: 611698 - RNA, 21 nt, Escherichia coli CFT073
ggauggucgcuugcgggcugg

SEQ ID NO: 611699 - RNA, 22 nt, Escherichia coli CFT073
ggauugcccuguuugucgauca

SEQ ID NO: 611700 - RNA, 23 nt, Escherichia coli CFT073
ggcaaaaucaucacucccuuucu

SEQ ID NO: 611701 - RNA, 20 nt, Escherichia coli CFT073
ggcaaaauccagaaaaaaag

SEQ ID NO: 611702 - RNA, 18 nt, Escherichia coli CFT073
ggcaaaauccuuccagcu

SEQ ID NO: 611703 - RNA, 15 nt, Escherichia coli CFT073
ggaucauguuuuuca

SEQ ID NO: 611704 - RNA, 13 nt, Escherichia coli CFT073
ggauccccugccc

SEQ ID NO: 611705 - RNA, 14 nt, Escherichia coli CFT073
ggauccccugcccg

SEQ ID NO: 611706 - RNA, 14 nt, Escherichia coli CFT073
ggauccggcagagg

SEQ ID NO: 611707 - RNA, 14 nt, Escherichia coli CFT073
ggauccgcucugcc

SEQ ID NO: 611708 - RNA, 15 nt, Escherichia coli CFT073
ggauccgcucugccc

SEQ ID NO: 611709 - RNA, 23 nt, Escherichia coli CFT073
ggaucgccggaauaucaccacug

SEQ ID NO: 611710 - RNA, 20 nt, Escherichia coli CFT073
ggaucgcauaaugccugcaa

SEQ ID NO: 611711 - RNA, 20 nt, Escherichia coli CFT073
ggauaauuaauccuucuccg

SEQ ID NO: 611712 - RNA, 22 nt, Escherichia coli CFT073
ggauaaggcguuugaacugaac

SEQ ID NO: 611713 - RNA, 19 nt, Escherichia coli CFT073
ggauaaucggcaauacuuu

SEQ ID NO: 611714 - RNA, 13 nt, Escherichia coli CFT073
ggauauaaaaaua

SEQ ID NO: 611715 - RNA, 15 nt, Escherichia coli CFT073
ggauauaaaaauaac

SEQ ID NO: 611716 - RNA, 16 nt, Escherichia coli CFT073
ggauauaaacucgcca

SEQ ID NO: 611717 - RNA, 20 nt, Escherichia coli CFT073
ggauauccaccgucaaaucc

SEQ ID NO: 611718 - RNA, 18 nt, Escherichia coli CFT073
ggauauccacccgcagcc

SEQ ID NO: 611719 - RNA, 17 nt, Escherichia coli CFT073
ggauauaauuuuuuuaa

SEQ ID NO: 611720 - RNA, 17 nt, Escherichia coli CFT073
ggauauacgcuuucagc

SEQ ID NO: 611721 - RNA, 18 nt, Escherichia coli CFT073
ggauauagcguaaagcca

SEQ ID NO: 611722 - RNA, 23 nt, Escherichia coli CFT073
ggauauugccggaugugaugcau

SEQ ID NO: 611723 - RNA, 16 nt, Escherichia coli CFT073
ggauaugaucugcaca

SEQ ID NO: 611724 - RNA, 15 nt, Escherichia coli CFT073
ggaucauaugcacaa

SEQ ID NO: 611725 - RNA, 17 nt, Escherichia coli CFT073
ggagcaguauugauaga

SEQ ID NO: 611726 - RNA, 22 nt, Escherichia coli CFT073
ggagcauuaacuccccuuuaaa

SEQ ID NO: 611727 - RNA, 14 nt, Escherichia coli CFT073
ggagccaguuggcg

SEQ ID NO: 611728 - RNA, 18 nt, Escherichia coli CFT073
ggagcucccccucuuccg

SEQ ID NO: 611729 - RNA, 20 nt, Escherichia coli CFT073
ggagcuaaacagagcugcaa

SEQ ID NO: 611730 - RNA, 12 nt, Escherichia coli CFT073
ggagcugcagcc

SEQ ID NO: 611731 - RNA, 19 nt, Escherichia coli CFT073
ggaguuuaggaaaguaagu

SEQ ID NO: 611732 - RNA, 13 nt, Escherichia coli CFT073
ggauaaagccccc

SEQ ID NO: 611733 - RNA, 17 nt, Escherichia coli CFT073
ggauaaaacugccagaa

SEQ ID NO: 611734 - RNA, 20 nt, Escherichia coli CFT073
ggauaaagcccccacaacau

SEQ ID NO: 611735 - RNA, 21 nt, Escherichia coli CFT073
ggauaaagcccccacaacauu

SEQ ID NO: 611736 - RNA, 13 nt, Escherichia coli CFT073
ggauaaaucaacg

SEQ ID NO: 611737 - RNA, 14 nt, Escherichia coli CFT073
ggaggguggcaccu

SEQ ID NO: 611738 - RNA, 18 nt, Escherichia coli CFT073
ggaggguucucccucccg

SEQ ID NO: 611739 - RNA, 22 nt, Escherichia coli CFT073
ggaggugaaaaccguccggcug

SEQ ID NO: 611740 - RNA, 16 nt, Escherichia coli CFT073
ggagaauccagcccca

SEQ ID NO: 611741 - RNA, 17 nt, Escherichia coli CFT073
ggagauuugcaucauca

SEQ ID NO: 611742 - RNA, 20 nt, Escherichia coli CFT073
ggagagggggcgauagaaua

SEQ ID NO: 611743 - RNA, 15 nt, Escherichia coli CFT073
ggagagcgccgggca

SEQ ID NO: 611744 - RNA, 22 nt, Escherichia coli CFT073
ggagagcgccgggcaaaugcuc

SEQ ID NO: 611745 - RNA, 17 nt, Escherichia coli CFT073
ggacguuuucucgucca

SEQ ID NO: 611746 - RNA, 12 nt, Escherichia coli CFT073
ggacuaaagaca

SEQ ID NO: 611747 - RNA, 14 nt, Escherichia coli CFT073
ggacgcgcaggagc

SEQ ID NO: 611748 - RNA, 20 nt, Escherichia coli CFT073
ggacgcgcaggagcggcgga

SEQ ID NO: 611749 - RNA, 17 nt, Escherichia coli CFT073
ggacaucccggcagaga

SEQ ID NO: 611750 - RNA, 15 nt, Escherichia coli CFT073
ggacaucaaagaaaa

SEQ ID NO: 611751 - RNA, 21 nt, Escherichia coli CFT073
ggacaucaaagaaaagcagug

SEQ ID NO: 611752 - RNA, 13 nt, Escherichia coli CFT073
ggaauuugcugcu

SEQ ID NO: 611753 - RNA, 17 nt, Escherichia coli CFT073
ggaauugcgcaacagag

SEQ ID NO: 611754 - RNA, 20 nt, Escherichia coli CFT073
ggaaugucuuuugugacgac

SEQ ID NO: 611755 - RNA, 22 nt, Escherichia coli CFT073
ggaauauaaguacuaaauaauu

SEQ ID NO: 611756 - RNA, 16 nt, Escherichia coli CFT073
ggaauaucaccacuga

SEQ ID NO: 611757 - RNA, 23 nt, Escherichia coli CFT073
ggaauaucaccacugaugccacu

SEQ ID NO: 611758 - RNA, 16 nt, Escherichia coli CFT073
ggaaggcccuuucccu

SEQ ID NO: 611759 - RNA, 23 nt, Escherichia coli CFT073
ggaaggaucgauggugaaguggc

SEQ ID NO: 611760 - RNA, 12 nt, Escherichia coli CFT073
ggaauggacugu

SEQ ID NO: 611761 - RNA, 15 nt, Escherichia coli CFT073
ggaauggucaccaca

SEQ ID NO: 611762 - RNA, 15 nt, Escherichia coli CFT073
ggaaucccaucgcag

SEQ ID NO: 611763 - RNA, 15 nt, Escherichia coli CFT073
ggaaucaaugugcuu

SEQ ID NO: 611764 - RNA, 18 nt, Escherichia coli CFT073
ggaacuuuuuucauccag

SEQ ID NO: 611765 - RNA, 21 nt, Escherichia coli CFT073
ggaacuuuuuucauccagcug

SEQ ID NO: 611766 - RNA, 19 nt, Escherichia coli CFT073
ggaacuuaguaggccugau

SEQ ID NO: 611767 - RNA, 14 nt, Escherichia coli CFT073
ggaacucuuucuga

SEQ ID NO: 611768 - RNA, 20 nt, Escherichia coli CFT073
ggaacgccagcagccacgac

SEQ ID NO: 611769 - RNA, 17 nt, Escherichia coli CFT073
ggaacggggguuuuacu

SEQ ID NO: 611770 - RNA, 21 nt, Escherichia coli CFT073
ggaacucagcgugccaucaaa

SEQ ID NO: 611771 - RNA, 21 nt, Escherichia coli CFT073
ggaagaccuuccagaaaaaga

SEQ ID NO: 611772 - RNA, 16 nt, Escherichia coli CFT073
ggaagacguagcaagc

SEQ ID NO: 611773 - RNA, 17 nt, Escherichia coli CFT073
ggaagacguagcaagca

SEQ ID NO: 611774 - RNA, 18 nt, Escherichia coli CFT073
ggaagacguagcaagcau

SEQ ID NO: 611775 - RNA, 17 nt, Escherichia coli CFT073
ggaagagacuauuucuu

SEQ ID NO: 611776 - RNA, 22 nt, Escherichia coli CFT073
ggaagcuuaucacagaggaaga

SEQ ID NO: 611777 - RNA, 23 nt, Escherichia coli CFT073
ggaagccaucuaugccaucuucu

SEQ ID NO: 611778 - RNA, 14 nt, Escherichia coli CFT073
ggaagcaauaagca

SEQ ID NO: 611779 - RNA, 15 nt, Escherichia coli CFT073
ggaagccaccacgcc

SEQ ID NO: 611780 - RNA, 18 nt, Escherichia coli CFT073
ggaagcgcaacagcgcgc

SEQ ID NO: 611781 - RNA, 11 nt, Escherichia coli CFT073
ggaacaagcca

SEQ ID NO: 611782 - RNA, 22 nt, Escherichia coli CFT073
ggaaauuaccgcaccaccagca

SEQ ID NO: 611783 - RNA, 12 nt, Escherichia coli CFT073
ggaaaucaucca

SEQ ID NO: 611784 - RNA, 13 nt, Escherichia coli CFT073
ggaaauacccugg

SEQ ID NO: 611785 - RNA, 14 nt, Escherichia coli CFT073
ggaaauaacgcuga

SEQ ID NO: 611786 - RNA, 14 nt, Escherichia coli CFT073
ggaaccacagcgcc

SEQ ID NO: 611787 - RNA, 16 nt, Escherichia coli CFT073
ggaaccugugacagca

SEQ ID NO: 611788 - RNA, 15 nt, Escherichia coli CFT073
ggaaccuaacgcugu

SEQ ID NO: 611789 - RNA, 15 nt, Escherichia coli CFT073
ggaaccggauuuuca

SEQ ID NO: 611790 - RNA, 21 nt, Escherichia coli CFT073
ggaacgagaacucggaagcag

SEQ ID NO: 611791 - RNA, 15 nt, Escherichia coli CFT073
ggaacauccuuuccu

SEQ ID NO: 611792 - RNA, 13 nt, Escherichia coli CFT073
ggaaccaaaugcc

SEQ ID NO: 611793 - RNA, 11 nt, Escherichia coli CFT073
ggaacauauca

SEQ ID NO: 611794 - RNA, 22 nt, Escherichia coli CFT073
ggaacaaucuugcaaaggcugu

SEQ ID NO: 611795 - RNA, 19 nt, Escherichia coli CFT073
ggaacacggcuuucugcaa

SEQ ID NO: 611796 - RNA, 16 nt, Escherichia coli CFT073
ggaaaacuuucuucag

SEQ ID NO: 611797 - RNA, 12 nt, Escherichia coli CFT073
ggaaaacaccga

SEQ ID NO: 611798 - RNA, 23 nt, Escherichia coli CFT073
ggaaaaauucaggggaagccaga

SEQ ID NO: 611799 - RNA, 24 nt, Escherichia coli CFT073
ggaaaaaguacuuuaccuggaacu

SEQ ID NO: 611800 - RNA, 17 nt, Escherichia coli CFT073
gcuuuuuuacaucauca

SEQ ID NO: 611801 - RNA, 18 nt, Escherichia coli CFT073
gcuuuuuuacaucaucag

SEQ ID NO: 611802 - RNA, 22 nt, Escherichia coli CFT073
gcuuuuuuagguacaaagccaa

SEQ ID NO: 611803 - RNA, 18 nt, Escherichia coli CFT073
gcuuuuuucucaacaggc

SEQ ID NO: 611804 - RNA, 18 nt, Escherichia coli CFT073
gcuuuuuugauuacagcu

SEQ ID NO: 611805 - RNA, 19 nt, Escherichia coli CFT073
ggaaagagcaaugugaaau

SEQ ID NO: 611806 - RNA, 18 nt, Escherichia coli CFT073
ggaaagcaagaccaacac

SEQ ID NO: 611807 - RNA, 13 nt, Escherichia coli CFT073
ggaaacuccagcc

SEQ ID NO: 611808 - RNA, 16 nt, Escherichia coli CFT073
ggaaacuggauggccu

SEQ ID NO: 611809 - RNA, 23 nt, Escherichia coli CFT073
ggaaacugucaauaaacgccugc

SEQ ID NO: 611810 - RNA, 14 nt, Escherichia coli CFT073
ggaaagcaccugca

SEQ ID NO: 611811 - RNA, 15 nt, Escherichia coli CFT073
ggaaagcaccugcac

SEQ ID NO: 611812 - RNA, 18 nt, Escherichia coli CFT073
ggaaaggauggcgaugcu

SEQ ID NO: 611813 - RNA, 20 nt, Escherichia coli CFT073
ggaaagcaguuuauaaaauu

SEQ ID NO: 611814 - RNA, 15 nt, Escherichia coli CFT073
ggaaaccggcgaaaa

SEQ ID NO: 611815 - RNA, 14 nt, Escherichia coli CFT073
ggaaaccaacucca

SEQ ID NO: 611816 - RNA, 21 nt, Escherichia coli CFT073
gcuuucacgucagggucgugc

SEQ ID NO: 611817 - RNA, 15 nt, Escherichia coli CFT073
gcuuucacucugaaa

SEQ ID NO: 611818 - RNA, 15 nt, Escherichia coli CFT073
gcuuucagcacgaca

SEQ ID NO: 611819 - RNA, 20 nt, Escherichia coli CFT073
gcuuucagcacuuaucucuu

SEQ ID NO: 611820 - RNA, 18 nt, Escherichia coli CFT073
gcuuuauguaauccugua

SEQ ID NO: 611821 - RNA, 23 nt, Escherichia coli CFT073
gcuuuauccugcccgcuccagcu

SEQ ID NO: 611822 - RNA, 20 nt, Escherichia coli CFT073
gcuuuaucgacuaacuucug

SEQ ID NO: 611823 - RNA, 21 nt, Escherichia coli CFT073
gcuuucaucacuugauccaua

SEQ ID NO: 611824 - RNA, 15 nt, Escherichia coli CFT073
gcuuucauucagaac

SEQ ID NO: 611825 - RNA, 16 nt, Escherichia coli CFT073
gcuuuccagagagaca

SEQ ID NO: 611826 - RNA, 13 nt, Escherichia coli CFT073
gcuuuccagcugu

SEQ ID NO: 611827 - RNA, 19 nt, Escherichia coli CFT073
gcuuugaaacgcacgcuga

SEQ ID NO: 611828 - RNA, 13 nt, Escherichia coli CFT073
gcuuugcccggca

SEQ ID NO: 611829 - RNA, 15 nt, Escherichia coli CFT073
gcuuugauauucauu

SEQ ID NO: 611830 - RNA, 15 nt, Escherichia coli CFT073
gcuuugauccgccag

SEQ ID NO: 611831 - RNA, 21 nt, Escherichia coli CFT073
gcuuucgcaauaaucaucucu

SEQ ID NO: 611832 - RNA, 22 nt, Escherichia coli CFT073
gcuuucgcaauaaucaucucuc

SEQ ID NO: 611833 - RNA, 16 nt, Escherichia coli CFT073
gcuuucgagcacgacu

SEQ ID NO: 611834 - RNA, 16 nt, Escherichia coli CFT073
gcuuucgcuuucucuu

SEQ ID NO: 611835 - RNA, 11 nt, Escherichia coli CFT073
gcuuucucaaa

SEQ ID NO: 611836 - RNA, 16 nt, Escherichia coli CFT073
gcuuucucaacaaaua

SEQ ID NO: 611837 - RNA, 11 nt, Escherichia coli CFT073
gcuuucugcug

SEQ ID NO: 611838 - RNA, 13 nt, Escherichia coli CFT073
gcuuucuucagcu

SEQ ID NO: 611839 - RNA, 12 nt, Escherichia coli CFT073
gcuuuugcaaac

SEQ ID NO: 611840 - RNA, 23 nt, Escherichia coli CFT073
gcuuuuggcucaucaauacgucc

SEQ ID NO: 611841 - RNA, 20 nt, Escherichia coli CFT073
gcuuuugguuuuucaaccac

SEQ ID NO: 611842 - RNA, 17 nt, Escherichia coli CFT073
gcuuuuugaauuguuuu

SEQ ID NO: 611843 - RNA, 19 nt, Escherichia coli CFT073
gcuuuuuccugccgcuaug

SEQ ID NO: 611844 - RNA, 19 nt, Escherichia coli CFT073
gcuuuuuccaggcuggcag

SEQ ID NO: 611845 - RNA, 20 nt, Escherichia coli CFT073
gcuuuuuauguuagccgccu

SEQ ID NO: 611846 - RNA, 18 nt, Escherichia coli CFT073
gcuuuuguggucaccaug

SEQ ID NO: 611847 - RNA, 12 nt, Escherichia coli CFT073
gcuuuuacaucg

SEQ ID NO: 611848 - RNA, 21 nt, Escherichia coli CFT073
gcuuugucauuaaauccgcca

SEQ ID NO: 611849 - RNA, 13 nt, Escherichia coli CFT073
gcuuuuauucaug

SEQ ID NO: 611850 - RNA, 18 nt, Escherichia coli CFT073
gcuuugccuccgcaacau

SEQ ID NO: 611851 - RNA, 15 nt, Escherichia coli CFT073
gcuuugcugugaagc

SEQ ID NO: 611852 - RNA, 12 nt, Escherichia coli CFT073
gcuuuggcaaau

SEQ ID NO: 611853 - RNA, 21 nt, Escherichia coli CFT073
gcuuuggcggccuucuuccag

SEQ ID NO: 611854 - RNA, 16 nt, Escherichia coli CFT073
gcuugcuuuccagcuu

SEQ ID NO: 611855 - RNA, 15 nt, Escherichia coli CFT073
gcuugcggccagcac

SEQ ID NO: 611856 - RNA, 17 nt, Escherichia coli CFT073
gcuugcgauccugcaga

SEQ ID NO: 611857 - RNA, 20 nt, Escherichia coli CFT073
gcuugcgcgcaaucagcacc

SEQ ID NO: 611858 - RNA, 16 nt, Escherichia coli CFT073
gcuugcgcgcaaucag

SEQ ID NO: 611859 - RNA, 18 nt, Escherichia coli CFT073
gcuugccgcgucuuauca

SEQ ID NO: 611860 - RNA, 19 nt, Escherichia coli CFT073
gcuugcaggaucagcuccg

SEQ ID NO: 611861 - RNA, 18 nt, Escherichia coli CFT073
gcuugaugcgucuuauca

SEQ ID NO: 611862 - RNA, 13 nt, Escherichia coli CFT073
gcuugaucuuccu

SEQ ID NO: 611863 - RNA, 15 nt, Escherichia coli CFT073
gcuugaucuuccuga

SEQ ID NO: 611864 - RNA, 17 nt, Escherichia coli CFT073
gcuuguuucauuacucg

SEQ ID NO: 611865 - RNA, 15 nt, Escherichia coli CFT073
gcuuuaaaagcuuau

SEQ ID NO: 611866 - RNA, 14 nt, Escherichia coli CFT073
gcuuuaaagcaggc

SEQ ID NO: 611867 - RNA, 22 nt, Escherichia coli CFT073
gcuuuaccaccgucaauaaaaa

SEQ ID NO: 611868 - RNA, 17 nt, Escherichia coli CFT073
gcuuuaaaugucauacu

SEQ ID NO: 611869 - RNA, 23 nt, Escherichia coli CFT073
gcuuuaauuucaugcucaccaau

SEQ ID NO: 611870 - RNA, 13 nt, Escherichia coli CFT073
gcuuuacgugcca

SEQ ID NO: 611871 - RNA, 20 nt, Escherichia coli CFT073
gcuuguuaauaaagugcgcu

SEQ ID NO: 611872 - RNA, 19 nt, Escherichia coli CFT073
gcuugucgccgguuaaucu

SEQ ID NO: 611873 - RNA, 22 nt, Escherichia coli CFT073
gcuuguaaaugaacucaacgcc

SEQ ID NO: 611874 - RNA, 14 nt, Escherichia coli CFT073
gcuucgugcuuaau

SEQ ID NO: 611875 - RNA, 16 nt, Escherichia coli CFT073
gcuucgugcuuaauca

SEQ ID NO: 611876 - RNA, 19 nt, Escherichia coli CFT073
gcuucgugauugcuuugau

SEQ ID NO: 611877 - RNA, 16 nt, Escherichia coli CFT073
gcuucgucgccagcuc

SEQ ID NO: 611878 - RNA, 19 nt, Escherichia coli CFT073
gcuucuaccuuauccagca

SEQ ID NO: 611879 - RNA, 21 nt, Escherichia coli CFT073
gcuucuaccuuauccagcaga

SEQ ID NO: 611880 - RNA, 12 nt, Escherichia coli CFT073
gcuucugcagcu

SEQ ID NO: 611881 - RNA, 17 nt, Escherichia coli CFT073
gcuucugacauagccac

SEQ ID NO: 611882 - RNA, 16 nt, Escherichia coli CFT073
gcuucucuuccaggua

SEQ ID NO: 611883 - RNA, 17 nt, Escherichia coli CFT073
gcuucucggcaaacagu

SEQ ID NO: 611884 - RNA, 18 nt, Escherichia coli CFT073
gcuucucgugaaauucac

SEQ ID NO: 611885 - RNA, 17 nt, Escherichia coli CFT073
gcuucuucuuccagguc

SEQ ID NO: 611886 - RNA, 13 nt, Escherichia coli CFT073
gcuucuuccagcu

SEQ ID NO: 611887 - RNA, 14 nt, Escherichia coli CFT073
gcuucuuccagcuu

SEQ ID NO: 611888 - RNA, 20 nt, Escherichia coli CFT073
gcuucuggcgacaucuucuc

SEQ ID NO: 611889 - RNA, 13 nt, Escherichia coli CFT073
gcuucuggcuggc

SEQ ID NO: 611890 - RNA, 16 nt, Escherichia coli CFT073
gcuucuggcuggcgcu

SEQ ID NO: 611891 - RNA, 22 nt, Escherichia coli CFT073
gcuucuguuuucgcaccugcca

SEQ ID NO: 611892 - RNA, 20 nt, Escherichia coli CFT073
gcuucuuacuauauaaaccu

SEQ ID NO: 611893 - RNA, 22 nt, Escherichia coli CFT073
gcuucuuucucaaucugcuugc

SEQ ID NO: 611894 - RNA, 23 nt, Escherichia coli CFT073
gcuucgguuuuguugccgcccgu

SEQ ID NO: 611895 - RNA, 16 nt, Escherichia coli CFT073
gcuucgucaccuguuc

SEQ ID NO: 611896 - RNA, 16 nt, Escherichia coli CFT073
gcuucggaaaacaaca

SEQ ID NO: 611897 - RNA, 21 nt, Escherichia coli CFT073
gcuucgcucucuuucaccagc

SEQ ID NO: 611898 - RNA, 14 nt, Escherichia coli CFT073
gcuucgcuucccaa

SEQ ID NO: 611899 - RNA, 16 nt, Escherichia coli CFT073
gcuucgacuuccugca

SEQ ID NO: 611900 - RNA, 14 nt, Escherichia coli CFT073
gcuucgauucccag

SEQ ID NO: 611901 - RNA, 22 nt, Escherichia coli CFT073
gcuucgcgaaguucuuccggca

SEQ ID NO: 611902 - RNA, 17 nt, Escherichia coli CFT073
gcuucgcgaaucgccac

SEQ ID NO: 611903 - RNA, 19 nt, Escherichia coli CFT073
gcuucgcgaaucgccacaa

SEQ ID NO: 611904 - RNA, 19 nt, Escherichia coli CFT073
gcuucgcggacaucgucca

SEQ ID NO: 611905 - RNA, 23 nt, Escherichia coli CFT073
gcuucgcggacaucguccagcuu

SEQ ID NO: 611906 - RNA, 17 nt, Escherichia coli CFT073
gcuuccagccaugccac

SEQ ID NO: 611907 - RNA, 20 nt, Escherichia coli CFT073
gcuuccagcgucgcggucag

SEQ ID NO: 611908 - RNA, 15 nt, Escherichia coli CFT073
gcuuccccaacacag

SEQ ID NO: 611909 - RNA, 17 nt, Escherichia coli CFT073
gcuucccguagcaggaa

SEQ ID NO: 611910 - RNA, 18 nt, Escherichia coli CFT073
gcuucccguagcaggaaa

SEQ ID NO: 611911 - RNA, 15 nt, Escherichia coli CFT073
gcuuccggcggcggu

SEQ ID NO: 611912 - RNA, 16 nt, Escherichia coli CFT073
gcuuccggcaauggcu

SEQ ID NO: 611913 - RNA, 18 nt, Escherichia coli CFT073
gcuucaaaccuucaucca

SEQ ID NO: 611914 - RNA, 22 nt, Escherichia coli CFT073
gcuucaaacgcugacggugcca

SEQ ID NO: 611915 - RNA, 15 nt, Escherichia coli CFT073
gcuucaaccagugca

SEQ ID NO: 611916 - RNA, 23 nt, Escherichia coli CFT073
gcuucaaucugauauuuagccag

SEQ ID NO: 611917 - RNA, 14 nt, Escherichia coli CFT073
gcuucaauuuuuuc

SEQ ID NO: 611918 - RNA, 12 nt, Escherichia coli CFT073
gcuucaaucuga

SEQ ID NO: 611919 - RNA, 13 nt, Escherichia coli CFT073
gcuucaaucugau

SEQ ID NO: 611920 - RNA, 21 nt, Escherichia coli CFT073
gcuucaaucaauaacagcgca

SEQ ID NO: 611921 - RNA, 23 nt, Escherichia coli CFT073
gcuucaauacgcucgaacagcug

SEQ ID NO: 611922 - RNA, 14 nt, Escherichia coli CFT073
gcuucaagaugcca

SEQ ID NO: 611923 - RNA, 15 nt, Escherichia coli CFT073
gcuucagauuagccg

SEQ ID NO: 611924 - RNA, 20 nt, Escherichia coli CFT073
gcuucacucccugccccguc

SEQ ID NO: 611925 - RNA, 20 nt, Escherichia coli CFT073
gcuucacugaaacagauaaa

SEQ ID NO: 611926 - RNA, 17 nt, Escherichia coli CFT073
gcuucaagcauugauuu

SEQ ID NO: 611927 - RNA, 20 nt, Escherichia coli CFT073
gcuucacaaaggcuugcugc

SEQ ID NO: 611928 - RNA, 19 nt, Escherichia coli CFT073
gcuucaccgacaucuuucu

SEQ ID NO: 611929 - RNA, 15 nt, Escherichia coli CFT073
gcuucaucagguuga

SEQ ID NO: 611930 - RNA, 17 nt, Escherichia coli CFT073
gcuucagcguaucccag

SEQ ID NO: 611931 - RNA, 23 nt, Escherichia coli CFT073
gcuucagcuugagguuggagauc

SEQ ID NO: 611932 - RNA, 17 nt, Escherichia coli CFT073
gcuucaggaauaagaca

SEQ ID NO: 611933 - RNA, 15 nt, Escherichia coli CFT073
gcuucaucugcacgc

SEQ ID NO: 611934 - RNA, 13 nt, Escherichia coli CFT073
gcuuccagaaucc

SEQ ID NO: 611935 - RNA, 16 nt, Escherichia coli CFT073
gcuuaccaugccaacg

SEQ ID NO: 611936 - RNA, 13 nt, Escherichia coli CFT073
gcuuacaucuuua

SEQ ID NO: 611937 - RNA, 22 nt, Escherichia coli CFT073
gcuuacaucuuuacaucauuca

SEQ ID NO: 611938 - RNA, 15 nt, Escherichia coli CFT073
gcuuaccaugccaac

SEQ ID NO: 611939 - RNA, 18 nt, Escherichia coli CFT073
gcuuaauugcccaaagcc

SEQ ID NO: 611940 - RNA, 14 nt, Escherichia coli CFT073
gcuuacacuuccuu

SEQ ID NO: 611941 - RNA, 22 nt, Escherichia coli CFT073
gcuuacacuuccuuuacuuugc

SEQ ID NO: 611942 - RNA, 18 nt, Escherichia coli CFT073
gcuuaagaucaacuucgc

SEQ ID NO: 611943 - RNA, 16 nt, Escherichia coli CFT073
gcuuaagccaucauca

SEQ ID NO: 611944 - RNA, 19 nt, Escherichia coli CFT073
gcuuaauccgcgcccuuuu

SEQ ID NO: 611945 - RNA, 17 nt, Escherichia coli CFT073
gcuuaaugagauaauca

SEQ ID NO: 611946 - RNA, 16 nt, Escherichia coli CFT073
gcuuaacguacugcug

SEQ ID NO: 611947 - RNA, 21 nt, Escherichia coli CFT073
gcuuaacugccauuucauaaa

SEQ ID NO: 611948 - RNA, 15 nt, Escherichia coli CFT073
gcuuaaauccaaacu

SEQ ID NO: 611949 - RNA, 12 nt, Escherichia coli CFT073
gcuuaacaguuc

SEQ ID NO: 611950 - RNA, 14 nt, Escherichia coli CFT073
gcuuaacaucccca

SEQ ID NO: 611951 - RNA, 15 nt, Escherichia coli CFT073
gcuuauaacugcccg

SEQ ID NO: 611952 - RNA, 19 nt, Escherichia coli CFT073
gcuuacguuacccagcacg

SEQ ID NO: 611953 - RNA, 19 nt, Escherichia coli CFT073
gcuuaucgcaggcuuccug

SEQ ID NO: 611954 - RNA, 20 nt, Escherichia coli CFT073
gcuuaucgcaggcuuccugg

SEQ ID NO: 611955 - RNA, 19 nt, Escherichia coli CFT073
gcuuauauacucuaaauaa

SEQ ID NO: 611956 - RNA, 14 nt, Escherichia coli CFT073
gcuuaucaaucucu

SEQ ID NO: 611957 - RNA, 13 nt, Escherichia coli CFT073
gcuuaucgcccug

SEQ ID NO: 611958 - RNA, 19 nt, Escherichia coli CFT073
gcuuaucgcccugcuccag

SEQ ID NO: 611959 - RNA, 20 nt, Escherichia coli CFT073
gcuuaucgcgauauucucgc

SEQ ID NO: 611960 - RNA, 22 nt, Escherichia coli CFT073
gcuuaucuuccguauuugucuc

SEQ ID NO: 611961 - RNA, 14 nt, Escherichia coli CFT073
gcuuaucuuccugu

SEQ ID NO: 611962 - RNA, 22 nt, Escherichia coli CFT073
gcuggucaggccaaacuacgcu

SEQ ID NO: 611963 - RNA, 13 nt, Escherichia coli CFT073
gcuggugauucag

SEQ ID NO: 611964 - RNA, 18 nt, Escherichia coli CFT073
gcuggugauugcaaagag

SEQ ID NO: 611965 - RNA, 13 nt, Escherichia coli CFT073
gcuggucgcccgg

SEQ ID NO: 611966 - RNA, 12 nt, Escherichia coli CFT073
gcugguaaacga

SEQ ID NO: 611967 - RNA, 17 nt, Escherichia coli CFT073
gcuggguuucgccugcc

SEQ ID NO: 611968 - RNA, 22 nt, Escherichia coli CFT073
gcuggguuucgccugccagaug

SEQ ID NO: 611969 - RNA, 17 nt, Escherichia coli CFT073
gcugggaaaucaccacc

SEQ ID NO: 611970 - RNA, 20 nt, Escherichia coli CFT073
gcugggaaaucaccaccagc

SEQ ID NO: 611971 - RNA, 18 nt, Escherichia coli CFT073
gcuggcuucuaucuucau

SEQ ID NO: 611972 - RNA, 14 nt, Escherichia coli CFT073
gcuggcugcagugg

SEQ ID NO: 611973 - RNA, 21 nt, Escherichia coli CFT073
gcugggauuuggcagcaccca

SEQ ID NO: 611974 - RNA, 13 nt, Escherichia coli CFT073
gcuggcaucgagc

SEQ ID NO: 611975 - RNA, 13 nt, Escherichia coli CFT073
gcuggcaucacca

SEQ ID NO: 611976 - RNA, 21 nt, Escherichia coli CFT073
gcuggccaugauuaccagcau

SEQ ID NO: 611977 - RNA, 22 nt, Escherichia coli CFT073
gcuggccaugauuaccagcauc

SEQ ID NO: 611978 - RNA, 18 nt, Escherichia coli CFT073
gcuggccgcgucuuaucc

SEQ ID NO: 611979 - RNA, 15 nt, Escherichia coli CFT073
gcuggcggcuggcac

SEQ ID NO: 611980 - RNA, 13 nt, Escherichia coli CFT073
gcuggcgggcugg

SEQ ID NO: 611981 - RNA, 14 nt, Escherichia coli CFT073
gcuggcggggccgc

SEQ ID NO: 611982 - RNA, 17 nt, Escherichia coli CFT073
gcuggcguacccaucaa

SEQ ID NO: 611983 - RNA, 18 nt, Escherichia coli CFT073
gcuggcgucacgccgacc

SEQ ID NO: 611984 - RNA, 18 nt, Escherichia coli CFT073
gcuggcgaucguccagcu

SEQ ID NO: 611985 - RNA, 20 nt, Escherichia coli CFT073
gcuggcgaucguccagcugc

SEQ ID NO: 611986 - RNA, 19 nt, Escherichia coli CFT073
gcuggcgagugcauccagu

SEQ ID NO: 611987 - RNA, 15 nt, Escherichia coli CFT073
gcuguaagccgccgc

SEQ ID NO: 611988 - RNA, 19 nt, Escherichia coli CFT073
gcuguaagccgccgccauc

SEQ ID NO: 611989 - RNA, 18 nt, Escherichia coli CFT073
gcuguaaggugaaagcaa

SEQ ID NO: 611990 - RNA, 16 nt, Escherichia coli CFT073
gcugguuucuggcggu

SEQ ID NO: 611991 - RNA, 20 nt, Escherichia coli CFT073
gcugguuuugugcgccacau

SEQ ID NO: 611992 - RNA, 20 nt, Escherichia coli CFT073
gcuguagcaguuccagcauc

SEQ ID NO: 611993 - RNA, 23 nt, Escherichia coli CFT073
gcuguaccuggccccuggcuggu

SEQ ID NO: 611994 - RNA, 14 nt, Escherichia coli CFT073
gcuguaauuucaca

SEQ ID NO: 611995 - RNA, 22 nt, Escherichia coli CFT073
gcugguugcgucuuaucaggcc

SEQ ID NO: 611996 - RNA, 20 nt, Escherichia coli CFT073
gcugguggauguuugcagua

SEQ ID NO: 611997 - RNA, 19 nt, Escherichia coli CFT073
gcugucaacugcgccacuc

SEQ ID NO: 611998 - RNA, 16 nt, Escherichia coli CFT073
gcuguauguuccccuc

SEQ ID NO: 611999 - RNA, 21 nt, Escherichia coli CFT073
gcugucaccucugcaacgucu

SEQ ID NO: 612000 - RNA, 22 nt, Escherichia coli CFT073
gcuguaggguggggaaaaaaca

SEQ ID NO: 612001 - RNA, 22 nt, Escherichia coli CFT073
gcuguaguucagaauugccgcc

SEQ ID NO: 612002 - RNA, 12 nt, Escherichia coli CFT073
gcuguccauacc

SEQ ID NO: 612003 - RNA, 16 nt, Escherichia coli CFT073
gcugucauccagcagu

SEQ ID NO: 612004 - RNA, 19 nt, Escherichia coli CFT073
gcuguccggcgcacuggug

SEQ ID NO: 612005 - RNA, 15 nt, Escherichia coli CFT073
gcugucgaucagaga

SEQ ID NO: 612006 - RNA, 18 nt, Escherichia coli CFT073
gcuguuccggcacaccuu

SEQ ID NO: 612007 - RNA, 16 nt, Escherichia coli CFT073
gcuguucaucccgacc

SEQ ID NO: 612008 - RNA, 15 nt, Escherichia coli CFT073
gcuguuguuccagcu

SEQ ID NO: 612009 - RNA, 15 nt, Escherichia coli CFT073
gcuguuggugccaga

SEQ ID NO: 612010 - RNA, 17 nt, Escherichia coli CFT073
gcuguuccagcaucaca

SEQ ID NO: 612011 - RNA, 14 nt, Escherichia coli CFT073
gcuguuuucagcac

SEQ ID NO: 612012 - RNA, 18 nt, Escherichia coli CFT073
gcuguuuucagcaccaga

SEQ ID NO: 612013 - RNA, 19 nt, Escherichia coli CFT073
gcuguuuuccagcaccacu

SEQ ID NO: 612014 - RNA, 14 nt, Escherichia coli CFT073
gcugugccuccugc

SEQ ID NO: 612015 - RNA, 14 nt, Escherichia coli CFT073
gcugugccaggacu

SEQ ID NO: 612016 - RNA, 15 nt, Escherichia coli CFT073
gcugucuuucaacag

SEQ ID NO: 612017 - RNA, 18 nt, Escherichia coli CFT073
gcugugaagugcugcaac

SEQ ID NO: 612018 - RNA, 21 nt, Escherichia coli CFT073
gcugugagcaggcguaccuuu

SEQ ID NO: 612019 - RNA, 22 nt, Escherichia coli CFT073
gcugugagguggagucagggga

SEQ ID NO: 612020 - RNA, 16 nt, Escherichia coli CFT073
gcugcgucgcggccug

SEQ ID NO: 612021 - RNA, 20 nt, Escherichia coli CFT073
gcugcgucgcggccuguucc

SEQ ID NO: 612022 - RNA, 14 nt, Escherichia coli CFT073
gcugcgucuuccac

SEQ ID NO: 612023 - RNA, 20 nt, Escherichia coli CFT073
gcugcguuuucacaguaauu

SEQ ID NO: 612024 - RNA, 12 nt, Escherichia coli CFT073
gcugcuaauauu

SEQ ID NO: 612025 - RNA, 23 nt, Escherichia coli CFT073
gcugcguuugcccuaaagcgcga

SEQ ID NO: 612026 - RNA, 18 nt, Escherichia coli CFT073
gcugcucggcaauuugug

SEQ ID NO: 612027 - RNA, 19 nt, Escherichia coli CFT073
gcugcucacaccaugccag

SEQ ID NO: 612028 - RNA, 9 nt, Escherichia coli CFT073
gcugcucag

SEQ ID NO: 612029 - RNA, 22 nt, Escherichia coli CFT073
gcugcuccugcgacugcauuug

SEQ ID NO: 612030 - RNA, 16 nt, Escherichia coli CFT073
gcugcggauccugagc

SEQ ID NO: 612031 - RNA, 14 nt, Escherichia coli CFT073
gcugcggccugcug

SEQ ID NO: 612032 - RNA, 22 nt, Escherichia coli CFT073
gcugcgggcgaucauauccagc

SEQ ID NO: 612033 - RNA, 19 nt, Escherichia coli CFT073
gcugcgggaguugcuccac

SEQ ID NO: 612034 - RNA, 14 nt, Escherichia coli CFT073
gcugcgccuguggu

SEQ ID NO: 612035 - RNA, 15 nt, Escherichia coli CFT073
gcugcgcgacggcga

SEQ ID NO: 612036 - RNA, 22 nt, Escherichia coli CFT073
gcugcgccauaaccgccagcac

SEQ ID NO: 612037 - RNA, 11 nt, Escherichia coli CFT073
gcugcgcccgc

SEQ ID NO: 612038 - RNA, 19 nt, Escherichia coli CFT073
gcugcuuuaucagaucacg

SEQ ID NO: 612039 - RNA, 23 nt, Escherichia coli CFT073
gcuggaaaugaccauaaaaggca

SEQ ID NO: 612040 - RNA, 22 nt, Escherichia coli CFT073
gcuggaaagcucuucaugcagc

SEQ ID NO: 612041 - RNA, 23 nt, Escherichia coli CFT073
gcuggaaaagguaaggauaaaaa

SEQ ID NO: 612042 - RNA, 16 nt, Escherichia coli CFT073
gcuggaaucaucaagc

SEQ ID NO: 612043 - RNA, 11 nt, Escherichia coli CFT073
gcugcuggagc

SEQ ID NO: 612044 - RNA, 21 nt, Escherichia coli CFT073
gcugcuggagcaggugaauca

SEQ ID NO: 612045 - RNA, 22 nt, Escherichia coli CFT073
gcugcugcacauacugcaucag

SEQ ID NO: 612046 - RNA, 14 nt, Escherichia coli CFT073
gcugcuguuuuuga

SEQ ID NO: 612047 - RNA, 21 nt, Escherichia coli CFT073
gcugcuuacauaguucuucaa

SEQ ID NO: 612048 - RNA, 17 nt, Escherichia coli CFT073
gcugcuguuaccagaca

SEQ ID NO: 612049 - RNA, 19 nt, Escherichia coli CFT073
gcuggauagggggguaaca

SEQ ID NO: 612050 - RNA, 22 nt, Escherichia coli CFT073
gcuggcaagauggcgaacauaa

SEQ ID NO: 612051 - RNA, 20 nt, Escherichia coli CFT073
gcuggcaaguucgucuuccg

SEQ ID NO: 612052 - RNA, 14 nt, Escherichia coli CFT073
gcuggcaagauggc

SEQ ID NO: 612053 - RNA, 23 nt, Escherichia coli CFT073
gcuggauggcgcaaugccaucca

SEQ ID NO: 612054 - RNA, 21 nt, Escherichia coli CFT073
gcuggcaaaaaugauagccag

SEQ ID NO: 612055 - RNA, 18 nt, Escherichia coli CFT073
gcuggaggaacgcgccuc

SEQ ID NO: 612056 - RNA, 13 nt, Escherichia coli CFT073
gcuggacguggug

SEQ ID NO: 612057 - RNA, 19 nt, Escherichia coli CFT073
gcuggacaucgucugcggu

SEQ ID NO: 612058 - RNA, 15 nt, Escherichia coli CFT073
gcugcauacucugca

SEQ ID NO: 612059 - RNA, 18 nt, Escherichia coli CFT073
gcugccacauuucucugu

SEQ ID NO: 612060 - RNA, 13 nt, Escherichia coli CFT073
gcugccacacugc

SEQ ID NO: 612061 - RNA, 16 nt, Escherichia coli CFT073
gcugcauuauccacgc

SEQ ID NO: 612062 - RNA, 17 nt, Escherichia coli CFT073
gcugcauuauccucaau

SEQ ID NO: 612063 - RNA, 22 nt, Escherichia coli CFT073
gcugcaugaugucgaauuucuc

SEQ ID NO: 612064 - RNA, 16 nt, Escherichia coli CFT073
gcugcauuucuggaau

SEQ ID NO: 612065 - RNA, 19 nt, Escherichia coli CFT073
gcugcaacuggcggcggcg

SEQ ID NO: 612066 - RNA, 22 nt, Escherichia coli CFT073
gcugcaaauauugccccagcgu

SEQ ID NO: 612067 - RNA, 13 nt, Escherichia coli CFT073
gcugauuuuguug

SEQ ID NO: 612068 - RNA, 21 nt, Escherichia coli CFT073
gcugauugcggucagcgcagc

SEQ ID NO: 612069 - RNA, 12 nt, Escherichia coli CFT073
gcugauugcugg

SEQ ID NO: 612070 - RNA, 13 nt, Escherichia coli CFT073
gcugauucuuccc

SEQ ID NO: 612071 - RNA, 20 nt, Escherichia coli CFT073
gcugcacauacugcaucagc

SEQ ID NO: 612072 - RNA, 18 nt, Escherichia coli CFT073
gcugcaccaacaucaugc

SEQ ID NO: 612073 - RNA, 14 nt, Escherichia coli CFT073
gcugcaccagcagc

SEQ ID NO: 612074 - RNA, 15 nt, Escherichia coli CFT073
gcugcacagagcuau

SEQ ID NO: 612075 - RNA, 17 nt, Escherichia coli CFT073
gcugcaccccacaaaca

SEQ ID NO: 612076 - RNA, 18 nt, Escherichia coli CFT073
gcugcaccccacaaacag

SEQ ID NO: 612077 - RNA, 21 nt, Escherichia coli CFT073
gcugcaccccacaaacagaau

SEQ ID NO: 612078 - RNA, 21 nt, Escherichia coli CFT073
gcugcgauaguggaacaaaga

SEQ ID NO: 612079 - RNA, 19 nt, Escherichia coli CFT073
gcugccuuucgcuccggca

SEQ ID NO: 612080 - RNA, 18 nt, Escherichia coli CFT073
gcugccggaccaucuucc

SEQ ID NO: 612081 - RNA, 16 nt, Escherichia coli CFT073
gcugccgcuccuucac

SEQ ID NO: 612082 - RNA, 14 nt, Escherichia coli CFT073
gcugccgcgccaga

SEQ ID NO: 612083 - RNA, 22 nt, Escherichia coli CFT073
gcugccccucaacuugcucaag

SEQ ID NO: 612084 - RNA, 11 nt, Escherichia coli CFT073
gcugccaggca

SEQ ID NO: 612085 - RNA, 14 nt, Escherichia coli CFT073
gcugccaucaucuu

SEQ ID NO: 612086 - RNA, 21 nt, Escherichia coli CFT073
gcugccgccagguuauccaga

SEQ ID NO: 612087 - RNA, 15 nt, Escherichia coli CFT073
gcugccgagcgcaag

SEQ ID NO: 612088 - RNA, 21 nt, Escherichia coli CFT073
uacaggaaauaagaagccaua

SEQ ID NO: 612089 - RNA, 16 nt, Escherichia coli CFT073
uacaggaacagccacu

SEQ ID NO: 612090 - RNA, 16 nt, Escherichia coli CFT073
uacagcucucacuuau

SEQ ID NO: 612091 - RNA, 17 nt, Escherichia coli CFT073
uacagcguuuugccauc

SEQ ID NO: 612092 - RNA, 12 nt, Escherichia coli CFT073
uacaguuuccuu

SEQ ID NO: 612093 - RNA, 16 nt, Escherichia coli CFT073
uacagugccccaaaug

SEQ ID NO: 612094 - RNA, 17 nt, Escherichia coli CFT073
uacagugccccaaaugu

SEQ ID NO: 612095 - RNA, 13 nt, Escherichia coli CFT073
uacagcaucggcu

SEQ ID NO: 612096 - RNA, 19 nt, Escherichia coli CFT073
uacagcaguacgccgagaa

SEQ ID NO: 612097 - RNA, 23 nt, Escherichia coli CFT073
uacagccagccagcaccaggcuu

SEQ ID NO: 612098 - RNA, 15 nt, Escherichia coli CFT073
uacacugguucccaa

SEQ ID NO: 612099 - RNA, 22 nt, Escherichia coli CFT073
uacaccuuaaggcuguucccac

SEQ ID NO: 612100 - RNA, 16 nt, Escherichia coli CFT073
uacacgaaacgaaacc

SEQ ID NO: 612101 - RNA, 17 nt, Escherichia coli CFT073
uacacgaaaugaauaau

SEQ ID NO: 612102 - RNA, 12 nt, Escherichia coli CFT073
uacaccugcugu

SEQ ID NO: 612103 - RNA, 13 nt, Escherichia coli CFT073
uacaccugcugug

SEQ ID NO: 612104 - RNA, 17 nt, Escherichia coli CFT073
uacaccgcgaagcagcu

SEQ ID NO: 612105 - RNA, 20 nt, Escherichia coli CFT073
uacaccgcagccgccacaau

SEQ ID NO: 612106 - RNA, 14 nt, Escherichia coli CFT073
uacacccagccccg

SEQ ID NO: 612107 - RNA, 19 nt, Escherichia coli CFT073
uacaccaucggcuggccuu

SEQ ID NO: 612108 - RNA, 23 nt, Escherichia coli CFT073
uacaccaccaccgacaccgcauu

SEQ ID NO: 612109 - RNA, 17 nt, Escherichia coli CFT073
uacacagcccaguuuuu

SEQ ID NO: 612110 - RNA, 11 nt, Escherichia coli CFT073
uacacagcccg

SEQ ID NO: 612111 - RNA, 17 nt, Escherichia coli CFT073
uacaagaaucaugccaa

SEQ ID NO: 612112 - RNA, 18 nt, Escherichia coli CFT073
uacaaguccugaauuaaa

SEQ ID NO: 612113 - RNA, 22 nt, Escherichia coli CFT073
uacaaacgccauaaacuucauu

SEQ ID NO: 612114 - RNA, 21 nt, Escherichia coli CFT073
uacaacugccgcgccugaauc

SEQ ID NO: 612115 - RNA, 12 nt, Escherichia coli CFT073
uaauuuuuccag

SEQ ID NO: 612116 - RNA, 14 nt, Escherichia coli CFT073
uaauuuuuccagca

SEQ ID NO: 612117 - RNA, 12 nt, Escherichia coli CFT073
uaauuuuuuaau

SEQ ID NO: 612118 - RNA, 13 nt, Escherichia coli CFT073
uaauuuuuuaaua

SEQ ID NO: 612119 - RNA, 14 nt, Escherichia coli CFT073
uaauuuuuuaauaa

SEQ ID NO: 612120 - RNA, 23 nt, Escherichia coli CFT073
uaauuuuuccagcauuucuucca

SEQ ID NO: 612121 - RNA, 18 nt, Escherichia coli CFT073
uacaaaauacaaacgcca

SEQ ID NO: 612122 - RNA, 19 nt, Escherichia coli CFT073
uacaaaaugacauuaagua

SEQ ID NO: 612123 - RNA, 21 nt, Escherichia coli CFT073
uacaaaaugacauuaaguaac

SEQ ID NO: 612124 - RNA, 16 nt, Escherichia coli CFT073
uacaaacaucauccag

SEQ ID NO: 612125 - RNA, 15 nt, Escherichia coli CFT073
uacaaacacugcuuu

SEQ ID NO: 612126 - RNA, 13 nt, Escherichia coli CFT073
uacaaaaauaagu

SEQ ID NO: 612127 - RNA, 17 nt, Escherichia coli CFT073
uaauuuuuuuaaucuau

SEQ ID NO: 612128 - RNA, 13 nt, Escherichia coli CFT073
uacaaaacauuau

SEQ ID NO: 612129 - RNA, 19 nt, Escherichia coli CFT073
uacaaaacauuauugagaa

SEQ ID NO: 612130 - RNA, 23 nt, Escherichia coli CFT073
uaauucuccgcacuccaacucuu

SEQ ID NO: 612131 - RNA, 14 nt, Escherichia coli CFT073
uaauuuaaaucaug

SEQ ID NO: 612132 - RNA, 20 nt, Escherichia coli CFT073
uaauuuauagauucuacgaa

SEQ ID NO: 612133 - RNA, 22 nt, Escherichia coli CFT073
uaauuugcgcgguaacgccauc

SEQ ID NO: 612134 - RNA, 21 nt, Escherichia coli CFT073
uaauuugcguuuucaccacug

SEQ ID NO: 612135 - RNA, 14 nt, Escherichia coli CFT073
uaauuugaucaaau

SEQ ID NO: 612136 - RNA, 21 nt, Escherichia coli CFT073
uaauuugaaaugacgcuuuau

SEQ ID NO: 612137 - RNA, 13 nt, Escherichia coli CFT073
uaauuucuuuuca

SEQ ID NO: 612138 - RNA, 12 nt, Escherichia coli CFT073
uaauuuccugcc

SEQ ID NO: 612139 - RNA, 18 nt, Escherichia coli CFT073
uaauuucaugcucaccaa

SEQ ID NO: 612140 - RNA, 20 nt, Escherichia coli CFT073
uaauuucaacagauuuugca

SEQ ID NO: 612141 - RNA, 19 nt, Escherichia coli CFT073
uaauuucacaccaucaaca

SEQ ID NO: 612142 - RNA, 14 nt, Escherichia coli CFT073
uaauucaacagauu

SEQ ID NO: 612143 - RNA, 18 nt, Escherichia coli CFT073
uaauucaccguucaauuc

SEQ ID NO: 612144 - RNA, 23 nt, Escherichia coli CFT073
uaauucaccguucaauuccgcaa

SEQ ID NO: 612145 - RNA, 12 nt, Escherichia coli CFT073
uaauucagcaga

SEQ ID NO: 612146 - RNA, 13 nt, Escherichia coli CFT073
uaauucagcagag

SEQ ID NO: 612147 - RNA, 20 nt, Escherichia coli CFT073
uaauucagcagagcaauauc

SEQ ID NO: 612148 - RNA, 18 nt, Escherichia coli CFT073
uaauuacgccaauuuaag

SEQ ID NO: 612149 - RNA, 15 nt, Escherichia coli CFT073
uaauuacgcccuuaa

SEQ ID NO: 612150 - RNA, 19 nt, Escherichia coli CFT073
uaauguuuucaguuaaugc

SEQ ID NO: 612151 - RNA, 15 nt, Escherichia coli CFT073
uaauuaauaauauaa

SEQ ID NO: 612152 - RNA, 21 nt, Escherichia coli CFT073
uaaugguauuaagccaguucu

SEQ ID NO: 612153 - RNA, 22 nt, Escherichia coli CFT073
uaauggcuaucgaaaucaaagu

SEQ ID NO: 612154 - RNA, 17 nt, Escherichia coli CFT073
uaauguuuccagcaucg

SEQ ID NO: 612155 - RNA, 23 nt, Escherichia coli CFT073
uaaugcuacuccaggaauaccac

SEQ ID NO: 612156 - RNA, 14 nt, Escherichia coli CFT073
uaauggcgcaauca

SEQ ID NO: 612157 - RNA, 18 nt, Escherichia coli CFT073
uaaugacguguaugcaua

SEQ ID NO: 612158 - RNA, 21 nt, Escherichia coli CFT073
uaaugacuuuuggaccacgga

SEQ ID NO: 612159 - RNA, 16 nt, Escherichia coli CFT073
uaaugauauguuuauu

SEQ ID NO: 612160 - RNA, 18 nt, Escherichia coli CFT073
uaaugacaaaaagaguuc

SEQ ID NO: 612161 - RNA, 18 nt, Escherichia coli CFT073
uaaucgaaaccuucagca

SEQ ID NO: 612162 - RNA, 13 nt, Escherichia coli CFT073
uaaugaaaacucg

SEQ ID NO: 612163 - RNA, 13 nt, Escherichia coli CFT073
uaaugcaacacua

SEQ ID NO: 612164 - RNA, 21 nt, Escherichia coli CFT073
uaaugcaacacuaccggucag

SEQ ID NO: 612165 - RNA, 19 nt, Escherichia coli CFT073
uaaugcaggcagcacugcu

SEQ ID NO: 612166 - RNA, 18 nt, Escherichia coli CFT073
uaaugcgacccacgcccc

SEQ ID NO: 612167 - RNA, 16 nt, Escherichia coli CFT073
uaaugccuuuuccagc

SEQ ID NO: 612168 - RNA, 23 nt, Escherichia coli CFT073
uaaugccgacauaggccagccgc

SEQ ID NO: 612169 - RNA, 22 nt, Escherichia coli CFT073
uaaugccucuccccagcggaaa

SEQ ID NO: 612170 - RNA, 22 nt, Escherichia coli CFT073
uaaugccaaucuucacaucauc

SEQ ID NO: 612171 - RNA, 18 nt, Escherichia coli CFT073
uaaugccaguucaguaaa

SEQ ID NO: 612172 - RNA, 18 nt, Escherichia coli CFT073
uaaucauggcguuuuucc

SEQ ID NO: 612173 - RNA, 21 nt, Escherichia coli CFT073
uaaucaugcagcgcagaccau

SEQ ID NO: 612174 - RNA, 12 nt, Escherichia coli CFT073
uaaucaugaacg

SEQ ID NO: 612175 - RNA, 17 nt, Escherichia coli CFT073
uaaucauuaacggccac

SEQ ID NO: 612176 - RNA, 20 nt, Escherichia coli CFT073
uaaucccggcaccaaucacc

SEQ ID NO: 612177 - RNA, 21 nt, Escherichia coli CFT073
uaaucccgugccugcuucagu

SEQ ID NO: 612178 - RNA, 15 nt, Escherichia coli CFT073
uaaucccuucccgca

SEQ ID NO: 612179 - RNA, 18 nt, Escherichia coli CFT073
uaauccgccgcuguggca

SEQ ID NO: 612180 - RNA, 13 nt, Escherichia coli CFT073
uaauccguauucc

SEQ ID NO: 612181 - RNA, 20 nt, Escherichia coli CFT073
uaauccgcuguaauugccgc

SEQ ID NO: 612182 - RNA, 14 nt, Escherichia coli CFT073
uaaucacucuuccc

SEQ ID NO: 612183 - RNA, 22 nt, Escherichia coli CFT073
uaaucaucaugcuuaaauauuu

SEQ ID NO: 612184 - RNA, 18 nt, Escherichia coli CFT073
uaaucaucccacaugaau

SEQ ID NO: 612185 - RNA, 19 nt, Escherichia coli CFT073
uaaucaucgccuucaucug

SEQ ID NO: 612186 - RNA, 13 nt, Escherichia coli CFT073
uaaucaccaguca

SEQ ID NO: 612187 - RNA, 11 nt, Escherichia coli CFT073
uaaucacgcug

SEQ ID NO: 612188 - RNA, 15 nt, Escherichia coli CFT073
uaaucaccagcaaca

SEQ ID NO: 612189 - RNA, 12 nt, Escherichia coli CFT073
uaaucaccagcg

SEQ ID NO: 612190 - RNA, 16 nt, Escherichia coli CFT073
uaauauugauauccgc

SEQ ID NO: 612191 - RNA, 18 nt, Escherichia coli CFT073
uaauauugaugcacacca

SEQ ID NO: 612192 - RNA, 13 nt, Escherichia coli CFT073
uaauauuucauuc

SEQ ID NO: 612193 - RNA, 19 nt, Escherichia coli CFT073
uaauauuuccccaauucau

SEQ ID NO: 612194 - RNA, 12 nt, Escherichia coli CFT073
uaauaucgcgca

SEQ ID NO: 612195 - RNA, 19 nt, Escherichia coli CFT073
uaauauccggugcauucau

SEQ ID NO: 612196 - RNA, 17 nt, Escherichia coli CFT073
uaauauccgguuucuga

SEQ ID NO: 612197 - RNA, 21 nt, Escherichia coli CFT073
uaauaucccaacgcaaaacca

SEQ ID NO: 612198 - RNA, 22 nt, Escherichia coli CFT073
uaauaucccaacgcaaaaccaa

SEQ ID NO: 612199 - RNA, 22 nt, Escherichia coli CFT073
uaacggcagaagcagcaggacc

SEQ ID NO: 612200 - RNA, 18 nt, Escherichia coli CFT073
uaacguaguguaaaugca

SEQ ID NO: 612201 - RNA, 22 nt, Escherichia coli CFT073
uaacggcagaucgguaauugcc

SEQ ID NO: 612202 - RNA, 20 nt, Escherichia coli CFT073
uaacggcagcaaggcuauuc

SEQ ID NO: 612203 - RNA, 22 nt, Escherichia coli CFT073
uaacgucauauacccugccaga

SEQ ID NO: 612204 - RNA, 21 nt, Escherichia coli CFT073
uaacgucgcaagacgaaaaau

SEQ ID NO: 612205 - RNA, 22 nt, Escherichia coli CFT073
uaacgucgcaagacgaaaaaug

SEQ ID NO: 612206 - RNA, 20 nt, Escherichia coli CFT073
uaacgucgccagaaaucagc

SEQ ID NO: 612207 - RNA, 20 nt, Escherichia coli CFT073
uaacgucgcgcggauuuguu

SEQ ID NO: 612208 - RNA, 21 nt, Escherichia coli CFT073
uaacgucgcgcggauuuguuc

SEQ ID NO: 612209 - RNA, 17 nt, Escherichia coli CFT073
uaacguccaguugaagc

SEQ ID NO: 612210 - RNA, 18 nt, Escherichia coli CFT073
uaauagugguaccaggau

SEQ ID NO: 612211 - RNA, 20 nt, Escherichia coli CFT073
uaauagcucugcuaauaaug

SEQ ID NO: 612212 - RNA, 21 nt, Escherichia coli CFT073
uaauagcucugcuaauaaugu

SEQ ID NO: 612213 - RNA, 16 nt, Escherichia coli CFT073
uaauagcugccagccc

SEQ ID NO: 612214 - RNA, 19 nt, Escherichia coli CFT073
uaauagcuuaacuacugcu

SEQ ID NO: 612215 - RNA, 16 nt, Escherichia coli CFT073
uacugguugauuuuaa

SEQ ID NO: 612216 - RNA, 22 nt, Escherichia coli CFT073
uacugguugauuuuaaaggauu

SEQ ID NO: 612217 - RNA, 13 nt, Escherichia coli CFT073
uacugguuuuacc

SEQ ID NO: 612218 - RNA, 14 nt, Escherichia coli CFT073
uacuguacaacaca

SEQ ID NO: 612219 - RNA, 12 nt, Escherichia coli CFT073
uacuguacaauc

SEQ ID NO: 612220 - RNA, 23 nt, Escherichia coli CFT073
uacuguauacgggcuuuuuaauu

SEQ ID NO: 612221 - RNA, 21 nt, Escherichia coli CFT073
uacuggagcuggcgaacaagu

SEQ ID NO: 612222 - RNA, 16 nt, Escherichia coli CFT073
uacuggaagaaaacau

SEQ ID NO: 612223 - RNA, 13 nt, Escherichia coli CFT073
uacuggaagugau

SEQ ID NO: 612224 - RNA, 22 nt, Escherichia coli CFT073
uacuggcauacaucaacgcgca

SEQ ID NO: 612225 - RNA, 15 nt, Escherichia coli CFT073
uacuggcuuucauuu

SEQ ID NO: 612226 - RNA, 18 nt, Escherichia coli CFT073
uacuuacacaucaugaua

SEQ ID NO: 612227 - RNA, 22 nt, Escherichia coli CFT073
uacuuaacacccccugcaaaac

SEQ ID NO: 612228 - RNA, 23 nt, Escherichia coli CFT073
uacuuccccggcagugcuuucau

SEQ ID NO: 612229 - RNA, 19 nt, Escherichia coli CFT073
uacuucacaugauaauaaa

SEQ ID NO: 612230 - RNA, 22 nt, Escherichia coli CFT073
uacuucacggcugcuaauauuu

SEQ ID NO: 612231 - RNA, 15 nt, Escherichia coli CFT073
uacuucaacacauaa

SEQ ID NO: 612232 - RNA, 15 nt, Escherichia coli CFT073
uacuuucaugcucaa

SEQ ID NO: 612233 - RNA, 16 nt, Escherichia coli CFT073
uacuuuccagccacag

SEQ ID NO: 612234 - RNA, 16 nt, Escherichia coli CFT073
uacuuuaaaauaagca

SEQ ID NO: 612235 - RNA, 12 nt, Escherichia coli CFT073
uacuucugcugc

SEQ ID NO: 612236 - RNA, 14 nt, Escherichia coli CFT073
uacugaucaucauu

SEQ ID NO: 612237 - RNA, 22 nt, Escherichia coli CFT073
uacugauugacgcguucgcuaa

SEQ ID NO: 612238 - RNA, 20 nt, Escherichia coli CFT073
uacugauuguacuguuacuc

SEQ ID NO: 612239 - RNA, 21 nt, Escherichia coli CFT073
uacugcaacguuauccguaca

SEQ ID NO: 612240 - RNA, 15 nt, Escherichia coli CFT073
uacugcaauuucauu

SEQ ID NO: 612241 - RNA, 15 nt, Escherichia coli CFT073
uacugcacucgccag

SEQ ID NO: 612242 - RNA, 13 nt, Escherichia coli CFT073
uacugcagccagc

SEQ ID NO: 612243 - RNA, 16 nt, Escherichia coli CFT073
uacugccucuuuuacc

SEQ ID NO: 612244 - RNA, 23 nt, Escherichia coli CFT073
uacugccugcggcuugucguauu

SEQ ID NO: 612245 - RNA, 12 nt, Escherichia coli CFT073
uacugccgggaa

SEQ ID NO: 612246 - RNA, 19 nt, Escherichia coli CFT073
uacugccuuucccuuaccc

SEQ ID NO: 612247 - RNA, 14 nt, Escherichia coli CFT073
uacugcgaauuucc

SEQ ID NO: 612248 - RNA, 18 nt, Escherichia coli CFT073
uacugcgaauuuccugcc

SEQ ID NO: 612249 - RNA, 20 nt, Escherichia coli CFT073
uacugcgaauuuccugccag

SEQ ID NO: 612250 - RNA, 16 nt, Escherichia coli CFT073
uacugcauggccagac

SEQ ID NO: 612251 - RNA, 17 nt, Escherichia coli CFT073
uacugcauggccagaca

SEQ ID NO: 612252 - RNA, 18 nt, Escherichia coli CFT073
uacugcauggccagacau

SEQ ID NO: 612253 - RNA, 20 nt, Escherichia coli CFT073
uacugcauggccagacauua

SEQ ID NO: 612254 - RNA, 15 nt, Escherichia coli CFT073
uacugccgaccagag

SEQ ID NO: 612255 - RNA, 16 nt, Escherichia coli CFT073
uacucuccuccagguu

SEQ ID NO: 612256 - RNA, 18 nt, Escherichia coli CFT073
uacucuaacuuauuguuu

SEQ ID NO: 612257 - RNA, 14 nt, Escherichia coli CFT073
uacucucugugcug

SEQ ID NO: 612258 - RNA, 17 nt, Escherichia coli CFT073
uacucucgugccagagc

SEQ ID NO: 612259 - RNA, 15 nt, Escherichia coli CFT073
uacucucuuucgcuu

SEQ ID NO: 612260 - RNA, 13 nt, Escherichia coli CFT073
uacugaaucccug

SEQ ID NO: 612261 - RNA, 17 nt, Escherichia coli CFT073
uacugaaucccugcgaa

SEQ ID NO: 612262 - RNA, 20 nt, Escherichia coli CFT073
uacucuuucaauuugcaggc

SEQ ID NO: 612263 - RNA, 19 nt, Escherichia coli CFT073
uacucuuugaacagccaga

SEQ ID NO: 612264 - RNA, 13 nt, Escherichia coli CFT073
uacugaaaccuga

SEQ ID NO: 612265 - RNA, 12 nt, Escherichia coli CFT073
uacuauucacca

SEQ ID NO: 612266 - RNA, 19 nt, Escherichia coli CFT073
uacuauucaccacuaccgu

SEQ ID NO: 612267 - RNA, 11 nt, Escherichia coli CFT073
uacuaaacauu

SEQ ID NO: 612268 - RNA, 18 nt, Escherichia coli CFT073
uacucaccaacgcagacg

SEQ ID NO: 612269 - RNA, 15 nt, Escherichia coli CFT073
uacguuugcagcaga

SEQ ID NO: 612270 - RNA, 15 nt, Escherichia coli CFT073
uacgugaaauccccu

SEQ ID NO: 612271 - RNA, 18 nt, Escherichia coli CFT073
uacucgccugccacaucc

SEQ ID NO: 612272 - RNA, 22 nt, Escherichia coli CFT073
uacucgcugauugccccuccgc

SEQ ID NO: 612273 - RNA, 16 nt, Escherichia coli CFT073
uacucgauaccagccc

SEQ ID NO: 612274 - RNA, 15 nt, Escherichia coli CFT073
uacucccuugccugc

SEQ ID NO: 612275 - RNA, 20 nt, Escherichia coli CFT073
uacucauaaguuucccagcu

SEQ ID NO: 612276 - RNA, 23 nt, Escherichia coli CFT073
uacucauccaucucgguuuucag

SEQ ID NO: 612277 - RNA, 14 nt, Escherichia coli CFT073
uacucauccaugca

SEQ ID NO: 612278 - RNA, 12 nt, Escherichia coli CFT073
uacucauuaaug

SEQ ID NO: 612279 - RNA, 14 nt, Escherichia coli CFT073
uacucauuauguca

SEQ ID NO: 612280 - RNA, 15 nt, Escherichia coli CFT073
uacucauuguuauca

SEQ ID NO: 612281 - RNA, 17 nt, Escherichia coli CFT073
uaccccgccagcagaau

SEQ ID NO: 612282 - RNA, 20 nt, Escherichia coli CFT073
uacccgacagauaaaucauc

SEQ ID NO: 612283 - RNA, 23 nt, Escherichia coli CFT073
uaccccagcggcaaccagcagca

SEQ ID NO: 612284 - RNA, 21 nt, Escherichia coli CFT073
uaccccagcuggcgccaggcu

SEQ ID NO: 612285 - RNA, 20 nt, Escherichia coli CFT073
uaccccauaacgacccaacu

SEQ ID NO: 612286 - RNA, 20 nt, Escherichia coli CFT073
uaccgaaaaucgccugaaca

SEQ ID NO: 612287 - RNA, 16 nt, Escherichia coli CFT073
uaccgaucaguaccag

SEQ ID NO: 612288 - RNA, 17 nt, Escherichia coli CFT073
uaccgaucgccagcagg

SEQ ID NO: 612289 - RNA, 19 nt, Escherichia coli CFT073
uaccgaucgcgguaacaga

SEQ ID NO: 612290 - RNA, 13 nt, Escherichia coli CFT073
uaccgaugaaguc

SEQ ID NO: 612291 - RNA, 16 nt, Escherichia coli CFT073
uaccgaugaagucauu

SEQ ID NO: 612292 - RNA, 17 nt, Escherichia coli CFT073
uacccgugcaucccaga

SEQ ID NO: 612293 - RNA, 22 nt, Escherichia coli CFT073
uacccucaacggaauaaacgcu

SEQ ID NO: 612294 - RNA, 13 nt, Escherichia coli CFT073
uacccugacccag

SEQ ID NO: 612295 - RNA, 17 nt, Escherichia coli CFT073
uaccgccguacgucagc

SEQ ID NO: 612296 - RNA, 17 nt, Escherichia coli CFT073
uaccgcgguucccagcg

SEQ ID NO: 612297 - RNA, 13 nt, Escherichia coli CFT073
uaccgcgguugau

SEQ ID NO: 612298 - RNA, 21 nt, Escherichia coli CFT073
uaccgcugcuggcguugucau

SEQ ID NO: 612299 - RNA, 23 nt, Escherichia coli CFT073
uaccgggcuuuuuugaucaaaau

SEQ ID NO: 612300 - RNA, 19 nt, Escherichia coli CFT073
uaccgggcgcgaggccagc

SEQ ID NO: 612301 - RNA, 20 nt, Escherichia coli CFT073
uaccgggccugaacaagcaa

SEQ ID NO: 612302 - RNA, 17 nt, Escherichia coli CFT073
uaccgcaccaccagcag

SEQ ID NO: 612303 - RNA, 20 nt, Escherichia coli CFT073
uaccgcaccaccagcagcug

SEQ ID NO: 612304 - RNA, 19 nt, Escherichia coli CFT073
uaccgcaccuuccggaaua

SEQ ID NO: 612305 - RNA, 13 nt, Escherichia coli CFT073
uaccaguaaccag

SEQ ID NO: 612306 - RNA, 19 nt, Escherichia coli CFT073
uaccaggucgaaguugauu

SEQ ID NO: 612307 - RNA, 19 nt, Escherichia coli CFT073
uaccagguuguaucaccac

SEQ ID NO: 612308 - RNA, 17 nt, Escherichia coli CFT073
uaccagcggccagacgc

SEQ ID NO: 612309 - RNA, 17 nt, Escherichia coli CFT073
uaccagcgguaaucaug

SEQ ID NO: 612310 - RNA, 17 nt, Escherichia coli CFT073
uaccagcuguuuuggua

SEQ ID NO: 612311 - RNA, 19 nt, Escherichia coli CFT073
uaccaggaucagcaaaaug

SEQ ID NO: 612312 - RNA, 19 nt, Escherichia coli CFT073
uaccaggcaauaaacaucc

SEQ ID NO: 612313 - RNA, 14 nt, Escherichia coli CFT073
uaccagccccauca

SEQ ID NO: 612314 - RNA, 20 nt, Escherichia coli CFT073
uaccagccgcgcccuaacag

SEQ ID NO: 612315 - RNA, 17 nt, Escherichia coli CFT073
uaccagcaccugcuuga

SEQ ID NO: 612316 - RNA, 19 nt, Escherichia coli CFT073
uaccagcaguacaguaccg

SEQ ID NO: 612317 - RNA, 14 nt, Escherichia coli CFT073
uaccagcgccgcca

SEQ ID NO: 612318 - RNA, 14 nt, Escherichia coli CFT073
uaccagcagcauca

SEQ ID NO: 612319 - RNA, 16 nt, Escherichia coli CFT073
uaccagauuaauuauu

SEQ ID NO: 612320 - RNA, 18 nt, Escherichia coli CFT073
uaccagauaagcagcgug

SEQ ID NO: 612321 - RNA, 23 nt, Escherichia coli CFT073
uaccagauaaucacccgccuuca

SEQ ID NO: 612322 - RNA, 23 nt, Escherichia coli CFT073
uaccagagauagcgaaccgcagg

SEQ ID NO: 612323 - RNA, 17 nt, Escherichia coli CFT073
uaccagaccgcacaccg

SEQ ID NO: 612324 - RNA, 15 nt, Escherichia coli CFT073
uacauaccagcagca

SEQ ID NO: 612325 - RNA, 14 nt, Escherichia coli CFT073
uacauaccagcagg

SEQ ID NO: 612326 - RNA, 19 nt, Escherichia coli CFT073
uacauacuguaaauaguau

SEQ ID NO: 612327 - RNA, 14 nt, Escherichia coli CFT073
uacauaacgcagcg

SEQ ID NO: 612328 - RNA, 20 nt, Escherichia coli CFT073
uacauaacagaauaucugcg

SEQ ID NO: 612329 - RNA, 20 nt, Escherichia coli CFT073
uacauagcgccucuuuauaa

SEQ ID NO: 612330 - RNA, 22 nt, Escherichia coli CFT073
uaccaccuuacuuacacaucau

SEQ ID NO: 612331 - RNA, 18 nt, Escherichia coli CFT073
uaccaccuuuuuaaucuc

SEQ ID NO: 612332 - RNA, 15 nt, Escherichia coli CFT073
uaccacgccuuguuc

SEQ ID NO: 612333 - RNA, 18 nt, Escherichia coli CFT073
uaccacggcauuuccgcc

SEQ ID NO: 612334 - RNA, 14 nt, Escherichia coli CFT073
uaccacuucauccg

SEQ ID NO: 612335 - RNA, 15 nt, Escherichia coli CFT073
uaccacuuccagcag

SEQ ID NO: 612336 - RNA, 19 nt, Escherichia coli CFT073
uaccacuuccagcagacca

SEQ ID NO: 612337 - RNA, 19 nt, Escherichia coli CFT073
uaccuuuaugcgaugaaac

SEQ ID NO: 612338 - RNA, 13 nt, Escherichia coli CFT073
uacgaaaauuugg

SEQ ID NO: 612339 - RNA, 18 nt, Escherichia coli CFT073
uacgauacaaaagcaccg

SEQ ID NO: 612340 - RNA, 13 nt, Escherichia coli CFT073
uacgaucagaguu

SEQ ID NO: 612341 - RNA, 16 nt, Escherichia coli CFT073
uacgaaucacaucguc

SEQ ID NO: 612342 - RNA, 19 nt, Escherichia coli CFT073
uacgagugcgcucuucaac

SEQ ID NO: 612343 - RNA, 16 nt, Escherichia coli CFT073
uaccuucguccauccc

SEQ ID NO: 612344 - RNA, 19 nt, Escherichia coli CFT073
uaccuuccuacaagagguc

SEQ ID NO: 612345 - RNA, 20 nt, Escherichia coli CFT073
uaccuuccuacaagagguca

SEQ ID NO: 612346 - RNA, 17 nt, Escherichia coli CFT073
uaccuucacaaaaugcc

SEQ ID NO: 612347 - RNA, 20 nt, Escherichia coli CFT073
uaccuucagacucgaaggaa

SEQ ID NO: 612348 - RNA, 21 nt, Escherichia coli CFT073
uaccuuuaaacuguuuccagu

SEQ ID NO: 612349 - RNA, 23 nt, Escherichia coli CFT073
uaccuuuaaagcggaugcgauuu

SEQ ID NO: 612350 - RNA, 14 nt, Escherichia coli CFT073
uaccuugcugcucc

SEQ ID NO: 612351 - RNA, 20 nt, Escherichia coli CFT073
uaccuugcuucuuacuauau

SEQ ID NO: 612352 - RNA, 12 nt, Escherichia coli CFT073
uaccuucuuccu

SEQ ID NO: 612353 - RNA, 14 nt, Escherichia coli CFT073
uaccggucagggcc

SEQ ID NO: 612354 - RNA, 22 nt, Escherichia coli CFT073
uaccuaacacgaucagccauac

SEQ ID NO: 612355 - RNA, 21 nt, Escherichia coli CFT073
uacgggauuuuacuucccagu

SEQ ID NO: 612356 - RNA, 15 nt, Escherichia coli CFT073
uacguagaucacuga

SEQ ID NO: 612357 - RNA, 22 nt, Escherichia coli CFT073
uacguagaucacugaaauugua

SEQ ID NO: 612358 - RNA, 19 nt, Escherichia coli CFT073
uacgggucacaaacaucau

SEQ ID NO: 612359 - RNA, 21 nt, Escherichia coli CFT073
uacgucggugcagcaugauuu

SEQ ID NO: 612360 - RNA, 20 nt, Escherichia coli CFT073
uacggcgcaucaguuucgau

SEQ ID NO: 612361 - RNA, 13 nt, Escherichia coli CFT073
uacgcauuugagc

SEQ ID NO: 612362 - RNA, 15 nt, Escherichia coli CFT073
uacgcauaaacaucu

SEQ ID NO: 612363 - RNA, 19 nt, Escherichia coli CFT073
uacgcaucgcgcaccagcg

SEQ ID NO: 612364 - RNA, 19 nt, Escherichia coli CFT073
uacgcaguaaauaaaaaau

SEQ ID NO: 612365 - RNA, 15 nt, Escherichia coli CFT073
uacgcaccacaccgu

SEQ ID NO: 612366 - RNA, 21 nt, Escherichia coli CFT073
uacgcaccggaaauugcugcc

SEQ ID NO: 612367 - RNA, 15 nt, Escherichia coli CFT073
uacgcaaugugcagc

SEQ ID NO: 612368 - RNA, 13 nt, Escherichia coli CFT073
uacggaacugcuc

SEQ ID NO: 612369 - RNA, 16 nt, Escherichia coli CFT073
uacggaaaaucucauu

SEQ ID NO: 612370 - RNA, 19 nt, Escherichia coli CFT073
uacggaccacgcacagccc

SEQ ID NO: 612371 - RNA, 20 nt, Escherichia coli CFT073
uacggaccacgcacagcccg

SEQ ID NO: 612372 - RNA, 16 nt, Escherichia coli CFT073
uacgcgcgcaggcaac

SEQ ID NO: 612373 - RNA, 17 nt, Escherichia coli CFT073
uacgcggaaacuuaauc

SEQ ID NO: 612374 - RNA, 18 nt, Escherichia coli CFT073
uacgcggacacuuuccug

SEQ ID NO: 612375 - RNA, 19 nt, Escherichia coli CFT073
uaguacauuguuuuccaga

SEQ ID NO: 612376 - RNA, 19 nt, Escherichia coli CFT073
uaguacccucugcaccaga

SEQ ID NO: 612377 - RNA, 15 nt, Escherichia coli CFT073
uaguaauguuuucuu

SEQ ID NO: 612378 - RNA, 13 nt, Escherichia coli CFT073
uaguaagcccagg

SEQ ID NO: 612379 - RNA, 14 nt, Escherichia coli CFT073
uaguaagcccaggg

SEQ ID NO: 612380 - RNA, 22 nt, Escherichia coli CFT073
uaguaaaaggcaccauaacuag

SEQ ID NO: 612381 - RNA, 19 nt, Escherichia coli CFT073
uaguaaagcuaccggcaaa

SEQ ID NO: 612382 - RNA, 21 nt, Escherichia coli CFT073
uagguuccggcaaucaacaga

SEQ ID NO: 612383 - RNA, 17 nt, Escherichia coli CFT073
uaggucggauaagacgc

SEQ ID NO: 612384 - RNA, 16 nt, Escherichia coli CFT073
uagguguuaauggaau

SEQ ID NO: 612385 - RNA, 23 nt, Escherichia coli CFT073
uaggucuuugacgucgaaacuga

SEQ ID NO: 612386 - RNA, 20 nt, Escherichia coli CFT073
uaguaucgauugaugauugc

SEQ ID NO: 612387 - RNA, 18 nt, Escherichia coli CFT073
uaguauuuuauggcagaa

SEQ ID NO: 612388 - RNA, 19 nt, Escherichia coli CFT073
uaguauuuuauggcagaau

SEQ ID NO: 612389 - RNA, 14 nt, Escherichia coli CFT073
uaguagagauccug

SEQ ID NO: 612390 - RNA, 20 nt, Escherichia coli CFT073
uaguacgcgggaauagcuca

SEQ ID NO: 612391 - RNA, 18 nt, Escherichia coli CFT073
uaguacucguagcccugg

SEQ ID NO: 612392 - RNA, 19 nt, Escherichia coli CFT073
uaguacuggaagaaaacau

SEQ ID NO: 612393 - RNA, 21 nt, Escherichia coli CFT073
uaguaggagaagcauccugca

SEQ ID NO: 612394 - RNA, 16 nt, Escherichia coli CFT073
uaguagguuguaccca

SEQ ID NO: 612395 - RNA, 21 nt, Escherichia coli CFT073
uaguaguucauccccucuucc

SEQ ID NO: 612396 - RNA, 14 nt, Escherichia coli CFT073
uagucgccagcucu

SEQ ID NO: 612397 - RNA, 22 nt, Escherichia coli CFT073
uagugauaugggcaaacaaaaa

SEQ ID NO: 612398 - RNA, 19 nt, Escherichia coli CFT073
uagugaucagccucucucu

SEQ ID NO: 612399 - RNA, 17 nt, Escherichia coli CFT073
uagugaugcaucauaug

SEQ ID NO: 612400 - RNA, 15 nt, Escherichia coli CFT073
uagucccaaacagca

SEQ ID NO: 612401 - RNA, 18 nt, Escherichia coli CFT073
uaguccggcaccagcgcu

SEQ ID NO: 612402 - RNA, 16 nt, Escherichia coli CFT073
uagucaguauuuuccc

SEQ ID NO: 612403 - RNA, 15 nt, Escherichia coli CFT073
uagucaugaugacgc

SEQ ID NO: 612404 - RNA, 13 nt, Escherichia coli CFT073
uagucauuuuuug

SEQ ID NO: 612405 - RNA, 23 nt, Escherichia coli CFT073
uauaaaacgagcgauccaacuaa

SEQ ID NO: 612406 - RNA, 19 nt, Escherichia coli CFT073
uaguugcugucgacaaagc

SEQ ID NO: 612407 - RNA, 16 nt, Escherichia coli CFT073
uagugcgcaguugccg

SEQ ID NO: 612408 - RNA, 12 nt, Escherichia coli CFT073
uagugcccggca

SEQ ID NO: 612409 - RNA, 13 nt, Escherichia coli CFT073
uaguucauccccu

SEQ ID NO: 612410 - RNA, 19 nt, Escherichia coli CFT073
uaguucauccccucuucca

SEQ ID NO: 612411 - RNA, 22 nt, Escherichia coli CFT073
uaguucauccccucuuccauuu

SEQ ID NO: 612412 - RNA, 18 nt, Escherichia coli CFT073
uauaacuauaugacucau

SEQ ID NO: 612413 - RNA, 22 nt, Escherichia coli CFT073
uauaacuauaugacucauaaaa

SEQ ID NO: 612414 - RNA, 21 nt, Escherichia coli CFT073
uauaacgggcuucccaacuga

SEQ ID NO: 612415 - RNA, 11 nt, Escherichia coli CFT073
uauaaccauuu

SEQ ID NO: 612416 - RNA, 20 nt, Escherichia coli CFT073
uauaaccggcaacagaacgc

SEQ ID NO: 612417 - RNA, 13 nt, Escherichia coli CFT073
uauaacaugguga

SEQ ID NO: 612418 - RNA, 23 nt, Escherichia coli CFT073
uauaaagcagaaugguuuuguca

SEQ ID NO: 612419 - RNA, 22 nt, Escherichia coli CFT073
uauaaagcccaucguugaaaaa

SEQ ID NO: 612420 - RNA, 17 nt, Escherichia coli CFT073
uauaacuuuaguaucac

SEQ ID NO: 612421 - RNA, 17 nt, Escherichia coli CFT073
uauaaguucaaguaaaa

SEQ ID NO: 612422 - RNA, 18 nt, Escherichia coli CFT073
uauaaguucaaguaaaac

SEQ ID NO: 612423 - RNA, 19 nt, Escherichia coli CFT073
uauaaguucaaguaaaaca

SEQ ID NO: 612424 - RNA, 13 nt, Escherichia coli CFT073
uauaaggcaucag

SEQ ID NO: 612425 - RNA, 17 nt, Escherichia coli CFT073
uauaaguacuaaauaau

SEQ ID NO: 612426 - RNA, 21 nt, Escherichia coli CFT073
uagcuauaaaugaacugggca

SEQ ID NO: 612427 - RNA, 15 nt, Escherichia coli CFT073
uagcuauauuuugcc

SEQ ID NO: 612428 - RNA, 19 nt, Escherichia coli CFT073
uagcuguggugcaauccac

SEQ ID NO: 612429 - RNA, 15 nt, Escherichia coli CFT073
uagcuucagguaaua

SEQ ID NO: 612430 - RNA, 20 nt, Escherichia coli CFT073
uagcuuaucaaucucugcaa

SEQ ID NO: 612431 - RNA, 23 nt, Escherichia coli CFT073
uagcuuaucgcaggcuuccuggc

SEQ ID NO: 612432 - RNA, 17 nt, Escherichia coli CFT073
uaggccaucggcagcau

SEQ ID NO: 612433 - RNA, 14 nt, Escherichia coli CFT073
uaggcaucagcaau

SEQ ID NO: 612434 - RNA, 16 nt, Escherichia coli CFT073
uaggauuauuuauuca

SEQ ID NO: 612435 - RNA, 17 nt, Escherichia coli CFT073
uaggcaaaaaaaugccc

SEQ ID NO: 612436 - RNA, 18 nt, Escherichia coli CFT073
uaggcaccgccaaagaua

SEQ ID NO: 612437 - RNA, 15 nt, Escherichia coli CFT073
uaggcaccugaaucu

SEQ ID NO: 612438 - RNA, 19 nt, Escherichia coli CFT073
uagcccuuuguaggccaga

SEQ ID NO: 612439 - RNA, 18 nt, Escherichia coli CFT073
uagcccuucaugcacucg

SEQ ID NO: 612440 - RNA, 22 nt, Escherichia coli CFT073
uagcccuaacagggcgcuguug

SEQ ID NO: 612441 - RNA, 13 nt, Escherichia coli CFT073
uagcgcaucacuu

SEQ ID NO: 612442 - RNA, 14 nt, Escherichia coli CFT073
uagcgcagcgauuc

SEQ ID NO: 612443 - RNA, 23 nt, Escherichia coli CFT073
uagcgcagcagauaaaagaccac

SEQ ID NO: 612444 - RNA, 22 nt, Escherichia coli CFT073
uagcgucaacuuuagcaaugug

SEQ ID NO: 612445 - RNA, 14 nt, Escherichia coli CFT073
uagcguaaagccag

SEQ ID NO: 612446 - RNA, 18 nt, Escherichia coli CFT073
uagcguaacuuaucaauu

SEQ ID NO: 612447 - RNA, 16 nt, Escherichia coli CFT073
uagcgugacaccagca

SEQ ID NO: 612448 - RNA, 18 nt, Escherichia coli CFT073
uagcguccggcugccagc

SEQ ID NO: 612449 - RNA, 17 nt, Escherichia coli CFT073
uagcgucgccagcaguu

SEQ ID NO: 612450 - RNA, 13 nt, Escherichia coli CFT073
uagcggagcaauu

SEQ ID NO: 612451 - RNA, 21 nt, Escherichia coli CFT073
uagcggacucaccgagcagca

SEQ ID NO: 612452 - RNA, 16 nt, Escherichia coli CFT073
uagcggcaagagaauu

SEQ ID NO: 612453 - RNA, 21 nt, Escherichia coli CFT073
uagccccggacggcaauuccg

SEQ ID NO: 612454 - RNA, 12 nt, Escherichia coli CFT073
uagccccagucu

SEQ ID NO: 612455 - RNA, 22 nt, Escherichia coli CFT073
uagccccagucuuccugcggca

SEQ ID NO: 612456 - RNA, 13 nt, Escherichia coli CFT073
uagcccaucagcu

SEQ ID NO: 612457 - RNA, 20 nt, Escherichia coli CFT073
uagcaugaugauaucacugg

SEQ ID NO: 612458 - RNA, 18 nt, Escherichia coli CFT073
uagcaugaacauugcugc

SEQ ID NO: 612459 - RNA, 21 nt, Escherichia coli CFT073
uagcagguaaaacggcagaau

SEQ ID NO: 612460 - RNA, 23 nt, Escherichia coli CFT073
uagcaaagaacguaaucaacgcc

SEQ ID NO: 612461 - RNA, 14 nt, Escherichia coli CFT073
uagcaaacaaaaag

SEQ ID NO: 612462 - RNA, 20 nt, Escherichia coli CFT073
uagcaaaguaguaaugauca

SEQ ID NO: 612463 - RNA, 20 nt, Escherichia coli CFT073
uagcaaauuaucccccagca

SEQ ID NO: 612464 - RNA, 20 nt, Escherichia coli CFT073
uagcagagcguuuaauaaaa

SEQ ID NO: 612465 - RNA, 23 nt, Escherichia coli CFT073
uagauucgggcuaauuuccugga

SEQ ID NO: 612466 - RNA, 23 nt, Escherichia coli CFT073
uagauuucguugugucgccagca

SEQ ID NO: 612467 - RNA, 13 nt, Escherichia coli CFT073
uagauuucucuaa

SEQ ID NO: 612468 - RNA, 11 nt, Escherichia coli CFT073
uagauuuugca

SEQ ID NO: 612469 - RNA, 17 nt, Escherichia coli CFT073
uagaugacacucacgca

SEQ ID NO: 612470 - RNA, 22 nt, Escherichia coli CFT073
uagauggcggaaauaacgcuga

SEQ ID NO: 612471 - RNA, 13 nt, Escherichia coli CFT073
uagaaaaauucaa

SEQ ID NO: 612472 - RNA, 16 nt, Escherichia coli CFT073
uaucuuuggcauuuau

SEQ ID NO: 612473 - RNA, 20 nt, Escherichia coli CFT073
uaugaauagcggaaaucucc

SEQ ID NO: 612474 - RNA, 22 nt, Escherichia coli CFT073
uaugaauagcggaaaucuccag

SEQ ID NO: 612475 - RNA, 13 nt, Escherichia coli CFT073
uaucuuuccagcc

SEQ ID NO: 612476 - RNA, 20 nt, Escherichia coli CFT073
uaucuuugauugaagaaauc

SEQ ID NO: 612477 - RNA, 13 nt, Escherichia coli CFT073
uaucuuucaucau

SEQ ID NO: 612478 - RNA, 14 nt, Escherichia coli CFT073
uaucuuucaucauu

SEQ ID NO: 612479 - RNA, 17 nt, Escherichia coli CFT073
uaucuuuaucugccagc

SEQ ID NO: 612480 - RNA, 22 nt, Escherichia coli CFT073
uaucugcuaauauuuugugauu

SEQ ID NO: 612481 - RNA, 20 nt, Escherichia coli CFT073
uaucugccagcacugccagc

SEQ ID NO: 612482 - RNA, 15 nt, Escherichia coli CFT073
uaucugccagccagu

SEQ ID NO: 612483 - RNA, 17 nt, Escherichia coli CFT073
uaucugccagccaguca

SEQ ID NO: 612484 - RNA, 10 nt, Escherichia coli CFT073
uaucuucuuu

SEQ ID NO: 612485 - RNA, 18 nt, Escherichia coli CFT073
uaucuggccuacaaaggg

SEQ ID NO: 612486 - RNA, 11 nt, Escherichia coli CFT073
uaucuggcaag

SEQ ID NO: 612487 - RNA, 15 nt, Escherichia coli CFT073
uaucuggccuacaaa

SEQ ID NO: 612488 - RNA, 17 nt, Escherichia coli CFT073
uaugauguauauuucug

SEQ ID NO: 612489 - RNA, 18 nt, Escherichia coli CFT073
uaugauguauauuucugu

SEQ ID NO: 612490 - RNA, 16 nt, Escherichia coli CFT073
uaugaucugcacagca

SEQ ID NO: 612491 - RNA, 18 nt, Escherichia coli CFT073
uaugaugagaacuccugg

SEQ ID NO: 612492 - RNA, 13 nt, Escherichia coli CFT073
uaugcagcggaau

SEQ ID NO: 612493 - RNA, 20 nt, Escherichia coli CFT073
uaugcaucgguggcgauacu

SEQ ID NO: 612494 - RNA, 22 nt, Escherichia coli CFT073
uaugcauaaaccgggucagccc

SEQ ID NO: 612495 - RNA, 18 nt, Escherichia coli CFT073
uaugcagagcauccagca

SEQ ID NO: 612496 - RNA, 16 nt, Escherichia coli CFT073
uaugcaaaugagaauc

SEQ ID NO: 612497 - RNA, 12 nt, Escherichia coli CFT073
uaugcaaaccau

SEQ ID NO: 612498 - RNA, 22 nt, Escherichia coli CFT073
uaugaccguuuuccccaacgau

SEQ ID NO: 612499 - RNA, 17 nt, Escherichia coli CFT073
uaugaguucgcggcgca

SEQ ID NO: 612500 - RNA, 23 nt, Escherichia coli CFT073
uaugagagccguuaaaacgacuc

SEQ ID NO: 612501 - RNA, 16 nt, Escherichia coli CFT073
uaugacuuaaaucucu

SEQ ID NO: 612502 - RNA, 15 nt, Escherichia coli CFT073
uaugcuuguuugccc

SEQ ID NO: 612503 - RNA, 14 nt, Escherichia coli CFT073
uauggaucaccauc

SEQ ID NO: 612504 - RNA, 12 nt, Escherichia coli CFT073
uauggagaaaac

SEQ ID NO: 612505 - RNA, 15 nt, Escherichia coli CFT073
uauggagcaggaaua

SEQ ID NO: 612506 - RNA, 19 nt, Escherichia coli CFT073
uaugcccucagccuucugu

SEQ ID NO: 612507 - RNA, 16 nt, Escherichia coli CFT073
uaugccgaucaucauc

SEQ ID NO: 612508 - RNA, 17 nt, Escherichia coli CFT073
uaugcgcuaucgccugc

SEQ ID NO: 612509 - RNA, 21 nt, Escherichia coli CFT073
uaugcggugccauuaaaccaa

SEQ ID NO: 612510 - RNA, 22 nt, Escherichia coli CFT073
uaugucauugccugauguugau

SEQ ID NO: 612511 - RNA, 13 nt, Escherichia coli CFT073
uaugucaccagca

SEQ ID NO: 612512 - RNA, 18 nt, Escherichia coli CFT073
uauguauacaaaaucugu

SEQ ID NO: 612513 - RNA, 22 nt, Escherichia coli CFT073
uaugguguaagaaugcucccca

SEQ ID NO: 612514 - RNA, 22 nt, Escherichia coli CFT073
uauguucaggauauuuauauuu

SEQ ID NO: 612515 - RNA, 23 nt, Escherichia coli CFT073
uauguuauagaguacuugcuaca

SEQ ID NO: 612516 - RNA, 19 nt, Escherichia coli CFT073
uaugugacuggaaaucaaa

SEQ ID NO: 612517 - RNA, 14 nt, Escherichia coli CFT073
uaugugcaauuuca

SEQ ID NO: 612518 - RNA, 11 nt, Escherichia coli CFT073
uauguuuuguc

SEQ ID NO: 612519 - RNA, 23 nt, Escherichia coli CFT073
uauguuuuugaauuaacuccagu

SEQ ID NO: 612520 - RNA, 15 nt, Escherichia coli CFT073
uauuaaaaauccgcu

SEQ ID NO: 612521 - RNA, 19 nt, Escherichia coli CFT073
uauguucccuuaauuaucu

SEQ ID NO: 612522 - RNA, 13 nt, Escherichia coli CFT073
uauguuuaauguu

SEQ ID NO: 612523 - RNA, 15 nt, Escherichia coli CFT073
uauguuuauuagccc

SEQ ID NO: 612524 - RNA, 14 nt, Escherichia coli CFT073
uaucguuuuucauu

SEQ ID NO: 612525 - RNA, 15 nt, Escherichia coli CFT073
uaucuauuacagcgc

SEQ ID NO: 612526 - RNA, 13 nt, Escherichia coli CFT073
uaucucaaaaauu

SEQ ID NO: 612527 - RNA, 12 nt, Escherichia coli CFT073
uaucuccauccg

SEQ ID NO: 612528 - RNA, 20 nt, Escherichia coli CFT073
uaucguauccgguuuuccag

SEQ ID NO: 612529 - RNA, 21 nt, Escherichia coli CFT073
uaucgugcuggauuuguguca

SEQ ID NO: 612530 - RNA, 16 nt, Escherichia coli CFT073
uaucguuaaagagauc

SEQ ID NO: 612531 - RNA, 13 nt, Escherichia coli CFT073
uaucguuauuaaa

SEQ ID NO: 612532 - RNA, 15 nt, Escherichia coli CFT073
uaucguugugguuaa

SEQ ID NO: 612533 - RNA, 23 nt, Escherichia coli CFT073
uauccugaacuuguuuacaaaua

SEQ ID NO: 612534 - RNA, 21 nt, Escherichia coli CFT073
uauccugcccgcuccagcuau

SEQ ID NO: 612535 - RNA, 15 nt, Escherichia coli CFT073
uauccugccggugau

SEQ ID NO: 612536 - RNA, 22 nt, Escherichia coli CFT073
uauccugcgguuugucaucauu

SEQ ID NO: 612537 - RNA, 20 nt, Escherichia coli CFT073
uauccuguggacgcagcuca

SEQ ID NO: 612538 - RNA, 15 nt, Escherichia coli CFT073
uaucgcccugccagc

SEQ ID NO: 612539 - RNA, 17 nt, Escherichia coli CFT073
uaucgcccugccagcga

SEQ ID NO: 612540 - RNA, 14 nt, Escherichia coli CFT073
uaucgcccuuacca

SEQ ID NO: 612541 - RNA, 21 nt, Escherichia coli CFT073
uaucgcgacgaauagguaacg

SEQ ID NO: 612542 - RNA, 15 nt, Escherichia coli CFT073
uaucgcgcagaaauu

SEQ ID NO: 612543 - RNA, 20 nt, Escherichia coli CFT073
uaucggagauaaccacguuc

SEQ ID NO: 612544 - RNA, 17 nt, Escherichia coli CFT073
uaucggcgaagugcaga

SEQ ID NO: 612545 - RNA, 21 nt, Escherichia coli CFT073
uaucgcugauauacccuucau

SEQ ID NO: 612546 - RNA, 19 nt, Escherichia coli CFT073
uaucgcucaauauccugac

SEQ ID NO: 612547 - RNA, 14 nt, Escherichia coli CFT073
uaucagcccaaaaa

SEQ ID NO: 612548 - RNA, 17 nt, Escherichia coli CFT073
uaucagcagcacaaacg

SEQ ID NO: 612549 - RNA, 16 nt, Escherichia coli CFT073
uaucagcaauaaaaaa

SEQ ID NO: 612550 - RNA, 22 nt, Escherichia coli CFT073
uaucagcaauaaaaaaaugagu

SEQ ID NO: 612551 - RNA, 23 nt, Escherichia coli CFT073
uaucagacuaaaccgcacuggca

SEQ ID NO: 612552 - RNA, 17 nt, Escherichia coli CFT073
uaucagaagauuaagag

SEQ ID NO: 612553 - RNA, 19 nt, Escherichia coli CFT073
uaucagacaaucugugugg

SEQ ID NO: 612554 - RNA, 18 nt, Escherichia coli CFT073
uauccaacugugaauccu

SEQ ID NO: 612555 - RNA, 20 nt, Escherichia coli CFT073
uauccauuugugacauuaac

SEQ ID NO: 612556 - RNA, 18 nt, Escherichia coli CFT073
uauccacccgcagccauc

SEQ ID NO: 612557 - RNA, 15 nt, Escherichia coli CFT073
uauccaucagacuuu

SEQ ID NO: 612558 - RNA, 23 nt, Escherichia coli CFT073
uauccaucagccaugguuuaauc

SEQ ID NO: 612559 - RNA, 19 nt, Escherichia coli CFT073
uauccuaauccuggccaua

SEQ ID NO: 612560 - RNA, 13 nt, Escherichia coli CFT073
uaucccaccagcg

SEQ ID NO: 612561 - RNA, 16 nt, Escherichia coli CFT073
uauccggaaacuggau

SEQ ID NO: 612562 - RNA, 23 nt, Escherichia coli CFT073
uauccggccuacgggaacagugc

SEQ ID NO: 612563 - RNA, 20 nt, Escherichia coli CFT073
uauccggcugaccuggaagu

SEQ ID NO: 612564 - RNA, 14 nt, Escherichia coli CFT073
uauauaaaccuucu

SEQ ID NO: 612565 - RNA, 23 nt, Escherichia coli CFT073
uauagguuccccauccuguauuu

SEQ ID NO: 612566 - RNA, 18 nt, Escherichia coli CFT073
uauauuuauucaucagcg

SEQ ID NO: 612567 - RNA, 19 nt, Escherichia coli CFT073
uauauuucauuuuauucga

SEQ ID NO: 612568 - RNA, 15 nt, Escherichia coli CFT073
uaucaaaaccuaacu

SEQ ID NO: 612569 - RNA, 18 nt, Escherichia coli CFT073
uaucacgcaucugcugua

SEQ ID NO: 612570 - RNA, 22 nt, Escherichia coli CFT073
uaucacgcgcaggcaaauuauu

SEQ ID NO: 612571 - RNA, 14 nt, Escherichia coli CFT073
uaucacuauaaaua

SEQ ID NO: 612572 - RNA, 21 nt, Escherichia coli CFT073
uaucacucggggcuuuucucu

SEQ ID NO: 612573 - RNA, 16 nt, Escherichia coli CFT073
uaucacuuuuauauaa

SEQ ID NO: 612574 - RNA, 19 nt, Escherichia coli CFT073
uaucacuuguaguuacauu

SEQ ID NO: 612575 - RNA, 20 nt, Escherichia coli CFT073
uaucaacggacgugaaauca

SEQ ID NO: 612576 - RNA, 16 nt, Escherichia coli CFT073
uaucaaaggucuuaau

SEQ ID NO: 612577 - RNA, 13 nt, Escherichia coli CFT073
uaucaaacagaaa

SEQ ID NO: 612578 - RNA, 17 nt, Escherichia coli CFT073
uaucaaacagaaaaacg

SEQ ID NO: 612579 - RNA, 21 nt, Escherichia coli CFT073
uaucaacaauaaacugcgacc

SEQ ID NO: 612580 - RNA, 21 nt, Escherichia coli CFT073
ucagcacuggcggcagcaggu

SEQ ID NO: 612581 - RNA, 18 nt, Escherichia coli CFT073
ucagcagauaccaacccu

SEQ ID NO: 612582 - RNA, 16 nt, Escherichia coli CFT073
ucagcagauggcagac

SEQ ID NO: 612583 - RNA, 17 nt, Escherichia coli CFT073
ucagcagcagacagccu

SEQ ID NO: 612584 - RNA, 14 nt, Escherichia coli CFT073
ucagcauacuccag

SEQ ID NO: 612585 - RNA, 16 nt, Escherichia coli CFT073
ucagcauacuccagcc

SEQ ID NO: 612586 - RNA, 14 nt, Escherichia coli CFT073
ucagcaguucagca

SEQ ID NO: 612587 - RNA, 20 nt, Escherichia coli CFT073
ucagcaguucagucagcagu

SEQ ID NO: 612588 - RNA, 14 nt, Escherichia coli CFT073
ucagcaguucugcc

SEQ ID NO: 612589 - RNA, 16 nt, Escherichia coli CFT073
ucagcaguucugccag

SEQ ID NO: 612590 - RNA, 12 nt, Escherichia coli CFT073
ucagcaggcugc

SEQ ID NO: 612591 - RNA, 18 nt, Escherichia coli CFT073
ucagcaacagguaaccca

SEQ ID NO: 612592 - RNA, 17 nt, Escherichia coli CFT073
ucagcaaggcuuuccag

SEQ ID NO: 612593 - RNA, 14 nt, Escherichia coli CFT073
ucagcaauacgcuu

SEQ ID NO: 612594 - RNA, 12 nt, Escherichia coli CFT073
ucagcaauuucu

SEQ ID NO: 612595 - RNA, 15 nt, Escherichia coli CFT073
ucagcaauuucuccg

SEQ ID NO: 612596 - RNA, 14 nt, Escherichia coli CFT073
ucagcacacauaac

SEQ ID NO: 612597 - RNA, 19 nt, Escherichia coli CFT073
ucagcacgacauaagcgca

SEQ ID NO: 612598 - RNA, 16 nt, Escherichia coli CFT073
ucagcacgccacucac

SEQ ID NO: 612599 - RNA, 18 nt, Escherichia coli CFT073
ucagcacguuaaguucau

SEQ ID NO: 612600 - RNA, 19 nt, Escherichia coli CFT073
ucagcacguuaaguucauu

SEQ ID NO: 612601 - RNA, 21 nt, Escherichia coli CFT073
ucagcacuacugccagauucu

SEQ ID NO: 612602 - RNA, 16 nt, Escherichia coli CFT073
ucagccaaauccagcg

SEQ ID NO: 612603 - RNA, 13 nt, Escherichia coli CFT073
ucagccaaucaca

SEQ ID NO: 612604 - RNA, 20 nt, Escherichia coli CFT073
ucagcauauuuggcgcuggc

SEQ ID NO: 612605 - RNA, 17 nt, Escherichia coli CFT073
ucagcaucaaugaccug

SEQ ID NO: 612606 - RNA, 19 nt, Escherichia coli CFT073
ucagcauccauaucgccau

SEQ ID NO: 612607 - RNA, 22 nt, Escherichia coli CFT073
ucagcaucccaccugaaauggu

SEQ ID NO: 612608 - RNA, 15 nt, Escherichia coli CFT073
ucagcaugucuugcc

SEQ ID NO: 612609 - RNA, 19 nt, Escherichia coli CFT073
ucagcaugucuugccuccc

SEQ ID NO: 612610 - RNA, 17 nt, Escherichia coli CFT073
ucagcaugacaaaaaag

SEQ ID NO: 612611 - RNA, 14 nt, Escherichia coli CFT073
ucagccauuuugca

SEQ ID NO: 612612 - RNA, 19 nt, Escherichia coli CFT073
ucagcccaaagagcaagaa

SEQ ID NO: 612613 - RNA, 19 nt, Escherichia coli CFT073
ucagccaggguucccggcc

SEQ ID NO: 612614 - RNA, 15 nt, Escherichia coli CFT073
ucagccuuaaucuuc

SEQ ID NO: 612615 - RNA, 17 nt, Escherichia coli CFT073
ucagccuuaaucuucac

SEQ ID NO: 612616 - RNA, 15 nt, Escherichia coli CFT073
ucagccuucuugcug

SEQ ID NO: 612617 - RNA, 16 nt, Escherichia coli CFT073
ucagcgaacaccagca

SEQ ID NO: 612618 - RNA, 18 nt, Escherichia coli CFT073
ucagccguauccaggccc

SEQ ID NO: 612619 - RNA, 14 nt, Escherichia coli CFT073
ucagccgcaaacuu

SEQ ID NO: 612620 - RNA, 22 nt, Escherichia coli CFT073
ucagccgcccgcgauaaaaauc

SEQ ID NO: 612621 - RNA, 16 nt, Escherichia coli CFT073
ucagcccuucuuuaug

SEQ ID NO: 612622 - RNA, 15 nt, Escherichia coli CFT073
ucagcccugcccaga

SEQ ID NO: 612623 - RNA, 17 nt, Escherichia coli CFT073
ucagcccuuuuggcaca

SEQ ID NO: 612624 - RNA, 15 nt, Escherichia coli CFT073
ucagccgaaacacac

SEQ ID NO: 612625 - RNA, 22 nt, Escherichia coli CFT073
ucagacuggcguuaggcacauc

SEQ ID NO: 612626 - RNA, 17 nt, Escherichia coli CFT073
ucagagaaucaugucag

SEQ ID NO: 612627 - RNA, 17 nt, Escherichia coli CFT073
ucagacuuugcgccauc

SEQ ID NO: 612628 - RNA, 13 nt, Escherichia coli CFT073
ucagagagccagc

SEQ ID NO: 612629 - RNA, 21 nt, Escherichia coli CFT073
ucagagccugccaauggcagg

SEQ ID NO: 612630 - RNA, 23 nt, Escherichia coli CFT073
ucagagcggccuucuucuuucag

SEQ ID NO: 612631 - RNA, 18 nt, Escherichia coli CFT073
ucagauaccaauuuauuu

SEQ ID NO: 612632 - RNA, 22 nt, Escherichia coli CFT073
ucagauaugcgcugucauucau

SEQ ID NO: 612633 - RNA, 16 nt, Escherichia coli CFT073
ucagaguugcaccagc

SEQ ID NO: 612634 - RNA, 17 nt, Escherichia coli CFT073
ucagaguugcaccagca

SEQ ID NO: 612635 - RNA, 17 nt, Escherichia coli CFT073
ucagaguuguaccaccc

SEQ ID NO: 612636 - RNA, 18 nt, Escherichia coli CFT073
ucagauaauagguaaaca

SEQ ID NO: 612637 - RNA, 19 nt, Escherichia coli CFT073
ucagcaaauaauucaucuu

SEQ ID NO: 612638 - RNA, 22 nt, Escherichia coli CFT073
ucagcaaauaauucaucuuuca

SEQ ID NO: 612639 - RNA, 13 nt, Escherichia coli CFT073
ucagauucaaauc

SEQ ID NO: 612640 - RNA, 21 nt, Escherichia coli CFT073
ucagauucagcgucgccagca

SEQ ID NO: 612641 - RNA, 17 nt, Escherichia coli CFT073
ucagauugaugcgagua

SEQ ID NO: 612642 - RNA, 20 nt, Escherichia coli CFT073
ucagauugcaccacaucggu

SEQ ID NO: 612643 - RNA, 22 nt, Escherichia coli CFT073
ucagauuguagugauccugcau

SEQ ID NO: 612644 - RNA, 17 nt, Escherichia coli CFT073
ucagaucagccacuucc

SEQ ID NO: 612645 - RNA, 16 nt, Escherichia coli CFT073
ucagauccagugcuuu

SEQ ID NO: 612646 - RNA, 21 nt, Escherichia coli CFT073
ucagaucagccacuuccugcu

SEQ ID NO: 612647 - RNA, 22 nt, Escherichia coli CFT073
ucagaucgccccggucaucaaa

SEQ ID NO: 612648 - RNA, 18 nt, Escherichia coli CFT073
ucagaucgcgaccgccuu

SEQ ID NO: 612649 - RNA, 19 nt, Escherichia coli CFT073
ucagaucgguuuuuuucga

SEQ ID NO: 612650 - RNA, 17 nt, Escherichia coli CFT073
ucagaucguucgcacca

SEQ ID NO: 612651 - RNA, 16 nt, Escherichia coli CFT073
ucagaucguugaccug

SEQ ID NO: 612652 - RNA, 22 nt, Escherichia coli CFT073
ucagaucguucgcaccaaaucc

SEQ ID NO: 612653 - RNA, 15 nt, Escherichia coli CFT073
ucagaaguugcaccc

SEQ ID NO: 612654 - RNA, 20 nt, Escherichia coli CFT073
ucagaaagccgccgacaugu

SEQ ID NO: 612655 - RNA, 18 nt, Escherichia coli CFT073
ucagaaagcgccagcaag

SEQ ID NO: 612656 - RNA, 19 nt, Escherichia coli CFT073
ucagaaaggcguuguccuu

SEQ ID NO: 612657 - RNA, 17 nt, Escherichia coli CFT073
ucagaaaguaauaugug

SEQ ID NO: 612658 - RNA, 14 nt, Escherichia coli CFT073
ucagaaacaaauac

SEQ ID NO: 612659 - RNA, 14 nt, Escherichia coli CFT073
ucacuuuuuuuccg

SEQ ID NO: 612660 - RNA, 13 nt, Escherichia coli CFT073
ucagacguucuuc

SEQ ID NO: 612661 - RNA, 22 nt, Escherichia coli CFT073
ucagacggccccgcgccagcgg

SEQ ID NO: 612662 - RNA, 13 nt, Escherichia coli CFT073
ucagacugagauc

SEQ ID NO: 612663 - RNA, 17 nt, Escherichia coli CFT073
ucagacucgaaggaaua

SEQ ID NO: 612664 - RNA, 12 nt, Escherichia coli CFT073
ucagaccuccgu

SEQ ID NO: 612665 - RNA, 18 nt, Escherichia coli CFT073
ucagaccggcaaccagca

SEQ ID NO: 612666 - RNA, 20 nt, Escherichia coli CFT073
ucagaccgugcgagaacgac

SEQ ID NO: 612667 - RNA, 19 nt, Escherichia coli CFT073
ucagacgacugucuuccug

SEQ ID NO: 612668 - RNA, 21 nt, Escherichia coli CFT073
ucagacgcucuuucaccagug

SEQ ID NO: 612669 - RNA, 19 nt, Escherichia coli CFT073
ucagacacgccgccagacc

SEQ ID NO: 612670 - RNA, 21 nt, Escherichia coli CFT073
ucagacaccggcgcacaaccg

SEQ ID NO: 612671 - RNA, 20 nt, Escherichia coli CFT073
ucagacaggcgaaaccagca

SEQ ID NO: 612672 - RNA, 23 nt, Escherichia coli CFT073
ucagacaggcgaaaccagcagcc

SEQ ID NO: 612673 - RNA, 18 nt, Escherichia coli CFT073
ucacucggggcuuuucuc

SEQ ID NO: 612674 - RNA, 22 nt, Escherichia coli CFT073
ucacucgugauaaccuguuaau

SEQ ID NO: 612675 - RNA, 12 nt, Escherichia coli CFT073
ucacucaguguu

SEQ ID NO: 612676 - RNA, 13 nt, Escherichia coli CFT073
ucacuccagucca

SEQ ID NO: 612677 - RNA, 13 nt, Escherichia coli CFT073
ucacucaucagcu

SEQ ID NO: 612678 - RNA, 17 nt, Escherichia coli CFT073
ucacucaucagcuuacg

SEQ ID NO: 612679 - RNA, 23 nt, Escherichia coli CFT073
ucacuacacgaccaugggcaauu

SEQ ID NO: 612680 - RNA, 18 nt, Escherichia coli CFT073
ucacuaccagugccagaa

SEQ ID NO: 612681 - RNA, 22 nt, Escherichia coli CFT073
ucacuacggcucagcaauauag

SEQ ID NO: 612682 - RNA, 23 nt, Escherichia coli CFT073
ucacuacguagucuuuaccgcug

SEQ ID NO: 612683 - RNA, 12 nt, Escherichia coli CFT073
ucacuauuaaag

SEQ ID NO: 612684 - RNA, 14 nt, Escherichia coli CFT073
ucacuauuaaagaa

SEQ ID NO: 612685 - RNA, 15 nt, Escherichia coli CFT073
ucacgucucaucagg

SEQ ID NO: 612686 - RNA, 12 nt, Escherichia coli CFT073
ucacguagccac

SEQ ID NO: 612687 - RNA, 14 nt, Escherichia coli CFT073
ucacguagccacgg

SEQ ID NO: 612688 - RNA, 14 nt, Escherichia coli CFT073
ucacguugauggua

SEQ ID NO: 612689 - RNA, 16 nt, Escherichia coli CFT073
ucacguugacgcauac

SEQ ID NO: 612690 - RNA, 17 nt, Escherichia coli CFT073
ucacguuuuucauccag

SEQ ID NO: 612691 - RNA, 13 nt, Escherichia coli CFT073
ucacguuuuccuu

SEQ ID NO: 612692 - RNA, 19 nt, Escherichia coli CFT073
ucacuaaggguaaaacgac

SEQ ID NO: 612693 - RNA, 19 nt, Escherichia coli CFT073
ucacuaaacccgaccacuu

SEQ ID NO: 612694 - RNA, 21 nt, Escherichia coli CFT073
ucacuaaacccgaccacuucc

SEQ ID NO: 612695 - RNA, 15 nt, Escherichia coli CFT073
ucacuuuccaguuca

SEQ ID NO: 612696 - RNA, 16 nt, Escherichia coli CFT073
ucacuuuccaguucaa

SEQ ID NO: 612697 - RNA, 23 nt, Escherichia coli CFT073
ucacuuucugaccaugcauauaa

SEQ ID NO: 612698 - RNA, 16 nt, Escherichia coli CFT073
ucacuuugcugucgau

SEQ ID NO: 612699 - RNA, 20 nt, Escherichia coli CFT073
ucacuuuguuccugaauuaa

SEQ ID NO: 612700 - RNA, 14 nt, Escherichia coli CFT073
ucacuuuucuuaau

SEQ ID NO: 612701 - RNA, 13 nt, Escherichia coli CFT073
ucacuuuucuucu

SEQ ID NO: 612702 - RNA, 13 nt, Escherichia coli CFT073
ucacuuuugccag

SEQ ID NO: 612703 - RNA, 16 nt, Escherichia coli CFT073
ucacuugccugcugug

SEQ ID NO: 612704 - RNA, 18 nt, Escherichia coli CFT073
ucacuuguaguuacauuu

SEQ ID NO: 612705 - RNA, 20 nt, Escherichia coli CFT073
ucacuucuggagguuuuaug

SEQ ID NO: 612706 - RNA, 20 nt, Escherichia coli CFT073
ucacuucuguuugcgccacg

SEQ ID NO: 612707 - RNA, 18 nt, Escherichia coli CFT073
ucacuucgucagaaaugg

SEQ ID NO: 612708 - RNA, 17 nt, Escherichia coli CFT073
ucacuucgauccaguga

SEQ ID NO: 612709 - RNA, 17 nt, Escherichia coli CFT073
ucacuuccugauccgcu

SEQ ID NO: 612710 - RNA, 18 nt, Escherichia coli CFT073
ucacuuccaguacgcgca

SEQ ID NO: 612711 - RNA, 17 nt, Escherichia coli CFT073
ucacuuacgauuuuaau

SEQ ID NO: 612712 - RNA, 18 nt, Escherichia coli CFT073
ucacuuacgauuuuaaua

SEQ ID NO: 612713 - RNA, 21 nt, Escherichia coli CFT073
ucacuuacgauuuuaauagcu

SEQ ID NO: 612714 - RNA, 15 nt, Escherichia coli CFT073
ucacuucaaauuuaa

SEQ ID NO: 612715 - RNA, 23 nt, Escherichia coli CFT073
ucacucuuucccuccucaaauca

SEQ ID NO: 612716 - RNA, 19 nt, Escherichia coli CFT073
ucacugaaacagauaaaag

SEQ ID NO: 612717 - RNA, 15 nt, Escherichia coli CFT073
ucacugacaccagca

SEQ ID NO: 612718 - RNA, 16 nt, Escherichia coli CFT073
ucacugacaccagcau

SEQ ID NO: 612719 - RNA, 17 nt, Escherichia coli CFT073
ucacugacgacuucagu

SEQ ID NO: 612720 - RNA, 21 nt, Escherichia coli CFT073
ucacugcaaauacccaaaaaa

SEQ ID NO: 612721 - RNA, 14 nt, Escherichia coli CFT073
ucacugccaccauc

SEQ ID NO: 612722 - RNA, 21 nt, Escherichia coli CFT073
ucacugccagaauagccgcag

SEQ ID NO: 612723 - RNA, 22 nt, Escherichia coli CFT073
ucacuggaagacgcugauucac

SEQ ID NO: 612724 - RNA, 21 nt, Escherichia coli CFT073
ucacugcgcucuaaaaucauc

SEQ ID NO: 612725 - RNA, 18 nt, Escherichia coli CFT073
ucacugucaucgacaaaa

SEQ ID NO: 612726 - RNA, 17 nt, Escherichia coli CFT073
ucacuguaucaggugua

SEQ ID NO: 612727 - RNA, 14 nt, Escherichia coli CFT073
ucacuggcgucaca

SEQ ID NO: 612728 - RNA, 14 nt, Escherichia coli CFT073
ucacuggcgucaug

SEQ ID NO: 612729 - RNA, 19 nt, Escherichia coli CFT073
ucacgcaacauuccggcgc

SEQ ID NO: 612730 - RNA, 22 nt, Escherichia coli CFT073
ucacgauuugcguaaaaccugc

SEQ ID NO: 612731 - RNA, 14 nt, Escherichia coli CFT073
ucacgauuauuaag

SEQ ID NO: 612732 - RNA, 15 nt, Escherichia coli CFT073
ucacgauggcgggcc

SEQ ID NO: 612733 - RNA, 17 nt, Escherichia coli CFT073
ucacgcagauacuggaa

SEQ ID NO: 612734 - RNA, 14 nt, Escherichia coli CFT073
ucacgcagcagggc

SEQ ID NO: 612735 - RNA, 17 nt, Escherichia coli CFT073
ucacgcagguuggaaua

SEQ ID NO: 612736 - RNA, 22 nt, Escherichia coli CFT073
ucacgcagguuggaauaaacaa

SEQ ID NO: 612737 - RNA, 14 nt, Escherichia coli CFT073
ucacgccccaaugc

SEQ ID NO: 612738 - RNA, 12 nt, Escherichia coli CFT073
ucacgcccgcgu

SEQ ID NO: 612739 - RNA, 16 nt, Escherichia coli CFT073
ucacgccgaccagacc

SEQ ID NO: 612740 - RNA, 21 nt, Escherichia coli CFT073
ucacgccgcauccggcauaaa

SEQ ID NO: 612741 - RNA, 12 nt, Escherichia coli CFT073
ucacgccaggca

SEQ ID NO: 612742 - RNA, 13 nt, Escherichia coli CFT073
ucacgccaaccag

SEQ ID NO: 612743 - RNA, 21 nt, Escherichia coli CFT073
ucacgcagcggaccgcuuugc

SEQ ID NO: 612744 - RNA, 13 nt, Escherichia coli CFT073
ucacgcaguuuau

SEQ ID NO: 612745 - RNA, 22 nt, Escherichia coli CFT073
ucacgcaccauaauauaaggau

SEQ ID NO: 612746 - RNA, 18 nt, Escherichia coli CFT073
ucacgccaucauccugau

SEQ ID NO: 612747 - RNA, 18 nt, Escherichia coli CFT073
ucacggcugcuaauauuu

SEQ ID NO: 612748 - RNA, 15 nt, Escherichia coli CFT073
ucacggcaccagcca

SEQ ID NO: 612749 - RNA, 22 nt, Escherichia coli CFT073
ucacgggcggcggcuuucaggg

SEQ ID NO: 612750 - RNA, 17 nt, Escherichia coli CFT073
ucacgcucgcaggcggc

SEQ ID NO: 612751 - RNA, 19 nt, Escherichia coli CFT073
ucacggaaucccguaaucc

SEQ ID NO: 612752 - RNA, 23 nt, Escherichia coli CFT073
ucacgcugccaauaaugcccgca

SEQ ID NO: 612753 - RNA, 13 nt, Escherichia coli CFT073
ucacgcuggcaga

SEQ ID NO: 612754 - RNA, 23 nt, Escherichia coli CFT073
ucacgcuuaucgcccugaauuuc

SEQ ID NO: 612755 - RNA, 20 nt, Escherichia coli CFT073
ucacgacaaaugcgccgcca

SEQ ID NO: 612756 - RNA, 21 nt, Escherichia coli CFT073
ucacgacaaccgggaucaccg

SEQ ID NO: 612757 - RNA, 18 nt, Escherichia coli CFT073
ucacgaccaucaaccuuc

SEQ ID NO: 612758 - RNA, 21 nt, Escherichia coli CFT073
ucacgacccggcguuuucaga

SEQ ID NO: 612759 - RNA, 18 nt, Escherichia coli CFT073
ucacgacuuguaccuuca

SEQ ID NO: 612760 - RNA, 20 nt, Escherichia coli CFT073
ucacgaugcaaauuuuuaau

SEQ ID NO: 612761 - RNA, 22 nt, Escherichia coli CFT073
ucacgaugcagcgucugcuguu

SEQ ID NO: 612762 - RNA, 15 nt, Escherichia coli CFT073
ucacgaauauuuccc

SEQ ID NO: 612763 - RNA, 16 nt, Escherichia coli CFT073
ucacgaauccgcacca

SEQ ID NO: 612764 - RNA, 18 nt, Escherichia coli CFT073
ucaccuugcucgaucaga

SEQ ID NO: 612765 - RNA, 23 nt, Escherichia coli CFT073
ucaccuuuuaccguacugccguc

SEQ ID NO: 612766 - RNA, 13 nt, Escherichia coli CFT073
ucaccuuuucgau

SEQ ID NO: 612767 - RNA, 21 nt, Escherichia coli CFT073
ucaccuuacaucaaaaaaaau

SEQ ID NO: 612768 - RNA, 23 nt, Escherichia coli CFT073
ucaccuuacuggaguaaaucaga

SEQ ID NO: 612769 - RNA, 16 nt, Escherichia coli CFT073
ucaccuugagggauuc

SEQ ID NO: 612770 - RNA, 20 nt, Escherichia coli CFT073
ucaccuucggugaauuucac

SEQ ID NO: 612771 - RNA, 19 nt, Escherichia coli CFT073
ucaccugcgcuggcaggcc

SEQ ID NO: 612772 - RNA, 17 nt, Escherichia coli CFT073
ucaccugcggugcagcc

SEQ ID NO: 612773 - RNA, 20 nt, Escherichia coli CFT073
ucaccugccugcagcugcuc

SEQ ID NO: 612774 - RNA, 16 nt, Escherichia coli CFT073
ucaccugcgauaaacc

SEQ ID NO: 612775 - RNA, 19 nt, Escherichia coli CFT073
ucaccucuuuuucgacuuc

SEQ ID NO: 612776 - RNA, 16 nt, Escherichia coli CFT073
ucaccugacagcagag

SEQ ID NO: 612777 - RNA, 18 nt, Escherichia coli CFT073
ucaccugauuaccuacca

SEQ ID NO: 612778 - RNA, 22 nt, Escherichia coli CFT073
ucaccucugucgaugcgcucug

SEQ ID NO: 612779 - RNA, 12 nt, Escherichia coli CFT073
ucaccucugcaa

SEQ ID NO: 612780 - RNA, 14 nt, Escherichia coli CFT073
ucaccucugucgau

SEQ ID NO: 612781 - RNA, 11 nt, Escherichia coli CFT073
ucaccucuuuc

SEQ ID NO: 612782 - RNA, 23 nt, Escherichia coli CFT073
ucaccuaauuuaaaauugauaac

SEQ ID NO: 612783 - RNA, 13 nt, Escherichia coli CFT073
ucaccuacaugac

SEQ ID NO: 612784 - RNA, 18 nt, Escherichia coli CFT073
ucaccguucagcuugcgu

SEQ ID NO: 612785 - RNA, 15 nt, Escherichia coli CFT073
ucaccgggauccagu

SEQ ID NO: 612786 - RNA, 18 nt, Escherichia coli CFT073
ucaccgguguucccgucc

SEQ ID NO: 612787 - RNA, 21 nt, Escherichia coli CFT073
ucaccgcguaugcccagcgca

SEQ ID NO: 612788 - RNA, 20 nt, Escherichia coli CFT073
ucaccgcuuuuuucaucucu

SEQ ID NO: 612789 - RNA, 15 nt, Escherichia coli CFT073
ucaccgccugcugau

SEQ ID NO: 612790 - RNA, 14 nt, Escherichia coli CFT073
ucaccgccuuacca

SEQ ID NO: 612791 - RNA, 22 nt, Escherichia coli CFT073
ucacccccguuaaccacuucag

SEQ ID NO: 612792 - RNA, 20 nt, Escherichia coli CFT073
ucaccccgcgcucacaccac

SEQ ID NO: 612793 - RNA, 16 nt, Escherichia coli CFT073
ucacccgauaaauaau

SEQ ID NO: 612794 - RNA, 18 nt, Escherichia coli CFT073
ucacccgauaaauaauaa

SEQ ID NO: 612795 - RNA, 22 nt, Escherichia coli CFT073
ucacccgccgguggcguuucca

SEQ ID NO: 612796 - RNA, 18 nt, Escherichia coli CFT073
ucacccgccuucacuucc

SEQ ID NO: 612797 - RNA, 22 nt, Escherichia coli CFT073
ucacccgcgccuaaauuuuucc

SEQ ID NO: 612798 - RNA, 18 nt, Escherichia coli CFT073
ucacccgcugcaacacuu

SEQ ID NO: 612799 - RNA, 21 nt, Escherichia coli CFT073
ucaccgacggauuauucacua

SEQ ID NO: 612800 - RNA, 16 nt, Escherichia coli CFT073
ucaccgaaccagggcg

SEQ ID NO: 612801 - RNA, 23 nt, Escherichia coli CFT073
ucaccgaagcggccgucagaucg

SEQ ID NO: 612802 - RNA, 15 nt, Escherichia coli CFT073
ucaccgccacgccuu

SEQ ID NO: 612803 - RNA, 18 nt, Escherichia coli CFT073
ucaccagaggaugcaggu

SEQ ID NO: 612804 - RNA, 22 nt, Escherichia coli CFT073
ucaccagaucgccuaauuucac

SEQ ID NO: 612805 - RNA, 14 nt, Escherichia coli CFT073
ucaccagacaucaa

SEQ ID NO: 612806 - RNA, 16 nt, Escherichia coli CFT073
ucaccacuaccguguc

SEQ ID NO: 612807 - RNA, 19 nt, Escherichia coli CFT073
ucaccacgccgagagaagc

SEQ ID NO: 612808 - RNA, 18 nt, Escherichia coli CFT073
ucaccaccaucaaaugcg

SEQ ID NO: 612809 - RNA, 20 nt, Escherichia coli CFT073
ucaccagcaaauccagcggu

SEQ ID NO: 612810 - RNA, 11 nt, Escherichia coli CFT073
ucaccagaccc

SEQ ID NO: 612811 - RNA, 17 nt, Escherichia coli CFT073
ucaccagcaucagcgau

SEQ ID NO: 612812 - RNA, 18 nt, Escherichia coli CFT073
ucaccagcaucgcuucca

SEQ ID NO: 612813 - RNA, 15 nt, Escherichia coli CFT073
ucaccagcauuagca

SEQ ID NO: 612814 - RNA, 19 nt, Escherichia coli CFT073
ucaccagcgcauugacgau

SEQ ID NO: 612815 - RNA, 19 nt, Escherichia coli CFT073
ucaccagcgcgaggaucac

SEQ ID NO: 612816 - RNA, 16 nt, Escherichia coli CFT073
ucaccaggucaccaga

SEQ ID NO: 612817 - RNA, 14 nt, Escherichia coli CFT073
ucaccagugaucug

SEQ ID NO: 612818 - RNA, 18 nt, Escherichia coli CFT073
ucaccauaaaucagaucg

SEQ ID NO: 612819 - RNA, 16 nt, Escherichia coli CFT073
ucaccauauucagcag

SEQ ID NO: 612820 - RNA, 18 nt, Escherichia coli CFT073
ucaccauauucagcagca

SEQ ID NO: 612821 - RNA, 23 nt, Escherichia coli CFT073
ucaccaugauuucguauacugca

SEQ ID NO: 612822 - RNA, 22 nt, Escherichia coli CFT073
ucaccaucgcaaacagcacauc

SEQ ID NO: 612823 - RNA, 13 nt, Escherichia coli CFT073
ucaccaucuucac

SEQ ID NO: 612824 - RNA, 14 nt, Escherichia coli CFT073
ucaccaucuucacu

SEQ ID NO: 612825 - RNA, 20 nt, Escherichia coli CFT073
ucacccagcguuugcugcuu

SEQ ID NO: 612826 - RNA, 18 nt, Escherichia coli CFT073
ucacccacgguuacgcua

SEQ ID NO: 612827 - RNA, 14 nt, Escherichia coli CFT073
ucaccauuggcauu

SEQ ID NO: 612828 - RNA, 12 nt, Escherichia coli CFT073
ucacccaacaau

SEQ ID NO: 612829 - RNA, 13 nt, Escherichia coli CFT073
ucacccacacuuc

SEQ ID NO: 612830 - RNA, 21 nt, Escherichia coli CFT073
ucacauuuuuaagccgcgcau

SEQ ID NO: 612831 - RNA, 20 nt, Escherichia coli CFT073
ucacauucuguccugaaaau

SEQ ID NO: 612832 - RNA, 23 nt, Escherichia coli CFT073
ucacauucuguccugaaaauuca

SEQ ID NO: 612833 - RNA, 17 nt, Escherichia coli CFT073
ucacauuguuaaagccc

SEQ ID NO: 612834 - RNA, 21 nt, Escherichia coli CFT073
ucacaugcuggaaccacagcg

SEQ ID NO: 612835 - RNA, 22 nt, Escherichia coli CFT073
ucacauggagcacuaucaauga

SEQ ID NO: 612836 - RNA, 21 nt, Escherichia coli CFT073
ucaccaacugcccgaacagca

SEQ ID NO: 612837 - RNA, 15 nt, Escherichia coli CFT073
ucaccaaacugcucg

SEQ ID NO: 612838 - RNA, 16 nt, Escherichia coli CFT073
ucaccaaucagguaag

SEQ ID NO: 612839 - RNA, 22 nt, Escherichia coli CFT073
ucaccaaugacagccccaccag

SEQ ID NO: 612840 - RNA, 23 nt, Escherichia coli CFT073
ucaccaaugacagccccaccagc

SEQ ID NO: 612841 - RNA, 21 nt, Escherichia coli CFT073
ucaccaauguugucgcagacg

SEQ ID NO: 612842 - RNA, 16 nt, Escherichia coli CFT073
ucaccaauuuuaaaac

SEQ ID NO: 612843 - RNA, 15 nt, Escherichia coli CFT073
ucacagucugaauac

SEQ ID NO: 612844 - RNA, 20 nt, Escherichia coli CFT073
ucacagucugaauaccgcua

SEQ ID NO: 612845 - RNA, 18 nt, Escherichia coli CFT073
ucacauaaucgaaaacau

SEQ ID NO: 612846 - RNA, 20 nt, Escherichia coli CFT073
ucacauagcccgguuuguua

SEQ ID NO: 612847 - RNA, 11 nt, Escherichia coli CFT073
ucacauacgcg

SEQ ID NO: 612848 - RNA, 15 nt, Escherichia coli CFT073
ucacauauugcagcu

SEQ ID NO: 612849 - RNA, 19 nt, Escherichia coli CFT073
ucacaucaccauaaaucag

SEQ ID NO: 612850 - RNA, 12 nt, Escherichia coli CFT073
ucacaucauaaa

SEQ ID NO: 612851 - RNA, 12 nt, Escherichia coli CFT073
ucacauccugcc

SEQ ID NO: 612852 - RNA, 19 nt, Escherichia coli CFT073
ucacauccaccagcgccuc

SEQ ID NO: 612853 - RNA, 13 nt, Escherichia coli CFT073
ucacaucccagca

SEQ ID NO: 612854 - RNA, 16 nt, Escherichia coli CFT073
ucacaucccagcagag

SEQ ID NO: 612855 - RNA, 23 nt, Escherichia coli CFT073
ucacaucguugauauuuguuuuu

SEQ ID NO: 612856 - RNA, 16 nt, Escherichia coli CFT073
ucacaucugacaaaau

SEQ ID NO: 612857 - RNA, 21 nt, Escherichia coli CFT073
ucacaucugacaaaaucaaua

SEQ ID NO: 612858 - RNA, 17 nt, Escherichia coli CFT073
ucacaccacaacagcca

SEQ ID NO: 612859 - RNA, 15 nt, Escherichia coli CFT073
ucacacagugaaucu

SEQ ID NO: 612860 - RNA, 18 nt, Escherichia coli CFT073
ucacaaucggcuuucacc

SEQ ID NO: 612861 - RNA, 21 nt, Escherichia coli CFT073
ucacaaucaucgcauccagcg

SEQ ID NO: 612862 - RNA, 16 nt, Escherichia coli CFT073
ucacaauguaaaucau

SEQ ID NO: 612863 - RNA, 20 nt, Escherichia coli CFT073
ucacaaugccgccaauaaug

SEQ ID NO: 612864 - RNA, 18 nt, Escherichia coli CFT073
ucacaacauugauaagca

SEQ ID NO: 612865 - RNA, 18 nt, Escherichia coli CFT073
ucacagagcgcuuauaca

SEQ ID NO: 612866 - RNA, 20 nt, Escherichia coli CFT073
ucacagagcgcuuauacacc

SEQ ID NO: 612867 - RNA, 16 nt, Escherichia coli CFT073
ucacagaagugaagca

SEQ ID NO: 612868 - RNA, 20 nt, Escherichia coli CFT073
ucacaggauggcccaaaugg

SEQ ID NO: 612869 - RNA, 16 nt, Escherichia coli CFT073
ucacaggcacaccgcc

SEQ ID NO: 612870 - RNA, 21 nt, Escherichia coli CFT073
ucacagaaaaaacaaacggca

SEQ ID NO: 612871 - RNA, 18 nt, Escherichia coli CFT073
ucacacugaugacaggcu

SEQ ID NO: 612872 - RNA, 17 nt, Escherichia coli CFT073
ucacaccauccagcaac

SEQ ID NO: 612873 - RNA, 22 nt, Escherichia coli CFT073
ucacaccauccagcaacaacag

SEQ ID NO: 612874 - RNA, 12 nt, Escherichia coli CFT073
ucacaccaugcc

SEQ ID NO: 612875 - RNA, 18 nt, Escherichia coli CFT073
ucacaccugcucagcacg

SEQ ID NO: 612876 - RNA, 21 nt, Escherichia coli CFT073
ucacaccuuguggaaauucca

SEQ ID NO: 612877 - RNA, 20 nt, Escherichia coli CFT073
ucaaugguggcaaucugaau

SEQ ID NO: 612878 - RNA, 14 nt, Escherichia coli CFT073
ucaaugucuccguu

SEQ ID NO: 612879 - RNA, 16 nt, Escherichia coli CFT073
ucaauguguugauaau

SEQ ID NO: 612880 - RNA, 16 nt, Escherichia coli CFT073
ucaaugccuuucuuug

SEQ ID NO: 612881 - RNA, 23 nt, Escherichia coli CFT073
ucaaugcguuguagcuuuuuccu

SEQ ID NO: 612882 - RNA, 15 nt, Escherichia coli CFT073
ucaaugcugaaagca

SEQ ID NO: 612883 - RNA, 14 nt, Escherichia coli CFT073
ucaauggcgcugca

SEQ ID NO: 612884 - RNA, 17 nt, Escherichia coli CFT073
ucaaugcgguaaucguc

SEQ ID NO: 612885 - RNA, 15 nt, Escherichia coli CFT073
ucaaugaaugcuucg

SEQ ID NO: 612886 - RNA, 21 nt, Escherichia coli CFT073
ucaaugacaguaucaccaacu

SEQ ID NO: 612887 - RNA, 23 nt, Escherichia coli CFT073
ucaaugaauugcuuaacagcauu

SEQ ID NO: 612888 - RNA, 21 nt, Escherichia coli CFT073
ucaaugcccacugcacagugu

SEQ ID NO: 612889 - RNA, 22 nt, Escherichia coli CFT073
ucaaugcccacugcacaguguu

SEQ ID NO: 612890 - RNA, 14 nt, Escherichia coli CFT073
ucaaucucuucaca

SEQ ID NO: 612891 - RNA, 15 nt, Escherichia coli CFT073
ucaaucgccaaaaag

SEQ ID NO: 612892 - RNA, 17 nt, Escherichia coli CFT073
ucaaucggaaaacaacc

SEQ ID NO: 612893 - RNA, 22 nt, Escherichia coli CFT073
ucaaucgcacccgccaucaucc

SEQ ID NO: 612894 - RNA, 14 nt, Escherichia coli CFT073
ucaauccugcagca

SEQ ID NO: 612895 - RNA, 20 nt, Escherichia coli CFT073
ucaauccggcaaucaacauc

SEQ ID NO: 612896 - RNA, 15 nt, Escherichia coli CFT073
ucaaucauugauaau

SEQ ID NO: 612897 - RNA, 14 nt, Escherichia coli CFT073
ucaaucagccccuu

SEQ ID NO: 612898 - RNA, 14 nt, Escherichia coli CFT073
ucaaucaggcuauc

SEQ ID NO: 612899 - RNA, 14 nt, Escherichia coli CFT073
ucaaucaguucauu

SEQ ID NO: 612900 - RNA, 16 nt, Escherichia coli CFT073
ucaauuagaauuauua

SEQ ID NO: 612901 - RNA, 15 nt, Escherichia coli CFT073
ucaauuacgcggcuu

SEQ ID NO: 612902 - RNA, 21 nt, Escherichia coli CFT073
ucaauuacaccaucacgcccc

SEQ ID NO: 612903 - RNA, 14 nt, Escherichia coli CFT073
ucaauuaugcccuc

SEQ ID NO: 612904 - RNA, 19 nt, Escherichia coli CFT073
ucaauuaacggcucugcuu

SEQ ID NO: 612905 - RNA, 17 nt, Escherichia coli CFT073
ucaauugcgcaccagcu

SEQ ID NO: 612906 - RNA, 17 nt, Escherichia coli CFT073
ucaauugcguucugucg

SEQ ID NO: 612907 - RNA, 13 nt, Escherichia coli CFT073
ucaauugaacucu

SEQ ID NO: 612908 - RNA, 15 nt, Escherichia coli CFT073
ucaauuugcaggcua

SEQ ID NO: 612909 - RNA, 17 nt, Escherichia coli CFT073
ucacaaaauagaaauuu

SEQ ID NO: 612910 - RNA, 20 nt, Escherichia coli CFT073
ucacaaagacgccaucaauu

SEQ ID NO: 612911 - RNA, 19 nt, Escherichia coli CFT073
ucacaaaggcuugcugcau

SEQ ID NO: 612912 - RNA, 12 nt, Escherichia coli CFT073
ucacaaacauca

SEQ ID NO: 612913 - RNA, 21 nt, Escherichia coli CFT073
ucaaguguggccgccagugau

SEQ ID NO: 612914 - RNA, 22 nt, Escherichia coli CFT073
ucaagucuggguauucagcgau

SEQ ID NO: 612915 - RNA, 24 nt, Escherichia coli CFT073
ucaagcgaaaucaacacgccugca

SEQ ID NO: 612916 - RNA, 20 nt, Escherichia coli CFT073
ucaagcguuucaucuucagu

SEQ ID NO: 612917 - RNA, 14 nt, Escherichia coli CFT073
ucaagcuaaaccaa

SEQ ID NO: 612918 - RNA, 20 nt, Escherichia coli CFT073
ucaagcugaccgauaaccug

SEQ ID NO: 612919 - RNA, 19 nt, Escherichia coli CFT073
ucaagcugaguauuaaccg

SEQ ID NO: 612920 - RNA, 13 nt, Escherichia coli CFT073
ucaagcugcaucu

SEQ ID NO: 612921 - RNA, 22 nt, Escherichia coli CFT073
ucaagcugcugacggugauaau

SEQ ID NO: 612922 - RNA, 16 nt, Escherichia coli CFT073
ucaagcuggcgcuggc

SEQ ID NO: 612923 - RNA, 20 nt, Escherichia coli CFT073
ucaagcuugcagaauuggcg

SEQ ID NO: 612924 - RNA, 23 nt, Escherichia coli CFT073
ucaaggucgcccuggacaugggu

SEQ ID NO: 612925 - RNA, 22 nt, Escherichia coli CFT073
ucaaggcugauguugauaaaga

SEQ ID NO: 612926 - RNA, 19 nt, Escherichia coli CFT073
ucaaggaaugaaauauuau

SEQ ID NO: 612927 - RNA, 19 nt, Escherichia coli CFT073
ucaaggcagagucaucucu

SEQ ID NO: 612928 - RNA, 16 nt, Escherichia coli CFT073
ucaauacuuuccagca

SEQ ID NO: 612929 - RNA, 20 nt, Escherichia coli CFT073
ucaauaccgccugcaaauaa

SEQ ID NO: 612930 - RNA, 18 nt, Escherichia coli CFT073
ucaauaauuucuucauug

SEQ ID NO: 612931 - RNA, 15 nt, Escherichia coli CFT073
ucaauaacagcgcaa

SEQ ID NO: 612932 - RNA, 19 nt, Escherichia coli CFT073
ucaauaagcuguucagaua

SEQ ID NO: 612933 - RNA, 22 nt, Escherichia coli CFT073
ucaauaauauccgguuucugau

SEQ ID NO: 612934 - RNA, 18 nt, Escherichia coli CFT073
ucaauauuugcaccuaaa

SEQ ID NO: 612935 - RNA, 15 nt, Escherichia coli CFT073
ucaauauuccaguca

SEQ ID NO: 612936 - RNA, 14 nt, Escherichia coli CFT073
ucaauaugaauuaa

SEQ ID NO: 612937 - RNA, 15 nt, Escherichia coli CFT073
ucaaucaccgcuuca

SEQ ID NO: 612938 - RNA, 18 nt, Escherichia coli CFT073
ucaaucaaauagccugcc

SEQ ID NO: 612939 - RNA, 12 nt, Escherichia coli CFT073
ucaaucaacaua

SEQ ID NO: 612940 - RNA, 21 nt, Escherichia coli CFT073
ucaauauacgaaaauuuggau

SEQ ID NO: 612941 - RNA, 14 nt, Escherichia coli CFT073
ucaauauauuaaaa

SEQ ID NO: 612942 - RNA, 16 nt, Escherichia coli CFT073
ucaauauccagcaggu

SEQ ID NO: 612943 - RNA, 14 nt, Escherichia coli CFT073
ucaauauccagucg

SEQ ID NO: 612944 - RNA, 19 nt, Escherichia coli CFT073
ucaauauccugaccuuuac

SEQ ID NO: 612945 - RNA, 21 nt, Escherichia coli CFT073
ucaauagucaguauuuucccu

SEQ ID NO: 612946 - RNA, 19 nt, Escherichia coli CFT073
ucaauauaaacagccccuc

SEQ ID NO: 612947 - RNA, 17 nt, Escherichia coli CFT073
ucaacaccgacuucaau

SEQ ID NO: 612948 - RNA, 16 nt, Escherichia coli CFT073
ucaacaauugaagaau

SEQ ID NO: 612949 - RNA, 22 nt, Escherichia coli CFT073
ucaacaauugcgggccaaagac

SEQ ID NO: 612950 - RNA, 18 nt, Escherichia coli CFT073
ucaacaauuugccaggcu

SEQ ID NO: 612951 - RNA, 21 nt, Escherichia coli CFT073
ucaacacaccgcccugcugua

SEQ ID NO: 612952 - RNA, 20 nt, Escherichia coli CFT073
ucaacagauaaauggcacag

SEQ ID NO: 612953 - RNA, 15 nt, Escherichia coli CFT073
ucaacagauuuugca

SEQ ID NO: 612954 - RNA, 17 nt, Escherichia coli CFT073
ucaacagccagaaggug

SEQ ID NO: 612955 - RNA, 16 nt, Escherichia coli CFT073
ucaacagcguuucuuc

SEQ ID NO: 612956 - RNA, 20 nt, Escherichia coli CFT073
ucaacaggaauguuguccag

SEQ ID NO: 612957 - RNA, 13 nt, Escherichia coli CFT073
ucaacaguaaacu

SEQ ID NO: 612958 - RNA, 13 nt, Escherichia coli CFT073
ucaacaguucaug

SEQ ID NO: 612959 - RNA, 19 nt, Escherichia coli CFT073
ucaaccaccggcaccacuu

SEQ ID NO: 612960 - RNA, 22 nt, Escherichia coli CFT073
ucaaccacuacgugaucgucuu

SEQ ID NO: 612961 - RNA, 12 nt, Escherichia coli CFT073
ucaaccacucac

SEQ ID NO: 612962 - RNA, 18 nt, Escherichia coli CFT073
ucaaccagcacaaagugg

SEQ ID NO: 612963 - RNA, 20 nt, Escherichia coli CFT073
ucaaccagcaccuuuuccag

SEQ ID NO: 612964 - RNA, 20 nt, Escherichia coli CFT073
ucaaccaggccuuccggguu

SEQ ID NO: 612965 - RNA, 16 nt, Escherichia coli CFT073
ucaacccaaccugcca

SEQ ID NO: 612966 - RNA, 18 nt, Escherichia coli CFT073
ucaacccccaccugcccg

SEQ ID NO: 612967 - RNA, 13 nt, Escherichia coli CFT073
ucaacccgcccag

SEQ ID NO: 612968 - RNA, 23 nt, Escherichia coli CFT073
ucaacccgcgcgcuaacggagaa

SEQ ID NO: 612969 - RNA, 13 nt, Escherichia coli CFT073
ucaacaucacacc

SEQ ID NO: 612970 - RNA, 16 nt, Escherichia coli CFT073
ucaacauacaaauagc

SEQ ID NO: 612971 - RNA, 20 nt, Escherichia coli CFT073
ucaacauguuccugccaguc

SEQ ID NO: 612972 - RNA, 20 nt, Escherichia coli CFT073
ucaacaaauagauaaaauau

SEQ ID NO: 612973 - RNA, 21 nt, Escherichia coli CFT073
ucaacaagcagcuugagaaaa

SEQ ID NO: 612974 - RNA, 22 nt, Escherichia coli CFT073
ucaacaagcagcuugagaaaau

SEQ ID NO: 612975 - RNA, 16 nt, Escherichia coli CFT073
ucaacaacaauuucac

SEQ ID NO: 612976 - RNA, 13 nt, Escherichia coli CFT073
ucaaauucauugu

SEQ ID NO: 612977 - RNA, 18 nt, Escherichia coli CFT073
ucaaauuucauaaucuga

SEQ ID NO: 612978 - RNA, 19 nt, Escherichia coli CFT073
ucaaauuacgauccaccac

SEQ ID NO: 612979 - RNA, 15 nt, Escherichia coli CFT073
ucaaaugcgccugca

SEQ ID NO: 612980 - RNA, 16 nt, Escherichia coli CFT073
ucaaaugcgccugcau

SEQ ID NO: 612981 - RNA, 23 nt, Escherichia coli CFT073
ucaaauggaccaucuccgaaguu

SEQ ID NO: 612982 - RNA, 23 nt, Escherichia coli CFT073
ucaaauggcauccuugcuaacca

SEQ ID NO: 612983 - RNA, 19 nt, Escherichia coli CFT073
ucaaaucugccguaacugc

SEQ ID NO: 612984 - RNA, 14 nt, Escherichia coli CFT073
ucaaauaucugccg

SEQ ID NO: 612985 - RNA, 15 nt, Escherichia coli CFT073
ucaaaucauccugcg

SEQ ID NO: 612986 - RNA, 16 nt, Escherichia coli CFT073
ucaaaucaccaaacug

SEQ ID NO: 612987 - RNA, 23 nt, Escherichia coli CFT073
ucaaaucaccauauucagcagca

SEQ ID NO: 612988 - RNA, 22 nt, Escherichia coli CFT073
ucaacggaccaauaaacgccag

SEQ ID NO: 612989 - RNA, 19 nt, Escherichia coli CFT073
ucaacggauauuguuugcu

SEQ ID NO: 612990 - RNA, 18 nt, Escherichia coli CFT073
ucaacgcgcuaauuucag

SEQ ID NO: 612991 - RNA, 14 nt, Escherichia coli CFT073
ucaacgcugccaug

SEQ ID NO: 612992 - RNA, 15 nt, Escherichia coli CFT073
ucaacgcugccauga

SEQ ID NO: 612993 - RNA, 22 nt, Escherichia coli CFT073
ucaacgccgcgugccaccauuc

SEQ ID NO: 612994 - RNA, 16 nt, Escherichia coli CFT073
ucaacgccgcuaucag

SEQ ID NO: 612995 - RNA, 14 nt, Escherichia coli CFT073
ucaacgccgggccu

SEQ ID NO: 612996 - RNA, 20 nt, Escherichia coli CFT073
ucaacgccgggccuguuaau

SEQ ID NO: 612997 - RNA, 14 nt, Escherichia coli CFT073
ucaacgccaccauc

SEQ ID NO: 612998 - RNA, 17 nt, Escherichia coli CFT073
ucaaccgcagugauuuc

SEQ ID NO: 612999 - RNA, 17 nt, Escherichia coli CFT073
ucaaccgcaccaaaucc

SEQ ID NO: 613000 - RNA, 15 nt, Escherichia coli CFT073
ucaaccgccugaauu

SEQ ID NO: 613001 - RNA, 21 nt, Escherichia coli CFT073
ucaaccgcgacauacuuaaau

SEQ ID NO: 613002 - RNA, 17 nt, Escherichia coli CFT073
ucaaccgccggauagcu

SEQ ID NO: 613003 - RNA, 14 nt, Escherichia coli CFT073
ucaaccguuugauu

SEQ ID NO: 613004 - RNA, 23 nt, Escherichia coli CFT073
ucaacgacgcugaagucagcaca

SEQ ID NO: 613005 - RNA, 18 nt, Escherichia coli CFT073
ucaaccucuuuuucugcc

SEQ ID NO: 613006 - RNA, 20 nt, Escherichia coli CFT073
ucaaccugaucgugccagga

SEQ ID NO: 613007 - RNA, 21 nt, Escherichia coli CFT073
ucaaccgugagguaugaaaau

SEQ ID NO: 613008 - RNA, 13 nt, Escherichia coli CFT073
ucaaccuucuucg

SEQ ID NO: 613009 - RNA, 16 nt, Escherichia coli CFT073
ucaacgucugcgccuu

SEQ ID NO: 613010 - RNA, 14 nt, Escherichia coli CFT073
ucaacggugcuuua

SEQ ID NO: 613011 - RNA, 19 nt, Escherichia coli CFT073
ucaacguacucugccacua

SEQ ID NO: 613012 - RNA, 18 nt, Escherichia coli CFT073
ucaacguugaauuucagg

SEQ ID NO: 613013 - RNA, 15 nt, Escherichia coli CFT073
ucaacguuauucgcu

SEQ ID NO: 613014 - RNA, 19 nt, Escherichia coli CFT073
ucaacguuauucgcuuccu

SEQ ID NO: 613015 - RNA, 23 nt, Escherichia coli CFT073
ucaacuccccgcauuuacucuca

SEQ ID NO: 613016 - RNA, 17 nt, Escherichia coli CFT073
ucaacuccgccagcaac

SEQ ID NO: 613017 - RNA, 18 nt, Escherichia coli CFT073
ucaacuccgccagcaacu

SEQ ID NO: 613018 - RNA, 20 nt, Escherichia coli CFT073
ucaacuacggcuuuuuucau

SEQ ID NO: 613019 - RNA, 21 nt, Escherichia coli CFT073
ucaacuacggcuuuuuucauu

SEQ ID NO: 613020 - RNA, 20 nt, Escherichia coli CFT073
ucaagcccugguaacugcca

SEQ ID NO: 613021 - RNA, 12 nt, Escherichia coli CFT073
ucaagcauuuuc

SEQ ID NO: 613022 - RNA, 19 nt, Escherichia coli CFT073
ucaagcauuuucucacugg

SEQ ID NO: 613023 - RNA, 16 nt, Escherichia coli CFT073
ucaagcauugauuuua

SEQ ID NO: 613024 - RNA, 16 nt, Escherichia coli CFT073
ucaagcaaggccaggu

SEQ ID NO: 613025 - RNA, 12 nt, Escherichia coli CFT073
ucaagcaaccag

SEQ ID NO: 613026 - RNA, 19 nt, Escherichia coli CFT073
ucaagcaaucaagcccugg

SEQ ID NO: 613027 - RNA, 23 nt, Escherichia coli CFT073
ucaagcacagccgcauuuuguug

SEQ ID NO: 613028 - RNA, 17 nt, Escherichia coli CFT073
ucaagcacccaaugcca

SEQ ID NO: 613029 - RNA, 17 nt, Escherichia coli CFT073
ucaagauggcucucauc

SEQ ID NO: 613030 - RNA, 19 nt, Escherichia coli CFT073
ucaagauggcucucaucca

SEQ ID NO: 613031 - RNA, 17 nt, Escherichia coli CFT073
ucaagauggggaauaag

SEQ ID NO: 613032 - RNA, 22 nt, Escherichia coli CFT073
ucaagauggggaauaagcugua

SEQ ID NO: 613033 - RNA, 14 nt, Escherichia coli CFT073
ucaacugacggucg

SEQ ID NO: 613034 - RNA, 15 nt, Escherichia coli CFT073
ucaacuuaagucucc

SEQ ID NO: 613035 - RNA, 12 nt, Escherichia coli CFT073
ucaacuuaauac

SEQ ID NO: 613036 - RNA, 11 nt, Escherichia coli CFT073
ucaacuuauug

SEQ ID NO: 613037 - RNA, 15 nt, Escherichia coli CFT073
ucaacuuccugaauc

SEQ ID NO: 613038 - RNA, 18 nt, Escherichia coli CFT073
ucaagaacggcuuucaua

SEQ ID NO: 613039 - RNA, 23 nt, Escherichia coli CFT073
ucaagaaaacugguuauaugaau

SEQ ID NO: 613040 - RNA, 21 nt, Escherichia coli CFT073
ucaagacgaauaccuucuucc

SEQ ID NO: 613041 - RNA, 15 nt, Escherichia coli CFT073
ucaagaaggauauaa

SEQ ID NO: 613042 - RNA, 17 nt, Escherichia coli CFT073
ucaagaauaguuuccag

SEQ ID NO: 613043 - RNA, 19 nt, Escherichia coli CFT073
ucaaacggcauaugccaug

SEQ ID NO: 613044 - RNA, 21 nt, Escherichia coli CFT073
ucaaacgauucggcaaucaca

SEQ ID NO: 613045 - RNA, 12 nt, Escherichia coli CFT073
ucaaaccuucau

SEQ ID NO: 613046 - RNA, 20 nt, Escherichia coli CFT073
ucaaacgcugacggugccag

SEQ ID NO: 613047 - RNA, 13 nt, Escherichia coli CFT073
ucaaaccaauggc

SEQ ID NO: 613048 - RNA, 17 nt, Escherichia coli CFT073
ucaaacagaaaaacgaa

SEQ ID NO: 613049 - RNA, 17 nt, Escherichia coli CFT073
ucaaacaugccgucaau

SEQ ID NO: 613050 - RNA, 12 nt, Escherichia coli CFT073
ucaaacagcccc

SEQ ID NO: 613051 - RNA, 13 nt, Escherichia coli CFT073
ucaaacaggcugc

SEQ ID NO: 613052 - RNA, 17 nt, Escherichia coli CFT073
ucaaacccuucuucaau

SEQ ID NO: 613053 - RNA, 19 nt, Escherichia coli CFT073
ucaaaccauucccggcuuu

SEQ ID NO: 613054 - RNA, 22 nt, Escherichia coli CFT073
ucaaaccauucccggcuuugca

SEQ ID NO: 613055 - RNA, 13 nt, Escherichia coli CFT073
ucaaaauucauaa

SEQ ID NO: 613056 - RNA, 17 nt, Escherichia coli CFT073
ucaaaauucaacuugga

SEQ ID NO: 613057 - RNA, 16 nt, Escherichia coli CFT073
ucaaaauuaccuuuac

SEQ ID NO: 613058 - RNA, 22 nt, Escherichia coli CFT073
ucaaaauuaccuuuacaugaaa

SEQ ID NO: 613059 - RNA, 15 nt, Escherichia coli CFT073
ucaaacacaggcaga

SEQ ID NO: 613060 - RNA, 23 nt, Escherichia coli CFT073
ucaaacaccaguucaccaccugg

SEQ ID NO: 613061 - RNA, 15 nt, Escherichia coli CFT073
ucaaacaaccguuca

SEQ ID NO: 613062 - RNA, 14 nt, Escherichia coli CFT073
ucaaaaugaacauu

SEQ ID NO: 613063 - RNA, 16 nt, Escherichia coli CFT073
ucaaaaucaccgauga

SEQ ID NO: 613064 - RNA, 19 nt, Escherichia coli CFT073
ucaaagcggugaucaaaac

SEQ ID NO: 613065 - RNA, 17 nt, Escherichia coli CFT073
ucaaagaacucacgcgc

SEQ ID NO: 613066 - RNA, 23 nt, Escherichia coli CFT073
ucaaacuggguuuugaucuccag

SEQ ID NO: 613067 - RNA, 15 nt, Escherichia coli CFT073
ucaaacuuuuaaauu

SEQ ID NO: 613068 - RNA, 23 nt, Escherichia coli CFT073
ucaaaggcauuaaaugcauacau

SEQ ID NO: 613069 - RNA, 21 nt, Escherichia coli CFT073
ucaaaggucuuaauuuuggua

SEQ ID NO: 613070 - RNA, 23 nt, Escherichia coli CFT073
ucaaaggugccaaugauuuugau

SEQ ID NO: 613071 - RNA, 14 nt, Escherichia coli CFT073
ucaaauaaagaagu

SEQ ID NO: 613072 - RNA, 18 nt, Escherichia coli CFT073
ucaaaguuaguaaaacua

SEQ ID NO: 613073 - RNA, 14 nt, Escherichia coli CFT073
ucaaaguucugcgu

SEQ ID NO: 613074 - RNA, 18 nt, Escherichia coli CFT073
ucaaaguuuugugcuuug

SEQ ID NO: 613075 - RNA, 13 nt, Escherichia coli CFT073
uauuuuccagauu

SEQ ID NO: 613076 - RNA, 21 nt, Escherichia coli CFT073
uauuuuccgagguuaauauuu

SEQ ID NO: 613077 - RNA, 20 nt, Escherichia coli CFT073
uauuuuccgagguuaauauu

SEQ ID NO: 613078 - RNA, 22 nt, Escherichia coli CFT073
uauuuucaggggagcuuugauu

SEQ ID NO: 613079 - RNA, 17 nt, Escherichia coli CFT073
uauuuugcuuccggcaa

SEQ ID NO: 613080 - RNA, 15 nt, Escherichia coli CFT073
uauuuugcuuuaagu

SEQ ID NO: 613081 - RNA, 17 nt, Escherichia coli CFT073
uauuuuuauaacuauau

SEQ ID NO: 613082 - RNA, 17 nt, Escherichia coli CFT073
uauuuuuuuaauuguga

SEQ ID NO: 613083 - RNA, 18 nt, Escherichia coli CFT073
uauuuuuuuccuaaaccc

SEQ ID NO: 613084 - RNA, 22 nt, Escherichia coli CFT073
ucaaaaaaaucuucacugaaua

SEQ ID NO: 613085 - RNA, 14 nt, Escherichia coli CFT073
ucaaaaaagucaga

SEQ ID NO: 613086 - RNA, 23 nt, Escherichia coli CFT073
ucaaaagcguaccgccaauuacc

SEQ ID NO: 613087 - RNA, 13 nt, Escherichia coli CFT073
uauuuauuuccuu

SEQ ID NO: 613088 - RNA, 16 nt, Escherichia coli CFT073
uauuuauccauaauuu

SEQ ID NO: 613089 - RNA, 15 nt, Escherichia coli CFT073
uauuuauuaauccag

SEQ ID NO: 613090 - RNA, 13 nt, Escherichia coli CFT073
uauuuccccauuc

SEQ ID NO: 613091 - RNA, 19 nt, Escherichia coli CFT073
uauuuccuucgcuuuaauu

SEQ ID NO: 613092 - RNA, 18 nt, Escherichia coli CFT073
uauuucgucgcaucacag

SEQ ID NO: 613093 - RNA, 16 nt, Escherichia coli CFT073
uauuucucauuuugau

SEQ ID NO: 613094 - RNA, 19 nt, Escherichia coli CFT073
uauuucacauauucauuac

SEQ ID NO: 613095 - RNA, 13 nt, Escherichia coli CFT073
uauuucagcccca

SEQ ID NO: 613096 - RNA, 22 nt, Escherichia coli CFT073
uauuucauagauuaauuuccca

SEQ ID NO: 613097 - RNA, 13 nt, Escherichia coli CFT073
uauuucauuuuau

SEQ ID NO: 613098 - RNA, 20 nt, Escherichia coli CFT073
uauuuccagcucaaccagau

SEQ ID NO: 613099 - RNA, 14 nt, Escherichia coli CFT073
uauuuguucagcaa

SEQ ID NO: 613100 - RNA, 23 nt, Escherichia coli CFT073
uauuuguuuuucaggaaauaaau

SEQ ID NO: 613101 - RNA, 21 nt, Escherichia coli CFT073
uauuuggcugccgagcaaauc

SEQ ID NO: 613102 - RNA, 12 nt, Escherichia coli CFT073
uauuugaauucc

SEQ ID NO: 613103 - RNA, 22 nt, Escherichia coli CFT073
uauuugacccgcaguaaaucag

SEQ ID NO: 613104 - RNA, 11 nt, Escherichia coli CFT073
uauuucugguc

SEQ ID NO: 613105 - RNA, 15 nt, Escherichia coli CFT073
uauuucuuuaucacc

SEQ ID NO: 613106 - RNA, 18 nt, Escherichia coli CFT073
uauuugaguucacugccg

SEQ ID NO: 613107 - RNA, 23 nt, Escherichia coli CFT073
uauuugccaaacgcguccaucac

SEQ ID NO: 613108 - RNA, 18 nt, Escherichia coli CFT073
uauuguuugucgccuuuu

SEQ ID NO: 613109 - RNA, 19 nt, Escherichia coli CFT073
uauuguuuagcguuauauu

SEQ ID NO: 613110 - RNA, 21 nt, Escherichia coli CFT073
uauuuaaacccuuucugcugc

SEQ ID NO: 613111 - RNA, 17 nt, Escherichia coli CFT073
uauuuaaacuucacgcu

SEQ ID NO: 613112 - RNA, 12 nt, Escherichia coli CFT073
uauuuaacaauu

SEQ ID NO: 613113 - RNA, 18 nt, Escherichia coli CFT073
uauuuaagccugcaucac

SEQ ID NO: 613114 - RNA, 17 nt, Escherichia coli CFT073
uauugcggcauuugucu

SEQ ID NO: 613115 - RNA, 15 nt, Escherichia coli CFT073
uauugcgucuguucu

SEQ ID NO: 613116 - RNA, 15 nt, Escherichia coli CFT073
uauugcuguaaagua

SEQ ID NO: 613117 - RNA, 14 nt, Escherichia coli CFT073
uauugcugaaaagg

SEQ ID NO: 613118 - RNA, 13 nt, Escherichia coli CFT073
uauugccucaugc

SEQ ID NO: 613119 - RNA, 21 nt, Escherichia coli CFT073
uauugccgacgguauuaacuc

SEQ ID NO: 613120 - RNA, 23 nt, Escherichia coli CFT073
uauuggagaauauguuuuuaaac

SEQ ID NO: 613121 - RNA, 15 nt, Escherichia coli CFT073
uauugcugcaccagc

SEQ ID NO: 613122 - RNA, 13 nt, Escherichia coli CFT073
uauugcuuugcug

SEQ ID NO: 613123 - RNA, 15 nt, Escherichia coli CFT073
uauugguguugugaa

SEQ ID NO: 613124 - RNA, 21 nt, Escherichia coli CFT073
uauugauucaucucuucuucc

SEQ ID NO: 613125 - RNA, 17 nt, Escherichia coli CFT073
uauugauuguuuuaaau

SEQ ID NO: 613126 - RNA, 21 nt, Escherichia coli CFT073
uauugaugcacaccaucgcau

SEQ ID NO: 613127 - RNA, 20 nt, Escherichia coli CFT073
uauugcaccagaucuuccag

SEQ ID NO: 613128 - RNA, 22 nt, Escherichia coli CFT073
uauugcauuggguguaaacguu

SEQ ID NO: 613129 - RNA, 23 nt, Escherichia coli CFT073
uauugagcgaccgcuucaaaguu

SEQ ID NO: 613130 - RNA, 20 nt, Escherichia coli CFT073
uauugaccguuucgccagac

SEQ ID NO: 613131 - RNA, 14 nt, Escherichia coli CFT073
uauucccuugcucu

SEQ ID NO: 613132 - RNA, 12 nt, Escherichia coli CFT073
uauuccccagac

SEQ ID NO: 613133 - RNA, 18 nt, Escherichia coli CFT073
uauuccccggucagcagc

SEQ ID NO: 613134 - RNA, 19 nt, Escherichia coli CFT073
uauuccgcgugaaaugcca

SEQ ID NO: 613135 - RNA, 16 nt, Escherichia coli CFT073
uauuccgcaccugcca

SEQ ID NO: 613136 - RNA, 18 nt, Escherichia coli CFT073
uauuccgcaccugccagc

SEQ ID NO: 613137 - RNA, 23 nt, Escherichia coli CFT073
uauucccgcgcuaccacuuccca

SEQ ID NO: 613138 - RNA, 20 nt, Escherichia coli CFT073
uauucccguauuacugagau

SEQ ID NO: 613139 - RNA, 18 nt, Escherichia coli CFT073
uauucauuaauaaccauu

SEQ ID NO: 613140 - RNA, 18 nt, Escherichia coli CFT073
uauucaugcccugcccgc

SEQ ID NO: 613141 - RNA, 12 nt, Escherichia coli CFT073
uauuccaguuca

SEQ ID NO: 613142 - RNA, 14 nt, Escherichia coli CFT073
uauuccauccugcu

SEQ ID NO: 613143 - RNA, 24 nt, Escherichia coli CFT073
uauucaucgccggaguacgccauu

SEQ ID NO: 613144 - RNA, 14 nt, Escherichia coli CFT073
uauucauaaaugcu

SEQ ID NO: 613145 - RNA, 21 nt, Escherichia coli CFT073
uauucacuacggucacgccac

SEQ ID NO: 613146 - RNA, 13 nt, Escherichia coli CFT073
uauucaccacuac

SEQ ID NO: 613147 - RNA, 14 nt, Escherichia coli CFT073
uauucaccacuacc

SEQ ID NO: 613148 - RNA, 16 nt, Escherichia coli CFT073
uauucacuugccugcu

SEQ ID NO: 613149 - RNA, 19 nt, Escherichia coli CFT073
uauucagaauuuuuaaccg

SEQ ID NO: 613150 - RNA, 21 nt, Escherichia coli CFT073
uauucagaucuugcucuacca

SEQ ID NO: 613151 - RNA, 14 nt, Escherichia coli CFT073
uauucagcagcaga

SEQ ID NO: 613152 - RNA, 19 nt, Escherichia coli CFT073
uauucagccugacuggugg

SEQ ID NO: 613153 - RNA, 15 nt, Escherichia coli CFT073
uauucaacgugagau

SEQ ID NO: 613154 - RNA, 18 nt, Escherichia coli CFT073
uauucggccuaccaugau

SEQ ID NO: 613155 - RNA, 20 nt, Escherichia coli CFT073
uauucgucgcagcuauccug

SEQ ID NO: 613156 - RNA, 18 nt, Escherichia coli CFT073
uauucgccccuucagaag

SEQ ID NO: 613157 - RNA, 14 nt, Escherichia coli CFT073
uauucuuuuuugau

SEQ ID NO: 613158 - RNA, 22 nt, Escherichia coli CFT073
uauucugguaaucgcaaagcug

SEQ ID NO: 613159 - RNA, 17 nt, Escherichia coli CFT073
uauucuggcuaaccaaa

SEQ ID NO: 613160 - RNA, 19 nt, Escherichia coli CFT073
uauuagcagugauuuauuu

SEQ ID NO: 613161 - RNA, 17 nt, Escherichia coli CFT073
uauuacuauggauauaa

SEQ ID NO: 613162 - RNA, 18 nt, Escherichia coli CFT073
uauuacugcgaauuuccu

SEQ ID NO: 613163 - RNA, 21 nt, Escherichia coli CFT073
uauuacugcgaauuuccugcc

SEQ ID NO: 613164 - RNA, 14 nt, Escherichia coli CFT073
uauuaguuaaauga

SEQ ID NO: 613165 - RNA, 20 nt, Escherichia coli CFT073
uauuauggugacaaacacag

SEQ ID NO: 613166 - RNA, 15 nt, Escherichia coli CFT073
uauuauuaaaccagg

SEQ ID NO: 613167 - RNA, 21 nt, Escherichia coli CFT073
uauuaucccccgauaaaacau

SEQ ID NO: 613168 - RNA, 15 nt, Escherichia coli CFT073
uauuauauaccauau

SEQ ID NO: 613169 - RNA, 15 nt, Escherichia coli CFT073
uauuaaccucucaga

SEQ ID NO: 613170 - RNA, 18 nt, Escherichia coli CFT073
uauuaauaccagaauaag

SEQ ID NO: 613171 - RNA, 13 nt, Escherichia coli CFT073
uauuaauauauau

SEQ ID NO: 613172 - RNA, 16 nt, Escherichia coli CFT073
uauuaaccaauaagua

SEQ ID NO: 613173 - RNA, 17 nt, Escherichia coli CFT073
uauuaaagcuuuaauuu

SEQ ID NO: 613174 - RNA, 11 nt, Escherichia coli CFT073
uauuaaauggc

SEQ ID NO: 613175 - RNA, 12 nt, Escherichia coli CFT073
uauuaaaccacc

SEQ ID NO: 613176 - RNA, 24 nt, Escherichia coli CFT073
uauuaaaccacccgcggcgaucug

SEQ ID NO: 613177 - RNA, 22 nt, Escherichia coli CFT073
uauuaauccagggaucaacauu

SEQ ID NO: 613178 - RNA, 21 nt, Escherichia coli CFT073
uauuaauccauaaccauaauu

SEQ ID NO: 613179 - RNA, 23 nt, Escherichia coli CFT073
uauuaauuuguaugguauaucgu

SEQ ID NO: 613180 - RNA, 20 nt, Escherichia coli CFT073
uauuacagccgggagugaau

SEQ ID NO: 613181 - RNA, 15 nt, Escherichia coli CFT073
uauuacccuuuauuu

SEQ ID NO: 613182 - RNA, 23 nt, Escherichia coli CFT073
uauuacuccacuuccugccaguu

SEQ ID NO: 613183 - RNA, 15 nt, Escherichia coli CFT073
uauuacucuccagac

SEQ ID NO: 613184 - RNA, 21 nt, Escherichia coli CFT073
uauuacugaccuccaguccca

SEQ ID NO: 613185 - RNA, 17 nt, Escherichia coli CFT073
uaaagcgcaugaugucu

SEQ ID NO: 613186 - RNA, 19 nt, Escherichia coli CFT073
uaaagcgcgaucgcuaccu

SEQ ID NO: 613187 - RNA, 18 nt, Escherichia coli CFT073
uaaagcguuccagcagcu

SEQ ID NO: 613188 - RNA, 13 nt, Escherichia coli CFT073
uaaagcguccagc

SEQ ID NO: 613189 - RNA, 14 nt, Escherichia coli CFT073
uaaaggucaauucc

SEQ ID NO: 613190 - RNA, 15 nt, Escherichia coli CFT073
uaaaggucaucacau

SEQ ID NO: 613191 - RNA, 23 nt, Escherichia coli CFT073
uaaagccgugaguauauuucagg

SEQ ID NO: 613192 - RNA, 16 nt, Escherichia coli CFT073
uaaagccugcuggcag

SEQ ID NO: 613193 - RNA, 14 nt, Escherichia coli CFT073
uaaagccuuuuacc

SEQ ID NO: 613194 - RNA, 19 nt, Escherichia coli CFT073
uaaagcccauaccacagca

SEQ ID NO: 613195 - RNA, 16 nt, Escherichia coli CFT073
uaaagcccaucguuga

SEQ ID NO: 613196 - RNA, 16 nt, Escherichia coli CFT073
uaaagagaucaaaguc

SEQ ID NO: 613197 - RNA, 21 nt, Escherichia coli CFT073
uaaagagaucaaagucucugu

SEQ ID NO: 613198 - RNA, 12 nt, Escherichia coli CFT073
uaaacuuucaua

SEQ ID NO: 613199 - RNA, 14 nt, Escherichia coli CFT073
uaaacuuuagcaca

SEQ ID NO: 613200 - RNA, 14 nt, Escherichia coli CFT073
uaaacuucacgcuc

SEQ ID NO: 613201 - RNA, 13 nt, Escherichia coli CFT073
uaaaccaaagccc

SEQ ID NO: 613202 - RNA, 16 nt, Escherichia coli CFT073
uaaaccaaccagcgug

SEQ ID NO: 613203 - RNA, 22 nt, Escherichia coli CFT073
uaaaccaacuucauacauugcc

SEQ ID NO: 613204 - RNA, 15 nt, Escherichia coli CFT073
uaaaccacaucagcg

SEQ ID NO: 613205 - RNA, 15 nt, Escherichia coli CFT073
uaaaccacccaccag

SEQ ID NO: 613206 - RNA, 20 nt, Escherichia coli CFT073
uaaaccacccaccagcgccg

SEQ ID NO: 613207 - RNA, 23 nt, Escherichia coli CFT073
uaaaccacugacacaggcagcaa

SEQ ID NO: 613208 - RNA, 23 nt, Escherichia coli CFT073
uaaaccgcaucauguaaaucaau

SEQ ID NO: 613209 - RNA, 19 nt, Escherichia coli CFT073
uaaaccggacaauaaaaaa

SEQ ID NO: 613210 - RNA, 19 nt, Escherichia coli CFT073
uaaaccguccccaaaaaag

SEQ ID NO: 613211 - RNA, 19 nt, Escherichia coli CFT073
uaaaccguggcaaaaucca

SEQ ID NO: 613212 - RNA, 13 nt, Escherichia coli CFT073
uaaacuucaccag

SEQ ID NO: 613213 - RNA, 17 nt, Escherichia coli CFT073
uaaacuucaacgcugcg

SEQ ID NO: 613214 - RNA, 18 nt, Escherichia coli CFT073
uaaacgguuucagcagug

SEQ ID NO: 613215 - RNA, 19 nt, Escherichia coli CFT073
uaaacguacuggcgauugu

SEQ ID NO: 613216 - RNA, 19 nt, Escherichia coli CFT073
uaaacgacccugccacagu

SEQ ID NO: 613217 - RNA, 16 nt, Escherichia coli CFT073
uaaacgaaucugcaaa

SEQ ID NO: 613218 - RNA, 16 nt, Escherichia coli CFT073
uaaaccuuguuuaauc

SEQ ID NO: 613219 - RNA, 13 nt, Escherichia coli CFT073
uaaaccuccagca

SEQ ID NO: 613220 - RNA, 17 nt, Escherichia coli CFT073
uaaaccuccagcaucag

SEQ ID NO: 613221 - RNA, 21 nt, Escherichia coli CFT073
uaaaccugcucaccagucacu

SEQ ID NO: 613222 - RNA, 20 nt, Escherichia coli CFT073
uaaaugacgggccaagcagg

SEQ ID NO: 613223 - RNA, 18 nt, Escherichia coli CFT073
uaaauggcacagugguca

SEQ ID NO: 613224 - RNA, 22 nt, Escherichia coli CFT073
uaaauggcgaacgggauaaacg

SEQ ID NO: 613225 - RNA, 19 nt, Escherichia coli CFT073
uaaauggcguaugccggau

SEQ ID NO: 613226 - RNA, 18 nt, Escherichia coli CFT073
uaaauauuuuuuagcaca

SEQ ID NO: 613227 - RNA, 21 nt, Escherichia coli CFT073
uaaauauuuuuuagcacaaga

SEQ ID NO: 613228 - RNA, 14 nt, Escherichia coli CFT073
uaaaucugccguca

SEQ ID NO: 613229 - RNA, 15 nt, Escherichia coli CFT073
uaaaucuucaagcau

SEQ ID NO: 613230 - RNA, 14 nt, Escherichia coli CFT073
uaaaucuucuucuu

SEQ ID NO: 613231 - RNA, 15 nt, Escherichia coli CFT073
uaaauaaucucuucc

SEQ ID NO: 613232 - RNA, 17 nt, Escherichia coli CFT073
uaaaguaacgaauaauc

SEQ ID NO: 613233 - RNA, 18 nt, Escherichia coli CFT073
uaaaguacgcuuucccuu

SEQ ID NO: 613234 - RNA, 17 nt, Escherichia coli CFT073
uaaaguacucuuugaac

SEQ ID NO: 613235 - RNA, 14 nt, Escherichia coli CFT073
uaaauaaaaacccg

SEQ ID NO: 613236 - RNA, 15 nt, Escherichia coli CFT073
uaaauaaacaccagc

SEQ ID NO: 613237 - RNA, 16 nt, Escherichia coli CFT073
uaaauaaacaccagca

SEQ ID NO: 613238 - RNA, 19 nt, Escherichia coli CFT073
uaaauuauuugcguagucu

SEQ ID NO: 613239 - RNA, 21 nt, Escherichia coli CFT073
uaaauuauagaugcagcauag

SEQ ID NO: 613240 - RNA, 22 nt, Escherichia coli CFT073
uaaauuauagaugcagcauaga

SEQ ID NO: 613241 - RNA, 16 nt, Escherichia coli CFT073
uaaauuaauggccuca

SEQ ID NO: 613242 - RNA, 23 nt, Escherichia coli CFT073
uaaauugcaguacgauaauggcu

SEQ ID NO: 613243 - RNA, 14 nt, Escherichia coli CFT073
uaaauuuaauaucu

SEQ ID NO: 613244 - RNA, 16 nt, Escherichia coli CFT073
uaaauuccgcucugua

SEQ ID NO: 613245 - RNA, 17 nt, Escherichia coli CFT073
uaaauucgccagacagu

SEQ ID NO: 613246 - RNA, 20 nt, Escherichia coli CFT073
uaaauugcaauuuuuauaug

SEQ ID NO: 613247 - RNA, 21 nt, Escherichia coli CFT073
uaaauuuuaagccauuaaauc

SEQ ID NO: 613248 - RNA, 15 nt, Escherichia coli CFT073
uaaauuucaggcaac

SEQ ID NO: 613249 - RNA, 19 nt, Escherichia coli CFT073
uaaauuucaggcaacaaaa

SEQ ID NO: 613250 - RNA, 20 nt, Escherichia coli CFT073
uaaauuucaggcaacaaaaa

SEQ ID NO: 613251 - RNA, 19 nt, Escherichia coli CFT073
uaaauuugccaucucugca

SEQ ID NO: 613252 - RNA, 16 nt, Escherichia coli CFT073
uaacacagcaauaaua

SEQ ID NO: 613253 - RNA, 18 nt, Escherichia coli CFT073
uaacacagcaauaauaau

SEQ ID NO: 613254 - RNA, 14 nt, Escherichia coli CFT073
uaacacacaauuac

SEQ ID NO: 613255 - RNA, 12 nt, Escherichia coli CFT073
uaacacaugcaa

SEQ ID NO: 613256 - RNA, 21 nt, Escherichia coli CFT073
uaacaaagggaaacgcggcgu

SEQ ID NO: 613257 - RNA, 16 nt, Escherichia coli CFT073
uaacaaauaauugcca

SEQ ID NO: 613258 - RNA, 14 nt, Escherichia coli CFT073
uaacaaauacgcuu

SEQ ID NO: 613259 - RNA, 16 nt, Escherichia coli CFT073
uaacaaaugugccauu

SEQ ID NO: 613260 - RNA, 14 nt, Escherichia coli CFT073
uaacaauuaucugg

SEQ ID NO: 613261 - RNA, 14 nt, Escherichia coli CFT073
uaacaauucuccaa

SEQ ID NO: 613262 - RNA, 17 nt, Escherichia coli CFT073
uaacaccaguuuccagu

SEQ ID NO: 613263 - RNA, 17 nt, Escherichia coli CFT073
uaacagauugagaauaa

SEQ ID NO: 613264 - RNA, 17 nt, Escherichia coli CFT073
uaacagcaaaacacccc

SEQ ID NO: 613265 - RNA, 11 nt, Escherichia coli CFT073
uaacagcagca

SEQ ID NO: 613266 - RNA, 13 nt, Escherichia coli CFT073
uaacauuacuaaa

SEQ ID NO: 613267 - RNA, 18 nt, Escherichia coli CFT073
uaacauuacuaaacauuu

SEQ ID NO: 613268 - RNA, 15 nt, Escherichia coli CFT073
uaacagcgcaccaga

SEQ ID NO: 613269 - RNA, 22 nt, Escherichia coli CFT073
uaacagcgcaccagaaacaaua

SEQ ID NO: 613270 - RNA, 20 nt, Escherichia coli CFT073
uaacagcgccgcgauaaaau

SEQ ID NO: 613271 - RNA, 17 nt, Escherichia coli CFT073
uaacaugagauccagcg

SEQ ID NO: 613272 - RNA, 21 nt, Escherichia coli CFT073
uaaccagcguuuccagcacca

SEQ ID NO: 613273 - RNA, 21 nt, Escherichia coli CFT073
uaacauuuuaguuuacauuaa

SEQ ID NO: 613274 - RNA, 17 nt, Escherichia coli CFT073
uaacauuggucagagca

SEQ ID NO: 613275 - RNA, 22 nt, Escherichia coli CFT073
uaacccgagaucuuuaauacac

SEQ ID NO: 613276 - RNA, 13 nt, Escherichia coli CFT073
uaaccauccacau

SEQ ID NO: 613277 - RNA, 12 nt, Escherichia coli CFT073
uaaccaucccuu

SEQ ID NO: 613278 - RNA, 14 nt, Escherichia coli CFT073
uaacgcguuaucag

SEQ ID NO: 613279 - RNA, 21 nt, Escherichia coli CFT073
uaacgcagcaaaagcaggcac

SEQ ID NO: 613280 - RNA, 16 nt, Escherichia coli CFT073
uaacgaugccagcgcu

SEQ ID NO: 613281 - RNA, 14 nt, Escherichia coli CFT073
uaacgcacaaccag

SEQ ID NO: 613282 - RNA, 20 nt, Escherichia coli CFT073
uaacgcagaaucuucuucuc

SEQ ID NO: 613283 - RNA, 23 nt, Escherichia coli CFT073
uaacgaaggugaacgccaccaac

SEQ ID NO: 613284 - RNA, 16 nt, Escherichia coli CFT073
uaacgaauaauccagc

SEQ ID NO: 613285 - RNA, 20 nt, Escherichia coli CFT073
uaacgaacgcagugauaacu

SEQ ID NO: 613286 - RNA, 19 nt, Escherichia coli CFT073
uaaccuuugaacagccaga

SEQ ID NO: 613287 - RNA, 16 nt, Escherichia coli CFT073
uaaccuuuuagcugug

SEQ ID NO: 613288 - RNA, 17 nt, Escherichia coli CFT073
uaaccgcuuaagcugcc

SEQ ID NO: 613289 - RNA, 22 nt, Escherichia coli CFT073
uaacccuucauauuccugaccc

SEQ ID NO: 613290 - RNA, 14 nt, Escherichia coli CFT073
uaaccgccaccagg

SEQ ID NO: 613291 - RNA, 18 nt, Escherichia coli CFT073
uaaccgagaauuuccaga

SEQ ID NO: 613292 - RNA, 18 nt, Escherichia coli CFT073
uaaccucaugguuuuuau

SEQ ID NO: 613293 - RNA, 21 nt, Escherichia coli CFT073
uaaccguugguuauccuggua

SEQ ID NO: 613294 - RNA, 20 nt, Escherichia coli CFT073
uaaccguuuguuuuuuaagg

SEQ ID NO: 613295 - RNA, 16 nt, Escherichia coli CFT073
uaaccguccaguugug

SEQ ID NO: 613296 - RNA, 21 nt, Escherichia coli CFT073
uaaccgguacgccgcguuuau

SEQ ID NO: 613297 - RNA, 20 nt, Escherichia coli CFT073
uaaccgguauugcuccagau

SEQ ID NO: 613298 - RNA, 16 nt, Escherichia coli CFT073
uaaaaucagcuuccuu

SEQ ID NO: 613299 - RNA, 12 nt, Escherichia coli CFT073
uaaaaucacagg

SEQ ID NO: 613300 - RNA, 18 nt, Escherichia coli CFT073
uaaaaguaaauaagaaaa

SEQ ID NO: 613301 - RNA, 22 nt, Escherichia coli CFT073
uaaaaguuuccuguuucucauu

SEQ ID NO: 613302 - RNA, 20 nt, Escherichia coli CFT073
uaaaagcgcgcccaacagua

SEQ ID NO: 613303 - RNA, 15 nt, Escherichia coli CFT073
uaaaagcgugaaaca

SEQ ID NO: 613304 - RNA, 20 nt, Escherichia coli CFT073
uaaaagccaggagccaacac

SEQ ID NO: 613305 - RNA, 14 nt, Escherichia coli CFT073
uaaaagccccuucg

SEQ ID NO: 613306 - RNA, 21 nt, Escherichia coli CFT073
uaaaagcauagccccagcgca

SEQ ID NO: 613307 - RNA, 13 nt, Escherichia coli CFT073
uaaaagccaggag

SEQ ID NO: 613308 - RNA, 21 nt, Escherichia coli CFT073
uaaaagcacagaaucuaagau

SEQ ID NO: 613309 - RNA, 14 nt, Escherichia coli CFT073
uaaaagcaaacugu

SEQ ID NO: 613310 - RNA, 13 nt, Escherichia coli CFT073
uaaaacuucauuu

SEQ ID NO: 613311 - RNA, 23 nt, Escherichia coli CFT073
uaaaacuucauuugucucaaaac

SEQ ID NO: 613312 - RNA, 16 nt, Escherichia coli CFT073
uaaaacuuuauucagu

SEQ ID NO: 613313 - RNA, 23 nt, Escherichia coli CFT073
uaaaaccggugugguaaauuuug

SEQ ID NO: 613314 - RNA, 19 nt, Escherichia coli CFT073
uaaaacagccuuguauuaa

SEQ ID NO: 613315 - RNA, 12 nt, Escherichia coli CFT073
uaaaacauuacu

SEQ ID NO: 613316 - RNA, 19 nt, Escherichia coli CFT073
uaaaacaucucuucccacg

SEQ ID NO: 613317 - RNA, 14 nt, Escherichia coli CFT073
uaaaaccgugcuuc

SEQ ID NO: 613318 - RNA, 17 nt, Escherichia coli CFT073
uaaaaccgugcuucagc

SEQ ID NO: 613319 - RNA, 11 nt, Escherichia coli CFT073
uaaaaaccaga

SEQ ID NO: 613320 - RNA, 17 nt, Escherichia coli CFT073
uaaaaauauauuccuau

SEQ ID NO: 613321 - RNA, 21 nt, Escherichia coli CFT073
uaaaaauauauuccuauauau

SEQ ID NO: 613322 - RNA, 15 nt, Escherichia coli CFT073
uaaaaacagccagca

SEQ ID NO: 613323 - RNA, 13 nt, Escherichia coli CFT073
uaaaacaauuaac

SEQ ID NO: 613324 - RNA, 16 nt, Escherichia coli CFT073
uaaaaaucaaaugcug

SEQ ID NO: 613325 - RNA, 22 nt, Escherichia coli CFT073
uaaaaaagaaaugccugcacuu

SEQ ID NO: 613326 - RNA, 13 nt, Escherichia coli CFT073
uaaaaaacagugc

SEQ ID NO: 613327 - RNA, 19 nt, Escherichia coli CFT073
uaaaaaacagugcuucuaa

SEQ ID NO: 613328 - RNA, 13 nt, Escherichia coli CFT073
uaaaaaaauuaau

SEQ ID NO: 613329 - RNA, 22 nt, Escherichia coli CFT073
uaaaaaaggcaccgauuccccc

SEQ ID NO: 613330 - RNA, 18 nt, Escherichia coli CFT073
guuuuuucuguauucauc

SEQ ID NO: 613331 - RNA, 23 nt, Escherichia coli CFT073
guuuuuucgcuugaucuuccuga

SEQ ID NO: 613332 - RNA, 22 nt, Escherichia coli CFT073
guuuuuuauauucaugaauaaa

SEQ ID NO: 613333 - RNA, 23 nt, Escherichia coli CFT073
guuuuuuuauaucucagauaaau

SEQ ID NO: 613334 - RNA, 21 nt, Escherichia coli CFT073
uaaaaaaagaacaaccaagac

SEQ ID NO: 613335 - RNA, 19 nt, Escherichia coli CFT073
uaaaaaaacuuuugucauu

SEQ ID NO: 613336 - RNA, 17 nt, Escherichia coli CFT073
uaaaaaaaugaguauua

SEQ ID NO: 613337 - RNA, 22 nt, Escherichia coli CFT073
uaaaaaaacgcgugccucuucu

SEQ ID NO: 613338 - RNA, 10 nt, Escherichia coli CFT073
guuuuugcau

SEQ ID NO: 613339 - RNA, 12 nt, Escherichia coli CFT073
guuuuugcuucu

SEQ ID NO: 613340 - RNA, 12 nt, Escherichia coli CFT073
guuuuucuuccg

SEQ ID NO: 613341 - RNA, 12 nt, Escherichia coli CFT073
guuuuucuuuuu

SEQ ID NO: 613342 - RNA, 19 nt, Escherichia coli CFT073
guuuuucggaucgaggcga

SEQ ID NO: 613343 - RNA, 12 nt, Escherichia coli CFT073
guuuuucauccc

SEQ ID NO: 613344 - RNA, 22 nt, Escherichia coli CFT073
guuuuucauugcacucuccucc

SEQ ID NO: 613345 - RNA, 12 nt, Escherichia coli CFT073
guuuuuccagcu

SEQ ID NO: 613346 - RNA, 15 nt, Escherichia coli CFT073
guuuuucccuucccg

SEQ ID NO: 613347 - RNA, 14 nt, Escherichia coli CFT073
guuuuguggcaaac

SEQ ID NO: 613348 - RNA, 13 nt, Escherichia coli CFT073
guuuuuaaaccaa

SEQ ID NO: 613349 - RNA, 17 nt, Escherichia coli CFT073
guuuugcaucaacugcg

SEQ ID NO: 613350 - RNA, 17 nt, Escherichia coli CFT073
guuuugcggcgugaccu

SEQ ID NO: 613351 - RNA, 20 nt, Escherichia coli CFT073
guuuuggcugugaauuacug

SEQ ID NO: 613352 - RNA, 17 nt, Escherichia coli CFT073
guuuugcuguuccagca

SEQ ID NO: 613353 - RNA, 22 nt, Escherichia coli CFT073
guuuugguuaacugaauauucc

SEQ ID NO: 613354 - RNA, 20 nt, Escherichia coli CFT073
guuuugaaaagaguucaucg

SEQ ID NO: 613355 - RNA, 17 nt, Escherichia coli CFT073
guuuucucuuuccagca

SEQ ID NO: 613356 - RNA, 14 nt, Escherichia coli CFT073
guuuucuccagcgc

SEQ ID NO: 613357 - RNA, 17 nt, Escherichia coli CFT073
guuuuaccggcaacucu

SEQ ID NO: 613358 - RNA, 20 nt, Escherichia coli CFT073
guuuuacauugauagcccaa

SEQ ID NO: 613359 - RNA, 19 nt, Escherichia coli CFT073
guuuuacaauauccagcgc

SEQ ID NO: 613360 - RNA, 20 nt, Escherichia coli CFT073
guuuuacaauauccagcgcg

SEQ ID NO: 613361 - RNA, 23 nt, Escherichia coli CFT073
guuuuacaauguccguaacauaa

SEQ ID NO: 613362 - RNA, 17 nt, Escherichia coli CFT073
guuuguccgccagaaau

SEQ ID NO: 613363 - RNA, 18 nt, Escherichia coli CFT073
guuuuauuauuccauccu

SEQ ID NO: 613364 - RNA, 16 nt, Escherichia coli CFT073
guuuuaucuccauccg

SEQ ID NO: 613365 - RNA, 17 nt, Escherichia coli CFT073
guuuuaguaguugugug

SEQ ID NO: 613366 - RNA, 20 nt, Escherichia coli CFT073
guuuuccgcuucuucuucca

SEQ ID NO: 613367 - RNA, 17 nt, Escherichia coli CFT073
guuuuccagggccagua

SEQ ID NO: 613368 - RNA, 18 nt, Escherichia coli CFT073
guuuuccagggccaguac

SEQ ID NO: 613369 - RNA, 17 nt, Escherichia coli CFT073
guuuucgauuuuuucca

SEQ ID NO: 613370 - RNA, 20 nt, Escherichia coli CFT073
guuuucgauuuuuuccagcg

SEQ ID NO: 613371 - RNA, 20 nt, Escherichia coli CFT073
guuuucuacuuuguaaacga

SEQ ID NO: 613372 - RNA, 14 nt, Escherichia coli CFT073
guuuucuacuuuuu

SEQ ID NO: 613373 - RNA, 16 nt, Escherichia coli CFT073
guuuucuacuuuuucu

SEQ ID NO: 613374 - RNA, 20 nt, Escherichia coli CFT073
guuuucgucaacguagcuau

SEQ ID NO: 613375 - RNA, 18 nt, Escherichia coli CFT073
guuuucguuacuccgcca

SEQ ID NO: 613376 - RNA, 24 nt, Escherichia coli CFT073
guuugccccauugcucuuucacuu

SEQ ID NO: 613377 - RNA, 17 nt, Escherichia coli CFT073
guuugcccuucacaggu

SEQ ID NO: 613378 - RNA, 16 nt, Escherichia coli CFT073
guuugcaauuugcagc

SEQ ID NO: 613379 - RNA, 15 nt, Escherichia coli CFT073
guuugcauccaguuc

SEQ ID NO: 613380 - RNA, 15 nt, Escherichia coli CFT073
guuugcgcccaguua

SEQ ID NO: 613381 - RNA, 20 nt, Escherichia coli CFT073
guuugcgcgacguugcuucu

SEQ ID NO: 613382 - RNA, 17 nt, Escherichia coli CFT073
guuugcgggacaacuug

SEQ ID NO: 613383 - RNA, 18 nt, Escherichia coli CFT073
guuucuucgaagaaaaac

SEQ ID NO: 613384 - RNA, 21 nt, Escherichia coli CFT073
guuucugucgagcaucacuau

SEQ ID NO: 613385 - RNA, 22 nt, Escherichia coli CFT073
guuucuggcguaccggagacga

SEQ ID NO: 613386 - RNA, 20 nt, Escherichia coli CFT073
guuucugcgcuucugccacg

SEQ ID NO: 613387 - RNA, 17 nt, Escherichia coli CFT073
guuucuacaagcagaga

SEQ ID NO: 613388 - RNA, 18 nt, Escherichia coli CFT073
guuucuacaagcagagag

SEQ ID NO: 613389 - RNA, 13 nt, Escherichia coli CFT073
guuuguagcagaa

SEQ ID NO: 613390 - RNA, 21 nt, Escherichia coli CFT073
guuuguuaaccaccaguaaau

SEQ ID NO: 613391 - RNA, 16 nt, Escherichia coli CFT073
guuuguucaagcgcaa

SEQ ID NO: 613392 - RNA, 21 nt, Escherichia coli CFT073
guuuguuucccccacugugca

SEQ ID NO: 613393 - RNA, 22 nt, Escherichia coli CFT073
guuugcuggcaaugaguaguuu

SEQ ID NO: 613394 - RNA, 18 nt, Escherichia coli CFT073
guuuggaagaccuuccag

SEQ ID NO: 613395 - RNA, 12 nt, Escherichia coli CFT073
guuuggcaucag

SEQ ID NO: 613396 - RNA, 22 nt, Escherichia coli CFT073
guuugggccgguacuuuugccc

SEQ ID NO: 613397 - RNA, 16 nt, Escherichia coli CFT073
guuugggcguuacagc

SEQ ID NO: 613398 - RNA, 19 nt, Escherichia coli CFT073
guuugggcguuacagcugg

SEQ ID NO: 613399 - RNA, 20 nt, Escherichia coli CFT073
guucuuacccacuguaucga

SEQ ID NO: 613400 - RNA, 10 nt, Escherichia coli CFT073
guucuuauaa

SEQ ID NO: 613401 - RNA, 21 nt, Escherichia coli CFT073
guucuguggcagggcagcgau

SEQ ID NO: 613402 - RNA, 17 nt, Escherichia coli CFT073
guucuggccguacccag

SEQ ID NO: 613403 - RNA, 22 nt, Escherichia coli CFT073
guucugcguuaagacuuuuuuc

SEQ ID NO: 613404 - RNA, 19 nt, Escherichia coli CFT073
guuuaaggucguuuugccc

SEQ ID NO: 613405 - RNA, 20 nt, Escherichia coli CFT073
guuuaaggucguuuugcccg

SEQ ID NO: 613406 - RNA, 18 nt, Escherichia coli CFT073
guugugccuuccaucccu

SEQ ID NO: 613407 - RNA, 12 nt, Escherichia coli CFT073
guugugaugcaa

SEQ ID NO: 613408 - RNA, 16 nt, Escherichia coli CFT073
guugugaauguucaau

SEQ ID NO: 613409 - RNA, 14 nt, Escherichia coli CFT073
guugugcaaugucu

SEQ ID NO: 613410 - RNA, 15 nt, Escherichia coli CFT073
guuuacgcagcucac

SEQ ID NO: 613411 - RNA, 17 nt, Escherichia coli CFT073
guuuacgccggaugcgg

SEQ ID NO: 613412 - RNA, 22 nt, Escherichia coli CFT073
guuuacgcguuuuucagaacuu

SEQ ID NO: 613413 - RNA, 17 nt, Escherichia coli CFT073
guuuacgccgcaucagg

SEQ ID NO: 613414 - RNA, 18 nt, Escherichia coli CFT073
guuuacggcuaaaaaaag

SEQ ID NO: 613415 - RNA, 22 nt, Escherichia coli CFT073
guuuauuugacccgcaguaaau

SEQ ID NO: 613416 - RNA, 16 nt, Escherichia coli CFT073
guuucaaacaggcugc

SEQ ID NO: 613417 - RNA, 13 nt, Escherichia coli CFT073
guuuagacgcugc

SEQ ID NO: 613418 - RNA, 17 nt, Escherichia coli CFT073
guuuauuguugauucga

SEQ ID NO: 613419 - RNA, 15 nt, Escherichia coli CFT073
guuucaauacucugc

SEQ ID NO: 613420 - RNA, 21 nt, Escherichia coli CFT073
guuucaccgaugcacagaacc

SEQ ID NO: 613421 - RNA, 21 nt, Escherichia coli CFT073
guuucaccgcacgacgaaucu

SEQ ID NO: 613422 - RNA, 18 nt, Escherichia coli CFT073
guuucacggucggccagu

SEQ ID NO: 613423 - RNA, 18 nt, Escherichia coli CFT073
guuucaauauccgguuca

SEQ ID NO: 613424 - RNA, 11 nt, Escherichia coli CFT073
guuucaaccug

SEQ ID NO: 613425 - RNA, 12 nt, Escherichia coli CFT073
guuuccagcacc

SEQ ID NO: 613426 - RNA, 21 nt, Escherichia coli CFT073
guuuccagcaucgaccaggau

SEQ ID NO: 613427 - RNA, 15 nt, Escherichia coli CFT073
guuucguuaaacgcc

SEQ ID NO: 613428 - RNA, 23 nt, Escherichia coli CFT073
guuucgggcagccuccccagcac

SEQ ID NO: 613429 - RNA, 15 nt, Escherichia coli CFT073
guuucggugaugaau

SEQ ID NO: 613430 - RNA, 13 nt, Escherichia coli CFT073
guuucaugaagca

SEQ ID NO: 613431 - RNA, 18 nt, Escherichia coli CFT073
guuucagaccaauaaucc

SEQ ID NO: 613432 - RNA, 19 nt, Escherichia coli CFT073
guuucagcaucccaggcau

SEQ ID NO: 613433 - RNA, 17 nt, Escherichia coli CFT073
guucggcggaugcagga

SEQ ID NO: 613434 - RNA, 16 nt, Escherichia coli CFT073
guucggcguucaccag

SEQ ID NO: 613435 - RNA, 19 nt, Escherichia coli CFT073
guucguagccacgaucgau

SEQ ID NO: 613436 - RNA, 16 nt, Escherichia coli CFT073
guucgucauacuccag

SEQ ID NO: 613437 - RNA, 21 nt, Escherichia coli CFT073
guucgaacguaggccucaggu

SEQ ID NO: 613438 - RNA, 15 nt, Escherichia coli CFT073
guucgaauccuuccc

SEQ ID NO: 613439 - RNA, 23 nt, Escherichia coli CFT073
guuccggcaaucaacagauaaau

SEQ ID NO: 613440 - RNA, 21 nt, Escherichia coli CFT073
guucuccacucugccaggcag

SEQ ID NO: 613441 - RNA, 20 nt, Escherichia coli CFT073
guucucaauuaccguuguua

SEQ ID NO: 613442 - RNA, 22 nt, Escherichia coli CFT073
guucucgcgauaaaacuucugc

SEQ ID NO: 613443 - RNA, 17 nt, Escherichia coli CFT073
guucuccuggcauaaac

SEQ ID NO: 613444 - RNA, 13 nt, Escherichia coli CFT073
guucucuucacgc

SEQ ID NO: 613445 - RNA, 15 nt, Escherichia coli CFT073
guucugaauacccgc

SEQ ID NO: 613446 - RNA, 23 nt, Escherichia coli CFT073
guucugcggcguaacgcaccagg

SEQ ID NO: 613447 - RNA, 13 nt, Escherichia coli CFT073
guuccgauaaguu

SEQ ID NO: 613448 - RNA, 19 nt, Escherichia coli CFT073
guuccauuucugcggguga

SEQ ID NO: 613449 - RNA, 16 nt, Escherichia coli CFT073
guuccauugagaaaau

SEQ ID NO: 613450 - RNA, 14 nt, Escherichia coli CFT073
guucccaacaacag

SEQ ID NO: 613451 - RNA, 18 nt, Escherichia coli CFT073
guuccagggccuccugca

SEQ ID NO: 613452 - RNA, 16 nt, Escherichia coli CFT073
guuccaguucgcuggc

SEQ ID NO: 613453 - RNA, 13 nt, Escherichia coli CFT073
guucaucugacca

SEQ ID NO: 613454 - RNA, 17 nt, Escherichia coli CFT073
guucaucuacuacugga

SEQ ID NO: 613455 - RNA, 19 nt, Escherichia coli CFT073
guucauccauaccacaggu

SEQ ID NO: 613456 - RNA, 23 nt, Escherichia coli CFT073
guucauccgcuucaggaauaaga

SEQ ID NO: 613457 - RNA, 15 nt, Escherichia coli CFT073
guuccacuuugcuuu

SEQ ID NO: 613458 - RNA, 17 nt, Escherichia coli CFT073
guucaugccggaugcgg

SEQ ID NO: 613459 - RNA, 15 nt, Escherichia coli CFT073
guuccacucuucccu

SEQ ID NO: 613460 - RNA, 15 nt, Escherichia coli CFT073
guuccacucuuucag

SEQ ID NO: 613461 - RNA, 21 nt, Escherichia coli CFT073
guuccacggaauauuucaccg

SEQ ID NO: 613462 - RNA, 22 nt, Escherichia coli CFT073
guucacggcgauaccaguaaua

SEQ ID NO: 613463 - RNA, 14 nt, Escherichia coli CFT073
guucaccugguuca

SEQ ID NO: 613464 - RNA, 17 nt, Escherichia coli CFT073
guucacgaauauuuccc

SEQ ID NO: 613465 - RNA, 19 nt, Escherichia coli CFT073
guucacgaccaucaaccuu

SEQ ID NO: 613466 - RNA, 21 nt, Escherichia coli CFT073
guucacgaccaucaaccuuca

SEQ ID NO: 613467 - RNA, 15 nt, Escherichia coli CFT073
guucacgcagcucac

SEQ ID NO: 613468 - RNA, 13 nt, Escherichia coli CFT073
guuaugaaacucc

SEQ ID NO: 613469 - RNA, 23 nt, Escherichia coli CFT073
guuaucuuccagcggccagacac

SEQ ID NO: 613470 - RNA, 18 nt, Escherichia coli CFT073
guuaucgauauacaaaca

SEQ ID NO: 613471 - RNA, 17 nt, Escherichia coli CFT073
guuauuaccaaaaacgg

SEQ ID NO: 613472 - RNA, 15 nt, Escherichia coli CFT073
guuaugucauugccu

SEQ ID NO: 613473 - RNA, 14 nt, Escherichia coli CFT073
guuauuaaaaaugg

SEQ ID NO: 613474 - RNA, 16 nt, Escherichia coli CFT073
guuauuauucauaaau

SEQ ID NO: 613475 - RNA, 18 nt, Escherichia coli CFT073
guucacaccaucaucggc

SEQ ID NO: 613476 - RNA, 17 nt, Escherichia coli CFT073
guucacacucugcuuga

SEQ ID NO: 613477 - RNA, 13 nt, Escherichia coli CFT073
guucaauuuccag

SEQ ID NO: 613478 - RNA, 19 nt, Escherichia coli CFT073
guucaaugcccacugcaca

SEQ ID NO: 613479 - RNA, 16 nt, Escherichia coli CFT073
guucaauaucuuccug

SEQ ID NO: 613480 - RNA, 13 nt, Escherichia coli CFT073
guucaaucugucc

SEQ ID NO: 613481 - RNA, 18 nt, Escherichia coli CFT073
guucaaucuguccuucca

SEQ ID NO: 613482 - RNA, 22 nt, Escherichia coli CFT073
guucaaggauguguuccuuggg

SEQ ID NO: 613483 - RNA, 15 nt, Escherichia coli CFT073
guucaauaauauuaa

SEQ ID NO: 613484 - RNA, 23 nt, Escherichia coli CFT073
guucaaacgauucggcaaucaca

SEQ ID NO: 613485 - RNA, 18 nt, Escherichia coli CFT073
guucaaagcguggugaga

SEQ ID NO: 613486 - RNA, 17 nt, Escherichia coli CFT073
guucaaaugugggagcu

SEQ ID NO: 613487 - RNA, 21 nt, Escherichia coli CFT073
guucaaccacuucggcaucuu

SEQ ID NO: 613488 - RNA, 22 nt, Escherichia coli CFT073
guuauuuuggcacacaccagau

SEQ ID NO: 613489 - RNA, 14 nt, Escherichia coli CFT073
guuauaaaacacau

SEQ ID NO: 613490 - RNA, 22 nt, Escherichia coli CFT073
guuauaagcgucguuaaucgcc

SEQ ID NO: 613491 - RNA, 18 nt, Escherichia coli CFT073
guuauagcgauuuuucau

SEQ ID NO: 613492 - RNA, 15 nt, Escherichia coli CFT073
guuauaggccccagc

SEQ ID NO: 613493 - RNA, 20 nt, Escherichia coli CFT073
guuauccgacuuauucuuca

SEQ ID NO: 613494 - RNA, 16 nt, Escherichia coli CFT073
guuauccagcaaccag

SEQ ID NO: 613495 - RNA, 15 nt, Escherichia coli CFT073
guuauccgccgcaua

SEQ ID NO: 613496 - RNA, 18 nt, Escherichia coli CFT073
guuauccggcugaccugg

SEQ ID NO: 613497 - RNA, 19 nt, Escherichia coli CFT073
guuauccugcaaauaacgc

SEQ ID NO: 613498 - RNA, 22 nt, Escherichia coli CFT073
guuaucgcgccaucaaaucugc

SEQ ID NO: 613499 - RNA, 13 nt, Escherichia coli CFT073
guuaucaaauuca

SEQ ID NO: 613500 - RNA, 14 nt, Escherichia coli CFT073
guuaucagaaccgc

SEQ ID NO: 613501 - RNA, 16 nt, Escherichia coli CFT073
guuagucgcugugaca

SEQ ID NO: 613502 - RNA, 16 nt, Escherichia coli CFT073
guuaccggaagacuga

SEQ ID NO: 613503 - RNA, 19 nt, Escherichia coli CFT073
guuaccgccggcuucaucu

SEQ ID NO: 613504 - RNA, 15 nt, Escherichia coli CFT073
guuaccgaucgccag

SEQ ID NO: 613505 - RNA, 16 nt, Escherichia coli CFT073
guuaccgaucgccagc

SEQ ID NO: 613506 - RNA, 20 nt, Escherichia coli CFT073
guuaauggcuuuacgugcca

SEQ ID NO: 613507 - RNA, 19 nt, Escherichia coli CFT073
guuacaucagaguacagau

SEQ ID NO: 613508 - RNA, 13 nt, Escherichia coli CFT073
guuacccagcacg

SEQ ID NO: 613509 - RNA, 16 nt, Escherichia coli CFT073
gugugggcacucgaag

SEQ ID NO: 613510 - RNA, 23 nt, Escherichia coli CFT073
guguuaccguaccaggcauauuc

SEQ ID NO: 613511 - RNA, 23 nt, Escherichia coli CFT073
guguucccguccgcacgcuggag

SEQ ID NO: 613512 - RNA, 22 nt, Escherichia coli CFT073
guguuccggcugguugaucaau

SEQ ID NO: 613513 - RNA, 13 nt, Escherichia coli CFT073
guguuccucugcc

SEQ ID NO: 613514 - RNA, 14 nt, Escherichia coli CFT073
guguuccucugcuc

SEQ ID NO: 613515 - RNA, 21 nt, Escherichia coli CFT073
guuaaauugaucgaugguugc

SEQ ID NO: 613516 - RNA, 17 nt, Escherichia coli CFT073
guuaaaaacagccagca

SEQ ID NO: 613517 - RNA, 17 nt, Escherichia coli CFT073
guuaaaaagauuaagaa

SEQ ID NO: 613518 - RNA, 18 nt, Escherichia coli CFT073
guuaaaaagauuaagaac

SEQ ID NO: 613519 - RNA, 11 nt, Escherichia coli CFT073
guuaaaaaaca

SEQ ID NO: 613520 - RNA, 13 nt, Escherichia coli CFT073
guuaaaaaaugca

SEQ ID NO: 613521 - RNA, 15 nt, Escherichia coli CFT073
guuaagccguucugg

SEQ ID NO: 613522 - RNA, 17 nt, Escherichia coli CFT073
guuaaucagauaaucaa

SEQ ID NO: 613523 - RNA, 19 nt, Escherichia coli CFT073
guuaauccacagcaaugca

SEQ ID NO: 613524 - RNA, 20 nt, Escherichia coli CFT073
guuaagcacagcggacaucu

SEQ ID NO: 613525 - RNA, 18 nt, Escherichia coli CFT073
guuaaugcgaaugaaaga

SEQ ID NO: 613526 - RNA, 22 nt, Escherichia coli CFT073
guuaaucuucagaucgaaaucu

SEQ ID NO: 613527 - RNA, 16 nt, Escherichia coli CFT073
guuaacaauacgccca

SEQ ID NO: 613528 - RNA, 12 nt, Escherichia coli CFT073
guuaacaacaac

SEQ ID NO: 613529 - RNA, 18 nt, Escherichia coli CFT073
guuaacagcgcaccagaa

SEQ ID NO: 613530 - RNA, 22 nt, Escherichia coli CFT073
guuaacccacagcgcaccaacg

SEQ ID NO: 613531 - RNA, 14 nt, Escherichia coli CFT073
guuaaccagcacca

SEQ ID NO: 613532 - RNA, 13 nt, Escherichia coli CFT073
guuaaccauaauc

SEQ ID NO: 613533 - RNA, 18 nt, Escherichia coli CFT073
guuaacgugucauaacug

SEQ ID NO: 613534 - RNA, 15 nt, Escherichia coli CFT073
guuaacgccagccac

SEQ ID NO: 613535 - RNA, 19 nt, Escherichia coli CFT073
guuaacugaauauuccagu

SEQ ID NO: 613536 - RNA, 21 nt, Escherichia coli CFT073
guuaacugaauauuccaguua

SEQ ID NO: 613537 - RNA, 15 nt, Escherichia coli CFT073
guuaagaaaacggaa

SEQ ID NO: 613538 - RNA, 20 nt, Escherichia coli CFT073
guguagccaauuaagucaac

SEQ ID NO: 613539 - RNA, 15 nt, Escherichia coli CFT073
guguaggaaaucagc

SEQ ID NO: 613540 - RNA, 12 nt, Escherichia coli CFT073
guguaggcaaag

SEQ ID NO: 613541 - RNA, 14 nt, Escherichia coli CFT073
guguaguucaccuu

SEQ ID NO: 613542 - RNA, 13 nt, Escherichia coli CFT073
guguaggccggau

SEQ ID NO: 613543 - RNA, 23 nt, Escherichia coli CFT073
guguaggccggauaagguguuca

SEQ ID NO: 613544 - RNA, 15 nt, Escherichia coli CFT073
gugucagugucagaa

SEQ ID NO: 613545 - RNA, 18 nt, Escherichia coli CFT073
guguccaaaugcagcacg

SEQ ID NO: 613546 - RNA, 11 nt, Escherichia coli CFT073
guguauuucug

SEQ ID NO: 613547 - RNA, 18 nt, Escherichia coli CFT073
guguauuuugcaucgagc

SEQ ID NO: 613548 - RNA, 21 nt, Escherichia coli CFT073
gugucagcaccagagaacuga

SEQ ID NO: 613549 - RNA, 17 nt, Escherichia coli CFT073
gugucgguguagacagc

SEQ ID NO: 613550 - RNA, 17 nt, Escherichia coli CFT073
gugucguuacgccgcag

SEQ ID NO: 613551 - RNA, 22 nt, Escherichia coli CFT073
gugugcguugcagcaaauaaaa

SEQ ID NO: 613552 - RNA, 14 nt, Escherichia coli CFT073
gugucgccagcaau

SEQ ID NO: 613553 - RNA, 19 nt, Escherichia coli CFT073
gugucgccagcaauacaaa

SEQ ID NO: 613554 - RNA, 17 nt, Escherichia coli CFT073
guggcaguuacugcccg

SEQ ID NO: 613555 - RNA, 20 nt, Escherichia coli CFT073
guggcggcgucagcggcugu

SEQ ID NO: 613556 - RNA, 14 nt, Escherichia coli CFT073
guggcguaaacgcc

SEQ ID NO: 613557 - RNA, 21 nt, Escherichia coli CFT073
guggcguuuuuaucgcccacg

SEQ ID NO: 613558 - RNA, 12 nt, Escherichia coli CFT073
gugguccagcug

SEQ ID NO: 613559 - RNA, 16 nt, Escherichia coli CFT073
gugggauuccagcgcc

SEQ ID NO: 613560 - RNA, 16 nt, Escherichia coli CFT073
guggaaugguuggcga

SEQ ID NO: 613561 - RNA, 21 nt, Escherichia coli CFT073
guggacauguuuuuauuaaag

SEQ ID NO: 613562 - RNA, 17 nt, Escherichia coli CFT073
guggagagcauauaaau

SEQ ID NO: 613563 - RNA, 17 nt, Escherichia coli CFT073
guggcagguaauccgca

SEQ ID NO: 613564 - RNA, 14 nt, Escherichia coli CFT073
guggcagaaugguu

SEQ ID NO: 613565 - RNA, 19 nt, Escherichia coli CFT073
guggaucacaucgccggug

SEQ ID NO: 613566 - RNA, 22 nt, Escherichia coli CFT073
guggcacacacuaccgccgagc

SEQ ID NO: 613567 - RNA, 15 nt, Escherichia coli CFT073
guggaacggugaaaa

SEQ ID NO: 613568 - RNA, 14 nt, Escherichia coli CFT073
guggaacaaagaaa

SEQ ID NO: 613569 - RNA, 18 nt, Escherichia coli CFT073
gugcgcaauacguugcaa

SEQ ID NO: 613570 - RNA, 15 nt, Escherichia coli CFT073
gugcgcaggcgcuga

SEQ ID NO: 613571 - RNA, 15 nt, Escherichia coli CFT073
gugcgccacaccgca

SEQ ID NO: 613572 - RNA, 16 nt, Escherichia coli CFT073
gugcgccagcaaauca

SEQ ID NO: 613573 - RNA, 16 nt, Escherichia coli CFT073
gugccaucacgccugc

SEQ ID NO: 613574 - RNA, 12 nt, Escherichia coli CFT073
gugccaguuuca

SEQ ID NO: 613575 - RNA, 14 nt, Escherichia coli CFT073
gugccaucuccagu

SEQ ID NO: 613576 - RNA, 20 nt, Escherichia coli CFT073
gugccauuaaaccaacaaaa

SEQ ID NO: 613577 - RNA, 22 nt, Escherichia coli CFT073
gugccggaacgccgcugguggc

SEQ ID NO: 613578 - RNA, 21 nt, Escherichia coli CFT073
gugccgauaucgauaaacagc

SEQ ID NO: 613579 - RNA, 22 nt, Escherichia coli CFT073
gugccugagccggaguugcaga

SEQ ID NO: 613580 - RNA, 19 nt, Escherichia coli CFT073
gugccugacggacgcgcgg

SEQ ID NO: 613581 - RNA, 14 nt, Escherichia coli CFT073
gugccgggcaaauu

SEQ ID NO: 613582 - RNA, 16 nt, Escherichia coli CFT073
gugccgguaaagcaau

SEQ ID NO: 613583 - RNA, 13 nt, Escherichia coli CFT073
gugcaaaaucaaa

SEQ ID NO: 613584 - RNA, 20 nt, Escherichia coli CFT073
gugcaaaaucaaacagaaua

SEQ ID NO: 613585 - RNA, 19 nt, Escherichia coli CFT073
gugcaaaggccaaugguua

SEQ ID NO: 613586 - RNA, 21 nt, Escherichia coli CFT073
gugcaaccgggcuauuugaau

SEQ ID NO: 613587 - RNA, 23 nt, Escherichia coli CFT073
gugcaaccgggcuauuugaauuc

SEQ ID NO: 613588 - RNA, 14 nt, Escherichia coli CFT073
gugcaacagagagc

SEQ ID NO: 613589 - RNA, 18 nt, Escherichia coli CFT073
gugauuuuacccggugcg

SEQ ID NO: 613590 - RNA, 22 nt, Escherichia coli CFT073
gugauuuccgccgccagcagac

SEQ ID NO: 613591 - RNA, 11 nt, Escherichia coli CFT073
gugaucuggcu

SEQ ID NO: 613592 - RNA, 13 nt, Escherichia coli CFT073
gugcacgcagcaa

SEQ ID NO: 613593 - RNA, 19 nt, Escherichia coli CFT073
gugcaccugccagcaucuc

SEQ ID NO: 613594 - RNA, 17 nt, Escherichia coli CFT073
gugcacuucuucacauc

SEQ ID NO: 613595 - RNA, 21 nt, Escherichia coli CFT073
gugcagaacggugagcgugcg

SEQ ID NO: 613596 - RNA, 16 nt, Escherichia coli CFT073
gugcagcgagugccgg

SEQ ID NO: 613597 - RNA, 15 nt, Escherichia coli CFT073
gugcagcgugccugg

SEQ ID NO: 613598 - RNA, 19 nt, Escherichia coli CFT073
gugcaucuccugacacaac

SEQ ID NO: 613599 - RNA, 18 nt, Escherichia coli CFT073
gugcaucuucacacugau

SEQ ID NO: 613600 - RNA, 12 nt, Escherichia coli CFT073
gugcaucccaga

SEQ ID NO: 613601 - RNA, 22 nt, Escherichia coli CFT073
gugcauccacuuugguuacacg

SEQ ID NO: 613602 - RNA, 23 nt, Escherichia coli CFT073
gugcauauacaaccaauaacuca

SEQ ID NO: 613603 - RNA, 15 nt, Escherichia coli CFT073
gugcaguuuguuaug

SEQ ID NO: 613604 - RNA, 21 nt, Escherichia coli CFT073
gugcauaaauaccggcauguu

SEQ ID NO: 613605 - RNA, 22 nt, Escherichia coli CFT073
gugcauaggccaucggcagcau

SEQ ID NO: 613606 - RNA, 20 nt, Escherichia coli CFT073
gugagcacaucagcgcccuc

SEQ ID NO: 613607 - RNA, 21 nt, Escherichia coli CFT073
gugagaucauuauuaaacagg

SEQ ID NO: 613608 - RNA, 14 nt, Escherichia coli CFT073
gugagauugcugcg

SEQ ID NO: 613609 - RNA, 18 nt, Escherichia coli CFT073
gugagcaugugcaauuuc

SEQ ID NO: 613610 - RNA, 21 nt, Escherichia coli CFT073
gugagcugucugucaaauuca

SEQ ID NO: 613611 - RNA, 15 nt, Escherichia coli CFT073
gugaguggcgcgcgc

SEQ ID NO: 613612 - RNA, 14 nt, Escherichia coli CFT073
gugagucuggaaga

SEQ ID NO: 613613 - RNA, 19 nt, Escherichia coli CFT073
gugagucauguugucuauu

SEQ ID NO: 613614 - RNA, 14 nt, Escherichia coli CFT073
gugauacagcaaaa

SEQ ID NO: 613615 - RNA, 22 nt, Escherichia coli CFT073
gugauauuacauaccagcagca

SEQ ID NO: 613616 - RNA, 19 nt, Escherichia coli CFT073
gugauauucacguuuuuca

SEQ ID NO: 613617 - RNA, 21 nt, Escherichia coli CFT073
gugauaaccuguuaaugcgaa

SEQ ID NO: 613618 - RNA, 22 nt, Escherichia coli CFT073
gugauaagcgaggccagccaga

SEQ ID NO: 613619 - RNA, 19 nt, Escherichia coli CFT073
gugaucacuuacgauuuua

SEQ ID NO: 613620 - RNA, 22 nt, Escherichia coli CFT073
gugaucggucggguauacagaa

SEQ ID NO: 613621 - RNA, 17 nt, Escherichia coli CFT073
gugaucguggccaugac

SEQ ID NO: 613622 - RNA, 16 nt, Escherichia coli CFT073
gugacgaguccuuccu

SEQ ID NO: 613623 - RNA, 17 nt, Escherichia coli CFT073
gugacgaguccuuccug

SEQ ID NO: 613624 - RNA, 17 nt, Escherichia coli CFT073
gugacggaacucuuccg

SEQ ID NO: 613625 - RNA, 13 nt, Escherichia coli CFT073
gugagagaaaauc

SEQ ID NO: 613626 - RNA, 12 nt, Escherichia coli CFT073
gugacuggcaga

SEQ ID NO: 613627 - RNA, 17 nt, Escherichia coli CFT073
gugacuggggggagcga

SEQ ID NO: 613628 - RNA, 20 nt, Escherichia coli CFT073
gugacaguguuauucccaac

SEQ ID NO: 613629 - RNA, 11 nt, Escherichia coli CFT073
gugacauucug

SEQ ID NO: 613630 - RNA, 22 nt, Escherichia coli CFT073
gugacauccagaucacgcagca

SEQ ID NO: 613631 - RNA, 18 nt, Escherichia coli CFT073
gugacacgcgcgcauggu

SEQ ID NO: 613632 - RNA, 12 nt, Escherichia coli CFT073
gugacagcagcg

SEQ ID NO: 613633 - RNA, 18 nt, Escherichia coli CFT073
gugacagcccggcauguu

SEQ ID NO: 613634 - RNA, 13 nt, Escherichia coli CFT073
gugacagcgguga

SEQ ID NO: 613635 - RNA, 22 nt, Escherichia coli CFT073
gugaccgaaccuguuuucaccg

SEQ ID NO: 613636 - RNA, 16 nt, Escherichia coli CFT073
gugacccgcagccagc

SEQ ID NO: 613637 - RNA, 20 nt, Escherichia coli CFT073
gugaaucggacgugauucca

SEQ ID NO: 613638 - RNA, 15 nt, Escherichia coli CFT073
gugaaucacuccauc

SEQ ID NO: 613639 - RNA, 18 nt, Escherichia coli CFT073
gugaauccccuuuauggu

SEQ ID NO: 613640 - RNA, 20 nt, Escherichia coli CFT073
gugaauccccuuuauggugg

SEQ ID NO: 613641 - RNA, 14 nt, Escherichia coli CFT073
gugacaaacacagc

SEQ ID NO: 613642 - RNA, 21 nt, Escherichia coli CFT073
gugacaauaauucccagcacc

SEQ ID NO: 613643 - RNA, 17 nt, Escherichia coli CFT073
gugacaaucaccagguc

SEQ ID NO: 613644 - RNA, 15 nt, Escherichia coli CFT073
gugaaguaauaauca

SEQ ID NO: 613645 - RNA, 16 nt, Escherichia coli CFT073
gugaauaccugagaca

SEQ ID NO: 613646 - RNA, 22 nt, Escherichia coli CFT073
gugaaaucagccguuucaccac

SEQ ID NO: 613647 - RNA, 14 nt, Escherichia coli CFT073
gugaacaucgccau

SEQ ID NO: 613648 - RNA, 14 nt, Escherichia coli CFT073
gugaacgccuuauc

SEQ ID NO: 613649 - RNA, 13 nt, Escherichia coli CFT073
gugaacgccuuau

SEQ ID NO: 613650 - RNA, 16 nt, Escherichia coli CFT073
gugaaccgucacuguu

SEQ ID NO: 613651 - RNA, 15 nt, Escherichia coli CFT073
gucuuuauccagcac

SEQ ID NO: 613652 - RNA, 20 nt, Escherichia coli CFT073
gucuuuauccagcaccacua

SEQ ID NO: 613653 - RNA, 15 nt, Escherichia coli CFT073
gucuuuuauuauaau

SEQ ID NO: 613654 - RNA, 19 nt, Escherichia coli CFT073
gucuuucuuuuuuucacuu

SEQ ID NO: 613655 - RNA, 16 nt, Escherichia coli CFT073
gucuuugcgcuccauc

SEQ ID NO: 613656 - RNA, 14 nt, Escherichia coli CFT073
gucuuucaacagau

SEQ ID NO: 613657 - RNA, 17 nt, Escherichia coli CFT073
gucuuucaacagauaac

SEQ ID NO: 613658 - RNA, 14 nt, Escherichia coli CFT073
gugaaaaaagcaag

SEQ ID NO: 613659 - RNA, 16 nt, Escherichia coli CFT073
gugaaaaaagcaagau

SEQ ID NO: 613660 - RNA, 13 nt, Escherichia coli CFT073
gugaaagaaaaug

SEQ ID NO: 613661 - RNA, 11 nt, Escherichia coli CFT073
gugaaagagau

SEQ ID NO: 613662 - RNA, 17 nt, Escherichia coli CFT073
gugaaacaguaaguuca

SEQ ID NO: 613663 - RNA, 13 nt, Escherichia coli CFT073
gugaaaaauaaaa

SEQ ID NO: 613664 - RNA, 22 nt, Escherichia coli CFT073
gugaaaacgacgcgguauuggu

SEQ ID NO: 613665 - RNA, 19 nt, Escherichia coli CFT073
gugaaacaaaucacuauua

SEQ ID NO: 613666 - RNA, 18 nt, Escherichia coli CFT073
gucuugagacagaaacaa

SEQ ID NO: 613667 - RNA, 13 nt, Escherichia coli CFT073
gucuucuucccag

SEQ ID NO: 613668 - RNA, 23 nt, Escherichia coli CFT073
gucuugaauaaauuggcuggggu

SEQ ID NO: 613669 - RNA, 14 nt, Escherichia coli CFT073
gucuucccgcagcc

SEQ ID NO: 613670 - RNA, 12 nt, Escherichia coli CFT073
gucuucccggcu

SEQ ID NO: 613671 - RNA, 17 nt, Escherichia coli CFT073
gucuuccgucacaggca

SEQ ID NO: 613672 - RNA, 21 nt, Escherichia coli CFT073
gucuucccugcugaauccccu

SEQ ID NO: 613673 - RNA, 21 nt, Escherichia coli CFT073
gucuucgucccagucgucauc

SEQ ID NO: 613674 - RNA, 16 nt, Escherichia coli CFT073
gucugaacguucugcu

SEQ ID NO: 613675 - RNA, 17 nt, Escherichia coli CFT073
gucugaacguucugcug

SEQ ID NO: 613676 - RNA, 16 nt, Escherichia coli CFT073
gucucuuuuuucagaa

SEQ ID NO: 613677 - RNA, 18 nt, Escherichia coli CFT073
gucucuuuuuucagaaua

SEQ ID NO: 613678 - RNA, 17 nt, Escherichia coli CFT073
gucucugguacgccugc

SEQ ID NO: 613679 - RNA, 14 nt, Escherichia coli CFT073
gucucuuccggcuc

SEQ ID NO: 613680 - RNA, 15 nt, Escherichia coli CFT073
gucucuucuuugcug

SEQ ID NO: 613681 - RNA, 18 nt, Escherichia coli CFT073
gucugccaucauggcauc

SEQ ID NO: 613682 - RNA, 18 nt, Escherichia coli CFT073
gucugccgggaagcucuc

SEQ ID NO: 613683 - RNA, 19 nt, Escherichia coli CFT073
gucugcgccugcgucuauc

SEQ ID NO: 613684 - RNA, 16 nt, Escherichia coli CFT073
gucugcggugcgccaa

SEQ ID NO: 613685 - RNA, 23 nt, Escherichia coli CFT073
gucugauaguaguuugaugagaa

SEQ ID NO: 613686 - RNA, 19 nt, Escherichia coli CFT073
gucugauauuuuauugauu

SEQ ID NO: 613687 - RNA, 18 nt, Escherichia coli CFT073
gucugagauuacauuggg

SEQ ID NO: 613688 - RNA, 16 nt, Escherichia coli CFT073
gucugauaaaaaaccc

SEQ ID NO: 613689 - RNA, 19 nt, Escherichia coli CFT073
gucuggcgaauuuauaaaa

SEQ ID NO: 613690 - RNA, 21 nt, Escherichia coli CFT073
gucuggcagauccugaaauuc

SEQ ID NO: 613691 - RNA, 18 nt, Escherichia coli CFT073
gucuggcauuuugcugcu

SEQ ID NO: 613692 - RNA, 17 nt, Escherichia coli CFT073
gucuggauugcagagaa

SEQ ID NO: 613693 - RNA, 16 nt, Escherichia coli CFT073
gucuggauuuacugca

SEQ ID NO: 613694 - RNA, 17 nt, Escherichia coli CFT073
gucuggaucuucuucau

SEQ ID NO: 613695 - RNA, 16 nt, Escherichia coli CFT073
gucuggauggcuugcu

SEQ ID NO: 613696 - RNA, 21 nt, Escherichia coli CFT073
gucuggagaugggugugcuga

SEQ ID NO: 613697 - RNA, 14 nt, Escherichia coli CFT073
gucuggaacggcag

SEQ ID NO: 613698 - RNA, 20 nt, Escherichia coli CFT073
gucugggcgagguccagcuc

SEQ ID NO: 613699 - RNA, 15 nt, Escherichia coli CFT073
gucugguaaagcaga

SEQ ID NO: 613700 - RNA, 18 nt, Escherichia coli CFT073
gucuguaccaccagaauc

SEQ ID NO: 613701 - RNA, 17 nt, Escherichia coli CFT073
gucuguaaaagccccuu

SEQ ID NO: 613702 - RNA, 16 nt, Escherichia coli CFT073
gucuguauuuggcugc

SEQ ID NO: 613703 - RNA, 15 nt, Escherichia coli CFT073
gucugucaaauucac

SEQ ID NO: 613704 - RNA, 17 nt, Escherichia coli CFT073
gucuggugaauccccuu

SEQ ID NO: 613705 - RNA, 14 nt, Escherichia coli CFT073
gucugguuuuccuu

SEQ ID NO: 613706 - RNA, 15 nt, Escherichia coli CFT073
gucuuagcguucugc

SEQ ID NO: 613707 - RNA, 21 nt, Escherichia coli CFT073
gucuuaucaggccuacaaguc

SEQ ID NO: 613708 - RNA, 21 nt, Escherichia coli CFT073
gucuuaucaggccuacacguu

SEQ ID NO: 613709 - RNA, 16 nt, Escherichia coli CFT073
gucuuaauagcuucuu

SEQ ID NO: 613710 - RNA, 16 nt, Escherichia coli CFT073
gucuguuugcgucaug

SEQ ID NO: 613711 - RNA, 21 nt, Escherichia coli CFT073
gucuucaucguccagcgucag

SEQ ID NO: 613712 - RNA, 16 nt, Escherichia coli CFT073
gucuuaucaugccuac

SEQ ID NO: 613713 - RNA, 14 nt, Escherichia coli CFT073
gucuucaaccgcag

SEQ ID NO: 613714 - RNA, 18 nt, Escherichia coli CFT073
gucuucacaaccgccauc

SEQ ID NO: 613715 - RNA, 16 nt, Escherichia coli CFT073
gucgguaauuucacug

SEQ ID NO: 613716 - RNA, 23 nt, Escherichia coli CFT073
gucgguguuaacaaugguggugg

SEQ ID NO: 613717 - RNA, 18 nt, Escherichia coli CFT073
gucguauuucagccccag

SEQ ID NO: 613718 - RNA, 18 nt, Escherichia coli CFT073
gucgugaucgugguggug

SEQ ID NO: 613719 - RNA, 20 nt, Escherichia coli CFT073
gucguccagauguucuucaa

SEQ ID NO: 613720 - RNA, 19 nt, Escherichia coli CFT073
gucguccucuucgggggag

SEQ ID NO: 613721 - RNA, 17 nt, Escherichia coli CFT073
gucucaugcgucaugag

SEQ ID NO: 613722 - RNA, 22 nt, Escherichia coli CFT073
gucuccaggcagaaacaucauc

SEQ ID NO: 613723 - RNA, 15 nt, Escherichia coli CFT073
gucuaacgaugccag

SEQ ID NO: 613724 - RNA, 19 nt, Escherichia coli CFT073
gucuaacgaugccagcgcu

SEQ ID NO: 613725 - RNA, 16 nt, Escherichia coli CFT073
gucuaagguaaaacaa

SEQ ID NO: 613726 - RNA, 14 nt, Escherichia coli CFT073
gucguuuuccugca

SEQ ID NO: 613727 - RNA, 23 nt, Escherichia coli CFT073
gucuaacaugagauccagcgagc

SEQ ID NO: 613728 - RNA, 15 nt, Escherichia coli CFT073
gucguugucuggcug

SEQ ID NO: 613729 - RNA, 17 nt, Escherichia coli CFT073
gucguugucuggcuggu

SEQ ID NO: 613730 - RNA, 13 nt, Escherichia coli CFT073
gucggauaagacg

SEQ ID NO: 613731 - RNA, 22 nt, Escherichia coli CFT073
gucggaucgcugaacgcaccuu

SEQ ID NO: 613732 - RNA, 16 nt, Escherichia coli CFT073
gucggcauauuuaaaa

SEQ ID NO: 613733 - RNA, 21 nt, Escherichia coli CFT073
gucggcaucguaauuuaacaa

SEQ ID NO: 613734 - RNA, 19 nt, Escherichia coli CFT073
gucggaaccgguuuagaaa

SEQ ID NO: 613735 - RNA, 14 nt, Escherichia coli CFT073
gucgcucacuucac

SEQ ID NO: 613736 - RNA, 15 nt, Escherichia coli CFT073
gucgcgcgaaucuuc

SEQ ID NO: 613737 - RNA, 16 nt, Escherichia coli CFT073
gucgaugggggagguc

SEQ ID NO: 613738 - RNA, 17 nt, Escherichia coli CFT073
gucgaugggggagguca

SEQ ID NO: 613739 - RNA, 17 nt, Escherichia coli CFT073
gucgagcaguugcugaa

SEQ ID NO: 613740 - RNA, 14 nt, Escherichia coli CFT073
gucggcuuucucau

SEQ ID NO: 613741 - RNA, 21 nt, Escherichia coli CFT073
gucgggugcgacaggagccgc

SEQ ID NO: 613742 - RNA, 21 nt, Escherichia coli CFT073
gucggggggaggcugcauuau

SEQ ID NO: 613743 - RNA, 21 nt, Escherichia coli CFT073
gucggcggcgaucgccugcug

SEQ ID NO: 613744 - RNA, 18 nt, Escherichia coli CFT073
gucggcgucagcgccauc

SEQ ID NO: 613745 - RNA, 18 nt, Escherichia coli CFT073
guccauugaagacaacau

SEQ ID NO: 613746 - RNA, 16 nt, Escherichia coli CFT073
gucccuaacaugccac

SEQ ID NO: 613747 - RNA, 19 nt, Escherichia coli CFT073
gucccugaaucgccacgcc

SEQ ID NO: 613748 - RNA, 15 nt, Escherichia coli CFT073
gucccugccagcguc

SEQ ID NO: 613749 - RNA, 12 nt, Escherichia coli CFT073
gucccuuucagg

SEQ ID NO: 613750 - RNA, 21 nt, Escherichia coli CFT073
guccguaaucucgaaagaggu

SEQ ID NO: 613751 - RNA, 17 nt, Escherichia coli CFT073
guccgagcuuaaugaaa

SEQ ID NO: 613752 - RNA, 17 nt, Escherichia coli CFT073
guccuuuacuucaccau

SEQ ID NO: 613753 - RNA, 17 nt, Escherichia coli CFT073
gucgaaauaucacugau

SEQ ID NO: 613754 - RNA, 20 nt, Escherichia coli CFT073
gucgacaguagccccgcggg

SEQ ID NO: 613755 - RNA, 18 nt, Escherichia coli CFT073
gucgaauugcaucuacgc

SEQ ID NO: 613756 - RNA, 19 nt, Escherichia coli CFT073
gucgacaauccagucagcg

SEQ ID NO: 613757 - RNA, 21 nt, Escherichia coli CFT073
gucgagauacacggugcucca

SEQ ID NO: 613758 - RNA, 16 nt, Escherichia coli CFT073
gucgagcagagaaacg

SEQ ID NO: 613759 - RNA, 16 nt, Escherichia coli CFT073
gucauaucgaccagcg

SEQ ID NO: 613760 - RNA, 13 nt, Escherichia coli CFT073
gucacgcagcagg

SEQ ID NO: 613761 - RNA, 15 nt, Escherichia coli CFT073
gucacgcagcagggc

SEQ ID NO: 613762 - RNA, 14 nt, Escherichia coli CFT073
gucacgcagggcau

SEQ ID NO: 613763 - RNA, 21 nt, Escherichia coli CFT073
gucauauagccgcgcaguuuc

SEQ ID NO: 613764 - RNA, 22 nt, Escherichia coli CFT073
gucaucaaacggcauaugccau

SEQ ID NO: 613765 - RNA, 17 nt, Escherichia coli CFT073
gucaucacgcagcguga

SEQ ID NO: 613766 - RNA, 22 nt, Escherichia coli CFT073
gucaucacgcagcgugaagcua

SEQ ID NO: 613767 - RNA, 22 nt, Escherichia coli CFT073
gucaucacuugcucccgggcau

SEQ ID NO: 613768 - RNA, 20 nt, Escherichia coli CFT073
gucaucacaucccagcagag

SEQ ID NO: 613769 - RNA, 21 nt, Escherichia coli CFT073
gucaucacaucccagcagaga

SEQ ID NO: 613770 - RNA, 21 nt, Escherichia coli CFT073
gucaucaauccugcagcaggu

SEQ ID NO: 613771 - RNA, 20 nt, Escherichia coli CFT073
gucaucccccaguggcagca

SEQ ID NO: 613772 - RNA, 16 nt, Escherichia coli CFT073
gucaucauauugucug

SEQ ID NO: 613773 - RNA, 21 nt, Escherichia coli CFT073
gucauccggcgucaucuuacu

SEQ ID NO: 613774 - RNA, 16 nt, Escherichia coli CFT073
gucaucgacagcaaau

SEQ ID NO: 613775 - RNA, 19 nt, Escherichia coli CFT073
gucaucgacgucagcagau

SEQ ID NO: 613776 - RNA, 18 nt, Escherichia coli CFT073
gucaucgcccuguuccug

SEQ ID NO: 613777 - RNA, 18 nt, Escherichia coli CFT073
gucaugcuccugauuggc

SEQ ID NO: 613778 - RNA, 23 nt, Escherichia coli CFT073
guccaaucaggcgaauaaauucc

SEQ ID NO: 613779 - RNA, 13 nt, Escherichia coli CFT073
guccaauggucau

SEQ ID NO: 613780 - RNA, 13 nt, Escherichia coli CFT073
guccacaaaccgu

SEQ ID NO: 613781 - RNA, 18 nt, Escherichia coli CFT073
guccagcuccguccagcc

SEQ ID NO: 613782 - RNA, 16 nt, Escherichia coli CFT073
guccagcuugccuuca

SEQ ID NO: 613783 - RNA, 22 nt, Escherichia coli CFT073
guccaguccacacugagcacca

SEQ ID NO: 613784 - RNA, 13 nt, Escherichia coli CFT073
guccauaaaccgu

SEQ ID NO: 613785 - RNA, 13 nt, Escherichia coli CFT073
guccacuuccugc

SEQ ID NO: 613786 - RNA, 14 nt, Escherichia coli CFT073
guccagacggagcu

SEQ ID NO: 613787 - RNA, 17 nt, Escherichia coli CFT073
guccacgacagaacccg

SEQ ID NO: 613788 - RNA, 13 nt, Escherichia coli CFT073
guccaccuggccu

SEQ ID NO: 613789 - RNA, 18 nt, Escherichia coli CFT073
guccacccauagcccaug

SEQ ID NO: 613790 - RNA, 23 nt, Escherichia coli CFT073
guauuuugucagcccuuuuggca

SEQ ID NO: 613791 - RNA, 11 nt, Escherichia coli CFT073
guauuuugcau

SEQ ID NO: 613792 - RNA, 12 nt, Escherichia coli CFT073
guauuuccaggg

SEQ ID NO: 613793 - RNA, 11 nt, Escherichia coli CFT073
guauuugauac

SEQ ID NO: 613794 - RNA, 21 nt, Escherichia coli CFT073
guauuugauaccaguuuccac

SEQ ID NO: 613795 - RNA, 19 nt, Escherichia coli CFT073
guauugggauguugauuaa

SEQ ID NO: 613796 - RNA, 17 nt, Escherichia coli CFT073
guauugccaugcacgca

SEQ ID NO: 613797 - RNA, 20 nt, Escherichia coli CFT073
guauuuagcccuucaugcac

SEQ ID NO: 613798 - RNA, 21 nt, Escherichia coli CFT073
guauugucauauaauguaucu

SEQ ID NO: 613799 - RNA, 15 nt, Escherichia coli CFT073
guauuuaaacuucac

SEQ ID NO: 613800 - RNA, 17 nt, Escherichia coli CFT073
guauucccguauuacug

SEQ ID NO: 613801 - RNA, 23 nt, Escherichia coli CFT073
guauuccaccguacgccagcguc

SEQ ID NO: 613802 - RNA, 17 nt, Escherichia coli CFT073
guauucaugcccugccc

SEQ ID NO: 613803 - RNA, 20 nt, Escherichia coli CFT073
guauucagaucagcggccag

SEQ ID NO: 613804 - RNA, 22 nt, Escherichia coli CFT073
guauuacgguaaggauauucau

SEQ ID NO: 613805 - RNA, 14 nt, Escherichia coli CFT073
guauucaaccguuu

SEQ ID NO: 613806 - RNA, 16 nt, Escherichia coli CFT073
guauucguuaaaacca

SEQ ID NO: 613807 - RNA, 16 nt, Escherichia coli CFT073
gucaaacaguucacgu

SEQ ID NO: 613808 - RNA, 15 nt, Escherichia coli CFT073
gucaaaccuggcggc

SEQ ID NO: 613809 - RNA, 13 nt, Escherichia coli CFT073
gucaaagauauua

SEQ ID NO: 613810 - RNA, 18 nt, Escherichia coli CFT073
gucaaagauauuauuaaa

SEQ ID NO: 613811 - RNA, 23 nt, Escherichia coli CFT073
gucaaagauauuauuaaaugcug

SEQ ID NO: 613812 - RNA, 21 nt, Escherichia coli CFT073
gucacaaugggcgugaaaggu

SEQ ID NO: 613813 - RNA, 11 nt, Escherichia coli CFT073
gucacacacaa

SEQ ID NO: 613814 - RNA, 14 nt, Escherichia coli CFT073
gucacagaagagag

SEQ ID NO: 613815 - RNA, 15 nt, Escherichia coli CFT073
gucaauaauuucuca

SEQ ID NO: 613816 - RNA, 16 nt, Escherichia coli CFT073
gucaauauccagcagg

SEQ ID NO: 613817 - RNA, 18 nt, Escherichia coli CFT073
gucaauauccagcagguu

SEQ ID NO: 613818 - RNA, 12 nt, Escherichia coli CFT073
gucaaucccagg

SEQ ID NO: 613819 - RNA, 14 nt, Escherichia coli CFT073
gucaaucacacuga

SEQ ID NO: 613820 - RNA, 13 nt, Escherichia coli CFT073
gucaaucacuuuc

SEQ ID NO: 613821 - RNA, 16 nt, Escherichia coli CFT073
gucacauguuccaggg

SEQ ID NO: 613822 - RNA, 15 nt, Escherichia coli CFT073
gucacaucaggccau

SEQ ID NO: 613823 - RNA, 22 nt, Escherichia coli CFT073
gucaccaaucagguaagcgaag

SEQ ID NO: 613824 - RNA, 21 nt, Escherichia coli CFT073
gucaccaaucugaaaccagcg

SEQ ID NO: 613825 - RNA, 22 nt, Escherichia coli CFT073
gucaccaaucugaaaccagcgu

SEQ ID NO: 613826 - RNA, 12 nt, Escherichia coli CFT073
gucaccacaaau

SEQ ID NO: 613827 - RNA, 14 nt, Escherichia coli CFT073
gucaccagcaucaa

SEQ ID NO: 613828 - RNA, 17 nt, Escherichia coli CFT073
gucaccagcaucaacaa

SEQ ID NO: 613829 - RNA, 16 nt, Escherichia coli CFT073
gucaccuaauuuaaaa

SEQ ID NO: 613830 - RNA, 16 nt, Escherichia coli CFT073
gucaccugcccgguau

SEQ ID NO: 613831 - RNA, 17 nt, Escherichia coli CFT073
gucaccuucuggcgacc

SEQ ID NO: 613832 - RNA, 22 nt, Escherichia coli CFT073
gucacgauacgguuauccugca

SEQ ID NO: 613833 - RNA, 23 nt, Escherichia coli CFT073
gucacgauacgguuauccugcaa

SEQ ID NO: 613834 - RNA, 16 nt, Escherichia coli CFT073
guaucucgcgccagua

SEQ ID NO: 613835 - RNA, 14 nt, Escherichia coli CFT073
guaucugaaguaaa

SEQ ID NO: 613836 - RNA, 19 nt, Escherichia coli CFT073
guaucuucaugcuccagca

SEQ ID NO: 613837 - RNA, 19 nt, Escherichia coli CFT073
guaugaauuuucgacagca

SEQ ID NO: 613838 - RNA, 15 nt, Escherichia coli CFT073
guaugacaaaagaau

SEQ ID NO: 613839 - RNA, 14 nt, Escherichia coli CFT073
guaucuuuccagcc

SEQ ID NO: 613840 - RNA, 23 nt, Escherichia coli CFT073
guaucgccacugcgccacgggcu

SEQ ID NO: 613841 - RNA, 17 nt, Escherichia coli CFT073
guaucgaguggcgcagu

SEQ ID NO: 613842 - RNA, 20 nt, Escherichia coli CFT073
guaucgcggggauauggugg

SEQ ID NO: 613843 - RNA, 16 nt, Escherichia coli CFT073
guaucguuaaagagau

SEQ ID NO: 613844 - RNA, 17 nt, Escherichia coli CFT073
guauguuuugucugccc

SEQ ID NO: 613845 - RNA, 14 nt, Escherichia coli CFT073
guauuaauuugcca

SEQ ID NO: 613846 - RNA, 20 nt, Escherichia coli CFT073
guauuacccggcacagcuuu

SEQ ID NO: 613847 - RNA, 21 nt, Escherichia coli CFT073
guauuacccggcacagcuuuc

SEQ ID NO: 613848 - RNA, 22 nt, Escherichia coli CFT073
guaugguauaucguuuuucauu

SEQ ID NO: 613849 - RNA, 17 nt, Escherichia coli CFT073
guauggucgugaucaau

SEQ ID NO: 613850 - RNA, 19 nt, Escherichia coli CFT073
guauguaauuaaacagccc

SEQ ID NO: 613851 - RNA, 21 nt, Escherichia coli CFT073
guauguaauuaaacagcccuu

SEQ ID NO: 613852 - RNA, 17 nt, Escherichia coli CFT073
guaugcagccaggccau

SEQ ID NO: 613853 - RNA, 17 nt, Escherichia coli CFT073
guaugcaucgguggcga

SEQ ID NO: 613854 - RNA, 16 nt, Escherichia coli CFT073
guauggaaaucaccca

SEQ ID NO: 613855 - RNA, 15 nt, Escherichia coli CFT073
guauccuguuuuuaa

SEQ ID NO: 613856 - RNA, 22 nt, Escherichia coli CFT073
guauccgcuauugaccagcgcc

SEQ ID NO: 613857 - RNA, 16 nt, Escherichia coli CFT073
guauccggcaugaaca

SEQ ID NO: 613858 - RNA, 13 nt, Escherichia coli CFT073
guauccggcucau

SEQ ID NO: 613859 - RNA, 14 nt, Escherichia coli CFT073
guaucaauaauucg

SEQ ID NO: 613860 - RNA, 13 nt, Escherichia coli CFT073
guaucaauaccag

SEQ ID NO: 613861 - RNA, 22 nt, Escherichia coli CFT073
guaucacucgugauaaccuguu

SEQ ID NO: 613862 - RNA, 20 nt, Escherichia coli CFT073
guaucacuggccucuucucu

SEQ ID NO: 613863 - RNA, 21 nt, Escherichia coli CFT073
guaucacuggccucuucucuc

SEQ ID NO: 613864 - RNA, 21 nt, Escherichia coli CFT073
guauccacucggcacauagac

SEQ ID NO: 613865 - RNA, 18 nt, Escherichia coli CFT073
guaucagggcgaaacaga

SEQ ID NO: 613866 - RNA, 11 nt, Escherichia coli CFT073
guaucaucgcu

SEQ ID NO: 613867 - RNA, 15 nt, Escherichia coli CFT073
guagcuggcaaugau

SEQ ID NO: 613868 - RNA, 13 nt, Escherichia coli CFT073
guagcuggcggca

SEQ ID NO: 613869 - RNA, 23 nt, Escherichia coli CFT073
guagcuuaucgcaggcuuccugg

SEQ ID NO: 613870 - RNA, 21 nt, Escherichia coli CFT073
  misc_feature (7)..(7): n is a, c, g or u
guagcungcaggauaaacgcc

SEQ ID NO: 613871 - RNA, 18 nt, Escherichia coli CFT073
guauaggauuaucauccc

SEQ ID NO: 613872 - RNA, 14 nt, Escherichia coli CFT073
guaucaaacacagg

SEQ ID NO: 613873 - RNA, 17 nt, Escherichia coli CFT073
guauagaaugcagcagc

SEQ ID NO: 613874 - RNA, 14 nt, Escherichia coli CFT073
guauacugcaaaua

SEQ ID NO: 613875 - RNA, 18 nt, Escherichia coli CFT073
guauacugcagcggucac

SEQ ID NO: 613876 - RNA, 21 nt, Escherichia coli CFT073
guauacugcagcggucacaug

SEQ ID NO: 613877 - RNA, 18 nt, Escherichia coli CFT073
guauagaaaccauccagc

SEQ ID NO: 613878 - RNA, 23 nt, Escherichia coli CFT073
guagcaacgauaacaaucaccaa

SEQ ID NO: 613879 - RNA, 14 nt, Escherichia coli CFT073
guagcaggaaauau

SEQ ID NO: 613880 - RNA, 20 nt, Escherichia coli CFT073
guagcagcagcgccaggcac

SEQ ID NO: 613881 - RNA, 23 nt, Escherichia coli CFT073
guagcaccacgguacgccagagu

SEQ ID NO: 613882 - RNA, 13 nt, Escherichia coli CFT073
guagaauaaaagc

SEQ ID NO: 613883 - RNA, 13 nt, Escherichia coli CFT073
guagacauaaccg

SEQ ID NO: 613884 - RNA, 14 nt, Escherichia coli CFT073
guagacauaaccgg

SEQ ID NO: 613885 - RNA, 18 nt, Escherichia coli CFT073
guagaaggcgacaaagcc

SEQ ID NO: 613886 - RNA, 21 nt, Escherichia coli CFT073
guagaacgguaacugaacgua

SEQ ID NO: 613887 - RNA, 15 nt, Escherichia coli CFT073
guagcccuucagcuu

SEQ ID NO: 613888 - RNA, 18 nt, Escherichia coli CFT073
guagccagcugccugcca

SEQ ID NO: 613889 - RNA, 18 nt, Escherichia coli CFT073
guagcaugaacauugcug

SEQ ID NO: 613890 - RNA, 20 nt, Escherichia coli CFT073
guagcaugaacauugcugcu

SEQ ID NO: 613891 - RNA, 15 nt, Escherichia coli CFT073
guagcaggccggaga

SEQ ID NO: 613892 - RNA, 22 nt, Escherichia coli CFT073
guagcguaaaggcugccagagu

SEQ ID NO: 613893 - RNA, 24 nt, Escherichia coli CFT073
guacugaccgucgccuucaacgua

SEQ ID NO: 613894 - RNA, 17 nt, Escherichia coli CFT073
guacucuucaauggcau

SEQ ID NO: 613895 - RNA, 11 nt, Escherichia coli CFT073
guacugcaacu

SEQ ID NO: 613896 - RNA, 11 nt, Escherichia coli CFT073
guacugcaggu

SEQ ID NO: 613897 - RNA, 16 nt, Escherichia coli CFT073
guacuuuaaaauaagc

SEQ ID NO: 613898 - RNA, 21 nt, Escherichia coli CFT073
guacgcggacacuuuccugcu

SEQ ID NO: 613899 - RNA, 21 nt, Escherichia coli CFT073
guacgcggcaauccccgccag

SEQ ID NO: 613900 - RNA, 18 nt, Escherichia coli CFT073
guacgcguucaaucaaau

SEQ ID NO: 613901 - RNA, 21 nt, Escherichia coli CFT073
guacucgcacuuuucccacua

SEQ ID NO: 613902 - RNA, 22 nt, Escherichia coli CFT073
guacucggcuacgaaccgagcg

SEQ ID NO: 613903 - RNA, 19 nt, Escherichia coli CFT073
guacgcauguuguuuucaa

SEQ ID NO: 613904 - RNA, 14 nt, Escherichia coli CFT073
guacgccaaucugc

SEQ ID NO: 613905 - RNA, 16 nt, Escherichia coli CFT073
guacgccaaucugcaa

SEQ ID NO: 613906 - RNA, 17 nt, Escherichia coli CFT073
guacgccaaucugcaaa

SEQ ID NO: 613907 - RNA, 15 nt, Escherichia coli CFT073
guaccacccugcuca

SEQ ID NO: 613908 - RNA, 20 nt, Escherichia coli CFT073
guaccacgcaaagcacgcca

SEQ ID NO: 613909 - RNA, 18 nt, Escherichia coli CFT073
guaccacgguucgcuggc

SEQ ID NO: 613910 - RNA, 12 nt, Escherichia coli CFT073
guacauccggca

SEQ ID NO: 613911 - RNA, 17 nt, Escherichia coli CFT073
guacauccggcaaugaa

SEQ ID NO: 613912 - RNA, 22 nt, Escherichia coli CFT073
guacauccggcaaugaaacuca

SEQ ID NO: 613913 - RNA, 19 nt, Escherichia coli CFT073
guaccaggcaauaaacauc

SEQ ID NO: 613914 - RNA, 21 nt, Escherichia coli CFT073
guaccagugcagaugcacaag

SEQ ID NO: 613915 - RNA, 20 nt, Escherichia coli CFT073
guaccagaccaacauaguua

SEQ ID NO: 613916 - RNA, 12 nt, Escherichia coli CFT073
guaccagacuga

SEQ ID NO: 613917 - RNA, 19 nt, Escherichia coli CFT073
guaccagacugacauguua

SEQ ID NO: 613918 - RNA, 14 nt, Escherichia coli CFT073
guaccagaugcauu

SEQ ID NO: 613919 - RNA, 17 nt, Escherichia coli CFT073
guaccagcaccugaauc

SEQ ID NO: 613920 - RNA, 12 nt, Escherichia coli CFT073
guaccagcagcg

SEQ ID NO: 613921 - RNA, 21 nt, Escherichia coli CFT073
guacgauaauggcuuccagua

SEQ ID NO: 613922 - RNA, 14 nt, Escherichia coli CFT073
guaccugucgggac

SEQ ID NO: 613923 - RNA, 19 nt, Escherichia coli CFT073
guaccugugaagugaaaaa

SEQ ID NO: 613924 - RNA, 16 nt, Escherichia coli CFT073
guaccuucgaugaaau

SEQ ID NO: 613925 - RNA, 19 nt, Escherichia coli CFT073
guaccuucguccaucccac

SEQ ID NO: 613926 - RNA, 20 nt, Escherichia coli CFT073
guaccuucguccaucccaca

SEQ ID NO: 613927 - RNA, 19 nt, Escherichia coli CFT073
guaccuguugugcgcggcu

SEQ ID NO: 613928 - RNA, 12 nt, Escherichia coli CFT073
guacaggcggca

SEQ ID NO: 613929 - RNA, 14 nt, Escherichia coli CFT073
guacagcccaggaa

SEQ ID NO: 613930 - RNA, 16 nt, Escherichia coli CFT073
guacagcucgaugaau

SEQ ID NO: 613931 - RNA, 18 nt, Escherichia coli CFT073
guacaggauauauuucau

SEQ ID NO: 613932 - RNA, 18 nt, Escherichia coli CFT073
guacagauacauuucagc

SEQ ID NO: 613933 - RNA, 18 nt, Escherichia coli CFT073
guacagagggcaggcaac

SEQ ID NO: 613934 - RNA, 20 nt, Escherichia coli CFT073
guacacgcugaagaucuuca

SEQ ID NO: 613935 - RNA, 20 nt, Escherichia coli CFT073
guacaccgcagccgccacaa

SEQ ID NO: 613936 - RNA, 13 nt, Escherichia coli CFT073
guacaccugcugu

SEQ ID NO: 613937 - RNA, 15 nt, Escherichia coli CFT073
guacaccaacaucac

SEQ ID NO: 613938 - RNA, 23 nt, Escherichia coli CFT073
guaauuugccguuaaucccagac

SEQ ID NO: 613939 - RNA, 19 nt, Escherichia coli CFT073
guaauuugcguuuucacca

SEQ ID NO: 613940 - RNA, 15 nt, Escherichia coli CFT073
guaauuguucgcuuu

SEQ ID NO: 613941 - RNA, 20 nt, Escherichia coli CFT073
guacaauggacgauuaucaa

SEQ ID NO: 613942 - RNA, 22 nt, Escherichia coli CFT073
guacaauaucgauaaucuucaa

SEQ ID NO: 613943 - RNA, 23 nt, Escherichia coli CFT073
guacaauauuaauuacuucucuu

SEQ ID NO: 613944 - RNA, 13 nt, Escherichia coli CFT073
guacaaacaucau

SEQ ID NO: 613945 - RNA, 20 nt, Escherichia coli CFT073
guacaaacauccaucugcuu

SEQ ID NO: 613946 - RNA, 19 nt, Escherichia coli CFT073
guacaaccguuucaugcca

SEQ ID NO: 613947 - RNA, 13 nt, Escherichia coli CFT073
guaaucaccaccc

SEQ ID NO: 613948 - RNA, 18 nt, Escherichia coli CFT073
guaaucaaucaccucuuu

SEQ ID NO: 613949 - RNA, 13 nt, Escherichia coli CFT073
guaaucaccagca

SEQ ID NO: 613950 - RNA, 18 nt, Escherichia coli CFT073
guaaucauaauuauaaua

SEQ ID NO: 613951 - RNA, 15 nt, Escherichia coli CFT073
guaaucauaaaacac

SEQ ID NO: 613952 - RNA, 20 nt, Escherichia coli CFT073
guaaaacggcagaaucuuaa

SEQ ID NO: 613953 - RNA, 21 nt, Escherichia coli CFT073
guaaaacgggcgcgaugacag

SEQ ID NO: 613954 - RNA, 17 nt, Escherichia coli CFT073
guaauaauuacuuacau

SEQ ID NO: 613955 - RNA, 17 nt, Escherichia coli CFT073
guaauaccagccuucuu

SEQ ID NO: 613956 - RNA, 21 nt, Escherichia coli CFT073
guaauacccagacuuuucaga

SEQ ID NO: 613957 - RNA, 21 nt, Escherichia coli CFT073
guaauuccagcgguuguagcc

SEQ ID NO: 613958 - RNA, 16 nt, Escherichia coli CFT073
guaauuccccggcuuu

SEQ ID NO: 613959 - RNA, 18 nt, Escherichia coli CFT073
guaauuacgcagcgcguu

SEQ ID NO: 613960 - RNA, 17 nt, Escherichia coli CFT073
guaaugauuaacagccc

SEQ ID NO: 613961 - RNA, 15 nt, Escherichia coli CFT073
guaaugccuuuucca

SEQ ID NO: 613962 - RNA, 17 nt, Escherichia coli CFT073
guaauccugcaaauuca

SEQ ID NO: 613963 - RNA, 16 nt, Escherichia coli CFT073
guaaugaaucagcaga

SEQ ID NO: 613964 - RNA, 17 nt, Escherichia coli CFT073
guaaugaaucagcagau

SEQ ID NO: 613965 - RNA, 15 nt, Escherichia coli CFT073
gguucuuaccgguga

SEQ ID NO: 613966 - RNA, 21 nt, Escherichia coli CFT073
gguucuuuggucaggcgcuga

SEQ ID NO: 613967 - RNA, 13 nt, Escherichia coli CFT073
gguucuuuuuuga

SEQ ID NO: 613968 - RNA, 18 nt, Escherichia coli CFT073
gguugaauagucgugcgg

SEQ ID NO: 613969 - RNA, 22 nt, Escherichia coli CFT073
gguugcaaucuuucgaguaaau

SEQ ID NO: 613970 - RNA, 20 nt, Escherichia coli CFT073
gguugcagaucuuucugcag

SEQ ID NO: 613971 - RNA, 22 nt, Escherichia coli CFT073
gguucugcacagcuuaaaaugc

SEQ ID NO: 613972 - RNA, 21 nt, Escherichia coli CFT073
gguucguaagcgauaaccgca

SEQ ID NO: 613973 - RNA, 21 nt, Escherichia coli CFT073
gguucgcuuuuauuucugcuu

SEQ ID NO: 613974 - RNA, 13 nt, Escherichia coli CFT073
gguucgccaucac

SEQ ID NO: 613975 - RNA, 13 nt, Escherichia coli CFT073
gguuggagcgcgu

SEQ ID NO: 613976 - RNA, 23 nt, Escherichia coli CFT073
gguuuaagacaauauaauaagaa

SEQ ID NO: 613977 - RNA, 14 nt, Escherichia coli CFT073
gguuguuauuuccg

SEQ ID NO: 613978 - RNA, 16 nt, Escherichia coli CFT073
gguugccguccagcgc

SEQ ID NO: 613979 - RNA, 23 nt, Escherichia coli CFT073
gguugccagcgacagaaaucaga

SEQ ID NO: 613980 - RNA, 18 nt, Escherichia coli CFT073
gguuggaauugaagcugu

SEQ ID NO: 613981 - RNA, 18 nt, Escherichia coli CFT073
gguugcgucuuaucaggc

SEQ ID NO: 613982 - RNA, 22 nt, Escherichia coli CFT073
gguuuucuccaaccagcuguuc

SEQ ID NO: 613983 - RNA, 14 nt, Escherichia coli CFT073
gguuuugaucacgu

SEQ ID NO: 613984 - RNA, 14 nt, Escherichia coli CFT073
gguuuuccagaacc

SEQ ID NO: 613985 - RNA, 19 nt, Escherichia coli CFT073
guaaaaacgcuuugcugcc

SEQ ID NO: 613986 - RNA, 13 nt, Escherichia coli CFT073
gguuugccagcag

SEQ ID NO: 613987 - RNA, 15 nt, Escherichia coli CFT073
gguuugccauaaccu

SEQ ID NO: 613988 - RNA, 14 nt, Escherichia coli CFT073
gguuucuuuauccg

SEQ ID NO: 613989 - RNA, 16 nt, Escherichia coli CFT073
gguuuguaggccggau

SEQ ID NO: 613990 - RNA, 11 nt, Escherichia coli CFT073
gguuuuaucca

SEQ ID NO: 613991 - RNA, 21 nt, Escherichia coli CFT073
gguuuucaacgugucuuuuac

SEQ ID NO: 613992 - RNA, 17 nt, Escherichia coli CFT073
gguuuccggaucgccaa

SEQ ID NO: 613993 - RNA, 15 nt, Escherichia coli CFT073
gguuucgaccacacc

SEQ ID NO: 613994 - RNA, 18 nt, Escherichia coli CFT073
gguuucgccgcggcgcag

SEQ ID NO: 613995 - RNA, 20 nt, Escherichia coli CFT073
gguuucaaauuacgauccac

SEQ ID NO: 613996 - RNA, 14 nt, Escherichia coli CFT073
gguuucaaccagca

SEQ ID NO: 613997 - RNA, 14 nt, Escherichia coli CFT073
gguuucaauccagg

SEQ ID NO: 613998 - RNA, 16 nt, Escherichia coli CFT073
gguuucaauccaggua

SEQ ID NO: 613999 - RNA, 14 nt, Escherichia coli CFT073
gguuucacccacgg

SEQ ID NO: 614000 - RNA, 18 nt, Escherichia coli CFT073
gguuucacguaccagaug

SEQ ID NO: 614001 - RNA, 16 nt, Escherichia coli CFT073
gguuaccuugauuauc

SEQ ID NO: 614002 - RNA, 16 nt, Escherichia coli CFT073
gguuauuuguaacugu

SEQ ID NO: 614003 - RNA, 20 nt, Escherichia coli CFT073
gguuccauuucugcggguga

SEQ ID NO: 614004 - RNA, 16 nt, Escherichia coli CFT073
gguuccacgcccgcac

SEQ ID NO: 614005 - RNA, 21 nt, Escherichia coli CFT073
gguuccccccacaaucagcca

SEQ ID NO: 614006 - RNA, 23 nt, Escherichia coli CFT073
gguuccuuccaguuguuuuugca

SEQ ID NO: 614007 - RNA, 20 nt, Escherichia coli CFT073
gguuccggcaaucaacagau

SEQ ID NO: 614008 - RNA, 12 nt, Escherichia coli CFT073
gguucaaccgca

SEQ ID NO: 614009 - RNA, 16 nt, Escherichia coli CFT073
gguucaauaucuuccu

SEQ ID NO: 614010 - RNA, 15 nt, Escherichia coli CFT073
gguucagcaaccaca

SEQ ID NO: 614011 - RNA, 12 nt, Escherichia coli CFT073
gguucaugcugc

SEQ ID NO: 614012 - RNA, 19 nt, Escherichia coli CFT073
gguucauugaacgcaaaug

SEQ ID NO: 614013 - RNA, 16 nt, Escherichia coli CFT073
gguucaucgagcagca

SEQ ID NO: 614014 - RNA, 21 nt, Escherichia coli CFT073
ggugcccgcauagcccagcgc

SEQ ID NO: 614015 - RNA, 23 nt, Escherichia coli CFT073
ggugccaucauacagccagcaau

SEQ ID NO: 614016 - RNA, 24 nt, Escherichia coli CFT073
gguggcaucuggugccagcgccag

SEQ ID NO: 614017 - RNA, 15 nt, Escherichia coli CFT073
ggugggcgaauacgg

SEQ ID NO: 614018 - RNA, 16 nt, Escherichia coli CFT073
ggugucaauccuucuu

SEQ ID NO: 614019 - RNA, 14 nt, Escherichia coli CFT073
gguguacuggcaau

SEQ ID NO: 614020 - RNA, 21 nt, Escherichia coli CFT073
gguguagccaauuaagucaac

SEQ ID NO: 614021 - RNA, 22 nt, Escherichia coli CFT073
gguguucauccuggcacagcag

SEQ ID NO: 614022 - RNA, 14 nt, Escherichia coli CFT073
ggucggggucgcga

SEQ ID NO: 614023 - RNA, 14 nt, Escherichia coli CFT073
ggucggguuaagcc

SEQ ID NO: 614024 - RNA, 23 nt, Escherichia coli CFT073
ggucgcucgagccgcauccgaca

SEQ ID NO: 614025 - RNA, 22 nt, Escherichia coli CFT073
ggucgcguagccaggcggcagu

SEQ ID NO: 614026 - RNA, 22 nt, Escherichia coli CFT073
ggucugaccguucgccccauac

SEQ ID NO: 614027 - RNA, 19 nt, Escherichia coli CFT073
gguccuaacaaccaucccc

SEQ ID NO: 614028 - RNA, 14 nt, Escherichia coli CFT073
gguccgcgaaucuc

SEQ ID NO: 614029 - RNA, 19 nt, Escherichia coli CFT073
gguccgccauuuccagcgu

SEQ ID NO: 614030 - RNA, 21 nt, Escherichia coli CFT073
ggugagcacaucagcgcccuc

SEQ ID NO: 614031 - RNA, 23 nt, Escherichia coli CFT073
ggucugcgacuguucgccaaaag

SEQ ID NO: 614032 - RNA, 18 nt, Escherichia coli CFT073
ggucuggcaaaaauaagg

SEQ ID NO: 614033 - RNA, 13 nt, Escherichia coli CFT073
ggucuggcgacgg

SEQ ID NO: 614034 - RNA, 16 nt, Escherichia coli CFT073
ggugaaguggcugacc

SEQ ID NO: 614035 - RNA, 18 nt, Escherichia coli CFT073
ggugaagugguugagugu

SEQ ID NO: 614036 - RNA, 23 nt, Escherichia coli CFT073
ggugaaguuuugucgcugauucg

SEQ ID NO: 614037 - RNA, 19 nt, Escherichia coli CFT073
ggugaauaccugagacaaa

SEQ ID NO: 614038 - RNA, 12 nt, Escherichia coli CFT073
ggugaaucaauc

SEQ ID NO: 614039 - RNA, 23 nt, Escherichia coli CFT073
ggugaauucaguaccagcaccug

SEQ ID NO: 614040 - RNA, 15 nt, Escherichia coli CFT073
ggugauuuauuucuc

SEQ ID NO: 614041 - RNA, 14 nt, Escherichia coli CFT073
ggugauuaaauuca

SEQ ID NO: 614042 - RNA, 20 nt, Escherichia coli CFT073
ggugauuaaauucaggccgu

SEQ ID NO: 614043 - RNA, 13 nt, Escherichia coli CFT073
ggugaugagcagg

SEQ ID NO: 614044 - RNA, 23 nt, Escherichia coli CFT073
ggucauuaaggcauaagcgcguu

SEQ ID NO: 614045 - RNA, 21 nt, Escherichia coli CFT073
gguccauauaaucgaaaccuu

SEQ ID NO: 614046 - RNA, 14 nt, Escherichia coli CFT073
ggucagaucagcca

SEQ ID NO: 614047 - RNA, 15 nt, Escherichia coli CFT073
ggucagcaagaaacu

SEQ ID NO: 614048 - RNA, 14 nt, Escherichia coli CFT073
ggucaucacccaga

SEQ ID NO: 614049 - RNA, 13 nt, Escherichia coli CFT073
ggucauaugcaaa

SEQ ID NO: 614050 - RNA, 16 nt, Escherichia coli CFT073
ggguguguagcgggug

SEQ ID NO: 614051 - RNA, 17 nt, Escherichia coli CFT073
gggugugacgacaccug

SEQ ID NO: 614052 - RNA, 18 nt, Escherichia coli CFT073
gguauagaaaccauccag

SEQ ID NO: 614053 - RNA, 12 nt, Escherichia coli CFT073
gguagcggguga

SEQ ID NO: 614054 - RNA, 13 nt, Escherichia coli CFT073
gguaucaaacaca

SEQ ID NO: 614055 - RNA, 21 nt, Escherichia coli CFT073
gguauagucacaaaauaagua

SEQ ID NO: 614056 - RNA, 17 nt, Escherichia coli CFT073
gguauagaaugcagcag

SEQ ID NO: 614057 - RNA, 11 nt, Escherichia coli CFT073
gguauaggauu

SEQ ID NO: 614058 - RNA, 15 nt, Escherichia coli CFT073
gguaucaaacacagg

SEQ ID NO: 614059 - RNA, 15 nt, Escherichia coli CFT073
ggucacaucgcugac

SEQ ID NO: 614060 - RNA, 22 nt, Escherichia coli CFT073
ggucaaagugggcgacaaaguu

SEQ ID NO: 614061 - RNA, 18 nt, Escherichia coli CFT073
gggguucccgagcggcca

SEQ ID NO: 614062 - RNA, 13 nt, Escherichia coli CFT073
gggguuacgaccu

SEQ ID NO: 614063 - RNA, 15 nt, Escherichia coli CFT073
gggguuuugcugauu

SEQ ID NO: 614064 - RNA, 15 nt, Escherichia coli CFT073
ggguaaaaccauuuu

SEQ ID NO: 614065 - RNA, 15 nt, Escherichia coli CFT073
ggguaauuucauuaa

SEQ ID NO: 614066 - RNA, 13 nt, Escherichia coli CFT073
ggguaagcgccac

SEQ ID NO: 614067 - RNA, 23 nt, Escherichia coli CFT073
gggucacugcgguguaaaccagc

SEQ ID NO: 614068 - RNA, 15 nt, Escherichia coli CFT073
ggguacgacuuccug

SEQ ID NO: 614069 - RNA, 18 nt, Escherichia coli CFT073
gggucgcgacugccagca

SEQ ID NO: 614070 - RNA, 22 nt, Escherichia coli CFT073
gggucagcggcggcucuuuugc

SEQ ID NO: 614071 - RNA, 22 nt, Escherichia coli CFT073
gggcuccauagggcagggugcc

SEQ ID NO: 614072 - RNA, 11 nt, Escherichia coli CFT073
gggccgucccc

SEQ ID NO: 614073 - RNA, 15 nt, Escherichia coli CFT073
gggccuccugcagcg

SEQ ID NO: 614074 - RNA, 14 nt, Escherichia coli CFT073
gggccucgcagcgg

SEQ ID NO: 614075 - RNA, 12 nt, Escherichia coli CFT073
gggccugaacaa

SEQ ID NO: 614076 - RNA, 15 nt, Escherichia coli CFT073
gggccugaacaagca

SEQ ID NO: 614077 - RNA, 18 nt, Escherichia coli CFT073
gggcgcuuccagccaugc

SEQ ID NO: 614078 - RNA, 20 nt, Escherichia coli CFT073
gggcggaacuucgcgaguga

SEQ ID NO: 614079 - RNA, 21 nt, Escherichia coli CFT073
gggcugauaccgcguuggcgc

SEQ ID NO: 614080 - RNA, 21 nt, Escherichia coli CFT073
gggcugacguuaagaaaacgg

SEQ ID NO: 614081 - RNA, 15 nt, Escherichia coli CFT073
ggggcauuuuccagu

SEQ ID NO: 614082 - RNA, 22 nt, Escherichia coli CFT073
ggggcauuuuuuccaggggcug

SEQ ID NO: 614083 - RNA, 14 nt, Escherichia coli CFT073
ggggcgaccugugc

SEQ ID NO: 614084 - RNA, 17 nt, Escherichia coli CFT073
gggcaaccucuggugug

SEQ ID NO: 614085 - RNA, 21 nt, Escherichia coli CFT073
gggcaagcaccuaaauccacc

SEQ ID NO: 614086 - RNA, 17 nt, Escherichia coli CFT073
gggcaauaaucuuuaca

SEQ ID NO: 614087 - RNA, 13 nt, Escherichia coli CFT073
gggcagaaacaac

SEQ ID NO: 614088 - RNA, 18 nt, Escherichia coli CFT073
gggauugcauccugcgcg

SEQ ID NO: 614089 - RNA, 18 nt, Escherichia coli CFT073
gggaucguagccuuguaa

SEQ ID NO: 614090 - RNA, 21 nt, Escherichia coli CFT073
gggauucacguugaugguagg

SEQ ID NO: 614091 - RNA, 16 nt, Escherichia coli CFT073
gggagauaaaaucgag

SEQ ID NO: 614092 - RNA, 18 nt, Escherichia coli CFT073
gggagaauuaacagguau

SEQ ID NO: 614093 - RNA, 17 nt, Escherichia coli CFT073
gggagacuucacugaaa

SEQ ID NO: 614094 - RNA, 11 nt, Escherichia coli CFT073
gggaucauuaa

SEQ ID NO: 614095 - RNA, 24 nt, Escherichia coli CFT073
gggccaguaaacugacccgcucgu

SEQ ID NO: 614096 - RNA, 18 nt, Escherichia coli CFT073
gggccgaacaucagauaa

SEQ ID NO: 614097 - RNA, 23 nt, Escherichia coli CFT073
ggcuucaucuuuaucaaucagcc

SEQ ID NO: 614098 - RNA, 20 nt, Escherichia coli CFT073
ggcuucacgcccagcacauu

SEQ ID NO: 614099 - RNA, 15 nt, Escherichia coli CFT073
ggcuuacguuaccca

SEQ ID NO: 614100 - RNA, 20 nt, Escherichia coli CFT073
ggcuuacguuacccagcacg

SEQ ID NO: 614101 - RNA, 22 nt, Escherichia coli CFT073
ggcuuauauaggugauaaagua

SEQ ID NO: 614102 - RNA, 15 nt, Escherichia coli CFT073
ggcuugccagcaggg

SEQ ID NO: 614103 - RNA, 17 nt, Escherichia coli CFT073
ggcugucgcacggcgca

SEQ ID NO: 614104 - RNA, 19 nt, Escherichia coli CFT073
ggcuguauuuuuccagcuc

SEQ ID NO: 614105 - RNA, 13 nt, Escherichia coli CFT073
gggacgcugcacg

SEQ ID NO: 614106 - RNA, 22 nt, Escherichia coli CFT073
gggacgguccgugcgcuuuuua

SEQ ID NO: 614107 - RNA, 17 nt, Escherichia coli CFT073
gggaauugugcuuucag

SEQ ID NO: 614108 - RNA, 12 nt, Escherichia coli CFT073
gggacauuuagc

SEQ ID NO: 614109 - RNA, 14 nt, Escherichia coli CFT073
gggaauagcucagu

SEQ ID NO: 614110 - RNA, 15 nt, Escherichia coli CFT073
gggaauagcucaguu

SEQ ID NO: 614111 - RNA, 20 nt, Escherichia coli CFT073
gggaauagcucaguugguag

SEQ ID NO: 614112 - RNA, 22 nt, Escherichia coli CFT073
gggaaggcccuuucccuucuug

SEQ ID NO: 614113 - RNA, 15 nt, Escherichia coli CFT073
gggaagggagcgccg

SEQ ID NO: 614114 - RNA, 19 nt, Escherichia coli CFT073
gggaagggucuuuuaaauc

SEQ ID NO: 614115 - RNA, 12 nt, Escherichia coli CFT073
gggaaggucagg

SEQ ID NO: 614116 - RNA, 13 nt, Escherichia coli CFT073
gggaaggucaggu

SEQ ID NO: 614117 - RNA, 14 nt, Escherichia coli CFT073
gggaagauaaaaac

SEQ ID NO: 614118 - RNA, 14 nt, Escherichia coli CFT073
gggaacugcaggca

SEQ ID NO: 614119 - RNA, 17 nt, Escherichia coli CFT073
ggcuuugcuguuuccag

SEQ ID NO: 614120 - RNA, 21 nt, Escherichia coli CFT073
ggcuuuguuacccccauccac

SEQ ID NO: 614121 - RNA, 12 nt, Escherichia coli CFT073
ggcuuucuucag

SEQ ID NO: 614122 - RNA, 23 nt, Escherichia coli CFT073
ggcuuucuucuggguugccugau

SEQ ID NO: 614123 - RNA, 22 nt, Escherichia coli CFT073
cuacagaacgcugcaauuuauu

SEQ ID NO: 614124 - RNA, 13 nt, Escherichia coli CFT073
cuacacaccuucu

SEQ ID NO: 614125 - RNA, 12 nt, Escherichia coli CFT073
cuacaucauuuu

SEQ ID NO: 614126 - RNA, 14 nt, Escherichia coli CFT073
cuacaugauuucug

SEQ ID NO: 614127 - RNA, 18 nt, Escherichia coli CFT073
cuacaugccaucacaccu

SEQ ID NO: 614128 - RNA, 15 nt, Escherichia coli CFT073
cuacagugccccaaa

SEQ ID NO: 614129 - RNA, 21 nt, Escherichia coli CFT073
cuacagcggaacuuuuuucau

SEQ ID NO: 614130 - RNA, 20 nt, Escherichia coli CFT073
cuacagccaugcgaaugcca

SEQ ID NO: 614131 - RNA, 16 nt, Escherichia coli CFT073
cuacccgauaggcuuc

SEQ ID NO: 614132 - RNA, 13 nt, Escherichia coli CFT073
cuaccgaccagac

SEQ ID NO: 614133 - RNA, 18 nt, Escherichia coli CFT073
cuaccagcugaaaucacc

SEQ ID NO: 614134 - RNA, 20 nt, Escherichia coli CFT073
cuaccagguuucgcaauaac

SEQ ID NO: 614135 - RNA, 23 nt, Escherichia coli CFT073
cuaccaguagugaaaaaagcaag

SEQ ID NO: 614136 - RNA, 17 nt, Escherichia coli CFT073
cuaccaugaucugcaaa

SEQ ID NO: 614137 - RNA, 23 nt, Escherichia coli CFT073
cuaccaugaucugcaaauucaau

SEQ ID NO: 614138 - RNA, 22 nt, Escherichia coli CFT073
cuaccagugccagaacagaaau

SEQ ID NO: 614139 - RNA, 16 nt, Escherichia coli CFT073
cuaccaguuccagcgc

SEQ ID NO: 614140 - RNA, 22 nt, Escherichia coli CFT073
cuaccaguuuggugacgccaca

SEQ ID NO: 614141 - RNA, 21 nt, Escherichia coli CFT073
cuacccaugaagaaaauucca

SEQ ID NO: 614142 - RNA, 22 nt, Escherichia coli CFT073
cuacccgaacaccaaucuucaa

SEQ ID NO: 614143 - RNA, 13 nt, Escherichia coli CFT073
cuacccgcgcagu

SEQ ID NO: 614144 - RNA, 21 nt, Escherichia coli CFT073
cuaccagcaaagagagaucca

SEQ ID NO: 614145 - RNA, 17 nt, Escherichia coli CFT073
cuaccacugccugaguu

SEQ ID NO: 614146 - RNA, 21 nt, Escherichia coli CFT073
cuaccaaaacggacauguugc

SEQ ID NO: 614147 - RNA, 16 nt, Escherichia coli CFT073
cuacguagcucaucuu

SEQ ID NO: 614148 - RNA, 20 nt, Escherichia coli CFT073
cuacgucgcgguugcaaucu

SEQ ID NO: 614149 - RNA, 19 nt, Escherichia coli CFT073
cuacgugauuccugcaauu

SEQ ID NO: 614150 - RNA, 22 nt, Escherichia coli CFT073
cuacgugccgggcaaauucaga

SEQ ID NO: 614151 - RNA, 15 nt, Escherichia coli CFT073
cuacguucgcgagga

SEQ ID NO: 614152 - RNA, 20 nt, Escherichia coli CFT073
cuacgcgccgccagccacag

SEQ ID NO: 614153 - RNA, 15 nt, Escherichia coli CFT073
cuacggucacgccac

SEQ ID NO: 614154 - RNA, 14 nt, Escherichia coli CFT073
cuacggucugccgg

SEQ ID NO: 614155 - RNA, 22 nt, Escherichia coli CFT073
cuacgcuucucucuguagaaca

SEQ ID NO: 614156 - RNA, 16 nt, Escherichia coli CFT073
cuacggcgacagcaaa

SEQ ID NO: 614157 - RNA, 15 nt, Escherichia coli CFT073
cuacggcucagcaau

SEQ ID NO: 614158 - RNA, 15 nt, Escherichia coli CFT073
cuagaaacuguuaag

SEQ ID NO: 614159 - RNA, 20 nt, Escherichia coli CFT073
cuaguacgccaaucugcaaa

SEQ ID NO: 614160 - RNA, 12 nt, Escherichia coli CFT073
cuauaaauauac

SEQ ID NO: 614161 - RNA, 14 nt, Escherichia coli CFT073
cuauaaauauacau

SEQ ID NO: 614162 - RNA, 23 nt, Escherichia coli CFT073
cuauaaauauacauacuguaaau

SEQ ID NO: 614163 - RNA, 22 nt, Escherichia coli CFT073
cucagccugauagagugugugu

SEQ ID NO: 614164 - RNA, 14 nt, Escherichia coli CFT073
cucagccuucugua

SEQ ID NO: 614165 - RNA, 13 nt, Escherichia coli CFT073
cucaggaaaagca

SEQ ID NO: 614166 - RNA, 16 nt, Escherichia coli CFT073
cucaggaacuuaguag

SEQ ID NO: 614167 - RNA, 15 nt, Escherichia coli CFT073
cucagcaguuucggc

SEQ ID NO: 614168 - RNA, 13 nt, Escherichia coli CFT073
cucacuuuuccgc

SEQ ID NO: 614169 - RNA, 20 nt, Escherichia coli CFT073
cucacgcugcguacagcgcg

SEQ ID NO: 614170 - RNA, 23 nt, Escherichia coli CFT073
cucacuuaaagccgcuuccgggc

SEQ ID NO: 614171 - RNA, 13 nt, Escherichia coli CFT073
cucacuuuguagg

SEQ ID NO: 614172 - RNA, 14 nt, Escherichia coli CFT073
cucacuuuguaggc

SEQ ID NO: 614173 - RNA, 18 nt, Escherichia coli CFT073
cucacuuuguaggccuga

SEQ ID NO: 614174 - RNA, 17 nt, Escherichia coli CFT073
cucaaucccuuucucca

SEQ ID NO: 614175 - RNA, 17 nt, Escherichia coli CFT073
cucaauccuacauccag

SEQ ID NO: 614176 - RNA, 18 nt, Escherichia coli CFT073
cucaaucgaaauacgacu

SEQ ID NO: 614177 - RNA, 22 nt, Escherichia coli CFT073
cucaaucgucaaacgcacgucu

SEQ ID NO: 614178 - RNA, 19 nt, Escherichia coli CFT073
cucaaaagcguaccgccaa

SEQ ID NO: 614179 - RNA, 19 nt, Escherichia coli CFT073
cucaaaccauuucugcgag

SEQ ID NO: 614180 - RNA, 13 nt, Escherichia coli CFT073
cucaaacgccagc

SEQ ID NO: 614181 - RNA, 17 nt, Escherichia coli CFT073
cucaaaccggcuccaga

SEQ ID NO: 614182 - RNA, 12 nt, Escherichia coli CFT073
cucaaacuggcu

SEQ ID NO: 614183 - RNA, 18 nt, Escherichia coli CFT073
cucaauuuauauucacuu

SEQ ID NO: 614184 - RNA, 14 nt, Escherichia coli CFT073
cucaauuuucacuu

SEQ ID NO: 614185 - RNA, 13 nt, Escherichia coli CFT073
cucacaaucaucg

SEQ ID NO: 614186 - RNA, 14 nt, Escherichia coli CFT073
cucacacaaacggc

SEQ ID NO: 614187 - RNA, 14 nt, Escherichia coli CFT073
cucacacagcuuuc

SEQ ID NO: 614188 - RNA, 16 nt, Escherichia coli CFT073
cucaccaauccaggca

SEQ ID NO: 614189 - RNA, 17 nt, Escherichia coli CFT073
cucaccaaucggcagaa

SEQ ID NO: 614190 - RNA, 14 nt, Escherichia coli CFT073
cucaauggcagcau

SEQ ID NO: 614191 - RNA, 19 nt, Escherichia coli CFT073
cucaaugguguuuuccacc

SEQ ID NO: 614192 - RNA, 22 nt, Escherichia coli CFT073
cucaauuccuuugcugcucuau

SEQ ID NO: 614193 - RNA, 21 nt, Escherichia coli CFT073
cucaccacggugauucagcgu

SEQ ID NO: 614194 - RNA, 18 nt, Escherichia coli CFT073
cucacaccaugccagaaa

SEQ ID NO: 614195 - RNA, 19 nt, Escherichia coli CFT073
cucaccagcaucgcuucca

SEQ ID NO: 614196 - RNA, 18 nt, Escherichia coli CFT073
cucacccccacucccgca

SEQ ID NO: 614197 - RNA, 21 nt, Escherichia coli CFT073
cucacgcauacaguaucgccu

SEQ ID NO: 614198 - RNA, 17 nt, Escherichia coli CFT073
cucaccauuggcauaca

SEQ ID NO: 614199 - RNA, 14 nt, Escherichia coli CFT073
cucaccauuuuuug

SEQ ID NO: 614200 - RNA, 13 nt, Escherichia coli CFT073
cuauuuuccuguu

SEQ ID NO: 614201 - RNA, 19 nt, Escherichia coli CFT073
cuauuuaacaauucuccaa

SEQ ID NO: 614202 - RNA, 13 nt, Escherichia coli CFT073
cuauuuacagauu

SEQ ID NO: 614203 - RNA, 18 nt, Escherichia coli CFT073
cuauuuacagauuuccca

SEQ ID NO: 614204 - RNA, 20 nt, Escherichia coli CFT073
cuauuuaccagcacaucuua

SEQ ID NO: 614205 - RNA, 23 nt, Escherichia coli CFT073
cuaucugccguucagccaaugcc

SEQ ID NO: 614206 - RNA, 15 nt, Escherichia coli CFT073
cuaucugacuuuccg

SEQ ID NO: 614207 - RNA, 18 nt, Escherichia coli CFT073
cuaucuucgauaaacuca

SEQ ID NO: 614208 - RNA, 22 nt, Escherichia coli CFT073
cuaucuggcgcgcuauuaccag

SEQ ID NO: 614209 - RNA, 13 nt, Escherichia coli CFT073
cuaucuacugccu

SEQ ID NO: 614210 - RNA, 17 nt, Escherichia coli CFT073
cuauacuccugauggcc

SEQ ID NO: 614211 - RNA, 18 nt, Escherichia coli CFT073
cuauucauugcuauuucc

SEQ ID NO: 614212 - RNA, 22 nt, Escherichia coli CFT073
cuauggaaguuccggcaccguu

SEQ ID NO: 614213 - RNA, 19 nt, Escherichia coli CFT073
cucgcugauugccccuccg

SEQ ID NO: 614214 - RNA, 11 nt, Escherichia coli CFT073
cucgcggcgga

SEQ ID NO: 614215 - RNA, 14 nt, Escherichia coli CFT073
cucggcgcggaugc

SEQ ID NO: 614216 - RNA, 21 nt, Escherichia coli CFT073
cucgcuggcguuguccgccag

SEQ ID NO: 614217 - RNA, 19 nt, Escherichia coli CFT073
cucgcuuaagccaucauca

SEQ ID NO: 614218 - RNA, 18 nt, Escherichia coli CFT073
cucgugcgguaucaccac

SEQ ID NO: 614219 - RNA, 12 nt, Escherichia coli CFT073
cucgugguucaa

SEQ ID NO: 614220 - RNA, 14 nt, Escherichia coli CFT073
cucguuauagguau

SEQ ID NO: 614221 - RNA, 22 nt, Escherichia coli CFT073
cucguuauuguuugucgccuuu

SEQ ID NO: 614222 - RNA, 14 nt, Escherichia coli CFT073
cucguucacauauu

SEQ ID NO: 614223 - RNA, 17 nt, Escherichia coli CFT073
cucgugauaguccagcc

SEQ ID NO: 614224 - RNA, 23 nt, Escherichia coli CFT073
cucgucggcgguuuucaucaucc

SEQ ID NO: 614225 - RNA, 20 nt, Escherichia coli CFT073
cucguuggguugccagcgac

SEQ ID NO: 614226 - RNA, 11 nt, Escherichia coli CFT073
cucguugauca

SEQ ID NO: 614227 - RNA, 14 nt, Escherichia coli CFT073
cucuaaaaucauca

SEQ ID NO: 614228 - RNA, 23 nt, Escherichia coli CFT073
cucuaagucuuucugugcaauca

SEQ ID NO: 614229 - RNA, 15 nt, Escherichia coli CFT073
cucuaacccuuccag

SEQ ID NO: 614230 - RNA, 18 nt, Escherichia coli CFT073
cucuaacccuuccagauu

SEQ ID NO: 614231 - RNA, 20 nt, Escherichia coli CFT073
cucuaacccuuccagauuca

SEQ ID NO: 614232 - RNA, 12 nt, Escherichia coli CFT073
cucgcccaugcg

SEQ ID NO: 614233 - RNA, 16 nt, Escherichia coli CFT073
cucgccccgugaugaa

SEQ ID NO: 614234 - RNA, 17 nt, Escherichia coli CFT073
cucgccauccuuaugca

SEQ ID NO: 614235 - RNA, 18 nt, Escherichia coli CFT073
cucgccacgucacucuuu

SEQ ID NO: 614236 - RNA, 16 nt, Escherichia coli CFT073
cucgccaguguucuuc

SEQ ID NO: 614237 - RNA, 19 nt, Escherichia coli CFT073
cucgccggaugaaaaguca

SEQ ID NO: 614238 - RNA, 16 nt, Escherichia coli CFT073
cucgccgcaaaaccca

SEQ ID NO: 614239 - RNA, 13 nt, Escherichia coli CFT073
cucgccgccgcag

SEQ ID NO: 614240 - RNA, 14 nt, Escherichia coli CFT073
cucgccccuccggg

SEQ ID NO: 614241 - RNA, 18 nt, Escherichia coli CFT073
cucgccccugcccuuuca

SEQ ID NO: 614242 - RNA, 17 nt, Escherichia coli CFT073
cucgcgaaccgccuggc

SEQ ID NO: 614243 - RNA, 18 nt, Escherichia coli CFT073
cucgccguucuccucaac

SEQ ID NO: 614244 - RNA, 16 nt, Escherichia coli CFT073
cucgcgcagcucauca

SEQ ID NO: 614245 - RNA, 18 nt, Escherichia coli CFT073
cucgcgauacgcuucaac

SEQ ID NO: 614246 - RNA, 14 nt, Escherichia coli CFT073
cucgcaaaauaaaa

SEQ ID NO: 614247 - RNA, 15 nt, Escherichia coli CFT073
cucgcaaaauaaaaa

SEQ ID NO: 614248 - RNA, 24 nt, Escherichia coli CFT073
cucgcaagccgaauaacggcucaa

SEQ ID NO: 614249 - RNA, 16 nt, Escherichia coli CFT073
cucgcacgccacgccg

SEQ ID NO: 614250 - RNA, 22 nt, Escherichia coli CFT073
cucgcaggcggcaucgugucgg

SEQ ID NO: 614251 - RNA, 16 nt, Escherichia coli CFT073
cucgcaucccauugcg

SEQ ID NO: 614252 - RNA, 13 nt, Escherichia coli CFT073
cucgcacuucuga

SEQ ID NO: 614253 - RNA, 21 nt, Escherichia coli CFT073
cucgcagaaauaccccgccag

SEQ ID NO: 614254 - RNA, 21 nt, Escherichia coli CFT073
cucgauuuuauaaagggaugc

SEQ ID NO: 614255 - RNA, 16 nt, Escherichia coli CFT073
cucgacgcagcagacg

SEQ ID NO: 614256 - RNA, 19 nt, Escherichia coli CFT073
cuccucaucaauauugucu

SEQ ID NO: 614257 - RNA, 17 nt, Escherichia coli CFT073
cuccgugucuuuauuuc

SEQ ID NO: 614258 - RNA, 16 nt, Escherichia coli CFT073
cuccgggcgcaccagu

SEQ ID NO: 614259 - RNA, 20 nt, Escherichia coli CFT073
cuccgggugugacaacaaca

SEQ ID NO: 614260 - RNA, 19 nt, Escherichia coli CFT073
cuccgcucuucaucuucca

SEQ ID NO: 614261 - RNA, 13 nt, Escherichia coli CFT073
cuccgggcaugaa

SEQ ID NO: 614262 - RNA, 22 nt, Escherichia coli CFT073
cuccggcgcguugauaccgugc

SEQ ID NO: 614263 - RNA, 14 nt, Escherichia coli CFT073
cuccgaucccugcg

SEQ ID NO: 614264 - RNA, 21 nt, Escherichia coli CFT073
cuccgcguucaauacgcaguu

SEQ ID NO: 614265 - RNA, 16 nt, Escherichia coli CFT073
cuccccgcaaaccaga

SEQ ID NO: 614266 - RNA, 14 nt, Escherichia coli CFT073
cucccccucuuccg

SEQ ID NO: 614267 - RNA, 19 nt, Escherichia coli CFT073
cucccauuuuauccucuuc

SEQ ID NO: 614268 - RNA, 14 nt, Escherichia coli CFT073
cuccccaaggacgc

SEQ ID NO: 614269 - RNA, 15 nt, Escherichia coli CFT073
cuccccacaccacca

SEQ ID NO: 614270 - RNA, 23 nt, Escherichia coli CFT073
cuccauguaauucggcaaucgcu

SEQ ID NO: 614271 - RNA, 14 nt, Escherichia coli CFT073
cuccagcaucuccu

SEQ ID NO: 614272 - RNA, 19 nt, Escherichia coli CFT073
cuccauugcccgcccgaca

SEQ ID NO: 614273 - RNA, 16 nt, Escherichia coli CFT073
cuccauuuuucguuuc

SEQ ID NO: 614274 - RNA, 13 nt, Escherichia coli CFT073
cuccacugcucac

SEQ ID NO: 614275 - RNA, 11 nt, Escherichia coli CFT073
cuccacuuccu

SEQ ID NO: 614276 - RNA, 14 nt, Escherichia coli CFT073
cuccacuuccugcc

SEQ ID NO: 614277 - RNA, 17 nt, Escherichia coli CFT073
cuccacuuccugccagu

SEQ ID NO: 614278 - RNA, 22 nt, Escherichia coli CFT073
cuccagaauuccgugccagcac

SEQ ID NO: 614279 - RNA, 19 nt, Escherichia coli CFT073
cuccagacaccgcugcuuc

SEQ ID NO: 614280 - RNA, 14 nt, Escherichia coli CFT073
cuccagauauugcu

SEQ ID NO: 614281 - RNA, 15 nt, Escherichia coli CFT073
cuccagauauugcuc

SEQ ID NO: 614282 - RNA, 18 nt, Escherichia coli CFT073
cuccagauauugcucuac

SEQ ID NO: 614283 - RNA, 18 nt, Escherichia coli CFT073
cuccagacgcccgcgccc

SEQ ID NO: 614284 - RNA, 19 nt, Escherichia coli CFT073
cuccagacgcccgcgccca

SEQ ID NO: 614285 - RNA, 14 nt, Escherichia coli CFT073
cuccagaugacugg

SEQ ID NO: 614286 - RNA, 16 nt, Escherichia coli CFT073
cuccagaugacuggcu

SEQ ID NO: 614287 - RNA, 13 nt, Escherichia coli CFT073
cuccagcagcuca

SEQ ID NO: 614288 - RNA, 14 nt, Escherichia coli CFT073
cuccagcagcucaa

SEQ ID NO: 614289 - RNA, 22 nt, Escherichia coli CFT073
cuccaaggucuccgcccagcgu

SEQ ID NO: 614290 - RNA, 16 nt, Escherichia coli CFT073
cuccaaucguucaacc

SEQ ID NO: 614291 - RNA, 22 nt, Escherichia coli CFT073
cuccaccagcaccagcaacaac

SEQ ID NO: 614292 - RNA, 14 nt, Escherichia coli CFT073
cuccacgcaggcgu

SEQ ID NO: 614293 - RNA, 20 nt, Escherichia coli CFT073
cuccacgcccagcgcaggaa

SEQ ID NO: 614294 - RNA, 20 nt, Escherichia coli CFT073
cuccaccggacggacuucaa

SEQ ID NO: 614295 - RNA, 22 nt, Escherichia coli CFT073
cucauugauuuucaaaucgagc

SEQ ID NO: 614296 - RNA, 14 nt, Escherichia coli CFT073
cucauuuucaauuc

SEQ ID NO: 614297 - RNA, 13 nt, Escherichia coli CFT073
cucauuuucucuu

SEQ ID NO: 614298 - RNA, 15 nt, Escherichia coli CFT073
cucauuuucucuuuu

SEQ ID NO: 614299 - RNA, 20 nt, Escherichia coli CFT073
cucauuuugauuaauauuga

SEQ ID NO: 614300 - RNA, 17 nt, Escherichia coli CFT073
cucauuuuuaacagugu

SEQ ID NO: 614301 - RNA, 23 nt, Escherichia coli CFT073
cucauuuuucagcguuccccaga

SEQ ID NO: 614302 - RNA, 17 nt, Escherichia coli CFT073
cuccaacaacccugcau

SEQ ID NO: 614303 - RNA, 14 nt, Escherichia coli CFT073
cuccaacccacaaa

SEQ ID NO: 614304 - RNA, 16 nt, Escherichia coli CFT073
cuccaacccacaaaaa

SEQ ID NO: 614305 - RNA, 20 nt, Escherichia coli CFT073
cuccaacccacaaaaacacc

SEQ ID NO: 614306 - RNA, 22 nt, Escherichia coli CFT073
cuccaacccacaaaaacaccgc

SEQ ID NO: 614307 - RNA, 15 nt, Escherichia coli CFT073
cucauuagcccggca

SEQ ID NO: 614308 - RNA, 15 nt, Escherichia coli CFT073
cucauuauucaaucg

SEQ ID NO: 614309 - RNA, 19 nt, Escherichia coli CFT073
cucaggccgauuucaugaa

SEQ ID NO: 614310 - RNA, 23 nt, Escherichia coli CFT073
cucaggccgauuucaugaagcug

SEQ ID NO: 614311 - RNA, 17 nt, Escherichia coli CFT073
cucaggcgcacgccaac

SEQ ID NO: 614312 - RNA, 22 nt, Escherichia coli CFT073
cucaggcgcacgccaacaaaaa

SEQ ID NO: 614313 - RNA, 18 nt, Escherichia coli CFT073
cguuuguccgccagaaau

SEQ ID NO: 614314 - RNA, 17 nt, Escherichia coli CFT073
cguuuguucugcauccu

SEQ ID NO: 614315 - RNA, 21 nt, Escherichia coli CFT073
cguuuuaaaucgccgcaucau

SEQ ID NO: 614316 - RNA, 20 nt, Escherichia coli CFT073
cguuuuacaauauccagcgc

SEQ ID NO: 614317 - RNA, 19 nt, Escherichia coli CFT073
cguuuuaccugcuauagcc

SEQ ID NO: 614318 - RNA, 19 nt, Escherichia coli CFT073
cguuuuacgcgucacaccu

SEQ ID NO: 614319 - RNA, 17 nt, Escherichia coli CFT073
cguuucucgacuuuuuc

SEQ ID NO: 614320 - RNA, 16 nt, Escherichia coli CFT073
cguuuggccacaccau

SEQ ID NO: 614321 - RNA, 18 nt, Escherichia coli CFT073
cguuuccauaucgcuggc

SEQ ID NO: 614322 - RNA, 19 nt, Escherichia coli CFT073
cguuucgccauaaaacagc

SEQ ID NO: 614323 - RNA, 15 nt, Escherichia coli CFT073
cguuucgcugcgucu

SEQ ID NO: 614324 - RNA, 15 nt, Escherichia coli CFT073
cguugauuucaccau

SEQ ID NO: 614325 - RNA, 19 nt, Escherichia coli CFT073
cguugcagaaguugugaaa

SEQ ID NO: 614326 - RNA, 16 nt, Escherichia coli CFT073
cguugcagcaaauaaa

SEQ ID NO: 614327 - RNA, 16 nt, Escherichia coli CFT073
cguugccaguaccauc

SEQ ID NO: 614328 - RNA, 19 nt, Escherichia coli CFT073
cguugccaucgugggauaa

SEQ ID NO: 614329 - RNA, 19 nt, Escherichia coli CFT073
cguugccacacgacgccag

SEQ ID NO: 614330 - RNA, 19 nt, Escherichia coli CFT073
cguugccacucaggcaaag

SEQ ID NO: 614331 - RNA, 17 nt, Escherichia coli CFT073
cguugugcgauccacgc

SEQ ID NO: 614332 - RNA, 16 nt, Escherichia coli CFT073
cguuguagcuuuuucc

SEQ ID NO: 614333 - RNA, 17 nt, Escherichia coli CFT073
cuaaacagagcugcaaa

SEQ ID NO: 614334 - RNA, 16 nt, Escherichia coli CFT073
cuaaaaguuauuaaaa

SEQ ID NO: 614335 - RNA, 9 nt, Escherichia coli CFT073
cuaaaaaca

SEQ ID NO: 614336 - RNA, 20 nt, Escherichia coli CFT073
cuaaaacuucauuugucuca

SEQ ID NO: 614337 - RNA, 16 nt, Escherichia coli CFT073
cuaaaagcacgccaga

SEQ ID NO: 614338 - RNA, 22 nt, Escherichia coli CFT073
cuaaaagcacgccagacaucac

SEQ ID NO: 614339 - RNA, 21 nt, Escherichia coli CFT073
cguuuuuaacguccgcucaau

SEQ ID NO: 614340 - RNA, 17 nt, Escherichia coli CFT073
cguuuuuacccagcagc

SEQ ID NO: 614341 - RNA, 22 nt, Escherichia coli CFT073
cguuuuuuuaucccuucuccac

SEQ ID NO: 614342 - RNA, 13 nt, Escherichia coli CFT073
cguuuuuuguccg

SEQ ID NO: 614343 - RNA, 19 nt, Escherichia coli CFT073
cguuuuucuuccggcagca

SEQ ID NO: 614344 - RNA, 11 nt, Escherichia coli CFT073
cguuuuuucac

SEQ ID NO: 614345 - RNA, 20 nt, Escherichia coli CFT073
cguuuugacagcucacgcgc

SEQ ID NO: 614346 - RNA, 21 nt, Escherichia coli CFT073
cguuuuccgcuaacucacgca

SEQ ID NO: 614347 - RNA, 16 nt, Escherichia coli CFT073
cguuuugccgccauca

SEQ ID NO: 614348 - RNA, 14 nt, Escherichia coli CFT073
cguuuucaccacuu

SEQ ID NO: 614349 - RNA, 14 nt, Escherichia coli CFT073
cguuuuacagcaac

SEQ ID NO: 614350 - RNA, 15 nt, Escherichia coli CFT073
cguuuuaguaacaac

SEQ ID NO: 614351 - RNA, 13 nt, Escherichia coli CFT073
cguuaccuuugca

SEQ ID NO: 614352 - RNA, 19 nt, Escherichia coli CFT073
cguuacggaccacgcacag

SEQ ID NO: 614353 - RNA, 22 nt, Escherichia coli CFT073
cguuagaaaacgccugcuccuc

SEQ ID NO: 614354 - RNA, 16 nt, Escherichia coli CFT073
cguuagguugugaaug

SEQ ID NO: 614355 - RNA, 22 nt, Escherichia coli CFT073
cguuauacaucgcuuuccaggu

SEQ ID NO: 614356 - RNA, 19 nt, Escherichia coli CFT073
cguuauagcgauuuuucau

SEQ ID NO: 614357 - RNA, 13 nt, Escherichia coli CFT073
cguuaucagaacg

SEQ ID NO: 614358 - RNA, 22 nt, Escherichia coli CFT073
cguuaucagaacgcguaguuaa

SEQ ID NO: 614359 - RNA, 13 nt, Escherichia coli CFT073
cguuacagcugga

SEQ ID NO: 614360 - RNA, 15 nt, Escherichia coli CFT073
cguuacaaccacaua

SEQ ID NO: 614361 - RNA, 16 nt, Escherichia coli CFT073
cguuacaaccacauau

SEQ ID NO: 614362 - RNA, 15 nt, Escherichia coli CFT073
cguuacccagcacgg

SEQ ID NO: 614363 - RNA, 22 nt, Escherichia coli CFT073
cguuaauuuccucuucccgcuc

SEQ ID NO: 614364 - RNA, 16 nt, Escherichia coli CFT073
cguuaauuucuuuuca

SEQ ID NO: 614365 - RNA, 15 nt, Escherichia coli CFT073
cguuaaucgccugcu

SEQ ID NO: 614366 - RNA, 19 nt, Escherichia coli CFT073
cguuaauacuacgcagacg

SEQ ID NO: 614367 - RNA, 18 nt, Escherichia coli CFT073
cguggcagaaugguuuca

SEQ ID NO: 614368 - RNA, 13 nt, Escherichia coli CFT073
cguggaugaaaca

SEQ ID NO: 614369 - RNA, 23 nt, Escherichia coli CFT073
cguggaugcgauguucccccagc

SEQ ID NO: 614370 - RNA, 19 nt, Escherichia coli CFT073
cguucacaaacagcgccug

SEQ ID NO: 614371 - RNA, 11 nt, Escherichia coli CFT073
cguucacgccg

SEQ ID NO: 614372 - RNA, 23 nt, Escherichia coli CFT073
cguucaaccacuucggcaucuuu

SEQ ID NO: 614373 - RNA, 20 nt, Escherichia coli CFT073
cguucagccgcuuuaucuga

SEQ ID NO: 614374 - RNA, 17 nt, Escherichia coli CFT073
cguucaguucaaaguua

SEQ ID NO: 614375 - RNA, 22 nt, Escherichia coli CFT073
cguucauaaauacagagcacgc

SEQ ID NO: 614376 - RNA, 23 nt, Escherichia coli CFT073
cguucauacgcaaugugcagcag

SEQ ID NO: 614377 - RNA, 24 nt, Escherichia coli CFT073
cguucaucgggcaucgcaaccaca

SEQ ID NO: 614378 - RNA, 15 nt, Escherichia coli CFT073
cguucccagcgcguu

SEQ ID NO: 614379 - RNA, 22 nt, Escherichia coli CFT073
cguucggugcgcgcuggcaucg

SEQ ID NO: 614380 - RNA, 21 nt, Escherichia coli CFT073
cguucgguauuaauuugccag

SEQ ID NO: 614381 - RNA, 14 nt, Escherichia coli CFT073
cguucgguuuugcg

SEQ ID NO: 614382 - RNA, 19 nt, Escherichia coli CFT073
cguuccggcggcacagcca

SEQ ID NO: 614383 - RNA, 21 nt, Escherichia coli CFT073
cguucccuucuugcgcaaacc

SEQ ID NO: 614384 - RNA, 20 nt, Escherichia coli CFT073
cguuccugacgaucaagcga

SEQ ID NO: 614385 - RNA, 13 nt, Escherichia coli CFT073
cguuccugcaacg

SEQ ID NO: 614386 - RNA, 14 nt, Escherichia coli CFT073
cguuccucaccuuc

SEQ ID NO: 614387 - RNA, 15 nt, Escherichia coli CFT073
cguugagguugaucu

SEQ ID NO: 614388 - RNA, 14 nt, Escherichia coli CFT073
cguugaguuuacgc

SEQ ID NO: 614389 - RNA, 20 nt, Escherichia coli CFT073
cguugauaccgugcagcacg

SEQ ID NO: 614390 - RNA, 14 nt, Escherichia coli CFT073
cguugaucuucucu

SEQ ID NO: 614391 - RNA, 19 nt, Escherichia coli CFT073
cguucggugauauacgcca

SEQ ID NO: 614392 - RNA, 15 nt, Escherichia coli CFT073
cguucuacuaugagg

SEQ ID NO: 614393 - RNA, 15 nt, Escherichia coli CFT073
cuaacccucucccca

SEQ ID NO: 614394 - RNA, 14 nt, Escherichia coli CFT073
cuaacagaucaucc

SEQ ID NO: 614395 - RNA, 15 nt, Escherichia coli CFT073
cuaacagaucaucca

SEQ ID NO: 614396 - RNA, 12 nt, Escherichia coli CFT073
cuaacagcagca

SEQ ID NO: 614397 - RNA, 14 nt, Escherichia coli CFT073
cuaaccauccacau

SEQ ID NO: 614398 - RNA, 14 nt, Escherichia coli CFT073
cuaacccaacauuc

SEQ ID NO: 614399 - RNA, 19 nt, Escherichia coli CFT073
cuaacacaugcaagucgaa

SEQ ID NO: 614400 - RNA, 18 nt, Escherichia coli CFT073
cuaacacagcaauaauaa

SEQ ID NO: 614401 - RNA, 14 nt, Escherichia coli CFT073
cuaacaccacauug

SEQ ID NO: 614402 - RNA, 23 nt, Escherichia coli CFT073
cuaacaacugcuggacgauuuca

SEQ ID NO: 614403 - RNA, 17 nt, Escherichia coli CFT073
cuaacguuggcaaauug

SEQ ID NO: 614404 - RNA, 18 nt, Escherichia coli CFT073
cuaacucacgcagauacu

SEQ ID NO: 614405 - RNA, 13 nt, Escherichia coli CFT073
cuaacucuuccug

SEQ ID NO: 614406 - RNA, 18 nt, Escherichia coli CFT073
cuaacucuuccugcgcac

SEQ ID NO: 614407 - RNA, 12 nt, Escherichia coli CFT073
cuaacuuauugu

SEQ ID NO: 614408 - RNA, 18 nt, Escherichia coli CFT073
cuaacuucgccaucagcg

SEQ ID NO: 614409 - RNA, 14 nt, Escherichia coli CFT073
cuaacuucuuuuuc

SEQ ID NO: 614410 - RNA, 15 nt, Escherichia coli CFT073
cuaacuucuuuuucg

SEQ ID NO: 614411 - RNA, 14 nt, Escherichia coli CFT073
cuaacucuugccag

SEQ ID NO: 614412 - RNA, 19 nt, Escherichia coli CFT073
cuaacucuugccagauuuu

SEQ ID NO: 614413 - RNA, 13 nt, Escherichia coli CFT073
cuaacugacuuuc

SEQ ID NO: 614414 - RNA, 19 nt, Escherichia coli CFT073
cuaacugacuuucuuuucc

SEQ ID NO: 614415 - RNA, 20 nt, Escherichia coli CFT073
cuaacugaucacguuuuccu

SEQ ID NO: 614416 - RNA, 21 nt, Escherichia coli CFT073
cuaacugcugcggaauagcaa

SEQ ID NO: 614417 - RNA, 18 nt, Escherichia coli CFT073
cuaacgucugguaaagca

SEQ ID NO: 614418 - RNA, 17 nt, Escherichia coli CFT073
cuaacgacaaaucauac

SEQ ID NO: 614419 - RNA, 16 nt, Escherichia coli CFT073
cuaaccggauaucuaa

SEQ ID NO: 614420 - RNA, 23 nt, Escherichia coli CFT073
cuaaccuguuuucgauuuuuucc

SEQ ID NO: 614421 - RNA, 18 nt, Escherichia coli CFT073
cuaagccccugagcgaau

SEQ ID NO: 614422 - RNA, 15 nt, Escherichia coli CFT073
cuaagaagucauugg

SEQ ID NO: 614423 - RNA, 19 nt, Escherichia coli CFT073
cuaagauaauccaggacau

SEQ ID NO: 614424 - RNA, 14 nt, Escherichia coli CFT073
cuaauaaacauugg

SEQ ID NO: 614425 - RNA, 21 nt, Escherichia coli CFT073
cuaaggguaaaacgacuggcc

SEQ ID NO: 614426 - RNA, 15 nt, Escherichia coli CFT073
cuaagcugcgggaaa

SEQ ID NO: 614427 - RNA, 14 nt, Escherichia coli CFT073
cuaaggcagccaga

SEQ ID NO: 614428 - RNA, 17 nt, Escherichia coli CFT073
cuaaucgcuuuauagca

SEQ ID NO: 614429 - RNA, 17 nt, Escherichia coli CFT073
cuaaucucuucaccaua

SEQ ID NO: 614430 - RNA, 14 nt, Escherichia coli CFT073
cuaaugauucauaa

SEQ ID NO: 614431 - RNA, 18 nt, Escherichia coli CFT073
cuaaugauucauaaacaa

SEQ ID NO: 614432 - RNA, 12 nt, Escherichia coli CFT073
cuaaugccaacg

SEQ ID NO: 614433 - RNA, 18 nt, Escherichia coli CFT073
cuaaugccggauaagccu

SEQ ID NO: 614434 - RNA, 14 nt, Escherichia coli CFT073
cuaauaccagaacu

SEQ ID NO: 614435 - RNA, 15 nt, Escherichia coli CFT073
cuaauaccagaacug

SEQ ID NO: 614436 - RNA, 22 nt, Escherichia coli CFT073
cuaauaccagaacugaagauuc

SEQ ID NO: 614437 - RNA, 13 nt, Escherichia coli CFT073
cuaauauuuugug

SEQ ID NO: 614438 - RNA, 18 nt, Escherichia coli CFT073
cuaauauuuugugauuua

SEQ ID NO: 614439 - RNA, 23 nt, Escherichia coli CFT073
cuaaucaucuguugugccacauc

SEQ ID NO: 614440 - RNA, 20 nt, Escherichia coli CFT073
cuaauuauuacucaacaggu

SEQ ID NO: 614441 - RNA, 12 nt, Escherichia coli CFT073
cuacaagagguc

SEQ ID NO: 614442 - RNA, 23 nt, Escherichia coli CFT073
cuacaaaaucaugcaaauucaau

SEQ ID NO: 614443 - RNA, 12 nt, Escherichia coli CFT073
cuacaaaccauc

SEQ ID NO: 614444 - RNA, 22 nt, Escherichia coli CFT073
cuacaaagguuuguaacucagg

SEQ ID NO: 614445 - RNA, 14 nt, Escherichia coli CFT073
cuacaaaacauuau

SEQ ID NO: 614446 - RNA, 19 nt, Escherichia coli CFT073
cgucguucaacaagccacg

SEQ ID NO: 614447 - RNA, 13 nt, Escherichia coli CFT073
cgucgugcgguga

SEQ ID NO: 614448 - RNA, 22 nt, Escherichia coli CFT073
cgucgucgcgcgaaucuucaua

SEQ ID NO: 614449 - RNA, 17 nt, Escherichia coli CFT073
cgucguaaucauaaaac

SEQ ID NO: 614450 - RNA, 17 nt, Escherichia coli CFT073
cgucgguguccacuucc

SEQ ID NO: 614451 - RNA, 19 nt, Escherichia coli CFT073
cgucgggccacgcugcgcu

SEQ ID NO: 614452 - RNA, 16 nt, Escherichia coli CFT073
cgucgccagcagcuca

SEQ ID NO: 614453 - RNA, 14 nt, Escherichia coli CFT073
cgucgccagcgccu

SEQ ID NO: 614454 - RNA, 18 nt, Escherichia coli CFT073
cgucgccaguaccagcag

SEQ ID NO: 614455 - RNA, 17 nt, Escherichia coli CFT073
cgucgccaauggaauag

SEQ ID NO: 614456 - RNA, 19 nt, Escherichia coli CFT073
cgucgccaauggaauagcg

SEQ ID NO: 614457 - RNA, 19 nt, Escherichia coli CFT073
cgucgccacaaucagcgcg

SEQ ID NO: 614458 - RNA, 16 nt, Escherichia coli CFT073
cgucgcaucacagacc

SEQ ID NO: 614459 - RNA, 16 nt, Escherichia coli CFT073
cgucgcaucaggcauu

SEQ ID NO: 614460 - RNA, 15 nt, Escherichia coli CFT073
cgucgcauccggcau

SEQ ID NO: 614461 - RNA, 15 nt, Escherichia coli CFT073
cgucgccgccgccag

SEQ ID NO: 614462 - RNA, 14 nt, Escherichia coli CFT073
cgucgcccgaugcc

SEQ ID NO: 614463 - RNA, 14 nt, Escherichia coli CFT073
cgucgcucacuuca

SEQ ID NO: 614464 - RNA, 20 nt, Escherichia coli CFT073
cgucggaacaucgaugccgc

SEQ ID NO: 614465 - RNA, 13 nt, Escherichia coli CFT073
cgugccgcauuuc

SEQ ID NO: 614466 - RNA, 16 nt, Escherichia coli CFT073
cgugcucgcuuuccau

SEQ ID NO: 614467 - RNA, 17 nt, Escherichia coli CFT073
cgugcugcgauucaggg

SEQ ID NO: 614468 - RNA, 16 nt, Escherichia coli CFT073
cgugcucgaacauccc

SEQ ID NO: 614469 - RNA, 19 nt, Escherichia coli CFT073
cgugcgcagcaucggcgca

SEQ ID NO: 614470 - RNA, 19 nt, Escherichia coli CFT073
cgugcagcaccgccgccag

SEQ ID NO: 614471 - RNA, 14 nt, Escherichia coli CFT073
cgugauuuuguagg

SEQ ID NO: 614472 - RNA, 20 nt, Escherichia coli CFT073
cgugauuaaacuucaccagc

SEQ ID NO: 614473 - RNA, 21 nt, Escherichia coli CFT073
cgugauugguuucaaccugca

SEQ ID NO: 614474 - RNA, 17 nt, Escherichia coli CFT073
cgugauuccugcaauuu

SEQ ID NO: 614475 - RNA, 21 nt, Escherichia coli CFT073
cgugaggguuucuggcuacac

SEQ ID NO: 614476 - RNA, 22 nt, Escherichia coli CFT073
cgugaucgucuucaaccgcagu

SEQ ID NO: 614477 - RNA, 16 nt, Escherichia coli CFT073
cgucuucugcagucac

SEQ ID NO: 614478 - RNA, 18 nt, Escherichia coli CFT073
cgucuuuggcccauugca

SEQ ID NO: 614479 - RNA, 16 nt, Escherichia coli CFT073
cgucuuugcgcuccau

SEQ ID NO: 614480 - RNA, 20 nt, Escherichia coli CFT073
cgugacuucauucagaaaaa

SEQ ID NO: 614481 - RNA, 13 nt, Escherichia coli CFT073
cgugacuuccagc

SEQ ID NO: 614482 - RNA, 20 nt, Escherichia coli CFT073
cgugacuuuaucuucugcug

SEQ ID NO: 614483 - RNA, 20 nt, Escherichia coli CFT073
cgugaauuuuaggaugcugc

SEQ ID NO: 614484 - RNA, 21 nt, Escherichia coli CFT073
cgugaaugccguaggcccagc

SEQ ID NO: 614485 - RNA, 16 nt, Escherichia coli CFT073
cgucuccucccgagcg

SEQ ID NO: 614486 - RNA, 18 nt, Escherichia coli CFT073
cgucuaucagcuucugca

SEQ ID NO: 614487 - RNA, 15 nt, Escherichia coli CFT073
cgucucaaucaccac

SEQ ID NO: 614488 - RNA, 22 nt, Escherichia coli CFT073
cgucucaaucaccaccagcgga

SEQ ID NO: 614489 - RNA, 15 nt, Escherichia coli CFT073
cgucucacuaucgcc

SEQ ID NO: 614490 - RNA, 19 nt, Escherichia coli CFT073
cgucucagcaccgucuggc

SEQ ID NO: 614491 - RNA, 14 nt, Escherichia coli CFT073
cgucuguguaccug

SEQ ID NO: 614492 - RNA, 18 nt, Escherichia coli CFT073
cgucugggcaaaaucauc

SEQ ID NO: 614493 - RNA, 19 nt, Escherichia coli CFT073
cgucugggcaaaaucauca

SEQ ID NO: 614494 - RNA, 18 nt, Escherichia coli CFT073
cgucucgugaacgcccgg

SEQ ID NO: 614495 - RNA, 23 nt, Escherichia coli CFT073
cgucugcggugcgccaaacugcc

SEQ ID NO: 614496 - RNA, 18 nt, Escherichia coli CFT073
cgucuggcagauccugaa

SEQ ID NO: 614497 - RNA, 21 nt, Escherichia coli CFT073
cgucuggcauuuugcugcuuc

SEQ ID NO: 614498 - RNA, 13 nt, Escherichia coli CFT073
cgucagaaacagu

SEQ ID NO: 614499 - RNA, 12 nt, Escherichia coli CFT073
cgucagacgcgc

SEQ ID NO: 614500 - RNA, 21 nt, Escherichia coli CFT073
cgucagaccggcaaccagcac

SEQ ID NO: 614501 - RNA, 23 nt, Escherichia coli CFT073
cgucagaccggcaaccagcaccg

SEQ ID NO: 614502 - RNA, 21 nt, Escherichia coli CFT073
cgucacuuugcugucgauuuu

SEQ ID NO: 614503 - RNA, 16 nt, Escherichia coli CFT073
cgucaggaagaagccc

SEQ ID NO: 614504 - RNA, 19 nt, Escherichia coli CFT073
cgucagauucggauccagc

SEQ ID NO: 614505 - RNA, 15 nt, Escherichia coli CFT073
cgucaucgacagcaa

SEQ ID NO: 614506 - RNA, 15 nt, Escherichia coli CFT073
cgucaucccaguccu

SEQ ID NO: 614507 - RNA, 19 nt, Escherichia coli CFT073
cgucaucccgguuucccgg

SEQ ID NO: 614508 - RNA, 22 nt, Escherichia coli CFT073
cgucaucauucaucgccuucuu

SEQ ID NO: 614509 - RNA, 23 nt, Escherichia coli CFT073
cguauuuuuggcucauaaaauca

SEQ ID NO: 614510 - RNA, 22 nt, Escherichia coli CFT073
cgucauuggcggcagaugacuc

SEQ ID NO: 614511 - RNA, 22 nt, Escherichia coli CFT073
cgucauuaauacaucaacuuaa

SEQ ID NO: 614512 - RNA, 16 nt, Escherichia coli CFT073
cgucaucuuacugcaa

SEQ ID NO: 614513 - RNA, 12 nt, Escherichia coli CFT073
cguccaccagaa

SEQ ID NO: 614514 - RNA, 15 nt, Escherichia coli CFT073
cguccaccaccgccg

SEQ ID NO: 614515 - RNA, 22 nt, Escherichia coli CFT073
cguccacggugcgacacugcgu

SEQ ID NO: 614516 - RNA, 14 nt, Escherichia coli CFT073
cguccagcagcaau

SEQ ID NO: 614517 - RNA, 17 nt, Escherichia coli CFT073
cgucccguccuucaucu

SEQ ID NO: 614518 - RNA, 15 nt, Escherichia coli CFT073
cgucccuacugcacu

SEQ ID NO: 614519 - RNA, 23 nt, Escherichia coli CFT073
cguccgcaaacguaaaugccagc

SEQ ID NO: 614520 - RNA, 13 nt, Escherichia coli CFT073
cguccgcacgcug

SEQ ID NO: 614521 - RNA, 18 nt, Escherichia coli CFT073
cguccgcauucuucugaa

SEQ ID NO: 614522 - RNA, 15 nt, Escherichia coli CFT073
cguagaggugauaug

SEQ ID NO: 614523 - RNA, 23 nt, Escherichia coli CFT073
cguagcuguuguucgaucaguug

SEQ ID NO: 614524 - RNA, 14 nt, Escherichia coli CFT073
cguagcugcugcuc

SEQ ID NO: 614525 - RNA, 15 nt, Escherichia coli CFT073
cguagccagauuguu

SEQ ID NO: 614526 - RNA, 14 nt, Escherichia coli CFT073
cguagccaggcuuu

SEQ ID NO: 614527 - RNA, 17 nt, Escherichia coli CFT073
cguagccauuaccaggu

SEQ ID NO: 614528 - RNA, 13 nt, Escherichia coli CFT073
cguauagaucagc

SEQ ID NO: 614529 - RNA, 12 nt, Escherichia coli CFT073
cguauccaucac

SEQ ID NO: 614530 - RNA, 19 nt, Escherichia coli CFT073
cguauccauuaccgccauc

SEQ ID NO: 614531 - RNA, 13 nt, Escherichia coli CFT073
cguauccugcaug

SEQ ID NO: 614532 - RNA, 22 nt, Escherichia coli CFT073
cguauccaccgacacuacaaau

SEQ ID NO: 614533 - RNA, 20 nt, Escherichia coli CFT073
cguauccagcauaccuucca

SEQ ID NO: 614534 - RNA, 18 nt, Escherichia coli CFT073
cguaggucggauaagacg

SEQ ID NO: 614535 - RNA, 15 nt, Escherichia coli CFT073
cguaggcccagccgu

SEQ ID NO: 614536 - RNA, 23 nt, Escherichia coli CFT073
cguaauuaguggcuaaccgucug

SEQ ID NO: 614537 - RNA, 15 nt, Escherichia coli CFT073
cguaauguuuccagc

SEQ ID NO: 614538 - RNA, 12 nt, Escherichia coli CFT073
cguaauuauucc

SEQ ID NO: 614539 - RNA, 16 nt, Escherichia coli CFT073
cguaauucgccaccgg

SEQ ID NO: 614540 - RNA, 22 nt, Escherichia coli CFT073
cguaaugaauguuuuccuguuu

SEQ ID NO: 614541 - RNA, 15 nt, Escherichia coli CFT073
cggcguacuggcaau

SEQ ID NO: 614542 - RNA, 18 nt, Escherichia coli CFT073
cggcguacuaucuacugc

SEQ ID NO: 614543 - RNA, 16 nt, Escherichia coli CFT073
cguacaaccaaaucug

SEQ ID NO: 614544 - RNA, 17 nt, Escherichia coli CFT073
cguacaaguccugaauu

SEQ ID NO: 614545 - RNA, 15 nt, Escherichia coli CFT073
cguacaccaacauca

SEQ ID NO: 614546 - RNA, 18 nt, Escherichia coli CFT073
cguacacccgccagaauc

SEQ ID NO: 614547 - RNA, 15 nt, Escherichia coli CFT073
cguacagauacauuu

SEQ ID NO: 614548 - RNA, 14 nt, Escherichia coli CFT073
cguacagcccagga

SEQ ID NO: 614549 - RNA, 15 nt, Escherichia coli CFT073
cguacauccggcaau

SEQ ID NO: 614550 - RNA, 13 nt, Escherichia coli CFT073
cguaccagugcag

SEQ ID NO: 614551 - RNA, 17 nt, Escherichia coli CFT073
cguacauugcugacaug

SEQ ID NO: 614552 - RNA, 20 nt, Escherichia coli CFT073
cguacauugcugacauggca

SEQ ID NO: 614553 - RNA, 15 nt, Escherichia coli CFT073
cguacaugcagggca

SEQ ID NO: 614554 - RNA, 13 nt, Escherichia coli CFT073
cguacugaucuuu

SEQ ID NO: 614555 - RNA, 12 nt, Escherichia coli CFT073
cguacugcugaa

SEQ ID NO: 614556 - RNA, 15 nt, Escherichia coli CFT073
cguacugcugaauga

SEQ ID NO: 614557 - RNA, 16 nt, Escherichia coli CFT073
cguacuggcaaucgcc

SEQ ID NO: 614558 - RNA, 13 nt, Escherichia coli CFT073
cguacuucacaua

SEQ ID NO: 614559 - RNA, 19 nt, Escherichia coli CFT073
cguacuggcgauugucggg

SEQ ID NO: 614560 - RNA, 15 nt, Escherichia coli CFT073
cguacuaucuacugc

SEQ ID NO: 614561 - RNA, 23 nt, Escherichia coli CFT073
cguaccugcauuagcaaugcccu

SEQ ID NO: 614562 - RNA, 17 nt, Escherichia coli CFT073
cguaccauuaucaccaa

SEQ ID NO: 614563 - RNA, 16 nt, Escherichia coli CFT073
cguacccgccugauag

SEQ ID NO: 614564 - RNA, 23 nt, Escherichia coli CFT073
cuuccucguuucgcccugccuuu

SEQ ID NO: 614565 - RNA, 18 nt, Escherichia coli CFT073
cuuccugauaaccuucca

SEQ ID NO: 614566 - RNA, 21 nt, Escherichia coli CFT073
cuuccugauaaccuuccagcu

SEQ ID NO: 614567 - RNA, 22 nt, Escherichia coli CFT073
cuuccugauaaccuuccagcuu

SEQ ID NO: 614568 - RNA, 18 nt, Escherichia coli CFT073
cuuccuugcguacaccaa

SEQ ID NO: 614569 - RNA, 22 nt, Escherichia coli CFT073
cuuccuuuagaagcacuaccuu

SEQ ID NO: 614570 - RNA, 17 nt, Escherichia coli CFT073
cuuccgcaauacagcca

SEQ ID NO: 614571 - RNA, 18 nt, Escherichia coli CFT073
cuuccgcaauacagccag

SEQ ID NO: 614572 - RNA, 21 nt, Escherichia coli CFT073
cuuccgcaauacagccagcca

SEQ ID NO: 614573 - RNA, 22 nt, Escherichia coli CFT073
cuuccgcaauacagccagccag

SEQ ID NO: 614574 - RNA, 17 nt, Escherichia coli CFT073
cuuccgcaggggaugga

SEQ ID NO: 614575 - RNA, 17 nt, Escherichia coli CFT073
cuuccgcugacagcgcg

SEQ ID NO: 614576 - RNA, 16 nt, Escherichia coli CFT073
cuuccgccaucaaucg

SEQ ID NO: 614577 - RNA, 23 nt, Escherichia coli CFT073
cuucgccaggauagaaaacgaca

SEQ ID NO: 614578 - RNA, 17 nt, Escherichia coli CFT073
cuucgccauaacaaaua

SEQ ID NO: 614579 - RNA, 17 nt, Escherichia coli CFT073
cuucgcauuuugcagcu

SEQ ID NO: 614580 - RNA, 22 nt, Escherichia coli CFT073
cuucgccaaauggcaggcacag

SEQ ID NO: 614581 - RNA, 14 nt, Escherichia coli CFT073
cuucgauucccagc

SEQ ID NO: 614582 - RNA, 16 nt, Escherichia coli CFT073
cuucgauucccagcuu

SEQ ID NO: 614583 - RNA, 14 nt, Escherichia coli CFT073
cuucgauggcuggg

SEQ ID NO: 614584 - RNA, 18 nt, Escherichia coli CFT073
cuucgauggcugggguac

SEQ ID NO: 614585 - RNA, 20 nt, Escherichia coli CFT073
cuucgaugguuggaauugaa

SEQ ID NO: 614586 - RNA, 14 nt, Escherichia coli CFT073
cuucgauacugccu

SEQ ID NO: 614587 - RNA, 18 nt, Escherichia coli CFT073
aaacuuaugcagcugcuc

SEQ ID NO: 614588 - RNA, 20 nt, Escherichia coli CFT073
aaacuuaucuuauucccacu

SEQ ID NO: 614589 - RNA, 17 nt, Escherichia coli CFT073
cuuccacaccacuucau

SEQ ID NO: 614590 - RNA, 16 nt, Escherichia coli CFT073
cuuccagcauuuccac

SEQ ID NO: 614591 - RNA, 15 nt, Escherichia coli CFT073
cuuccagccaugcca

SEQ ID NO: 614592 - RNA, 23 nt, Escherichia coli CFT073
cuuccagaucaccgcagaagcga

SEQ ID NO: 614593 - RNA, 20 nt, Escherichia coli CFT073
cuuccacaauaccaaucgca

SEQ ID NO: 614594 - RNA, 15 nt, Escherichia coli CFT073
cuuccagauucaguu

SEQ ID NO: 614595 - RNA, 17 nt, Escherichia coli CFT073
cuuccagcaaauccauc

SEQ ID NO: 614596 - RNA, 15 nt, Escherichia coli CFT073
cuuccagcaaaucca

SEQ ID NO: 614597 - RNA, 15 nt, Escherichia coli CFT073
cuucccaugucagac

SEQ ID NO: 614598 - RNA, 23 nt, Escherichia coli CFT073
cuucccauacccaccaauuaauc

SEQ ID NO: 614599 - RNA, 15 nt, Escherichia coli CFT073
cuucccccaccacca

SEQ ID NO: 614600 - RNA, 23 nt, Escherichia coli CFT073
cuucccccauugccgccucugcc

SEQ ID NO: 614601 - RNA, 19 nt, Escherichia coli CFT073
cuucccccugagcgguggc

SEQ ID NO: 614602 - RNA, 16 nt, Escherichia coli CFT073
cuuccccgcuucagcc

SEQ ID NO: 614603 - RNA, 17 nt, Escherichia coli CFT073
cuuccccgcuucagccc

SEQ ID NO: 614604 - RNA, 17 nt, Escherichia coli CFT073
cuucccuucucuucaaa

SEQ ID NO: 614605 - RNA, 15 nt, Escherichia coli CFT073
cuucccagauaaauc

SEQ ID NO: 614606 - RNA, 20 nt, Escherichia coli CFT073
cuuccauuccaccauacaga

SEQ ID NO: 614607 - RNA, 23 nt, Escherichia coli CFT073
cuuccauucuccgcucuucaucu

SEQ ID NO: 614608 - RNA, 20 nt, Escherichia coli CFT073
cuuccaucuuaauacgcugg

SEQ ID NO: 614609 - RNA, 19 nt, Escherichia coli CFT073
cuuccaucgcaucuucgcc

SEQ ID NO: 614610 - RNA, 13 nt, Escherichia coli CFT073
cuuccagcgcauc

SEQ ID NO: 614611 - RNA, 19 nt, Escherichia coli CFT073
cuuccagcgcaucgccaaa

SEQ ID NO: 614612 - RNA, 14 nt, Escherichia coli CFT073
cuuccagcgauaau

SEQ ID NO: 614613 - RNA, 18 nt, Escherichia coli CFT073
cuucacgcggguugccac

SEQ ID NO: 614614 - RNA, 13 nt, Escherichia coli CFT073
cuucacugaaaca

SEQ ID NO: 614615 - RNA, 12 nt, Escherichia coli CFT073
cuucacacugau

SEQ ID NO: 614616 - RNA, 12 nt, Escherichia coli CFT073
cuucacaggccg

SEQ ID NO: 614617 - RNA, 12 nt, Escherichia coli CFT073
cuuauucaccac

SEQ ID NO: 614618 - RNA, 18 nt, Escherichia coli CFT073
cuuauucaccaccaucaa

SEQ ID NO: 614619 - RNA, 14 nt, Escherichia coli CFT073
cuuauucacgccaa

SEQ ID NO: 614620 - RNA, 21 nt, Escherichia coli CFT073
cuuauucugugaacuucaggu

SEQ ID NO: 614621 - RNA, 15 nt, Escherichia coli CFT073
cuucaaacugcagca

SEQ ID NO: 614622 - RNA, 15 nt, Escherichia coli CFT073
cuucaaagacgcuuu

SEQ ID NO: 614623 - RNA, 12 nt, Escherichia coli CFT073
cuucaaauauug

SEQ ID NO: 614624 - RNA, 22 nt, Escherichia coli CFT073
cuucaaaguuuugugcuuuguu

SEQ ID NO: 614625 - RNA, 12 nt, Escherichia coli CFT073
cuucaaauaaac

SEQ ID NO: 614626 - RNA, 22 nt, Escherichia coli CFT073
cuucaaggcagagucaucucug

SEQ ID NO: 614627 - RNA, 13 nt, Escherichia coli CFT073
cuucaaccaccuc

SEQ ID NO: 614628 - RNA, 17 nt, Escherichia coli CFT073
cuucaacacaggccggc

SEQ ID NO: 614629 - RNA, 19 nt, Escherichia coli CFT073
cuucaaguguggccgccag

SEQ ID NO: 614630 - RNA, 19 nt, Escherichia coli CFT073
cuucaucguucaucuguaa

SEQ ID NO: 614631 - RNA, 13 nt, Escherichia coli CFT073
cuucaucugcacg

SEQ ID NO: 614632 - RNA, 12 nt, Escherichia coli CFT073
cuucaucuucca

SEQ ID NO: 614633 - RNA, 19 nt, Escherichia coli CFT073
cuucaucguaguaguucau

SEQ ID NO: 614634 - RNA, 17 nt, Escherichia coli CFT073
cuucaucgugcucgcuu

SEQ ID NO: 614635 - RNA, 18 nt, Escherichia coli CFT073
cuucaucgugcucgcuuu

SEQ ID NO: 614636 - RNA, 20 nt, Escherichia coli CFT073
cuucaucgaacgggugauuu

SEQ ID NO: 614637 - RNA, 17 nt, Escherichia coli CFT073
cuucaucgaugcugcuc

SEQ ID NO: 614638 - RNA, 18 nt, Escherichia coli CFT073
cuucaucgaugcugcucu

SEQ ID NO: 614639 - RNA, 16 nt, Escherichia coli CFT073
cuucauuaccuucaau

SEQ ID NO: 614640 - RNA, 13 nt, Escherichia coli CFT073
cuucauuaccuuc

SEQ ID NO: 614641 - RNA, 22 nt, Escherichia coli CFT073
cuucauaacuuugaucgcguuu

SEQ ID NO: 614642 - RNA, 18 nt, Escherichia coli CFT073
cuucauaccauauuguuu

SEQ ID NO: 614643 - RNA, 21 nt, Escherichia coli CFT073
cuucauagucucgcccacggu

SEQ ID NO: 614644 - RNA, 16 nt, Escherichia coli CFT073
cuucauagugcgcggu

SEQ ID NO: 614645 - RNA, 21 nt, Escherichia coli CFT073
cuucaguuucuucaacaggcg

SEQ ID NO: 614646 - RNA, 20 nt, Escherichia coli CFT073
cuucagcgaagcccacaccg

SEQ ID NO: 614647 - RNA, 23 nt, Escherichia coli CFT073
cuucagacgguccgcgagauaac

SEQ ID NO: 614648 - RNA, 14 nt, Escherichia coli CFT073
cuucagaauggaaa

SEQ ID NO: 614649 - RNA, 22 nt, Escherichia coli CFT073
cuuaauaauucccgugcugcuu

SEQ ID NO: 614650 - RNA, 16 nt, Escherichia coli CFT073
cuuaagauaagaauaa

SEQ ID NO: 614651 - RNA, 20 nt, Escherichia coli CFT073
cuuaagauucggcuucuucc

SEQ ID NO: 614652 - RNA, 18 nt, Escherichia coli CFT073
cuuaagucuccauuuuuu

SEQ ID NO: 614653 - RNA, 22 nt, Escherichia coli CFT073
cuuaaguuagucgcuuucauuc

SEQ ID NO: 614654 - RNA, 16 nt, Escherichia coli CFT073
cuuaaggcuguuccca

SEQ ID NO: 614655 - RNA, 20 nt, Escherichia coli CFT073
cuuaaggcuguucccacgca

SEQ ID NO: 614656 - RNA, 14 nt, Escherichia coli CFT073
cuuaagcgccugau

SEQ ID NO: 614657 - RNA, 13 nt, Escherichia coli CFT073
cuuaagguuuuuu

SEQ ID NO: 614658 - RNA, 16 nt, Escherichia coli CFT073
cuuaagguuuuuuccu

SEQ ID NO: 614659 - RNA, 15 nt, Escherichia coli CFT073
cuuacacuuccuuua

SEQ ID NO: 614660 - RNA, 22 nt, Escherichia coli CFT073
cuuacgcgccagagcuggcacc

SEQ ID NO: 614661 - RNA, 20 nt, Escherichia coli CFT073
cuuacgggcguauucaauaa

SEQ ID NO: 614662 - RNA, 22 nt, Escherichia coli CFT073
cuuacguauuucgauuuguucu

SEQ ID NO: 614663 - RNA, 23 nt, Escherichia coli CFT073
cuuacguauuucgauuuguucug

SEQ ID NO: 614664 - RNA, 14 nt, Escherichia coli CFT073
cuuacuugcugcuc

SEQ ID NO: 614665 - RNA, 18 nt, Escherichia coli CFT073
cuuacuugcugcucugaa

SEQ ID NO: 614666 - RNA, 21 nt, Escherichia coli CFT073
cuuauaaccagacgauuuucc

SEQ ID NO: 614667 - RNA, 22 nt, Escherichia coli CFT073
cuuauaaccagacgauuuuccc

SEQ ID NO: 614668 - RNA, 13 nt, Escherichia coli CFT073
cuuauaagucuca

SEQ ID NO: 614669 - RNA, 22 nt, Escherichia coli CFT073
cuuaucuuauucccacuuuuca

SEQ ID NO: 614670 - RNA, 19 nt, Escherichia coli CFT073
cuuaucaggccuacaaguc

SEQ ID NO: 614671 - RNA, 13 nt, Escherichia coli CFT073
cuuaucaggccug

SEQ ID NO: 614672 - RNA, 17 nt, Escherichia coli CFT073
cuuaucaggccugcaaa

SEQ ID NO: 614673 - RNA, 17 nt, Escherichia coli CFT073
cuuaucaggccuacaaa

SEQ ID NO: 614674 - RNA, 23 nt, Escherichia coli CFT073
cuuauccagcaacguuucgcugg

SEQ ID NO: 614675 - RNA, 19 nt, Escherichia coli CFT073
cuguuuggugcauaggcca

SEQ ID NO: 614676 - RNA, 16 nt, Escherichia coli CFT073
cuguuugcgucauggu

SEQ ID NO: 614677 - RNA, 18 nt, Escherichia coli CFT073
cuguuugcgucagcuuca

SEQ ID NO: 614678 - RNA, 21 nt, Escherichia coli CFT073
cuguuguaguuggaugacauu

SEQ ID NO: 614679 - RNA, 20 nt, Escherichia coli CFT073
cuguugauugcguucaaucu

SEQ ID NO: 614680 - RNA, 15 nt, Escherichia coli CFT073
cuguugccagcagca

SEQ ID NO: 614681 - RNA, 20 nt, Escherichia coli CFT073
cuguugcccaugcuucugca

SEQ ID NO: 614682 - RNA, 17 nt, Escherichia coli CFT073
cuguugccugcacucag

SEQ ID NO: 614683 - RNA, 19 nt, Escherichia coli CFT073
cuguuggcaacgcaaacug

SEQ ID NO: 614684 - RNA, 14 nt, Escherichia coli CFT073
cuguuuuaucacau

SEQ ID NO: 614685 - RNA, 14 nt, Escherichia coli CFT073
cuuaacgguuuuac

SEQ ID NO: 614686 - RNA, 16 nt, Escherichia coli CFT073
cuuaacguuaccuuua

SEQ ID NO: 614687 - RNA, 20 nt, Escherichia coli CFT073
cuuaacggcagcgccugcag

SEQ ID NO: 614688 - RNA, 18 nt, Escherichia coli CFT073
aaacugugaguacccuuu

SEQ ID NO: 614689 - RNA, 16 nt, Escherichia coli CFT073
aaacugugcaaugaaa

SEQ ID NO: 614690 - RNA, 16 nt, Escherichia coli CFT073
aaacugguuauaugaa

SEQ ID NO: 614691 - RNA, 19 nt, Escherichia coli CFT073
aaacugguuauaugaauac

SEQ ID NO: 614692 - RNA, 22 nt, Escherichia coli CFT073
aaacugguugcaacaucaaacu

SEQ ID NO: 614693 - RNA, 22 nt, Escherichia coli CFT073
aaacuguaucccagcccagcgg

SEQ ID NO: 614694 - RNA, 20 nt, Escherichia coli CFT073
aaacuggggcauuuuuucca

SEQ ID NO: 614695 - RNA, 18 nt, Escherichia coli CFT073
aaacuggugguaagaaua

SEQ ID NO: 614696 - RNA, 16 nt, Escherichia coli CFT073
cugugucucuucuuug

SEQ ID NO: 614697 - RNA, 21 nt, Escherichia coli CFT073
cugugucgguuaccaguacac

SEQ ID NO: 614698 - RNA, 19 nt, Escherichia coli CFT073
cugugugauccacugcaga

SEQ ID NO: 614699 - RNA, 17 nt, Escherichia coli CFT073
cugugugguuuuguagu

SEQ ID NO: 614700 - RNA, 13 nt, Escherichia coli CFT073
cuguguuguucug

SEQ ID NO: 614701 - RNA, 19 nt, Escherichia coli CFT073
cuguuaagcccauuuuuuu

SEQ ID NO: 614702 - RNA, 21 nt, Escherichia coli CFT073
cuguuaagaagggcuggccaa

SEQ ID NO: 614703 - RNA, 15 nt, Escherichia coli CFT073
cugugucgccgagcc

SEQ ID NO: 614704 - RNA, 21 nt, Escherichia coli CFT073
cuguguaaugaauggaguugu

SEQ ID NO: 614705 - RNA, 21 nt, Escherichia coli CFT073
cugugguauaugcguugcggu

SEQ ID NO: 614706 - RNA, 16 nt, Escherichia coli CFT073
cuguuccagguuuugu

SEQ ID NO: 614707 - RNA, 22 nt, Escherichia coli CFT073
cuguuccaguacggauaaugga

SEQ ID NO: 614708 - RNA, 17 nt, Escherichia coli CFT073
cuguugauaaaacacuc

SEQ ID NO: 614709 - RNA, 21 nt, Escherichia coli CFT073
cuguugacguccagcccuucu

SEQ ID NO: 614710 - RNA, 14 nt, Escherichia coli CFT073
cuguugaaauacaa

SEQ ID NO: 614711 - RNA, 15 nt, Escherichia coli CFT073
cuguugaaauuauug

SEQ ID NO: 614712 - RNA, 15 nt, Escherichia coli CFT073
cuguugaccaagaac

SEQ ID NO: 614713 - RNA, 16 nt, Escherichia coli CFT073
cuguucagugauggca

SEQ ID NO: 614714 - RNA, 21 nt, Escherichia coli CFT073
cuguucaucccgaccagugca

SEQ ID NO: 614715 - RNA, 14 nt, Escherichia coli CFT073
cuguucaucuggcg

SEQ ID NO: 614716 - RNA, 16 nt, Escherichia coli CFT073
cuguucauuuuguagg

SEQ ID NO: 614717 - RNA, 20 nt, Escherichia coli CFT073
cugugcgcguuauuuguugc

SEQ ID NO: 614718 - RNA, 14 nt, Escherichia coli CFT073
cugugcgucugcuu

SEQ ID NO: 614719 - RNA, 18 nt, Escherichia coli CFT073
cugugccuccugcggcuu

SEQ ID NO: 614720 - RNA, 19 nt, Escherichia coli CFT073
cugugccugagccggaguu

SEQ ID NO: 614721 - RNA, 18 nt, Escherichia coli CFT073
cuguggcagucacuuccu

SEQ ID NO: 614722 - RNA, 14 nt, Escherichia coli CFT073
cuguggaucuuccc

SEQ ID NO: 614723 - RNA, 17 nt, Escherichia coli CFT073
cugugcaauauuacuuc

SEQ ID NO: 614724 - RNA, 14 nt, Escherichia coli CFT073
cugugcaaugaaaa

SEQ ID NO: 614725 - RNA, 15 nt, Escherichia coli CFT073
cugugcaaugaaaaa

SEQ ID NO: 614726 - RNA, 22 nt, Escherichia coli CFT073
cugugcagcaagccacucagcc

SEQ ID NO: 614727 - RNA, 16 nt, Escherichia coli CFT073
cugugcaaccuuuucc

SEQ ID NO: 614728 - RNA, 24 nt, Escherichia coli CFT073
cugugaucauaucccggcugaaua

SEQ ID NO: 614729 - RNA, 24 nt, Escherichia coli CFT073
cugugauuucuuuauugauaaaca

SEQ ID NO: 614730 - RNA, 18 nt, Escherichia coli CFT073
cugugaaguauuaauguc

SEQ ID NO: 614731 - RNA, 19 nt, Escherichia coli CFT073
cugugaagucgggaacugg

SEQ ID NO: 614732 - RNA, 18 nt, Escherichia coli CFT073
cugugaacucaggcugcc

SEQ ID NO: 614733 - RNA, 14 nt, Escherichia coli CFT073
cugucuaccagcac

SEQ ID NO: 614734 - RNA, 22 nt, Escherichia coli CFT073
cugucuaaugauucauaaacaa

SEQ ID NO: 614735 - RNA, 17 nt, Escherichia coli CFT073
cugugaaacaccugcau

SEQ ID NO: 614736 - RNA, 18 nt, Escherichia coli CFT073
cugugaaacaccugcauu

SEQ ID NO: 614737 - RNA, 13 nt, Escherichia coli CFT073
cugugaagcaccu

SEQ ID NO: 614738 - RNA, 17 nt, Escherichia coli CFT073
cugugaagcaccugcgu

SEQ ID NO: 614739 - RNA, 18 nt, Escherichia coli CFT073
cugugaagcaccugcguu

SEQ ID NO: 614740 - RNA, 16 nt, Escherichia coli CFT073
cugucugaaugauaac

SEQ ID NO: 614741 - RNA, 20 nt, Escherichia coli CFT073
cugucgauuuguacucuucc

SEQ ID NO: 614742 - RNA, 22 nt, Escherichia coli CFT073
cugucgauuuucacauaagcug

SEQ ID NO: 614743 - RNA, 16 nt, Escherichia coli CFT073
cugucgauaaacucau

SEQ ID NO: 614744 - RNA, 22 nt, Escherichia coli CFT073
cuguccucuucagcaucaauga

SEQ ID NO: 614745 - RNA, 14 nt, Escherichia coli CFT073
cuguccuccaugau

SEQ ID NO: 614746 - RNA, 16 nt, Escherichia coli CFT073
cugucgcgucaaucac

SEQ ID NO: 614747 - RNA, 17 nt, Escherichia coli CFT073
cugucgcgucaaucacu

SEQ ID NO: 614748 - RNA, 21 nt, Escherichia coli CFT073
cugucgcgucaaucacuuucu

SEQ ID NO: 614749 - RNA, 17 nt, Escherichia coli CFT073
cugucggguaagcgcca

SEQ ID NO: 614750 - RNA, 19 nt, Escherichia coli CFT073
cugucgcuuuugcaucuuc

SEQ ID NO: 614751 - RNA, 20 nt, Escherichia coli CFT073
cugucggcacugaccaccac

SEQ ID NO: 614752 - RNA, 22 nt, Escherichia coli CFT073
cugucggcacugaccaccacca

SEQ ID NO: 614753 - RNA, 15 nt, Escherichia coli CFT073
cuguaucgaugcugu

SEQ ID NO: 614754 - RNA, 17 nt, Escherichia coli CFT073
cuguaucgcaucaggca

SEQ ID NO: 614755 - RNA, 15 nt, Escherichia coli CFT073
cuguauguuccccuc

SEQ ID NO: 614756 - RNA, 21 nt, Escherichia coli CFT073
cugucaacagcguuucuucga

SEQ ID NO: 614757 - RNA, 11 nt, Escherichia coli CFT073
cugucaacugc

SEQ ID NO: 614758 - RNA, 15 nt, Escherichia coli CFT073
cuguauuuuuccagc

SEQ ID NO: 614759 - RNA, 13 nt, Escherichia coli CFT073
cuguauuuuuuaa

SEQ ID NO: 614760 - RNA, 17 nt, Escherichia coli CFT073
cuguaguccaggccuga

SEQ ID NO: 614761 - RNA, 18 nt, Escherichia coli CFT073
cuguagagcuaccggcag

SEQ ID NO: 614762 - RNA, 21 nt, Escherichia coli CFT073
cuguagagcuaccggcaggaa

SEQ ID NO: 614763 - RNA, 15 nt, Escherichia coli CFT073
cuguagauauauccu

SEQ ID NO: 614764 - RNA, 14 nt, Escherichia coli CFT073
cuguagccagcucg

SEQ ID NO: 614765 - RNA, 13 nt, Escherichia coli CFT073
cuguacuuccugu

SEQ ID NO: 614766 - RNA, 19 nt, Escherichia coli CFT073
cuguagaacaccugucuuc

SEQ ID NO: 614767 - RNA, 15 nt, Escherichia coli CFT073
cugucaucgacaaaa

SEQ ID NO: 614768 - RNA, 23 nt, Escherichia coli CFT073
cugucaucgacaaaaacccugcc

SEQ ID NO: 614769 - RNA, 18 nt, Escherichia coli CFT073
cugucagugaccagcggc

SEQ ID NO: 614770 - RNA, 22 nt, Escherichia coli CFT073
cugucagugaccagcggcagaa

SEQ ID NO: 614771 - RNA, 12 nt, Escherichia coli CFT073
cugucagucugc

SEQ ID NO: 614772 - RNA, 15 nt, Escherichia coli CFT073
cugucaguuggcugu

SEQ ID NO: 614773 - RNA, 14 nt, Escherichia coli CFT073
cugucagcacgcug

SEQ ID NO: 614774 - RNA, 20 nt, Escherichia coli CFT073
cugucagaccuccguuuuuc

SEQ ID NO: 614775 - RNA, 13 nt, Escherichia coli CFT073
cugucaccuuuua

SEQ ID NO: 614776 - RNA, 15 nt, Escherichia coli CFT073
cugucaccgccucca

SEQ ID NO: 614777 - RNA, 14 nt, Escherichia coli CFT073
cugucaccucugca

SEQ ID NO: 614778 - RNA, 17 nt, Escherichia coli CFT073
cugucaccucugcaacg

SEQ ID NO: 614779 - RNA, 22 nt, Escherichia coli CFT073
aaacugaccgucuccaagauau

SEQ ID NO: 614780 - RNA, 18 nt, Escherichia coli CFT073
aaacugcguagaguccag

SEQ ID NO: 614781 - RNA, 13 nt, Escherichia coli CFT073
aaacugcagcagg

SEQ ID NO: 614782 - RNA, 18 nt, Escherichia coli CFT073
aaacugccccgccagugc

SEQ ID NO: 614783 - RNA, 22 nt, Escherichia coli CFT073
aaacugccgucaauuuuaagca

SEQ ID NO: 614784 - RNA, 22 nt, Escherichia coli CFT073
cugucaauaaacgccugcuuau

SEQ ID NO: 614785 - RNA, 13 nt, Escherichia coli CFT073
cugucaauaaacg

SEQ ID NO: 614786 - RNA, 20 nt, Escherichia coli CFT073
cugucaauaaacgccugcuu

SEQ ID NO: 614787 - RNA, 18 nt, Escherichia coli CFT073
cuguccacgacagaaccc

SEQ ID NO: 614788 - RNA, 20 nt, Escherichia coli CFT073
cuguccacgacagaacccgg

SEQ ID NO: 614789 - RNA, 19 nt, Escherichia coli CFT073
cuguccacauccagauguc

SEQ ID NO: 614790 - RNA, 22 nt, Escherichia coli CFT073
cugucaugugugacugcacugu

SEQ ID NO: 614791 - RNA, 17 nt, Escherichia coli CFT073
cugucauucauucagau

SEQ ID NO: 614792 - RNA, 16 nt, Escherichia coli CFT073
cuguccgauuuguucu

SEQ ID NO: 614793 - RNA, 19 nt, Escherichia coli CFT073
cuguccgcauccccuacuc

SEQ ID NO: 614794 - RNA, 16 nt, Escherichia coli CFT073
cuguccggcgcacugg

SEQ ID NO: 614795 - RNA, 20 nt, Escherichia coli CFT073
cuguaauucguaacggccag

SEQ ID NO: 614796 - RNA, 22 nt, Escherichia coli CFT073
cuguaauugcuuagccgccggg

SEQ ID NO: 614797 - RNA, 16 nt, Escherichia coli CFT073
cuguaaugccuuuucc

SEQ ID NO: 614798 - RNA, 19 nt, Escherichia coli CFT073
cuguaaugccuuuuccagc

SEQ ID NO: 614799 - RNA, 16 nt, Escherichia coli CFT073
cuguaccaaaaucauc

SEQ ID NO: 614800 - RNA, 15 nt, Escherichia coli CFT073
cuguacaguaaucgu

SEQ ID NO: 614801 - RNA, 16 nt, Escherichia coli CFT073
cuguacaagcaacuug

SEQ ID NO: 614802 - RNA, 11 nt, Escherichia coli CFT073
cuguaccuucu

SEQ ID NO: 614803 - RNA, 23 nt, Escherichia coli CFT073
cuguacgcgccaguuaucaggcu

SEQ ID NO: 614804 - RNA, 23 nt, Escherichia coli CFT073
cuguaaaagcgcauuuaucuuca

SEQ ID NO: 614805 - RNA, 16 nt, Escherichia coli CFT073
cugguuuuuuauauuc

SEQ ID NO: 614806 - RNA, 21 nt, Escherichia coli CFT073
cuguaagcaauuauucauauc

SEQ ID NO: 614807 - RNA, 18 nt, Escherichia coli CFT073
cuguaagccucuuucaga

SEQ ID NO: 614808 - RNA, 20 nt, Escherichia coli CFT073
cuguaacgcaggauguaauc

SEQ ID NO: 614809 - RNA, 21 nt, Escherichia coli CFT073
cuguaacaaggugaaucaagc

SEQ ID NO: 614810 - RNA, 18 nt, Escherichia coli CFT073
cuggugauucagggcagc

SEQ ID NO: 614811 - RNA, 19 nt, Escherichia coli CFT073
cuggugcuugccagagcag

SEQ ID NO: 614812 - RNA, 23 nt, Escherichia coli CFT073
cuggugcuuuaaaugucauacua

SEQ ID NO: 614813 - RNA, 20 nt, Escherichia coli CFT073
cugguguggagugcagcacu

SEQ ID NO: 614814 - RNA, 19 nt, Escherichia coli CFT073
cugguggcgauugaagcag

SEQ ID NO: 614815 - RNA, 14 nt, Escherichia coli CFT073
cugguggcaccucg

SEQ ID NO: 614816 - RNA, 19 nt, Escherichia coli CFT073
cuggugggaccaaaauccg

SEQ ID NO: 614817 - RNA, 18 nt, Escherichia coli CFT073
cugguuuguaggucaggu

SEQ ID NO: 614818 - RNA, 15 nt, Escherichia coli CFT073
cugguuuugaacagc

SEQ ID NO: 614819 - RNA, 20 nt, Escherichia coli CFT073
cugguuuucagcgaaacagc

SEQ ID NO: 614820 - RNA, 19 nt, Escherichia coli CFT073
cugguuguauggccuggug

SEQ ID NO: 614821 - RNA, 18 nt, Escherichia coli CFT073
cugguugacgcguaaauc

SEQ ID NO: 614822 - RNA, 20 nt, Escherichia coli CFT073
cugguugauauuuuccugcg

SEQ ID NO: 614823 - RNA, 18 nt, Escherichia coli CFT073
cugguugauucauggcau

SEQ ID NO: 614824 - RNA, 23 nt, Escherichia coli CFT073
cugguguucuuuuacgcuaccau

SEQ ID NO: 614825 - RNA, 22 nt, Escherichia coli CFT073
cugguuaguuucagcgcgggga

SEQ ID NO: 614826 - RNA, 21 nt, Escherichia coli CFT073
cugguuaucuuccaccaccac

SEQ ID NO: 614827 - RNA, 23 nt, Escherichia coli CFT073
cugguucagucguauccucagaa

SEQ ID NO: 614828 - RNA, 15 nt, Escherichia coli CFT073
cugguucccagagcu

SEQ ID NO: 614829 - RNA, 19 nt, Escherichia coli CFT073
cugguucccagagcuuuug

SEQ ID NO: 614830 - RNA, 21 nt, Escherichia coli CFT073
cugguucccagagcuuuugcc

SEQ ID NO: 614831 - RNA, 17 nt, Escherichia coli CFT073
cugguucccaacaacag

SEQ ID NO: 614832 - RNA, 15 nt, Escherichia coli CFT073
cugguugaaauaaac

SEQ ID NO: 614833 - RNA, 17 nt, Escherichia coli CFT073
cugguugaaauaaacca

SEQ ID NO: 614834 - RNA, 12 nt, Escherichia coli CFT073
cugggcgcggcc

SEQ ID NO: 614835 - RNA, 18 nt, Escherichia coli CFT073
cugggcgaucggcaggaa

SEQ ID NO: 614836 - RNA, 20 nt, Escherichia coli CFT073
cugggcuucauccagcagcg

SEQ ID NO: 614837 - RNA, 14 nt, Escherichia coli CFT073
cugggguaccugga

SEQ ID NO: 614838 - RNA, 15 nt, Escherichia coli CFT073
cugggguaccuggau

SEQ ID NO: 614839 - RNA, 14 nt, Escherichia coli CFT073
cugguaaacgaccc

SEQ ID NO: 614840 - RNA, 14 nt, Escherichia coli CFT073
cuggguuccuucca

SEQ ID NO: 614841 - RNA, 20 nt, Escherichia coli CFT073
cuggguuucgccugccagau

SEQ ID NO: 614842 - RNA, 19 nt, Escherichia coli CFT073
cuggguagaguuugaacuc

SEQ ID NO: 614843 - RNA, 12 nt, Escherichia coli CFT073
cuggguaacacc

SEQ ID NO: 614844 - RNA, 14 nt, Escherichia coli CFT073
cuggguauucagcg

SEQ ID NO: 614845 - RNA, 21 nt, Escherichia coli CFT073
cugguaguuguacaacugcuu

SEQ ID NO: 614846 - RNA, 22 nt, Escherichia coli CFT073
cugguaucaauaauucggcuua

SEQ ID NO: 614847 - RNA, 12 nt, Escherichia coli CFT073
cuggucaaagac

SEQ ID NO: 614848 - RNA, 18 nt, Escherichia coli CFT073
cuggucaggaauggaaau

SEQ ID NO: 614849 - RNA, 22 nt, Escherichia coli CFT073
cuggucaggccaaacuacgcug

SEQ ID NO: 614850 - RNA, 18 nt, Escherichia coli CFT073
cuggucaaccgcaccaaa

SEQ ID NO: 614851 - RNA, 15 nt, Escherichia coli CFT073
cugguacguuuauua

SEQ ID NO: 614852 - RNA, 12 nt, Escherichia coli CFT073
cugguaacugua

SEQ ID NO: 614853 - RNA, 16 nt, Escherichia coli CFT073
cugguaaucaccaccc

SEQ ID NO: 614854 - RNA, 23 nt, Escherichia coli CFT073
cugguaaucgcggguugccauug

SEQ ID NO: 614855 - RNA, 18 nt, Escherichia coli CFT073
cugguaccugucgcuuuu

SEQ ID NO: 614856 - RNA, 12 nt, Escherichia coli CFT073
cuggugaauauc

SEQ ID NO: 614857 - RNA, 13 nt, Escherichia coli CFT073
cuggugaauaucg

SEQ ID NO: 614858 - RNA, 20 nt, Escherichia coli CFT073
cuggucgagcguugccgcuc

SEQ ID NO: 614859 - RNA, 20 nt, Escherichia coli CFT073
cuggucgaggaucucugcaa

SEQ ID NO: 614860 - RNA, 13 nt, Escherichia coli CFT073
cuggucgagaucg

SEQ ID NO: 614861 - RNA, 23 nt, Escherichia coli CFT073
cuggccuagaugaaugacugucc

SEQ ID NO: 614862 - RNA, 19 nt, Escherichia coli CFT073
cuggccgguuugccauaac

SEQ ID NO: 614863 - RNA, 15 nt, Escherichia coli CFT073
cuggccguacccagc

SEQ ID NO: 614864 - RNA, 14 nt, Escherichia coli CFT073
cuggccgcuucaga

SEQ ID NO: 614865 - RNA, 13 nt, Escherichia coli CFT073
cuggcgacgccgg

SEQ ID NO: 614866 - RNA, 14 nt, Escherichia coli CFT073
cuggcgagugcauc

SEQ ID NO: 614867 - RNA, 17 nt, Escherichia coli CFT073
cuggccuuuauuuucca

SEQ ID NO: 614868 - RNA, 21 nt, Escherichia coli CFT073
cuggcgaaaggaggcauugaa

SEQ ID NO: 614869 - RNA, 16 nt, Escherichia coli CFT073
cuggcaucaaucgcuc

SEQ ID NO: 614870 - RNA, 22 nt, Escherichia coli CFT073
cuggcaucaaucgcucccagcc

SEQ ID NO: 614871 - RNA, 21 nt, Escherichia coli CFT073
cuggcacucuuccagaccaaa

SEQ ID NO: 614872 - RNA, 15 nt, Escherichia coli CFT073
cuggcagaaugaagu

SEQ ID NO: 614873 - RNA, 18 nt, Escherichia coli CFT073
cuggcagcaccacgcaga

SEQ ID NO: 614874 - RNA, 21 nt, Escherichia coli CFT073
cuggcagggaaagaaacgcca

SEQ ID NO: 614875 - RNA, 16 nt, Escherichia coli CFT073
cuggcaguggugcggc

SEQ ID NO: 614876 - RNA, 19 nt, Escherichia coli CFT073
cuggcauaaacacggcgaa

SEQ ID NO: 614877 - RNA, 17 nt, Escherichia coli CFT073
cuggcgcgcuauuacca

SEQ ID NO: 614878 - RNA, 19 nt, Escherichia coli CFT073
cuggcgcauuaacggcaag

SEQ ID NO: 614879 - RNA, 18 nt, Escherichia coli CFT073
cuggcgcaggagccgcau

SEQ ID NO: 614880 - RNA, 19 nt, Escherichia coli CFT073
cuggcgcagcgcagcgcca

SEQ ID NO: 614881 - RNA, 12 nt, Escherichia coli CFT073
cuggcgcagcau

SEQ ID NO: 614882 - RNA, 12 nt, Escherichia coli CFT073
cuggcgcagcag

SEQ ID NO: 614883 - RNA, 20 nt, Escherichia coli CFT073
cuggcgcaacacccugaugu

SEQ ID NO: 614884 - RNA, 16 nt, Escherichia coli CFT073
cuggcgcaacugcgcc

SEQ ID NO: 614885 - RNA, 13 nt, Escherichia coli CFT073
cuggcgaugcccc

SEQ ID NO: 614886 - RNA, 22 nt, Escherichia coli CFT073
cuggcgaugcccccaggagcgc

SEQ ID NO: 614887 - RNA, 15 nt, Escherichia coli CFT073
cuggcgcuaucaaua

SEQ ID NO: 614888 - RNA, 14 nt, Escherichia coli CFT073
cuggcgcugcucag

SEQ ID NO: 614889 - RNA, 16 nt, Escherichia coli CFT073
cuggcgcugcucaggc

SEQ ID NO: 614890 - RNA, 17 nt, Escherichia coli CFT073
cuggcggcgugaugccg

SEQ ID NO: 614891 - RNA, 20 nt, Escherichia coli CFT073
aaacucacugccagcaucag

SEQ ID NO: 614892 - RNA, 22 nt, Escherichia coli CFT073
aaacucauccaccacaaaagca

SEQ ID NO: 614893 - RNA, 21 nt, Escherichia coli CFT073
cugggauauaaacucgccaaa

SEQ ID NO: 614894 - RNA, 19 nt, Escherichia coli CFT073
cugggaucguagccuugua

SEQ ID NO: 614895 - RNA, 15 nt, Escherichia coli CFT073
cugggaugccccggg

SEQ ID NO: 614896 - RNA, 23 nt, Escherichia coli CFT073
cugggcacucuuggcaccgccuu

SEQ ID NO: 614897 - RNA, 18 nt, Escherichia coli CFT073
cugggauuuggcagcacc

SEQ ID NO: 614898 - RNA, 17 nt, Escherichia coli CFT073
cugggcaaaaucaucac

SEQ ID NO: 614899 - RNA, 14 nt, Escherichia coli CFT073
cugggcaaugcugu

SEQ ID NO: 614900 - RNA, 14 nt, Escherichia coli CFT073
cugggccagcacca

SEQ ID NO: 614901 - RNA, 23 nt, Escherichia coli CFT073
cuggcuuuuggaccgccaauuaa

SEQ ID NO: 614902 - RNA, 22 nt, Escherichia coli CFT073
cugggaaaucaccaccagcacc

SEQ ID NO: 614903 - RNA, 22 nt, Escherichia coli CFT073
cuggcuuuacuuaacuccaucc

SEQ ID NO: 614904 - RNA, 16 nt, Escherichia coli CFT073
cuggcuugccagccac

SEQ ID NO: 614905 - RNA, 16 nt, Escherichia coli CFT073
cuggcuugcugccccc

SEQ ID NO: 614906 - RNA, 18 nt, Escherichia coli CFT073
cuggcuucuaucuucauc

SEQ ID NO: 614907 - RNA, 12 nt, Escherichia coli CFT073
cuggcuggcgcu

SEQ ID NO: 614908 - RNA, 16 nt, Escherichia coli CFT073
cuggcugguggaacag

SEQ ID NO: 614909 - RNA, 23 nt, Escherichia coli CFT073
cuggcuguaaaauuauccucuuc

SEQ ID NO: 614910 - RNA, 19 nt, Escherichia coli CFT073
cuggcugucgaucuccggc

SEQ ID NO: 614911 - RNA, 17 nt, Escherichia coli CFT073
cuggcuaagcaucgcaa

SEQ ID NO: 614912 - RNA, 22 nt, Escherichia coli CFT073
cuggcguguugcuccacgccag

SEQ ID NO: 614913 - RNA, 19 nt, Escherichia coli CFT073
cuggcguuacccagcgcca

SEQ ID NO: 614914 - RNA, 21 nt, Escherichia coli CFT073
cuggcugagcaaacaguucug

SEQ ID NO: 614915 - RNA, 23 nt, Escherichia coli CFT073
cuggcugacauaaacaccagcaa

SEQ ID NO: 614916 - RNA, 17 nt, Escherichia coli CFT073
cuggcugccagcccgcu

SEQ ID NO: 614917 - RNA, 23 nt, Escherichia coli CFT073
cuggcugccagcccgcugguugu

SEQ ID NO: 614918 - RNA, 22 nt, Escherichia coli CFT073
cuggcugcccaugccuuguuua

SEQ ID NO: 614919 - RNA, 16 nt, Escherichia coli CFT073
cuggcugccuuagucu

SEQ ID NO: 614920 - RNA, 20 nt, Escherichia coli CFT073
cuggcucauuaguuaauuca

SEQ ID NO: 614921 - RNA, 20 nt, Escherichia coli CFT073
cuggcugaacgccugcacca

SEQ ID NO: 614922 - RNA, 14 nt, Escherichia coli CFT073
cuggcugaaucccu

SEQ ID NO: 614923 - RNA, 15 nt, Escherichia coli CFT073
cuggcugaaucccug

SEQ ID NO: 614924 - RNA, 14 nt, Escherichia coli CFT073
aaacuccccgcaaa

SEQ ID NO: 614925 - RNA, 15 nt, Escherichia coli CFT073
aaacucgaugacaac

SEQ ID NO: 614926 - RNA, 23 nt, Escherichia coli CFT073
cuggcgucacgccgaccagaccg

SEQ ID NO: 614927 - RNA, 16 nt, Escherichia coli CFT073
cuggcgucauggcgcu

SEQ ID NO: 614928 - RNA, 15 nt, Escherichia coli CFT073
cuggcgucuccuccc

SEQ ID NO: 614929 - RNA, 16 nt, Escherichia coli CFT073
cuggcgugaaauucac

SEQ ID NO: 614930 - RNA, 19 nt, Escherichia coli CFT073
cuggcgguugauaaugauu

SEQ ID NO: 614931 - RNA, 17 nt, Escherichia coli CFT073
cuggcguacagagggca

SEQ ID NO: 614932 - RNA, 14 nt, Escherichia coli CFT073
cuggcguagagauc

SEQ ID NO: 614933 - RNA, 23 nt, Escherichia coli CFT073
cuggcguagagaucccccgcaca

SEQ ID NO: 614934 - RNA, 20 nt, Escherichia coli CFT073
cuggcgggaauaaaagccag

SEQ ID NO: 614935 - RNA, 13 nt, Escherichia coli CFT073
cuggcaccaucag

SEQ ID NO: 614936 - RNA, 17 nt, Escherichia coli CFT073
cuggcaaucgccagcgg

SEQ ID NO: 614937 - RNA, 23 nt, Escherichia coli CFT073
cuggcaaucaugcgcauaaccca

SEQ ID NO: 614938 - RNA, 15 nt, Escherichia coli CFT073
cuggcacaagacuga

SEQ ID NO: 614939 - RNA, 18 nt, Escherichia coli CFT073
cuggauaaucacaauggu

SEQ ID NO: 614940 - RNA, 15 nt, Escherichia coli CFT073
cuggauaucgagaua

SEQ ID NO: 614941 - RNA, 13 nt, Escherichia coli CFT073
cuggaugccauuu

SEQ ID NO: 614942 - RNA, 15 nt, Escherichia coli CFT073
cuggaaucaucaagc

SEQ ID NO: 614943 - RNA, 14 nt, Escherichia coli CFT073
cuggaauaauaacu

SEQ ID NO: 614944 - RNA, 22 nt, Escherichia coli CFT073
cuggagcaguauugauagauuu

SEQ ID NO: 614945 - RNA, 19 nt, Escherichia coli CFT073
cuggagccugauccauacu

SEQ ID NO: 614946 - RNA, 14 nt, Escherichia coli CFT073
cuggaguaaaucag

SEQ ID NO: 614947 - RNA, 18 nt, Escherichia coli CFT073
cuggaguaaaucagagga

SEQ ID NO: 614948 - RNA, 19 nt, Escherichia coli CFT073
cugcuguaagccaaaccga

SEQ ID NO: 614949 - RNA, 15 nt, Escherichia coli CFT073
cugcuguucuucugc

SEQ ID NO: 614950 - RNA, 23 nt, Escherichia coli CFT073
cugcugaugcgccgcuaacgucu

SEQ ID NO: 614951 - RNA, 18 nt, Escherichia coli CFT073
cugcuggguaaagacauc

SEQ ID NO: 614952 - RNA, 22 nt, Escherichia coli CFT073
cuggaagaccagcgaaaccuga

SEQ ID NO: 614953 - RNA, 21 nt, Escherichia coli CFT073
cuggaagaaaacauuuuaaac

SEQ ID NO: 614954 - RNA, 19 nt, Escherichia coli CFT073
cuggaaccucgcgaaugcu

SEQ ID NO: 614955 - RNA, 21 nt, Escherichia coli CFT073
cuggaacaguugcagucucau

SEQ ID NO: 614956 - RNA, 21 nt, Escherichia coli CFT073
cuggaacgggaagaaaccauu

SEQ ID NO: 614957 - RNA, 19 nt, Escherichia coli CFT073
cuggaacugaaaggcacuc

SEQ ID NO: 614958 - RNA, 12 nt, Escherichia coli CFT073
cugcuucugccg

SEQ ID NO: 614959 - RNA, 15 nt, Escherichia coli CFT073
cugcuucggucagca

SEQ ID NO: 614960 - RNA, 13 nt, Escherichia coli CFT073
cugcuucuuacca

SEQ ID NO: 614961 - RNA, 11 nt, Escherichia coli CFT073
cugcuugccau

SEQ ID NO: 614962 - RNA, 16 nt, Escherichia coli CFT073
cugcuugccauucacu

SEQ ID NO: 614963 - RNA, 13 nt, Escherichia coli CFT073
cugcuugccaccg

SEQ ID NO: 614964 - RNA, 12 nt, Escherichia coli CFT073
cugcuaauuuau

SEQ ID NO: 614965 - RNA, 14 nt, Escherichia coli CFT073
cugcgugcaguucc

SEQ ID NO: 614966 - RNA, 16 nt, Escherichia coli CFT073
cugcgugcaguuccug

SEQ ID NO: 614967 - RNA, 16 nt, Escherichia coli CFT073
cugcuccagcagcuca

SEQ ID NO: 614968 - RNA, 22 nt, Escherichia coli CFT073
cugcuccagcguaccugccgcg

SEQ ID NO: 614969 - RNA, 19 nt, Escherichia coli CFT073
cugcuccaucgcaugccag

SEQ ID NO: 614970 - RNA, 12 nt, Escherichia coli CFT073
aaacuaucugaa

SEQ ID NO: 614971 - RNA, 16 nt, Escherichia coli CFT073
cugcugaauauugcca

SEQ ID NO: 614972 - RNA, 17 nt, Escherichia coli CFT073
cugcugaccaccagcac

SEQ ID NO: 614973 - RNA, 12 nt, Escherichia coli CFT073
cugcucuugauc

SEQ ID NO: 614974 - RNA, 17 nt, Escherichia coli CFT073
cugcucuucacgcccgc

SEQ ID NO: 614975 - RNA, 14 nt, Escherichia coli CFT073
cugcgguaauccgg

SEQ ID NO: 614976 - RNA, 22 nt, Escherichia coli CFT073
cugcgguacggauagccgcccc

SEQ ID NO: 614977 - RNA, 22 nt, Escherichia coli CFT073
cugcgucgcggccuguuccaau

SEQ ID NO: 614978 - RNA, 19 nt, Escherichia coli CFT073
cugcggccugcugcacaga

SEQ ID NO: 614979 - RNA, 18 nt, Escherichia coli CFT073
cugcggaaucaccggcaa

SEQ ID NO: 614980 - RNA, 19 nt, Escherichia coli CFT073
cugcgcuugcgcggcagcu

SEQ ID NO: 614981 - RNA, 13 nt, Escherichia coli CFT073
cugcgacaccagc

SEQ ID NO: 614982 - RNA, 15 nt, Escherichia coli CFT073
cugcgacaccagcau

SEQ ID NO: 614983 - RNA, 19 nt, Escherichia coli CFT073
cugcgaaucgcuucauuua

SEQ ID NO: 614984 - RNA, 20 nt, Escherichia coli CFT073
cugcgaaucuaaaucagguu

SEQ ID NO: 614985 - RNA, 17 nt, Escherichia coli CFT073
cugcgaaucgcuucauu

SEQ ID NO: 614986 - RNA, 16 nt, Escherichia coli CFT073
cugcgaauugagauga

SEQ ID NO: 614987 - RNA, 19 nt, Escherichia coli CFT073
cugcgacgucugaucggca

SEQ ID NO: 614988 - RNA, 19 nt, Escherichia coli CFT073
cugccacucuccugguugu

SEQ ID NO: 614989 - RNA, 19 nt, Escherichia coli CFT073
cugccagaaaucggccuuc

SEQ ID NO: 614990 - RNA, 22 nt, Escherichia coli CFT073
cugccaccaggaacgcgccaag

SEQ ID NO: 614991 - RNA, 13 nt, Escherichia coli CFT073
cugccaccagcac

SEQ ID NO: 614992 - RNA, 15 nt, Escherichia coli CFT073
cugccacauccccuc

SEQ ID NO: 614993 - RNA, 13 nt, Escherichia coli CFT073
cugcaucaaccag

SEQ ID NO: 614994 - RNA, 18 nt, Escherichia coli CFT073
cugcaucaaccagcaccu

SEQ ID NO: 614995 - RNA, 17 nt, Escherichia coli CFT073
cugcaucacgagcgcga

SEQ ID NO: 614996 - RNA, 20 nt, Escherichia coli CFT073
cugccaggucgugccagaaa

SEQ ID NO: 614997 - RNA, 17 nt, Escherichia coli CFT073
cugccaggugcagccca

SEQ ID NO: 614998 - RNA, 22 nt, Escherichia coli CFT073
cugccaggugcagcccauaagc

SEQ ID NO: 614999 - RNA, 15 nt, Escherichia coli CFT073
cugccaguaagcagu

SEQ ID NO: 615000 - RNA, 14 nt, Escherichia coli CFT073
cugccaguaauucc

SEQ ID NO: 615001 - RNA, 12 nt, Escherichia coli CFT073
cugccaggcugc

SEQ ID NO: 615002 - RNA, 16 nt, Escherichia coli CFT073
cugccagggcacugau

SEQ ID NO: 615003 - RNA, 12 nt, Escherichia coli CFT073
cugccaggcagc

SEQ ID NO: 615004 - RNA, 13 nt, Escherichia coli CFT073
cugccagcccgcu

SEQ ID NO: 615005 - RNA, 14 nt, Escherichia coli CFT073
cugccagcccggca

SEQ ID NO: 615006 - RNA, 22 nt, Escherichia coli CFT073
cugccagcccggcagcuuuaau

SEQ ID NO: 615007 - RNA, 15 nt, Escherichia coli CFT073
cugccacuucuucca

SEQ ID NO: 615008 - RNA, 13 nt, Escherichia coli CFT073
cugccagaaccgc

SEQ ID NO: 615009 - RNA, 15 nt, Escherichia coli CFT073
cugccagaaccgcuu

SEQ ID NO: 615010 - RNA, 15 nt, Escherichia coli CFT073
cugccagaagcagaa

SEQ ID NO: 615011 - RNA, 13 nt, Escherichia coli CFT073
cugccagcgccga

SEQ ID NO: 615012 - RNA, 17 nt, Escherichia coli CFT073
cugccagcgugagggaa

SEQ ID NO: 615013 - RNA, 15 nt, Escherichia coli CFT073
cugccagcguggcga

SEQ ID NO: 615014 - RNA, 23 nt, Escherichia coli CFT073
cugccagcugcucauagcggcug

SEQ ID NO: 615015 - RNA, 16 nt, Escherichia coli CFT073
cugccauuguugcugg

SEQ ID NO: 615016 - RNA, 20 nt, Escherichia coli CFT073
cugccauuguugcuggaucc

SEQ ID NO: 615017 - RNA, 14 nt, Escherichia coli CFT073
cugcccaagugcag

SEQ ID NO: 615018 - RNA, 19 nt, Escherichia coli CFT073
cugcccccggcguuaucgg

SEQ ID NO: 615019 - RNA, 16 nt, Escherichia coli CFT073
cugcccgaacagcaac

SEQ ID NO: 615020 - RNA, 17 nt, Escherichia coli CFT073
cugccgagauggugcca

SEQ ID NO: 615021 - RNA, 15 nt, Escherichia coli CFT073
cugccgaccaucugu

SEQ ID NO: 615022 - RNA, 15 nt, Escherichia coli CFT073
cugccgaccagagcc

SEQ ID NO: 615023 - RNA, 19 nt, Escherichia coli CFT073
cugccuugugggcuauaac

SEQ ID NO: 615024 - RNA, 21 nt, Escherichia coli CFT073
cugccuugaguuuuucauccc

SEQ ID NO: 615025 - RNA, 16 nt, Escherichia coli CFT073
cugccguagugaugca

SEQ ID NO: 615026 - RNA, 16 nt, Escherichia coli CFT073
cugccguaacugcgcc

SEQ ID NO: 615027 - RNA, 15 nt, Escherichia coli CFT073
cugccguacaggcag

SEQ ID NO: 615028 - RNA, 23 nt, Escherichia coli CFT073
cugccggaguauuucauggggaa

SEQ ID NO: 615029 - RNA, 20 nt, Escherichia coli CFT073
cugccggacguucgcccacu

SEQ ID NO: 615030 - RNA, 21 nt, Escherichia coli CFT073
cugccggaacaggcaucacuu

SEQ ID NO: 615031 - RNA, 16 nt, Escherichia coli CFT073
cugccgcugcgcguga

SEQ ID NO: 615032 - RNA, 14 nt, Escherichia coli CFT073
cugccggaauaauc

SEQ ID NO: 615033 - RNA, 17 nt, Escherichia coli CFT073
cugccggaccaucuucc

SEQ ID NO: 615034 - RNA, 20 nt, Escherichia coli CFT073
cugcaccgccuccagcgaca

SEQ ID NO: 615035 - RNA, 20 nt, Escherichia coli CFT073
cugcaccugcucaggcagaa

SEQ ID NO: 615036 - RNA, 22 nt, Escherichia coli CFT073
cugcacgcgauggcuuuccacc

SEQ ID NO: 615037 - RNA, 23 nt, Escherichia coli CFT073
cugcacgcgauggcuuuccaccu

SEQ ID NO: 615038 - RNA, 13 nt, Escherichia coli CFT073
cugcacgcccuga

SEQ ID NO: 615039 - RNA, 14 nt, Escherichia coli CFT073
cugcacgcccugau

SEQ ID NO: 615040 - RNA, 19 nt, Escherichia coli CFT073
cugcacguuggcgcauaac

SEQ ID NO: 615041 - RNA, 22 nt, Escherichia coli CFT073
cugcaacagguuacgcuggauu

SEQ ID NO: 615042 - RNA, 13 nt, Escherichia coli CFT073
cugcaaccagaaa

SEQ ID NO: 615043 - RNA, 19 nt, Escherichia coli CFT073
cugcacagcauucagcuuc

SEQ ID NO: 615044 - RNA, 13 nt, Escherichia coli CFT073
cugcaccagcagc

SEQ ID NO: 615045 - RNA, 18 nt, Escherichia coli CFT073
cugcaccagcagcgucag

SEQ ID NO: 615046 - RNA, 18 nt, Escherichia coli CFT073
cugcaccagaacucccug

SEQ ID NO: 615047 - RNA, 22 nt, Escherichia coli CFT073
cugcaccagaacucccuguucc

SEQ ID NO: 615048 - RNA, 17 nt, Escherichia coli CFT073
cugcaccagguuuucgu

SEQ ID NO: 615049 - RNA, 19 nt, Escherichia coli CFT073
cugauuuguaugguuuugu

SEQ ID NO: 615050 - RNA, 15 nt, Escherichia coli CFT073
cugcaaauauugccc

SEQ ID NO: 615051 - RNA, 22 nt, Escherichia coli CFT073
cugcaaaucugcgccuacggca

SEQ ID NO: 615052 - RNA, 22 nt, Escherichia coli CFT073
cugcaacaucaauaaagccgcc

SEQ ID NO: 615053 - RNA, 13 nt, Escherichia coli CFT073
cugcaacaucacc

SEQ ID NO: 615054 - RNA, 15 nt, Escherichia coli CFT073
cugcaaauucaauaa

SEQ ID NO: 615055 - RNA, 23 nt, Escherichia coli CFT073
cugcaaauuuuaacgcauaauaa

SEQ ID NO: 615056 - RNA, 21 nt, Escherichia coli CFT073
cugcaacaacaccagcaggug

SEQ ID NO: 615057 - RNA, 15 nt, Escherichia coli CFT073
cugcauaccauugcg

SEQ ID NO: 615058 - RNA, 13 nt, Escherichia coli CFT073
cugcagcugcaga

SEQ ID NO: 615059 - RNA, 19 nt, Escherichia coli CFT073
cugcaggaaaucaaugcca

SEQ ID NO: 615060 - RNA, 23 nt, Escherichia coli CFT073
cugcaggaaaucaaugccaccag

SEQ ID NO: 615061 - RNA, 14 nt, Escherichia coli CFT073
cugcagaaaaucca

SEQ ID NO: 615062 - RNA, 11 nt, Escherichia coli CFT073
cugcacucagg

SEQ ID NO: 615063 - RNA, 13 nt, Escherichia coli CFT073
cugcacucaggua

SEQ ID NO: 615064 - RNA, 16 nt, Escherichia coli CFT073
cugcacugacaggccg

SEQ ID NO: 615065 - RNA, 21 nt, Escherichia coli CFT073
cugcacugacaggccgugcag

SEQ ID NO: 615066 - RNA, 22 nt, Escherichia coli CFT073
cugcacugaguuacguccaugu

SEQ ID NO: 615067 - RNA, 23 nt, Escherichia coli CFT073
cugcacugucccaaaaugucgga

SEQ ID NO: 615068 - RNA, 16 nt, Escherichia coli CFT073
cugcagcaggcgagcu

SEQ ID NO: 615069 - RNA, 14 nt, Escherichia coli CFT073
cugcagacugaagc

SEQ ID NO: 615070 - RNA, 18 nt, Escherichia coli CFT073
cugcagccaguugcucuu

SEQ ID NO: 615071 - RNA, 19 nt, Escherichia coli CFT073
cugcagccaucgucgccac

SEQ ID NO: 615072 - RNA, 13 nt, Escherichia coli CFT073
cugaauuccccuc

SEQ ID NO: 615073 - RNA, 15 nt, Escherichia coli CFT073
cugaauuggguucuu

SEQ ID NO: 615074 - RNA, 21 nt, Escherichia coli CFT073
cugaauuaacuuaucaagaaa

SEQ ID NO: 615075 - RNA, 23 nt, Escherichia coli CFT073
cugaauggcgauuucacaagacu

SEQ ID NO: 615076 - RNA, 14 nt, Escherichia coli CFT073
cugaaugcugccuu

SEQ ID NO: 615077 - RNA, 18 nt, Escherichia coli CFT073
cugaauauugccaauggu

SEQ ID NO: 615078 - RNA, 20 nt, Escherichia coli CFT073
cugaauauucggcuccagau

SEQ ID NO: 615079 - RNA, 24 nt, Escherichia coli CFT073
cugaauauucggcuccagauuacu

SEQ ID NO: 615080 - RNA, 20 nt, Escherichia coli CFT073
cugaauagugccgcaccagc

SEQ ID NO: 615081 - RNA, 15 nt, Escherichia coli CFT073
cugaauaucaucacc

SEQ ID NO: 615082 - RNA, 17 nt, Escherichia coli CFT073
cugaauauccugacuuu

SEQ ID NO: 615083 - RNA, 15 nt, Escherichia coli CFT073
cugaauaucuuucuc

SEQ ID NO: 615084 - RNA, 19 nt, Escherichia coli CFT073
cugaaucacaauccgcucu

SEQ ID NO: 615085 - RNA, 16 nt, Escherichia coli CFT073
cugaaucuggcuucau

SEQ ID NO: 615086 - RNA, 21 nt, Escherichia coli CFT073
cugaaguggguaaugucacac

SEQ ID NO: 615087 - RNA, 11 nt, Escherichia coli CFT073
cugaauaauca

SEQ ID NO: 615088 - RNA, 11 nt, Escherichia coli CFT073
cugaauaaucc

SEQ ID NO: 615089 - RNA, 16 nt, Escherichia coli CFT073
cugaauacacugcuga

SEQ ID NO: 615090 - RNA, 23 nt, Escherichia coli CFT073
cugaauacacugcugauaaucca

SEQ ID NO: 615091 - RNA, 20 nt, Escherichia coli CFT073
cugaauacccgccagaaaag

SEQ ID NO: 615092 - RNA, 19 nt, Escherichia coli CFT073
cugaauaccguaaaacuca

SEQ ID NO: 615093 - RNA, 14 nt, Escherichia coli CFT073
cucuacucccugcu

SEQ ID NO: 615094 - RNA, 16 nt, Escherichia coli CFT073
cucuaccuggucaccg

SEQ ID NO: 615095 - RNA, 21 nt, Escherichia coli CFT073
cucuacgucgcgguugcaauc

SEQ ID NO: 615096 - RNA, 17 nt, Escherichia coli CFT073
cucuacaauauccucaa

SEQ ID NO: 615097 - RNA, 21 nt, Escherichia coli CFT073
cucuacaauauccucaagcgu

SEQ ID NO: 615098 - RNA, 17 nt, Escherichia coli CFT073
cugaauugugaugguuu

SEQ ID NO: 615099 - RNA, 14 nt, Escherichia coli CFT073
cugaauuugcucca

SEQ ID NO: 615100 - RNA, 17 nt, Escherichia coli CFT073
cugacagaccacucucu

SEQ ID NO: 615101 - RNA, 18 nt, Escherichia coli CFT073
cugacagaccacucucug

SEQ ID NO: 615102 - RNA, 14 nt, Escherichia coli CFT073
cugacagacugcuu

SEQ ID NO: 615103 - RNA, 16 nt, Escherichia coli CFT073
cugacaggucaucgca

SEQ ID NO: 615104 - RNA, 13 nt, Escherichia coli CFT073
cugacauaaacac

SEQ ID NO: 615105 - RNA, 20 nt, Escherichia coli CFT073
cugacauagacgccacccga

SEQ ID NO: 615106 - RNA, 19 nt, Escherichia coli CFT073
cugaccggaauuuacccgc

SEQ ID NO: 615107 - RNA, 16 nt, Escherichia coli CFT073
cugaccgguuucgaac

SEQ ID NO: 615108 - RNA, 22 nt, Escherichia coli CFT073
cugaccgucaaagcgccagcgc

SEQ ID NO: 615109 - RNA, 17 nt, Escherichia coli CFT073
cugaccgucgcagccag

SEQ ID NO: 615110 - RNA, 15 nt, Escherichia coli CFT073
cugaccgucuuuuuu

SEQ ID NO: 615111 - RNA, 22 nt, Escherichia coli CFT073
cugaccgucuuuuuuuacgggu

SEQ ID NO: 615112 - RNA, 19 nt, Escherichia coli CFT073
cugacauauuuuuguugaa

SEQ ID NO: 615113 - RNA, 20 nt, Escherichia coli CFT073
cugacauggcaauagcuucu

SEQ ID NO: 615114 - RNA, 16 nt, Escherichia coli CFT073
cugacauuaccuucua

SEQ ID NO: 615115 - RNA, 15 nt, Escherichia coli CFT073
cugaccgcccggccc

SEQ ID NO: 615116 - RNA, 17 nt, Escherichia coli CFT073
cugacuuccugccucuu

SEQ ID NO: 615117 - RNA, 23 nt, Escherichia coli CFT073
cugacuuacuuccugucuucccu

SEQ ID NO: 615118 - RNA, 14 nt, Escherichia coli CFT073
cugacuuccacuuc

SEQ ID NO: 615119 - RNA, 14 nt, Escherichia coli CFT073
cugacguucagccg

SEQ ID NO: 615120 - RNA, 22 nt, Escherichia coli CFT073
cugacguaaacccguugcuuca

SEQ ID NO: 615121 - RNA, 21 nt, Escherichia coli CFT073
cugacggugauaaucauccca

SEQ ID NO: 615122 - RNA, 19 nt, Escherichia coli CFT073
cugacggugauacagcaaa

SEQ ID NO: 615123 - RNA, 21 nt, Escherichia coli CFT073
cugacggugauacagcaaaau

SEQ ID NO: 615124 - RNA, 19 nt, Escherichia coli CFT073
cugacgcccguuuucaccu

SEQ ID NO: 615125 - RNA, 14 nt, Escherichia coli CFT073
cugauuuucuucca

SEQ ID NO: 615126 - RNA, 21 nt, Escherichia coli CFT073
cugauuucucuggagaaauau

SEQ ID NO: 615127 - RNA, 18 nt, Escherichia coli CFT073
cugauuuccccccggcag

SEQ ID NO: 615128 - RNA, 17 nt, Escherichia coli CFT073
cugauucacgcugacaa

SEQ ID NO: 615129 - RNA, 17 nt, Escherichia coli CFT073
cugauuccgggccacca

SEQ ID NO: 615130 - RNA, 22 nt, Escherichia coli CFT073
cugauuccaggucaaucccagg

SEQ ID NO: 615131 - RNA, 13 nt, Escherichia coli CFT073
cugauucaagauu

SEQ ID NO: 615132 - RNA, 17 nt, Escherichia coli CFT073
cugauguuguuucucuu

SEQ ID NO: 615133 - RNA, 23 nt, Escherichia coli CFT073
cugauguuguuucucuuucuuca

SEQ ID NO: 615134 - RNA, 21 nt, Escherichia coli CFT073
cugauuaacgcuuguaaauga

SEQ ID NO: 615135 - RNA, 22 nt, Escherichia coli CFT073
cugauuaacuugcgacagccau

SEQ ID NO: 615136 - RNA, 21 nt, Escherichia coli CFT073
cugauuaagaucgugcagcac

SEQ ID NO: 615137 - RNA, 20 nt, Escherichia coli CFT073
cugauuaagcggguuuugaa

SEQ ID NO: 615138 - RNA, 18 nt, Escherichia coli CFT073
cugauuaauauugaggau

SEQ ID NO: 615139 - RNA, 20 nt, Escherichia coli CFT073
cugauuaccuaccaacgcac

SEQ ID NO: 615140 - RNA, 14 nt, Escherichia coli CFT073
cugaugugcuccau

SEQ ID NO: 615141 - RNA, 15 nt, Escherichia coli CFT073
cugauguugauaaaa

SEQ ID NO: 615142 - RNA, 15 nt, Escherichia coli CFT073
cugauguugauaaag

SEQ ID NO: 615143 - RNA, 22 nt, Escherichia coli CFT073
cugauggagauuaacugggcgu

SEQ ID NO: 615144 - RNA, 23 nt, Escherichia coli CFT073
cugauggcuguuuucagcaccag

SEQ ID NO: 615145 - RNA, 20 nt, Escherichia coli CFT073
cugauguaaucaacuccgcc

SEQ ID NO: 615146 - RNA, 19 nt, Escherichia coli CFT073
cugaugauauuuuucccug

SEQ ID NO: 615147 - RNA, 14 nt, Escherichia coli CFT073
cugaugaucuaaaa

SEQ ID NO: 615148 - RNA, 21 nt, Escherichia coli CFT073
cugaugagcaaaucgcggcuu

SEQ ID NO: 615149 - RNA, 21 nt, Escherichia coli CFT073
cugaugcuuuccgccgucauc

SEQ ID NO: 615150 - RNA, 19 nt, Escherichia coli CFT073
cugauggaagacauagcac

SEQ ID NO: 615151 - RNA, 14 nt, Escherichia coli CFT073
cugaucuuuaucaa

SEQ ID NO: 615152 - RNA, 21 nt, Escherichia coli CFT073
cugaucuuuaucaagcaccaa

SEQ ID NO: 615153 - RNA, 15 nt, Escherichia coli CFT073
cugaugaaagcaugu

SEQ ID NO: 615154 - RNA, 12 nt, Escherichia coli CFT073
cugauaucaccu

SEQ ID NO: 615155 - RNA, 14 nt, Escherichia coli CFT073
cugauaucaccugc

SEQ ID NO: 615156 - RNA, 16 nt, Escherichia coli CFT073
cugauaucaccugcuu

SEQ ID NO: 615157 - RNA, 22 nt, Escherichia coli CFT073
cugauaucggcucauaaaaacu

SEQ ID NO: 615158 - RNA, 23 nt, Escherichia coli CFT073
cugauaucggcucauaaaaacuc

SEQ ID NO: 615159 - RNA, 21 nt, Escherichia coli CFT073
cugauauaucaccuuccagaa

SEQ ID NO: 615160 - RNA, 23 nt, Escherichia coli CFT073
cugaugacaaacgcaaaacugcc

SEQ ID NO: 615161 - RNA, 19 nt, Escherichia coli CFT073
cugaugaaguugaaaucac

SEQ ID NO: 615162 - RNA, 12 nt, Escherichia coli CFT073
cugaugagcaaa

SEQ ID NO: 615163 - RNA, 15 nt, Escherichia coli CFT073
cugauaaccuuccag

SEQ ID NO: 615164 - RNA, 11 nt, Escherichia coli CFT073
cugauaagaca

SEQ ID NO: 615165 - RNA, 19 nt, Escherichia coli CFT073
cugauaagacgcggcccgc

SEQ ID NO: 615166 - RNA, 10 nt, Escherichia coli CFT073
cugauaagau

SEQ ID NO: 615167 - RNA, 18 nt, Escherichia coli CFT073
cugauaaaugaagaaaaa

SEQ ID NO: 615168 - RNA, 13 nt, Escherichia coli CFT073
cugauaaaucccg

SEQ ID NO: 615169 - RNA, 21 nt, Escherichia coli CFT073
cugaguaucgaaaacaucaaa

SEQ ID NO: 615170 - RNA, 12 nt, Escherichia coli CFT073
cugauaaaaaac

SEQ ID NO: 615171 - RNA, 14 nt, Escherichia coli CFT073
cugauaaaaaaccc

SEQ ID NO: 615172 - RNA, 22 nt, Escherichia coli CFT073
cugagcgugagugcgaaacaga

SEQ ID NO: 615173 - RNA, 17 nt, Escherichia coli CFT073
cugacuuuaccugccug

SEQ ID NO: 615174 - RNA, 21 nt, Escherichia coli CFT073
cugacuuuaccugccugacga

SEQ ID NO: 615175 - RNA, 22 nt, Escherichia coli CFT073
cugacuuucuuuucccuguggg

SEQ ID NO: 615176 - RNA, 15 nt, Escherichia coli CFT073
cugagaaaaagcgaa

SEQ ID NO: 615177 - RNA, 23 nt, Escherichia coli CFT073
cugagccugugcauguuuaacca

SEQ ID NO: 615178 - RNA, 19 nt, Escherichia coli CFT073
cugagcgaagcgcaugccu

SEQ ID NO: 615179 - RNA, 22 nt, Escherichia coli CFT073
cugagcuucuucaaaaaaguca

SEQ ID NO: 615180 - RNA, 23 nt, Escherichia coli CFT073
gaauuaaaaacaguaugcaacaa

SEQ ID NO: 615181 - RNA, 22 nt, Escherichia coli CFT073
gaauuaaaauaucaggcugaac

SEQ ID NO: 615182 - RNA, 13 nt, Escherichia coli CFT073
gaauuaaccagaa

SEQ ID NO: 615183 - RNA, 15 nt, Escherichia coli CFT073
gaauuaacaccacca

SEQ ID NO: 615184 - RNA, 15 nt, Escherichia coli CFT073
gaauugcccacugcg

SEQ ID NO: 615185 - RNA, 18 nt, Escherichia coli CFT073
gaauugccuguucaaccu

SEQ ID NO: 615186 - RNA, 16 nt, Escherichia coli CFT073
gaauuaucuauauuua

SEQ ID NO: 615187 - RNA, 13 nt, Escherichia coli CFT073
gaauuaugcagcc

SEQ ID NO: 615188 - RNA, 17 nt, Escherichia coli CFT073
gaauuauuagcaacgau

SEQ ID NO: 615189 - RNA, 12 nt, Escherichia coli CFT073
gaauuauucaga

SEQ ID NO: 615190 - RNA, 20 nt, Escherichia coli CFT073
gaauugcugcgcccgcagcg

SEQ ID NO: 615191 - RNA, 14 nt, Escherichia coli CFT073
gaauugcuuccagu

SEQ ID NO: 615192 - RNA, 18 nt, Escherichia coli CFT073
gaauugugcuuucaguuc

SEQ ID NO: 615193 - RNA, 16 nt, Escherichia coli CFT073
gaauuuaaaugacaau

SEQ ID NO: 615194 - RNA, 15 nt, Escherichia coli CFT073
gacaaaaagaguucc

SEQ ID NO: 615195 - RNA, 15 nt, Escherichia coli CFT073
gaauuucagaaaacg

SEQ ID NO: 615196 - RNA, 15 nt, Escherichia coli CFT073
gaauuuaucuuucag

SEQ ID NO: 615197 - RNA, 19 nt, Escherichia coli CFT073
gaauuuaucuuucagcacu

SEQ ID NO: 615198 - RNA, 16 nt, Escherichia coli CFT073
gaauuucaauaauucc

SEQ ID NO: 615199 - RNA, 14 nt, Escherichia coli CFT073
gacaauaaucguuc

SEQ ID NO: 615200 - RNA, 22 nt, Escherichia coli CFT073
gacaauacuugccggagauuca

SEQ ID NO: 615201 - RNA, 13 nt, Escherichia coli CFT073
gacaauaaucaac

SEQ ID NO: 615202 - RNA, 22 nt, Escherichia coli CFT073
gacaauaaaacguugcccgcug

SEQ ID NO: 615203 - RNA, 19 nt, Escherichia coli CFT073
gacaaguuguugcucacac

SEQ ID NO: 615204 - RNA, 12 nt, Escherichia coli CFT073
gacaauaauauc

SEQ ID NO: 615205 - RNA, 20 nt, Escherichia coli CFT073
gacaauaauaucuuucuugc

SEQ ID NO: 615206 - RNA, 21 nt, Escherichia coli CFT073
gacaaugccgaauagaacaua

SEQ ID NO: 615207 - RNA, 22 nt, Escherichia coli CFT073
gacaauguggccuuaauuggcc

SEQ ID NO: 615208 - RNA, 14 nt, Escherichia coli CFT073
gacaccaaucagcc

SEQ ID NO: 615209 - RNA, 17 nt, Escherichia coli CFT073
gacaccaaggaacugug

SEQ ID NO: 615210 - RNA, 16 nt, Escherichia coli CFT073
gacaccacccaacaga

SEQ ID NO: 615211 - RNA, 11 nt, Escherichia coli CFT073
gacaccagcau

SEQ ID NO: 615212 - RNA, 13 nt, Escherichia coli CFT073
gacaccagccaga

SEQ ID NO: 615213 - RNA, 18 nt, Escherichia coli CFT073
gacaccagccaucuguuc

SEQ ID NO: 615214 - RNA, 18 nt, Escherichia coli CFT073
gacaccaguucagugacc

SEQ ID NO: 615215 - RNA, 17 nt, Escherichia coli CFT073
gacaacgccuuguucgc

SEQ ID NO: 615216 - RNA, 21 nt, Escherichia coli CFT073
gacaacgccuuguucgcccug

SEQ ID NO: 615217 - RNA, 16 nt, Escherichia coli CFT073
gacaaccugcugugua

SEQ ID NO: 615218 - RNA, 22 nt, Escherichia coli CFT073
gacaaaaucaauauaaacagcc

SEQ ID NO: 615219 - RNA, 17 nt, Escherichia coli CFT073
gacaaaaucagaaacaa

SEQ ID NO: 615220 - RNA, 13 nt, Escherichia coli CFT073
gacaaaagugaau

SEQ ID NO: 615221 - RNA, 24 nt, Escherichia coli CFT073
gacaaaauccccuucauuaagaau

SEQ ID NO: 615222 - RNA, 21 nt, Escherichia coli CFT073
gacaaacaccgaaccagagau

SEQ ID NO: 615223 - RNA, 21 nt, Escherichia coli CFT073
gacaaacagcucgacaccaaa

SEQ ID NO: 615224 - RNA, 21 nt, Escherichia coli CFT073
gacaaaccggcuggcuaacau

SEQ ID NO: 615225 - RNA, 20 nt, Escherichia coli CFT073
gacaaacucaccuggcugau

SEQ ID NO: 615226 - RNA, 13 nt, Escherichia coli CFT073
gacaaacugcgug

SEQ ID NO: 615227 - RNA, 19 nt, Escherichia coli CFT073
gacaaacuuccagaauaug

SEQ ID NO: 615228 - RNA, 18 nt, Escherichia coli CFT073
gacaacauugauuucuua

SEQ ID NO: 615229 - RNA, 12 nt, Escherichia coli CFT073
gacaaccagcac

SEQ ID NO: 615230 - RNA, 11 nt, Escherichia coli CFT073
gaauguuccau

SEQ ID NO: 615231 - RNA, 22 nt, Escherichia coli CFT073
gaauggugccgacagguggugu

SEQ ID NO: 615232 - RNA, 14 nt, Escherichia coli CFT073
gaauguaaugcaug

SEQ ID NO: 615233 - RNA, 21 nt, Escherichia coli CFT073
gaaugccggaaucagaauccg

SEQ ID NO: 615234 - RNA, 16 nt, Escherichia coli CFT073
gaaugccauaaaaguc

SEQ ID NO: 615235 - RNA, 21 nt, Escherichia coli CFT073
gaaugccgcagcacccugagu

SEQ ID NO: 615236 - RNA, 22 nt, Escherichia coli CFT073
gaaugacaucaucgccccgcuc

SEQ ID NO: 615237 - RNA, 15 nt, Escherichia coli CFT073
gaaucgccccagcac

SEQ ID NO: 615238 - RNA, 14 nt, Escherichia coli CFT073
gaaucgccagcauc

SEQ ID NO: 615239 - RNA, 19 nt, Escherichia coli CFT073
gaaucuguucuggaaaaaa

SEQ ID NO: 615240 - RNA, 13 nt, Escherichia coli CFT073
gaaucgauaaccc

SEQ ID NO: 615241 - RNA, 18 nt, Escherichia coli CFT073
gaaucgagcaauaaacac

SEQ ID NO: 615242 - RNA, 17 nt, Escherichia coli CFT073
gaauccuucccccacca

SEQ ID NO: 615243 - RNA, 18 nt, Escherichia coli CFT073
gaauccuucccccaccac

SEQ ID NO: 615244 - RNA, 12 nt, Escherichia coli CFT073
gaaugaauuucc

SEQ ID NO: 615245 - RNA, 22 nt, Escherichia coli CFT073
gaaugaaauagacauuacgcau

SEQ ID NO: 615246 - RNA, 16 nt, Escherichia coli CFT073
gaaugaaauauuaucu

SEQ ID NO: 615247 - RNA, 12 nt, Escherichia coli CFT073
gaaugacuaagc

SEQ ID NO: 615248 - RNA, 13 nt, Escherichia coli CFT073
gaaugaaaacgaa

SEQ ID NO: 615249 - RNA, 18 nt, Escherichia coli CFT073
gaaucuucuucucagcca

SEQ ID NO: 615250 - RNA, 14 nt, Escherichia coli CFT073
gaauccagcaagcu

SEQ ID NO: 615251 - RNA, 19 nt, Escherichia coli CFT073
gaauccccacaaaccaccg

SEQ ID NO: 615252 - RNA, 14 nt, Escherichia coli CFT073
gaauccccacugca

SEQ ID NO: 615253 - RNA, 24 nt, Escherichia coli CFT073
gaauccccacugcauggcggcguc

SEQ ID NO: 615254 - RNA, 19 nt, Escherichia coli CFT073
gaauccagccccaccagca

SEQ ID NO: 615255 - RNA, 19 nt, Escherichia coli CFT073
gaauccaggccagauacug

SEQ ID NO: 615256 - RNA, 23 nt, Escherichia coli CFT073
gaaucccaguacuguacaacaca

SEQ ID NO: 615257 - RNA, 13 nt, Escherichia coli CFT073
gaaucaaucucag

SEQ ID NO: 615258 - RNA, 23 nt, Escherichia coli CFT073
gaaucaacggcaacaauuuccgc

SEQ ID NO: 615259 - RNA, 12 nt, Escherichia coli CFT073
gaaucagcagcg

SEQ ID NO: 615260 - RNA, 14 nt, Escherichia coli CFT073
gaaucagcaguuca

SEQ ID NO: 615261 - RNA, 22 nt, Escherichia coli CFT073
gaaucagucccugaaucgccac

SEQ ID NO: 615262 - RNA, 22 nt, Escherichia coli CFT073
gaaucaucauaucgucauuauc

SEQ ID NO: 615263 - RNA, 19 nt, Escherichia coli CFT073
gaaucaaaucaaccaggcc

SEQ ID NO: 615264 - RNA, 18 nt, Escherichia coli CFT073
gaaucaaacauggagagu

SEQ ID NO: 615265 - RNA, 13 nt, Escherichia coli CFT073
gaauaccuucuuc

SEQ ID NO: 615266 - RNA, 15 nt, Escherichia coli CFT073
gaauagagccuggcu

SEQ ID NO: 615267 - RNA, 23 nt, Escherichia coli CFT073
gaauagcucaguugguagagcac

SEQ ID NO: 615268 - RNA, 19 nt, Escherichia coli CFT073
gaauagccgcagcuaucag

SEQ ID NO: 615269 - RNA, 15 nt, Escherichia coli CFT073
gaauagcgccacgcc

SEQ ID NO: 615270 - RNA, 23 nt, Escherichia coli CFT073
gaauagcgccacgccaaccaccg

SEQ ID NO: 615271 - RNA, 12 nt, Escherichia coli CFT073
gaauaaaagcca

SEQ ID NO: 615272 - RNA, 22 nt, Escherichia coli CFT073
gaauaagcuguacggagcggau

SEQ ID NO: 615273 - RNA, 20 nt, Escherichia coli CFT073
gaauaaguuucagcaucagg

SEQ ID NO: 615274 - RNA, 15 nt, Escherichia coli CFT073
gaauaagcugccgcu

SEQ ID NO: 615275 - RNA, 13 nt, Escherichia coli CFT073
gaauaccgacauc

SEQ ID NO: 615276 - RNA, 16 nt, Escherichia coli CFT073
gaauaccguaaaacuc

SEQ ID NO: 615277 - RNA, 12 nt, Escherichia coli CFT073
gaauacccagca

SEQ ID NO: 615278 - RNA, 13 nt, Escherichia coli CFT073
gaauaaucagaug

SEQ ID NO: 615279 - RNA, 15 nt, Escherichia coli CFT073
gaauaaucagcagug

SEQ ID NO: 615280 - RNA, 17 nt, Escherichia coli CFT073
gaauaauccccacauca

SEQ ID NO: 615281 - RNA, 21 nt, Escherichia coli CFT073
gaagucgcagaccaaacucuu

SEQ ID NO: 615282 - RNA, 22 nt, Escherichia coli CFT073
gaagucuuaagugggcaacaag

SEQ ID NO: 615283 - RNA, 14 nt, Escherichia coli CFT073
gaagucguuaguaa

SEQ ID NO: 615284 - RNA, 20 nt, Escherichia coli CFT073
gaaguuuugucgcugauucg

SEQ ID NO: 615285 - RNA, 17 nt, Escherichia coli CFT073
gaaguaacagagugaau

SEQ ID NO: 615286 - RNA, 15 nt, Escherichia coli CFT073
gaaguaagaggagga

SEQ ID NO: 615287 - RNA, 21 nt, Escherichia coli CFT073
gaaguaagaggaggacagcca

SEQ ID NO: 615288 - RNA, 17 nt, Escherichia coli CFT073
gaagguuuuuucuguau

SEQ ID NO: 615289 - RNA, 19 nt, Escherichia coli CFT073
gaagguaaguuguugauaa

SEQ ID NO: 615290 - RNA, 17 nt, Escherichia coli CFT073
gaaguacgcaguaaaua

SEQ ID NO: 615291 - RNA, 21 nt, Escherichia coli CFT073
gaaguacgcaguaaauaaaaa

SEQ ID NO: 615292 - RNA, 14 nt, Escherichia coli CFT073
gaagguaacaccag

SEQ ID NO: 615293 - RNA, 21 nt, Escherichia coli CFT073
gaagguaacaccaguuuccag

SEQ ID NO: 615294 - RNA, 16 nt, Escherichia coli CFT073
gaaggcgcauugcugg

SEQ ID NO: 615295 - RNA, 14 nt, Escherichia coli CFT073
gaagcuugcuucuu

SEQ ID NO: 615296 - RNA, 13 nt, Escherichia coli CFT073
gaagcuuuucggg

SEQ ID NO: 615297 - RNA, 20 nt, Escherichia coli CFT073
gaaggaaggcaugagccgcu

SEQ ID NO: 615298 - RNA, 21 nt, Escherichia coli CFT073
gaaggaagacguagcaagcau

SEQ ID NO: 615299 - RNA, 17 nt, Escherichia coli CFT073
gaaggauauaaaaauaa

SEQ ID NO: 615300 - RNA, 12 nt, Escherichia coli CFT073
gaagcaccugcg

SEQ ID NO: 615301 - RNA, 23 nt, Escherichia coli CFT073
gaagcacguacgcuguucgccag

SEQ ID NO: 615302 - RNA, 15 nt, Escherichia coli CFT073
gaagcacuaccuugc

SEQ ID NO: 615303 - RNA, 19 nt, Escherichia coli CFT073
gaagcccacaccgcccagc

SEQ ID NO: 615304 - RNA, 15 nt, Escherichia coli CFT073
gaagcagcgcuggag

SEQ ID NO: 615305 - RNA, 21 nt, Escherichia coli CFT073
gaagcagcgcuggagagcgcc

SEQ ID NO: 615306 - RNA, 17 nt, Escherichia coli CFT073
gaagcagcuccagaauu

SEQ ID NO: 615307 - RNA, 18 nt, Escherichia coli CFT073
gaagcaagguagugcuuc

SEQ ID NO: 615308 - RNA, 13 nt, Escherichia coli CFT073
gaagcaauaagca

SEQ ID NO: 615309 - RNA, 13 nt, Escherichia coli CFT073
gaagaucaccaca

SEQ ID NO: 615310 - RNA, 21 nt, Escherichia coli CFT073
gaagauagaggcccuuggcgu

SEQ ID NO: 615311 - RNA, 18 nt, Escherichia coli CFT073
gaagcgccguccaguaau

SEQ ID NO: 615312 - RNA, 22 nt, Escherichia coli CFT073
gaagcgccggaugcgacgcauc

SEQ ID NO: 615313 - RNA, 22 nt, Escherichia coli CFT073
gaagcccaguaccgccagugca

SEQ ID NO: 615314 - RNA, 13 nt, Escherichia coli CFT073
gaagcggcagagg

SEQ ID NO: 615315 - RNA, 16 nt, Escherichia coli CFT073
gaagcguacugucugc

SEQ ID NO: 615316 - RNA, 14 nt, Escherichia coli CFT073
gaagcguauggcgu

SEQ ID NO: 615317 - RNA, 12 nt, Escherichia coli CFT073
gaagcgugcauc

SEQ ID NO: 615318 - RNA, 18 nt, Escherichia coli CFT073
aaagaguuguaauuuaaa

SEQ ID NO: 615319 - RNA, 19 nt, Escherichia coli CFT073
aaagaguuccugaugaaaa

SEQ ID NO: 615320 - RNA, 19 nt, Escherichia coli CFT073
aaagauaaaauaaccgucu

SEQ ID NO: 615321 - RNA, 19 nt, Escherichia coli CFT073
gaagaaccaagccugcugg

SEQ ID NO: 615322 - RNA, 20 nt, Escherichia coli CFT073
gaagaaaucccccagcauca

SEQ ID NO: 615323 - RNA, 22 nt, Escherichia coli CFT073
gaagagaauuugcucuucuuuc

SEQ ID NO: 615324 - RNA, 13 nt, Escherichia coli CFT073
gaacuucccgcug

SEQ ID NO: 615325 - RNA, 13 nt, Escherichia coli CFT073
gaacuucgccagc

SEQ ID NO: 615326 - RNA, 16 nt, Escherichia coli CFT073
gaacuucgccagcgug

SEQ ID NO: 615327 - RNA, 15 nt, Escherichia coli CFT073
gaacuucggcagaga

SEQ ID NO: 615328 - RNA, 18 nt, Escherichia coli CFT073
gaacuucggcagagaaag

SEQ ID NO: 615329 - RNA, 13 nt, Escherichia coli CFT073
gaacuuuuuucau

SEQ ID NO: 615330 - RNA, 18 nt, Escherichia coli CFT073
gaacuuuuuucauccagc

SEQ ID NO: 615331 - RNA, 19 nt, Escherichia coli CFT073
gaacuuuuuucauccagcu

SEQ ID NO: 615332 - RNA, 15 nt, Escherichia coli CFT073
gaagaaaaaccguau

SEQ ID NO: 615333 - RNA, 18 nt, Escherichia coli CFT073
gacguacaccauuuaaug

SEQ ID NO: 615334 - RNA, 23 nt, Escherichia coli CFT073
gacguacaccauuuaaugacaaa

SEQ ID NO: 615335 - RNA, 13 nt, Escherichia coli CFT073
gacggugauaauc

SEQ ID NO: 615336 - RNA, 16 nt, Escherichia coli CFT073
gacggcgaccagaacu

SEQ ID NO: 615337 - RNA, 13 nt, Escherichia coli CFT073
gacggcguucuuu

SEQ ID NO: 615338 - RNA, 22 nt, Escherichia coli CFT073
gacggaagcuuaucacagagga

SEQ ID NO: 615339 - RNA, 16 nt, Escherichia coli CFT073
gacggaauaaacccac

SEQ ID NO: 615340 - RNA, 15 nt, Escherichia coli CFT073
gacggacgcgcggcg

SEQ ID NO: 615341 - RNA, 16 nt, Escherichia coli CFT073
gacggaaaagacuaua

SEQ ID NO: 615342 - RNA, 15 nt, Escherichia coli CFT073
gacgcuuaucuuccg

SEQ ID NO: 615343 - RNA, 20 nt, Escherichia coli CFT073
gacggaacgaucgcuuucaa

SEQ ID NO: 615344 - RNA, 17 nt, Escherichia coli CFT073
gacgcuuacucuuucaa

SEQ ID NO: 615345 - RNA, 21 nt, Escherichia coli CFT073
gacgccguuccagauuccugc

SEQ ID NO: 615346 - RNA, 18 nt, Escherichia coli CFT073
gacgccggauaucccccu

SEQ ID NO: 615347 - RNA, 20 nt, Escherichia coli CFT073
gacuagcagcauuucaaaac

SEQ ID NO: 615348 - RNA, 11 nt, Escherichia coli CFT073
gacuaucacuc

SEQ ID NO: 615349 - RNA, 14 nt, Escherichia coli CFT073
gacuauccgccaua

SEQ ID NO: 615350 - RNA, 15 nt, Escherichia coli CFT073
gacuauuucaaacac

SEQ ID NO: 615351 - RNA, 13 nt, Escherichia coli CFT073
gacuauuucuuca

SEQ ID NO: 615352 - RNA, 14 nt, Escherichia coli CFT073
gacuauuaauauau

SEQ ID NO: 615353 - RNA, 17 nt, Escherichia coli CFT073
gacguucaugccggucg

SEQ ID NO: 615354 - RNA, 16 nt, Escherichia coli CFT073
gacuaacuucugaucu

SEQ ID NO: 615355 - RNA, 14 nt, Escherichia coli CFT073
gacgugugauaaug

SEQ ID NO: 615356 - RNA, 15 nt, Escherichia coli CFT073
gacguuaagaaaacg

SEQ ID NO: 615357 - RNA, 20 nt, Escherichia coli CFT073
gacguuaauccgcucugccc

SEQ ID NO: 615358 - RNA, 15 nt, Escherichia coli CFT073
gacguuauugguggu

SEQ ID NO: 615359 - RNA, 17 nt, Escherichia coli CFT073
gacguuauugguggugu

SEQ ID NO: 615360 - RNA, 19 nt, Escherichia coli CFT073
gacgucagcagauggcaga

SEQ ID NO: 615361 - RNA, 13 nt, Escherichia coli CFT073
gaccugucucuua

SEQ ID NO: 615362 - RNA, 12 nt, Escherichia coli CFT073
gaccuugccaag

SEQ ID NO: 615363 - RNA, 19 nt, Escherichia coli CFT073
gaccuuucaguuugccgcu

SEQ ID NO: 615364 - RNA, 13 nt, Escherichia coli CFT073
gacgaaccggcac

SEQ ID NO: 615365 - RNA, 21 nt, Escherichia coli CFT073
gacgaaaacucgcuaaccacu

SEQ ID NO: 615366 - RNA, 21 nt, Escherichia coli CFT073
gaccugcgucugaugaaagca

SEQ ID NO: 615367 - RNA, 18 nt, Escherichia coli CFT073
gaccugcaacugaugacu

SEQ ID NO: 615368 - RNA, 18 nt, Escherichia coli CFT073
gaccugaauuugcuccag

SEQ ID NO: 615369 - RNA, 19 nt, Escherichia coli CFT073
gaccugaauuugcuccaga

SEQ ID NO: 615370 - RNA, 16 nt, Escherichia coli CFT073
gaccugacuguuccag

SEQ ID NO: 615371 - RNA, 12 nt, Escherichia coli CFT073
gaccggagaaaa

SEQ ID NO: 615372 - RNA, 14 nt, Escherichia coli CFT073
gaccgcuuuccuca

SEQ ID NO: 615373 - RNA, 18 nt, Escherichia coli CFT073
gaccgcuuuccucaucag

SEQ ID NO: 615374 - RNA, 23 nt, Escherichia coli CFT073
gaccgcuuuccucaucagaaaga

SEQ ID NO: 615375 - RNA, 16 nt, Escherichia coli CFT073
gaccggaaguaagagg

SEQ ID NO: 615376 - RNA, 22 nt, Escherichia coli CFT073
gaccggaauuuacccgccaggu

SEQ ID NO: 615377 - RNA, 18 nt, Escherichia coli CFT073
gacgccagccgauccgga

SEQ ID NO: 615378 - RNA, 12 nt, Escherichia coli CFT073
gacgccagcgcu

SEQ ID NO: 615379 - RNA, 22 nt, Escherichia coli CFT073
gacgccagcguucaaacaccag

SEQ ID NO: 615380 - RNA, 18 nt, Escherichia coli CFT073
gacgcauaauccaggcau

SEQ ID NO: 615381 - RNA, 21 nt, Escherichia coli CFT073
gacgcauaauccaggcaucag

SEQ ID NO: 615382 - RNA, 16 nt, Escherichia coli CFT073
gacgccaauaccgauc

SEQ ID NO: 615383 - RNA, 21 nt, Escherichia coli CFT073
gacgccaauaccgaucaguac

SEQ ID NO: 615384 - RNA, 18 nt, Escherichia coli CFT073
gacgccacaacgauaauc

SEQ ID NO: 615385 - RNA, 12 nt, Escherichia coli CFT073
gacgcccugcgc

SEQ ID NO: 615386 - RNA, 13 nt, Escherichia coli CFT073
gacgcccgggcuu

SEQ ID NO: 615387 - RNA, 15 nt, Escherichia coli CFT073
gacgaucaacagaau

SEQ ID NO: 615388 - RNA, 20 nt, Escherichia coli CFT073
gacgcauaaaaaaagcgggc

SEQ ID NO: 615389 - RNA, 15 nt, Escherichia coli CFT073
gacaggucaaaguaa

SEQ ID NO: 615390 - RNA, 15 nt, Escherichia coli CFT073
gacagguucaugcug

SEQ ID NO: 615391 - RNA, 20 nt, Escherichia coli CFT073
gacagguucaugcugcggcu

SEQ ID NO: 615392 - RNA, 19 nt, Escherichia coli CFT073
gacaguagccuuuaucugu

SEQ ID NO: 615393 - RNA, 14 nt, Escherichia coli CFT073
gacaguaucaccaa

SEQ ID NO: 615394 - RNA, 16 nt, Escherichia coli CFT073
gacagccccaccagca

SEQ ID NO: 615395 - RNA, 21 nt, Escherichia coli CFT073
gacagccccaccagcaaauau

SEQ ID NO: 615396 - RNA, 16 nt, Escherichia coli CFT073
gacagaccacucucug

SEQ ID NO: 615397 - RNA, 18 nt, Escherichia coli CFT073
gacaccggcgcacaaccg

SEQ ID NO: 615398 - RNA, 19 nt, Escherichia coli CFT073
gacagccaggaauccagca

SEQ ID NO: 615399 - RNA, 17 nt, Escherichia coli CFT073
gacagcaucgaccaugc

SEQ ID NO: 615400 - RNA, 18 nt, Escherichia coli CFT073
gacagagaacaucaaucc

SEQ ID NO: 615401 - RNA, 23 nt, Escherichia coli CFT073
gacagacggcgacgcgcgcgggu

SEQ ID NO: 615402 - RNA, 17 nt, Escherichia coli CFT073
gacaguguuauucccaa

SEQ ID NO: 615403 - RNA, 24 nt, Escherichia coli CFT073
gacauccagaucacgcagcaagcc

SEQ ID NO: 615404 - RNA, 20 nt, Escherichia coli CFT073
gacauccauauccagugcac

SEQ ID NO: 615405 - RNA, 17 nt, Escherichia coli CFT073
gacagugaaacacaugg

SEQ ID NO: 615406 - RNA, 23 nt, Escherichia coli CFT073
gacauccgccagcgccucuucua

SEQ ID NO: 615407 - RNA, 17 nt, Escherichia coli CFT073
gaccaauccagccggca

SEQ ID NO: 615408 - RNA, 15 nt, Escherichia coli CFT073
gaccaauccgccagc

SEQ ID NO: 615409 - RNA, 16 nt, Escherichia coli CFT073
gaccaauaacccguug

SEQ ID NO: 615410 - RNA, 20 nt, Escherichia coli CFT073
gaccaauuacacacaacaca

SEQ ID NO: 615411 - RNA, 15 nt, Escherichia coli CFT073
gaccacaaucaacgc

SEQ ID NO: 615412 - RNA, 14 nt, Escherichia coli CFT073
gaccaccaaauaaa

SEQ ID NO: 615413 - RNA, 21 nt, Escherichia coli CFT073
gacauguugcuuaaugcggga

SEQ ID NO: 615414 - RNA, 14 nt, Escherichia coli CFT073
gacauguuuuccag

SEQ ID NO: 615415 - RNA, 23 nt, Escherichia coli CFT073
gaccaaacauacgacuuugcgca

SEQ ID NO: 615416 - RNA, 13 nt, Escherichia coli CFT073
gaccaaacugcuc

SEQ ID NO: 615417 - RNA, 15 nt, Escherichia coli CFT073
gacauuucccccuuc

SEQ ID NO: 615418 - RNA, 21 nt, Escherichia coli CFT073
gacauuuggggcacuguagcu

SEQ ID NO: 615419 - RNA, 17 nt, Escherichia coli CFT073
gaccgcuucaggaacug

SEQ ID NO: 615420 - RNA, 23 nt, Escherichia coli CFT073
gaccgcuaauagcgcagcggucg

SEQ ID NO: 615421 - RNA, 18 nt, Escherichia coli CFT073
gaccgccgcucaccugac

SEQ ID NO: 615422 - RNA, 21 nt, Escherichia coli CFT073
gaccgccgucguaacaggaaa

SEQ ID NO: 615423 - RNA, 14 nt, Escherichia coli CFT073
gaccgccagcgcca

SEQ ID NO: 615424 - RNA, 19 nt, Escherichia coli CFT073
gaccgccaguaucuucacu

SEQ ID NO: 615425 - RNA, 21 nt, Escherichia coli CFT073
gaccccauauucgaacccgug

SEQ ID NO: 615426 - RNA, 15 nt, Escherichia coli CFT073
gacccgaccgagcug

SEQ ID NO: 615427 - RNA, 15 nt, Escherichia coli CFT073
gaccgaacaggucac

SEQ ID NO: 615428 - RNA, 14 nt, Escherichia coli CFT073
gaccgccaauuaau

SEQ ID NO: 615429 - RNA, 19 nt, Escherichia coli CFT073
gaccauucgccguccagga

SEQ ID NO: 615430 - RNA, 23 nt, Escherichia coli CFT073
gacccauaauguguuaauaaugc

SEQ ID NO: 615431 - RNA, 22 nt, Escherichia coli CFT073
gaccaucggcacgaccaggaac

SEQ ID NO: 615432 - RNA, 18 nt, Escherichia coli CFT073
gaccaucggcgcuggcgu

SEQ ID NO: 615433 - RNA, 17 nt, Escherichia coli CFT073
gaccaucagcaugacaa

SEQ ID NO: 615434 - RNA, 13 nt, Escherichia coli CFT073
gaccauaacccgc

SEQ ID NO: 615435 - RNA, 14 nt, Escherichia coli CFT073
gaccaguuugccuu

SEQ ID NO: 615436 - RNA, 12 nt, Escherichia coli CFT073
gaccauaaaagg

SEQ ID NO: 615437 - RNA, 19 nt, Escherichia coli CFT073
gaccauaaugauggugaaa

SEQ ID NO: 615438 - RNA, 20 nt, Escherichia coli CFT073
gaccagcgccgcgagcaucg

SEQ ID NO: 615439 - RNA, 16 nt, Escherichia coli CFT073
gaccagcuccagcagu

SEQ ID NO: 615440 - RNA, 18 nt, Escherichia coli CFT073
gaccagcuccagcagucc

SEQ ID NO: 615441 - RNA, 12 nt, Escherichia coli CFT073
gaccagcgggcg

SEQ ID NO: 615442 - RNA, 17 nt, Escherichia coli CFT073
gaccaccgaaugcgccu

SEQ ID NO: 615443 - RNA, 17 nt, Escherichia coli CFT073
gaccacccaccgcagcc

SEQ ID NO: 615444 - RNA, 15 nt, Escherichia coli CFT073
gaccaccgcauucca

SEQ ID NO: 615445 - RNA, 17 nt, Escherichia coli CFT073
gaccacgcacagcccgc

SEQ ID NO: 615446 - RNA, 20 nt, Escherichia coli CFT073
gaccacgcacagcccgccgc

SEQ ID NO: 615447 - RNA, 22 nt, Escherichia coli CFT073
gaaccaugcaaucacugccacc

SEQ ID NO: 615448 - RNA, 23 nt, Escherichia coli CFT073
gaaccaugcaaucacugccacca

SEQ ID NO: 615449 - RNA, 18 nt, Escherichia coli CFT073
gaaccaucaccucuucac

SEQ ID NO: 615450 - RNA, 11 nt, Escherichia coli CFT073
gaaccaucggc

SEQ ID NO: 615451 - RNA, 19 nt, Escherichia coli CFT073
gaaccagggaaaaaagccc

SEQ ID NO: 615452 - RNA, 14 nt, Escherichia coli CFT073
gaaccaguauccgc

SEQ ID NO: 615453 - RNA, 16 nt, Escherichia coli CFT073
gaaccaguauccgcua

SEQ ID NO: 615454 - RNA, 16 nt, Escherichia coli CFT073
gaaccagaauuuccag

SEQ ID NO: 615455 - RNA, 18 nt, Escherichia coli CFT073
gaaccagcgcacagagca

SEQ ID NO: 615456 - RNA, 13 nt, Escherichia coli CFT073
gaaccacagcccg

SEQ ID NO: 615457 - RNA, 17 nt, Escherichia coli CFT073
gaaccaccagauccaac

SEQ ID NO: 615458 - RNA, 18 nt, Escherichia coli CFT073
gaaccaaacagcgccaga

SEQ ID NO: 615459 - RNA, 18 nt, Escherichia coli CFT073
gaaccaaaguagauaauc

SEQ ID NO: 615460 - RNA, 13 nt, Escherichia coli CFT073
gaaccaaucacua

SEQ ID NO: 615461 - RNA, 21 nt, Escherichia coli CFT073
gaaccaaucagccgagcuuca

SEQ ID NO: 615462 - RNA, 23 nt, Escherichia coli CFT073
gaacauucccgguuucaggauga

SEQ ID NO: 615463 - RNA, 17 nt, Escherichia coli CFT073
gaacauaugcacaugau

SEQ ID NO: 615464 - RNA, 18 nt, Escherichia coli CFT073
gaacauccggcacuuucg

SEQ ID NO: 615465 - RNA, 13 nt, Escherichia coli CFT073
gaaccgcaggugg

SEQ ID NO: 615466 - RNA, 18 nt, Escherichia coli CFT073
gaaccgaucagauugaga

SEQ ID NO: 615467 - RNA, 21 nt, Escherichia coli CFT073
gaaccgauaguauggagcagg

SEQ ID NO: 615468 - RNA, 17 nt, Escherichia coli CFT073
gaacccgcaguccugca

SEQ ID NO: 615469 - RNA, 23 nt, Escherichia coli CFT073
gaaccgccgcugucugaaugaua

SEQ ID NO: 615470 - RNA, 20 nt, Escherichia coli CFT073
gaaccgccuggcgcugcuca

SEQ ID NO: 615471 - RNA, 17 nt, Escherichia coli CFT073
gaaccgcguaacuuuug

SEQ ID NO: 615472 - RNA, 13 nt, Escherichia coli CFT073
gaacgagaaaagc

SEQ ID NO: 615473 - RNA, 22 nt, Escherichia coli CFT073
gaaccuuccaucgcaucuucgc

SEQ ID NO: 615474 - RNA, 17 nt, Escherichia coli CFT073
gaaccugugacagcagc

SEQ ID NO: 615475 - RNA, 19 nt, Escherichia coli CFT073
gaaccugugacagcagcgg

SEQ ID NO: 615476 - RNA, 16 nt, Escherichia coli CFT073
gaaccuguucaacaau

SEQ ID NO: 615477 - RNA, 15 nt, Escherichia coli CFT073
gaacucaggcugcca

SEQ ID NO: 615478 - RNA, 20 nt, Escherichia coli CFT073
gaacucaggcugccagauca

SEQ ID NO: 615479 - RNA, 16 nt, Escherichia coli CFT073
gaacucacacaaauau

SEQ ID NO: 615480 - RNA, 15 nt, Escherichia coli CFT073
gaacucacagggcug

SEQ ID NO: 615481 - RNA, 15 nt, Escherichia coli CFT073
gaacuccugaaagcg

SEQ ID NO: 615482 - RNA, 15 nt, Escherichia coli CFT073
gaacucgaccugcaa

SEQ ID NO: 615483 - RNA, 22 nt, Escherichia coli CFT073
gaacuaguagcaugaaguaaca

SEQ ID NO: 615484 - RNA, 14 nt, Escherichia coli CFT073
gaacucaaaccauu

SEQ ID NO: 615485 - RNA, 19 nt, Escherichia coli CFT073
gaacuaccgugcuguacag

SEQ ID NO: 615486 - RNA, 18 nt, Escherichia coli CFT073
gaacugggccugcauauc

SEQ ID NO: 615487 - RNA, 21 nt, Escherichia coli CFT073
gaacuggcguuacccuugugg

SEQ ID NO: 615488 - RNA, 15 nt, Escherichia coli CFT073
gaacugcuccagggc

SEQ ID NO: 615489 - RNA, 16 nt, Escherichia coli CFT073
gaacugcaaggagagc

SEQ ID NO: 615490 - RNA, 15 nt, Escherichia coli CFT073
gaacugcaacucacc

SEQ ID NO: 615491 - RNA, 13 nt, Escherichia coli CFT073
gaacgugcauauu

SEQ ID NO: 615492 - RNA, 16 nt, Escherichia coli CFT073
gaacgucgcagggaga

SEQ ID NO: 615493 - RNA, 21 nt, Escherichia coli CFT073
gaacguauacucgauaccagc

SEQ ID NO: 615494 - RNA, 13 nt, Escherichia coli CFT073
gaacguuuucacc

SEQ ID NO: 615495 - RNA, 12 nt, Escherichia coli CFT073
gaacgcuugcgg

SEQ ID NO: 615496 - RNA, 21 nt, Escherichia coli CFT073
gaacggauagagcgcugcgca

SEQ ID NO: 615497 - RNA, 14 nt, Escherichia coli CFT073
gaacggauauuuug

SEQ ID NO: 615498 - RNA, 21 nt, Escherichia coli CFT073
gaacggcagagaaaccacauc

SEQ ID NO: 615499 - RNA, 15 nt, Escherichia coli CFT073
gaacggcggucaggu

SEQ ID NO: 615500 - RNA, 13 nt, Escherichia coli CFT073
gaacgccgcuggu

SEQ ID NO: 615501 - RNA, 20 nt, Escherichia coli CFT073
gaacgcaccgaccaucggca

SEQ ID NO: 615502 - RNA, 17 nt, Escherichia coli CFT073
gaacgccuuauccggcc

SEQ ID NO: 615503 - RNA, 15 nt, Escherichia coli CFT073
gaacgcgcugcacca

SEQ ID NO: 615504 - RNA, 19 nt, Escherichia coli CFT073
gaacgcugacaaacugcgu

SEQ ID NO: 615505 - RNA, 23 nt, Escherichia coli CFT073
gaacgcugacaaacugcguguga

SEQ ID NO: 615506 - RNA, 14 nt, Escherichia coli CFT073
gaacgcugcauacu

SEQ ID NO: 615507 - RNA, 17 nt, Escherichia coli CFT073
gaacaaagcaaauaaug

SEQ ID NO: 615508 - RNA, 19 nt, Escherichia coli CFT073
gaacaaaacauacuuucuc

SEQ ID NO: 615509 - RNA, 21 nt, Escherichia coli CFT073
gaacaaucuugcaaaggcugu

SEQ ID NO: 615510 - RNA, 17 nt, Escherichia coli CFT073
gaacaccuuauccggcc

SEQ ID NO: 615511 - RNA, 19 nt, Escherichia coli CFT073
gaacaccgguauucuccug

SEQ ID NO: 615512 - RNA, 17 nt, Escherichia coli CFT073
gaacacgcaacaccagc

SEQ ID NO: 615513 - RNA, 18 nt, Escherichia coli CFT073
gaacacgcaacaccagca

SEQ ID NO: 615514 - RNA, 15 nt, Escherichia coli CFT073
gaacacggacaauac

SEQ ID NO: 615515 - RNA, 16 nt, Escherichia coli CFT073
gaacaguuuucgcacc

SEQ ID NO: 615516 - RNA, 22 nt, Escherichia coli CFT073
gaacagccagaaugaggcauca

SEQ ID NO: 615517 - RNA, 24 nt, Escherichia coli CFT073
gaacagccagaaugaggcaucauu

SEQ ID NO: 615518 - RNA, 20 nt, Escherichia coli CFT073
gaacacguuaugcuuacuga

SEQ ID NO: 615519 - RNA, 18 nt, Escherichia coli CFT073
gaaauuugcauaaaaauu

SEQ ID NO: 615520 - RNA, 21 nt, Escherichia coli CFT073
gaaauugcaaacgcguuaagc

SEQ ID NO: 615521 - RNA, 18 nt, Escherichia coli CFT073
aaagagaugaaugaauuu

SEQ ID NO: 615522 - RNA, 20 nt, Escherichia coli CFT073
gaaauuauucuacgcgaccu

SEQ ID NO: 615523 - RNA, 21 nt, Escherichia coli CFT073
gaaauucacuuccgucaugua

SEQ ID NO: 615524 - RNA, 18 nt, Escherichia coli CFT073
gaaauuaccgcaccacca

SEQ ID NO: 615525 - RNA, 18 nt, Escherichia coli CFT073
gaaaugauguuugcgaca

SEQ ID NO: 615526 - RNA, 18 nt, Escherichia coli CFT073
gaaaugccaaauauuucu

SEQ ID NO: 615527 - RNA, 15 nt, Escherichia coli CFT073
gaaaugccaguaacu

SEQ ID NO: 615528 - RNA, 18 nt, Escherichia coli CFT073
gaaaaugguuugccagca

SEQ ID NO: 615529 - RNA, 15 nt, Escherichia coli CFT073
gaaaaugcuuuccag

SEQ ID NO: 615530 - RNA, 21 nt, Escherichia coli CFT073
gaaaaugcucgccuugcugcc

SEQ ID NO: 615531 - RNA, 16 nt, Escherichia coli CFT073
gaaaauggcgcucagg

SEQ ID NO: 615532 - RNA, 17 nt, Escherichia coli CFT073
gaaaaugccgcacauca

SEQ ID NO: 615533 - RNA, 21 nt, Escherichia coli CFT073
gaaaaugccucuugucucguu

SEQ ID NO: 615534 - RNA, 14 nt, Escherichia coli CFT073
gaaaaugaaauaaa

SEQ ID NO: 615535 - RNA, 22 nt, Escherichia coli CFT073
gaaaaugaaauaaaacaaauau

SEQ ID NO: 615536 - RNA, 14 nt, Escherichia coli CFT073
gaaaaucuucucuc

SEQ ID NO: 615537 - RNA, 21 nt, Escherichia coli CFT073
gaaacuucaccaacugugugc

SEQ ID NO: 615538 - RNA, 23 nt, Escherichia coli CFT073
gaaacuuauuuaaacccuuucug

SEQ ID NO: 615539 - RNA, 16 nt, Escherichia coli CFT073
gaaacuguucgcuggu

SEQ ID NO: 615540 - RNA, 16 nt, Escherichia coli CFT073
gaaacuggauggccug

SEQ ID NO: 615541 - RNA, 19 nt, Escherichia coli CFT073
gaaacuggauggccugauu

SEQ ID NO: 615542 - RNA, 19 nt, Escherichia coli CFT073
gaaacugaucauuaucacc

SEQ ID NO: 615543 - RNA, 12 nt, Escherichia coli CFT073
gaaagauuuaau

SEQ ID NO: 615544 - RNA, 21 nt, Escherichia coli CFT073
gaaacuugcgugauauuacau

SEQ ID NO: 615545 - RNA, 14 nt, Escherichia coli CFT073
gaaagcaaaaaaag

SEQ ID NO: 615546 - RNA, 16 nt, Escherichia coli CFT073
gaaagcaaaaaaagaa

SEQ ID NO: 615547 - RNA, 16 nt, Escherichia coli CFT073
gaaagcaaaaaagaag

SEQ ID NO: 615548 - RNA, 17 nt, Escherichia coli CFT073
gaaagcaccugcacagg

SEQ ID NO: 615549 - RNA, 19 nt, Escherichia coli CFT073
gaaagcgccagcaagagca

SEQ ID NO: 615550 - RNA, 21 nt, Escherichia coli CFT073
gaaagcgccaucaaugugcug

SEQ ID NO: 615551 - RNA, 17 nt, Escherichia coli CFT073
gaaagcgccucaagcuc

SEQ ID NO: 615552 - RNA, 18 nt, Escherichia coli CFT073
gaaagcaguaccgcagcc

SEQ ID NO: 615553 - RNA, 22 nt, Escherichia coli CFT073
gaaagcugcugaccaccagcac

SEQ ID NO: 615554 - RNA, 21 nt, Escherichia coli CFT073
gaaauaaucgggaauacagaa

SEQ ID NO: 615555 - RNA, 18 nt, Escherichia coli CFT073
gaaaguauaugagaagac

SEQ ID NO: 615556 - RNA, 20 nt, Escherichia coli CFT073
gaaaguaaucuauauuucug

SEQ ID NO: 615557 - RNA, 14 nt, Escherichia coli CFT073
gaaauacgacugau

SEQ ID NO: 615558 - RNA, 18 nt, Escherichia coli CFT073
gaaauaccccgccagcag

SEQ ID NO: 615559 - RNA, 18 nt, Escherichia coli CFT073
gaaauacaaguccccgcu

SEQ ID NO: 615560 - RNA, 17 nt, Escherichia coli CFT073
gaaauaccacucagcuu

SEQ ID NO: 615561 - RNA, 21 nt, Escherichia coli CFT073
gaaauaccacucagcuuaaga

SEQ ID NO: 615562 - RNA, 15 nt, Escherichia coli CFT073
gaaauauucaacacc

SEQ ID NO: 615563 - RNA, 14 nt, Escherichia coli CFT073
gaaauagcccacua

SEQ ID NO: 615564 - RNA, 21 nt, Escherichia coli CFT073
gaaauagcgccauaaaacucg

SEQ ID NO: 615565 - RNA, 18 nt, Escherichia coli CFT073
gaaauagauuuucagaau

SEQ ID NO: 615566 - RNA, 16 nt, Escherichia coli CFT073
gaaauauuuuaaaauu

SEQ ID NO: 615567 - RNA, 13 nt, Escherichia coli CFT073
gaaaucaaauaca

SEQ ID NO: 615568 - RNA, 15 nt, Escherichia coli CFT073
gaaaucaaauacauc

SEQ ID NO: 615569 - RNA, 14 nt, Escherichia coli CFT073
gaaaucaacacgcc

SEQ ID NO: 615570 - RNA, 19 nt, Escherichia coli CFT073
gaaaucaaugccaccagaa

SEQ ID NO: 615571 - RNA, 22 nt, Escherichia coli CFT073
gaaaucagagauuugcuccagc

SEQ ID NO: 615572 - RNA, 22 nt, Escherichia coli CFT073
gaaauccggcaccugucagacu

SEQ ID NO: 615573 - RNA, 11 nt, Escherichia coli CFT073
gaaaucaccac

SEQ ID NO: 615574 - RNA, 16 nt, Escherichia coli CFT073
gaaaucaccaccagca

SEQ ID NO: 615575 - RNA, 21 nt, Escherichia coli CFT073
gaaaucaccaccagcaccgcg

SEQ ID NO: 615576 - RNA, 16 nt, Escherichia coli CFT073
gaaaucaccaccgcaa

SEQ ID NO: 615577 - RNA, 16 nt, Escherichia coli CFT073
gaaaucacuggcguca

SEQ ID NO: 615578 - RNA, 15 nt, Escherichia coli CFT073
gaaaacgaauugucc

SEQ ID NO: 615579 - RNA, 19 nt, Escherichia coli CFT073
gaaaacgcauaucuucuga

SEQ ID NO: 615580 - RNA, 15 nt, Escherichia coli CFT073
gaaaacgaaagcgcc

SEQ ID NO: 615581 - RNA, 14 nt, Escherichia coli CFT073
gaaaacgaauugca

SEQ ID NO: 615582 - RNA, 13 nt, Escherichia coli CFT073
gaaaacuaucuga

SEQ ID NO: 615583 - RNA, 20 nt, Escherichia coli CFT073
gaaaacuaucugaaaaugaa

SEQ ID NO: 615584 - RNA, 17 nt, Escherichia coli CFT073
gaaaacuauuacugacc

SEQ ID NO: 615585 - RNA, 15 nt, Escherichia coli CFT073
gaaaaccacccgcaa

SEQ ID NO: 615586 - RNA, 16 nt, Escherichia coli CFT073
gaaaaccauaaugaug

SEQ ID NO: 615587 - RNA, 15 nt, Escherichia coli CFT073
gaaaacaucaaaagg

SEQ ID NO: 615588 - RNA, 20 nt, Escherichia coli CFT073
gaaaacaauuacgccgagcg

SEQ ID NO: 615589 - RNA, 17 nt, Escherichia coli CFT073
gaaaauacucagcaccc

SEQ ID NO: 615590 - RNA, 15 nt, Escherichia coli CFT073
gaaaaucagcaucaa

SEQ ID NO: 615591 - RNA, 14 nt, Escherichia coli CFT073
gaaaaucagcauca

SEQ ID NO: 615592 - RNA, 13 nt, Escherichia coli CFT073
gaaaauacagcaa

SEQ ID NO: 615593 - RNA, 22 nt, Escherichia coli CFT073
gaaaauaacguaguguaaaugc

SEQ ID NO: 615594 - RNA, 20 nt, Escherichia coli CFT073
gaaaacuuaucuuauuccca

SEQ ID NO: 615595 - RNA, 20 nt, Escherichia coli CFT073
gaaaacucgcuaaccacugu

SEQ ID NO: 615596 - RNA, 16 nt, Escherichia coli CFT073
gaaaagaaacugugau

SEQ ID NO: 615597 - RNA, 14 nt, Escherichia coli CFT073
gaaaagauguguca

SEQ ID NO: 615598 - RNA, 22 nt, Escherichia coli CFT073
gaaaagaguauuacaucacuua

SEQ ID NO: 615599 - RNA, 14 nt, Escherichia coli CFT073
gaaaagcaacaacc

SEQ ID NO: 615600 - RNA, 17 nt, Escherichia coli CFT073
cuuuuuuuugccccaga

SEQ ID NO: 615601 - RNA, 17 nt, Escherichia coli CFT073
cuuuuuuaugcaccuuu

SEQ ID NO: 615602 - RNA, 14 nt, Escherichia coli CFT073
cuuuuuuauggaau

SEQ ID NO: 615603 - RNA, 19 nt, Escherichia coli CFT073
cuuuuuucagccguaucca

SEQ ID NO: 615604 - RNA, 13 nt, Escherichia coli CFT073
gaaaaaaccagaa

SEQ ID NO: 615605 - RNA, 13 nt, Escherichia coli CFT073
gaaaaaacacaaa

SEQ ID NO: 615606 - RNA, 23 nt, Escherichia coli CFT073
gaaaaauaaaagcgugaaacaaa

SEQ ID NO: 615607 - RNA, 16 nt, Escherichia coli CFT073
cuuuuuuacaucauca

SEQ ID NO: 615608 - RNA, 14 nt, Escherichia coli CFT073
cuuuuucucugauc

SEQ ID NO: 615609 - RNA, 21 nt, Escherichia coli CFT073
cuuuuucugccugaucuuucu

SEQ ID NO: 615610 - RNA, 12 nt, Escherichia coli CFT073
cuuuuucuucac

SEQ ID NO: 615611 - RNA, 14 nt, Escherichia coli CFT073
cuuuucccacuaac

SEQ ID NO: 615612 - RNA, 13 nt, Escherichia coli CFT073
cuuuucccuuuca

SEQ ID NO: 615613 - RNA, 20 nt, Escherichia coli CFT073
cuuuucaggcuagccgccag

SEQ ID NO: 615614 - RNA, 16 nt, Escherichia coli CFT073
cuuuucauauuauuug

SEQ ID NO: 615615 - RNA, 21 nt, Escherichia coli CFT073
cuuuucaucagaucgcgaccg

SEQ ID NO: 615616 - RNA, 13 nt, Escherichia coli CFT073
cuuuucaccuuca

SEQ ID NO: 615617 - RNA, 19 nt, Escherichia coli CFT073
cuuuucaccuucaaaauuu

SEQ ID NO: 615618 - RNA, 20 nt, Escherichia coli CFT073
cuuuuaaaucauccugaauc

SEQ ID NO: 615619 - RNA, 20 nt, Escherichia coli CFT073
cuuuguuuccccugguucaa

SEQ ID NO: 615620 - RNA, 20 nt, Escherichia coli CFT073
cuuuuacgcgggcagugcgc

SEQ ID NO: 615621 - RNA, 18 nt, Escherichia coli CFT073
cuuuuaccgacaggucaa

SEQ ID NO: 615622 - RNA, 18 nt, Escherichia coli CFT073
cuuuuauucauguugauu

SEQ ID NO: 615623 - RNA, 13 nt, Escherichia coli CFT073
cuuuuauuagccg

SEQ ID NO: 615624 - RNA, 16 nt, Escherichia coli CFT073
cuuuuacugcacucgc

SEQ ID NO: 615625 - RNA, 17 nt, Escherichia coli CFT073
cuuuucgcgucaaucac

SEQ ID NO: 615626 - RNA, 21 nt, Escherichia coli CFT073
cuuuucgcauguaacugccuu

SEQ ID NO: 615627 - RNA, 23 nt, Escherichia coli CFT073
cuuuucgccaccggcaaucugcu

SEQ ID NO: 615628 - RNA, 20 nt, Escherichia coli CFT073
cuuuucgcccuggacaacau

SEQ ID NO: 615629 - RNA, 23 nt, Escherichia coli CFT073
cuuuucggcaugaaucauggcgu

SEQ ID NO: 615630 - RNA, 17 nt, Escherichia coli CFT073
cuuuugccgcauccuca

SEQ ID NO: 615631 - RNA, 15 nt, Escherichia coli CFT073
cuuuugccuucugag

SEQ ID NO: 615632 - RNA, 17 nt, Escherichia coli CFT073
cuuuugcgguuuuucuc

SEQ ID NO: 615633 - RNA, 16 nt, Escherichia coli CFT073
cuuuugcugucucauc

SEQ ID NO: 615634 - RNA, 14 nt, Escherichia coli CFT073
cuuuugugacgaca

SEQ ID NO: 615635 - RNA, 23 nt, Escherichia coli CFT073
aaagacugaauugccagcaucag

SEQ ID NO: 615636 - RNA, 13 nt, Escherichia coli CFT073
aaagacuauauua

SEQ ID NO: 615637 - RNA, 20 nt, Escherichia coli CFT073
aaagacuauauuaaagaugu

SEQ ID NO: 615638 - RNA, 15 nt, Escherichia coli CFT073
aaagacuauccgcca

SEQ ID NO: 615639 - RNA, 22 nt, Escherichia coli CFT073
aaagacgguggcacauaauuga

SEQ ID NO: 615640 - RNA, 17 nt, Escherichia coli CFT073
cuuuacgcgucuuauca

SEQ ID NO: 615641 - RNA, 17 nt, Escherichia coli CFT073
cuuuacgcaaagcagca

SEQ ID NO: 615642 - RNA, 22 nt, Escherichia coli CFT073
cuuuaccggaugcucacagagu

SEQ ID NO: 615643 - RNA, 18 nt, Escherichia coli CFT073
cuuuacccguguuuugca

SEQ ID NO: 615644 - RNA, 14 nt, Escherichia coli CFT073
cuuuacccagcgga

SEQ ID NO: 615645 - RNA, 17 nt, Escherichia coli CFT073
cuuuacccagcggaugu

SEQ ID NO: 615646 - RNA, 20 nt, Escherichia coli CFT073
cuuuaaucuuagacaucaaa

SEQ ID NO: 615647 - RNA, 22 nt, Escherichia coli CFT073
cuuuaaugacugaacgugaaau

SEQ ID NO: 615648 - RNA, 17 nt, Escherichia coli CFT073
cuuuaaauugcguaaag

SEQ ID NO: 615649 - RNA, 23 nt, Escherichia coli CFT073
cuuuaaguucagccaguugaucu

SEQ ID NO: 615650 - RNA, 19 nt, Escherichia coli CFT073
cuuuaacaucgcaaaauac

SEQ ID NO: 615651 - RNA, 21 nt, Escherichia coli CFT073
cuucgcugacgccugccagcu

SEQ ID NO: 615652 - RNA, 17 nt, Escherichia coli CFT073
cuucggcagucacuuuu

SEQ ID NO: 615653 - RNA, 23 nt, Escherichia coli CFT073
aaagacaucgcccgauucacaua

SEQ ID NO: 615654 - RNA, 18 nt, Escherichia coli CFT073
aaagacaucgcuggaggc

SEQ ID NO: 615655 - RNA, 14 nt, Escherichia coli CFT073
aaagaccauaauga

SEQ ID NO: 615656 - RNA, 14 nt, Escherichia coli CFT073
aaagaccagccagc

SEQ ID NO: 615657 - RNA, 17 nt, Escherichia coli CFT073
aaagaccagccagcaau

SEQ ID NO: 615658 - RNA, 12 nt, Escherichia coli CFT073
aaagaccauuga

SEQ ID NO: 615659 - RNA, 13 nt, Escherichia coli CFT073
cuucggcgggcag

SEQ ID NO: 615660 - RNA, 15 nt, Escherichia coli CFT073
cuucggcgaaaauca

SEQ ID NO: 615661 - RNA, 16 nt, Escherichia coli CFT073
cuuucagcguuaauuc

SEQ ID NO: 615662 - RNA, 23 nt, Escherichia coli CFT073
cuuucagcccaccuugcgggcag

SEQ ID NO: 615663 - RNA, 22 nt, Escherichia coli CFT073
cuuucagccccagcgcaauagu

SEQ ID NO: 615664 - RNA, 22 nt, Escherichia coli CFT073
cuuucaccgccugaucauuucc

SEQ ID NO: 615665 - RNA, 22 nt, Escherichia coli CFT073
cuuucaggaacagcgacagauu

SEQ ID NO: 615666 - RNA, 22 nt, Escherichia coli CFT073
cuuucacaucagaacagcccca

SEQ ID NO: 615667 - RNA, 20 nt, Escherichia coli CFT073
cuuucacauugaugaaguca

SEQ ID NO: 615668 - RNA, 16 nt, Escherichia coli CFT073
cuuucaauuccuggaa

SEQ ID NO: 615669 - RNA, 15 nt, Escherichia coli CFT073
cuuucaaugccugau

SEQ ID NO: 615670 - RNA, 21 nt, Escherichia coli CFT073
cuuucaaugcuuuuugcauuu

SEQ ID NO: 615671 - RNA, 18 nt, Escherichia coli CFT073
cuuuauuggguugcagua

SEQ ID NO: 615672 - RNA, 23 nt, Escherichia coli CFT073
cuuuauuggguugcaguaacugc

SEQ ID NO: 615673 - RNA, 15 nt, Escherichia coli CFT073
cuuuauccagcacca

SEQ ID NO: 615674 - RNA, 17 nt, Escherichia coli CFT073
cuuuauccagcaccacu

SEQ ID NO: 615675 - RNA, 15 nt, Escherichia coli CFT073
cuuuaucgacauaaa

SEQ ID NO: 615676 - RNA, 19 nt, Escherichia coli CFT073
cuuuaucgacauaaaucau

SEQ ID NO: 615677 - RNA, 15 nt, Escherichia coli CFT073
cuuuaucaaucagcc

SEQ ID NO: 615678 - RNA, 15 nt, Escherichia coli CFT073
cuuuaucaagcacca

SEQ ID NO: 615679 - RNA, 20 nt, Escherichia coli CFT073
cuuuauagugugcaaucacu

SEQ ID NO: 615680 - RNA, 14 nt, Escherichia coli CFT073
cuuuagcaguucuu

SEQ ID NO: 615681 - RNA, 21 nt, Escherichia coli CFT073
cuuugucuuucuggaaauaga

SEQ ID NO: 615682 - RNA, 19 nt, Escherichia coli CFT073
cuuuguuacccccauccac

SEQ ID NO: 615683 - RNA, 12 nt, Escherichia coli CFT073
cuuugugccauc

SEQ ID NO: 615684 - RNA, 22 nt, Escherichia coli CFT073
cuuugugccaucgccacaccag

SEQ ID NO: 615685 - RNA, 17 nt, Escherichia coli CFT073
cuuugcugugaagcacc

SEQ ID NO: 615686 - RNA, 14 nt, Escherichia coli CFT073
cuuugcuguugauu

SEQ ID NO: 615687 - RNA, 14 nt, Escherichia coli CFT073
cuuugcugccuuuc

SEQ ID NO: 615688 - RNA, 13 nt, Escherichia coli CFT073
cuuugcuggcaug

SEQ ID NO: 615689 - RNA, 19 nt, Escherichia coli CFT073
cuuuguaggccugauaaga

SEQ ID NO: 615690 - RNA, 14 nt, Escherichia coli CFT073
cuuuguauccacuc

SEQ ID NO: 615691 - RNA, 18 nt, Escherichia coli CFT073
cuuugucauuaaauccgc

SEQ ID NO: 615692 - RNA, 17 nt, Escherichia coli CFT073
cuuugucgaucauguag

SEQ ID NO: 615693 - RNA, 18 nt, Escherichia coli CFT073
cuuugucgauuuccuuca

SEQ ID NO: 615694 - RNA, 13 nt, Escherichia coli CFT073
cuuugaugccacc

SEQ ID NO: 615695 - RNA, 16 nt, Escherichia coli CFT073
cuuugaugccaccagg

SEQ ID NO: 615696 - RNA, 17 nt, Escherichia coli CFT073
cuuugaugccaccaggc

SEQ ID NO: 615697 - RNA, 21 nt, Escherichia coli CFT073
cuuugaucucuaacgguucuu

SEQ ID NO: 615698 - RNA, 17 nt, Escherichia coli CFT073
cuuugcguuuggcauca

SEQ ID NO: 615699 - RNA, 19 nt, Escherichia coli CFT073
cuuucucaaaauacugccu

SEQ ID NO: 615700 - RNA, 23 nt, Escherichia coli CFT073
cuuucucagucauaacguucagc

SEQ ID NO: 615701 - RNA, 15 nt, Escherichia coli CFT073
cuuucucgucaauac

SEQ ID NO: 615702 - RNA, 16 nt, Escherichia coli CFT073
cuuucucuucaucuau

SEQ ID NO: 615703 - RNA, 19 nt, Escherichia coli CFT073
cuuucuuuuuuucacuuuc

SEQ ID NO: 615704 - RNA, 22 nt, Escherichia coli CFT073
cuuucugacgaauuaccaacac

SEQ ID NO: 615705 - RNA, 17 nt, Escherichia coli CFT073
cuuucauuuucggcagu

SEQ ID NO: 615706 - RNA, 19 nt, Escherichia coli CFT073
cuuuccauucuuucccagc

SEQ ID NO: 615707 - RNA, 20 nt, Escherichia coli CFT073
cuuucccgcgcccgugcauc

SEQ ID NO: 615708 - RNA, 15 nt, Escherichia coli CFT073
cuuucauuucagcgu

SEQ ID NO: 615709 - RNA, 18 nt, Escherichia coli CFT073
cuuucccuucacucugcu

SEQ ID NO: 615710 - RNA, 16 nt, Escherichia coli CFT073
cuuucguuauuacagc

SEQ ID NO: 615711 - RNA, 17 nt, Escherichia coli CFT073
gagcagauacugaugaa

SEQ ID NO: 615712 - RNA, 18 nt, Escherichia coli CFT073
gagcagcaaccacuugca

SEQ ID NO: 615713 - RNA, 19 nt, Escherichia coli CFT073
gagcagcauuccggcauuu

SEQ ID NO: 615714 - RNA, 16 nt, Escherichia coli CFT073
gagcaaaucgcggcuu

SEQ ID NO: 615715 - RNA, 12 nt, Escherichia coli CFT073
gagcaaauaaaa

SEQ ID NO: 615716 - RNA, 19 nt, Escherichia coli CFT073
gagcaagaaccccagccag

SEQ ID NO: 615717 - RNA, 16 nt, Escherichia coli CFT073
gagcaaggcauaggcu

SEQ ID NO: 615718 - RNA, 20 nt, Escherichia coli CFT073
gagccaaacucauccaccac

SEQ ID NO: 615719 - RNA, 19 nt, Escherichia coli CFT073
aaagcagacaacccacgca

SEQ ID NO: 615720 - RNA, 15 nt, Escherichia coli CFT073
aaagcagagugugaa

SEQ ID NO: 615721 - RNA, 16 nt, Escherichia coli CFT073
aaagcagauaacccag

SEQ ID NO: 615722 - RNA, 15 nt, Escherichia coli CFT073
aaagcagacaaccca

SEQ ID NO: 615723 - RNA, 24 nt, Escherichia coli CFT073
aaagcaccugauuaguggcacacu

SEQ ID NO: 615724 - RNA, 11 nt, Escherichia coli CFT073
gagcagcgcgc

SEQ ID NO: 615725 - RNA, 12 nt, Escherichia coli CFT073
gagcagcgcgcu

SEQ ID NO: 615726 - RNA, 18 nt, Escherichia coli CFT073
gacucauaaaaauauauu

SEQ ID NO: 615727 - RNA, 16 nt, Escherichia coli CFT073
gacucaccaaucggca

SEQ ID NO: 615728 - RNA, 14 nt, Escherichia coli CFT073
gacucagcaacagg

SEQ ID NO: 615729 - RNA, 23 nt, Escherichia coli CFT073
gacucagcaacagguaacccagu

SEQ ID NO: 615730 - RNA, 14 nt, Escherichia coli CFT073
gacucaccagcauc

SEQ ID NO: 615731 - RNA, 18 nt, Escherichia coli CFT073
gagagucauuaugcugga

SEQ ID NO: 615732 - RNA, 18 nt, Escherichia coli CFT073
gagaggccuucgacugau

SEQ ID NO: 615733 - RNA, 14 nt, Escherichia coli CFT073
gacucauuguaucu

SEQ ID NO: 615734 - RNA, 18 nt, Escherichia coli CFT073
gagauucauccaguucca

SEQ ID NO: 615735 - RNA, 16 nt, Escherichia coli CFT073
gagauuccgcuugccu

SEQ ID NO: 615736 - RNA, 16 nt, Escherichia coli CFT073
gagauuugcuccagcg

SEQ ID NO: 615737 - RNA, 16 nt, Escherichia coli CFT073
gagcaaaccacaggcc

SEQ ID NO: 615738 - RNA, 14 nt, Escherichia coli CFT073
gagauguugcugcu

SEQ ID NO: 615739 - RNA, 16 nt, Escherichia coli CFT073
gagauuguaucccuuu

SEQ ID NO: 615740 - RNA, 15 nt, Escherichia coli CFT073
gagaucuucgccauc

SEQ ID NO: 615741 - RNA, 22 nt, Escherichia coli CFT073
gagaucuuucacgcccaguccg

SEQ ID NO: 615742 - RNA, 22 nt, Escherichia coli CFT073
gagaucguuaugcaaaugagaa

SEQ ID NO: 615743 - RNA, 18 nt, Escherichia coli CFT073
gagaucggggucaacuuc

SEQ ID NO: 615744 - RNA, 20 nt, Escherichia coli CFT073
gagcgccugucugcaaaaau

SEQ ID NO: 615745 - RNA, 23 nt, Escherichia coli CFT073
gagcgguaaagaacugagcgccg

SEQ ID NO: 615746 - RNA, 10 nt, Escherichia coli CFT073
gagcggcagu

SEQ ID NO: 615747 - RNA, 21 nt, Escherichia coli CFT073
gagcguacugaccgucgccuu

SEQ ID NO: 615748 - RNA, 19 nt, Escherichia coli CFT073
gagcgucauauagccgccu

SEQ ID NO: 615749 - RNA, 16 nt, Escherichia coli CFT073
gagcgugagugcgaaa

SEQ ID NO: 615750 - RNA, 19 nt, Escherichia coli CFT073
gagcguggcuggcugaccu

SEQ ID NO: 615751 - RNA, 23 nt, Escherichia coli CFT073
gagcuaaaaucgccaaacuuaag

SEQ ID NO: 615752 - RNA, 22 nt, Escherichia coli CFT073
gagcguuucaaaaacaaagaau

SEQ ID NO: 615753 - RNA, 17 nt, Escherichia coli CFT073
gagcucaauauauuaaa

SEQ ID NO: 615754 - RNA, 16 nt, Escherichia coli CFT073
gagcgauccaacuaaa

SEQ ID NO: 615755 - RNA, 13 nt, Escherichia coli CFT073
gagcgcaagccac

SEQ ID NO: 615756 - RNA, 17 nt, Escherichia coli CFT073
gagcgcaagccacgggc

SEQ ID NO: 615757 - RNA, 16 nt, Escherichia coli CFT073
gagcgcaaauugcugg

SEQ ID NO: 615758 - RNA, 23 nt, Escherichia coli CFT073
gagcgccguugcgcccaucauca

SEQ ID NO: 615759 - RNA, 14 nt, Escherichia coli CFT073
gagcgcgaaaccuu

SEQ ID NO: 615760 - RNA, 16 nt, Escherichia coli CFT073
gagcgccauaucggca

SEQ ID NO: 615761 - RNA, 15 nt, Escherichia coli CFT073
gagccgcauccgaca

SEQ ID NO: 615762 - RNA, 16 nt, Escherichia coli CFT073
gagccagccccacagc

SEQ ID NO: 615763 - RNA, 17 nt, Escherichia coli CFT073
gauaaaaguuacaucag

SEQ ID NO: 615764 - RNA, 20 nt, Escherichia coli CFT073
gaguuugccaccaacaguaa

SEQ ID NO: 615765 - RNA, 14 nt, Escherichia coli CFT073
gauaaaacgacacc

SEQ ID NO: 615766 - RNA, 18 nt, Escherichia coli CFT073
gaguuguaauuuaaauca

SEQ ID NO: 615767 - RNA, 12 nt, Escherichia coli CFT073
gaguuucaacau

SEQ ID NO: 615768 - RNA, 19 nt, Escherichia coli CFT073
gaguucgugacgucucaau

SEQ ID NO: 615769 - RNA, 14 nt, Escherichia coli CFT073
gauaaacuccugca

SEQ ID NO: 615770 - RNA, 18 nt, Escherichia coli CFT073
gauaaacaucgccauaaa

SEQ ID NO: 615771 - RNA, 19 nt, Escherichia coli CFT073
gauaacguuuagcgguggc

SEQ ID NO: 615772 - RNA, 20 nt, Escherichia coli CFT073
gauaacgagcaugauacuca

SEQ ID NO: 615773 - RNA, 20 nt, Escherichia coli CFT073
gauaacgcccucuaaaauaa

SEQ ID NO: 615774 - RNA, 19 nt, Escherichia coli CFT073
gauaacgccuggcaguggu

SEQ ID NO: 615775 - RNA, 20 nt, Escherichia coli CFT073
gauaaccuaacucuuccugc

SEQ ID NO: 615776 - RNA, 13 nt, Escherichia coli CFT073
gauaaccuucuuc

SEQ ID NO: 615777 - RNA, 17 nt, Escherichia coli CFT073
gaguggcgaaauuggua

SEQ ID NO: 615778 - RNA, 18 nt, Escherichia coli CFT073
gagugguuagagcacaga

SEQ ID NO: 615779 - RNA, 16 nt, Escherichia coli CFT073
gaguucgagucucguu

SEQ ID NO: 615780 - RNA, 13 nt, Escherichia coli CFT073
gaguguuccucug

SEQ ID NO: 615781 - RNA, 21 nt, Escherichia coli CFT073
gagugugauuacagccaggcg

SEQ ID NO: 615782 - RNA, 16 nt, Escherichia coli CFT073
gaguguggccaguucc

SEQ ID NO: 615783 - RNA, 19 nt, Escherichia coli CFT073
gagugacaguucaaucucc

SEQ ID NO: 615784 - RNA, 18 nt, Escherichia coli CFT073
gaguggauuaucuucacc

SEQ ID NO: 615785 - RNA, 12 nt, Escherichia coli CFT073
gagugcagcacu

SEQ ID NO: 615786 - RNA, 23 nt, Escherichia coli CFT073
gagugauacguaaaccacugaca

SEQ ID NO: 615787 - RNA, 15 nt, Escherichia coli CFT073
gagugauuccguuca

SEQ ID NO: 615788 - RNA, 20 nt, Escherichia coli CFT073
gagucacgcgguuaucccaa

SEQ ID NO: 615789 - RNA, 18 nt, Escherichia coli CFT073
gaguauuacccggcacag

SEQ ID NO: 615790 - RNA, 17 nt, Escherichia coli CFT073
gaguauucuugcugaua

SEQ ID NO: 615791 - RNA, 23 nt, Escherichia coli CFT073
gaguauuucauggggaauuugcg

SEQ ID NO: 615792 - RNA, 16 nt, Escherichia coli CFT073
gaguauuuccagcuca

SEQ ID NO: 615793 - RNA, 21 nt, Escherichia coli CFT073
gaguauugcuuugcugugaag

SEQ ID NO: 615794 - RNA, 17 nt, Escherichia coli CFT073
gaguagccagcugccug

SEQ ID NO: 615795 - RNA, 16 nt, Escherichia coli CFT073
gaguaccgagaaaauc

SEQ ID NO: 615796 - RNA, 17 nt, Escherichia coli CFT073
gaguacgcgguuuuugu

SEQ ID NO: 615797 - RNA, 17 nt, Escherichia coli CFT073
gaguacgccauuucggg

SEQ ID NO: 615798 - RNA, 23 nt, Escherichia coli CFT073
gaguacgugaguaguggaaaccg

SEQ ID NO: 615799 - RNA, 19 nt, Escherichia coli CFT073
gaguaauuaauacgccagc

SEQ ID NO: 615800 - RNA, 14 nt, Escherichia coli CFT073
gaguacaaaaauaa

SEQ ID NO: 615801 - RNA, 19 nt, Escherichia coli CFT073
gaguacacuguaccugguc

SEQ ID NO: 615802 - RNA, 16 nt, Escherichia coli CFT073
gaguaaugaaaccgaa

SEQ ID NO: 615803 - RNA, 15 nt, Escherichia coli CFT073
gaguaaggcaaggau

SEQ ID NO: 615804 - RNA, 23 nt, Escherichia coli CFT073
gaguaaagcccgccaucgcccau

SEQ ID NO: 615805 - RNA, 14 nt, Escherichia coli CFT073
gaguaaaucagagg

SEQ ID NO: 615806 - RNA, 15 nt, Escherichia coli CFT073
gaggguuucuggcua

SEQ ID NO: 615807 - RNA, 21 nt, Escherichia coli CFT073
gagguaacaauaaauucgcca

SEQ ID NO: 615808 - RNA, 13 nt, Escherichia coli CFT073
gaguaaagcccgc

SEQ ID NO: 615809 - RNA, 19 nt, Escherichia coli CFT073
gagggugacaucaaucagc

SEQ ID NO: 615810 - RNA, 21 nt, Escherichia coli CFT073
gaggcgacgguuuccaggcag

SEQ ID NO: 615811 - RNA, 17 nt, Escherichia coli CFT073
gaggcgaucgucgccgu

SEQ ID NO: 615812 - RNA, 21 nt, Escherichia coli CFT073
gaggccgaguagccagcugcc

SEQ ID NO: 615813 - RNA, 13 nt, Escherichia coli CFT073
gaggcgccagcau

SEQ ID NO: 615814 - RNA, 12 nt, Escherichia coli CFT073
gaggagagcagg

SEQ ID NO: 615815 - RNA, 21 nt, Escherichia coli CFT073
gaggagagugcaaugaaaaac

SEQ ID NO: 615816 - RNA, 23 nt, Escherichia coli CFT073
gaggagagugcaaugaaaaaccg

SEQ ID NO: 615817 - RNA, 21 nt, Escherichia coli CFT073
gaggaggacagccaggaaucc

SEQ ID NO: 615818 - RNA, 15 nt, Escherichia coli CFT073
gaggcauagcguucg

SEQ ID NO: 615819 - RNA, 13 nt, Escherichia coli CFT073
gaggccaaaacca

SEQ ID NO: 615820 - RNA, 17 nt, Escherichia coli CFT073
gaggccaauuuggcugc

SEQ ID NO: 615821 - RNA, 17 nt, Escherichia coli CFT073
gaggcauuggcaaauuu

SEQ ID NO: 615822 - RNA, 14 nt, Escherichia coli CFT073
gagcugauuuccgg

SEQ ID NO: 615823 - RNA, 21 nt, Escherichia coli CFT073
gagcugcagccaguugcucuu

SEQ ID NO: 615824 - RNA, 23 nt, Escherichia coli CFT073
gagcuuuuuuaauguggcugggg

SEQ ID NO: 615825 - RNA, 13 nt, Escherichia coli CFT073
gaggaaaaguaau

SEQ ID NO: 615826 - RNA, 15 nt, Escherichia coli CFT073
gaggaacgcccccaa

SEQ ID NO: 615827 - RNA, 21 nt, Escherichia coli CFT073
gaggaagcgcaacagcgcgcc

SEQ ID NO: 615828 - RNA, 22 nt, Escherichia coli CFT073
gaggacuauuuacagauuuccc

SEQ ID NO: 615829 - RNA, 21 nt, Escherichia coli CFT073
gaggacgguaaauacugguca

SEQ ID NO: 615830 - RNA, 17 nt, Escherichia coli CFT073
gaucucuuuauuugauu

SEQ ID NO: 615831 - RNA, 19 nt, Escherichia coli CFT073
gaucugacauuugcaucca

SEQ ID NO: 615832 - RNA, 19 nt, Escherichia coli CFT073
gaucugaugaguacgcccu

SEQ ID NO: 615833 - RNA, 14 nt, Escherichia coli CFT073
gaucugauuuucuu

SEQ ID NO: 615834 - RNA, 17 nt, Escherichia coli CFT073
gaucugcacagcauuca

SEQ ID NO: 615835 - RNA, 12 nt, Escherichia coli CFT073
gaucucuuccac

SEQ ID NO: 615836 - RNA, 21 nt, Escherichia coli CFT073
gaucuggaauggaaacagcac

SEQ ID NO: 615837 - RNA, 20 nt, Escherichia coli CFT073
gaucuaugucgcauccggca

SEQ ID NO: 615838 - RNA, 14 nt, Escherichia coli CFT073
gaucucaucuucca

SEQ ID NO: 615839 - RNA, 20 nt, Escherichia coli CFT073
gaucgcuuucgcuuucucuu

SEQ ID NO: 615840 - RNA, 21 nt, Escherichia coli CFT073
gaucggacuucaugcgcagca

SEQ ID NO: 615841 - RNA, 19 nt, Escherichia coli CFT073
gaucgcucaucugcugcgu

SEQ ID NO: 615842 - RNA, 18 nt, Escherichia coli CFT073
gaucgcgcaaacagugac

SEQ ID NO: 615843 - RNA, 19 nt, Escherichia coli CFT073
gaucgccguuaaccaugca

SEQ ID NO: 615844 - RNA, 16 nt, Escherichia coli CFT073
gaucguugagcagcag

SEQ ID NO: 615845 - RNA, 21 nt, Escherichia coli CFT073
gaucguugagcagcagaugau

SEQ ID NO: 615846 - RNA, 15 nt, Escherichia coli CFT073
gaucgucaauaauca

SEQ ID NO: 615847 - RNA, 17 nt, Escherichia coli CFT073
gaucguagccuuguaau

SEQ ID NO: 615848 - RNA, 14 nt, Escherichia coli CFT073
gaucggucgccuga

SEQ ID NO: 615849 - RNA, 17 nt, Escherichia coli CFT073
gauccgguucgccaugu

SEQ ID NO: 615850 - RNA, 22 nt, Escherichia coli CFT073
gauccugagcuaacgcgguggu

SEQ ID NO: 615851 - RNA, 21 nt, Escherichia coli CFT073
gauccugauacagaccgcgca

SEQ ID NO: 615852 - RNA, 16 nt, Escherichia coli CFT073
gauccugagcaaacag

SEQ ID NO: 615853 - RNA, 24 nt, Escherichia coli CFT073
gauccugagcaaacagucgcccga

SEQ ID NO: 615854 - RNA, 17 nt, Escherichia coli CFT073
gauccugcaacaacacc

SEQ ID NO: 615855 - RNA, 21 nt, Escherichia coli CFT073
aaagcccgcagcguccagcgc

SEQ ID NO: 615856 - RNA, 14 nt, Escherichia coli CFT073
aaagcccaucaucc

SEQ ID NO: 615857 - RNA, 18 nt, Escherichia coli CFT073
aaagcccaucgccagcgc

SEQ ID NO: 615858 - RNA, 17 nt, Escherichia coli CFT073
aaagcccccacaacauu

SEQ ID NO: 615859 - RNA, 18 nt, Escherichia coli CFT073
aaagcccccacaacauug

SEQ ID NO: 615860 - RNA, 15 nt, Escherichia coli CFT073
aaagccgccagagau

SEQ ID NO: 615861 - RNA, 23 nt, Escherichia coli CFT073
aaagcccggcgucaugccgggca

SEQ ID NO: 615862 - RNA, 15 nt, Escherichia coli CFT073
aaagcccucaccgaa

SEQ ID NO: 615863 - RNA, 21 nt, Escherichia coli CFT073
aaagcccaucaccgccaggcc

SEQ ID NO: 615864 - RNA, 18 nt, Escherichia coli CFT073
gaucgacaguugcugcgu

SEQ ID NO: 615865 - RNA, 22 nt, Escherichia coli CFT073
gauccuggucaaagugggcgac

SEQ ID NO: 615866 - RNA, 23 nt, Escherichia coli CFT073
gauccuggcuguauuuuuccagc

SEQ ID NO: 615867 - RNA, 13 nt, Escherichia coli CFT073
gaucgauaagcca

SEQ ID NO: 615868 - RNA, 14 nt, Escherichia coli CFT073
gaucgaugccaaag

SEQ ID NO: 615869 - RNA, 19 nt, Escherichia coli CFT073
gaucccuaacuggcgggcg

SEQ ID NO: 615870 - RNA, 19 nt, Escherichia coli CFT073
gaucccggcuuccugcagc

SEQ ID NO: 615871 - RNA, 21 nt, Escherichia coli CFT073
gaucccggagaagagauaaac

SEQ ID NO: 615872 - RNA, 14 nt, Escherichia coli CFT073
gauccccgcagcaa

SEQ ID NO: 615873 - RNA, 22 nt, Escherichia coli CFT073
gauccccggccaguccagagcc

SEQ ID NO: 615874 - RNA, 19 nt, Escherichia coli CFT073
gauccccugcccgauaaaa

SEQ ID NO: 615875 - RNA, 17 nt, Escherichia coli CFT073
gaucccuucgccgccgc

SEQ ID NO: 615876 - RNA, 20 nt, Escherichia coli CFT073
gauccgcuuuacgcaguugu

SEQ ID NO: 615877 - RNA, 23 nt, Escherichia coli CFT073
gauccggauggauccccgcagca

SEQ ID NO: 615878 - RNA, 18 nt, Escherichia coli CFT073
gauccaaaccgacugccu

SEQ ID NO: 615879 - RNA, 15 nt, Escherichia coli CFT073
gauccaccaccgcaa

SEQ ID NO: 615880 - RNA, 14 nt, Escherichia coli CFT073
gauccaugccgcca

SEQ ID NO: 615881 - RNA, 23 nt, Escherichia coli CFT073
gaucccacggcggugucgccaga

SEQ ID NO: 615882 - RNA, 12 nt, Escherichia coli CFT073
gaucccagaacc

SEQ ID NO: 615883 - RNA, 15 nt, Escherichia coli CFT073
gauccagcgcaauac

SEQ ID NO: 615884 - RNA, 11 nt, Escherichia coli CFT073
gauccagcgcg

SEQ ID NO: 615885 - RNA, 16 nt, Escherichia coli CFT073
gauccauacucuuucc

SEQ ID NO: 615886 - RNA, 21 nt, Escherichia coli CFT073
gauccauacucuuucccggca

SEQ ID NO: 615887 - RNA, 14 nt, Escherichia coli CFT073
gauccagugcguau

SEQ ID NO: 615888 - RNA, 12 nt, Escherichia coli CFT073
gaucaagcgaac

SEQ ID NO: 615889 - RNA, 19 nt, Escherichia coli CFT073
gaucaagcuggcgcuggcg

SEQ ID NO: 615890 - RNA, 19 nt, Escherichia coli CFT073
gaucaaggcauauaccaca

SEQ ID NO: 615891 - RNA, 17 nt, Escherichia coli CFT073
gaucacaucauaaauaa

SEQ ID NO: 615892 - RNA, 21 nt, Escherichia coli CFT073
gaucacauccaguacgccuuc

SEQ ID NO: 615893 - RNA, 20 nt, Escherichia coli CFT073
gaucaccaauaccagcauca

SEQ ID NO: 615894 - RNA, 21 nt, Escherichia coli CFT073
gaucaccaauaccagcaucag

SEQ ID NO: 615895 - RNA, 15 nt, Escherichia coli CFT073
gaucaccaauaucaa

SEQ ID NO: 615896 - RNA, 18 nt, Escherichia coli CFT073
gaucaagugaacuuucuc

SEQ ID NO: 615897 - RNA, 17 nt, Escherichia coli CFT073
gaucaccgcagaagcga

SEQ ID NO: 615898 - RNA, 19 nt, Escherichia coli CFT073
gaucaccaguccaucggca

SEQ ID NO: 615899 - RNA, 15 nt, Escherichia coli CFT073
gauauguauuauaag

SEQ ID NO: 615900 - RNA, 20 nt, Escherichia coli CFT073
gauaugugcagaagcccagu

SEQ ID NO: 615901 - RNA, 18 nt, Escherichia coli CFT073
gauauuaauuuguauggu

SEQ ID NO: 615902 - RNA, 17 nt, Escherichia coli CFT073
gauauggccuucuucau

SEQ ID NO: 615903 - RNA, 22 nt, Escherichia coli CFT073
gaucaaccgcgacauacuuaaa

SEQ ID NO: 615904 - RNA, 23 nt, Escherichia coli CFT073
gaucaaccgcgacauacuuaaau

SEQ ID NO: 615905 - RNA, 16 nt, Escherichia coli CFT073
gaucaacagaaugaua

SEQ ID NO: 615906 - RNA, 14 nt, Escherichia coli CFT073
gaucaacaggcacu

SEQ ID NO: 615907 - RNA, 16 nt, Escherichia coli CFT073
gaucagacccagaacc

SEQ ID NO: 615908 - RNA, 17 nt, Escherichia coli CFT073
gaucagaccgccaauca

SEQ ID NO: 615909 - RNA, 20 nt, Escherichia coli CFT073
gaucagaccgccaaucagca

SEQ ID NO: 615910 - RNA, 20 nt, Escherichia coli CFT073
gaucagcauccauaucgcca

SEQ ID NO: 615911 - RNA, 12 nt, Escherichia coli CFT073
gaucagcauuuc

SEQ ID NO: 615912 - RNA, 23 nt, Escherichia coli CFT073
gaucagcaacgccgguuccagua

SEQ ID NO: 615913 - RNA, 18 nt, Escherichia coli CFT073
gaucaccguagaaggcga

SEQ ID NO: 615914 - RNA, 19 nt, Escherichia coli CFT073
gaucacgcggucaaugguc

SEQ ID NO: 615915 - RNA, 15 nt, Escherichia coli CFT073
gaucacguaauaaaa

SEQ ID NO: 615916 - RNA, 17 nt, Escherichia coli CFT073
gaucacguuuuccuuca

SEQ ID NO: 615917 - RNA, 14 nt, Escherichia coli CFT073
gaucacugaaauug

SEQ ID NO: 615918 - RNA, 14 nt, Escherichia coli CFT073
gaucacuuccagca

SEQ ID NO: 615919 - RNA, 20 nt, Escherichia coli CFT073
gaucaugccgacaaacagcg

SEQ ID NO: 615920 - RNA, 14 nt, Escherichia coli CFT073
gaucauggcucaga

SEQ ID NO: 615921 - RNA, 14 nt, Escherichia coli CFT073
gaucaugauaaaua

SEQ ID NO: 615922 - RNA, 19 nt, Escherichia coli CFT073
gaucaugauaaauaauaaa

SEQ ID NO: 615923 - RNA, 19 nt, Escherichia coli CFT073
gaucaugaugaugccaaaa

SEQ ID NO: 615924 - RNA, 23 nt, Escherichia coli CFT073
gaucaugaugaugccaaaaugca

SEQ ID NO: 615925 - RNA, 18 nt, Escherichia coli CFT073
gaucauuccgcccagacc

SEQ ID NO: 615926 - RNA, 16 nt, Escherichia coli CFT073
gaucauucaccagccc

SEQ ID NO: 615927 - RNA, 14 nt, Escherichia coli CFT073
gaucauggcuggca

SEQ ID NO: 615928 - RNA, 13 nt, Escherichia coli CFT073
gaucauuaaccag

SEQ ID NO: 615929 - RNA, 14 nt, Escherichia coli CFT073
gaucauuaaccagu

SEQ ID NO: 615930 - RNA, 15 nt, Escherichia coli CFT073
gaucaucucaacaaa

SEQ ID NO: 615931 - RNA, 12 nt, Escherichia coli CFT073
gaucaucuggcg

SEQ ID NO: 615932 - RNA, 22 nt, Escherichia coli CFT073
gaucaucaucgcgaucccccag

SEQ ID NO: 615933 - RNA, 19 nt, Escherichia coli CFT073
gaucaucauuacguucuua

SEQ ID NO: 615934 - RNA, 15 nt, Escherichia coli CFT073
gaucaucaaaaaaca

SEQ ID NO: 615935 - RNA, 23 nt, Escherichia coli CFT073
gaucaucaccgacggauuauuca

SEQ ID NO: 615936 - RNA, 15 nt, Escherichia coli CFT073
gaucaggcagugaau

SEQ ID NO: 615937 - RNA, 13 nt, Escherichia coli CFT073
gaucagcgguuuu

SEQ ID NO: 615938 - RNA, 23 nt, Escherichia coli CFT073
gaucagcgguuuugccagcgaga

SEQ ID NO: 615939 - RNA, 15 nt, Escherichia coli CFT073
gaucagcgucaguug

SEQ ID NO: 615940 - RNA, 18 nt, Escherichia coli CFT073
gaucagcgucaguugggc

SEQ ID NO: 615941 - RNA, 21 nt, Escherichia coli CFT073
gaucagcgaagcgcaucaggc

SEQ ID NO: 615942 - RNA, 23 nt, Escherichia coli CFT073
gaucagccucucucugaggguga

SEQ ID NO: 615943 - RNA, 14 nt, Escherichia coli CFT073
gaucagcggccagu

SEQ ID NO: 615944 - RNA, 23 nt, Escherichia coli CFT073
gaucaguugcucggcaaggccaa

SEQ ID NO: 615945 - RNA, 22 nt, Escherichia coli CFT073
gaucaguuggcagagauucuuc

SEQ ID NO: 615946 - RNA, 18 nt, Escherichia coli CFT073
gaucauaaccaacaaaac

SEQ ID NO: 615947 - RNA, 15 nt, Escherichia coli CFT073
gauaugaaugauaug

SEQ ID NO: 615948 - RNA, 11 nt, Escherichia coli CFT073
gauaugaccgu

SEQ ID NO: 615949 - RNA, 15 nt, Escherichia coli CFT073
gauaucuuucacaaa

SEQ ID NO: 615950 - RNA, 21 nt, Escherichia coli CFT073
gauaugcgcugucauucauuc

SEQ ID NO: 615951 - RNA, 18 nt, Escherichia coli CFT073
gauaugcaguaaggaaau

SEQ ID NO: 615952 - RNA, 14 nt, Escherichia coli CFT073
gauaugcagcagcc

SEQ ID NO: 615953 - RNA, 17 nt, Escherichia coli CFT073
gauaugauguaacaguu

SEQ ID NO: 615954 - RNA, 21 nt, Escherichia coli CFT073
gauauacgccacuucaucguc

SEQ ID NO: 615955 - RNA, 15 nt, Escherichia coli CFT073
gauauacguguacgu

SEQ ID NO: 615956 - RNA, 16 nt, Escherichia coli CFT073
gauauacguucgccca

SEQ ID NO: 615957 - RNA, 18 nt, Escherichia coli CFT073
gauagugcccggcaauac

SEQ ID NO: 615958 - RNA, 14 nt, Escherichia coli CFT073
gauaguggcucagg

SEQ ID NO: 615959 - RNA, 22 nt, Escherichia coli CFT073
gauagugugcgaucgagauuca

SEQ ID NO: 615960 - RNA, 20 nt, Escherichia coli CFT073
gauagugcugccaucuucuu

SEQ ID NO: 615961 - RNA, 18 nt, Escherichia coli CFT073
gauaguggaacaaagaaa

SEQ ID NO: 615962 - RNA, 17 nt, Escherichia coli CFT073
gauagucguugccacac

SEQ ID NO: 615963 - RNA, 15 nt, Escherichia coli CFT073
gauagucgaaucagu

SEQ ID NO: 615964 - RNA, 20 nt, Escherichia coli CFT073
gauagggcuguuuagcugaa

SEQ ID NO: 615965 - RNA, 20 nt, Escherichia coli CFT073
gauagcugucccagucuuuc

SEQ ID NO: 615966 - RNA, 14 nt, Escherichia coli CFT073
gauagauuucucua

SEQ ID NO: 615967 - RNA, 15 nt, Escherichia coli CFT073
gauagauuucucuaa

SEQ ID NO: 615968 - RNA, 16 nt, Escherichia coli CFT073
gauagauuucucuaaa

SEQ ID NO: 615969 - RNA, 16 nt, Escherichia coli CFT073
gauacuuaucaucaug

SEQ ID NO: 615970 - RNA, 21 nt, Escherichia coli CFT073
gauacuggaagugaucuuuca

SEQ ID NO: 615971 - RNA, 22 nt, Escherichia coli CFT073
gauacuggcguuacccagcgcc

SEQ ID NO: 615972 - RNA, 18 nt, Escherichia coli CFT073
gauacuggaaaaucuggc

SEQ ID NO: 615973 - RNA, 19 nt, Escherichia coli CFT073
gauacuggaaaaucuggcg

SEQ ID NO: 615974 - RNA, 12 nt, Escherichia coli CFT073
gauacugccuuu

SEQ ID NO: 615975 - RNA, 13 nt, Escherichia coli CFT073
gauacucugccau

SEQ ID NO: 615976 - RNA, 21 nt, Escherichia coli CFT073
gauacugaccuuaccaaugcu

SEQ ID NO: 615977 - RNA, 22 nt, Escherichia coli CFT073
gauacugaccuuaccaaugcug

SEQ ID NO: 615978 - RNA, 16 nt, Escherichia coli CFT073
gauagacacugccgcc

SEQ ID NO: 615979 - RNA, 17 nt, Escherichia coli CFT073
gauagagagcagucagg

SEQ ID NO: 615980 - RNA, 20 nt, Escherichia coli CFT073
gauagagagcagucagguuc

SEQ ID NO: 615981 - RNA, 17 nt, Escherichia coli CFT073
gauacgaucaucuggcg

SEQ ID NO: 615982 - RNA, 15 nt, Escherichia coli CFT073
gauacgcauaaacau

SEQ ID NO: 615983 - RNA, 19 nt, Escherichia coli CFT073
gauacgcauagcggcucac

SEQ ID NO: 615984 - RNA, 18 nt, Escherichia coli CFT073
gauacgcuggcgaucaug

SEQ ID NO: 615985 - RNA, 17 nt, Escherichia coli CFT073
gauacgcuucaaccagu

SEQ ID NO: 615986 - RNA, 18 nt, Escherichia coli CFT073
gauacgcuucaaccaguu

SEQ ID NO: 615987 - RNA, 15 nt, Escherichia coli CFT073
gauaagccccaguuc

SEQ ID NO: 615988 - RNA, 19 nt, Escherichia coli CFT073
gauaagcguagcgcaucag

SEQ ID NO: 615989 - RNA, 20 nt, Escherichia coli CFT073
gauaagcguagcgcaucagg

SEQ ID NO: 615990 - RNA, 17 nt, Escherichia coli CFT073
gauaagaugcgccagca

SEQ ID NO: 615991 - RNA, 18 nt, Escherichia coli CFT073
gauaagaugcguuaagcg

SEQ ID NO: 615992 - RNA, 18 nt, Escherichia coli CFT073
gauaagacgcguuaagcg

SEQ ID NO: 615993 - RNA, 23 nt, Escherichia coli CFT073
aaagcgacgugcaguagcagcag

SEQ ID NO: 615994 - RNA, 15 nt, Escherichia coli CFT073
aaagcgacuuugccu

SEQ ID NO: 615995 - RNA, 20 nt, Escherichia coli CFT073
gaugauucccagucaggcac

SEQ ID NO: 615996 - RNA, 13 nt, Escherichia coli CFT073
gaugauugccaca

SEQ ID NO: 615997 - RNA, 20 nt, Escherichia coli CFT073
aaagcgacacaaucaaaucc

SEQ ID NO: 615998 - RNA, 18 nt, Escherichia coli CFT073
aaagcgaccaaccaucau

SEQ ID NO: 615999 - RNA, 14 nt, Escherichia coli CFT073
gaugcagcaucaug

SEQ ID NO: 616000 - RNA, 15 nt, Escherichia coli CFT073
gaugcagcaucaugu

SEQ ID NO: 616001 - RNA, 13 nt, Escherichia coli CFT073
gaugcacagaacc

SEQ ID NO: 616002 - RNA, 15 nt, Escherichia coli CFT073
gaugauuucgauccg

SEQ ID NO: 616003 - RNA, 14 nt, Escherichia coli CFT073
gaugcaacacauua

SEQ ID NO: 616004 - RNA, 15 nt, Escherichia coli CFT073
gaugcaauuaucauu

SEQ ID NO: 616005 - RNA, 13 nt, Escherichia coli CFT073
gaugcccagcuca

SEQ ID NO: 616006 - RNA, 20 nt, Escherichia coli CFT073
gaugcccggcgaaccgggcg

SEQ ID NO: 616007 - RNA, 23 nt, Escherichia coli CFT073
gaugcccgguugcuuuucacaac

SEQ ID NO: 616008 - RNA, 17 nt, Escherichia coli CFT073
gaugcagguuaaccgcu

SEQ ID NO: 616009 - RNA, 13 nt, Escherichia coli CFT073
gaugcauccggca

SEQ ID NO: 616010 - RNA, 17 nt, Escherichia coli CFT073
gaugccacaaucucgcc

SEQ ID NO: 616011 - RNA, 23 nt, Escherichia coli CFT073
gaugccacccauuacacugaaaa

SEQ ID NO: 616012 - RNA, 15 nt, Escherichia coli CFT073
gaugccacuggaugu

SEQ ID NO: 616013 - RNA, 12 nt, Escherichia coli CFT073
gaugccaaaaau

SEQ ID NO: 616014 - RNA, 11 nt, Escherichia coli CFT073
gaugccagcac

SEQ ID NO: 616015 - RNA, 18 nt, Escherichia coli CFT073
gaugccagcacucugugc

SEQ ID NO: 616016 - RNA, 17 nt, Escherichia coli CFT073
gaugcgucgcuggcggu

SEQ ID NO: 616017 - RNA, 15 nt, Escherichia coli CFT073
gaugcguucuucaau

SEQ ID NO: 616018 - RNA, 15 nt, Escherichia coli CFT073
gaugcggcguaaacg

SEQ ID NO: 616019 - RNA, 21 nt, Escherichia coli CFT073
gaugcgcuacgcuuaucaggc

SEQ ID NO: 616020 - RNA, 21 nt, Escherichia coli CFT073
gaugcgcguacuuaccgcacg

SEQ ID NO: 616021 - RNA, 18 nt, Escherichia coli CFT073
gaugcggucgcugccgcc

SEQ ID NO: 616022 - RNA, 17 nt, Escherichia coli CFT073
gaugcggcgugauaaaa

SEQ ID NO: 616023 - RNA, 22 nt, Escherichia coli CFT073
gaugcgacguuacaaccacaua

SEQ ID NO: 616024 - RNA, 17 nt, Escherichia coli CFT073
gaugccuugugggccug

SEQ ID NO: 616025 - RNA, 21 nt, Escherichia coli CFT073
gaugccgccuggugcaggcgu

SEQ ID NO: 616026 - RNA, 17 nt, Escherichia coli CFT073
gaugccgcuuaucccca

SEQ ID NO: 616027 - RNA, 21 nt, Escherichia coli CFT073
gaugccggaaucaaccauggu

SEQ ID NO: 616028 - RNA, 16 nt, Escherichia coli CFT073
gaugccgcauccggcu

SEQ ID NO: 616029 - RNA, 19 nt, Escherichia coli CFT073
aaagccgugccagauggca

SEQ ID NO: 616030 - RNA, 16 nt, Escherichia coli CFT073
aaagccuguaaugccu

SEQ ID NO: 616031 - RNA, 20 nt, Escherichia coli CFT073
gaugaucauccggcuuuuuu

SEQ ID NO: 616032 - RNA, 14 nt, Escherichia coli CFT073
gaugaucaaaaaaa

SEQ ID NO: 616033 - RNA, 23 nt, Escherichia coli CFT073
gaugaucaaaaaaaucuucacug

SEQ ID NO: 616034 - RNA, 14 nt, Escherichia coli CFT073
gaugaucuaaaagc

SEQ ID NO: 616035 - RNA, 15 nt, Escherichia coli CFT073
gaugauccuggauuu

SEQ ID NO: 616036 - RNA, 17 nt, Escherichia coli CFT073
gaugacccagcgccagc

SEQ ID NO: 616037 - RNA, 23 nt, Escherichia coli CFT073
gaugacauaaccuugcaggccau

SEQ ID NO: 616038 - RNA, 24 nt, Escherichia coli CFT073
gaugaccgccacgguaucaagccc

SEQ ID NO: 616039 - RNA, 18 nt, Escherichia coli CFT073
gaugacuuucaaagagag

SEQ ID NO: 616040 - RNA, 15 nt, Escherichia coli CFT073
gaugagauacauugg

SEQ ID NO: 616041 - RNA, 20 nt, Escherichia coli CFT073
gaugaggcguuaacagcgca

SEQ ID NO: 616042 - RNA, 11 nt, Escherichia coli CFT073
gaucuucucuu

SEQ ID NO: 616043 - RNA, 21 nt, Escherichia coli CFT073
gaucuuccccuuuugccuucu

SEQ ID NO: 616044 - RNA, 12 nt, Escherichia coli CFT073
gaucuuccagcg

SEQ ID NO: 616045 - RNA, 15 nt, Escherichia coli CFT073
gaucuuccagcgcau

SEQ ID NO: 616046 - RNA, 17 nt, Escherichia coli CFT073
gaucuuugacugaaauu

SEQ ID NO: 616047 - RNA, 19 nt, Escherichia coli CFT073
gaucuuugacugaaauuua

SEQ ID NO: 616048 - RNA, 20 nt, Escherichia coli CFT073
gaucuuuaucaaucaccgcu

SEQ ID NO: 616049 - RNA, 19 nt, Escherichia coli CFT073
gaugaaaagauuaacguga

SEQ ID NO: 616050 - RNA, 19 nt, Escherichia coli CFT073
gaugaaauacuaaauauga

SEQ ID NO: 616051 - RNA, 18 nt, Escherichia coli CFT073
gaugaacggugcgcaggc

SEQ ID NO: 616052 - RNA, 18 nt, Escherichia coli CFT073
gaugaacgcgcagaucau

SEQ ID NO: 616053 - RNA, 19 nt, Escherichia coli CFT073
gaugacagaaucagcagcg

SEQ ID NO: 616054 - RNA, 12 nt, Escherichia coli CFT073
gaugaaugcaac

SEQ ID NO: 616055 - RNA, 15 nt, Escherichia coli CFT073
gaugaauaacccuaa

SEQ ID NO: 616056 - RNA, 17 nt, Escherichia coli CFT073
gaugaauaacuccguca

SEQ ID NO: 616057 - RNA, 15 nt, Escherichia coli CFT073
gaugaagcaacuggu

SEQ ID NO: 616058 - RNA, 21 nt, Escherichia coli CFT073
gaugaagcgagugcgaaacuu

SEQ ID NO: 616059 - RNA, 18 nt, Escherichia coli CFT073
gauguuguacaugcugcu

SEQ ID NO: 616060 - RNA, 18 nt, Escherichia coli CFT073
gauuaaacuucaccagca

SEQ ID NO: 616061 - RNA, 11 nt, Escherichia coli CFT073
gauuaaaauau

SEQ ID NO: 616062 - RNA, 13 nt, Escherichia coli CFT073
gauuaaaauauaa

SEQ ID NO: 616063 - RNA, 21 nt, Escherichia coli CFT073
gauuaauaaaauuauccaacu

SEQ ID NO: 616064 - RNA, 22 nt, Escherichia coli CFT073
gauuaauaaggaugcaacacau

SEQ ID NO: 616065 - RNA, 22 nt, Escherichia coli CFT073
gauuaacagcccaugacaggca

SEQ ID NO: 616066 - RNA, 20 nt, Escherichia coli CFT073
gaugugcguuggcuucaccu

SEQ ID NO: 616067 - RNA, 16 nt, Escherichia coli CFT073
gaugugcuuaucaggg

SEQ ID NO: 616068 - RNA, 14 nt, Escherichia coli CFT073
gaugugcuucagcu

SEQ ID NO: 616069 - RNA, 18 nt, Escherichia coli CFT073
gauguggcucagccagac

SEQ ID NO: 616070 - RNA, 15 nt, Escherichia coli CFT073
gauguuaccaacacu

SEQ ID NO: 616071 - RNA, 20 nt, Escherichia coli CFT073
gaugucugucagucugcuuu

SEQ ID NO: 616072 - RNA, 21 nt, Escherichia coli CFT073
gaugugaugcccggucgcucc

SEQ ID NO: 616073 - RNA, 12 nt, Escherichia coli CFT073
gauuaucuucac

SEQ ID NO: 616074 - RNA, 15 nt, Escherichia coli CFT073
gauuauccaugccac

SEQ ID NO: 616075 - RNA, 11 nt, Escherichia coli CFT073
gauuauccagc

SEQ ID NO: 616076 - RNA, 12 nt, Escherichia coli CFT073
gauuaucaugcc

SEQ ID NO: 616077 - RNA, 14 nt, Escherichia coli CFT073
gauuauuacucaac

SEQ ID NO: 616078 - RNA, 18 nt, Escherichia coli CFT073
gauuauucaaaaacagau

SEQ ID NO: 616079 - RNA, 22 nt, Escherichia coli CFT073
gauuauugcuugaucaggaaau

SEQ ID NO: 616080 - RNA, 21 nt, Escherichia coli CFT073
gauuacuuaacuuccaucccu

SEQ ID NO: 616081 - RNA, 22 nt, Escherichia coli CFT073
gauuaccugucgcgucaaucac

SEQ ID NO: 616082 - RNA, 21 nt, Escherichia coli CFT073
gauuaccgcaaacucaucgcc

SEQ ID NO: 616083 - RNA, 15 nt, Escherichia coli CFT073
gauuaccgccagcaa

SEQ ID NO: 616084 - RNA, 12 nt, Escherichia coli CFT073
gauuaccgccuu

SEQ ID NO: 616085 - RNA, 19 nt, Escherichia coli CFT073
gauuacucccuugccugca

SEQ ID NO: 616086 - RNA, 22 nt, Escherichia coli CFT073
gauuacucccuugccugcagga

SEQ ID NO: 616087 - RNA, 15 nt, Escherichia coli CFT073
gauuacagccaggcg

SEQ ID NO: 616088 - RNA, 18 nt, Escherichia coli CFT073
gauuaccagagaaaagau

SEQ ID NO: 616089 - RNA, 14 nt, Escherichia coli CFT073
gauuaccagcauca

SEQ ID NO: 616090 - RNA, 19 nt, Escherichia coli CFT073
gauuacacaaguccagcac

SEQ ID NO: 616091 - RNA, 16 nt, Escherichia coli CFT073
gauguagcgauuuacu

SEQ ID NO: 616092 - RNA, 16 nt, Escherichia coli CFT073
gaugucaaucagggcg

SEQ ID NO: 616093 - RNA, 14 nt, Escherichia coli CFT073
gauguauauuucug

SEQ ID NO: 616094 - RNA, 15 nt, Escherichia coli CFT073
gaugguuuuauagcg

SEQ ID NO: 616095 - RNA, 15 nt, Escherichia coli CFT073
gauguaauucagcca

SEQ ID NO: 616096 - RNA, 22 nt, Escherichia coli CFT073
gauggugcuaauugcaccaucc

SEQ ID NO: 616097 - RNA, 14 nt, Escherichia coli CFT073
gauggcuuuccacc

SEQ ID NO: 616098 - RNA, 11 nt, Escherichia coli CFT073
gauggcugggg

SEQ ID NO: 616099 - RNA, 21 nt, Escherichia coli CFT073
gauggcuauuacuuuaagccu

SEQ ID NO: 616100 - RNA, 13 nt, Escherichia coli CFT073
gaugggccagcac

SEQ ID NO: 616101 - RNA, 14 nt, Escherichia coli CFT073
gauggugaaguggc

SEQ ID NO: 616102 - RNA, 15 nt, Escherichia coli CFT073
gaugguauucaucgc

SEQ ID NO: 616103 - RNA, 23 nt, Escherichia coli CFT073
gaugguacuucaaucgccaccac

SEQ ID NO: 616104 - RNA, 18 nt, Escherichia coli CFT073
gaugguacuucaaucgcc

SEQ ID NO: 616105 - RNA, 15 nt, Escherichia coli CFT073
gauggagauuuuccg

SEQ ID NO: 616106 - RNA, 18 nt, Escherichia coli CFT073
gauggcaaaagugauauu

SEQ ID NO: 616107 - RNA, 17 nt, Escherichia coli CFT073
gaugcuuugaccucccg

SEQ ID NO: 616108 - RNA, 22 nt, Escherichia coli CFT073
gauggaacaaaauuuucagcgu

SEQ ID NO: 616109 - RNA, 16 nt, Escherichia coli CFT073
gaugcugcuguuuuug

SEQ ID NO: 616110 - RNA, 12 nt, Escherichia coli CFT073
gaugcugugccu

SEQ ID NO: 616111 - RNA, 22 nt, Escherichia coli CFT073
gaugcugugccuccugcggcuu

SEQ ID NO: 616112 - RNA, 16 nt, Escherichia coli CFT073
gaugcuguugcugauu

SEQ ID NO: 616113 - RNA, 19 nt, Escherichia coli CFT073
gauggcauaccauccggca

SEQ ID NO: 616114 - RNA, 22 nt, Escherichia coli CFT073
gauggcagaguugccauccggc

SEQ ID NO: 616115 - RNA, 11 nt, Escherichia coli CFT073
gauggcagggc

SEQ ID NO: 616116 - RNA, 15 nt, Escherichia coli CFT073
gauggcagggcagca

SEQ ID NO: 616117 - RNA, 15 nt, Escherichia coli CFT073
gauggcagaaaucaa

SEQ ID NO: 616118 - RNA, 17 nt, Escherichia coli CFT073
gauggcacgcauccggc

SEQ ID NO: 616119 - RNA, 18 nt, Escherichia coli CFT073
gauggcgauacugccgcc

SEQ ID NO: 616120 - RNA, 16 nt, Escherichia coli CFT073
gauggcgcgaaacguc

SEQ ID NO: 616121 - RNA, 14 nt, Escherichia coli CFT073
gauuuuacuuccca

SEQ ID NO: 616122 - RNA, 14 nt, Escherichia coli CFT073
gauuuguucuggug

SEQ ID NO: 616123 - RNA, 15 nt, Escherichia coli CFT073
gauuugucugccauu

SEQ ID NO: 616124 - RNA, 13 nt, Escherichia coli CFT073
gauuuuauuucac

SEQ ID NO: 616125 - RNA, 15 nt, Escherichia coli CFT073
gauuuucaucuucuu

SEQ ID NO: 616126 - RNA, 15 nt, Escherichia coli CFT073
gauuuucaucuuuug

SEQ ID NO: 616127 - RNA, 13 nt, Escherichia coli CFT073
gauuuugcaauaa

SEQ ID NO: 616128 - RNA, 14 nt, Escherichia coli CFT073
gauuuucuucagcu

SEQ ID NO: 616129 - RNA, 14 nt, Escherichia coli CFT073
gauuucucuaaaaa

SEQ ID NO: 616130 - RNA, 20 nt, Escherichia coli CFT073
gauuucguugugucgccagc

SEQ ID NO: 616131 - RNA, 22 nt, Escherichia coli CFT073
gauuucguugugucgccagcaa

SEQ ID NO: 616132 - RNA, 22 nt, Escherichia coli CFT073
gauuucuuugucgaucauguag

SEQ ID NO: 616133 - RNA, 19 nt, Escherichia coli CFT073
gauuugcagaucgcggccu

SEQ ID NO: 616134 - RNA, 15 nt, Escherichia coli CFT073
gauuugcaucaucaa

SEQ ID NO: 616135 - RNA, 22 nt, Escherichia coli CFT073
gauuugcaucaucaagguaauu

SEQ ID NO: 616136 - RNA, 20 nt, Escherichia coli CFT073
gauuugcgaauccggcagcg

SEQ ID NO: 616137 - RNA, 18 nt, Escherichia coli CFT073
gauuugcccaucaggcca

SEQ ID NO: 616138 - RNA, 18 nt, Escherichia coli CFT073
gauuugcguaaaaccugc

SEQ ID NO: 616139 - RNA, 14 nt, Escherichia coli CFT073
gauuucauccggcu

SEQ ID NO: 616140 - RNA, 19 nt, Escherichia coli CFT073
gauuucaucgcccaggcaa

SEQ ID NO: 616141 - RNA, 18 nt, Escherichia coli CFT073
gauuuccaucuccagcug

SEQ ID NO: 616142 - RNA, 12 nt, Escherichia coli CFT073
gauuuccagcuc

SEQ ID NO: 616143 - RNA, 17 nt, Escherichia coli CFT073
gauuucacgcucagcaa

SEQ ID NO: 616144 - RNA, 14 nt, Escherichia coli CFT073
gauuuacuuucuug

SEQ ID NO: 616145 - RNA, 15 nt, Escherichia coli CFT073
gauuguuuaaaaaua

SEQ ID NO: 616146 - RNA, 22 nt, Escherichia coli CFT073
gauuguuucuucgauggcuggg

SEQ ID NO: 616147 - RNA, 20 nt, Escherichia coli CFT073
gauuguucaacgaaaauaug

SEQ ID NO: 616148 - RNA, 15 nt, Escherichia coli CFT073
gauuguuaaucacau

SEQ ID NO: 616149 - RNA, 18 nt, Escherichia coli CFT073
gauugguuucaaccugca

SEQ ID NO: 616150 - RNA, 15 nt, Escherichia coli CFT073
gauuguacuuuaaaa

SEQ ID NO: 616151 - RNA, 17 nt, Escherichia coli CFT073
gauuguacuuuaaaaua

SEQ ID NO: 616152 - RNA, 13 nt, Escherichia coli CFT073
gauuuacuaaaac

SEQ ID NO: 616153 - RNA, 15 nt, Escherichia coli CFT073
gauuuacuaaaacuu

SEQ ID NO: 616154 - RNA, 13 nt, Escherichia coli CFT073
gauuuaacagcaa

SEQ ID NO: 616155 - RNA, 14 nt, Escherichia coli CFT073
gauuuaacagcaaa

SEQ ID NO: 616156 - RNA, 18 nt, Escherichia coli CFT073
gauuuaaaaaugccagcc

SEQ ID NO: 616157 - RNA, 16 nt, Escherichia coli CFT073
gauucggauccagcac

SEQ ID NO: 616158 - RNA, 16 nt, Escherichia coli CFT073
gauucggcaaucacaa

SEQ ID NO: 616159 - RNA, 17 nt, Escherichia coli CFT073
gauucgggcuaauuucc

SEQ ID NO: 616160 - RNA, 10 nt, Escherichia coli CFT073
gauucccugc

SEQ ID NO: 616161 - RNA, 14 nt, Escherichia coli CFT073
gauuccccagccac

SEQ ID NO: 616162 - RNA, 17 nt, Escherichia coli CFT073
gauucgacgcaaacaac

SEQ ID NO: 616163 - RNA, 20 nt, Escherichia coli CFT073
gauuccugcgcuuccaguuc

SEQ ID NO: 616164 - RNA, 14 nt, Escherichia coli CFT073
gauuccuuccagua

SEQ ID NO: 616165 - RNA, 12 nt, Escherichia coli CFT073
gauucauacugu

SEQ ID NO: 616166 - RNA, 18 nt, Escherichia coli CFT073
gauucaucucuucuuccg

SEQ ID NO: 616167 - RNA, 13 nt, Escherichia coli CFT073
gauuccaggucaa

SEQ ID NO: 616168 - RNA, 20 nt, Escherichia coli CFT073
gauuccaggucaaucccagg

SEQ ID NO: 616169 - RNA, 15 nt, Escherichia coli CFT073
gauuccacucauuaa

SEQ ID NO: 616170 - RNA, 15 nt, Escherichia coli CFT073
gauucccccggugcc

SEQ ID NO: 616171 - RNA, 14 nt, Escherichia coli CFT073
gauucaaauccagu

SEQ ID NO: 616172 - RNA, 23 nt, Escherichia coli CFT073
gauucagcgucggugucaucgac

SEQ ID NO: 616173 - RNA, 14 nt, Escherichia coli CFT073
gauucaaugcaauu

SEQ ID NO: 616174 - RNA, 18 nt, Escherichia coli CFT073
gauucacgccaaccagcu

SEQ ID NO: 616175 - RNA, 13 nt, Escherichia coli CFT073
gauugaugugcuu

SEQ ID NO: 616176 - RNA, 12 nt, Escherichia coli CFT073
gauugccagcau

SEQ ID NO: 616177 - RNA, 18 nt, Escherichia coli CFT073
gauugccauguuuuccuu

SEQ ID NO: 616178 - RNA, 12 nt, Escherichia coli CFT073
gauucuucccac

SEQ ID NO: 616179 - RNA, 15 nt, Escherichia coli CFT073
gauugaguauuaaau

SEQ ID NO: 616180 - RNA, 12 nt, Escherichia coli CFT073
gcaaauaauucc

SEQ ID NO: 616181 - RNA, 19 nt, Escherichia coli CFT073
gcaaauaauuccccaccug

SEQ ID NO: 616182 - RNA, 19 nt, Escherichia coli CFT073
gcaaauacccaaaaaauag

SEQ ID NO: 616183 - RNA, 12 nt, Escherichia coli CFT073
gcaaaucaccac

SEQ ID NO: 616184 - RNA, 15 nt, Escherichia coli CFT073
gcaaaucaacuaaaa

SEQ ID NO: 616185 - RNA, 13 nt, Escherichia coli CFT073
gcaaaucaaauca

SEQ ID NO: 616186 - RNA, 15 nt, Escherichia coli CFT073
gcaaaguagagcgaa

SEQ ID NO: 616187 - RNA, 21 nt, Escherichia coli CFT073
gcaaaguaaagcgcgucacca

SEQ ID NO: 616188 - RNA, 17 nt, Escherichia coli CFT073
gcaaaguagagcgaaac

SEQ ID NO: 616189 - RNA, 20 nt, Escherichia coli CFT073
gcaaagucacccgauaaaua

SEQ ID NO: 616190 - RNA, 19 nt, Escherichia coli CFT073
gcaaagucuucacgggaaa

SEQ ID NO: 616191 - RNA, 15 nt, Escherichia coli CFT073
gcaaaugaugcacca

SEQ ID NO: 616192 - RNA, 22 nt, Escherichia coli CFT073
gcaaaucucacuacaacaaccu

SEQ ID NO: 616193 - RNA, 23 nt, Escherichia coli CFT073
gcaaaucgccgagaucaacagca

SEQ ID NO: 616194 - RNA, 17 nt, Escherichia coli CFT073
gcaaaucggucggugca

SEQ ID NO: 616195 - RNA, 15 nt, Escherichia coli CFT073
gcaaauuuauuaucu

SEQ ID NO: 616196 - RNA, 15 nt, Escherichia coli CFT073
gcaaauuucgucgua

SEQ ID NO: 616197 - RNA, 20 nt, Escherichia coli CFT073
gcaaauuauuaauuaaacaa

SEQ ID NO: 616198 - RNA, 20 nt, Escherichia coli CFT073
gcaacaccgcuuuaaucacc

SEQ ID NO: 616199 - RNA, 23 nt, Escherichia coli CFT073
gcaacaccgcuuuaaucacccga

SEQ ID NO: 616200 - RNA, 21 nt, Escherichia coli CFT073
gcaacaaccaccacaccugcc

SEQ ID NO: 616201 - RNA, 14 nt, Escherichia coli CFT073
gcaacaacagcgcg

SEQ ID NO: 616202 - RNA, 21 nt, Escherichia coli CFT073
gcaacaaguucgaaccaacaa

SEQ ID NO: 616203 - RNA, 13 nt, Escherichia coli CFT073
gcaacagcgcggu

SEQ ID NO: 616204 - RNA, 15 nt, Escherichia coli CFT073
gcaacacgccagcgu

SEQ ID NO: 616205 - RNA, 12 nt, Escherichia coli CFT073
gcaacacuacac

SEQ ID NO: 616206 - RNA, 16 nt, Escherichia coli CFT073
gcaacacuuuaucugc

SEQ ID NO: 616207 - RNA, 20 nt, Escherichia coli CFT073
gcaacagaaacgccauccag

SEQ ID NO: 616208 - RNA, 17 nt, Escherichia coli CFT073
gcaacagaacgcgccuu

SEQ ID NO: 616209 - RNA, 14 nt, Escherichia coli CFT073
gcaacauaucuuuu

SEQ ID NO: 616210 - RNA, 22 nt, Escherichia coli CFT073
gcaacaucaaauacagcuuaau

SEQ ID NO: 616211 - RNA, 13 nt, Escherichia coli CFT073
gcaacaucaacag

SEQ ID NO: 616212 - RNA, 16 nt, Escherichia coli CFT073
gcaacaucaacagacc

SEQ ID NO: 616213 - RNA, 16 nt, Escherichia coli CFT073
gcaacaucaauaaagc

SEQ ID NO: 616214 - RNA, 16 nt, Escherichia coli CFT073
gcaacauggcgcggca

SEQ ID NO: 616215 - RNA, 19 nt, Escherichia coli CFT073
gcaaccacacccacaucaa

SEQ ID NO: 616216 - RNA, 17 nt, Escherichia coli CFT073
gcaacccagaagaaagc

SEQ ID NO: 616217 - RNA, 23 nt, Escherichia coli CFT073
gcaaccagagccggugccauuuc

SEQ ID NO: 616218 - RNA, 16 nt, Escherichia coli CFT073
gcaaccagcaaugcca

SEQ ID NO: 616219 - RNA, 16 nt, Escherichia coli CFT073
gcaaccagcagcauca

SEQ ID NO: 616220 - RNA, 17 nt, Escherichia coli CFT073
gcaaccagcagcaucac

SEQ ID NO: 616221 - RNA, 11 nt, Escherichia coli CFT073
gcaaccaggua

SEQ ID NO: 616222 - RNA, 21 nt, Escherichia coli CFT073
gcaaccaguagcaaaacucac

SEQ ID NO: 616223 - RNA, 13 nt, Escherichia coli CFT073
gcaaccaucagua

SEQ ID NO: 616224 - RNA, 19 nt, Escherichia coli CFT073
gcaaagcccgggcacauca

SEQ ID NO: 616225 - RNA, 22 nt, Escherichia coli CFT073
gcaaagcccgggcacaucaccu

SEQ ID NO: 616226 - RNA, 23 nt, Escherichia coli CFT073
gcaaagcuguuaucgauauacaa

SEQ ID NO: 616227 - RNA, 17 nt, Escherichia coli CFT073
gcaaaggcgacaauaaa

SEQ ID NO: 616228 - RNA, 16 nt, Escherichia coli CFT073
gcaaaggccagcaauc

SEQ ID NO: 616229 - RNA, 17 nt, Escherichia coli CFT073
gcaaagauuuguugauu

SEQ ID NO: 616230 - RNA, 19 nt, Escherichia coli CFT073
gcaaagagagaagccaggu

SEQ ID NO: 616231 - RNA, 20 nt, Escherichia coli CFT073
gcaaagagagaagccaggua

SEQ ID NO: 616232 - RNA, 13 nt, Escherichia coli CFT073
gcaaagagcagca

SEQ ID NO: 616233 - RNA, 23 nt, Escherichia coli CFT073
gcaaacugcugauguuguuucuc

SEQ ID NO: 616234 - RNA, 18 nt, Escherichia coli CFT073
gcaaacugguugaaauaa

SEQ ID NO: 616235 - RNA, 16 nt, Escherichia coli CFT073
gcaaacagcacaucuc

SEQ ID NO: 616236 - RNA, 18 nt, Escherichia coli CFT073
gcaaacaguucugcagcg

SEQ ID NO: 616237 - RNA, 15 nt, Escherichia coli CFT073
gcaaacaccagcuga

SEQ ID NO: 616238 - RNA, 16 nt, Escherichia coli CFT073
gcaaacaccagcugaa

SEQ ID NO: 616239 - RNA, 15 nt, Escherichia coli CFT073
gcaaacacgccgccg

SEQ ID NO: 616240 - RNA, 18 nt, Escherichia coli CFT073
gcaaacagaauuaucauu

SEQ ID NO: 616241 - RNA, 14 nt, Escherichia coli CFT073
gcaaacaugcagcc

SEQ ID NO: 616242 - RNA, 21 nt, Escherichia coli CFT073
gcaaacauacccacgaaaucu

SEQ ID NO: 616243 - RNA, 17 nt, Escherichia coli CFT073
gcaaacaucggcuuauu

SEQ ID NO: 616244 - RNA, 16 nt, Escherichia coli CFT073
gcaaaccugcaaugau

SEQ ID NO: 616245 - RNA, 22 nt, Escherichia coli CFT073
gcaaacgcguuaagcccaguuc

SEQ ID NO: 616246 - RNA, 21 nt, Escherichia coli CFT073
gcaaacucaucgccgccaaac

SEQ ID NO: 616247 - RNA, 22 nt, Escherichia coli CFT073
gcaaacggcagcaugauacaaa

SEQ ID NO: 616248 - RNA, 20 nt, Escherichia coli CFT073
gcaaacgguuaugaauaacu

SEQ ID NO: 616249 - RNA, 13 nt, Escherichia coli CFT073
gauuuuucaucac

SEQ ID NO: 616250 - RNA, 23 nt, Escherichia coli CFT073
gauuuuuccacuccgcuuaccau

SEQ ID NO: 616251 - RNA, 20 nt, Escherichia coli CFT073
gauuuuuccccacuucaucc

SEQ ID NO: 616252 - RNA, 16 nt, Escherichia coli CFT073
gauuuugcaauaaugg

SEQ ID NO: 616253 - RNA, 23 nt, Escherichia coli CFT073
gauuuuguaaucaacaaaagugg

SEQ ID NO: 616254 - RNA, 15 nt, Escherichia coli CFT073
gauuuugugcaaaaa

SEQ ID NO: 616255 - RNA, 15 nt, Escherichia coli CFT073
gcaaaaaagaaggaa

SEQ ID NO: 616256 - RNA, 19 nt, Escherichia coli CFT073
gauuuuuuccaacaggcga

SEQ ID NO: 616257 - RNA, 16 nt, Escherichia coli CFT073
gauuuuuuccagcgca

SEQ ID NO: 616258 - RNA, 21 nt, Escherichia coli CFT073
gcaaaaaaguagcgcagcaga

SEQ ID NO: 616259 - RNA, 19 nt, Escherichia coli CFT073
gcaaaaccaucaauccacu

SEQ ID NO: 616260 - RNA, 15 nt, Escherichia coli CFT073
gcaaaauuucuauca

SEQ ID NO: 616261 - RNA, 19 nt, Escherichia coli CFT073
gcaaacaacgccacacgca

SEQ ID NO: 616262 - RNA, 15 nt, Escherichia coli CFT073
gcaaaauccuuccag

SEQ ID NO: 616263 - RNA, 13 nt, Escherichia coli CFT073
gcaaaagcaggca

SEQ ID NO: 616264 - RNA, 12 nt, Escherichia coli CFT073
gcaaaauaggua

SEQ ID NO: 616265 - RNA, 22 nt, Escherichia coli CFT073
gcaaaauagguaucguaauuuu

SEQ ID NO: 616266 - RNA, 15 nt, Escherichia coli CFT073
gcaaaaucaccauca

SEQ ID NO: 616267 - RNA, 13 nt, Escherichia coli CFT073
gcaucgaccagga

SEQ ID NO: 616268 - RNA, 21 nt, Escherichia coli CFT073
gcauccuggcuguuacucaac

SEQ ID NO: 616269 - RNA, 20 nt, Escherichia coli CFT073
gcauccuggggauucaucac

SEQ ID NO: 616270 - RNA, 24 nt, Escherichia coli CFT073
gcauccguucuucggcgcugacca

SEQ ID NO: 616271 - RNA, 13 nt, Escherichia coli CFT073
gcauccugaauua

SEQ ID NO: 616272 - RNA, 12 nt, Escherichia coli CFT073
gcauccugcacc

SEQ ID NO: 616273 - RNA, 19 nt, Escherichia coli CFT073
gcauccugcgcguuacugg

SEQ ID NO: 616274 - RNA, 18 nt, Escherichia coli CFT073
gcauccaacuucguuacu

SEQ ID NO: 616275 - RNA, 17 nt, Escherichia coli CFT073
gcaucauguaaaucaau

SEQ ID NO: 616276 - RNA, 22 nt, Escherichia coli CFT073
gcaucauccgucggcuucacgc

SEQ ID NO: 616277 - RNA, 20 nt, Escherichia coli CFT073
gcaucaucgagaucgacacc

SEQ ID NO: 616278 - RNA, 17 nt, Escherichia coli CFT073
gcauccaggcaaaguac

SEQ ID NO: 616279 - RNA, 15 nt, Escherichia coli CFT073
gcaucuccuguuuca

SEQ ID NO: 616280 - RNA, 16 nt, Escherichia coli CFT073
gcaucugaagccugcu

SEQ ID NO: 616281 - RNA, 17 nt, Escherichia coli CFT073
gcaucugauaagcccag

SEQ ID NO: 616282 - RNA, 14 nt, Escherichia coli CFT073
gcaucuccugcaac

SEQ ID NO: 616283 - RNA, 18 nt, Escherichia coli CFT073
gcaucuaucgaaucuguu

SEQ ID NO: 616284 - RNA, 19 nt, Escherichia coli CFT073
gcaucuaucgaaucuguuc

SEQ ID NO: 616285 - RNA, 17 nt, Escherichia coli CFT073
gcaucuacgcucucuuc

SEQ ID NO: 616286 - RNA, 17 nt, Escherichia coli CFT073
gcaucgcccccaucgcc

SEQ ID NO: 616287 - RNA, 16 nt, Escherichia coli CFT073
gcaucguggaugaaac

SEQ ID NO: 616288 - RNA, 16 nt, Escherichia coli CFT073
gcaucgcaccauucac

SEQ ID NO: 616289 - RNA, 12 nt, Escherichia coli CFT073
gcaucgcaucaa

SEQ ID NO: 616290 - RNA, 15 nt, Escherichia coli CFT073
gcaucgcaucaggcu

SEQ ID NO: 616291 - RNA, 16 nt, Escherichia coli CFT073
gcaucgccaaacaggc

SEQ ID NO: 616292 - RNA, 15 nt, Escherichia coli CFT073
gcaucgcaaaccaga

SEQ ID NO: 616293 - RNA, 20 nt, Escherichia coli CFT073
gcaucgcaaaccagacgcgc

SEQ ID NO: 616294 - RNA, 22 nt, Escherichia coli CFT073
gcaucgcaaaccagacgcgcgu

SEQ ID NO: 616295 - RNA, 19 nt, Escherichia coli CFT073
gcauauguuuacgcuggcg

SEQ ID NO: 616296 - RNA, 16 nt, Escherichia coli CFT073
gcauaugcuucuuccu

SEQ ID NO: 616297 - RNA, 22 nt, Escherichia coli CFT073
gcauauuccaccacuucauacu

SEQ ID NO: 616298 - RNA, 14 nt, Escherichia coli CFT073
gcauauuuaaaaac

SEQ ID NO: 616299 - RNA, 16 nt, Escherichia coli CFT073
gcaucaaagaacucac

SEQ ID NO: 616300 - RNA, 15 nt, Escherichia coli CFT073
gcaucaggcuggugu

SEQ ID NO: 616301 - RNA, 20 nt, Escherichia coli CFT073
gcaucagucucaaaccggcu

SEQ ID NO: 616302 - RNA, 22 nt, Escherichia coli CFT073
gcaucaagaaugcucgcuggca

SEQ ID NO: 616303 - RNA, 14 nt, Escherichia coli CFT073
gcaucaagaaaacu

SEQ ID NO: 616304 - RNA, 21 nt, Escherichia coli CFT073
gcaucaagaaugcucgcuggc

SEQ ID NO: 616305 - RNA, 22 nt, Escherichia coli CFT073
gcaucaggcauuauggcgcagu

SEQ ID NO: 616306 - RNA, 17 nt, Escherichia coli CFT073
gcaucaggccaaacaga

SEQ ID NO: 616307 - RNA, 17 nt, Escherichia coli CFT073
gcaucaaccagcaccuu

SEQ ID NO: 616308 - RNA, 23 nt, Escherichia coli CFT073
gcauaauaccgcgagauauccac

SEQ ID NO: 616309 - RNA, 23 nt, Escherichia coli CFT073
gcauaagaccgugagcaaugcac

SEQ ID NO: 616310 - RNA, 14 nt, Escherichia coli CFT073
gcauaauaucuuuc

SEQ ID NO: 616311 - RNA, 18 nt, Escherichia coli CFT073
gcauaauccacuuucuua

SEQ ID NO: 616312 - RNA, 15 nt, Escherichia coli CFT073
gcauaauccaggcau

SEQ ID NO: 616313 - RNA, 17 nt, Escherichia coli CFT073
gcauaaugucgcuggcc

SEQ ID NO: 616314 - RNA, 15 nt, Escherichia coli CFT073
gcauaauuuccagca

SEQ ID NO: 616315 - RNA, 22 nt, Escherichia coli CFT073
gcauagcuaauccccuccagcg

SEQ ID NO: 616316 - RNA, 19 nt, Escherichia coli CFT073
gcauagcuggcguagccag

SEQ ID NO: 616317 - RNA, 20 nt, Escherichia coli CFT073
gcauagcuggcguagccagu

SEQ ID NO: 616318 - RNA, 16 nt, Escherichia coli CFT073
gcauaucuucugaagg

SEQ ID NO: 616319 - RNA, 13 nt, Escherichia coli CFT073
gcauauccggugc

SEQ ID NO: 616320 - RNA, 16 nt, Escherichia coli CFT073
gcauagccccagcgca

SEQ ID NO: 616321 - RNA, 19 nt, Escherichia coli CFT073
gcauagccggagguuuuuc

SEQ ID NO: 616322 - RNA, 21 nt, Escherichia coli CFT073
gcauuucuccgcguucaauac

SEQ ID NO: 616323 - RNA, 19 nt, Escherichia coli CFT073
gcauuucucgguauuacaa

SEQ ID NO: 616324 - RNA, 20 nt, Escherichia coli CFT073
gcauuucggcccaugacaaa

SEQ ID NO: 616325 - RNA, 22 nt, Escherichia coli CFT073
gcauuucgugcggguaaccagc

SEQ ID NO: 616326 - RNA, 18 nt, Escherichia coli CFT073
gcauuuccgcugauucaa

SEQ ID NO: 616327 - RNA, 16 nt, Escherichia coli CFT073
gcauuuucucacuggc

SEQ ID NO: 616328 - RNA, 16 nt, Escherichia coli CFT073
gcauuuguaggcagga

SEQ ID NO: 616329 - RNA, 18 nt, Escherichia coli CFT073
gcauuugaacuggaaaaa

SEQ ID NO: 616330 - RNA, 22 nt, Escherichia coli CFT073
gccaaacugugcaccgcccugc

SEQ ID NO: 616331 - RNA, 12 nt, Escherichia coli CFT073
gcauuuucuucc

SEQ ID NO: 616332 - RNA, 19 nt, Escherichia coli CFT073
gcauuuugcggaucugcuc

SEQ ID NO: 616333 - RNA, 13 nt, Escherichia coli CFT073
gcauuccagucca

SEQ ID NO: 616334 - RNA, 14 nt, Escherichia coli CFT073
gcauucccgccacc

SEQ ID NO: 616335 - RNA, 21 nt, Escherichia coli CFT073
gcauucgccguuaccagcacc

SEQ ID NO: 616336 - RNA, 18 nt, Escherichia coli CFT073
gcauucagggcagugcca

SEQ ID NO: 616337 - RNA, 14 nt, Escherichia coli CFT073
gcauuaccucaaua

SEQ ID NO: 616338 - RNA, 18 nt, Escherichia coli CFT073
gcauuacgaaaucggcac

SEQ ID NO: 616339 - RNA, 16 nt, Escherichia coli CFT073
gcauuacgcucgcugc

SEQ ID NO: 616340 - RNA, 13 nt, Escherichia coli CFT073
gcauuacaagaau

SEQ ID NO: 616341 - RNA, 13 nt, Escherichia coli CFT073
gcauuggcaauca

SEQ ID NO: 616342 - RNA, 16 nt, Escherichia coli CFT073
gcauuaacucacuggc

SEQ ID NO: 616343 - RNA, 23 nt, Escherichia coli CFT073
gcaugucaggcaguguucuggcu

SEQ ID NO: 616344 - RNA, 22 nt, Escherichia coli CFT073
gcauguaacccuuugcggugca

SEQ ID NO: 616345 - RNA, 20 nt, Escherichia coli CFT073
gcauggugcuggcuuauuaa

SEQ ID NO: 616346 - RNA, 16 nt, Escherichia coli CFT073
gcauggaucgccgcgg

SEQ ID NO: 616347 - RNA, 16 nt, Escherichia coli CFT073
gcauggaagcgcaggu

SEQ ID NO: 616348 - RNA, 13 nt, Escherichia coli CFT073
gcaucuucuucau

SEQ ID NO: 616349 - RNA, 16 nt, Escherichia coli CFT073
gcaucuucuucauucc

SEQ ID NO: 616350 - RNA, 17 nt, Escherichia coli CFT073
gcaucuucuucuggcuc

SEQ ID NO: 616351 - RNA, 23 nt, Escherichia coli CFT073
gcaucugccaccguguauuucug

SEQ ID NO: 616352 - RNA, 11 nt, Escherichia coli CFT073
gcaucugcuug

SEQ ID NO: 616353 - RNA, 22 nt, Escherichia coli CFT073
gcaucuggcgauacggugcaca

SEQ ID NO: 616354 - RNA, 12 nt, Escherichia coli CFT073
gcaugaucgaag

SEQ ID NO: 616355 - RNA, 18 nt, Escherichia coli CFT073
gcaugcaggcaugcaaua

SEQ ID NO: 616356 - RNA, 23 nt, Escherichia coli CFT073
gcagcuccagaguaacuucacca

SEQ ID NO: 616357 - RNA, 12 nt, Escherichia coli CFT073
gcagcuccagcc

SEQ ID NO: 616358 - RNA, 19 nt, Escherichia coli CFT073
gcagcuccccacaccacca

SEQ ID NO: 616359 - RNA, 17 nt, Escherichia coli CFT073
gcagcuaauugauugua

SEQ ID NO: 616360 - RNA, 20 nt, Escherichia coli CFT073
gcagcguuucgcgcgcgccu

SEQ ID NO: 616361 - RNA, 14 nt, Escherichia coli CFT073
gcaaccgagcgccc

SEQ ID NO: 616362 - RNA, 21 nt, Escherichia coli CFT073
gcaaccgcauccagauucuca

SEQ ID NO: 616363 - RNA, 15 nt, Escherichia coli CFT073
gcagcguaacggcuc

SEQ ID NO: 616364 - RNA, 21 nt, Escherichia coli CFT073
gcagcgucagugacggcuucu

SEQ ID NO: 616365 - RNA, 15 nt, Escherichia coli CFT073
gcagcguccagcgcc

SEQ ID NO: 616366 - RNA, 13 nt, Escherichia coli CFT073
gcagcuuuuucag

SEQ ID NO: 616367 - RNA, 13 nt, Escherichia coli CFT073
gcaggaacagaau

SEQ ID NO: 616368 - RNA, 12 nt, Escherichia coli CFT073
gcagcuucacgg

SEQ ID NO: 616369 - RNA, 16 nt, Escherichia coli CFT073
gcagcugugccgcugg

SEQ ID NO: 616370 - RNA, 20 nt, Escherichia coli CFT073
gcagcuuaaucauaauguug

SEQ ID NO: 616371 - RNA, 18 nt, Escherichia coli CFT073
gcagcuuaucuuuuucgg

SEQ ID NO: 616372 - RNA, 13 nt, Escherichia coli CFT073
gcagcuucacaaa

SEQ ID NO: 616373 - RNA, 18 nt, Escherichia coli CFT073
gcagcuucacaaaggcuu

SEQ ID NO: 616374 - RNA, 14 nt, Escherichia coli CFT073
gcaggaauggcugg

SEQ ID NO: 616375 - RNA, 14 nt, Escherichia coli CFT073
gcaggagcggcgga

SEQ ID NO: 616376 - RNA, 17 nt, Escherichia coli CFT073
gcaggagcugagugcga

SEQ ID NO: 616377 - RNA, 13 nt, Escherichia coli CFT073
gcaggccggagac

SEQ ID NO: 616378 - RNA, 15 nt, Escherichia coli CFT073
gcaggcuauuucugg

SEQ ID NO: 616379 - RNA, 20 nt, Escherichia coli CFT073
gcagggcgaaacgaggaaga

SEQ ID NO: 616380 - RNA, 23 nt, Escherichia coli CFT073
gcagggcgaauuccugacuuacu

SEQ ID NO: 616381 - RNA, 14 nt, Escherichia coli CFT073
gcagggcauccaga

SEQ ID NO: 616382 - RNA, 15 nt, Escherichia coli CFT073
gcaggcuggugguga

SEQ ID NO: 616383 - RNA, 20 nt, Escherichia coli CFT073
gcagggcaauacgcuccgcc

SEQ ID NO: 616384 - RNA, 21 nt, Escherichia coli CFT073
gcagggcaauacgcuccgccc

SEQ ID NO: 616385 - RNA, 18 nt, Escherichia coli CFT073
gcaguaaggaaauguucc

SEQ ID NO: 616386 - RNA, 13 nt, Escherichia coli CFT073
gcaguaaagugau

SEQ ID NO: 616387 - RNA, 12 nt, Escherichia coli CFT073
gcaguaaaccac

SEQ ID NO: 616388 - RNA, 14 nt, Escherichia coli CFT073
gcaguaaaccaccc

SEQ ID NO: 616389 - RNA, 22 nt, Escherichia coli CFT073
gcagguuuuccaguuuauggaa

SEQ ID NO: 616390 - RNA, 15 nt, Escherichia coli CFT073
gcaggggaauuucaa

SEQ ID NO: 616391 - RNA, 13 nt, Escherichia coli CFT073
gcagugaucacuu

SEQ ID NO: 616392 - RNA, 17 nt, Escherichia coli CFT073
gcagugauuuauuuuua

SEQ ID NO: 616393 - RNA, 14 nt, Escherichia coli CFT073
gcagucgugcccaa

SEQ ID NO: 616394 - RNA, 17 nt, Escherichia coli CFT073
gcagucgugcccaacug

SEQ ID NO: 616395 - RNA, 22 nt, Escherichia coli CFT073
gcagucggaaccgguuuagaaa

SEQ ID NO: 616396 - RNA, 19 nt, Escherichia coli CFT073
gcagucuuaauagcuucuu

SEQ ID NO: 616397 - RNA, 19 nt, Escherichia coli CFT073
gcagucccaucuucugaau

SEQ ID NO: 616398 - RNA, 19 nt, Escherichia coli CFT073
gcagucaccugcggugcag

SEQ ID NO: 616399 - RNA, 14 nt, Escherichia coli CFT073
gcagucacgccagu

SEQ ID NO: 616400 - RNA, 16 nt, Escherichia coli CFT073
gcaguuagcuuuucuc

SEQ ID NO: 616401 - RNA, 22 nt, Escherichia coli CFT073
gcaguuagcuuuucuccugcuu

SEQ ID NO: 616402 - RNA, 13 nt, Escherichia coli CFT073
gcaguuauuauaa

SEQ ID NO: 616403 - RNA, 14 nt, Escherichia coli CFT073
gcagugucagcacc

SEQ ID NO: 616404 - RNA, 16 nt, Escherichia coli CFT073
gcaguucccuacucuc

SEQ ID NO: 616405 - RNA, 21 nt, Escherichia coli CFT073
gcaguucgucgcguuugcccg

SEQ ID NO: 616406 - RNA, 19 nt, Escherichia coli CFT073
gcagugguaucaauaucca

SEQ ID NO: 616407 - RNA, 14 nt, Escherichia coli CFT073
gcaguggugcggcu

SEQ ID NO: 616408 - RNA, 23 nt, Escherichia coli CFT073
gcagugcgcgaaccagagacaga

SEQ ID NO: 616409 - RNA, 16 nt, Escherichia coli CFT073
gcagugcuuucauuuc

SEQ ID NO: 616410 - RNA, 17 nt, Escherichia coli CFT073
gcaguggaauauaauuu

SEQ ID NO: 616411 - RNA, 14 nt, Escherichia coli CFT073
gcagugccauccca

SEQ ID NO: 616412 - RNA, 20 nt, Escherichia coli CFT073
gcagugccugccaugccaaa

SEQ ID NO: 616413 - RNA, 17 nt, Escherichia coli CFT073
gcaguuuuuccccugcc

SEQ ID NO: 616414 - RNA, 21 nt, Escherichia coli CFT073
gcaguuugcgguguguggcug

SEQ ID NO: 616415 - RNA, 15 nt, Escherichia coli CFT073
gcaguuucagccagu

SEQ ID NO: 616416 - RNA, 22 nt, Escherichia coli CFT073
gcaguuuaugaaucaaaucaac

SEQ ID NO: 616417 - RNA, 19 nt, Escherichia coli CFT073
gcaguuucaccagcaguaa

SEQ ID NO: 616418 - RNA, 13 nt, Escherichia coli CFT073
gcaguuucgucaa

SEQ ID NO: 616419 - RNA, 19 nt, Escherichia coli CFT073
gcaguugccagcuuuuguu

SEQ ID NO: 616420 - RNA, 15 nt, Escherichia coli CFT073
gcaguugugugccag

SEQ ID NO: 616421 - RNA, 19 nt, Escherichia coli CFT073
gcaguugugugccaguaau

SEQ ID NO: 616422 - RNA, 14 nt, Escherichia coli CFT073
gcaguuggucagca

SEQ ID NO: 616423 - RNA, 17 nt, Escherichia coli CFT073
gcaguuguaaucacgcu

SEQ ID NO: 616424 - RNA, 13 nt, Escherichia coli CFT073
gcaguugcugacu

SEQ ID NO: 616425 - RNA, 23 nt, Escherichia coli CFT073
gcauaaccagagagcuuauccag

SEQ ID NO: 616426 - RNA, 19 nt, Escherichia coli CFT073
gcauaaauuucaggcaaca

SEQ ID NO: 616427 - RNA, 21 nt, Escherichia coli CFT073
gcauaaauuucaggcaacaaa

SEQ ID NO: 616428 - RNA, 11 nt, Escherichia coli CFT073
gcauaacacaa

SEQ ID NO: 616429 - RNA, 16 nt, Escherichia coli CFT073
gcauaaacacaggcac

SEQ ID NO: 616430 - RNA, 19 nt, Escherichia coli CFT073
gcauaaaagggcagcagga

SEQ ID NO: 616431 - RNA, 19 nt, Escherichia coli CFT073
gccacaauacugaucauca

SEQ ID NO: 616432 - RNA, 20 nt, Escherichia coli CFT073
gccacaauaaagcgauaaau

SEQ ID NO: 616433 - RNA, 14 nt, Escherichia coli CFT073
gccacaacuucaac

SEQ ID NO: 616434 - RNA, 17 nt, Escherichia coli CFT073
gccacaacuucaacguu

SEQ ID NO: 616435 - RNA, 16 nt, Escherichia coli CFT073
gccacaauauagucgc

SEQ ID NO: 616436 - RNA, 22 nt, Escherichia coli CFT073
gccacaaucggcguaccgcaca

SEQ ID NO: 616437 - RNA, 19 nt, Escherichia coli CFT073
gccaaagcaccacuccuca

SEQ ID NO: 616438 - RNA, 20 nt, Escherichia coli CFT073
gccaaagcaccacuccucaa

SEQ ID NO: 616439 - RNA, 17 nt, Escherichia coli CFT073
gccaaagccgccgagca

SEQ ID NO: 616440 - RNA, 23 nt, Escherichia coli CFT073
gccaaagcgacacaaucaaaucc

SEQ ID NO: 616441 - RNA, 16 nt, Escherichia coli CFT073
gccaaagucaucaauu

SEQ ID NO: 616442 - RNA, 21 nt, Escherichia coli CFT073
gccaaauauuucuuuaucacc

SEQ ID NO: 616443 - RNA, 14 nt, Escherichia coli CFT073
gccaaauaaaaucc

SEQ ID NO: 616444 - RNA, 16 nt, Escherichia coli CFT073
gccaaauccagcacca

SEQ ID NO: 616445 - RNA, 19 nt, Escherichia coli CFT073
gccaaauccggcaaauaac

SEQ ID NO: 616446 - RNA, 20 nt, Escherichia coli CFT073
gccaaauguauccaucacca

SEQ ID NO: 616447 - RNA, 19 nt, Escherichia coli CFT073
gccacauuucucugucagg

SEQ ID NO: 616448 - RNA, 10 nt, Escherichia coli CFT073
gccaccaacg

SEQ ID NO: 616449 - RNA, 15 nt, Escherichia coli CFT073
gccaccaauacuugc

SEQ ID NO: 616450 - RNA, 23 nt, Escherichia coli CFT073
gccacaucagcauauuuggcgcu

SEQ ID NO: 616451 - RNA, 13 nt, Escherichia coli CFT073
gccacaucgccau

SEQ ID NO: 616452 - RNA, 15 nt, Escherichia coli CFT073
gccacaguaaaaccg

SEQ ID NO: 616453 - RNA, 19 nt, Escherichia coli CFT073
gccacaguugaucagccag

SEQ ID NO: 616454 - RNA, 13 nt, Escherichia coli CFT073
gccacauacuguu

SEQ ID NO: 616455 - RNA, 15 nt, Escherichia coli CFT073
gccaccagaaccgcc

SEQ ID NO: 616456 - RNA, 15 nt, Escherichia coli CFT073
gccaccacguucagg

SEQ ID NO: 616457 - RNA, 13 nt, Escherichia coli CFT073
gccaccacucaaa

SEQ ID NO: 616458 - RNA, 14 nt, Escherichia coli CFT073
gccaccaccagcgu

SEQ ID NO: 616459 - RNA, 16 nt, Escherichia coli CFT073
gccaccaccucuucca

SEQ ID NO: 616460 - RNA, 13 nt, Escherichia coli CFT073
gccaccagugccg

SEQ ID NO: 616461 - RNA, 15 nt, Escherichia coli CFT073
gccaccagcacaccg

SEQ ID NO: 616462 - RNA, 21 nt, Escherichia coli CFT073
gccaccguguauuucugguca

SEQ ID NO: 616463 - RNA, 15 nt, Escherichia coli CFT073
gccacgccuuccuga

SEQ ID NO: 616464 - RNA, 22 nt, Escherichia coli CFT073
gccacgccgaggcauucagcca

SEQ ID NO: 616465 - RNA, 15 nt, Escherichia coli CFT073
gccacgccaaccacc

SEQ ID NO: 616466 - RNA, 21 nt, Escherichia coli CFT073
gccacgcauaacgcguaagua

SEQ ID NO: 616467 - RNA, 16 nt, Escherichia coli CFT073
gccacgaugcacagcu

SEQ ID NO: 616468 - RNA, 17 nt, Escherichia coli CFT073
gccacgaugcacagcuc

SEQ ID NO: 616469 - RNA, 13 nt, Escherichia coli CFT073
gccacgcaaacuu

SEQ ID NO: 616470 - RNA, 22 nt, Escherichia coli CFT073
gccaccuccgcuaaauccgccg

SEQ ID NO: 616471 - RNA, 17 nt, Escherichia coli CFT073
gccaccucgcaacaaug

SEQ ID NO: 616472 - RNA, 21 nt, Escherichia coli CFT073
gccagcacagaucgcacuuaa

SEQ ID NO: 616473 - RNA, 15 nt, Escherichia coli CFT073
gccagcacagccagc

SEQ ID NO: 616474 - RNA, 16 nt, Escherichia coli CFT073
gccagcacagccagcc

SEQ ID NO: 616475 - RNA, 19 nt, Escherichia coli CFT073
gccagcaagagcaaauaaa

SEQ ID NO: 616476 - RNA, 22 nt, Escherichia coli CFT073
gccagcaagagcaaauaaaaca

SEQ ID NO: 616477 - RNA, 18 nt, Escherichia coli CFT073
gccagcaauccccagaca

SEQ ID NO: 616478 - RNA, 19 nt, Escherichia coli CFT073
gccagcaacuguaacgcag

SEQ ID NO: 616479 - RNA, 12 nt, Escherichia coli CFT073
gccagcaccauc

SEQ ID NO: 616480 - RNA, 13 nt, Escherichia coli CFT073
gccagauugcugc

SEQ ID NO: 616481 - RNA, 14 nt, Escherichia coli CFT073
gccagauucuccag

SEQ ID NO: 616482 - RNA, 19 nt, Escherichia coli CFT073
gccagauuguuauccagcu

SEQ ID NO: 616483 - RNA, 20 nt, Escherichia coli CFT073
gccagauuguuauccagcug

SEQ ID NO: 616484 - RNA, 23 nt, Escherichia coli CFT073
gccagauuguuauccagcuguuc

SEQ ID NO: 616485 - RNA, 13 nt, Escherichia coli CFT073
gccagcaaaaaau

SEQ ID NO: 616486 - RNA, 14 nt, Escherichia coli CFT073
gccagauggcaucc

SEQ ID NO: 616487 - RNA, 16 nt, Escherichia coli CFT073
gccagauggcauccag

SEQ ID NO: 616488 - RNA, 18 nt, Escherichia coli CFT073
gccagauggcuuugcccu

SEQ ID NO: 616489 - RNA, 22 nt, Escherichia coli CFT073
gccagaguggauuaucuucacc

SEQ ID NO: 616490 - RNA, 16 nt, Escherichia coli CFT073
gccagauccuggcugu

SEQ ID NO: 616491 - RNA, 23 nt, Escherichia coli CFT073
gccagauauugauucaucucuuc

SEQ ID NO: 616492 - RNA, 12 nt, Escherichia coli CFT073
gccagagagcga

SEQ ID NO: 616493 - RNA, 16 nt, Escherichia coli CFT073
gccagagcagcaacaa

SEQ ID NO: 616494 - RNA, 19 nt, Escherichia coli CFT073
gccagagcagcaacaagcc

SEQ ID NO: 616495 - RNA, 16 nt, Escherichia coli CFT073
gccagacgcgccgcca

SEQ ID NO: 616496 - RNA, 13 nt, Escherichia coli CFT073
gccagacgcguca

SEQ ID NO: 616497 - RNA, 21 nt, Escherichia coli CFT073
gccagacgcgucacgcacugg

SEQ ID NO: 616498 - RNA, 19 nt, Escherichia coli CFT073
gccagacguccaaucggcc

SEQ ID NO: 616499 - RNA, 17 nt, Escherichia coli CFT073
gccagacucaccagcau

SEQ ID NO: 616500 - RNA, 13 nt, Escherichia coli CFT073
gccagacucagca

SEQ ID NO: 616501 - RNA, 15 nt, Escherichia coli CFT073
gccagacucagcaac

SEQ ID NO: 616502 - RNA, 17 nt, Escherichia coli CFT073
gccagacaaaccacgcc

SEQ ID NO: 616503 - RNA, 17 nt, Escherichia coli CFT073
gccagaauccccacugc

SEQ ID NO: 616504 - RNA, 17 nt, Escherichia coli CFT073
gccagaauccccggcag

SEQ ID NO: 616505 - RNA, 22 nt, Escherichia coli CFT073
gccagaauccggugauugcugc

SEQ ID NO: 616506 - RNA, 21 nt, Escherichia coli CFT073
gccagaauaacgugaucgaac

SEQ ID NO: 616507 - RNA, 18 nt, Escherichia coli CFT073
gccagaauagccgcagcu

SEQ ID NO: 616508 - RNA, 14 nt, Escherichia coli CFT073
gccagaauagcgcc

SEQ ID NO: 616509 - RNA, 13 nt, Escherichia coli CFT073
gccagaaucaaac

SEQ ID NO: 616510 - RNA, 15 nt, Escherichia coli CFT073
gccagacaauccagc

SEQ ID NO: 616511 - RNA, 14 nt, Escherichia coli CFT073
gccagacagugucu

SEQ ID NO: 616512 - RNA, 22 nt, Escherichia coli CFT073
gccagacauuacaaaauacaaa

SEQ ID NO: 616513 - RNA, 12 nt, Escherichia coli CFT073
gccagaccacug

SEQ ID NO: 616514 - RNA, 19 nt, Escherichia coli CFT073
gccagaccacugcgccgcu

SEQ ID NO: 616515 - RNA, 17 nt, Escherichia coli CFT073
gccagaccgaacagcau

SEQ ID NO: 616516 - RNA, 13 nt, Escherichia coli CFT073
gccagaagcagaa

SEQ ID NO: 616517 - RNA, 15 nt, Escherichia coli CFT073
gccagaagcagaaug

SEQ ID NO: 616518 - RNA, 14 nt, Escherichia coli CFT073
gccagaacagaaau

SEQ ID NO: 616519 - RNA, 15 nt, Escherichia coli CFT073
gccagaacagaaaug

SEQ ID NO: 616520 - RNA, 14 nt, Escherichia coli CFT073
gccagaaaccagcc

SEQ ID NO: 616521 - RNA, 22 nt, Escherichia coli CFT073
gccagaaaccagccacggcgca

SEQ ID NO: 616522 - RNA, 22 nt, Escherichia coli CFT073
gccagaacacgcucccagcagu

SEQ ID NO: 616523 - RNA, 14 nt, Escherichia coli CFT073
gccagaaccgagca

SEQ ID NO: 616524 - RNA, 19 nt, Escherichia coli CFT073
gccagaaccgagcacaccu

SEQ ID NO: 616525 - RNA, 14 nt, Escherichia coli CFT073
gccagaaaaccugg

SEQ ID NO: 616526 - RNA, 20 nt, Escherichia coli CFT073
gccagaaaaccuggcgcagu

SEQ ID NO: 616527 - RNA, 17 nt, Escherichia coli CFT073
gccacuuuaugauccag

SEQ ID NO: 616528 - RNA, 21 nt, Escherichia coli CFT073
gccacuuuucggcaaccgcau

SEQ ID NO: 616529 - RNA, 14 nt, Escherichia coli CFT073
gccacgcuuucugg

SEQ ID NO: 616530 - RNA, 18 nt, Escherichia coli CFT073
gccacuucuuccagcggc

SEQ ID NO: 616531 - RNA, 18 nt, Escherichia coli CFT073
gccagcagcgcaaagccc

SEQ ID NO: 616532 - RNA, 23 nt, Escherichia coli CFT073
gccagcagcgaaucagcccagcc

SEQ ID NO: 616533 - RNA, 14 nt, Escherichia coli CFT073
gccagcagccauuc

SEQ ID NO: 616534 - RNA, 18 nt, Escherichia coli CFT073
gccagcacugccagccac

SEQ ID NO: 616535 - RNA, 20 nt, Escherichia coli CFT073
gccagcacuuuguaaccagu

SEQ ID NO: 616536 - RNA, 20 nt, Escherichia coli CFT073
gccagcagggcaaacagcac

SEQ ID NO: 616537 - RNA, 17 nt, Escherichia coli CFT073
gccagccaucgccugcu

SEQ ID NO: 616538 - RNA, 14 nt, Escherichia coli CFT073
gccagccaugagac

SEQ ID NO: 616539 - RNA, 16 nt, Escherichia coli CFT073
gccagccauucaaucu

SEQ ID NO: 616540 - RNA, 17 nt, Escherichia coli CFT073
gccagccacaggccgcu

SEQ ID NO: 616541 - RNA, 21 nt, Escherichia coli CFT073
gccagcauugcgccagcgaga

SEQ ID NO: 616542 - RNA, 11 nt, Escherichia coli CFT073
gccagcaucgc

SEQ ID NO: 616543 - RNA, 15 nt, Escherichia coli CFT073
gccagcaucagaccc

SEQ ID NO: 616544 - RNA, 19 nt, Escherichia coli CFT073
gccagcaucagacccaccc

SEQ ID NO: 616545 - RNA, 16 nt, Escherichia coli CFT073
gccagcaguugcugac

SEQ ID NO: 616546 - RNA, 15 nt, Escherichia coli CFT073
gccagcauacagcuu

SEQ ID NO: 616547 - RNA, 21 nt, Escherichia coli CFT073
gccagcgauuuugccagccgc

SEQ ID NO: 616548 - RNA, 16 nt, Escherichia coli CFT073
gccagcgaagccagcu

SEQ ID NO: 616549 - RNA, 20 nt, Escherichia coli CFT073
gccagcgaagguaacaccag

SEQ ID NO: 616550 - RNA, 23 nt, Escherichia coli CFT073
gccagcgcaccuucauucaggcc

SEQ ID NO: 616551 - RNA, 14 nt, Escherichia coli CFT073
gccagcgcaggcag

SEQ ID NO: 616552 - RNA, 16 nt, Escherichia coli CFT073
gccagcgccaaagcca

SEQ ID NO: 616553 - RNA, 21 nt, Escherichia coli CFT073
gccagcgccaucgguagcacc

SEQ ID NO: 616554 - RNA, 13 nt, Escherichia coli CFT073
gccagcgccgcgc

SEQ ID NO: 616555 - RNA, 20 nt, Escherichia coli CFT073
gccagcgcccguaaaccaag

SEQ ID NO: 616556 - RNA, 22 nt, Escherichia coli CFT073
gccagcgcccguaaaccaagcu

SEQ ID NO: 616557 - RNA, 20 nt, Escherichia coli CFT073
gccagcccuuucagcccacc

SEQ ID NO: 616558 - RNA, 14 nt, Escherichia coli CFT073
gccagccgccgcuc

SEQ ID NO: 616559 - RNA, 14 nt, Escherichia coli CFT073
gccagccccucagc

SEQ ID NO: 616560 - RNA, 20 nt, Escherichia coli CFT073
gccagccugcgcuaccagaa

SEQ ID NO: 616561 - RNA, 17 nt, Escherichia coli CFT073
gccagccuccaacccac

SEQ ID NO: 616562 - RNA, 14 nt, Escherichia coli CFT073
gccaggacaucagc

SEQ ID NO: 616563 - RNA, 18 nt, Escherichia coli CFT073
gccaggaaccugugacag

SEQ ID NO: 616564 - RNA, 18 nt, Escherichia coli CFT073
gccaggaacaacgacagg

SEQ ID NO: 616565 - RNA, 14 nt, Escherichia coli CFT073
gccagcuugcagcc

SEQ ID NO: 616566 - RNA, 15 nt, Escherichia coli CFT073
gccagcuugcagccg

SEQ ID NO: 616567 - RNA, 16 nt, Escherichia coli CFT073
gccagcuugcagccgu

SEQ ID NO: 616568 - RNA, 22 nt, Escherichia coli CFT073
gccagcucugcgcccugcauca

SEQ ID NO: 616569 - RNA, 21 nt, Escherichia coli CFT073
gccaggcaacagauaauaaaa

SEQ ID NO: 616570 - RNA, 16 nt, Escherichia coli CFT073
gccaggcacgccgcgc

SEQ ID NO: 616571 - RNA, 15 nt, Escherichia coli CFT073
gccaggcacuuccca

SEQ ID NO: 616572 - RNA, 22 nt, Escherichia coli CFT073
gccaggagccaacacuuucacu

SEQ ID NO: 616573 - RNA, 22 nt, Escherichia coli CFT073
gccaggccuaacaccaucagug

SEQ ID NO: 616574 - RNA, 19 nt, Escherichia coli CFT073
gccaggcagagcucaacca

SEQ ID NO: 616575 - RNA, 18 nt, Escherichia coli CFT073
gccagcggcaccgaggau

SEQ ID NO: 616576 - RNA, 21 nt, Escherichia coli CFT073
gccagcggcaccgaggaugaa

SEQ ID NO: 616577 - RNA, 14 nt, Escherichia coli CFT073
gccagcgcugccca

SEQ ID NO: 616578 - RNA, 17 nt, Escherichia coli CFT073
gccagcgcugcccacca

SEQ ID NO: 616579 - RNA, 20 nt, Escherichia coli CFT073
gccagcgcuguuagcgugca

SEQ ID NO: 616580 - RNA, 12 nt, Escherichia coli CFT073
gccagcggcggc

SEQ ID NO: 616581 - RNA, 10 nt, Escherichia coli CFT073
gccagcggcg

SEQ ID NO: 616582 - RNA, 19 nt, Escherichia coli CFT073
gccagcgcgcggcuggcac

SEQ ID NO: 616583 - RNA, 20 nt, Escherichia coli CFT073
gccagcgucaguucucuggc

SEQ ID NO: 616584 - RNA, 21 nt, Escherichia coli CFT073
gccagcguaccuugcggcggu

SEQ ID NO: 616585 - RNA, 18 nt, Escherichia coli CFT073
gccagcgguagcucgacc

SEQ ID NO: 616586 - RNA, 16 nt, Escherichia coli CFT073
gccagcuccagcgcuu

SEQ ID NO: 616587 - RNA, 23 nt, Escherichia coli CFT073
gccagcguuaucccauuccacuc

SEQ ID NO: 616588 - RNA, 15 nt, Escherichia coli CFT073
gccgccuggugcagg

SEQ ID NO: 616589 - RNA, 20 nt, Escherichia coli CFT073
gccgccuucguagccgcaua

SEQ ID NO: 616590 - RNA, 21 nt, Escherichia coli CFT073
gccgcgaaacugcguggcgaa

SEQ ID NO: 616591 - RNA, 18 nt, Escherichia coli CFT073
gccgcgauagcaagcgcu

SEQ ID NO: 616592 - RNA, 20 nt, Escherichia coli CFT073
gccgccuaacgacaaaucau

SEQ ID NO: 616593 - RNA, 12 nt, Escherichia coli CFT073
gccgcgccgcgc

SEQ ID NO: 616594 - RNA, 16 nt, Escherichia coli CFT073
gccgcgcggguggugc

SEQ ID NO: 616595 - RNA, 13 nt, Escherichia coli CFT073
gccgccgcagaca

SEQ ID NO: 616596 - RNA, 18 nt, Escherichia coli CFT073
aaagcugagaaaauguau

SEQ ID NO: 616597 - RNA, 15 nt, Escherichia coli CFT073
aaagcugauaaucau

SEQ ID NO: 616598 - RNA, 18 nt, Escherichia coli CFT073
gccgcuaucaggccaccu

SEQ ID NO: 616599 - RNA, 16 nt, Escherichia coli CFT073
gccgcugcuauggcgc

SEQ ID NO: 616600 - RNA, 15 nt, Escherichia coli CFT073
gccgcuguaauacca

SEQ ID NO: 616601 - RNA, 19 nt, Escherichia coli CFT073
gccgcuggucacuaccugc

SEQ ID NO: 616602 - RNA, 21 nt, Escherichia coli CFT073
gccgcuuaaauuggcgcucuc

SEQ ID NO: 616603 - RNA, 19 nt, Escherichia coli CFT073
gccgcuuauccccagaaug

SEQ ID NO: 616604 - RNA, 14 nt, Escherichia coli CFT073
gccgcuggcgcagc

SEQ ID NO: 616605 - RNA, 14 nt, Escherichia coli CFT073
gccgcggcgcggcg

SEQ ID NO: 616606 - RNA, 20 nt, Escherichia coli CFT073
gccgcggcucaggcgcacgc

SEQ ID NO: 616607 - RNA, 20 nt, Escherichia coli CFT073
gccgcgguaucaaacacagg

SEQ ID NO: 616608 - RNA, 19 nt, Escherichia coli CFT073
gccgcguguuuccgggccg

SEQ ID NO: 616609 - RNA, 18 nt, Escherichia coli CFT073
gccgcgucuuauccggca

SEQ ID NO: 616610 - RNA, 18 nt, Escherichia coli CFT073
gccgcgucuuauccggcc

SEQ ID NO: 616611 - RNA, 14 nt, Escherichia coli CFT073
gccgauccgcguca

SEQ ID NO: 616612 - RNA, 22 nt, Escherichia coli CFT073
gccgagaauaaaacaagcagcu

SEQ ID NO: 616613 - RNA, 19 nt, Escherichia coli CFT073
gccgagauauagccccaug

SEQ ID NO: 616614 - RNA, 21 nt, Escherichia coli CFT073
gccgagaagauuuuuugccag

SEQ ID NO: 616615 - RNA, 22 nt, Escherichia coli CFT073
gccgagaagauuuuuugccagc

SEQ ID NO: 616616 - RNA, 14 nt, Escherichia coli CFT073
gccgagcagcuguu

SEQ ID NO: 616617 - RNA, 14 nt, Escherichia coli CFT073
gccgcaaaacccag

SEQ ID NO: 616618 - RNA, 17 nt, Escherichia coli CFT073
gccgcaacuaccagcag

SEQ ID NO: 616619 - RNA, 19 nt, Escherichia coli CFT073
gccgcauggaaccaguuca

SEQ ID NO: 616620 - RNA, 13 nt, Escherichia coli CFT073
gccgcauccggcc

SEQ ID NO: 616621 - RNA, 21 nt, Escherichia coli CFT073
gccgcauccggccaucaguau

SEQ ID NO: 616622 - RNA, 22 nt, Escherichia coli CFT073
gccgcauccggccaucaguauu

SEQ ID NO: 616623 - RNA, 21 nt, Escherichia coli CFT073
gccgcaucagugaucagccac

SEQ ID NO: 616624 - RNA, 22 nt, Escherichia coli CFT073
gccgccacuucuggcggcggca

SEQ ID NO: 616625 - RNA, 19 nt, Escherichia coli CFT073
gccgccacuugagccgcca

SEQ ID NO: 616626 - RNA, 21 nt, Escherichia coli CFT073
gccgccacuugagccgccacc

SEQ ID NO: 616627 - RNA, 12 nt, Escherichia coli CFT073
gccgcauugccc

SEQ ID NO: 616628 - RNA, 22 nt, Escherichia coli CFT073
gccgcauccgacaaauguguuc

SEQ ID NO: 616629 - RNA, 13 nt, Escherichia coli CFT073
gccgcauccggca

SEQ ID NO: 616630 - RNA, 15 nt, Escherichia coli CFT073
gccgcauaguccagu

SEQ ID NO: 616631 - RNA, 17 nt, Escherichia coli CFT073
gcccugucgaggccaau

SEQ ID NO: 616632 - RNA, 12 nt, Escherichia coli CFT073
gccgaaaucaag

SEQ ID NO: 616633 - RNA, 13 nt, Escherichia coli CFT073
gcccugcuccagc

SEQ ID NO: 616634 - RNA, 17 nt, Escherichia coli CFT073
gcccuggacaacauucc

SEQ ID NO: 616635 - RNA, 19 nt, Escherichia coli CFT073
gcccuggacaacauuccug

SEQ ID NO: 616636 - RNA, 10 nt, Escherichia coli CFT073
gcccugccuu

SEQ ID NO: 616637 - RNA, 19 nt, Escherichia coli CFT073
gccgagaaauaucagcagc

SEQ ID NO: 616638 - RNA, 21 nt, Escherichia coli CFT073
gccgaccgcaaggaagccuga

SEQ ID NO: 616639 - RNA, 17 nt, Escherichia coli CFT073
gccgaacagucgcugau

SEQ ID NO: 616640 - RNA, 21 nt, Escherichia coli CFT073
gccgaacagugccagacaaac

SEQ ID NO: 616641 - RNA, 14 nt, Escherichia coli CFT073
gccgaaccauguca

SEQ ID NO: 616642 - RNA, 15 nt, Escherichia coli CFT073
gccgacaaucucuuc

SEQ ID NO: 616643 - RNA, 17 nt, Escherichia coli CFT073
gccaucuuccggguuau

SEQ ID NO: 616644 - RNA, 17 nt, Escherichia coli CFT073
gccauguuuggcaaaag

SEQ ID NO: 616645 - RNA, 20 nt, Escherichia coli CFT073
gccaugcugagcuucuucaa

SEQ ID NO: 616646 - RNA, 14 nt, Escherichia coli CFT073
gccaugcugguuac

SEQ ID NO: 616647 - RNA, 16 nt, Escherichia coli CFT073
gccaugcuguagugaa

SEQ ID NO: 616648 - RNA, 20 nt, Escherichia coli CFT073
gccauuaaaucagccuuaau

SEQ ID NO: 616649 - RNA, 13 nt, Escherichia coli CFT073
gccauuaaacgca

SEQ ID NO: 616650 - RNA, 18 nt, Escherichia coli CFT073
gccauuaaugccgcaacu

SEQ ID NO: 616651 - RNA, 12 nt, Escherichia coli CFT073
gccauuaccacc

SEQ ID NO: 616652 - RNA, 22 nt, Escherichia coli CFT073
gccauuagcaaauuauccccca

SEQ ID NO: 616653 - RNA, 14 nt, Escherichia coli CFT073
gccauuaccagguc

SEQ ID NO: 616654 - RNA, 20 nt, Escherichia coli CFT073
gccauugggaauuugcuccg

SEQ ID NO: 616655 - RNA, 22 nt, Escherichia coli CFT073
gccauuuaacgcaucacgaaua

SEQ ID NO: 616656 - RNA, 17 nt, Escherichia coli CFT073
gcccaaaguguaaaaaa

SEQ ID NO: 616657 - RNA, 18 nt, Escherichia coli CFT073
gcccaaagccaaucugug

SEQ ID NO: 616658 - RNA, 16 nt, Escherichia coli CFT073
gccauugcccgaggau

SEQ ID NO: 616659 - RNA, 19 nt, Escherichia coli CFT073
gccauugcccgaugcgcaa

SEQ ID NO: 616660 - RNA, 16 nt, Escherichia coli CFT073
gccauuggccugaaua

SEQ ID NO: 616661 - RNA, 21 nt, Escherichia coli CFT073
gcccacaaucuuaggggacau

SEQ ID NO: 616662 - RNA, 12 nt, Escherichia coli CFT073
gcccaaccagca

SEQ ID NO: 616663 - RNA, 13 nt, Escherichia coli CFT073
gcccaaccagcag

SEQ ID NO: 616664 - RNA, 18 nt, Escherichia coli CFT073
gccaucaucccuacaggu

SEQ ID NO: 616665 - RNA, 18 nt, Escherichia coli CFT073
gccaucauccugaugguc

SEQ ID NO: 616666 - RNA, 22 nt, Escherichia coli CFT073
gccaucaucuuccacuuugucg

SEQ ID NO: 616667 - RNA, 19 nt, Escherichia coli CFT073
gccauccguaauuauuacu

SEQ ID NO: 616668 - RNA, 23 nt, Escherichia coli CFT073
gccaucagccacuucaaccagcg

SEQ ID NO: 616669 - RNA, 13 nt, Escherichia coli CFT073
gccaucagcagcg

SEQ ID NO: 616670 - RNA, 16 nt, Escherichia coli CFT073
gccaucagcgccugau

SEQ ID NO: 616671 - RNA, 22 nt, Escherichia coli CFT073
gccaucugaauaaacggcucau

SEQ ID NO: 616672 - RNA, 19 nt, Escherichia coli CFT073
gccauauaacgggcuuccc

SEQ ID NO: 616673 - RNA, 20 nt, Escherichia coli CFT073
gccauauaugccaucgccag

SEQ ID NO: 616674 - RNA, 21 nt, Escherichia coli CFT073
gccauaucaccaccgucauca

SEQ ID NO: 616675 - RNA, 15 nt, Escherichia coli CFT073
gccauauuucacaua

SEQ ID NO: 616676 - RNA, 19 nt, Escherichia coli CFT073
gccauauggcugcauccag

SEQ ID NO: 616677 - RNA, 14 nt, Escherichia coli CFT073
gccaggcuccagau

SEQ ID NO: 616678 - RNA, 18 nt, Escherichia coli CFT073
gccaggcgcugcuggagc

SEQ ID NO: 616679 - RNA, 17 nt, Escherichia coli CFT073
gcccauaaauacgucuu

SEQ ID NO: 616680 - RNA, 15 nt, Escherichia coli CFT073
gcccauaagcaaaag

SEQ ID NO: 616681 - RNA, 19 nt, Escherichia coli CFT073
gcccauacauaccagcagg

SEQ ID NO: 616682 - RNA, 17 nt, Escherichia coli CFT073
gcccauacuuaaugcca

SEQ ID NO: 616683 - RNA, 21 nt, Escherichia coli CFT073
gcccagguuauacaccuguuc

SEQ ID NO: 616684 - RNA, 19 nt, Escherichia coli CFT073
gcccagggaaacagccacc

SEQ ID NO: 616685 - RNA, 15 nt, Escherichia coli CFT073
gcccaucaucuggcu

SEQ ID NO: 616686 - RNA, 22 nt, Escherichia coli CFT073
gcccaucaguguccagaugcug

SEQ ID NO: 616687 - RNA, 15 nt, Escherichia coli CFT073
gcccaucauccgcgc

SEQ ID NO: 616688 - RNA, 14 nt, Escherichia coli CFT073
gcccaucaggccag

SEQ ID NO: 616689 - RNA, 24 nt, Escherichia coli CFT073
gcccauccaggguuuuauuauucc

SEQ ID NO: 616690 - RNA, 19 nt, Escherichia coli CFT073
gcccaucauugacagaccg

SEQ ID NO: 616691 - RNA, 18 nt, Escherichia coli CFT073
gcccaucaugcgccaggu

SEQ ID NO: 616692 - RNA, 19 nt, Escherichia coli CFT073
gcccaucgauaugggcagc

SEQ ID NO: 616693 - RNA, 20 nt, Escherichia coli CFT073
gcccaucgcgcccgccgcca

SEQ ID NO: 616694 - RNA, 22 nt, Escherichia coli CFT073
gcccagcguuccggcguccacc

SEQ ID NO: 616695 - RNA, 20 nt, Escherichia coli CFT073
gcccaggaguuacugcaacg

SEQ ID NO: 616696 - RNA, 13 nt, Escherichia coli CFT073
gcccaggaaggcu

SEQ ID NO: 616697 - RNA, 21 nt, Escherichia coli CFT073
gcccagcuuaguaagcccagg

SEQ ID NO: 616698 - RNA, 22 nt, Escherichia coli CFT073
gcccagcuuaguaagcccaggg

SEQ ID NO: 616699 - RNA, 20 nt, Escherichia coli CFT073
gcccagccaucgacaccagc

SEQ ID NO: 616700 - RNA, 13 nt, Escherichia coli CFT073
gcccaccagccgc

SEQ ID NO: 616701 - RNA, 14 nt, Escherichia coli CFT073
gcccaccagccgca

SEQ ID NO: 616702 - RNA, 17 nt, Escherichia coli CFT073
gcccacgcaccaccagc

SEQ ID NO: 616703 - RNA, 16 nt, Escherichia coli CFT073
gcccaccgcauccagu

SEQ ID NO: 616704 - RNA, 16 nt, Escherichia coli CFT073
gcccacgguaaaauac

SEQ ID NO: 616705 - RNA, 15 nt, Escherichia coli CFT073
gccccaucugcccca

SEQ ID NO: 616706 - RNA, 13 nt, Escherichia coli CFT073
gcccccagacuga

SEQ ID NO: 616707 - RNA, 24 nt, Escherichia coli CFT073
gcccauugccagcgcugcccacca

SEQ ID NO: 616708 - RNA, 21 nt, Escherichia coli CFT073
gcccauuccccagccgaucag

SEQ ID NO: 616709 - RNA, 14 nt, Escherichia coli CFT073
gcccauucagcaug

SEQ ID NO: 616710 - RNA, 18 nt, Escherichia coli CFT073
gcccaucgcgcccgccgc

SEQ ID NO: 616711 - RNA, 11 nt, Escherichia coli CFT073
gccccgccagu

SEQ ID NO: 616712 - RNA, 20 nt, Escherichia coli CFT073
gccccggcgaucccagagcg

SEQ ID NO: 616713 - RNA, 19 nt, Escherichia coli CFT073
gccccggcugcgcgacggc

SEQ ID NO: 616714 - RNA, 12 nt, Escherichia coli CFT073
gccccggccagu

SEQ ID NO: 616715 - RNA, 23 nt, Escherichia coli CFT073
gccccuaaauaaacaccagcagu

SEQ ID NO: 616716 - RNA, 15 nt, Escherichia coli CFT073
gccccgugaugaacu

SEQ ID NO: 616717 - RNA, 16 nt, Escherichia coli CFT073
gccccgguuucucuuc

SEQ ID NO: 616718 - RNA, 21 nt, Escherichia coli CFT073
gcccgacgaggcgcuggcgca

SEQ ID NO: 616719 - RNA, 21 nt, Escherichia coli CFT073
gcccgacgauaccgccgcaca

SEQ ID NO: 616720 - RNA, 11 nt, Escherichia coli CFT073
gcccgccgcca

SEQ ID NO: 616721 - RNA, 18 nt, Escherichia coli CFT073
gcccgauaagcuugcgca

SEQ ID NO: 616722 - RNA, 14 nt, Escherichia coli CFT073
gcccgcgcccaggc

SEQ ID NO: 616723 - RNA, 16 nt, Escherichia coli CFT073
gcccgcguagagaaaa

SEQ ID NO: 616724 - RNA, 12 nt, Escherichia coli CFT073
gcccgcuccagc

SEQ ID NO: 616725 - RNA, 19 nt, Escherichia coli CFT073
gcccgcuugaaagcgggcu

SEQ ID NO: 616726 - RNA, 23 nt, Escherichia coli CFT073
gcccgcuucaaacgcugacggug

SEQ ID NO: 616727 - RNA, 16 nt, Escherichia coli CFT073
gcccggcauucaccuc

SEQ ID NO: 616728 - RNA, 19 nt, Escherichia coli CFT073
gcccggcaagugucgccug

SEQ ID NO: 616729 - RNA, 21 nt, Escherichia coli CFT073
gcccggcaauacacgccgggc

SEQ ID NO: 616730 - RNA, 23 nt, Escherichia coli CFT073
gcccggcaauacacgccgggcag

SEQ ID NO: 616731 - RNA, 15 nt, Escherichia coli CFT073
gcccggcaacaacag

SEQ ID NO: 616732 - RNA, 16 nt, Escherichia coli CFT073
gcccggcaccagcacc

SEQ ID NO: 616733 - RNA, 16 nt, Escherichia coli CFT073
gcccggauuaagucua

SEQ ID NO: 616734 - RNA, 15 nt, Escherichia coli CFT073
gcccggacuagcgcu

SEQ ID NO: 616735 - RNA, 17 nt, Escherichia coli CFT073
gcccggagccaucccug

SEQ ID NO: 616736 - RNA, 15 nt, Escherichia coli CFT073
gcccggcguggugca

SEQ ID NO: 616737 - RNA, 17 nt, Escherichia coli CFT073
gcccggcguggugcagc

SEQ ID NO: 616738 - RNA, 20 nt, Escherichia coli CFT073
gcccggcguggugcagccgc

SEQ ID NO: 616739 - RNA, 15 nt, Escherichia coli CFT073
gcgcgaucuuccucu

SEQ ID NO: 616740 - RNA, 13 nt, Escherichia coli CFT073
gcgccuguugauu

SEQ ID NO: 616741 - RNA, 19 nt, Escherichia coli CFT073
gcgccuucgugcggcugca

SEQ ID NO: 616742 - RNA, 14 nt, Escherichia coli CFT073
gcgcgaaccagaga

SEQ ID NO: 616743 - RNA, 22 nt, Escherichia coli CFT073
gcgcgaaaacgcauaucuucug

SEQ ID NO: 616744 - RNA, 18 nt, Escherichia coli CFT073
gcgcgaaauagcccgguu

SEQ ID NO: 616745 - RNA, 13 nt, Escherichia coli CFT073
gcgcgaccaaugu

SEQ ID NO: 616746 - RNA, 19 nt, Escherichia coli CFT073
gcgcgaccaaugucagggc

SEQ ID NO: 616747 - RNA, 21 nt, Escherichia coli CFT073
gcgccuuuuuucgccgcagca

SEQ ID NO: 616748 - RNA, 18 nt, Escherichia coli CFT073
gcgcgaaaacaacuggca

SEQ ID NO: 616749 - RNA, 13 nt, Escherichia coli CFT073
gcgccuuuauaag

SEQ ID NO: 616750 - RNA, 23 nt, Escherichia coli CFT073
gcgccuuugaugccaccaggcag

SEQ ID NO: 616751 - RNA, 24 nt, Escherichia coli CFT073
gcgccuuugaugccaccaggcagc

SEQ ID NO: 616752 - RNA, 19 nt, Escherichia coli CFT073
gcgcggcaauggucccuug

SEQ ID NO: 616753 - RNA, 18 nt, Escherichia coli CFT073
gcgcggauuucggcggcu

SEQ ID NO: 616754 - RNA, 16 nt, Escherichia coli CFT073
gcgcggcgcaggcgcu

SEQ ID NO: 616755 - RNA, 17 nt, Escherichia coli CFT073
gcgcggcauuacgcccg

SEQ ID NO: 616756 - RNA, 12 nt, Escherichia coli CFT073
gcgccucaggca

SEQ ID NO: 616757 - RNA, 23 nt, Escherichia coli CFT073
gcgccucaguuucgacaccuuca

SEQ ID NO: 616758 - RNA, 21 nt, Escherichia coli CFT073
gcgccucaaaauaaggcugcc

SEQ ID NO: 616759 - RNA, 24 nt, Escherichia coli CFT073
gcgccucaaaauaaggcugccagu

SEQ ID NO: 616760 - RNA, 23 nt, Escherichia coli CFT073
gcgccuauaaggcucucuuacca

SEQ ID NO: 616761 - RNA, 22 nt, Escherichia coli CFT073
gcgccucaacgccuaaugccag

SEQ ID NO: 616762 - RNA, 19 nt, Escherichia coli CFT073
gcgccguuucagccagaga

SEQ ID NO: 616763 - RNA, 22 nt, Escherichia coli CFT073
gcgccuguguuuuuacgcaggc

SEQ ID NO: 616764 - RNA, 20 nt, Escherichia coli CFT073
gcgccuggguguauuguucc

SEQ ID NO: 616765 - RNA, 18 nt, Escherichia coli CFT073
gcgccugcggccagcagc

SEQ ID NO: 616766 - RNA, 22 nt, Escherichia coli CFT073
gcgccugcggccagcagcugua

SEQ ID NO: 616767 - RNA, 18 nt, Escherichia coli CFT073
gcgccugcagucagccag

SEQ ID NO: 616768 - RNA, 21 nt, Escherichia coli CFT073
gcgccugcagcggccaguagc

SEQ ID NO: 616769 - RNA, 22 nt, Escherichia coli CFT073
gcgccugcagcugcagauaacu

SEQ ID NO: 616770 - RNA, 13 nt, Escherichia coli CFT073
gcgccucuuccag

SEQ ID NO: 616771 - RNA, 17 nt, Escherichia coli CFT073
gcgccguccacaaaccg

SEQ ID NO: 616772 - RNA, 16 nt, Escherichia coli CFT073
gcgccgggaaugccac

SEQ ID NO: 616773 - RNA, 22 nt, Escherichia coli CFT073
gcgccccuggucauaggcugcc

SEQ ID NO: 616774 - RNA, 12 nt, Escherichia coli CFT073
gcgccccacgga

SEQ ID NO: 616775 - RNA, 18 nt, Escherichia coli CFT073
gcgcccagcucuuuaccu

SEQ ID NO: 616776 - RNA, 18 nt, Escherichia coli CFT073
gcgcccaguuucuucagg

SEQ ID NO: 616777 - RNA, 16 nt, Escherichia coli CFT073
gcgcccguaaaccaag

SEQ ID NO: 616778 - RNA, 18 nt, Escherichia coli CFT073
gcgcccguaaaccaagcu

SEQ ID NO: 616779 - RNA, 19 nt, Escherichia coli CFT073
gcgcccgcuuuucgccagu

SEQ ID NO: 616780 - RNA, 17 nt, Escherichia coli CFT073
gcgccaucaaugugcug

SEQ ID NO: 616781 - RNA, 23 nt, Escherichia coli CFT073
gcgccaucaguguuggcggcaga

SEQ ID NO: 616782 - RNA, 17 nt, Escherichia coli CFT073
gcgccaucgguagcacc

SEQ ID NO: 616783 - RNA, 14 nt, Escherichia coli CFT073
gcgccaucgccagg

SEQ ID NO: 616784 - RNA, 15 nt, Escherichia coli CFT073
gcgccaucgccagga

SEQ ID NO: 616785 - RNA, 23 nt, Escherichia coli CFT073
gcgccauuacccggugccgccgu

SEQ ID NO: 616786 - RNA, 14 nt, Escherichia coli CFT073
gcgccauuuuucac

SEQ ID NO: 616787 - RNA, 14 nt, Escherichia coli CFT073
gcgcccaaccagca

SEQ ID NO: 616788 - RNA, 21 nt, Escherichia coli CFT073
gcgccagcgucgcauccggca

SEQ ID NO: 616789 - RNA, 16 nt, Escherichia coli CFT073
gcgccagcuaccagaa

SEQ ID NO: 616790 - RNA, 21 nt, Escherichia coli CFT073
gcgccaggcuucauacaccac

SEQ ID NO: 616791 - RNA, 16 nt, Escherichia coli CFT073
gcgccaguaccgccgc

SEQ ID NO: 616792 - RNA, 22 nt, Escherichia coli CFT073
gcgccaguugcuuauccagcac

SEQ ID NO: 616793 - RNA, 21 nt, Escherichia coli CFT073
gcgccagguguuuaaccaaca

SEQ ID NO: 616794 - RNA, 19 nt, Escherichia coli CFT073
gcgccaggcgcugaacuuc

SEQ ID NO: 616795 - RNA, 13 nt, Escherichia coli CFT073
gcgccgccaaccc

SEQ ID NO: 616796 - RNA, 18 nt, Escherichia coli CFT073
gcgccgccagccacaggc

SEQ ID NO: 616797 - RNA, 20 nt, Escherichia coli CFT073
gcgccgcaacuaccagcagu

SEQ ID NO: 616798 - RNA, 20 nt, Escherichia coli CFT073
gcgcccuggcccauugccag

SEQ ID NO: 616799 - RNA, 12 nt, Escherichia coli CFT073
gcgcccuguucu

SEQ ID NO: 616800 - RNA, 16 nt, Escherichia coli CFT073
gcgccgaagcugacca

SEQ ID NO: 616801 - RNA, 19 nt, Escherichia coli CFT073
gcgccgacugcgccaauac

SEQ ID NO: 616802 - RNA, 14 nt, Escherichia coli CFT073
gcgccgcucggugc

SEQ ID NO: 616803 - RNA, 16 nt, Escherichia coli CFT073
gcgccgcucggugcgc

SEQ ID NO: 616804 - RNA, 13 nt, Escherichia coli CFT073
gcgccgcugagaa

SEQ ID NO: 616805 - RNA, 17 nt, Escherichia coli CFT073
gcgccggaauauauuca

SEQ ID NO: 616806 - RNA, 18 nt, Escherichia coli CFT073
gcgccggaaaccagcggc

SEQ ID NO: 616807 - RNA, 16 nt, Escherichia coli CFT073
gcgccgccucagccag

SEQ ID NO: 616808 - RNA, 10 nt, Escherichia coli CFT073
gcgccgccgc

SEQ ID NO: 616809 - RNA, 14 nt, Escherichia coli CFT073
gcgggaccagcacg

SEQ ID NO: 616810 - RNA, 19 nt, Escherichia coli CFT073
gcgggcgaucauauccagc

SEQ ID NO: 616811 - RNA, 14 nt, Escherichia coli CFT073
gcggcuucugccag

SEQ ID NO: 616812 - RNA, 15 nt, Escherichia coli CFT073
gcggcuugcaccagc

SEQ ID NO: 616813 - RNA, 12 nt, Escherichia coli CFT073
gcggcuggcgca

SEQ ID NO: 616814 - RNA, 17 nt, Escherichia coli CFT073
gcggcugcgccuguggu

SEQ ID NO: 616815 - RNA, 12 nt, Escherichia coli CFT073
gcggcugcgcag

SEQ ID NO: 616816 - RNA, 13 nt, Escherichia coli CFT073
gcggcugcgcagc

SEQ ID NO: 616817 - RNA, 21 nt, Escherichia coli CFT073
gcggcugacugcuucgcacag

SEQ ID NO: 616818 - RNA, 11 nt, Escherichia coli CFT073
gcggcuccaga

SEQ ID NO: 616819 - RNA, 13 nt, Escherichia coli CFT073
gcggcuccagaau

SEQ ID NO: 616820 - RNA, 20 nt, Escherichia coli CFT073
gcgggcgcaaugcccgcagu

SEQ ID NO: 616821 - RNA, 16 nt, Escherichia coli CFT073
gcggggauaugguggu

SEQ ID NO: 616822 - RNA, 16 nt, Escherichia coli CFT073
gcgguaaaauggucag

SEQ ID NO: 616823 - RNA, 13 nt, Escherichia coli CFT073
gcgguaaauuuuu

SEQ ID NO: 616824 - RNA, 14 nt, Escherichia coli CFT073
gcgguaacgccauc

SEQ ID NO: 616825 - RNA, 21 nt, Escherichia coli CFT073
gcgguaacuccggcauaauaa

SEQ ID NO: 616826 - RNA, 19 nt, Escherichia coli CFT073
gcgggucaaucggcgcgag

SEQ ID NO: 616827 - RNA, 22 nt, Escherichia coli CFT073
gcggguaucguuaaagagauca

SEQ ID NO: 616828 - RNA, 14 nt, Escherichia coli CFT073
gcggcgcaugcagg

SEQ ID NO: 616829 - RNA, 16 nt, Escherichia coli CFT073
gcggcgcauucaccag

SEQ ID NO: 616830 - RNA, 17 nt, Escherichia coli CFT073
gcggcgcauucaccagc

SEQ ID NO: 616831 - RNA, 13 nt, Escherichia coli CFT073
gcggcgcggcggg

SEQ ID NO: 616832 - RNA, 13 nt, Escherichia coli CFT073
gcggcggcgaccu

SEQ ID NO: 616833 - RNA, 11 nt, Escherichia coli CFT073
gcggcggcaga

SEQ ID NO: 616834 - RNA, 23 nt, Escherichia coli CFT073
gcggcggguuaaccagcaccagc

SEQ ID NO: 616835 - RNA, 20 nt, Escherichia coli CFT073
gcggcgguaaaaucauccug

SEQ ID NO: 616836 - RNA, 16 nt, Escherichia coli CFT073
gcggcguugccgaucg

SEQ ID NO: 616837 - RNA, 14 nt, Escherichia coli CFT073
gcggcuaucccaaa

SEQ ID NO: 616838 - RNA, 22 nt, Escherichia coli CFT073
gcggcuacugauguucgccaga

SEQ ID NO: 616839 - RNA, 15 nt, Escherichia coli CFT073
gcggcuauucaccac

SEQ ID NO: 616840 - RNA, 22 nt, Escherichia coli CFT073
gcggcuccagacgcccgcgccc

SEQ ID NO: 616841 - RNA, 16 nt, Escherichia coli CFT073
gcggcguagggcaggc

SEQ ID NO: 616842 - RNA, 14 nt, Escherichia coli CFT073
gcggaccagcgggc

SEQ ID NO: 616843 - RNA, 21 nt, Escherichia coli CFT073
gcggacgcacauagcgugaca

SEQ ID NO: 616844 - RNA, 15 nt, Escherichia coli CFT073
gcggacgugcaccgu

SEQ ID NO: 616845 - RNA, 13 nt, Escherichia coli CFT073
gcggcaaaacccu

SEQ ID NO: 616846 - RNA, 20 nt, Escherichia coli CFT073
gcggcaacggaaaaaccccg

SEQ ID NO: 616847 - RNA, 20 nt, Escherichia coli CFT073
gcggcacccauuuauccagc

SEQ ID NO: 616848 - RNA, 21 nt, Escherichia coli CFT073
gcggcagcuuguacugcucgc

SEQ ID NO: 616849 - RNA, 20 nt, Escherichia coli CFT073
gcggcagcgucgcauccaac

SEQ ID NO: 616850 - RNA, 14 nt, Escherichia coli CFT073
gcggcagcuccagc

SEQ ID NO: 616851 - RNA, 14 nt, Escherichia coli CFT073
gcggcaucuucucc

SEQ ID NO: 616852 - RNA, 17 nt, Escherichia coli CFT073
gcggcauuuccagaccu

SEQ ID NO: 616853 - RNA, 18 nt, Escherichia coli CFT073
gcggcauuucgccgagca

SEQ ID NO: 616854 - RNA, 16 nt, Escherichia coli CFT073
gcggcauuacgcccga

SEQ ID NO: 616855 - RNA, 23 nt, Escherichia coli CFT073
gcggcauuacgcgccucuuccag

SEQ ID NO: 616856 - RNA, 12 nt, Escherichia coli CFT073
gcgcuuuuucuu

SEQ ID NO: 616857 - RNA, 14 nt, Escherichia coli CFT073
gcgcuuaucgccag

SEQ ID NO: 616858 - RNA, 19 nt, Escherichia coli CFT073
gcggaaacagcggcugcuu

SEQ ID NO: 616859 - RNA, 16 nt, Escherichia coli CFT073
gcgcugugagcaggcg

SEQ ID NO: 616860 - RNA, 19 nt, Escherichia coli CFT073
gcgcuuaacgcgggcuucu

SEQ ID NO: 616861 - RNA, 20 nt, Escherichia coli CFT073
gcgcuuaaucaauugcagga

SEQ ID NO: 616862 - RNA, 21 nt, Escherichia coli CFT073
gcgcuuaaucaauugcaggaa

SEQ ID NO: 616863 - RNA, 16 nt, Escherichia coli CFT073
gcggaagaccugacug

SEQ ID NO: 616864 - RNA, 14 nt, Escherichia coli CFT073
gcggaaccgcaggc

SEQ ID NO: 616865 - RNA, 16 nt, Escherichia coli CFT073
gcggaaaucuccagau

SEQ ID NO: 616866 - RNA, 16 nt, Escherichia coli CFT073
gcggaaaugcagaggc

SEQ ID NO: 616867 - RNA, 18 nt, Escherichia coli CFT073
gcgcugguaaucaccacc

SEQ ID NO: 616868 - RNA, 18 nt, Escherichia coli CFT073
gcgcuggcgaucguccag

SEQ ID NO: 616869 - RNA, 11 nt, Escherichia coli CFT073
gcgcuggcgca

SEQ ID NO: 616870 - RNA, 13 nt, Escherichia coli CFT073
gcgcucuucuuca

SEQ ID NO: 616871 - RNA, 12 nt, Escherichia coli CFT073
gcgcucgcugau

SEQ ID NO: 616872 - RNA, 18 nt, Escherichia coli CFT073
gcgcucgccguaggccau

SEQ ID NO: 616873 - RNA, 15 nt, Escherichia coli CFT073
gcgcucgacuuuagu

SEQ ID NO: 616874 - RNA, 15 nt, Escherichia coli CFT073
gcgcugcgucuucca

SEQ ID NO: 616875 - RNA, 12 nt, Escherichia coli CFT073
gcgcugcucagg

SEQ ID NO: 616876 - RNA, 16 nt, Escherichia coli CFT073
gcgcugcucaggcgac

SEQ ID NO: 616877 - RNA, 16 nt, Escherichia coli CFT073
gcgcugauucuuccca

SEQ ID NO: 616878 - RNA, 17 nt, Escherichia coli CFT073
gcgauauccgggcaaaa

SEQ ID NO: 616879 - RNA, 14 nt, Escherichia coli CFT073
gcgaucguccagcu

SEQ ID NO: 616880 - RNA, 23 nt, Escherichia coli CFT073
gcgauaucaguuauugacgccgu

SEQ ID NO: 616881 - RNA, 16 nt, Escherichia coli CFT073
gcgauaacgccccaau

SEQ ID NO: 616882 - RNA, 18 nt, Escherichia coli CFT073
gcgauaacguguuccagu

SEQ ID NO: 616883 - RNA, 12 nt, Escherichia coli CFT073
gcgauaaccagg

SEQ ID NO: 616884 - RNA, 13 nt, Escherichia coli CFT073
gcgauaaccgcac

SEQ ID NO: 616885 - RNA, 17 nt, Escherichia coli CFT073
gcgauaaccgcaccuuc

SEQ ID NO: 616886 - RNA, 22 nt, Escherichia coli CFT073
gcgauaaccuucaccgugaaug

SEQ ID NO: 616887 - RNA, 12 nt, Escherichia coli CFT073
gcgauaaaacuu

SEQ ID NO: 616888 - RNA, 21 nt, Escherichia coli CFT073
gcgagccgucgcuaucgaugc

SEQ ID NO: 616889 - RNA, 13 nt, Escherichia coli CFT073
gcgagcuggcgcu

SEQ ID NO: 616890 - RNA, 23 nt, Escherichia coli CFT073
gcgagcuuucgaccagccaggcc

SEQ ID NO: 616891 - RNA, 17 nt, Escherichia coli CFT073
gcgagcuuucgaccagc

SEQ ID NO: 616892 - RNA, 23 nt, Escherichia coli CFT073
gcgagugugauuacagccaggcg

SEQ ID NO: 616893 - RNA, 12 nt, Escherichia coli CFT073
gcgacucuccug

SEQ ID NO: 616894 - RNA, 14 nt, Escherichia coli CFT073
gcgagcaucgcgag

SEQ ID NO: 616895 - RNA, 19 nt, Escherichia coli CFT073
gcgagacuccgccgccauu

SEQ ID NO: 616896 - RNA, 15 nt, Escherichia coli CFT073
gcgacguugcuucuc

SEQ ID NO: 616897 - RNA, 15 nt, Escherichia coli CFT073
gcgacggacgcccgc

SEQ ID NO: 616898 - RNA, 23 nt, Escherichia coli CFT073
gcgaaggcaucggcaacgaaaua

SEQ ID NO: 616899 - RNA, 15 nt, Escherichia coli CFT073
gcgaagcuggucagc

SEQ ID NO: 616900 - RNA, 12 nt, Escherichia coli CFT073
gcgaagugcaga

SEQ ID NO: 616901 - RNA, 13 nt, Escherichia coli CFT073
gcgauuaauaaaa

SEQ ID NO: 616902 - RNA, 17 nt, Escherichia coli CFT073
gcgauuaugaaacaaga

SEQ ID NO: 616903 - RNA, 21 nt, Escherichia coli CFT073
gcgauuauuuauucccgccag

SEQ ID NO: 616904 - RNA, 14 nt, Escherichia coli CFT073
gcgauucaaauucg

SEQ ID NO: 616905 - RNA, 17 nt, Escherichia coli CFT073
gcgauucagcaacauca

SEQ ID NO: 616906 - RNA, 21 nt, Escherichia coli CFT073
gcgauucauaugcgccagcug

SEQ ID NO: 616907 - RNA, 23 nt, Escherichia coli CFT073
gcgauuucacaagacuguaaaua

SEQ ID NO: 616908 - RNA, 23 nt, Escherichia coli CFT073
gcgauugcuguuggcguugcacc

SEQ ID NO: 616909 - RNA, 13 nt, Escherichia coli CFT073
gcgcaaaggccag

SEQ ID NO: 616910 - RNA, 16 nt, Escherichia coli CFT073
gcgcaaagcccgccgc

SEQ ID NO: 616911 - RNA, 20 nt, Escherichia coli CFT073
gcgauuuucuacuucuuuca

SEQ ID NO: 616912 - RNA, 22 nt, Escherichia coli CFT073
gcgcaaaaaacuaucccaucag

SEQ ID NO: 616913 - RNA, 23 nt, Escherichia coli CFT073
gcgcaaaaaacuaucccaucagc

SEQ ID NO: 616914 - RNA, 18 nt, Escherichia coli CFT073
gcgauggcgggaucgccg

SEQ ID NO: 616915 - RNA, 16 nt, Escherichia coli CFT073
gcgauggcuuuccacc

SEQ ID NO: 616916 - RNA, 16 nt, Escherichia coli CFT073
gcgauggcggcagccu

SEQ ID NO: 616917 - RNA, 24 nt, Escherichia coli CFT073
gcgauggaagagguguaauacguu

SEQ ID NO: 616918 - RNA, 17 nt, Escherichia coli CFT073
gcgauggacgcagacca

SEQ ID NO: 616919 - RNA, 14 nt, Escherichia coli CFT073
gcgaugcaaaauca

SEQ ID NO: 616920 - RNA, 15 nt, Escherichia coli CFT073
gcgaugaucgccgcc

SEQ ID NO: 616921 - RNA, 15 nt, Escherichia coli CFT073
gcgcaaucagcaccg

SEQ ID NO: 616922 - RNA, 16 nt, Escherichia coli CFT073
gcgcaauacgcgcaga

SEQ ID NO: 616923 - RNA, 20 nt, Escherichia coli CFT073
gcgcaaguuuauguaguguu

SEQ ID NO: 616924 - RNA, 22 nt, Escherichia coli CFT073
gcgcaaucgcuguacucaccaa

SEQ ID NO: 616925 - RNA, 21 nt, Escherichia coli CFT073
gcgcaaucguaugaucauccg

SEQ ID NO: 616926 - RNA, 16 nt, Escherichia coli CFT073
gcgcaaaggccagcaa

SEQ ID NO: 616927 - RNA, 15 nt, Escherichia coli CFT073
gcgcaaauugcuggu

SEQ ID NO: 616928 - RNA, 14 nt, Escherichia coli CFT073
gcgcaacagcgcgc

SEQ ID NO: 616929 - RNA, 15 nt, Escherichia coli CFT073
gcgcaacagcgcgcc

SEQ ID NO: 616930 - RNA, 17 nt, Escherichia coli CFT073
gcgcaaugcccgcagua

SEQ ID NO: 616931 - RNA, 14 nt, Escherichia coli CFT073
gcgcaauguugcug

SEQ ID NO: 616932 - RNA, 13 nt, Escherichia coli CFT073
gcgcacaucagga

SEQ ID NO: 616933 - RNA, 20 nt, Escherichia coli CFT073
gcgcagacaccagaauagug

SEQ ID NO: 616934 - RNA, 17 nt, Escherichia coli CFT073
gcgcacucuacucccug

SEQ ID NO: 616935 - RNA, 19 nt, Escherichia coli CFT073
gcgcacucuacucccugcu

SEQ ID NO: 616936 - RNA, 13 nt, Escherichia coli CFT073
gcgcacuggcgcu

SEQ ID NO: 616937 - RNA, 16 nt, Escherichia coli CFT073
gcgcacgccaacaaaa

SEQ ID NO: 616938 - RNA, 14 nt, Escherichia coli CFT073
gcgcaccuuuacca

SEQ ID NO: 616939 - RNA, 21 nt, Escherichia coli CFT073
gcgcaccuucauucaggccaa

SEQ ID NO: 616940 - RNA, 19 nt, Escherichia coli CFT073
gcgcagauuaauugggcga

SEQ ID NO: 616941 - RNA, 20 nt, Escherichia coli CFT073
gcgcagcaaggucaggcgaa

SEQ ID NO: 616942 - RNA, 17 nt, Escherichia coli CFT073
gcgcagcacggugcggg

SEQ ID NO: 616943 - RNA, 22 nt, Escherichia coli CFT073
gcgcagugugcgaugcucgccg

SEQ ID NO: 616944 - RNA, 19 nt, Escherichia coli CFT073
gcgcaguucgcacaccgcu

SEQ ID NO: 616945 - RNA, 18 nt, Escherichia coli CFT073
gcgcaggggcagaaacaa

SEQ ID NO: 616946 - RNA, 23 nt, Escherichia coli CFT073
gcgcaggguuugcaucgccauga

SEQ ID NO: 616947 - RNA, 23 nt, Escherichia coli CFT073
gcgcagcuuccggccagcaugcc

SEQ ID NO: 616948 - RNA, 22 nt, Escherichia coli CFT073
gcgcaggcaagccuugcagcca

SEQ ID NO: 616949 - RNA, 16 nt, Escherichia coli CFT073
gcgcaggagcggcgga

SEQ ID NO: 616950 - RNA, 17 nt, Escherichia coli CFT073
gcgcaggagcggcggag

SEQ ID NO: 616951 - RNA, 19 nt, Escherichia coli CFT073
gcgccagagcgcggcguga

SEQ ID NO: 616952 - RNA, 18 nt, Escherichia coli CFT073
gcgccagaaagguauuua

SEQ ID NO: 616953 - RNA, 22 nt, Escherichia coli CFT073
gcgccagaaaguuuuucaacac

SEQ ID NO: 616954 - RNA, 19 nt, Escherichia coli CFT073
gcgccaccucuuucaccaa

SEQ ID NO: 616955 - RNA, 11 nt, Escherichia coli CFT073
gcgccagcaag

SEQ ID NO: 616956 - RNA, 18 nt, Escherichia coli CFT073
gcgccagcaaaucagcca

SEQ ID NO: 616957 - RNA, 23 nt, Escherichia coli CFT073
gcgccagcaaaucagccauugcu

SEQ ID NO: 616958 - RNA, 22 nt, Escherichia coli CFT073
gcgccagcaagagcaaauaaaa

SEQ ID NO: 616959 - RNA, 14 nt, Escherichia coli CFT073
gcgccagcacaccc

SEQ ID NO: 616960 - RNA, 13 nt, Escherichia coli CFT073
gcgccagccagcc

SEQ ID NO: 616961 - RNA, 21 nt, Escherichia coli CFT073
gcgccagcaucgcauccggca

SEQ ID NO: 616962 - RNA, 22 nt, Escherichia coli CFT073
gcgccagcaucgcauccggcaa

SEQ ID NO: 616963 - RNA, 17 nt, Escherichia coli CFT073
gcgccagcggccagcgc

SEQ ID NO: 616964 - RNA, 21 nt, Escherichia coli CFT073
gcgcauaguuuuuugggauga

SEQ ID NO: 616965 - RNA, 23 nt, Escherichia coli CFT073
gcgcauaagaccgugagcaaugc

SEQ ID NO: 616966 - RNA, 21 nt, Escherichia coli CFT073
gcgcauaaaagcuguacaucg

SEQ ID NO: 616967 - RNA, 19 nt, Escherichia coli CFT073
gcgcauccaguuccuucaa

SEQ ID NO: 616968 - RNA, 13 nt, Escherichia coli CFT073
gcgcaucagcaga

SEQ ID NO: 616969 - RNA, 14 nt, Escherichia coli CFT073
gcgcaugcaggcau

SEQ ID NO: 616970 - RNA, 21 nt, Escherichia coli CFT073
gcgcaucgggcgauucgaugu

SEQ ID NO: 616971 - RNA, 15 nt, Escherichia coli CFT073
gcgcauccgccagca

SEQ ID NO: 616972 - RNA, 13 nt, Escherichia coli CFT073
gcgccaaacugcc

SEQ ID NO: 616973 - RNA, 19 nt, Escherichia coli CFT073
gcgccaagcccguguuucu

SEQ ID NO: 616974 - RNA, 13 nt, Escherichia coli CFT073
gcgcauggcggca

SEQ ID NO: 616975 - RNA, 18 nt, Escherichia coli CFT073
gcgcauuaacucacuggc

SEQ ID NO: 616976 - RNA, 16 nt, Escherichia coli CFT073
gcgcauuaccucaaua

SEQ ID NO: 616977 - RNA, 17 nt, Escherichia coli CFT073
gcgcauguuggcgcggu

SEQ ID NO: 616978 - RNA, 23 nt, Escherichia coli CFT073
gcgcauuaaauaccaagccaagc

SEQ ID NO: 616979 - RNA, 19 nt, Escherichia coli CFT073
gcgcauuugcggcagagca

SEQ ID NO: 616980 - RNA, 17 nt, Escherichia coli CFT073
gcgcauuucccagcaag

SEQ ID NO: 616981 - RNA, 19 nt, Escherichia coli CFT073
gcgcauuucccagcaagaa

SEQ ID NO: 616982 - RNA, 12 nt, Escherichia coli CFT073
gcgcauugacga

SEQ ID NO: 616983 - RNA, 12 nt, Escherichia coli CFT073
gcgaaauaauca

SEQ ID NO: 616984 - RNA, 14 nt, Escherichia coli CFT073
gcgaaccagagaca

SEQ ID NO: 616985 - RNA, 22 nt, Escherichia coli CFT073
gcgaacaucgagugcggcgagc

SEQ ID NO: 616986 - RNA, 22 nt, Escherichia coli CFT073
gcgaaccgggcuuuguuuuggg

SEQ ID NO: 616987 - RNA, 16 nt, Escherichia coli CFT073
gcgaaccuugcgcggu

SEQ ID NO: 616988 - RNA, 23 nt, Escherichia coli CFT073
gcgaaccuugcgcgguguugaua

SEQ ID NO: 616989 - RNA, 13 nt, Escherichia coli CFT073
gcgaacuaaacaa

SEQ ID NO: 616990 - RNA, 14 nt, Escherichia coli CFT073
gcgaacuaaacaac

SEQ ID NO: 616991 - RNA, 22 nt, Escherichia coli CFT073
gccuugaguuuuucaucccucu

SEQ ID NO: 616992 - RNA, 20 nt, Escherichia coli CFT073
gccuugaguaccgagaaaau

SEQ ID NO: 616993 - RNA, 21 nt, Escherichia coli CFT073
gccuucgcaaaaaaccauccc

SEQ ID NO: 616994 - RNA, 15 nt, Escherichia coli CFT073
gccuucgccuuucag

SEQ ID NO: 616995 - RNA, 21 nt, Escherichia coli CFT073
gccuuuauuaaugacauucag

SEQ ID NO: 616996 - RNA, 17 nt, Escherichia coli CFT073
gccuuuauuaaugacau

SEQ ID NO: 616997 - RNA, 20 nt, Escherichia coli CFT073
gccuuucagccccagcgcaa

SEQ ID NO: 616998 - RNA, 18 nt, Escherichia coli CFT073
gccuuucuuuguucuucu

SEQ ID NO: 616999 - RNA, 23 nt, Escherichia coli CFT073
gccuuucacgccgggaaauuuuu

SEQ ID NO: 617000 - RNA, 13 nt, Escherichia coli CFT073
gccuuucagauca

SEQ ID NO: 617001 - RNA, 15 nt, Escherichia coli CFT073
gccuuuggcaccguu

SEQ ID NO: 617002 - RNA, 17 nt, Escherichia coli CFT073
gccuuugacuauuucau

SEQ ID NO: 617003 - RNA, 14 nt, Escherichia coli CFT073
gccuuugaugccac

SEQ ID NO: 617004 - RNA, 15 nt, Escherichia coli CFT073
gccucugccgcaaug

SEQ ID NO: 617005 - RNA, 13 nt, Escherichia coli CFT073
gccucuuccagua

SEQ ID NO: 617006 - RNA, 16 nt, Escherichia coli CFT073
gccucuucuaaaucgu

SEQ ID NO: 617007 - RNA, 13 nt, Escherichia coli CFT073
gccucuucucucg

SEQ ID NO: 617008 - RNA, 22 nt, Escherichia coli CFT073
gccucuucucucgcucaugcca

SEQ ID NO: 617009 - RNA, 17 nt, Escherichia coli CFT073
gccucuucuuuugccug

SEQ ID NO: 617010 - RNA, 16 nt, Escherichia coli CFT073
gccugccgcauccggc

SEQ ID NO: 617011 - RNA, 22 nt, Escherichia coli CFT073
gccugcccgugggcaggccagg

SEQ ID NO: 617012 - RNA, 23 nt, Escherichia coli CFT073
gccuggcgaaaggaggcauugaa

SEQ ID NO: 617013 - RNA, 21 nt, Escherichia coli CFT073
gccugcuucagugagcugucu

SEQ ID NO: 617014 - RNA, 13 nt, Escherichia coli CFT073
gccugcugguugc

SEQ ID NO: 617015 - RNA, 22 nt, Escherichia coli CFT073
gccugcuggcuagccucccugc

SEQ ID NO: 617016 - RNA, 18 nt, Escherichia coli CFT073
gccugcugcgucgcggcc

SEQ ID NO: 617017 - RNA, 16 nt, Escherichia coli CFT073
gccugcugcacagagc

SEQ ID NO: 617018 - RNA, 17 nt, Escherichia coli CFT073
gccugcugcacagagcu

SEQ ID NO: 617019 - RNA, 18 nt, Escherichia coli CFT073
gccugcggcgaucuucaa

SEQ ID NO: 617020 - RNA, 16 nt, Escherichia coli CFT073
gccugcggcgcaugca

SEQ ID NO: 617021 - RNA, 14 nt, Escherichia coli CFT073
gccuguuucauagu

SEQ ID NO: 617022 - RNA, 15 nt, Escherichia coli CFT073
gccuuaaucuucacu

SEQ ID NO: 617023 - RNA, 19 nt, Escherichia coli CFT073
gccuucacaggccgccagg

SEQ ID NO: 617024 - RNA, 16 nt, Escherichia coli CFT073
gccuguucgccgccgc

SEQ ID NO: 617025 - RNA, 20 nt, Escherichia coli CFT073
gccugucaccgccuccaccu

SEQ ID NO: 617026 - RNA, 19 nt, Escherichia coli CFT073
gccugggggggaaacccac

SEQ ID NO: 617027 - RNA, 23 nt, Escherichia coli CFT073
gccugggugaugguccaguuaag

SEQ ID NO: 617028 - RNA, 14 nt, Escherichia coli CFT073
gccuggucaaagac

SEQ ID NO: 617029 - RNA, 20 nt, Escherichia coli CFT073
gccuggguuuucacagaagu

SEQ ID NO: 617030 - RNA, 17 nt, Escherichia coli CFT073
gccuggguuuucacaga

SEQ ID NO: 617031 - RNA, 13 nt, Escherichia coli CFT073
gccgcuugcgaua

SEQ ID NO: 617032 - RNA, 22 nt, Escherichia coli CFT073
gccggaaacauaaauaguggca

SEQ ID NO: 617033 - RNA, 15 nt, Escherichia coli CFT073
gccgcuuuuucugca

SEQ ID NO: 617034 - RNA, 14 nt, Escherichia coli CFT073
gccgcuuuaucuga

SEQ ID NO: 617035 - RNA, 20 nt, Escherichia coli CFT073
gccggaacauccacuaaccc

SEQ ID NO: 617036 - RNA, 15 nt, Escherichia coli CFT073
gccggaacgccgcug

SEQ ID NO: 617037 - RNA, 18 nt, Escherichia coli CFT073
gccggaacgccgcuggug

SEQ ID NO: 617038 - RNA, 22 nt, Escherichia coli CFT073
gccgucugccacuucuuccagc

SEQ ID NO: 617039 - RNA, 15 nt, Escherichia coli CFT073
gccgucuucuuccca

SEQ ID NO: 617040 - RNA, 13 nt, Escherichia coli CFT073
gccguggccgaga

SEQ ID NO: 617041 - RNA, 23 nt, Escherichia coli CFT073
gccguggagauuggcccgccaag

SEQ ID NO: 617042 - RNA, 16 nt, Escherichia coli CFT073
gccguguucuuaccca

SEQ ID NO: 617043 - RNA, 16 nt, Escherichia coli CFT073
gccguuaacuaacggu

SEQ ID NO: 617044 - RNA, 15 nt, Escherichia coli CFT073
gccguuauguugauu

SEQ ID NO: 617045 - RNA, 14 nt, Escherichia coli CFT073
gccguuccuggcac

SEQ ID NO: 617046 - RNA, 14 nt, Escherichia coli CFT073
gccguuccagauuc

SEQ ID NO: 617047 - RNA, 16 nt, Escherichia coli CFT073
gccguuugcugcauga

SEQ ID NO: 617048 - RNA, 14 nt, Escherichia coli CFT073
gccguuucaccacg

SEQ ID NO: 617049 - RNA, 19 nt, Escherichia coli CFT073
gccguuuaacacgcucugg

SEQ ID NO: 617050 - RNA, 20 nt, Escherichia coli CFT073
gccuacaaucccguugaaaa

SEQ ID NO: 617051 - RNA, 20 nt, Escherichia coli CFT073
gccuacaaguccguugaaau

SEQ ID NO: 617052 - RNA, 18 nt, Escherichia coli CFT073
gccuacgggaacagugcu

SEQ ID NO: 617053 - RNA, 21 nt, Escherichia coli CFT073
gccuacagaacgcugcaauuu

SEQ ID NO: 617054 - RNA, 20 nt, Escherichia coli CFT073
gccucccauucaucgccacc

SEQ ID NO: 617055 - RNA, 17 nt, Escherichia coli CFT073
gccuccccagcacgcuu

SEQ ID NO: 617056 - RNA, 16 nt, Escherichia coli CFT073
gccucaugugauggua

SEQ ID NO: 617057 - RNA, 14 nt, Escherichia coli CFT073
gccucaguggcugc

SEQ ID NO: 617058 - RNA, 23 nt, Escherichia coli CFT073
gccucaguggcugcguuucaugu

SEQ ID NO: 617059 - RNA, 12 nt, Escherichia coli CFT073
gccucgccgagc

SEQ ID NO: 617060 - RNA, 16 nt, Escherichia coli CFT073
gccucgccgaaacgcu

SEQ ID NO: 617061 - RNA, 21 nt, Escherichia coli CFT073
gccucuaacagaucauccauc

SEQ ID NO: 617062 - RNA, 14 nt, Escherichia coli CFT073
gccucgcuuugcca

SEQ ID NO: 617063 - RNA, 20 nt, Escherichia coli CFT073
ggucaucgguuaauuccagc

SEQ ID NO: 617064 - RNA, 23 nt, Escherichia coli CFT073
ggucaucacucuguuuuaacgca

SEQ ID NO: 617065 - RNA, 10 nt, Escherichia coli CFT073
ggucaucauc

SEQ ID NO: 617066 - RNA, 15 nt, Escherichia coli CFT073
ggucauaucaucaag

SEQ ID NO: 617067 - RNA, 13 nt, Escherichia coli CFT073
ggucauauugcca

SEQ ID NO: 617068 - RNA, 20 nt, Escherichia coli CFT073
ggucaucacaucccagcaga

SEQ ID NO: 617069 - RNA, 18 nt, Escherichia coli CFT073
gguccacacgcgcccagc

SEQ ID NO: 617070 - RNA, 16 nt, Escherichia coli CFT073
gguccgggcaucaaca

SEQ ID NO: 617071 - RNA, 17 nt, Escherichia coli CFT073
gguccaucacuugcugc

SEQ ID NO: 617072 - RNA, 19 nt, Escherichia coli CFT073
gguccaguuuuuaucauaa

SEQ ID NO: 617073 - RNA, 13 nt, Escherichia coli CFT073
ggucacugagccc

SEQ ID NO: 617074 - RNA, 17 nt, Escherichia coli CFT073
ggucacugacaccagca

SEQ ID NO: 617075 - RNA, 22 nt, Escherichia coli CFT073
ggucagagagccagccccacag

SEQ ID NO: 617076 - RNA, 19 nt, Escherichia coli CFT073
ggucacgguauuaauacuc

SEQ ID NO: 617077 - RNA, 15 nt, Escherichia coli CFT073
ggucaccggaacuuu

SEQ ID NO: 617078 - RNA, 15 nt, Escherichia coli CFT073
ggucaccggaucuuc

SEQ ID NO: 617079 - RNA, 12 nt, Escherichia coli CFT073
ggucaccacacc

SEQ ID NO: 617080 - RNA, 20 nt, Escherichia coli CFT073
ggucagccacaguugaucag

SEQ ID NO: 617081 - RNA, 23 nt, Escherichia coli CFT073
ggucagcagcuuucuuuauaucu

SEQ ID NO: 617082 - RNA, 16 nt, Escherichia coli CFT073
ggucagcaagaaacug

SEQ ID NO: 617083 - RNA, 14 nt, Escherichia coli CFT073
ggucugccaacuuu

SEQ ID NO: 617084 - RNA, 22 nt, Escherichia coli CFT073
ggucugacgcugaauacgcacc

SEQ ID NO: 617085 - RNA, 17 nt, Escherichia coli CFT073
ggucugcagacugaagc

SEQ ID NO: 617086 - RNA, 19 nt, Escherichia coli CFT073
ggucuucuuccgcgccaaa

SEQ ID NO: 617087 - RNA, 13 nt, Escherichia coli CFT073
ggucuugagcgga

SEQ ID NO: 617088 - RNA, 20 nt, Escherichia coli CFT073
ggucuuuuaaauccugcaca

SEQ ID NO: 617089 - RNA, 13 nt, Escherichia coli CFT073
ggugaaaaaccaa

SEQ ID NO: 617090 - RNA, 19 nt, Escherichia coli CFT073
ggugaaagcaaaaaagaag

SEQ ID NO: 617091 - RNA, 21 nt, Escherichia coli CFT073
ggucgugcgguuucagcucac

SEQ ID NO: 617092 - RNA, 22 nt, Escherichia coli CFT073
ggucgugacugccgccagcauu

SEQ ID NO: 617093 - RNA, 13 nt, Escherichia coli CFT073
ggucgugcagaac

SEQ ID NO: 617094 - RNA, 17 nt, Escherichia coli CFT073
ggucggguauacagaaa

SEQ ID NO: 617095 - RNA, 13 nt, Escherichia coli CFT073
ggucgcgcggaag

SEQ ID NO: 617096 - RNA, 16 nt, Escherichia coli CFT073
ggucgccagaagguga

SEQ ID NO: 617097 - RNA, 17 nt, Escherichia coli CFT073
ggucgauugucgcggcu

SEQ ID NO: 617098 - RNA, 15 nt, Escherichia coli CFT073
ggucgcaaacggcga

SEQ ID NO: 617099 - RNA, 17 nt, Escherichia coli CFT073
ggucgauggccggguga

SEQ ID NO: 617100 - RNA, 18 nt, Escherichia coli CFT073
ggucgcacugcucuuuuu

SEQ ID NO: 617101 - RNA, 16 nt, Escherichia coli CFT073
gguccuggcgaucggg

SEQ ID NO: 617102 - RNA, 14 nt, Escherichia coli CFT073
gguacaaacaucau

SEQ ID NO: 617103 - RNA, 11 nt, Escherichia coli CFT073
gguaccaggau

SEQ ID NO: 617104 - RNA, 15 nt, Escherichia coli CFT073
gguacucaucagaga

SEQ ID NO: 617105 - RNA, 22 nt, Escherichia coli CFT073
gguagagcacgaccuugccaag

SEQ ID NO: 617106 - RNA, 17 nt, Escherichia coli CFT073
gguacuguaucgaugcu

SEQ ID NO: 617107 - RNA, 22 nt, Escherichia coli CFT073
gguagacaccaaggaacugugc

SEQ ID NO: 617108 - RNA, 18 nt, Escherichia coli CFT073
gguaucuaucacuauaaa

SEQ ID NO: 617109 - RNA, 17 nt, Escherichia coli CFT073
gguaucuuuccagccug

SEQ ID NO: 617110 - RNA, 13 nt, Escherichia coli CFT073
gguauuaauacuc

SEQ ID NO: 617111 - RNA, 19 nt, Escherichia coli CFT073
gguauucaaccguuuccag

SEQ ID NO: 617112 - RNA, 14 nt, Escherichia coli CFT073
ggucaaaagcugca

SEQ ID NO: 617113 - RNA, 17 nt, Escherichia coli CFT073
ggucaaagugggcgaca

SEQ ID NO: 617114 - RNA, 17 nt, Escherichia coli CFT073
ggucaaauucaaaugcc

SEQ ID NO: 617115 - RNA, 18 nt, Escherichia coli CFT073
gguagcuggugaacauuu

SEQ ID NO: 617116 - RNA, 15 nt, Escherichia coli CFT073
gguagggauaucuuc

SEQ ID NO: 617117 - RNA, 11 nt, Escherichia coli CFT073
gguaguacuua

SEQ ID NO: 617118 - RNA, 18 nt, Escherichia coli CFT073
gguauaacuugccaggcc

SEQ ID NO: 617119 - RNA, 21 nt, Escherichia coli CFT073
gguauaacuugccaggccgau

SEQ ID NO: 617120 - RNA, 13 nt, Escherichia coli CFT073
gguauaaggagca

SEQ ID NO: 617121 - RNA, 15 nt, Escherichia coli CFT073
gguauaggccaugcu

SEQ ID NO: 617122 - RNA, 21 nt, Escherichia coli CFT073
gguaucaucccagccaaugca

SEQ ID NO: 617123 - RNA, 15 nt, Escherichia coli CFT073
gguaucgccacugcg

SEQ ID NO: 617124 - RNA, 17 nt, Escherichia coli CFT073
gguaucgcgaaaaaaaa

SEQ ID NO: 617125 - RNA, 18 nt, Escherichia coli CFT073
gguaucgcgccagccagu

SEQ ID NO: 617126 - RNA, 21 nt, Escherichia coli CFT073
gggugauuucaaaauuaaagc

SEQ ID NO: 617127 - RNA, 15 nt, Escherichia coli CFT073
gggugauaagcgagg

SEQ ID NO: 617128 - RNA, 19 nt, Escherichia coli CFT073
gggugaucaagcguagugg

SEQ ID NO: 617129 - RNA, 21 nt, Escherichia coli CFT073
ggguugcagcggagaucgcca

SEQ ID NO: 617130 - RNA, 20 nt, Escherichia coli CFT073
ggguuaucuuccagcggcca

SEQ ID NO: 617131 - RNA, 17 nt, Escherichia coli CFT073
ggguucgacgcgguuga

SEQ ID NO: 617132 - RNA, 19 nt, Escherichia coli CFT073
ggguucccgagcggccaaa

SEQ ID NO: 617133 - RNA, 15 nt, Escherichia coli CFT073
gguaaucgucagcau

SEQ ID NO: 617134 - RNA, 11 nt, Escherichia coli CFT073
gguaauucccu

SEQ ID NO: 617135 - RNA, 19 nt, Escherichia coli CFT073
gguaauugcccgcagaugu

SEQ ID NO: 617136 - RNA, 15 nt, Escherichia coli CFT073
gguaauaggcaggca

SEQ ID NO: 617137 - RNA, 18 nt, Escherichia coli CFT073
gguaaucagcuuauccag

SEQ ID NO: 617138 - RNA, 20 nt, Escherichia coli CFT073
gguaauccagcgucgccagc

SEQ ID NO: 617139 - RNA, 22 nt, Escherichia coli CFT073
gguaauacuaaucucacccaua

SEQ ID NO: 617140 - RNA, 20 nt, Escherichia coli CFT073
gguaauacccagacuuuuca

SEQ ID NO: 617141 - RNA, 17 nt, Escherichia coli CFT073
gguaauauauaacagaa

SEQ ID NO: 617142 - RNA, 13 nt, Escherichia coli CFT073
gguaauaaacgcc

SEQ ID NO: 617143 - RNA, 13 nt, Escherichia coli CFT073
gguaacggcagau

SEQ ID NO: 617144 - RNA, 15 nt, Escherichia coli CFT073
gguaacuucgcugau

SEQ ID NO: 617145 - RNA, 13 nt, Escherichia coli CFT073
gguaagcaacaga

SEQ ID NO: 617146 - RNA, 14 nt, Escherichia coli CFT073
gguaaagcccucac

SEQ ID NO: 617147 - RNA, 13 nt, Escherichia coli CFT073
gguaaaugcucau

SEQ ID NO: 617148 - RNA, 14 nt, Escherichia coli CFT073
gguaacaggaagaa

SEQ ID NO: 617149 - RNA, 20 nt, Escherichia coli CFT073
ggguuguugcacuauugcgu

SEQ ID NO: 617150 - RNA, 13 nt, Escherichia coli CFT073
ggguuuaauaauc

SEQ ID NO: 617151 - RNA, 14 nt, Escherichia coli CFT073
ggguuuucuacuuu

SEQ ID NO: 617152 - RNA, 11 nt, Escherichia coli CFT073
gguaaaaggga

SEQ ID NO: 617153 - RNA, 18 nt, Escherichia coli CFT073
gguaaaaccgacuuaaaa

SEQ ID NO: 617154 - RNA, 14 nt, Escherichia coli CFT073
gguaaaaccgguuu

SEQ ID NO: 617155 - RNA, 21 nt, Escherichia coli CFT073
gguaaaauggucagccagcgg

SEQ ID NO: 617156 - RNA, 19 nt, Escherichia coli CFT073
ggguaacacucuauccagc

SEQ ID NO: 617157 - RNA, 13 nt, Escherichia coli CFT073
ggguaauaaacca

SEQ ID NO: 617158 - RNA, 23 nt, Escherichia coli CFT073
ggguaaucagcuuauccagcaac

SEQ ID NO: 617159 - RNA, 21 nt, Escherichia coli CFT073
ggguaaucgucagcaucucug

SEQ ID NO: 617160 - RNA, 22 nt, Escherichia coli CFT073
gggguuuucucuuuccagcaac

SEQ ID NO: 617161 - RNA, 21 nt, Escherichia coli CFT073
ggguaaaaccccgcguacuga

SEQ ID NO: 617162 - RNA, 19 nt, Escherichia coli CFT073
ggguaaacacccaggccau

SEQ ID NO: 617163 - RNA, 15 nt, Escherichia coli CFT073
ggguaaucgccagca

SEQ ID NO: 617164 - RNA, 20 nt, Escherichia coli CFT073
ggggucagggcuucaaaguu

SEQ ID NO: 617165 - RNA, 13 nt, Escherichia coli CFT073
ggguauuauuucu

SEQ ID NO: 617166 - RNA, 14 nt, Escherichia coli CFT073
gggucagcggcggc

SEQ ID NO: 617167 - RNA, 22 nt, Escherichia coli CFT073
gggucaguuucaccucuccggg

SEQ ID NO: 617168 - RNA, 19 nt, Escherichia coli CFT073
gggugacgaguccuuccug

SEQ ID NO: 617169 - RNA, 20 nt, Escherichia coli CFT073
gggugacagcaggaaaauga

SEQ ID NO: 617170 - RNA, 20 nt, Escherichia coli CFT073
gggugaagacggccauccca

SEQ ID NO: 617171 - RNA, 17 nt, Escherichia coli CFT073
gggucgccagaagguga

SEQ ID NO: 617172 - RNA, 17 nt, Escherichia coli CFT073
gggcuuuuuuauuucau

SEQ ID NO: 617173 - RNA, 18 nt, Escherichia coli CFT073
gggcuuuauucaccagua

SEQ ID NO: 617174 - RNA, 21 nt, Escherichia coli CFT073
gggcuuuguagguaauggcgu

SEQ ID NO: 617175 - RNA, 18 nt, Escherichia coli CFT073
gggcuuccagcaaaucca

SEQ ID NO: 617176 - RNA, 18 nt, Escherichia coli CFT073
gggcuguuuuccagcacc

SEQ ID NO: 617177 - RNA, 15 nt, Escherichia coli CFT073
gggcuuauauaggug

SEQ ID NO: 617178 - RNA, 12 nt, Escherichia coli CFT073
gggcuggccaau

SEQ ID NO: 617179 - RNA, 19 nt, Escherichia coli CFT073
gggcuggccaauuggcugg

SEQ ID NO: 617180 - RNA, 18 nt, Escherichia coli CFT073
ggggcacuguagcucgcc

SEQ ID NO: 617181 - RNA, 23 nt, Escherichia coli CFT073
ggggaacgcguagcgcaaaucaa

SEQ ID NO: 617182 - RNA, 17 nt, Escherichia coli CFT073
ggggacauuuagcggcc

SEQ ID NO: 617183 - RNA, 21 nt, Escherichia coli CFT073
ggggcgaccugugccgccgcc

SEQ ID NO: 617184 - RNA, 15 nt, Escherichia coli CFT073
gggggagagccagca

SEQ ID NO: 617185 - RNA, 13 nt, Escherichia coli CFT073
gggcgggaaaaga

SEQ ID NO: 617186 - RNA, 14 nt, Escherichia coli CFT073
gggcgucaaaauca

SEQ ID NO: 617187 - RNA, 19 nt, Escherichia coli CFT073
gggcuauacacccuucucg

SEQ ID NO: 617188 - RNA, 16 nt, Escherichia coli CFT073
gggcguuacagcugga

SEQ ID NO: 617189 - RNA, 16 nt, Escherichia coli CFT073
gggcugaugaaguuga

SEQ ID NO: 617190 - RNA, 21 nt, Escherichia coli CFT073
gggcugacauuaucagacacc

SEQ ID NO: 617191 - RNA, 20 nt, Escherichia coli CFT073
gggcgaauuccugacuuacc

SEQ ID NO: 617192 - RNA, 22 nt, Escherichia coli CFT073
gggcgaacgagauaauggcaau

SEQ ID NO: 617193 - RNA, 12 nt, Escherichia coli CFT073
gggcgauuucag

SEQ ID NO: 617194 - RNA, 12 nt, Escherichia coli CFT073
gggcauuucuuu

SEQ ID NO: 617195 - RNA, 19 nt, Escherichia coli CFT073
gggcauuuuuuccaggggc

SEQ ID NO: 617196 - RNA, 21 nt, Escherichia coli CFT073
gggcauccacaguaagccggu

SEQ ID NO: 617197 - RNA, 15 nt, Escherichia coli CFT073
gggcauccagacgug

SEQ ID NO: 617198 - RNA, 20 nt, Escherichia coli CFT073
gggcaugauuaucaugcccu

SEQ ID NO: 617199 - RNA, 18 nt, Escherichia coli CFT073
gggcauguguuagcccug

SEQ ID NO: 617200 - RNA, 13 nt, Escherichia coli CFT073
gggcaugaacaaa

SEQ ID NO: 617201 - RNA, 19 nt, Escherichia coli CFT073
gggccauccaccagugacu

SEQ ID NO: 617202 - RNA, 16 nt, Escherichia coli CFT073
gggccaugcacccgca

SEQ ID NO: 617203 - RNA, 17 nt, Escherichia coli CFT073
gggccaugcacccgcaa

SEQ ID NO: 617204 - RNA, 21 nt, Escherichia coli CFT073
gggcaaccucuggugugcguu

SEQ ID NO: 617205 - RNA, 21 nt, Escherichia coli CFT073
gggcaacggccaaaagcacaa

SEQ ID NO: 617206 - RNA, 19 nt, Escherichia coli CFT073
gggcaagcaccuaaaucca

SEQ ID NO: 617207 - RNA, 20 nt, Escherichia coli CFT073
gggcaagcaccuaaauccac

SEQ ID NO: 617208 - RNA, 18 nt, Escherichia coli CFT073
gggaucuccagugagaga

SEQ ID NO: 617209 - RNA, 14 nt, Escherichia coli CFT073
gggauauaaaccgc

SEQ ID NO: 617210 - RNA, 20 nt, Escherichia coli CFT073
gggauauaugucaccagcau

SEQ ID NO: 617211 - RNA, 21 nt, Escherichia coli CFT073
gggauauaugucaccagcauu

SEQ ID NO: 617212 - RNA, 20 nt, Escherichia coli CFT073
gggaucauccacccgcagca

SEQ ID NO: 617213 - RNA, 17 nt, Escherichia coli CFT073
gggaucaucucaacaaa

SEQ ID NO: 617214 - RNA, 22 nt, Escherichia coli CFT073
gggaucgccggaauaucaccac

SEQ ID NO: 617215 - RNA, 12 nt, Escherichia coli CFT073
gggcaggcgugu

SEQ ID NO: 617216 - RNA, 20 nt, Escherichia coli CFT073
gggcaggugacaccaccgcc

SEQ ID NO: 617217 - RNA, 22 nt, Escherichia coli CFT073
gggcagugcucguagaagccag

SEQ ID NO: 617218 - RNA, 19 nt, Escherichia coli CFT073
gggcacucuuggcaccgcc

SEQ ID NO: 617219 - RNA, 15 nt, Escherichia coli CFT073
gggcagacgccccug

SEQ ID NO: 617220 - RNA, 19 nt, Escherichia coli CFT073
gggcaccaguaaaacgggc

SEQ ID NO: 617221 - RNA, 22 nt, Escherichia coli CFT073
gggagcgcuuuuuccugccgcu

SEQ ID NO: 617222 - RNA, 16 nt, Escherichia coli CFT073
gggagcagacuguaaa

SEQ ID NO: 617223 - RNA, 13 nt, Escherichia coli CFT073
gggagauguaaua

SEQ ID NO: 617224 - RNA, 18 nt, Escherichia coli CFT073
gggaauucgaagcuguag

SEQ ID NO: 617225 - RNA, 18 nt, Escherichia coli CFT073
gggaaucgauaacugcuc

SEQ ID NO: 617226 - RNA, 17 nt, Escherichia coli CFT073
gggaauaaaagccagga

SEQ ID NO: 617227 - RNA, 17 nt, Escherichia coli CFT073
gggaaggucagguuuga

SEQ ID NO: 617228 - RNA, 17 nt, Escherichia coli CFT073
gggaaucaaucauuucu

SEQ ID NO: 617229 - RNA, 22 nt, Escherichia coli CFT073
gggaauaguacauuguuuucca

SEQ ID NO: 617230 - RNA, 16 nt, Escherichia coli CFT073
gggaagugcgcccagg

SEQ ID NO: 617231 - RNA, 14 nt, Escherichia coli CFT073
gggaacuuaucauc

SEQ ID NO: 617232 - RNA, 20 nt, Escherichia coli CFT073
ggcuuuaauaccugccuggu

SEQ ID NO: 617233 - RNA, 13 nt, Escherichia coli CFT073
ggcuuuaaucacc

SEQ ID NO: 617234 - RNA, 13 nt, Escherichia coli CFT073
ggcuuuaucagaa

SEQ ID NO: 617235 - RNA, 18 nt, Escherichia coli CFT073
ggcuuuuuuacaucauca

SEQ ID NO: 617236 - RNA, 12 nt, Escherichia coli CFT073
ggcuuuuuaauu

SEQ ID NO: 617237 - RNA, 22 nt, Escherichia coli CFT073
ggcuuuuuauguuagccgccug

SEQ ID NO: 617238 - RNA, 22 nt, Escherichia coli CFT073
ggcuuaacagauugagaauaau

SEQ ID NO: 617239 - RNA, 13 nt, Escherichia coli CFT073
ggcuuaauugccc

SEQ ID NO: 617240 - RNA, 20 nt, Escherichia coli CFT073
ggcuguugauguccaguucc

SEQ ID NO: 617241 - RNA, 19 nt, Escherichia coli CFT073
ggcugugguacugccgacg

SEQ ID NO: 617242 - RNA, 20 nt, Escherichia coli CFT073
ggcuucgaguaaggcaagga

SEQ ID NO: 617243 - RNA, 13 nt, Escherichia coli CFT073
ggcuuccccaaca

SEQ ID NO: 617244 - RNA, 22 nt, Escherichia coli CFT073
ggcuucaaucaauaacagcgca

SEQ ID NO: 617245 - RNA, 18 nt, Escherichia coli CFT073
ggcuucaaccguuucuuu

SEQ ID NO: 617246 - RNA, 17 nt, Escherichia coli CFT073
ggcuugccagccacaug

SEQ ID NO: 617247 - RNA, 14 nt, Escherichia coli CFT073
ggcuugcaccagca

SEQ ID NO: 617248 - RNA, 16 nt, Escherichia coli CFT073
ggcuugcaccagcagc

SEQ ID NO: 617249 - RNA, 17 nt, Escherichia coli CFT073
ggcuugcucguuuucaa

SEQ ID NO: 617250 - RNA, 20 nt, Escherichia coli CFT073
ggcuugcugaugcacgcaga

SEQ ID NO: 617251 - RNA, 23 nt, Escherichia coli CFT073
ggcuucuaccuuauccagcagau

SEQ ID NO: 617252 - RNA, 14 nt, Escherichia coli CFT073
ggcuucugccagua

SEQ ID NO: 617253 - RNA, 15 nt, Escherichia coli CFT073
ggcuucucgcucgag

SEQ ID NO: 617254 - RNA, 23 nt, Escherichia coli CFT073
ggcuucguguuaaccuaaagccu

SEQ ID NO: 617255 - RNA, 14 nt, Escherichia coli CFT073
ggcugcuugagcca

SEQ ID NO: 617256 - RNA, 13 nt, Escherichia coli CFT073
ggcuggcauuccg

SEQ ID NO: 617257 - RNA, 18 nt, Escherichia coli CFT073
ggcugugaauuacugcug

SEQ ID NO: 617258 - RNA, 16 nt, Escherichia coli CFT073
ggcugucauccagcag

SEQ ID NO: 617259 - RNA, 21 nt, Escherichia coli CFT073
ggcugguaacaguccguggca

SEQ ID NO: 617260 - RNA, 19 nt, Escherichia coli CFT073
ggcucugauugccuuccac

SEQ ID NO: 617261 - RNA, 12 nt, Escherichia coli CFT073
ggcucuaucugg

SEQ ID NO: 617262 - RNA, 15 nt, Escherichia coli CFT073
ggcucucauccaaua

SEQ ID NO: 617263 - RNA, 21 nt, Escherichia coli CFT073
ggcucgauugguugcagcacg

SEQ ID NO: 617264 - RNA, 18 nt, Escherichia coli CFT073
ggcucgccauccagugaa

SEQ ID NO: 617265 - RNA, 19 nt, Escherichia coli CFT073
ggcuccagacgcccgcgcc

SEQ ID NO: 617266 - RNA, 21 nt, Escherichia coli CFT073
ggcuccaguuaacgccgcgcc

SEQ ID NO: 617267 - RNA, 21 nt, Escherichia coli CFT073
ggcucgacaagcguaauuauu

SEQ ID NO: 617268 - RNA, 20 nt, Escherichia coli CFT073
ggcucccaccgcacaaagcg

SEQ ID NO: 617269 - RNA, 20 nt, Escherichia coli CFT073
ggcugcgcuugcggccagca

SEQ ID NO: 617270 - RNA, 21 nt, Escherichia coli CFT073
ggcugccggaccaucuuccag

SEQ ID NO: 617271 - RNA, 12 nt, Escherichia coli CFT073
ggcugcauuccu

SEQ ID NO: 617272 - RNA, 14 nt, Escherichia coli CFT073
ggcugccagcucuc

SEQ ID NO: 617273 - RNA, 12 nt, Escherichia coli CFT073
ggcugccgagca

SEQ ID NO: 617274 - RNA, 21 nt, Escherichia coli CFT073
ggcugacacuauucgccagca

SEQ ID NO: 617275 - RNA, 21 nt, Escherichia coli CFT073
ggcugaccgucgcagccagcg

SEQ ID NO: 617276 - RNA, 23 nt, Escherichia coli CFT073
ggcugagaaccgcacagguugca

SEQ ID NO: 617277 - RNA, 13 nt, Escherichia coli CFT073
ggcugaagaagua

SEQ ID NO: 617278 - RNA, 20 nt, Escherichia coli CFT073
ggcugagcaaacaguucugc

SEQ ID NO: 617279 - RNA, 20 nt, Escherichia coli CFT073
ggcugaugaaguugaaauca

SEQ ID NO: 617280 - RNA, 13 nt, Escherichia coli CFT073
ggcugaugugcuu

SEQ ID NO: 617281 - RNA, 13 nt, Escherichia coli CFT073
aaauaagaaaagc

SEQ ID NO: 617282 - RNA, 16 nt, Escherichia coli CFT073
aaauaagaaaaugccu

SEQ ID NO: 617283 - RNA, 11 nt, Escherichia coli CFT073
ggcgagcgcca

SEQ ID NO: 617284 - RNA, 16 nt, Escherichia coli CFT073
ggcgacugccagccac

SEQ ID NO: 617285 - RNA, 13 nt, Escherichia coli CFT073
ggcgacuggcuga

SEQ ID NO: 617286 - RNA, 19 nt, Escherichia coli CFT073
ggcgagcaacgcagcggcg

SEQ ID NO: 617287 - RNA, 17 nt, Escherichia coli CFT073
ggcgacggcuggcaaaa

SEQ ID NO: 617288 - RNA, 15 nt, Escherichia coli CFT073
aaauaacugguuagc

SEQ ID NO: 617289 - RNA, 16 nt, Escherichia coli CFT073
aaauaacguaaaaacc

SEQ ID NO: 617290 - RNA, 13 nt, Escherichia coli CFT073
aaauaacauaucc

SEQ ID NO: 617291 - RNA, 20 nt, Escherichia coli CFT073
ggcgacgauaagucuggccg

SEQ ID NO: 617292 - RNA, 20 nt, Escherichia coli CFT073
ggcgaccugugccgccgccc

SEQ ID NO: 617293 - RNA, 15 nt, Escherichia coli CFT073
ggccuuuaacacgca

SEQ ID NO: 617294 - RNA, 19 nt, Escherichia coli CFT073
ggcgaaaaaccuaauacuc

SEQ ID NO: 617295 - RNA, 18 nt, Escherichia coli CFT073
ggcgaaaagcuucuuccu

SEQ ID NO: 617296 - RNA, 14 nt, Escherichia coli CFT073
ggcgaaaccagcag

SEQ ID NO: 617297 - RNA, 22 nt, Escherichia coli CFT073
ggcgaacaaguucgcuccagcc

SEQ ID NO: 617298 - RNA, 14 nt, Escherichia coli CFT073
ggccgagaggcuga

SEQ ID NO: 617299 - RNA, 18 nt, Escherichia coli CFT073
ggcgaccguucgccaggu

SEQ ID NO: 617300 - RNA, 22 nt, Escherichia coli CFT073
ggcgaccguucgccaggucaga

SEQ ID NO: 617301 - RNA, 17 nt, Escherichia coli CFT073
ggcgaccaguucgcuuu

SEQ ID NO: 617302 - RNA, 22 nt, Escherichia coli CFT073
ggcgaccacugaccgcccggcc

SEQ ID NO: 617303 - RNA, 23 nt, Escherichia coli CFT073
ggcgaccacugaccgcccggccc

SEQ ID NO: 617304 - RNA, 18 nt, Escherichia coli CFT073
ggcgacagcugcgaccag

SEQ ID NO: 617305 - RNA, 16 nt, Escherichia coli CFT073
aaauaaucccguucag

SEQ ID NO: 617306 - RNA, 21 nt, Escherichia coli CFT073
aaauaauaucagccuuuucau

SEQ ID NO: 617307 - RNA, 13 nt, Escherichia coli CFT073
aaauaaucaaaug

SEQ ID NO: 617308 - RNA, 14 nt, Escherichia coli CFT073
aaauaaucaccaga

SEQ ID NO: 617309 - RNA, 19 nt, Escherichia coli CFT073
aaauaaucuguugauuuaa

SEQ ID NO: 617310 - RNA, 17 nt, Escherichia coli CFT073
aaauaagcacaaagcaa

SEQ ID NO: 617311 - RNA, 19 nt, Escherichia coli CFT073
aaauaagcacaaagcaaua

SEQ ID NO: 617312 - RNA, 20 nt, Escherichia coli CFT073
aaauaagcacaaagcaauau

SEQ ID NO: 617313 - RNA, 23 nt, Escherichia coli CFT073
aaauaagcacaaagcaauauuau

SEQ ID NO: 617314 - RNA, 16 nt, Escherichia coli CFT073
aaauaauaaguaaaca

SEQ ID NO: 617315 - RNA, 13 nt, Escherichia coli CFT073
aaauaauuugaac

SEQ ID NO: 617316 - RNA, 13 nt, Escherichia coli CFT073
aaauaaugcagcg

SEQ ID NO: 617317 - RNA, 17 nt, Escherichia coli CFT073
ggcgauauccagcgcgg

SEQ ID NO: 617318 - RNA, 14 nt, Escherichia coli CFT073
ggcgauaucuuccg

SEQ ID NO: 617319 - RNA, 13 nt, Escherichia coli CFT073
ggcgauaccagua

SEQ ID NO: 617320 - RNA, 21 nt, Escherichia coli CFT073
ggcgauaccaguaauaagccc

SEQ ID NO: 617321 - RNA, 16 nt, Escherichia coli CFT073
aaauaccacucagcuu

SEQ ID NO: 617322 - RNA, 21 nt, Escherichia coli CFT073
aaauaccagcccuggcuaaag

SEQ ID NO: 617323 - RNA, 18 nt, Escherichia coli CFT073
aaauaccauuagucacau

SEQ ID NO: 617324 - RNA, 14 nt, Escherichia coli CFT073
aaauacccaaaaaa

SEQ ID NO: 617325 - RNA, 15 nt, Escherichia coli CFT073
aaauacccaaaaaau

SEQ ID NO: 617326 - RNA, 19 nt, Escherichia coli CFT073
ggcgaugcacaugcuucag

SEQ ID NO: 617327 - RNA, 23 nt, Escherichia coli CFT073
ggcgauuuaaucccgugccugcu

SEQ ID NO: 617328 - RNA, 17 nt, Escherichia coli CFT073
ggcgauuucagaucagg

SEQ ID NO: 617329 - RNA, 15 nt, Escherichia coli CFT073
ggcgauuaauccagu

SEQ ID NO: 617330 - RNA, 21 nt, Escherichia coli CFT073
ggcgcaaaggcggaaacgcug

SEQ ID NO: 617331 - RNA, 20 nt, Escherichia coli CFT073
ggcgcaaaaaacuaucccau

SEQ ID NO: 617332 - RNA, 17 nt, Escherichia coli CFT073
ggcgcaccaguucgccg

SEQ ID NO: 617333 - RNA, 21 nt, Escherichia coli CFT073
ggcguagagaucccccgcaca

SEQ ID NO: 617334 - RNA, 16 nt, Escherichia coli CFT073
ggcgguauuuaaacuc

SEQ ID NO: 617335 - RNA, 12 nt, Escherichia coli CFT073
ggcgggaaaaau

SEQ ID NO: 617336 - RNA, 12 nt, Escherichia coli CFT073
ggcggcggcaca

SEQ ID NO: 617337 - RNA, 13 nt, Escherichia coli CFT073
ggcgggagaaaug

SEQ ID NO: 617338 - RNA, 15 nt, Escherichia coli CFT073
ggcggaggggaggaa

SEQ ID NO: 617339 - RNA, 21 nt, Escherichia coli CFT073
ggcggcaaucacauccaccag

SEQ ID NO: 617340 - RNA, 16 nt, Escherichia coli CFT073
ggcggcaaucgcugcu

SEQ ID NO: 617341 - RNA, 23 nt, Escherichia coli CFT073
ggcggcacagccagcgcaggcag

SEQ ID NO: 617342 - RNA, 15 nt, Escherichia coli CFT073
ggcggcacaggucgc

SEQ ID NO: 617343 - RNA, 14 nt, Escherichia coli CFT073
aaauaccguucauu

SEQ ID NO: 617344 - RNA, 22 nt, Escherichia coli CFT073
aaauacgcgugguauuaguaga

SEQ ID NO: 617345 - RNA, 14 nt, Escherichia coli CFT073
ggcgcgaaauguca

SEQ ID NO: 617346 - RNA, 16 nt, Escherichia coli CFT073
ggcgcggacgcacaua

SEQ ID NO: 617347 - RNA, 18 nt, Escherichia coli CFT073
ggcgcggaaagcaccugc

SEQ ID NO: 617348 - RNA, 14 nt, Escherichia coli CFT073
ggcgcggcccuggg

SEQ ID NO: 617349 - RNA, 12 nt, Escherichia coli CFT073
ggcgcugcucag

SEQ ID NO: 617350 - RNA, 22 nt, Escherichia coli CFT073
ggcgcugcucaggcgacgcgga

SEQ ID NO: 617351 - RNA, 17 nt, Escherichia coli CFT073
ggcgcugaugagcaaau

SEQ ID NO: 617352 - RNA, 15 nt, Escherichia coli CFT073
aaagucggcaccagu

SEQ ID NO: 617353 - RNA, 17 nt, Escherichia coli CFT073
aaagucggggagaaagu

SEQ ID NO: 617354 - RNA, 20 nt, Escherichia coli CFT073
aaagucggggagaaaguuuc

SEQ ID NO: 617355 - RNA, 20 nt, Escherichia coli CFT073
ggcccgcgucgcaucaggca

SEQ ID NO: 617356 - RNA, 24 nt, Escherichia coli CFT073
ggcccgucacgcagucagcacugg

SEQ ID NO: 617357 - RNA, 14 nt, Escherichia coli CFT073
ggccccuggcuggu

SEQ ID NO: 617358 - RNA, 14 nt, Escherichia coli CFT073
ggcccagccgugaa

SEQ ID NO: 617359 - RNA, 12 nt, Escherichia coli CFT073
ggcccaucaucu

SEQ ID NO: 617360 - RNA, 16 nt, Escherichia coli CFT073
ggcccauaacccacac

SEQ ID NO: 617361 - RNA, 14 nt, Escherichia coli CFT073
ggccauagauuaaa

SEQ ID NO: 617362 - RNA, 16 nt, Escherichia coli CFT073
ggccaguuugacaucg

SEQ ID NO: 617363 - RNA, 17 nt, Escherichia coli CFT073
ggccauaaccaugcagc

SEQ ID NO: 617364 - RNA, 18 nt, Escherichia coli CFT073
ggccauacccgccagugc

SEQ ID NO: 617365 - RNA, 16 nt, Escherichia coli CFT073
ggccaugauuaccagc

SEQ ID NO: 617366 - RNA, 18 nt, Escherichia coli CFT073
ggccaugaccaccgcagc

SEQ ID NO: 617367 - RNA, 16 nt, Escherichia coli CFT073
ggccaugcggcgagga

SEQ ID NO: 617368 - RNA, 15 nt, Escherichia coli CFT073
ggcaugcuucacuga

SEQ ID NO: 617369 - RNA, 19 nt, Escherichia coli CFT073
ggcauuaauuaguaggccg

SEQ ID NO: 617370 - RNA, 22 nt, Escherichia coli CFT073
ggcauuacaagaaucaugccaa

SEQ ID NO: 617371 - RNA, 22 nt, Escherichia coli CFT073
ggcauuguuggaccguagacug

SEQ ID NO: 617372 - RNA, 20 nt, Escherichia coli CFT073
ggcauuguaggccagauaaa

SEQ ID NO: 617373 - RNA, 18 nt, Escherichia coli CFT073
ggcauucagauaauaggu

SEQ ID NO: 617374 - RNA, 13 nt, Escherichia coli CFT073
ggccaauuggcug

SEQ ID NO: 617375 - RNA, 15 nt, Escherichia coli CFT073
ggccacgaugcacag

SEQ ID NO: 617376 - RNA, 15 nt, Escherichia coli CFT073
ggccagacauuacaa

SEQ ID NO: 617377 - RNA, 23 nt, Escherichia coli CFT073
ggccagauacugccgaccagagc

SEQ ID NO: 617378 - RNA, 13 nt, Escherichia coli CFT073
aaagucacauucc

SEQ ID NO: 617379 - RNA, 17 nt, Escherichia coli CFT073
aaagucaaaauucaacu

SEQ ID NO: 617380 - RNA, 21 nt, Escherichia coli CFT073
aaagucaucgggcguuuucuu

SEQ ID NO: 617381 - RNA, 12 nt, Escherichia coli CFT073
aaagucaucaau

SEQ ID NO: 617382 - RNA, 19 nt, Escherichia coli CFT073
aaagucauuccuucaaccc

SEQ ID NO: 617383 - RNA, 17 nt, Escherichia coli CFT073
ggcaucgcuucacgcgg

SEQ ID NO: 617384 - RNA, 20 nt, Escherichia coli CFT073
ggcauauugacgucgcuaag

SEQ ID NO: 617385 - RNA, 18 nt, Escherichia coli CFT073
ggcaucacgaauccgcac

SEQ ID NO: 617386 - RNA, 16 nt, Escherichia coli CFT073
ggcauccagagaucgc

SEQ ID NO: 617387 - RNA, 14 nt, Escherichia coli CFT073
ggcaucauuauucc

SEQ ID NO: 617388 - RNA, 20 nt, Escherichia coli CFT073
ggcauccaagcugguggcaa

SEQ ID NO: 617389 - RNA, 23 nt, Escherichia coli CFT073
ggcaucaggcugguguaaaaacu

SEQ ID NO: 617390 - RNA, 22 nt, Escherichia coli CFT073
ggcagguugagcaacaacuuca

SEQ ID NO: 617391 - RNA, 22 nt, Escherichia coli CFT073
ggcaguaaaucaauauccacug

SEQ ID NO: 617392 - RNA, 22 nt, Escherichia coli CFT073
ggcaggguggugacaccaugcc

SEQ ID NO: 617393 - RNA, 23 nt, Escherichia coli CFT073
aaaguaggccguacagcccagga

SEQ ID NO: 617394 - RNA, 19 nt, Escherichia coli CFT073
ggcaggaaguaaaacggug

SEQ ID NO: 617395 - RNA, 14 nt, Escherichia coli CFT073
ggcaggaaaucgag

SEQ ID NO: 617396 - RNA, 20 nt, Escherichia coli CFT073
ggcagcuuuaccggcuucgu

SEQ ID NO: 617397 - RNA, 10 nt, Escherichia coli CFT073
ggcaggaaaa

SEQ ID NO: 617398 - RNA, 17 nt, Escherichia coli CFT073
ggcagcucuuucucgcu

SEQ ID NO: 617399 - RNA, 14 nt, Escherichia coli CFT073
aaaguauaugagaa

SEQ ID NO: 617400 - RNA, 20 nt, Escherichia coli CFT073
ggcaggccccgucagcaaaa

SEQ ID NO: 617401 - RNA, 15 nt, Escherichia coli CFT073
ggcaggccuaacaca

SEQ ID NO: 617402 - RNA, 20 nt, Escherichia coli CFT073
ggcaggcuucaacacaggcc

SEQ ID NO: 617403 - RNA, 19 nt, Escherichia coli CFT073
ggcaagugugaugguauuc

SEQ ID NO: 617404 - RNA, 14 nt, Escherichia coli CFT073
ggcaaggccaauac

SEQ ID NO: 617405 - RNA, 20 nt, Escherichia coli CFT073
ggcaagccgcuaacagcagc

SEQ ID NO: 617406 - RNA, 18 nt, Escherichia coli CFT073
ggcagaacaccggcagcg

SEQ ID NO: 617407 - RNA, 12 nt, Escherichia coli CFT073
ggcagaacggug

SEQ ID NO: 617408 - RNA, 22 nt, Escherichia coli CFT073
ggcagaauacuucacaugauaa

SEQ ID NO: 617409 - RNA, 13 nt, Escherichia coli CFT073
ggcagaccagagc

SEQ ID NO: 617410 - RNA, 15 nt, Escherichia coli CFT073
ggcagacaaaacaua

SEQ ID NO: 617411 - RNA, 13 nt, Escherichia coli CFT073
ggcagacagcgcc

SEQ ID NO: 617412 - RNA, 16 nt, Escherichia coli CFT073
ggcagagaaagcaaaa

SEQ ID NO: 617413 - RNA, 18 nt, Escherichia coli CFT073
ggcagagaaagcaaaaau

SEQ ID NO: 617414 - RNA, 14 nt, Escherichia coli CFT073
ggcagacuuuuccu

SEQ ID NO: 617415 - RNA, 17 nt, Escherichia coli CFT073
ggcagagaaaccacauc

SEQ ID NO: 617416 - RNA, 16 nt, Escherichia coli CFT073
ggcagagccaaauaau

SEQ ID NO: 617417 - RNA, 21 nt, Escherichia coli CFT073
ggcagccaguucgagaaaaau

SEQ ID NO: 617418 - RNA, 23 nt, Escherichia coli CFT073
ggcagccagccaugcggcaucuu

SEQ ID NO: 617419 - RNA, 13 nt, Escherichia coli CFT073
ggcagauaaaaug

SEQ ID NO: 617420 - RNA, 13 nt, Escherichia coli CFT073
ggcagauccacca

SEQ ID NO: 617421 - RNA, 21 nt, Escherichia coli CFT073
ggcaaaaccaucaauccacuu

SEQ ID NO: 617422 - RNA, 17 nt, Escherichia coli CFT073
ggcaaaacggugcaggc

SEQ ID NO: 617423 - RNA, 15 nt, Escherichia coli CFT073
ggcaacaucaaauac

SEQ ID NO: 617424 - RNA, 15 nt, Escherichia coli CFT073
ggcaacaucaaauca

SEQ ID NO: 617425 - RNA, 19 nt, Escherichia coli CFT073
ggcaacccagaagaaagcc

SEQ ID NO: 617426 - RNA, 15 nt, Escherichia coli CFT073
ggcaagaauuacuuc

SEQ ID NO: 617427 - RNA, 19 nt, Escherichia coli CFT073
ggcaagaaacgcuccacca

SEQ ID NO: 617428 - RNA, 13 nt, Escherichia coli CFT073
ggcaagccagcau

SEQ ID NO: 617429 - RNA, 14 nt, Escherichia coli CFT073
ggcaagccagcaua

SEQ ID NO: 617430 - RNA, 14 nt, Escherichia coli CFT073
ggcaagauacugca

SEQ ID NO: 617431 - RNA, 23 nt, Escherichia coli CFT073
ggcaagauuugcaucacuccagu

SEQ ID NO: 617432 - RNA, 13 nt, Escherichia coli CFT073
ggauuuuacccac

SEQ ID NO: 617433 - RNA, 13 nt, Escherichia coli CFT073
ggauuugugucag

SEQ ID NO: 617434 - RNA, 13 nt, Escherichia coli CFT073
ggauucagucuua

SEQ ID NO: 617435 - RNA, 21 nt, Escherichia coli CFT073
ggauuccagcgccgccagaag

SEQ ID NO: 617436 - RNA, 23 nt, Escherichia coli CFT073
ggauuaucaucccaguuuggauc

SEQ ID NO: 617437 - RNA, 23 nt, Escherichia coli CFT073
ggauuagcgaccgaacaggucac

SEQ ID NO: 617438 - RNA, 18 nt, Escherichia coli CFT073
ggauucacguugauggua

SEQ ID NO: 617439 - RNA, 13 nt, Escherichia coli CFT073
ggauguugcugca

SEQ ID NO: 617440 - RNA, 14 nt, Escherichia coli CFT073
ggauguuugcagua

SEQ ID NO: 617441 - RNA, 14 nt, Escherichia coli CFT073
ggauuaauuaccag

SEQ ID NO: 617442 - RNA, 16 nt, Escherichia coli CFT073
ggaugcgaccagcguc

SEQ ID NO: 617443 - RNA, 23 nt, Escherichia coli CFT073
ggaugcgaccagcgucguaucca

SEQ ID NO: 617444 - RNA, 17 nt, Escherichia coli CFT073
ggaugccguuaauaaua

SEQ ID NO: 617445 - RNA, 23 nt, Escherichia coli CFT073
ggaugccguuaauaauaaacugc

SEQ ID NO: 617446 - RNA, 12 nt, Escherichia coli CFT073
ggaugcggcagg

SEQ ID NO: 617447 - RNA, 20 nt, Escherichia coli CFT073
ggaugcgagucaggccagga

SEQ ID NO: 617448 - RNA, 12 nt, Escherichia coli CFT073
ggaugccccggg

SEQ ID NO: 617449 - RNA, 20 nt, Escherichia coli CFT073
ggaugcggugcgagcgccuu

SEQ ID NO: 617450 - RNA, 17 nt, Escherichia coli CFT073
ggaugcggcgugauaaa

SEQ ID NO: 617451 - RNA, 11 nt, Escherichia coli CFT073
ggauggcggcu

SEQ ID NO: 617452 - RNA, 19 nt, Escherichia coli CFT073
ggauggccucugccagcug

SEQ ID NO: 617453 - RNA, 20 nt, Escherichia coli CFT073
ggauggccugauucacgcug

SEQ ID NO: 617454 - RNA, 17 nt, Escherichia coli CFT073
ggauggcaacagcagcc

SEQ ID NO: 617455 - RNA, 13 nt, Escherichia coli CFT073
ggauggcacauga

SEQ ID NO: 617456 - RNA, 23 nt, Escherichia coli CFT073
aaaguacacauugccauuguugu

SEQ ID NO: 617457 - RNA, 18 nt, Escherichia coli CFT073
aaaguaccaucguccagc

SEQ ID NO: 617458 - RNA, 21 nt, Escherichia coli CFT073
aaaguacucuuugaacagcca

SEQ ID NO: 617459 - RNA, 17 nt, Escherichia coli CFT073
aaaguacgcuuucccuu

SEQ ID NO: 617460 - RNA, 23 nt, Escherichia coli CFT073
ggauggucgcuugcgggcuggcg

SEQ ID NO: 617461 - RNA, 19 nt, Escherichia coli CFT073
ggauggcuccgggcagggc

SEQ ID NO: 617462 - RNA, 21 nt, Escherichia coli CFT073
ggaugaucauccacgaccaga

SEQ ID NO: 617463 - RNA, 11 nt, Escherichia coli CFT073
ggaugauucac

SEQ ID NO: 617464 - RNA, 13 nt, Escherichia coli CFT073
ggaugacaaaccg

SEQ ID NO: 617465 - RNA, 17 nt, Escherichia coli CFT073
ggaugacauaaccuugc

SEQ ID NO: 617466 - RNA, 12 nt, Escherichia coli CFT073
ggaugacccagc

SEQ ID NO: 617467 - RNA, 17 nt, Escherichia coli CFT073
ggaugacgaauaauugc

SEQ ID NO: 617468 - RNA, 22 nt, Escherichia coli CFT073
ggaucuuccagcgcaucgccaa

SEQ ID NO: 617469 - RNA, 16 nt, Escherichia coli CFT073
ggaucuuugacugaaa

SEQ ID NO: 617470 - RNA, 19 nt, Escherichia coli CFT073
ggaucugguguucuuuuac

SEQ ID NO: 617471 - RNA, 13 nt, Escherichia coli CFT073
ggaucuggauaaa

SEQ ID NO: 617472 - RNA, 19 nt, Escherichia coli CFT073
ggaucuggauaaauaugac

SEQ ID NO: 617473 - RNA, 23 nt, Escherichia coli CFT073
ggaucugauuuucuuccaguagc

SEQ ID NO: 617474 - RNA, 19 nt, Escherichia coli CFT073
ggaucguugagcagcagau

SEQ ID NO: 617475 - RNA, 15 nt, Escherichia coli CFT073
ggaucgcuuuuacau

SEQ ID NO: 617476 - RNA, 22 nt, Escherichia coli CFT073
ggaucaggcagugaauuucuac

SEQ ID NO: 617477 - RNA, 21 nt, Escherichia coli CFT073
ggauaccgcacgcucaaagac

SEQ ID NO: 617478 - RNA, 17 nt, Escherichia coli CFT073
ggauacgcuuuauccag

SEQ ID NO: 617479 - RNA, 15 nt, Escherichia coli CFT073
ggauaccccagcugg

SEQ ID NO: 617480 - RNA, 19 nt, Escherichia coli CFT073
ggauaagaaagauacaaaa

SEQ ID NO: 617481 - RNA, 17 nt, Escherichia coli CFT073
ggauaauccggaaaagc

SEQ ID NO: 617482 - RNA, 15 nt, Escherichia coli CFT073
ggaguggugaugguu

SEQ ID NO: 617483 - RNA, 17 nt, Escherichia coli CFT073
ggagccaucccugcagg

SEQ ID NO: 617484 - RNA, 15 nt, Escherichia coli CFT073
ggaguugaucgccag

SEQ ID NO: 617485 - RNA, 18 nt, Escherichia coli CFT073
ggauaaaucuccauuuca

SEQ ID NO: 617486 - RNA, 12 nt, Escherichia coli CFT073
aaagguaccgac

SEQ ID NO: 617487 - RNA, 13 nt, Escherichia coli CFT073
aaaggucaucauc

SEQ ID NO: 617488 - RNA, 19 nt, Escherichia coli CFT073
aaaggucaucaucacuuuu

SEQ ID NO: 617489 - RNA, 11 nt, Escherichia coli CFT073
ggacucugccg

SEQ ID NO: 617490 - RNA, 22 nt, Escherichia coli CFT073
ggacugccgcacuuacagcaac

SEQ ID NO: 617491 - RNA, 18 nt, Escherichia coli CFT073
ggacuggccgggcacauu

SEQ ID NO: 617492 - RNA, 15 nt, Escherichia coli CFT073
ggagacuaaggcagc

SEQ ID NO: 617493 - RNA, 22 nt, Escherichia coli CFT073
ggagaaagucguaggccugaua

SEQ ID NO: 617494 - RNA, 14 nt, Escherichia coli CFT073
ggacuucuggcaga

SEQ ID NO: 617495 - RNA, 21 nt, Escherichia coli CFT073
aaaguaaccuuugaacagcca

SEQ ID NO: 617496 - RNA, 22 nt, Escherichia coli CFT073
ggagaaaagaccagccagcaau

SEQ ID NO: 617497 - RNA, 22 nt, Escherichia coli CFT073
ggagagggggcgauagaauagc

SEQ ID NO: 617498 - RNA, 14 nt, Escherichia coli CFT073
ggagauucaaagac

SEQ ID NO: 617499 - RNA, 12 nt, Escherichia coli CFT073
ggagcacggagg

SEQ ID NO: 617500 - RNA, 10 nt, Escherichia coli CFT073
ggagcaccug

SEQ ID NO: 617501 - RNA, 22 nt, Escherichia coli CFT073
ggacacuguaccggcaaaauca

SEQ ID NO: 617502 - RNA, 16 nt, Escherichia coli CFT073
ggacggaauuaucagu

SEQ ID NO: 617503 - RNA, 17 nt, Escherichia coli CFT073
ggaaugccggaaucaga

SEQ ID NO: 617504 - RNA, 23 nt, Escherichia coli CFT073
ggaauuaucaguaccaaagccuc

SEQ ID NO: 617505 - RNA, 17 nt, Escherichia coli CFT073
ggaauucaacuaacuga

SEQ ID NO: 617506 - RNA, 15 nt, Escherichia coli CFT073
ggaauucagcguggc

SEQ ID NO: 617507 - RNA, 18 nt, Escherichia coli CFT073
ggaauggucaccacaaau

SEQ ID NO: 617508 - RNA, 14 nt, Escherichia coli CFT073
ggaauaaaaagcga

SEQ ID NO: 617509 - RNA, 15 nt, Escherichia coli CFT073
ggaauaaaagccagg

SEQ ID NO: 617510 - RNA, 22 nt, Escherichia coli CFT073
ggaauaaucuguaccuucugca

SEQ ID NO: 617511 - RNA, 20 nt, Escherichia coli CFT073
ggaauuucaucaucacgaaa

SEQ ID NO: 617512 - RNA, 16 nt, Escherichia coli CFT073
ggaauugcgcaacaga

SEQ ID NO: 617513 - RNA, 19 nt, Escherichia coli CFT073
ggacaaaguaauggaaggc

SEQ ID NO: 617514 - RNA, 20 nt, Escherichia coli CFT073
ggacaaauaaggaaaacugg

SEQ ID NO: 617515 - RNA, 17 nt, Escherichia coli CFT073
ggaacugcaaggagagc

SEQ ID NO: 617516 - RNA, 12 nt, Escherichia coli CFT073
ggaacugcaggc

SEQ ID NO: 617517 - RNA, 17 nt, Escherichia coli CFT073
ggaacggcguugcugcc

SEQ ID NO: 617518 - RNA, 10 nt, Escherichia coli CFT073
ggaaguagau

SEQ ID NO: 617519 - RNA, 16 nt, Escherichia coli CFT073
ggaagccggucauauu

SEQ ID NO: 617520 - RNA, 19 nt, Escherichia coli CFT073
ggaagccuuccgcaaacag

SEQ ID NO: 617521 - RNA, 23 nt, Escherichia coli CFT073
ggaagccuuccgcaaacaggcgc

SEQ ID NO: 617522 - RNA, 13 nt, Escherichia coli CFT073
gcuuucgcauuua

SEQ ID NO: 617523 - RNA, 17 nt, Escherichia coli CFT073
gcuuuccggaaaaauca

SEQ ID NO: 617524 - RNA, 19 nt, Escherichia coli CFT073
ggaacaauccucccuuacc

SEQ ID NO: 617525 - RNA, 20 nt, Escherichia coli CFT073
ggaacaaaauuuucagcgug

SEQ ID NO: 617526 - RNA, 21 nt, Escherichia coli CFT073
gcuuucgauaugaacuugcuc

SEQ ID NO: 617527 - RNA, 19 nt, Escherichia coli CFT073
ggaacauaucaaaaagcug

SEQ ID NO: 617528 - RNA, 14 nt, Escherichia coli CFT073
ggaacaucagcauu

SEQ ID NO: 617529 - RNA, 18 nt, Escherichia coli CFT073
ggaacauccggcaaauua

SEQ ID NO: 617530 - RNA, 21 nt, Escherichia coli CFT073
gcuuuacccugguuagcaacc

SEQ ID NO: 617531 - RNA, 20 nt, Escherichia coli CFT073
gcuuuaccaccgucaauaaa

SEQ ID NO: 617532 - RNA, 21 nt, Escherichia coli CFT073
gcuuuagggggggcucuuucc

SEQ ID NO: 617533 - RNA, 15 nt, Escherichia coli CFT073
gcuuuauacaaauga

SEQ ID NO: 617534 - RNA, 17 nt, Escherichia coli CFT073
gcuugugcaccagcugg

SEQ ID NO: 617535 - RNA, 14 nt, Escherichia coli CFT073
gcuuucaauuccug

SEQ ID NO: 617536 - RNA, 22 nt, Escherichia coli CFT073
gcuuucaacgcgcuaauuucag

SEQ ID NO: 617537 - RNA, 21 nt, Escherichia coli CFT073
gcuuucacucaguguuggaug

SEQ ID NO: 617538 - RNA, 15 nt, Escherichia coli CFT073
gcuuucaccaauguu

SEQ ID NO: 617539 - RNA, 18 nt, Escherichia coli CFT073
gcuuucaaaucagcgaau

SEQ ID NO: 617540 - RNA, 12 nt, Escherichia coli CFT073
gcuuuauucaug

SEQ ID NO: 617541 - RNA, 18 nt, Escherichia coli CFT073
gcuuuacuguacaauccu

SEQ ID NO: 617542 - RNA, 23 nt, Escherichia coli CFT073
gcuuuaucuguacuuaaaacuca

SEQ ID NO: 617543 - RNA, 17 nt, Escherichia coli CFT073
gcuuuccagcuguacca

SEQ ID NO: 617544 - RNA, 21 nt, Escherichia coli CFT073
gcuuuccagcuguaccagcaa

SEQ ID NO: 617545 - RNA, 19 nt, Escherichia coli CFT073
gcuuucagcacuuaucucu

SEQ ID NO: 617546 - RNA, 19 nt, Escherichia coli CFT073
gcuuucaucacuugaucca

SEQ ID NO: 617547 - RNA, 17 nt, Escherichia coli CFT073
gcuuucauauuccagcc

SEQ ID NO: 617548 - RNA, 23 nt, Escherichia coli CFT073
aaaggccgcaggcuguuaccccu

SEQ ID NO: 617549 - RNA, 16 nt, Escherichia coli CFT073
gcuugugcaccagcug

SEQ ID NO: 617550 - RNA, 14 nt, Escherichia coli CFT073
gcuugucauuacca

SEQ ID NO: 617551 - RNA, 18 nt, Escherichia coli CFT073
gcuugucagacggugcca

SEQ ID NO: 617552 - RNA, 15 nt, Escherichia coli CFT073
aaaggcaccuggaaa

SEQ ID NO: 617553 - RNA, 16 nt, Escherichia coli CFT073
aaaggccagccaggca

SEQ ID NO: 617554 - RNA, 14 nt, Escherichia coli CFT073
gcuuggcugcaaau

SEQ ID NO: 617555 - RNA, 15 nt, Escherichia coli CFT073
aaaggauuuacuaaa

SEQ ID NO: 617556 - RNA, 15 nt, Escherichia coli CFT073
gcuugcuuuccagcu

SEQ ID NO: 617557 - RNA, 18 nt, Escherichia coli CFT073
gcuugacgcgucuuauca

SEQ ID NO: 617558 - RNA, 22 nt, Escherichia coli CFT073
gcuugacgcgucuuaucaggcc

SEQ ID NO: 617559 - RNA, 21 nt, Escherichia coli CFT073
gcuugaauuuaucuucaccaa

SEQ ID NO: 617560 - RNA, 16 nt, Escherichia coli CFT073
gcuugagccagugagc

SEQ ID NO: 617561 - RNA, 17 nt, Escherichia coli CFT073
gcuugaaggguuuaaua

SEQ ID NO: 617562 - RNA, 13 nt, Escherichia coli CFT073
gcuucuucuucca

SEQ ID NO: 617563 - RNA, 13 nt, Escherichia coli CFT073
gcuucuuccagca

SEQ ID NO: 617564 - RNA, 22 nt, Escherichia coli CFT073
gcuugaugcgucuuaucaggcc

SEQ ID NO: 617565 - RNA, 15 nt, Escherichia coli CFT073
gcuugcaccagcagc

SEQ ID NO: 617566 - RNA, 20 nt, Escherichia coli CFT073
gcuugcaaaagcaggagcaa

SEQ ID NO: 617567 - RNA, 12 nt, Escherichia coli CFT073
gcuugccagcag

SEQ ID NO: 617568 - RNA, 15 nt, Escherichia coli CFT073
gcuugccagagcagc

SEQ ID NO: 617569 - RNA, 19 nt, Escherichia coli CFT073
gcuugccagauggcaucca

SEQ ID NO: 617570 - RNA, 15 nt, Escherichia coli CFT073
gcuugccuagggcgc

SEQ ID NO: 617571 - RNA, 23 nt, Escherichia coli CFT073
gcuugcgaaaauagucguccauu

SEQ ID NO: 617572 - RNA, 14 nt, Escherichia coli CFT073
gcuugcucaaguug

SEQ ID NO: 617573 - RNA, 15 nt, Escherichia coli CFT073
gcuugcucaguguca

SEQ ID NO: 617574 - RNA, 16 nt, Escherichia coli CFT073
gcuugcggccagcaca

SEQ ID NO: 617575 - RNA, 21 nt, Escherichia coli CFT073
gcuucgcgaaguucuuccggc

SEQ ID NO: 617576 - RNA, 21 nt, Escherichia coli CFT073
gcuucgccaucuccaucaucu

SEQ ID NO: 617577 - RNA, 16 nt, Escherichia coli CFT073
gcuuccuuaagccgcu

SEQ ID NO: 617578 - RNA, 20 nt, Escherichia coli CFT073
gcuucgcggacuucuggcag

SEQ ID NO: 617579 - RNA, 21 nt, Escherichia coli CFT073
gcuucgcggacaucguccagc

SEQ ID NO: 617580 - RNA, 21 nt, Escherichia coli CFT073
gcuucgcuaagauaccccagc

SEQ ID NO: 617581 - RNA, 20 nt, Escherichia coli CFT073
gcuucgauaccguccaccag

SEQ ID NO: 617582 - RNA, 18 nt, Escherichia coli CFT073
gcuucgagcuggaagcca

SEQ ID NO: 617583 - RNA, 20 nt, Escherichia coli CFT073
gcuucgccagcgcgcggcug

SEQ ID NO: 617584 - RNA, 22 nt, Escherichia coli CFT073
gcuucgccagcgcgcggcuggc

SEQ ID NO: 617585 - RNA, 19 nt, Escherichia coli CFT073
gcuucgcuggcagcugcua

SEQ ID NO: 617586 - RNA, 13 nt, Escherichia coli CFT073
gcuucgcuuccca

SEQ ID NO: 617587 - RNA, 17 nt, Escherichia coli CFT073
gcuucguuuuccgccac

SEQ ID NO: 617588 - RNA, 14 nt, Escherichia coli CFT073
gcuucguuuugaca

SEQ ID NO: 617589 - RNA, 13 nt, Escherichia coli CFT073
gcuucucuuccag

SEQ ID NO: 617590 - RNA, 14 nt, Escherichia coli CFT073
gcuucugcagcuuu

SEQ ID NO: 617591 - RNA, 21 nt, Escherichia coli CFT073
gcuucuguuuucgcaccugcc

SEQ ID NO: 617592 - RNA, 22 nt, Escherichia coli CFT073
gcuucaauacgcaucaccucac

SEQ ID NO: 617593 - RNA, 21 nt, Escherichia coli CFT073
gcuucaaucaacauauuucuc

SEQ ID NO: 617594 - RNA, 17 nt, Escherichia coli CFT073
gcuucagauuagccgca

SEQ ID NO: 617595 - RNA, 17 nt, Escherichia coli CFT073
gcuucagauuguugaua

SEQ ID NO: 617596 - RNA, 21 nt, Escherichia coli CFT073
gcuucacgcggguugccaccg

SEQ ID NO: 617597 - RNA, 17 nt, Escherichia coli CFT073
gcuuauuguacagcgcc

SEQ ID NO: 617598 - RNA, 19 nt, Escherichia coli CFT073
gcuucaaaaagcggguuuu

SEQ ID NO: 617599 - RNA, 18 nt, Escherichia coli CFT073
gcuuauucccuucuuucu

SEQ ID NO: 617600 - RNA, 13 nt, Escherichia coli CFT073
gcuucaaaguuug

SEQ ID NO: 617601 - RNA, 14 nt, Escherichia coli CFT073
gcuucaaaguuuug

SEQ ID NO: 617602 - RNA, 15 nt, Escherichia coli CFT073
gcuucaacacaggcc

SEQ ID NO: 617603 - RNA, 17 nt, Escherichia coli CFT073
gcuucaaccagugcacc

SEQ ID NO: 617604 - RNA, 22 nt, Escherichia coli CFT073
gcuucaaccagugcaccagcuu

SEQ ID NO: 617605 - RNA, 19 nt, Escherichia coli CFT073
gcuucaaccguuucuuuuu

SEQ ID NO: 617606 - RNA, 21 nt, Escherichia coli CFT073
gcuuacuugcugcucugaagu

SEQ ID NO: 617607 - RNA, 21 nt, Escherichia coli CFT073
gcuuacucuucguucuucuuc

SEQ ID NO: 617608 - RNA, 15 nt, Escherichia coli CFT073
gcuuacucuuucaau

SEQ ID NO: 617609 - RNA, 15 nt, Escherichia coli CFT073
gcuuacguauuucga

SEQ ID NO: 617610 - RNA, 21 nt, Escherichia coli CFT073
gcuuacguccgccguugcgcc

SEQ ID NO: 617611 - RNA, 21 nt, Escherichia coli CFT073
gcuuacucaugaugucauaaa

SEQ ID NO: 617612 - RNA, 18 nt, Escherichia coli CFT073
gcuuacucuucguucuuc

SEQ ID NO: 617613 - RNA, 16 nt, Escherichia coli CFT073
gcuuaccauccacacc

SEQ ID NO: 617614 - RNA, 15 nt, Escherichia coli CFT073
gcuuacgcaacucau

SEQ ID NO: 617615 - RNA, 22 nt, Escherichia coli CFT073
gcuuacgcaacugccaguaaag

SEQ ID NO: 617616 - RNA, 16 nt, Escherichia coli CFT073
gcuuaguaagcccagg

SEQ ID NO: 617617 - RNA, 17 nt, Escherichia coli CFT073
gcuuaggauuauuuauu

SEQ ID NO: 617618 - RNA, 17 nt, Escherichia coli CFT073
gcuucgaaacagaaaua

SEQ ID NO: 617619 - RNA, 12 nt, Escherichia coli CFT073
gcuuccugcagc

SEQ ID NO: 617620 - RNA, 15 nt, Escherichia coli CFT073
gcuuccggucugcga

SEQ ID NO: 617621 - RNA, 17 nt, Escherichia coli CFT073
gcuuccggucugcgauc

SEQ ID NO: 617622 - RNA, 15 nt, Escherichia coli CFT073
gcuuccggcagcuuc

SEQ ID NO: 617623 - RNA, 15 nt, Escherichia coli CFT073
gcuuccgcugaaaug

SEQ ID NO: 617624 - RNA, 21 nt, Escherichia coli CFT073
gcuuccauauuggcgcgggcg

SEQ ID NO: 617625 - RNA, 22 nt, Escherichia coli CFT073
gcuuccaguuccauccaccagc

SEQ ID NO: 617626 - RNA, 16 nt, Escherichia coli CFT073
gcuuccagccaugcca

SEQ ID NO: 617627 - RNA, 13 nt, Escherichia coli CFT073
gcuuccagccggu

SEQ ID NO: 617628 - RNA, 15 nt, Escherichia coli CFT073
gcuuccauugccugc

SEQ ID NO: 617629 - RNA, 18 nt, Escherichia coli CFT073
gcuucccgauaagggagc

SEQ ID NO: 617630 - RNA, 19 nt, Escherichia coli CFT073
gcuucccgauaagggagca

SEQ ID NO: 617631 - RNA, 21 nt, Escherichia coli CFT073
gcuucccgauaagggagcagg

SEQ ID NO: 617632 - RNA, 17 nt, Escherichia coli CFT073
gcuucauucacgauuug

SEQ ID NO: 617633 - RNA, 18 nt, Escherichia coli CFT073
gcuucaugcaucgguuuu

SEQ ID NO: 617634 - RNA, 18 nt, Escherichia coli CFT073
gcuucauuacgcgcuggg

SEQ ID NO: 617635 - RNA, 11 nt, Escherichia coli CFT073
gcuucaucgcc

SEQ ID NO: 617636 - RNA, 15 nt, Escherichia coli CFT073
gcuucaucgcccaca

SEQ ID NO: 617637 - RNA, 19 nt, Escherichia coli CFT073
gcuucauccagcagcgacu

SEQ ID NO: 617638 - RNA, 14 nt, Escherichia coli CFT073
gcuucaucuuuauu

SEQ ID NO: 617639 - RNA, 17 nt, Escherichia coli CFT073
gcuucaucuuuauucau

SEQ ID NO: 617640 - RNA, 18 nt, Escherichia coli CFT073
gcuucauugcucucuucu

SEQ ID NO: 617641 - RNA, 20 nt, Escherichia coli CFT073
gcuucauugcucucuucucc

SEQ ID NO: 617642 - RNA, 18 nt, Escherichia coli CFT073
gcuucauaggcuuccacu

SEQ ID NO: 617643 - RNA, 19 nt, Escherichia coli CFT073
gcuucauaggcuuccacuu

SEQ ID NO: 617644 - RNA, 23 nt, Escherichia coli CFT073
gcuuaacgauuugagaucuuuaa

SEQ ID NO: 617645 - RNA, 18 nt, Escherichia coli CFT073
gcuuaagcgaccaguugu

SEQ ID NO: 617646 - RNA, 18 nt, Escherichia coli CFT073
gcuguuucuggcaccagg

SEQ ID NO: 617647 - RNA, 17 nt, Escherichia coli CFT073
gcuguuuguucaagcgc

SEQ ID NO: 617648 - RNA, 18 nt, Escherichia coli CFT073
gcuguugcuuccaccauc

SEQ ID NO: 617649 - RNA, 17 nt, Escherichia coli CFT073
gcuguuguucagugcau

SEQ ID NO: 617650 - RNA, 18 nt, Escherichia coli CFT073
gcuguuguuccagcuucc

SEQ ID NO: 617651 - RNA, 17 nt, Escherichia coli CFT073
gcuguuccggcuuuguu

SEQ ID NO: 617652 - RNA, 19 nt, Escherichia coli CFT073
gcuguuccucaacuuuguu

SEQ ID NO: 617653 - RNA, 15 nt, Escherichia coli CFT073
gcuguugccaccauu

SEQ ID NO: 617654 - RNA, 14 nt, Escherichia coli CFT073
gcuguugccagcag

SEQ ID NO: 617655 - RNA, 16 nt, Escherichia coli CFT073
gcuguugccagcagca

SEQ ID NO: 617656 - RNA, 22 nt, Escherichia coli CFT073
gcuguggugcaauccacaagca

SEQ ID NO: 617657 - RNA, 15 nt, Escherichia coli CFT073
gcuggugcaggcgau

SEQ ID NO: 617658 - RNA, 18 nt, Escherichia coli CFT073
gcuggugauucagggcag

SEQ ID NO: 617659 - RNA, 19 nt, Escherichia coli CFT073
gcuggucacugacgacuuc

SEQ ID NO: 617660 - RNA, 18 nt, Escherichia coli CFT073
gcuggcaccgugaaagag

SEQ ID NO: 617661 - RNA, 17 nt, Escherichia coli CFT073
gcuggcaaacaugcagc

SEQ ID NO: 617662 - RNA, 16 nt, Escherichia coli CFT073
aaaggauaaauaaaau

SEQ ID NO: 617663 - RNA, 13 nt, Escherichia coli CFT073
gcuguaguucaga

SEQ ID NO: 617664 - RNA, 14 nt, Escherichia coli CFT073
gcuguauuuuucca

SEQ ID NO: 617665 - RNA, 18 nt, Escherichia coli CFT073
gcuguauucaagccauga

SEQ ID NO: 617666 - RNA, 15 nt, Escherichia coli CFT073
gcugcuccuuuuguu

SEQ ID NO: 617667 - RNA, 15 nt, Escherichia coli CFT073
gcugcgcuugcugcc

SEQ ID NO: 617668 - RNA, 22 nt, Escherichia coli CFT073
gcugcgcuugaggauguugauc

SEQ ID NO: 617669 - RNA, 17 nt, Escherichia coli CFT073
gcugcgcuugcggccag

SEQ ID NO: 617670 - RNA, 18 nt, Escherichia coli CFT073
gcugcgcuugcggccagc

SEQ ID NO: 617671 - RNA, 20 nt, Escherichia coli CFT073
gcugcguuugcccuaaagcg

SEQ ID NO: 617672 - RNA, 15 nt, Escherichia coli CFT073
gcugcguuuuuucac

SEQ ID NO: 617673 - RNA, 19 nt, Escherichia coli CFT073
gcugcgcgcuuucuccagc

SEQ ID NO: 617674 - RNA, 18 nt, Escherichia coli CFT073
gcugcgcgauauuccgca

SEQ ID NO: 617675 - RNA, 20 nt, Escherichia coli CFT073
gcugcgcgauauuccgcaac

SEQ ID NO: 617676 - RNA, 19 nt, Escherichia coli CFT073
gcugcgccuaacaacugcu

SEQ ID NO: 617677 - RNA, 23 nt, Escherichia coli CFT073
gcugcgccaguugcuuauccagc

SEQ ID NO: 617678 - RNA, 24 nt, Escherichia coli CFT073
gcugcugcguuccggcaugauuca

SEQ ID NO: 617679 - RNA, 17 nt, Escherichia coli CFT073
gcugcuggcaucaccaa

SEQ ID NO: 617680 - RNA, 14 nt, Escherichia coli CFT073
gcuggaaccacagc

SEQ ID NO: 617681 - RNA, 13 nt, Escherichia coli CFT073
gcuggaucccaga

SEQ ID NO: 617682 - RNA, 14 nt, Escherichia coli CFT073
gcuggaagaccgua

SEQ ID NO: 617683 - RNA, 18 nt, Escherichia coli CFT073
gcugcgauccgcgcgggu

SEQ ID NO: 617684 - RNA, 22 nt, Escherichia coli CFT073
gcugcgauccgcgcggguaaaa

SEQ ID NO: 617685 - RNA, 19 nt, Escherichia coli CFT073
gcugcgaucgcaaauccac

SEQ ID NO: 617686 - RNA, 19 nt, Escherichia coli CFT073
gcugccuuuggcgucucca

SEQ ID NO: 617687 - RNA, 15 nt, Escherichia coli CFT073
gcugccuuucgcucc

SEQ ID NO: 617688 - RNA, 14 nt, Escherichia coli CFT073
gcugccuacacaau

SEQ ID NO: 617689 - RNA, 18 nt, Escherichia coli CFT073
gcugccguucucaaaggu

SEQ ID NO: 617690 - RNA, 14 nt, Escherichia coli CFT073
gcugccguuaaaga

SEQ ID NO: 617691 - RNA, 16 nt, Escherichia coli CFT073
gcugccguagccgaug

SEQ ID NO: 617692 - RNA, 12 nt, Escherichia coli CFT073
gcugccagcccc

SEQ ID NO: 617693 - RNA, 22 nt, Escherichia coli CFT073
gcugccagaaaucggccuucca

SEQ ID NO: 617694 - RNA, 15 nt, Escherichia coli CFT073
gcugccagaaccgcu

SEQ ID NO: 617695 - RNA, 22 nt, Escherichia coli CFT073
gcugccagagucagcaaugcca

SEQ ID NO: 617696 - RNA, 15 nt, Escherichia coli CFT073
gcugccagccaggau

SEQ ID NO: 617697 - RNA, 21 nt, Escherichia coli CFT073
gcugccggaacaggcaucacu

SEQ ID NO: 617698 - RNA, 23 nt, Escherichia coli CFT073
gcugccggaccaucuuccagcug

SEQ ID NO: 617699 - RNA, 16 nt, Escherichia coli CFT073
gcugauuuuauuucaa

SEQ ID NO: 617700 - RNA, 15 nt, Escherichia coli CFT073
gcugcaaaaagccuu

SEQ ID NO: 617701 - RNA, 20 nt, Escherichia coli CFT073
gcugcaaauauugccccagc

SEQ ID NO: 617702 - RNA, 18 nt, Escherichia coli CFT073
gcugcaacuggcggcggc

SEQ ID NO: 617703 - RNA, 13 nt, Escherichia coli CFT073
gcugcaauaaaau

SEQ ID NO: 617704 - RNA, 18 nt, Escherichia coli CFT073
gcugcacguuuucaaccg

SEQ ID NO: 617705 - RNA, 12 nt, Escherichia coli CFT073
gcugccacacug

SEQ ID NO: 617706 - RNA, 15 nt, Escherichia coli CFT073
gcugaucgucagcac

SEQ ID NO: 617707 - RNA, 17 nt, Escherichia coli CFT073
gcugaugugauaaugcc

SEQ ID NO: 617708 - RNA, 14 nt, Escherichia coli CFT073
gcugauucuuccca

SEQ ID NO: 617709 - RNA, 20 nt, Escherichia coli CFT073
gcugagaacauaaacaccca

SEQ ID NO: 617710 - RNA, 19 nt, Escherichia coli CFT073
gcugaucaccguagaaggc

SEQ ID NO: 617711 - RNA, 12 nt, Escherichia coli CFT073
gcugaauguucu

SEQ ID NO: 617712 - RNA, 13 nt, Escherichia coli CFT073
gcugaaucccugu

SEQ ID NO: 617713 - RNA, 17 nt, Escherichia coli CFT073
gcugacaggcgcugaug

SEQ ID NO: 617714 - RNA, 18 nt, Escherichia coli CFT073
gcugacauaaacaccagc

SEQ ID NO: 617715 - RNA, 20 nt, Escherichia coli CFT073
gcugacauaaacaccagcaa

SEQ ID NO: 617716 - RNA, 17 nt, Escherichia coli CFT073
gcugacauaaacaccag

SEQ ID NO: 617717 - RNA, 21 nt, Escherichia coli CFT073
gcugacauaaacaccagcaau

SEQ ID NO: 617718 - RNA, 20 nt, Escherichia coli CFT073
gcugacgcaucuuauccagc

SEQ ID NO: 617719 - RNA, 22 nt, Escherichia coli CFT073
gcugacgcaucuuauccagccu

SEQ ID NO: 617720 - RNA, 20 nt, Escherichia coli CFT073
gcugaccgucaaagcgccag

SEQ ID NO: 617721 - RNA, 20 nt, Escherichia coli CFT073
gcugaauaauccccacauca

SEQ ID NO: 617722 - RNA, 23 nt, Escherichia coli CFT073
gcugaauaauccccacaucaggc

SEQ ID NO: 617723 - RNA, 17 nt, Escherichia coli CFT073
gcugaagaaaaugguuu

SEQ ID NO: 617724 - RNA, 17 nt, Escherichia coli CFT073
gcugaacagucgcugau

SEQ ID NO: 617725 - RNA, 14 nt, Escherichia coli CFT073
gcugaacaucgucu

SEQ ID NO: 617726 - RNA, 15 nt, Escherichia coli CFT073
gcugaacgcaccuuc

SEQ ID NO: 617727 - RNA, 23 nt, Escherichia coli CFT073
gcugaaacgcucgcagcccgugg

SEQ ID NO: 617728 - RNA, 21 nt, Escherichia coli CFT073
gcugaaaucaccgccaccagc

SEQ ID NO: 617729 - RNA, 22 nt, Escherichia coli CFT073
gcugaaaucaccgccaccagcg

SEQ ID NO: 617730 - RNA, 21 nt, Escherichia coli CFT073
gcucucgccgcgcuccaucau

SEQ ID NO: 617731 - RNA, 16 nt, Escherichia coli CFT073
gcucgcugcaaaacag

SEQ ID NO: 617732 - RNA, 19 nt, Escherichia coli CFT073
gcucgcugcaaaacagguc

SEQ ID NO: 617733 - RNA, 17 nt, Escherichia coli CFT073
gcucgcugccaucgacu

SEQ ID NO: 617734 - RNA, 15 nt, Escherichia coli CFT073
gcucgcuggcaggcc

SEQ ID NO: 617735 - RNA, 22 nt, Escherichia coli CFT073
gcucgcgauacgcuucaaccag

SEQ ID NO: 617736 - RNA, 21 nt, Escherichia coli CFT073
gcucgcguucgauagcgcgcc

SEQ ID NO: 617737 - RNA, 15 nt, Escherichia coli CFT073
gcucgccgccgcaga

SEQ ID NO: 617738 - RNA, 18 nt, Escherichia coli CFT073
gcucuacaauugguaaau

SEQ ID NO: 617739 - RNA, 19 nt, Escherichia coli CFT073
gcucgugcgguaucaccac

SEQ ID NO: 617740 - RNA, 23 nt, Escherichia coli CFT073
gcucgugcgguaucaccacccag

SEQ ID NO: 617741 - RNA, 23 nt, Escherichia coli CFT073
gcucgcagaaauaccccgccagc

SEQ ID NO: 617742 - RNA, 20 nt, Escherichia coli CFT073
gcucgcagguuauaccuuua

SEQ ID NO: 617743 - RNA, 16 nt, Escherichia coli CFT073
gcucgaucaguucagc

SEQ ID NO: 617744 - RNA, 18 nt, Escherichia coli CFT073
gcucgaacagcugguuga

SEQ ID NO: 617745 - RNA, 20 nt, Escherichia coli CFT073
gcuccugcagaaaauccagc

SEQ ID NO: 617746 - RNA, 13 nt, Escherichia coli CFT073
gcuccuguugaug

SEQ ID NO: 617747 - RNA, 15 nt, Escherichia coli CFT073
gcuccuucucugagc

SEQ ID NO: 617748 - RNA, 17 nt, Escherichia coli CFT073
gcuccuucucugagcug

SEQ ID NO: 617749 - RNA, 18 nt, Escherichia coli CFT073
gcuccguccagccaccgc

SEQ ID NO: 617750 - RNA, 17 nt, Escherichia coli CFT073
gcuccgguacucaucag

SEQ ID NO: 617751 - RNA, 22 nt, Escherichia coli CFT073
gcuccgggugugacaacaacau

SEQ ID NO: 617752 - RNA, 15 nt, Escherichia coli CFT073
gcuccggcagcagca

SEQ ID NO: 617753 - RNA, 17 nt, Escherichia coli CFT073
gcuccggaagaugaaaa

SEQ ID NO: 617754 - RNA, 18 nt, Escherichia coli CFT073
gcuccggaagaugaaaaa

SEQ ID NO: 617755 - RNA, 19 nt, Escherichia coli CFT073
gcuccgccaucuucuugca

SEQ ID NO: 617756 - RNA, 11 nt, Escherichia coli CFT073
gcuccgccagc

SEQ ID NO: 617757 - RNA, 12 nt, Escherichia coli CFT073
gcucccucaaua

SEQ ID NO: 617758 - RNA, 16 nt, Escherichia coli CFT073
gcuccauaauugccag

SEQ ID NO: 617759 - RNA, 17 nt, Escherichia coli CFT073
gcuccaucaggucauca

SEQ ID NO: 617760 - RNA, 15 nt, Escherichia coli CFT073
gcucauuuucuuuca

SEQ ID NO: 617761 - RNA, 13 nt, Escherichia coli CFT073
gcucaucugacgu

SEQ ID NO: 617762 - RNA, 23 nt, Escherichia coli CFT073
gcuccaaucguucaaccacuucg

SEQ ID NO: 617763 - RNA, 19 nt, Escherichia coli CFT073
gcuccacacgcucuuccag

SEQ ID NO: 617764 - RNA, 23 nt, Escherichia coli CFT073
gcuccacaagaaugccugccagc

SEQ ID NO: 617765 - RNA, 17 nt, Escherichia coli CFT073
gcuccagccgcuccccu

SEQ ID NO: 617766 - RNA, 16 nt, Escherichia coli CFT073
gcuccagcagcucaau

SEQ ID NO: 617767 - RNA, 15 nt, Escherichia coli CFT073
gcucauagcggcugc

SEQ ID NO: 617768 - RNA, 20 nt, Escherichia coli CFT073
gcucauaugcagcauccagc

SEQ ID NO: 617769 - RNA, 22 nt, Escherichia coli CFT073
gcucauaugcagcauccagcug

SEQ ID NO: 617770 - RNA, 16 nt, Escherichia coli CFT073
gcucauaaaaucacgc

SEQ ID NO: 617771 - RNA, 18 nt, Escherichia coli CFT073
gcucaucaccgcaaaguc

SEQ ID NO: 617772 - RNA, 12 nt, Escherichia coli CFT073
gcucaucagcgg

SEQ ID NO: 617773 - RNA, 18 nt, Escherichia coli CFT073
gcucaucaggccuggcac

SEQ ID NO: 617774 - RNA, 22 nt, Escherichia coli CFT073
gcucaucagcggguuuucuacu

SEQ ID NO: 617775 - RNA, 23 nt, Escherichia coli CFT073
gcucauccuguggcuuuuuugua

SEQ ID NO: 617776 - RNA, 23 nt, Escherichia coli CFT073
gcucaucgaaaauacacgcugca

SEQ ID NO: 617777 - RNA, 14 nt, Escherichia coli CFT073
gcggucaaugguca

SEQ ID NO: 617778 - RNA, 16 nt, Escherichia coli CFT073
gcggucaaaagcugca

SEQ ID NO: 617779 - RNA, 15 nt, Escherichia coli CFT073
gcgguauuuaaacuc

SEQ ID NO: 617780 - RNA, 16 nt, Escherichia coli CFT073
gcgguaucaccaccca

SEQ ID NO: 617781 - RNA, 20 nt, Escherichia coli CFT073
guuuuauagcgggaaauacu

SEQ ID NO: 617782 - RNA, 13 nt, Escherichia coli CFT073
guuuuaguaacaa

SEQ ID NO: 617783 - RNA, 14 nt, Escherichia coli CFT073
aaaucagauaaaac

SEQ ID NO: 617784 - RNA, 15 nt, Escherichia coli CFT073
aaaucagauaaaaca

SEQ ID NO: 617785 - RNA, 17 nt, Escherichia coli CFT073
aaaucauauucuuuuug

SEQ ID NO: 617786 - RNA, 24 nt, Escherichia coli CFT073
aaauccagaaaaaaagcaucugcu

SEQ ID NO: 617787 - RNA, 20 nt, Escherichia coli CFT073
aaauccaaccucuucuuuua

SEQ ID NO: 617788 - RNA, 13 nt, Escherichia coli CFT073
aaaucauuuaucu

SEQ ID NO: 617789 - RNA, 11 nt, Escherichia coli CFT073
aaaucaucacu

SEQ ID NO: 617790 - RNA, 17 nt, Escherichia coli CFT073
guuuugcaaucaucgca

SEQ ID NO: 617791 - RNA, 23 nt, Escherichia coli CFT073
guuuugccagucaggcaugauca

SEQ ID NO: 617792 - RNA, 17 nt, Escherichia coli CFT073
guuuugccagucagcuc

SEQ ID NO: 617793 - RNA, 12 nt, Escherichia coli CFT073
guuuucaccagu

SEQ ID NO: 617794 - RNA, 18 nt, Escherichia coli CFT073
guuuucaaugucuccguu

SEQ ID NO: 617795 - RNA, 14 nt, Escherichia coli CFT073
guuuucaccggcac

SEQ ID NO: 617796 - RNA, 21 nt, Escherichia coli CFT073
guuuucaccuuacuuccggcu

SEQ ID NO: 617797 - RNA, 17 nt, Escherichia coli CFT073
guuuucaguagcaugaa

SEQ ID NO: 617798 - RNA, 13 nt, Escherichia coli CFT073
guuuucuuugcca

SEQ ID NO: 617799 - RNA, 16 nt, Escherichia coli CFT073
guuuucagcaccagau

SEQ ID NO: 617800 - RNA, 23 nt, Escherichia coli CFT073
guuugcucaucaugaaaugcagg

SEQ ID NO: 617801 - RNA, 19 nt, Escherichia coli CFT073
guuugccguuaaucucucc

SEQ ID NO: 617802 - RNA, 16 nt, Escherichia coli CFT073
guuugcgacaaacuuc

SEQ ID NO: 617803 - RNA, 21 nt, Escherichia coli CFT073
guuugcgcagccaguuaaccu

SEQ ID NO: 617804 - RNA, 20 nt, Escherichia coli CFT073
guuugcggaauaugcugaau

SEQ ID NO: 617805 - RNA, 16 nt, Escherichia coli CFT073
guuugcgggacaacuu

SEQ ID NO: 617806 - RNA, 18 nt, Escherichia coli CFT073
guuugcgguguguggcug

SEQ ID NO: 617807 - RNA, 19 nt, Escherichia coli CFT073
guuugcgucagcuucagau

SEQ ID NO: 617808 - RNA, 15 nt, Escherichia coli CFT073
guuugcgucauggua

SEQ ID NO: 617809 - RNA, 16 nt, Escherichia coli CFT073
guuuuaccuucauccc

SEQ ID NO: 617810 - RNA, 18 nt, Escherichia coli CFT073
guuuguugagauaauuua

SEQ ID NO: 617811 - RNA, 16 nt, Escherichia coli CFT073
guuugugguaaauuaa

SEQ ID NO: 617812 - RNA, 18 nt, Escherichia coli CFT073
guuugugacuuuaaaaaa

SEQ ID NO: 617813 - RNA, 19 nt, Escherichia coli CFT073
guuugaguucaccgccauu

SEQ ID NO: 617814 - RNA, 16 nt, Escherichia coli CFT073
guuugaucacuuccag

SEQ ID NO: 617815 - RNA, 18 nt, Escherichia coli CFT073
guuugaucacuuccagca

SEQ ID NO: 617816 - RNA, 21 nt, Escherichia coli CFT073
guuugccgcuuuuaacccaac

SEQ ID NO: 617817 - RNA, 20 nt, Escherichia coli CFT073
guuucuucgauggcuggggu

SEQ ID NO: 617818 - RNA, 19 nt, Escherichia coli CFT073
guuugacauaaauuccgcu

SEQ ID NO: 617819 - RNA, 13 nt, Escherichia coli CFT073
guuucuuccagcc

SEQ ID NO: 617820 - RNA, 15 nt, Escherichia coli CFT073
guuucuuccagccac

SEQ ID NO: 617821 - RNA, 14 nt, Escherichia coli CFT073
guuucuucacccuu

SEQ ID NO: 617822 - RNA, 16 nt, Escherichia coli CFT073
guuucugcgcuucugc

SEQ ID NO: 617823 - RNA, 13 nt, Escherichia coli CFT073
guuucucuuucuu

SEQ ID NO: 617824 - RNA, 16 nt, Escherichia coli CFT073
guuucugccgguucgg

SEQ ID NO: 617825 - RNA, 16 nt, Escherichia coli CFT073
guuucgguagaaaaau

SEQ ID NO: 617826 - RNA, 16 nt, Escherichia coli CFT073
guuucgcuucuucagc

SEQ ID NO: 617827 - RNA, 18 nt, Escherichia coli CFT073
guuucgcccguucuuccu

SEQ ID NO: 617828 - RNA, 21 nt, Escherichia coli CFT073
guuucgaucagcaauuucucc

SEQ ID NO: 617829 - RNA, 12 nt, Escherichia coli CFT073
guuucgccagcc

SEQ ID NO: 617830 - RNA, 22 nt, Escherichia coli CFT073
aaaucaacgacaaaaauaccac

SEQ ID NO: 617831 - RNA, 20 nt, Escherichia coli CFT073
aaaucacucgccgcugcgga

SEQ ID NO: 617832 - RNA, 22 nt, Escherichia coli CFT073
aaaucacuauuaaagaaaguaa

SEQ ID NO: 617833 - RNA, 22 nt, Escherichia coli CFT073
aaaucacuaaacccgaccacuu

SEQ ID NO: 617834 - RNA, 18 nt, Escherichia coli CFT073
aaaucacuauuaaagaaa

SEQ ID NO: 617835 - RNA, 20 nt, Escherichia coli CFT073
aaaucacuauuaaagaaagu

SEQ ID NO: 617836 - RNA, 18 nt, Escherichia coli CFT073
guuucucugacgcucuca

SEQ ID NO: 617837 - RNA, 23 nt, Escherichia coli CFT073
guuucucugacgcucucaacgcc

SEQ ID NO: 617838 - RNA, 14 nt, Escherichia coli CFT073
aaaucaccaccagc

SEQ ID NO: 617839 - RNA, 21 nt, Escherichia coli CFT073
aaaucaccauauucagcagca

SEQ ID NO: 617840 - RNA, 17 nt, Escherichia coli CFT073
aaaucaccaccagcacc

SEQ ID NO: 617841 - RNA, 20 nt, Escherichia coli CFT073
aaaucaccgaugacagaauc

SEQ ID NO: 617842 - RNA, 17 nt, Escherichia coli CFT073
aaaucaccgccaccagc

SEQ ID NO: 617843 - RNA, 13 nt, Escherichia coli CFT073
aaaucaacauguu

SEQ ID NO: 617844 - RNA, 13 nt, Escherichia coli CFT073
aaaucaaauacau

SEQ ID NO: 617845 - RNA, 11 nt, Escherichia coli CFT073
aaaucaaauca

SEQ ID NO: 617846 - RNA, 16 nt, Escherichia coli CFT073
aaauauuuucagggga

SEQ ID NO: 617847 - RNA, 23 nt, Escherichia coli CFT073
guuuccuggagaguguuuuaucu

SEQ ID NO: 617848 - RNA, 15 nt, Escherichia coli CFT073
aaauauugcuaacug

SEQ ID NO: 617849 - RNA, 18 nt, Escherichia coli CFT073
guuuccauucgcugcugc

SEQ ID NO: 617850 - RNA, 20 nt, Escherichia coli CFT073
guuucccgcuccaaaauuug

SEQ ID NO: 617851 - RNA, 13 nt, Escherichia coli CFT073
guuuccauucgcu

SEQ ID NO: 617852 - RNA, 12 nt, Escherichia coli CFT073
guuuccaggcag

SEQ ID NO: 617853 - RNA, 13 nt, Escherichia coli CFT073
guuuccaggcagc

SEQ ID NO: 617854 - RNA, 13 nt, Escherichia coli CFT073
guuuccauaaccg

SEQ ID NO: 617855 - RNA, 17 nt, Escherichia coli CFT073
guuuccauaucgcuggc

SEQ ID NO: 617856 - RNA, 18 nt, Escherichia coli CFT073
guuuccauaucgcuggcu

SEQ ID NO: 617857 - RNA, 21 nt, Escherichia coli CFT073
aaauauuguuuuuauugucau

SEQ ID NO: 617858 - RNA, 22 nt, Escherichia coli CFT073
guuucacaacauugauaagcaa

SEQ ID NO: 617859 - RNA, 15 nt, Escherichia coli CFT073
guuucaauccaggua

SEQ ID NO: 617860 - RNA, 17 nt, Escherichia coli CFT073
guuuaugccggaugcgg

SEQ ID NO: 617861 - RNA, 23 nt, Escherichia coli CFT073
guuucaacggaccaauaaacgcc

SEQ ID NO: 617862 - RNA, 20 nt, Escherichia coli CFT073
guuucaacaucauuucccac

SEQ ID NO: 617863 - RNA, 18 nt, Escherichia coli CFT073
guuucaacauuuccagcg

SEQ ID NO: 617864 - RNA, 14 nt, Escherichia coli CFT073
guuucaaccagcag

SEQ ID NO: 617865 - RNA, 15 nt, Escherichia coli CFT073
guuucaaccagcagg

SEQ ID NO: 617866 - RNA, 21 nt, Escherichia coli CFT073
guuuaucaauuaacugugcca

SEQ ID NO: 617867 - RNA, 21 nt, Escherichia coli CFT073
guuuaugcaauagcgccugcu

SEQ ID NO: 617868 - RNA, 12 nt, Escherichia coli CFT073
guuuauccaucu

SEQ ID NO: 617869 - RNA, 17 nt, Escherichia coli CFT073
guuuacuaaaaguuauu

SEQ ID NO: 617870 - RNA, 18 nt, Escherichia coli CFT073
guuuacucguccauagua

SEQ ID NO: 617871 - RNA, 20 nt, Escherichia coli CFT073
guuuacuuccccggcagugc

SEQ ID NO: 617872 - RNA, 23 nt, Escherichia coli CFT073
guuuacuucgcuuuacccugguu

SEQ ID NO: 617873 - RNA, 14 nt, Escherichia coli CFT073
guuuaaggaaaaac

SEQ ID NO: 617874 - RNA, 17 nt, Escherichia coli CFT073
guuuaaugguuugcccu

SEQ ID NO: 617875 - RNA, 14 nt, Escherichia coli CFT073
guuuacgauuguua

SEQ ID NO: 617876 - RNA, 19 nt, Escherichia coli CFT073
guuuacgccgcaucaggcc

SEQ ID NO: 617877 - RNA, 19 nt, Escherichia coli CFT073
guuuaacacgcucuggaug

SEQ ID NO: 617878 - RNA, 21 nt, Escherichia coli CFT073
guugucaccccuaaaccucuu

SEQ ID NO: 617879 - RNA, 11 nt, Escherichia coli CFT073
aaauauuauug

SEQ ID NO: 617880 - RNA, 19 nt, Escherichia coli CFT073
aaauaugcuuuuauucaug

SEQ ID NO: 617881 - RNA, 21 nt, Escherichia coli CFT073
aaauaugcuuuuauucauguu

SEQ ID NO: 617882 - RNA, 21 nt, Escherichia coli CFT073
guuucagugacgucacuuaau

SEQ ID NO: 617883 - RNA, 14 nt, Escherichia coli CFT073
guuucauaguuuua

SEQ ID NO: 617884 - RNA, 16 nt, Escherichia coli CFT073
guuucauaucugccag

SEQ ID NO: 617885 - RNA, 11 nt, Escherichia coli CFT073
guuucaucuca

SEQ ID NO: 617886 - RNA, 13 nt, Escherichia coli CFT073
guuucaucuucag

SEQ ID NO: 617887 - RNA, 16 nt, Escherichia coli CFT073
guuucacguaccagau

SEQ ID NO: 617888 - RNA, 18 nt, Escherichia coli CFT073
guuucacuaagauguugu

SEQ ID NO: 617889 - RNA, 23 nt, Escherichia coli CFT073
guuucacuaagauguuguucaau

SEQ ID NO: 617890 - RNA, 22 nt, Escherichia coli CFT073
guuucaccagcaguaaaccgcu

SEQ ID NO: 617891 - RNA, 14 nt, Escherichia coli CFT073
aaauaucgagcagc

SEQ ID NO: 617892 - RNA, 20 nt, Escherichia coli CFT073
guuucagccccaucagcgcc

SEQ ID NO: 617893 - RNA, 14 nt, Escherichia coli CFT073
aaauaucuucuacu

SEQ ID NO: 617894 - RNA, 17 nt, Escherichia coli CFT073
aaauaugaaaucucuug

SEQ ID NO: 617895 - RNA, 20 nt, Escherichia coli CFT073
aaauaugaugaaggacaaug

SEQ ID NO: 617896 - RNA, 15 nt, Escherichia coli CFT073
guuggaauaaacaaa

SEQ ID NO: 617897 - RNA, 17 nt, Escherichia coli CFT073
guuggcgaauaaccgcu

SEQ ID NO: 617898 - RNA, 15 nt, Escherichia coli CFT073
guuggcgcagcaaau

SEQ ID NO: 617899 - RNA, 19 nt, Escherichia coli CFT073
guuggcgcugaaucccgca

SEQ ID NO: 617900 - RNA, 22 nt, Escherichia coli CFT073
guugguagagcacgaccuugcc

SEQ ID NO: 617901 - RNA, 23 nt, Escherichia coli CFT073
guuggucaucaucaggaacaucc

SEQ ID NO: 617902 - RNA, 17 nt, Escherichia coli CFT073
guugcucucgccagcac

SEQ ID NO: 617903 - RNA, 17 nt, Escherichia coli CFT073
guugcucaugcaacaca

SEQ ID NO: 617904 - RNA, 15 nt, Escherichia coli CFT073
guugcuaacggccac

SEQ ID NO: 617905 - RNA, 17 nt, Escherichia coli CFT073
guugcgcgacggugcgg

SEQ ID NO: 617906 - RNA, 18 nt, Escherichia coli CFT073
guugcgcgguuagaaaau

SEQ ID NO: 617907 - RNA, 21 nt, Escherichia coli CFT073
guugcgcagaguuuccaggcu

SEQ ID NO: 617908 - RNA, 16 nt, Escherichia coli CFT073
guugcgcaugaccuuu

SEQ ID NO: 617909 - RNA, 17 nt, Escherichia coli CFT073
guugcgcccaucaucau

SEQ ID NO: 617910 - RNA, 18 nt, Escherichia coli CFT073
guugcgcccaucaucauc

SEQ ID NO: 617911 - RNA, 21 nt, Escherichia coli CFT073
guugcggguaaucaucgccuu

SEQ ID NO: 617912 - RNA, 21 nt, Escherichia coli CFT073
guugcgcugaaacuucaccaa

SEQ ID NO: 617913 - RNA, 23 nt, Escherichia coli CFT073
guugcgcuucacgaucuucacgg

SEQ ID NO: 617914 - RNA, 17 nt, Escherichia coli CFT073
guucucaccaacuggcg

SEQ ID NO: 617915 - RNA, 15 nt, Escherichia coli CFT073
guucucgcaaaacgu

SEQ ID NO: 617916 - RNA, 22 nt, Escherichia coli CFT073
guucuccacucugccaggcagc

SEQ ID NO: 617917 - RNA, 20 nt, Escherichia coli CFT073
guucucccauaggaugaggu

SEQ ID NO: 617918 - RNA, 12 nt, Escherichia coli CFT073
guucuccucaac

SEQ ID NO: 617919 - RNA, 16 nt, Escherichia coli CFT073
guucucgcgauaaaac

SEQ ID NO: 617920 - RNA, 18 nt, Escherichia coli CFT073
guugaggaacucaaacca

SEQ ID NO: 617921 - RNA, 15 nt, Escherichia coli CFT073
guugcaggaaggcga

SEQ ID NO: 617922 - RNA, 16 nt, Escherichia coli CFT073
guugauaaugauuuug

SEQ ID NO: 617923 - RNA, 22 nt, Escherichia coli CFT073
guugauacucauuguuaucagc

SEQ ID NO: 617924 - RNA, 12 nt, Escherichia coli CFT073
guugcaccagca

SEQ ID NO: 617925 - RNA, 21 nt, Escherichia coli CFT073
guugccugaauacacugcuga

SEQ ID NO: 617926 - RNA, 14 nt, Escherichia coli CFT073
guugccugcacuca

SEQ ID NO: 617927 - RNA, 15 nt, Escherichia coli CFT073
guugccuguuucaua

SEQ ID NO: 617928 - RNA, 14 nt, Escherichia coli CFT073
guugcgacaaacca

SEQ ID NO: 617929 - RNA, 16 nt, Escherichia coli CFT073
guugccgcuuuuucca

SEQ ID NO: 617930 - RNA, 18 nt, Escherichia coli CFT073
guugccggagaaacuccg

SEQ ID NO: 617931 - RNA, 13 nt, Escherichia coli CFT073
guugcaguaaaau

SEQ ID NO: 617932 - RNA, 16 nt, Escherichia coli CFT073
guugcaguuauuauaa

SEQ ID NO: 617933 - RNA, 24 nt, Escherichia coli CFT073
guucauccagacggguaaacggca

SEQ ID NO: 617934 - RNA, 18 nt, Escherichia coli CFT073
guucauccccucuuccau

SEQ ID NO: 617935 - RNA, 15 nt, Escherichia coli CFT073
guucagcggugucug

SEQ ID NO: 617936 - RNA, 17 nt, Escherichia coli CFT073
guucaggauaauuaucu

SEQ ID NO: 617937 - RNA, 19 nt, Escherichia coli CFT073
guucagggauacaagccac

SEQ ID NO: 617938 - RNA, 20 nt, Escherichia coli CFT073
guuccacauaaaguagccaa

SEQ ID NO: 617939 - RNA, 14 nt, Escherichia coli CFT073
guuauugccuggca

SEQ ID NO: 617940 - RNA, 18 nt, Escherichia coli CFT073
guuauuuguucagcaaau

SEQ ID NO: 617941 - RNA, 15 nt, Escherichia coli CFT073
guucaccaccuggcg

SEQ ID NO: 617942 - RNA, 14 nt, Escherichia coli CFT073
guucaccagguuuu

SEQ ID NO: 617943 - RNA, 17 nt, Escherichia coli CFT073
guucagccgcuuuaucu

SEQ ID NO: 617944 - RNA, 15 nt, Escherichia coli CFT073
guucagcaguucugc

SEQ ID NO: 617945 - RNA, 19 nt, Escherichia coli CFT073
guucacgccgcaucuggca

SEQ ID NO: 617946 - RNA, 13 nt, Escherichia coli CFT073
guuccuugcugcg

SEQ ID NO: 617947 - RNA, 19 nt, Escherichia coli CFT073
guucgccagcuccagcgcu

SEQ ID NO: 617948 - RNA, 19 nt, Escherichia coli CFT073
guucgccuucauucaccag

SEQ ID NO: 617949 - RNA, 21 nt, Escherichia coli CFT073
guucgccauuuagcagggcag

SEQ ID NO: 617950 - RNA, 19 nt, Escherichia coli CFT073
guucggcgagcaguuguuc

SEQ ID NO: 617951 - RNA, 15 nt, Escherichia coli CFT073
guuccuucaagccau

SEQ ID NO: 617952 - RNA, 22 nt, Escherichia coli CFT073
guuccggcaaucaacagauaaa

SEQ ID NO: 617953 - RNA, 21 nt, Escherichia coli CFT073
guucccaaaucaaaucauccu

SEQ ID NO: 617954 - RNA, 14 nt, Escherichia coli CFT073
guuccauaaucgcc

SEQ ID NO: 617955 - RNA, 22 nt, Escherichia coli CFT073
guuccauaaucgccugaccgau

SEQ ID NO: 617956 - RNA, 14 nt, Escherichia coli CFT073
guuccauccaccag

SEQ ID NO: 617957 - RNA, 18 nt, Escherichia coli CFT073
guuccauccaccagcccc

SEQ ID NO: 617958 - RNA, 13 nt, Escherichia coli CFT073
guuaugcucggca

SEQ ID NO: 617959 - RNA, 20 nt, Escherichia coli CFT073
guuauugauaucuuccaugc

SEQ ID NO: 617960 - RNA, 13 nt, Escherichia coli CFT073
guuauugauggug

SEQ ID NO: 617961 - RNA, 13 nt, Escherichia coli CFT073
guuauugccaauc

SEQ ID NO: 617962 - RNA, 20 nt, Escherichia coli CFT073
guuauguacgcguaaaauau

SEQ ID NO: 617963 - RNA, 22 nt, Escherichia coli CFT073
guuaugcaccgacaauccaguu

SEQ ID NO: 617964 - RNA, 18 nt, Escherichia coli CFT073
guuaucagcaauaaaaaa

SEQ ID NO: 617965 - RNA, 12 nt, Escherichia coli CFT073
guuaucaauuau

SEQ ID NO: 617966 - RNA, 23 nt, Escherichia coli CFT073
guuaucagaaccgcccagaccug

SEQ ID NO: 617967 - RNA, 19 nt, Escherichia coli CFT073
guuauaccacuuacauucc

SEQ ID NO: 617968 - RNA, 14 nt, Escherichia coli CFT073
guuauaccagucca

SEQ ID NO: 617969 - RNA, 23 nt, Escherichia coli CFT073
guuagucgcugugacauccagau

SEQ ID NO: 617970 - RNA, 23 nt, Escherichia coli CFT073
guuagucgcuuucauucagaaca

SEQ ID NO: 617971 - RNA, 23 nt, Escherichia coli CFT073
guuauagcgauuuuucaucacug

SEQ ID NO: 617972 - RNA, 14 nt, Escherichia coli CFT073
guuaccgccagcac

SEQ ID NO: 617973 - RNA, 15 nt, Escherichia coli CFT073
guuaccgccagcacc

SEQ ID NO: 617974 - RNA, 21 nt, Escherichia coli CFT073
guuacccgacgcgccagguac

SEQ ID NO: 617975 - RNA, 17 nt, Escherichia coli CFT073
guuaccgaauccagcaa

SEQ ID NO: 617976 - RNA, 12 nt, Escherichia coli CFT073
guuacccagcac

SEQ ID NO: 617977 - RNA, 14 nt, Escherichia coli CFT073
guuacccagcgcca

SEQ ID NO: 617978 - RNA, 15 nt, Escherichia coli CFT073
guuacccagcgccau

SEQ ID NO: 617979 - RNA, 21 nt, Escherichia coli CFT073
guuacccagcgccaugccaac

SEQ ID NO: 617980 - RNA, 18 nt, Escherichia coli CFT073
guuaccuucggccccauc

SEQ ID NO: 617981 - RNA, 17 nt, Escherichia coli CFT073
guuaccguaccaggcau

SEQ ID NO: 617982 - RNA, 17 nt, Escherichia coli CFT073
guuagaaacgccccagc

SEQ ID NO: 617983 - RNA, 18 nt, Escherichia coli CFT073
guuaauuuccucuucccg

SEQ ID NO: 617984 - RNA, 14 nt, Escherichia coli CFT073
guuaauucucccug

SEQ ID NO: 617985 - RNA, 16 nt, Escherichia coli CFT073
guuaauucucccugcg

SEQ ID NO: 617986 - RNA, 22 nt, Escherichia coli CFT073
guuaaucucucccguugcuucu

SEQ ID NO: 617987 - RNA, 19 nt, Escherichia coli CFT073
guuaaugcuccccuuucuu

SEQ ID NO: 617988 - RNA, 12 nt, Escherichia coli CFT073
guuaagcauucg

SEQ ID NO: 617989 - RNA, 20 nt, Escherichia coli CFT073
guuaaggccgcuuucagagc

SEQ ID NO: 617990 - RNA, 13 nt, Escherichia coli CFT073
guuaagauucagc

SEQ ID NO: 617991 - RNA, 12 nt, Escherichia coli CFT073
guuaaccauaau

SEQ ID NO: 617992 - RNA, 16 nt, Escherichia coli CFT073
guuaaccauaaucuca

SEQ ID NO: 617993 - RNA, 18 nt, Escherichia coli CFT073
guuaacccagcacuuaac

SEQ ID NO: 617994 - RNA, 16 nt, Escherichia coli CFT073
guuaaccgcuucggaa

SEQ ID NO: 617995 - RNA, 17 nt, Escherichia coli CFT073
guuaaaacgcacgcugu

SEQ ID NO: 617996 - RNA, 10 nt, Escherichia coli CFT073
guuaaccagc

SEQ ID NO: 617997 - RNA, 12 nt, Escherichia coli CFT073
guuaaccagcac

SEQ ID NO: 617998 - RNA, 17 nt, Escherichia coli CFT073
guuaaaaaaagaacaac

SEQ ID NO: 617999 - RNA, 22 nt, Escherichia coli CFT073
guguugccgccaccuuucuguu

SEQ ID NO: 618000 - RNA, 13 nt, Escherichia coli CFT073
aaauaucaccaau

SEQ ID NO: 618001 - RNA, 23 nt, Escherichia coli CFT073
aaauaucacucggggcuuuucuc

SEQ ID NO: 618002 - RNA, 17 nt, Escherichia coli CFT073
aaauaucaaaaacaaau

SEQ ID NO: 618003 - RNA, 20 nt, Escherichia coli CFT073
aaauaucaaaaacaaauuuu

SEQ ID NO: 618004 - RNA, 20 nt, Escherichia coli CFT073
gugugacguuauugguggug

SEQ ID NO: 618005 - RNA, 16 nt, Escherichia coli CFT073
guguggagugcagcac

SEQ ID NO: 618006 - RNA, 17 nt, Escherichia coli CFT073
gugugcuacggucugcc

SEQ ID NO: 618007 - RNA, 16 nt, Escherichia coli CFT073
gugugguugcggacug

SEQ ID NO: 618008 - RNA, 15 nt, Escherichia coli CFT073
gugugguaaauuuug

SEQ ID NO: 618009 - RNA, 17 nt, Escherichia coli CFT073
guguggcaucguccguc

SEQ ID NO: 618010 - RNA, 12 nt, Escherichia coli CFT073
guguuaauaaug

SEQ ID NO: 618011 - RNA, 17 nt, Escherichia coli CFT073
guguuaggaucacgccc

SEQ ID NO: 618012 - RNA, 14 nt, Escherichia coli CFT073
guguuacgccgcac

SEQ ID NO: 618013 - RNA, 14 nt, Escherichia coli CFT073
guguuccagagaac

SEQ ID NO: 618014 - RNA, 17 nt, Escherichia coli CFT073
gugggucagcggcggcu

SEQ ID NO: 618015 - RNA, 22 nt, Escherichia coli CFT073
guggguacuguaucgaugcugu

SEQ ID NO: 618016 - RNA, 22 nt, Escherichia coli CFT073
gugguguguuugaucacuucca

SEQ ID NO: 618017 - RNA, 20 nt, Escherichia coli CFT073
guguaccugucgggacacga

SEQ ID NO: 618018 - RNA, 19 nt, Escherichia coli CFT073
guguacauccuuguacaug

SEQ ID NO: 618019 - RNA, 17 nt, Escherichia coli CFT073
gugguuaccaucaacca

SEQ ID NO: 618020 - RNA, 20 nt, Escherichia coli CFT073
gugucuaacgaugccagcgc

SEQ ID NO: 618021 - RNA, 13 nt, Escherichia coli CFT073
gugugaaaccuuu

SEQ ID NO: 618022 - RNA, 18 nt, Escherichia coli CFT073
guguccaguaauggccaa

SEQ ID NO: 618023 - RNA, 13 nt, Escherichia coli CFT073
guguccacuuccg

SEQ ID NO: 618024 - RNA, 20 nt, Escherichia coli CFT073
guggcaucuggugccagcgc

SEQ ID NO: 618025 - RNA, 15 nt, Escherichia coli CFT073
guggcaucagguuua

SEQ ID NO: 618026 - RNA, 16 nt, Escherichia coli CFT073
guggccacagcaagca

SEQ ID NO: 618027 - RNA, 13 nt, Escherichia coli CFT073
guggcagggcagc

SEQ ID NO: 618028 - RNA, 15 nt, Escherichia coli CFT073
guggcagggcagcga

SEQ ID NO: 618029 - RNA, 18 nt, Escherichia coli CFT073
guggcucaggcucucauu

SEQ ID NO: 618030 - RNA, 16 nt, Escherichia coli CFT073
guggcguuuccagcag

SEQ ID NO: 618031 - RNA, 19 nt, Escherichia coli CFT073
guggcguuuuuaucgccca

SEQ ID NO: 618032 - RNA, 18 nt, Escherichia coli CFT073
gugggauuccagcgccgc

SEQ ID NO: 618033 - RNA, 15 nt, Escherichia coli CFT073
guggcguuuccagca

SEQ ID NO: 618034 - RNA, 23 nt, Escherichia coli CFT073
guggcguaaacgccuuauccggc

SEQ ID NO: 618035 - RNA, 16 nt, Escherichia coli CFT073
guggcgccccacuuca

SEQ ID NO: 618036 - RNA, 20 nt, Escherichia coli CFT073
guggcgcaggggcagaaaca

SEQ ID NO: 618037 - RNA, 20 nt, Escherichia coli CFT073
guggcgauucauaugcgcca

SEQ ID NO: 618038 - RNA, 15 nt, Escherichia coli CFT073
guggcgaugaugauc

SEQ ID NO: 618039 - RNA, 19 nt, Escherichia coli CFT073
guggcgauaaucagcgcca

SEQ ID NO: 618040 - RNA, 15 nt, Escherichia coli CFT073
guggaacucuucaca

SEQ ID NO: 618041 - RNA, 17 nt, Escherichia coli CFT073
guggaaucaaugugcuu

SEQ ID NO: 618042 - RNA, 16 nt, Escherichia coli CFT073
guggcaaauugcccaa

SEQ ID NO: 618043 - RNA, 14 nt, Escherichia coli CFT073
guggcaaaauccaa

SEQ ID NO: 618044 - RNA, 16 nt, Escherichia coli CFT073
guggaucgauuucaau

SEQ ID NO: 618045 - RNA, 16 nt, Escherichia coli CFT073
guggauagacgcaggu

SEQ ID NO: 618046 - RNA, 18 nt, Escherichia coli CFT073
gugcuguucugccgggug

SEQ ID NO: 618047 - RNA, 20 nt, Escherichia coli CFT073
gugcuggauuugugucagaa

SEQ ID NO: 618048 - RNA, 14 nt, Escherichia coli CFT073
aaauauacacgaaa

SEQ ID NO: 618049 - RNA, 20 nt, Escherichia coli CFT073
gugcagggugagggcaauaa

SEQ ID NO: 618050 - RNA, 21 nt, Escherichia coli CFT073
aaauauaaaccguccccaaaa

SEQ ID NO: 618051 - RNA, 22 nt, Escherichia coli CFT073
gugacuucauucagaaaaacua

SEQ ID NO: 618052 - RNA, 16 nt, Escherichia coli CFT073
gugacuuuaaaaaaau

SEQ ID NO: 618053 - RNA, 15 nt, Escherichia coli CFT073
gugacugccgccagc

SEQ ID NO: 618054 - RNA, 11 nt, Escherichia coli CFT073
gugacugcuga

SEQ ID NO: 618055 - RNA, 16 nt, Escherichia coli CFT073
gugacugcuuuuucaa

SEQ ID NO: 618056 - RNA, 16 nt, Escherichia coli CFT073
gugacuggaaaucaaa

SEQ ID NO: 618057 - RNA, 17 nt, Escherichia coli CFT073
gugacuagcagcauuuc

SEQ ID NO: 618058 - RNA, 19 nt, Escherichia coli CFT073
gugacuagcagcauuucaa

SEQ ID NO: 618059 - RNA, 22 nt, Escherichia coli CFT073
gugagccaggacgauaaaccag

SEQ ID NO: 618060 - RNA, 15 nt, Escherichia coli CFT073
gugagcacaucagcg

SEQ ID NO: 618061 - RNA, 17 nt, Escherichia coli CFT073
gugaguugguuauucaa

SEQ ID NO: 618062 - RNA, 22 nt, Escherichia coli CFT073
gugaguuugucgggcaggagcu

SEQ ID NO: 618063 - RNA, 20 nt, Escherichia coli CFT073
gugauaaaagucaggcaauu

SEQ ID NO: 618064 - RNA, 23 nt, Escherichia coli CFT073
gugauaaacccaacggcaaacau

SEQ ID NO: 618065 - RNA, 14 nt, Escherichia coli CFT073
gugaggaucaccag

SEQ ID NO: 618066 - RNA, 12 nt, Escherichia coli CFT073
gugagcgugcgg

SEQ ID NO: 618067 - RNA, 15 nt, Escherichia coli CFT073
gugagcuguccugua

SEQ ID NO: 618068 - RNA, 17 nt, Escherichia coli CFT073
gugaggcggucuguauu

SEQ ID NO: 618069 - RNA, 22 nt, Escherichia coli CFT073
gugaggggaacccguuggcaca

SEQ ID NO: 618070 - RNA, 15 nt, Escherichia coli CFT073
gugcaaucagcggcg

SEQ ID NO: 618071 - RNA, 15 nt, Escherichia coli CFT073
gugcacgugccagau

SEQ ID NO: 618072 - RNA, 15 nt, Escherichia coli CFT073
gugcacuuacaaggu

SEQ ID NO: 618073 - RNA, 23 nt, Escherichia coli CFT073
gugcacuuguuuaugccagaugc

SEQ ID NO: 618074 - RNA, 19 nt, Escherichia coli CFT073
gugcagaaucaaucucagc

SEQ ID NO: 618075 - RNA, 22 nt, Escherichia coli CFT073
gugcagacauuccccgccagga

SEQ ID NO: 618076 - RNA, 18 nt, Escherichia coli CFT073
gugcaggaauggcugggg

SEQ ID NO: 618077 - RNA, 19 nt, Escherichia coli CFT073
gugauucagggcagcaaua

SEQ ID NO: 618078 - RNA, 21 nt, Escherichia coli CFT073
gugauucauaguaagcagauu

SEQ ID NO: 618079 - RNA, 22 nt, Escherichia coli CFT073
gugaucgccccggaagccagac

SEQ ID NO: 618080 - RNA, 16 nt, Escherichia coli CFT073
gugauugcuuuuguua

SEQ ID NO: 618081 - RNA, 22 nt, Escherichia coli CFT073
gugauugccgcgacgguugcgg

SEQ ID NO: 618082 - RNA, 19 nt, Escherichia coli CFT073
gugauuuacuuucuugcca

SEQ ID NO: 618083 - RNA, 21 nt, Escherichia coli CFT073
gugauuucaggcuuuuuucca

SEQ ID NO: 618084 - RNA, 18 nt, Escherichia coli CFT073
gugcaacuuuacuaaaaa

SEQ ID NO: 618085 - RNA, 21 nt, Escherichia coli CFT073
gugaacugccacacaggccau

SEQ ID NO: 618086 - RNA, 14 nt, Escherichia coli CFT073
gugaagcaccugcg

SEQ ID NO: 618087 - RNA, 18 nt, Escherichia coli CFT073
gugaagcacguaaaucuu

SEQ ID NO: 618088 - RNA, 21 nt, Escherichia coli CFT073
gugaagacggccaucccagug

SEQ ID NO: 618089 - RNA, 18 nt, Escherichia coli CFT073
gugaagagauccaccagc

SEQ ID NO: 618090 - RNA, 17 nt, Escherichia coli CFT073
gugaacccggcgauuga

SEQ ID NO: 618091 - RNA, 15 nt, Escherichia coli CFT073
aaauagcucaaugaa

SEQ ID NO: 618092 - RNA, 14 nt, Escherichia coli CFT073
aaauagccugccag

SEQ ID NO: 618093 - RNA, 17 nt, Escherichia coli CFT073
aaauagcgccauaaaac

SEQ ID NO: 618094 - RNA, 21 nt, Escherichia coli CFT073
gugaaguugccggauguguug

SEQ ID NO: 618095 - RNA, 14 nt, Escherichia coli CFT073
gugaauucaucgua

SEQ ID NO: 618096 - RNA, 15 nt, Escherichia coli CFT073
gugaauuucacuuuc

SEQ ID NO: 618097 - RNA, 22 nt, Escherichia coli CFT073
gugaauuucacuuucugaccau

SEQ ID NO: 618098 - RNA, 14 nt, Escherichia coli CFT073
gugaaucacuccau

SEQ ID NO: 618099 - RNA, 18 nt, Escherichia coli CFT073
gugaaucccaguacugua

SEQ ID NO: 618100 - RNA, 14 nt, Escherichia coli CFT073
gugaaucucaggca

SEQ ID NO: 618101 - RNA, 16 nt, Escherichia coli CFT073
gugaaucucaggcaaa

SEQ ID NO: 618102 - RNA, 17 nt, Escherichia coli CFT073
gugaaugguggcgauga

SEQ ID NO: 618103 - RNA, 21 nt, Escherichia coli CFT073
gugacgccugcuccaucaucc

SEQ ID NO: 618104 - RNA, 21 nt, Escherichia coli CFT073
gugacgguuuuacgcucccac

SEQ ID NO: 618105 - RNA, 13 nt, Escherichia coli CFT073
gugacgucacuua

SEQ ID NO: 618106 - RNA, 20 nt, Escherichia coli CFT073
gugacgucucaaucaccacc

SEQ ID NO: 618107 - RNA, 22 nt, Escherichia coli CFT073
gugaccaucagcaugacaaaaa

SEQ ID NO: 618108 - RNA, 13 nt, Escherichia coli CFT073
gugaccaucuucc

SEQ ID NO: 618109 - RNA, 18 nt, Escherichia coli CFT073
gugacccgcagccagcac

SEQ ID NO: 618110 - RNA, 13 nt, Escherichia coli CFT073
gugacauuaacca

SEQ ID NO: 618111 - RNA, 15 nt, Escherichia coli CFT073
gugacagaggauauu

SEQ ID NO: 618112 - RNA, 23 nt, Escherichia coli CFT073
gugacaccaccgcccgguuuuuu

SEQ ID NO: 618113 - RNA, 21 nt, Escherichia coli CFT073
gugaaaaaccaaucucccagc

SEQ ID NO: 618114 - RNA, 23 nt, Escherichia coli CFT073
gugaaaaauaaaagcgugaaaca

SEQ ID NO: 618115 - RNA, 13 nt, Escherichia coli CFT073
gucuuuugaucaa

SEQ ID NO: 618116 - RNA, 15 nt, Escherichia coli CFT073
gucuuguuacuggcu

SEQ ID NO: 618117 - RNA, 14 nt, Escherichia coli CFT073
gugaaaaucgaguu

SEQ ID NO: 618118 - RNA, 23 nt, Escherichia coli CFT073
gugaaaccgcagcaacuacagca

SEQ ID NO: 618119 - RNA, 14 nt, Escherichia coli CFT073
gugaaacaccugca

SEQ ID NO: 618120 - RNA, 16 nt, Escherichia coli CFT073
gugaaauaaaaucagc

SEQ ID NO: 618121 - RNA, 16 nt, Escherichia coli CFT073
gugaaauacaguuauc

SEQ ID NO: 618122 - RNA, 12 nt, Escherichia coli CFT073
gugaaagcaaaa

SEQ ID NO: 618123 - RNA, 21 nt, Escherichia coli CFT073
gugaaagagccaucauucugc

SEQ ID NO: 618124 - RNA, 20 nt, Escherichia coli CFT073
aaauagcaaaguaguaauga

SEQ ID NO: 618125 - RNA, 18 nt, Escherichia coli CFT073
aaauagccagcagagcaa

SEQ ID NO: 618126 - RNA, 17 nt, Escherichia coli CFT073
aaauagccaauucccag

SEQ ID NO: 618127 - RNA, 15 nt, Escherichia coli CFT073
gucuguucuggugug

SEQ ID NO: 618128 - RNA, 20 nt, Escherichia coli CFT073
gucuuaaaccggacaauaaa

SEQ ID NO: 618129 - RNA, 18 nt, Escherichia coli CFT073
gucuguccggggagaacg

SEQ ID NO: 618130 - RNA, 14 nt, Escherichia coli CFT073
gucuuaagcggcua

SEQ ID NO: 618131 - RNA, 22 nt, Escherichia coli CFT073
gucuuacagggcguauaacaca

SEQ ID NO: 618132 - RNA, 20 nt, Escherichia coli CFT073
gucuuaucaggccuacaauc

SEQ ID NO: 618133 - RNA, 20 nt, Escherichia coli CFT073
gucuuaucaggccuacaggu

SEQ ID NO: 618134 - RNA, 23 nt, Escherichia coli CFT073
gucuuauccggcauauaagugca

SEQ ID NO: 618135 - RNA, 20 nt, Escherichia coli CFT073
gucuucugcagucaccugcg

SEQ ID NO: 618136 - RNA, 20 nt, Escherichia coli CFT073
gucuucguacaugguaauaa

SEQ ID NO: 618137 - RNA, 22 nt, Escherichia coli CFT073
gucuucgccaaauggcaggcac

SEQ ID NO: 618138 - RNA, 23 nt, Escherichia coli CFT073
gucuucgauuaaguuuuccguac

SEQ ID NO: 618139 - RNA, 10 nt, Escherichia coli CFT073
gucuuccugc

SEQ ID NO: 618140 - RNA, 19 nt, Escherichia coli CFT073
gucuucccgagacaucccu

SEQ ID NO: 618141 - RNA, 21 nt, Escherichia coli CFT073
gucuucccgagacaucccuuu

SEQ ID NO: 618142 - RNA, 15 nt, Escherichia coli CFT073
gucuugccucccugc

SEQ ID NO: 618143 - RNA, 21 nt, Escherichia coli CFT073
gucuugaauaaauuggcuggg

SEQ ID NO: 618144 - RNA, 11 nt, Escherichia coli CFT073
gucuucuuccg

SEQ ID NO: 618145 - RNA, 20 nt, Escherichia coli CFT073
gucugaccucuucuacugca

SEQ ID NO: 618146 - RNA, 22 nt, Escherichia coli CFT073
gucugcgaugaucgccgccagu

SEQ ID NO: 618147 - RNA, 20 nt, Escherichia coli CFT073
gucugcgccgcauucagggc

SEQ ID NO: 618148 - RNA, 14 nt, Escherichia coli CFT073
gucugccccgccgc

SEQ ID NO: 618149 - RNA, 17 nt, Escherichia coli CFT073
gucugccacuucuucca

SEQ ID NO: 618150 - RNA, 19 nt, Escherichia coli CFT073
gucugccacuucuuccagc

SEQ ID NO: 618151 - RNA, 20 nt, Escherichia coli CFT073
gucugccacuucuuccagcg

SEQ ID NO: 618152 - RNA, 21 nt, Escherichia coli CFT073
gucugaucggcaaucacgccc

SEQ ID NO: 618153 - RNA, 18 nt, Escherichia coli CFT073
gucuggguauucagcgau

SEQ ID NO: 618154 - RNA, 14 nt, Escherichia coli CFT073
gucugggcaaaauc

SEQ ID NO: 618155 - RNA, 14 nt, Escherichia coli CFT073
gucuggcagauccu

SEQ ID NO: 618156 - RNA, 16 nt, Escherichia coli CFT073
gucuggcauuuugcug

SEQ ID NO: 618157 - RNA, 14 nt, Escherichia coli CFT073
gucugcugaagcau

SEQ ID NO: 618158 - RNA, 18 nt, Escherichia coli CFT073
gucuggaagaccagcgaa

SEQ ID NO: 618159 - RNA, 21 nt, Escherichia coli CFT073
gucugcugugugauccacugc

SEQ ID NO: 618160 - RNA, 20 nt, Escherichia coli CFT073
gucugcgucaucggcagcau

SEQ ID NO: 618161 - RNA, 22 nt, Escherichia coli CFT073
gucguucgccagucuccaggca

SEQ ID NO: 618162 - RNA, 22 nt, Escherichia coli CFT073
gucguugcaaucagcggugccg

SEQ ID NO: 618163 - RNA, 17 nt, Escherichia coli CFT073
gucguucaacaagccac

SEQ ID NO: 618164 - RNA, 15 nt, Escherichia coli CFT073
gucgugccagaaaau

SEQ ID NO: 618165 - RNA, 12 nt, Escherichia coli CFT073
gucucaucuuua

SEQ ID NO: 618166 - RNA, 18 nt, Escherichia coli CFT073
gucuccaccuuaucgaca

SEQ ID NO: 618167 - RNA, 16 nt, Escherichia coli CFT073
gucguugucuggcugg

SEQ ID NO: 618168 - RNA, 20 nt, Escherichia coli CFT073
gucguugucuggcuggugga

SEQ ID NO: 618169 - RNA, 19 nt, Escherichia coli CFT073
gucucagcaccgucuggca

SEQ ID NO: 618170 - RNA, 16 nt, Escherichia coli CFT073
gucucaucaggccugc

SEQ ID NO: 618171 - RNA, 11 nt, Escherichia coli CFT073
gucucaucgcu

SEQ ID NO: 618172 - RNA, 19 nt, Escherichia coli CFT073
gucucuugccgguuuugca

SEQ ID NO: 618173 - RNA, 16 nt, Escherichia coli CFT073
gucucgacaaacuccg

SEQ ID NO: 618174 - RNA, 18 nt, Escherichia coli CFT073
gucuccgguuucccggca

SEQ ID NO: 618175 - RNA, 21 nt, Escherichia coli CFT073
gucgccugacguacaccauuu

SEQ ID NO: 618176 - RNA, 16 nt, Escherichia coli CFT073
gucgcggaccaacaaa

SEQ ID NO: 618177 - RNA, 22 nt, Escherichia coli CFT073
gucgcaaacaacgccacacgca

SEQ ID NO: 618178 - RNA, 17 nt, Escherichia coli CFT073
gucgcaagacgaaaaau

SEQ ID NO: 618179 - RNA, 22 nt, Escherichia coli CFT073
gucgcaagacgaaaaaugaaua

SEQ ID NO: 618180 - RNA, 14 nt, Escherichia coli CFT073
gucgcagccagcgc

SEQ ID NO: 618181 - RNA, 17 nt, Escherichia coli CFT073
gucgccgcgcaaaucca

SEQ ID NO: 618182 - RNA, 12 nt, Escherichia coli CFT073
gucggaacaucg

SEQ ID NO: 618183 - RNA, 20 nt, Escherichia coli CFT073
gucgcuuuugcaucuucagu

SEQ ID NO: 618184 - RNA, 12 nt, Escherichia coli CFT073
gucgcuucacgc

SEQ ID NO: 618185 - RNA, 21 nt, Escherichia coli CFT073
gucggcuuugcccaucugggc

SEQ ID NO: 618186 - RNA, 23 nt, Escherichia coli CFT073
gucggcuuugcccaucugggcug

SEQ ID NO: 618187 - RNA, 21 nt, Escherichia coli CFT073
gucgugaaugccguaggccca

SEQ ID NO: 618188 - RNA, 17 nt, Escherichia coli CFT073
gucgguguccacuuccg

SEQ ID NO: 618189 - RNA, 16 nt, Escherichia coli CFT073
guccugcaaggugguc

SEQ ID NO: 618190 - RNA, 19 nt, Escherichia coli CFT073
guccugcauuguuccacuc

SEQ ID NO: 618191 - RNA, 20 nt, Escherichia coli CFT073
guccuaacaaccauccccaa

SEQ ID NO: 618192 - RNA, 14 nt, Escherichia coli CFT073
guccggcgcugcaa

SEQ ID NO: 618193 - RNA, 16 nt, Escherichia coli CFT073
guccgggcaucaacag

SEQ ID NO: 618194 - RNA, 17 nt, Escherichia coli CFT073
guccggcagcagaaagc

SEQ ID NO: 618195 - RNA, 17 nt, Escherichia coli CFT073
guccggcaccagcgcug

SEQ ID NO: 618196 - RNA, 19 nt, Escherichia coli CFT073
guccgcgguugguuuuauc

SEQ ID NO: 618197 - RNA, 17 nt, Escherichia coli CFT073
gucccggaauccuucau

SEQ ID NO: 618198 - RNA, 19 nt, Escherichia coli CFT073
gucccggaauccuucaucu

SEQ ID NO: 618199 - RNA, 17 nt, Escherichia coli CFT073
gucgauaucgauaauca

SEQ ID NO: 618200 - RNA, 19 nt, Escherichia coli CFT073
gucgauauuacgggucaca

SEQ ID NO: 618201 - RNA, 12 nt, Escherichia coli CFT073
gucgaucagacc

SEQ ID NO: 618202 - RNA, 14 nt, Escherichia coli CFT073
gucagccagcacug

SEQ ID NO: 618203 - RNA, 18 nt, Escherichia coli CFT073
gucagccagcacugacau

SEQ ID NO: 618204 - RNA, 13 nt, Escherichia coli CFT073
gucagccagcggc

SEQ ID NO: 618205 - RNA, 17 nt, Escherichia coli CFT073
gucagcaugucuugccu

SEQ ID NO: 618206 - RNA, 19 nt, Escherichia coli CFT073
gucagcacucacgccaggc

SEQ ID NO: 618207 - RNA, 20 nt, Escherichia coli CFT073
gucagcacucacgccaggca

SEQ ID NO: 618208 - RNA, 23 nt, Escherichia coli CFT073
gucagcacuggcgaauucugcag

SEQ ID NO: 618209 - RNA, 21 nt, Escherichia coli CFT073
gucacguagcggcggcagauu

SEQ ID NO: 618210 - RNA, 18 nt, Escherichia coli CFT073
gucacgguuucaaagaaa

SEQ ID NO: 618211 - RNA, 13 nt, Escherichia coli CFT073
gucacuaaauuca

SEQ ID NO: 618212 - RNA, 15 nt, Escherichia coli CFT073
gucacuaauugcagc

SEQ ID NO: 618213 - RNA, 14 nt, Escherichia coli CFT073
gucacucacgcugc

SEQ ID NO: 618214 - RNA, 14 nt, Escherichia coli CFT073
gucacucgcauggu

SEQ ID NO: 618215 - RNA, 20 nt, Escherichia coli CFT073
gucagcccuucccggugcgc

SEQ ID NO: 618216 - RNA, 13 nt, Escherichia coli CFT073
gucagccgcccgc

SEQ ID NO: 618217 - RNA, 18 nt, Escherichia coli CFT073
gucagccaucgccaccgc

SEQ ID NO: 618218 - RNA, 16 nt, Escherichia coli CFT073
gucagcgaucagcauu

SEQ ID NO: 618219 - RNA, 20 nt, Escherichia coli CFT073
gucaggcaagccgcuaacag

SEQ ID NO: 618220 - RNA, 15 nt, Escherichia coli CFT073
gucaggggagugagg

SEQ ID NO: 618221 - RNA, 16 nt, Escherichia coli CFT073
gucaggggcauuuucc

SEQ ID NO: 618222 - RNA, 12 nt, Escherichia coli CFT073
gucagggccugc

SEQ ID NO: 618223 - RNA, 22 nt, Escherichia coli CFT073
gucaagcgguaaccauccauau

SEQ ID NO: 618224 - RNA, 15 nt, Escherichia coli CFT073
gucaaggaaugaaau

SEQ ID NO: 618225 - RNA, 19 nt, Escherichia coli CFT073
gucaaucacacugacuuua

SEQ ID NO: 618226 - RNA, 13 nt, Escherichia coli CFT073
gucaauccuucuu

SEQ ID NO: 618227 - RNA, 20 nt, Escherichia coli CFT073
gucaaugccgucaccagcau

SEQ ID NO: 618228 - RNA, 18 nt, Escherichia coli CFT073
gucaaucugcccgaccag

SEQ ID NO: 618229 - RNA, 18 nt, Escherichia coli CFT073
gucaauugagacaacuca

SEQ ID NO: 618230 - RNA, 16 nt, Escherichia coli CFT073
gucacgccaauaaucg

SEQ ID NO: 618231 - RNA, 15 nt, Escherichia coli CFT073
gucaccgccagguga

SEQ ID NO: 618232 - RNA, 18 nt, Escherichia coli CFT073
gucaccgccuccaccuga

SEQ ID NO: 618233 - RNA, 16 nt, Escherichia coli CFT073
gucacgcuggcagauu

SEQ ID NO: 618234 - RNA, 18 nt, Escherichia coli CFT073
gucccagauagcuguccc

SEQ ID NO: 618235 - RNA, 18 nt, Escherichia coli CFT073
guccauauauaaaaucau

SEQ ID NO: 618236 - RNA, 17 nt, Escherichia coli CFT073
guccauccauacgggca

SEQ ID NO: 618237 - RNA, 16 nt, Escherichia coli CFT073
guccaucccacacugu

SEQ ID NO: 618238 - RNA, 14 nt, Escherichia coli CFT073
guccaggauuuucu

SEQ ID NO: 618239 - RNA, 22 nt, Escherichia coli CFT073
guccagcuuuucgauaacccug

SEQ ID NO: 618240 - RNA, 22 nt, Escherichia coli CFT073
guccagcuugccuucacaggcc

SEQ ID NO: 618241 - RNA, 14 nt, Escherichia coli CFT073
guccagcugccugc

SEQ ID NO: 618242 - RNA, 14 nt, Escherichia coli CFT073
guccagcgugucug

SEQ ID NO: 618243 - RNA, 15 nt, Escherichia coli CFT073
guccacccccauaau

SEQ ID NO: 618244 - RNA, 14 nt, Escherichia coli CFT073
guccaaucagcaca

SEQ ID NO: 618245 - RNA, 20 nt, Escherichia coli CFT073
guccaagaugggccagcacg

SEQ ID NO: 618246 - RNA, 21 nt, Escherichia coli CFT073
guccagcccuccucacuguug

SEQ ID NO: 618247 - RNA, 12 nt, Escherichia coli CFT073
guccagcgccug

SEQ ID NO: 618248 - RNA, 16 nt, Escherichia coli CFT073
guccagcgccugaaua

SEQ ID NO: 618249 - RNA, 21 nt, Escherichia coli CFT073
gucaucggaucauuagucaca

SEQ ID NO: 618250 - RNA, 18 nt, Escherichia coli CFT073
gucaucggcguugcccau

SEQ ID NO: 618251 - RNA, 18 nt, Escherichia coli CFT073
gucaucgggcguuuucuu

SEQ ID NO: 618252 - RNA, 22 nt, Escherichia coli CFT073
gucauggcccaugacaucccca

SEQ ID NO: 618253 - RNA, 19 nt, Escherichia coli CFT073
gucaucuguaagcaauuau

SEQ ID NO: 618254 - RNA, 21 nt, Escherichia coli CFT073
gucauuuuacguguuucagaa

SEQ ID NO: 618255 - RNA, 19 nt, Escherichia coli CFT073
guccaaauagcucaaugaa

SEQ ID NO: 618256 - RNA, 22 nt, Escherichia coli CFT073
guccaagaacuaguagcaugaa

SEQ ID NO: 618257 - RNA, 19 nt, Escherichia coli CFT073
gucaugucucucagagaau

SEQ ID NO: 618258 - RNA, 15 nt, Escherichia coli CFT073
gucaucccuuccugc

SEQ ID NO: 618259 - RNA, 22 nt, Escherichia coli CFT073
gucaucaucgcucccaaaccgc

SEQ ID NO: 618260 - RNA, 14 nt, Escherichia coli CFT073
gucaucaucacuuu

SEQ ID NO: 618261 - RNA, 20 nt, Escherichia coli CFT073
gucaucagcgccaacccgcu

SEQ ID NO: 618262 - RNA, 17 nt, Escherichia coli CFT073
gucaucaauccugcagc

SEQ ID NO: 618263 - RNA, 11 nt, Escherichia coli CFT073
gucauaugcaa

SEQ ID NO: 618264 - RNA, 12 nt, Escherichia coli CFT073
uaccgugcagca

SEQ ID NO: 618265 - RNA, 18 nt, Escherichia coli CFT073
uaccgugcagcacggaga

SEQ ID NO: 618266 - RNA, 13 nt, Escherichia coli CFT073
uaccgucuguaac

SEQ ID NO: 618267 - RNA, 16 nt, Escherichia coli CFT073
uaccgugguuuuggua

SEQ ID NO: 618268 - RNA, 22 nt, Escherichia coli CFT073
uaccguugcggcuccagacgcc

SEQ ID NO: 618269 - RNA, 16 nt, Escherichia coli CFT073
uaccguaccaggcaua

SEQ ID NO: 618270 - RNA, 15 nt, Escherichia coli CFT073
uaccguaucuaccac

SEQ ID NO: 618271 - RNA, 22 nt, Escherichia coli CFT073
uaccguaugauguauauuucug

SEQ ID NO: 618272 - RNA, 16 nt, Escherichia coli CFT073
uaccggcaauguuacc

SEQ ID NO: 618273 - RNA, 18 nt, Escherichia coli CFT073
uaccgguuucaauccagg

SEQ ID NO: 618274 - RNA, 13 nt, Escherichia coli CFT073
uaccguaaaaaua

SEQ ID NO: 618275 - RNA, 14 nt, Escherichia coli CFT073
uaccguaaaacuca

SEQ ID NO: 618276 - RNA, 19 nt, Escherichia coli CFT073
uacgagcuucgacuuccug

SEQ ID NO: 618277 - RNA, 18 nt, Escherichia coli CFT073
uacgaggauucgaaccuc

SEQ ID NO: 618278 - RNA, 11 nt, Escherichia coli CFT073
uacgcaaagag

SEQ ID NO: 618279 - RNA, 22 nt, Escherichia coli CFT073
uacgagucgccuguacuuccug

SEQ ID NO: 618280 - RNA, 16 nt, Escherichia coli CFT073
uacgcaucaguuucau

SEQ ID NO: 618281 - RNA, 14 nt, Escherichia coli CFT073
uacgcaucaugccg

SEQ ID NO: 618282 - RNA, 13 nt, Escherichia coli CFT073
uacgccagacucu

SEQ ID NO: 618283 - RNA, 21 nt, Escherichia coli CFT073
uacgcauaaccgguaccugcc

SEQ ID NO: 618284 - RNA, 18 nt, Escherichia coli CFT073
uacgcaucaccccuuccu

SEQ ID NO: 618285 - RNA, 16 nt, Escherichia coli CFT073
uacgcacuucuucguu

SEQ ID NO: 618286 - RNA, 14 nt, Escherichia coli CFT073
uacgcagacggcuu

SEQ ID NO: 618287 - RNA, 21 nt, Escherichia coli CFT073
uacgcagacggcuuucuucag

SEQ ID NO: 618288 - RNA, 21 nt, Escherichia coli CFT073
uacgcaggagcagaacagguu

SEQ ID NO: 618289 - RNA, 19 nt, Escherichia coli CFT073
uacgccgcaaaucgccgag

SEQ ID NO: 618290 - RNA, 22 nt, Escherichia coli CFT073
uacgccugcaauuuaccuuucc

SEQ ID NO: 618291 - RNA, 13 nt, Escherichia coli CFT073
uacgcccgcgaac

SEQ ID NO: 618292 - RNA, 22 nt, Escherichia coli CFT073
uacgcccgcugcgcccaguuuc

SEQ ID NO: 618293 - RNA, 21 nt, Escherichia coli CFT073
uacgccaucaguuucagagcg

SEQ ID NO: 618294 - RNA, 13 nt, Escherichia coli CFT073
uacgccaucuguu

SEQ ID NO: 618295 - RNA, 22 nt, Escherichia coli CFT073
uacgcccacgcuucacugccgg

SEQ ID NO: 618296 - RNA, 14 nt, Escherichia coli CFT073
uacuaaauaugaaa

SEQ ID NO: 618297 - RNA, 16 nt, Escherichia coli CFT073
uacuacaucugcauca

SEQ ID NO: 618298 - RNA, 20 nt, Escherichia coli CFT073
uacuacaaacaaugccagaa

SEQ ID NO: 618299 - RNA, 22 nt, Escherichia coli CFT073
uacuacaauccugugcuccagu

SEQ ID NO: 618300 - RNA, 12 nt, Escherichia coli CFT073
uacuaauaucau

SEQ ID NO: 618301 - RNA, 13 nt, Escherichia coli CFT073
uacuaauuaauaa

SEQ ID NO: 618302 - RNA, 15 nt, Escherichia coli CFT073
uacggcuuuuuucau

SEQ ID NO: 618303 - RNA, 17 nt, Escherichia coli CFT073
uacgggaggucaucagc

SEQ ID NO: 618304 - RNA, 14 nt, Escherichia coli CFT073
uacggcucagcaau

SEQ ID NO: 618305 - RNA, 14 nt, Escherichia coli CFT073
uacggcuaaaaaaa

SEQ ID NO: 618306 - RNA, 14 nt, Escherichia coli CFT073
uacggcggucuggc

SEQ ID NO: 618307 - RNA, 15 nt, Escherichia coli CFT073
uacggcguuucacuu

SEQ ID NO: 618308 - RNA, 16 nt, Escherichia coli CFT073
uacgggcaaucuccug

SEQ ID NO: 618309 - RNA, 20 nt, Escherichia coli CFT073
uacguagcaccaacaucgac

SEQ ID NO: 618310 - RNA, 13 nt, Escherichia coli CFT073
uacguaauucacc

SEQ ID NO: 618311 - RNA, 22 nt, Escherichia coli CFT073
uacgcggacacuuuccugcucg

SEQ ID NO: 618312 - RNA, 18 nt, Escherichia coli CFT073
uacgcggccugcacugag

SEQ ID NO: 618313 - RNA, 15 nt, Escherichia coli CFT073
uacgcgcguuuucaa

SEQ ID NO: 618314 - RNA, 16 nt, Escherichia coli CFT073
uacgcguaaaauauug

SEQ ID NO: 618315 - RNA, 20 nt, Escherichia coli CFT073
uacgcgggaauagcucaguu

SEQ ID NO: 618316 - RNA, 21 nt, Escherichia coli CFT073
uacgcuauacaaccaccccac

SEQ ID NO: 618317 - RNA, 17 nt, Escherichia coli CFT073
uacgcgcugaccuucag

SEQ ID NO: 618318 - RNA, 16 nt, Escherichia coli CFT073
uacgcgauaaaaaacc

SEQ ID NO: 618319 - RNA, 23 nt, Escherichia coli CFT073
uacucgcugauugccccuccgca

SEQ ID NO: 618320 - RNA, 23 nt, Escherichia coli CFT073
uacucuuucccggcaaucaccgc

SEQ ID NO: 618321 - RNA, 15 nt, Escherichia coli CFT073
uacugaacaggcgca

SEQ ID NO: 618322 - RNA, 12 nt, Escherichia coli CFT073
uacugaacuuau

SEQ ID NO: 618323 - RNA, 18 nt, Escherichia coli CFT073
uacugaaggcgcauugcu

SEQ ID NO: 618324 - RNA, 21 nt, Escherichia coli CFT073
uacugaccgucgccuucaacg

SEQ ID NO: 618325 - RNA, 22 nt, Escherichia coli CFT073
uacugaccaucagcagcggcac

SEQ ID NO: 618326 - RNA, 20 nt, Escherichia coli CFT073
uacugaaucccugcgaacug

SEQ ID NO: 618327 - RNA, 11 nt, Escherichia coli CFT073
uacugacauca

SEQ ID NO: 618328 - RNA, 16 nt, Escherichia coli CFT073
uacugacaucaaaccc

SEQ ID NO: 618329 - RNA, 12 nt, Escherichia coli CFT073
uacugacaucgc

SEQ ID NO: 618330 - RNA, 17 nt, Escherichia coli CFT073
uacugccagcucaccuc

SEQ ID NO: 618331 - RNA, 18 nt, Escherichia coli CFT073
uacugcccgcacaccuca

SEQ ID NO: 618332 - RNA, 14 nt, Escherichia coli CFT073
uacugcaaauauug

SEQ ID NO: 618333 - RNA, 14 nt, Escherichia coli CFT073
uacugagcaaggca

SEQ ID NO: 618334 - RNA, 13 nt, Escherichia coli CFT073
uacugaucaucau

SEQ ID NO: 618335 - RNA, 22 nt, Escherichia coli CFT073
uacucuaacuuauuguuuucau

SEQ ID NO: 618336 - RNA, 23 nt, Escherichia coli CFT073
uacucuaccuuccuacaagaggu

SEQ ID NO: 618337 - RNA, 17 nt, Escherichia coli CFT073
uacucucuuucgcuuga

SEQ ID NO: 618338 - RNA, 23 nt, Escherichia coli CFT073
uacucuccugcggcgacaaaugu

SEQ ID NO: 618339 - RNA, 19 nt, Escherichia coli CFT073
uacucuugugccaguuccg

SEQ ID NO: 618340 - RNA, 21 nt, Escherichia coli CFT073
uacucuuucccggcaaucacc

SEQ ID NO: 618341 - RNA, 19 nt, Escherichia coli CFT073
uacucuucuuuaauuaauc

SEQ ID NO: 618342 - RNA, 19 nt, Escherichia coli CFT073
uacucuuccgguguaucag

SEQ ID NO: 618343 - RNA, 12 nt, Escherichia coli CFT073
uacuacuuuguu

SEQ ID NO: 618344 - RNA, 20 nt, Escherichia coli CFT073
uacuacuggagacagauuua

SEQ ID NO: 618345 - RNA, 14 nt, Escherichia coli CFT073
uacucuaaauaauu

SEQ ID NO: 618346 - RNA, 11 nt, Escherichia coli CFT073
uacuggcaaua

SEQ ID NO: 618347 - RNA, 22 nt, Escherichia coli CFT073
uacuggcaaucgccagcggcag

SEQ ID NO: 618348 - RNA, 20 nt, Escherichia coli CFT073
uacuggccuuuauuuuccag

SEQ ID NO: 618349 - RNA, 17 nt, Escherichia coli CFT073
uacuggcgauugucauu

SEQ ID NO: 618350 - RNA, 21 nt, Escherichia coli CFT073
uacugucguuuagacgcugcg

SEQ ID NO: 618351 - RNA, 13 nt, Escherichia coli CFT073
uacugucugcucg

SEQ ID NO: 618352 - RNA, 19 nt, Escherichia coli CFT073
uacuggaagcaggucacca

SEQ ID NO: 618353 - RNA, 20 nt, Escherichia coli CFT073
uacuggacacugaauaaaca

SEQ ID NO: 618354 - RNA, 15 nt, Escherichia coli CFT073
uacuggagacagauu

SEQ ID NO: 618355 - RNA, 23 nt, Escherichia coli CFT073
uacuggagacagauuuauaaaau

SEQ ID NO: 618356 - RNA, 14 nt, Escherichia coli CFT073
uacugccgggugga

SEQ ID NO: 618357 - RNA, 20 nt, Escherichia coli CFT073
uacugccguagugaugcauc

SEQ ID NO: 618358 - RNA, 23 nt, Escherichia coli CFT073
uacugccuuucccuuacccucuc

SEQ ID NO: 618359 - RNA, 14 nt, Escherichia coli CFT073
uacugcgcuuuuaa

SEQ ID NO: 618360 - RNA, 22 nt, Escherichia coli CFT073
uacugcugaaugaggcuuuaau

SEQ ID NO: 618361 - RNA, 20 nt, Escherichia coli CFT073
uacuucaacauaagcaaauc

SEQ ID NO: 618362 - RNA, 16 nt, Escherichia coli CFT073
uacuucacggcugcua

SEQ ID NO: 618363 - RNA, 22 nt, Escherichia coli CFT073
uacuucaccauucacauccaca

SEQ ID NO: 618364 - RNA, 17 nt, Escherichia coli CFT073
uacuuaucuaauaaaca

SEQ ID NO: 618365 - RNA, 15 nt, Escherichia coli CFT073
uacuuauugaaagca

SEQ ID NO: 618366 - RNA, 12 nt, Escherichia coli CFT073
uacuucuuucac

SEQ ID NO: 618367 - RNA, 19 nt, Escherichia coli CFT073
uacccgaagcgccaauacc

SEQ ID NO: 618368 - RNA, 18 nt, Escherichia coli CFT073
uacccggcacacaaauaa

SEQ ID NO: 618369 - RNA, 14 nt, Escherichia coli CFT073
uacccggcacagcu

SEQ ID NO: 618370 - RNA, 18 nt, Escherichia coli CFT073
uacccgggucaucaccca

SEQ ID NO: 618371 - RNA, 13 nt, Escherichia coli CFT073
uacccgccaccgg

SEQ ID NO: 618372 - RNA, 13 nt, Escherichia coli CFT073
uacccgcgcagug

SEQ ID NO: 618373 - RNA, 23 nt, Escherichia coli CFT073
uacccgcgcuuuuucggaaagcc

SEQ ID NO: 618374 - RNA, 20 nt, Escherichia coli CFT073
uacccuauuuaaagcacaaa

SEQ ID NO: 618375 - RNA, 13 nt, Escherichia coli CFT073
uacccgugcaucc

SEQ ID NO: 618376 - RNA, 12 nt, Escherichia coli CFT073
uacccucugcac

SEQ ID NO: 618377 - RNA, 16 nt, Escherichia coli CFT073
uacccucugcaccaga

SEQ ID NO: 618378 - RNA, 17 nt, Escherichia coli CFT073
uacccugacccagaccg

SEQ ID NO: 618379 - RNA, 18 nt, Escherichia coli CFT073
uaccgcagugaaauuucu

SEQ ID NO: 618380 - RNA, 16 nt, Escherichia coli CFT073
uaccgcauuaucaagg

SEQ ID NO: 618381 - RNA, 12 nt, Escherichia coli CFT073
uaccgccacagc

SEQ ID NO: 618382 - RNA, 16 nt, Escherichia coli CFT073
uaccgccacagcagcc

SEQ ID NO: 618383 - RNA, 12 nt, Escherichia coli CFT073
uaccgccagacc

SEQ ID NO: 618384 - RNA, 16 nt, Escherichia coli CFT073
uaccggacuccagaca

SEQ ID NO: 618385 - RNA, 17 nt, Escherichia coli CFT073
uaccggacuccagacac

SEQ ID NO: 618386 - RNA, 13 nt, Escherichia coli CFT073
uaccggcaaacuu

SEQ ID NO: 618387 - RNA, 23 nt, Escherichia coli CFT073
uaccggcaacgucagucccaacu

SEQ ID NO: 618388 - RNA, 17 nt, Escherichia coli CFT073
uaccgacgaucaacaga

SEQ ID NO: 618389 - RNA, 19 nt, Escherichia coli CFT073
uaccgacgaucaacagaau

SEQ ID NO: 618390 - RNA, 17 nt, Escherichia coli CFT073
uaccgaagaguaaccaa

SEQ ID NO: 618391 - RNA, 18 nt, Escherichia coli CFT073
uaccgaagaguaaccaaa

SEQ ID NO: 618392 - RNA, 14 nt, Escherichia coli CFT073
uaccgaauccagca

SEQ ID NO: 618393 - RNA, 16 nt, Escherichia coli CFT073
uaccgauaucaauaac

SEQ ID NO: 618394 - RNA, 14 nt, Escherichia coli CFT073
uaccgauccccgga

SEQ ID NO: 618395 - RNA, 22 nt, Escherichia coli CFT073
uaccgaucgcgguaacagauga

SEQ ID NO: 618396 - RNA, 19 nt, Escherichia coli CFT073
uaccgaugaagucauugau

SEQ ID NO: 618397 - RNA, 13 nt, Escherichia coli CFT073
uaccgcaccacca

SEQ ID NO: 618398 - RNA, 23 nt, Escherichia coli CFT073
uacccaggucgcccgguugcagc

SEQ ID NO: 618399 - RNA, 22 nt, Escherichia coli CFT073
uacccagugaauccagcaugcu

SEQ ID NO: 618400 - RNA, 22 nt, Escherichia coli CFT073
uaccccauauuggcaacagcca

SEQ ID NO: 618401 - RNA, 12 nt, Escherichia coli CFT073
uaccccauccau

SEQ ID NO: 618402 - RNA, 17 nt, Escherichia coli CFT073
uaccccgcauccugaau

SEQ ID NO: 618403 - RNA, 23 nt, Escherichia coli CFT073
uaccccgcaucguggccugcuca

SEQ ID NO: 618404 - RNA, 14 nt, Escherichia coli CFT073
uacccaaaaaauag

SEQ ID NO: 618405 - RNA, 18 nt, Escherichia coli CFT073
uaccauuucuucugcgcu

SEQ ID NO: 618406 - RNA, 23 nt, Escherichia coli CFT073
uacccaaccgauaaccacgcuca

SEQ ID NO: 618407 - RNA, 15 nt, Escherichia coli CFT073
uacccaaucccccac

SEQ ID NO: 618408 - RNA, 18 nt, Escherichia coli CFT073
uacccagcaaugccaggc

SEQ ID NO: 618409 - RNA, 14 nt, Escherichia coli CFT073
uaccauauaaacau

SEQ ID NO: 618410 - RNA, 19 nt, Escherichia coli CFT073
uaccauaagagaugaauuu

SEQ ID NO: 618411 - RNA, 12 nt, Escherichia coli CFT073
uaccaguccuac

SEQ ID NO: 618412 - RNA, 16 nt, Escherichia coli CFT073
uaccaguccuacacac

SEQ ID NO: 618413 - RNA, 16 nt, Escherichia coli CFT073
uaccagugcagcgcau

SEQ ID NO: 618414 - RNA, 15 nt, Escherichia coli CFT073
uaccagugccagaac

SEQ ID NO: 618415 - RNA, 20 nt, Escherichia coli CFT073
uaccaggaucagcaaaaugg

SEQ ID NO: 618416 - RNA, 20 nt, Escherichia coli CFT073
uaccaggcgaccguuuucac

SEQ ID NO: 618417 - RNA, 21 nt, Escherichia coli CFT073
uaccaugcuaauaaucagcac

SEQ ID NO: 618418 - RNA, 15 nt, Escherichia coli CFT073
uaccaugaauuucac

SEQ ID NO: 618419 - RNA, 15 nt, Escherichia coli CFT073
uaccauucccagacu

SEQ ID NO: 618420 - RNA, 23 nt, Escherichia coli CFT073
uaccaugggaaauggcuggucag

SEQ ID NO: 618421 - RNA, 15 nt, Escherichia coli CFT073
uaccauuaucaccaa

SEQ ID NO: 618422 - RNA, 17 nt, Escherichia coli CFT073
uaccaucggcagcgcca

SEQ ID NO: 618423 - RNA, 21 nt, Escherichia coli CFT073
uaccaucacuuugcagaaaau

SEQ ID NO: 618424 - RNA, 19 nt, Escherichia coli CFT073
uaccauccacaccaaaaua

SEQ ID NO: 618425 - RNA, 15 nt, Escherichia coli CFT073
uaccagcaggaaucc

SEQ ID NO: 618426 - RNA, 15 nt, Escherichia coli CFT073
uaccagcaguacagu

SEQ ID NO: 618427 - RNA, 17 nt, Escherichia coli CFT073
uaccagaucuaucuggc

SEQ ID NO: 618428 - RNA, 18 nt, Escherichia coli CFT073
uaccagauuaauuauuga

SEQ ID NO: 618429 - RNA, 20 nt, Escherichia coli CFT073
uaccagcaacgcuucaacca

SEQ ID NO: 618430 - RNA, 19 nt, Escherichia coli CFT073
uaccagcaccugcuugaac

SEQ ID NO: 618431 - RNA, 20 nt, Escherichia coli CFT073
uaccagccuucuucauccag

SEQ ID NO: 618432 - RNA, 18 nt, Escherichia coli CFT073
uaccagcguagugauacc

SEQ ID NO: 618433 - RNA, 14 nt, Escherichia coli CFT073
uaccagcuguuuug

SEQ ID NO: 618434 - RNA, 19 nt, Escherichia coli CFT073
uaccacccuugcccaccag

SEQ ID NO: 618435 - RNA, 18 nt, Escherichia coli CFT073
uaccagaccgcacaccga

SEQ ID NO: 618436 - RNA, 16 nt, Escherichia coli CFT073
uaccagagucuuugcu

SEQ ID NO: 618437 - RNA, 16 nt, Escherichia coli CFT073
uaccagauaaacaucg

SEQ ID NO: 618438 - RNA, 21 nt, Escherichia coli CFT073
uaccacagguccuggcuauuc

SEQ ID NO: 618439 - RNA, 23 nt, Escherichia coli CFT073
uaccaccaauguggaaagcccca

SEQ ID NO: 618440 - RNA, 21 nt, Escherichia coli CFT073
uaccaccagcgacagccagcc

SEQ ID NO: 618441 - RNA, 18 nt, Escherichia coli CFT073
uacaucugcaucaaguuc

SEQ ID NO: 618442 - RNA, 16 nt, Escherichia coli CFT073
uacaucugguaauuga

SEQ ID NO: 618443 - RNA, 21 nt, Escherichia coli CFT073
uacauuccggccugcagugca

SEQ ID NO: 618444 - RNA, 14 nt, Escherichia coli CFT073
uaccaacgcacccg

SEQ ID NO: 618445 - RNA, 16 nt, Escherichia coli CFT073
uaccacaacaaaucgu

SEQ ID NO: 618446 - RNA, 14 nt, Escherichia coli CFT073
uacauugcgaacag

SEQ ID NO: 618447 - RNA, 22 nt, Escherichia coli CFT073
uaccaaauaaacgaaucugcaa

SEQ ID NO: 618448 - RNA, 17 nt, Escherichia coli CFT073
uaccaaauugguaaaau

SEQ ID NO: 618449 - RNA, 14 nt, Escherichia coli CFT073
uaccaacacacuga

SEQ ID NO: 618450 - RNA, 14 nt, Escherichia coli CFT073
uacauccacugcau

SEQ ID NO: 618451 - RNA, 20 nt, Escherichia coli CFT073
uacauccgggcgagcuuaua

SEQ ID NO: 618452 - RNA, 19 nt, Escherichia coli CFT073
uacaucaucagaaaugcca

SEQ ID NO: 618453 - RNA, 14 nt, Escherichia coli CFT073
uacauagccaucug

SEQ ID NO: 618454 - RNA, 21 nt, Escherichia coli CFT073
uacauagccaucugccugauc

SEQ ID NO: 618455 - RNA, 15 nt, Escherichia coli CFT073
uacauacugagaacc

SEQ ID NO: 618456 - RNA, 11 nt, Escherichia coli CFT073
uacauacugag

SEQ ID NO: 618457 - RNA, 21 nt, Escherichia coli CFT073
uacauaagcaccgaacaagaa

SEQ ID NO: 618458 - RNA, 16 nt, Escherichia coli CFT073
uacauaccagcagcau

SEQ ID NO: 618459 - RNA, 19 nt, Escherichia coli CFT073
uacagugccccaaaugucg

SEQ ID NO: 618460 - RNA, 21 nt, Escherichia coli CFT073
uacagucaaggaaugaaauau

SEQ ID NO: 618461 - RNA, 22 nt, Escherichia coli CFT073
uacagucaaggaaugaaauauu

SEQ ID NO: 618462 - RNA, 14 nt, Escherichia coli CFT073
uacaggguaaaaag

SEQ ID NO: 618463 - RNA, 16 nt, Escherichia coli CFT073
uacaggguaaaaagag

SEQ ID NO: 618464 - RNA, 19 nt, Escherichia coli CFT073
uaauaagguucauugaacg

SEQ ID NO: 618465 - RNA, 21 nt, Escherichia coli CFT073
uaauaagguucauugaacgca

SEQ ID NO: 618466 - RNA, 14 nt, Escherichia coli CFT073
uaauaaucagcaca

SEQ ID NO: 618467 - RNA, 16 nt, Escherichia coli CFT073
uaauaaguaaacaaac

SEQ ID NO: 618468 - RNA, 20 nt, Escherichia coli CFT073
uaauacccagacuuuucaga

SEQ ID NO: 618469 - RNA, 23 nt, Escherichia coli CFT073
uaauaccgacuucagccagugcu

SEQ ID NO: 618470 - RNA, 12 nt, Escherichia coli CFT073
uaauacaggcua

SEQ ID NO: 618471 - RNA, 19 nt, Escherichia coli CFT073
uaauaauuaaauuguucau

SEQ ID NO: 618472 - RNA, 22 nt, Escherichia coli CFT073
uaauaaugucucuguugugaag

SEQ ID NO: 618473 - RNA, 18 nt, Escherichia coli CFT073
uaauaauuauaaaucccu

SEQ ID NO: 618474 - RNA, 14 nt, Escherichia coli CFT073
uaauaauucccgca

SEQ ID NO: 618475 - RNA, 21 nt, Escherichia coli CFT073
uaauauacagccuuaacaaga

SEQ ID NO: 618476 - RNA, 14 nt, Escherichia coli CFT073
uaauauaaggagcc

SEQ ID NO: 618477 - RNA, 22 nt, Escherichia coli CFT073
uaauauaaggagccuguguaau

SEQ ID NO: 618478 - RNA, 23 nt, Escherichia coli CFT073
uaauauaaacgacagcguuucau

SEQ ID NO: 618479 - RNA, 15 nt, Escherichia coli CFT073
uaauagcuucuucuu

SEQ ID NO: 618480 - RNA, 13 nt, Escherichia coli CFT073
uaauagcuuaacu

SEQ ID NO: 618481 - RNA, 14 nt, Escherichia coli CFT073
uaauagguaaacau

SEQ ID NO: 618482 - RNA, 19 nt, Escherichia coli CFT073
uaauaggcaggcaucauca

SEQ ID NO: 618483 - RNA, 22 nt, Escherichia coli CFT073
uaauaggccgcaugugcccccu

SEQ ID NO: 618484 - RNA, 17 nt, Escherichia coli CFT073
uaauacgugaaaucggu

SEQ ID NO: 618485 - RNA, 16 nt, Escherichia coli CFT073
uaauacgcuaaauaaa

SEQ ID NO: 618486 - RNA, 22 nt, Escherichia coli CFT073
uaauacgcuaaauaaacaauga

SEQ ID NO: 618487 - RNA, 22 nt, Escherichia coli CFT073
uaauacgcugcgucugcgcgua

SEQ ID NO: 618488 - RNA, 16 nt, Escherichia coli CFT073
uaauaccugcaccaac

SEQ ID NO: 618489 - RNA, 15 nt, Escherichia coli CFT073
uaauaccugccuggu

SEQ ID NO: 618490 - RNA, 18 nt, Escherichia coli CFT073
uaauagauaauuuugaaa

SEQ ID NO: 618491 - RNA, 20 nt, Escherichia coli CFT073
uaaucauuaacggccacgau

SEQ ID NO: 618492 - RNA, 14 nt, Escherichia coli CFT073
uaaucaucaugcuu

SEQ ID NO: 618493 - RNA, 11 nt, Escherichia coli CFT073
uaaucaucaug

SEQ ID NO: 618494 - RNA, 15 nt, Escherichia coli CFT073
uaaucaucucuccuu

SEQ ID NO: 618495 - RNA, 13 nt, Escherichia coli CFT073
uaaucaucuucau

SEQ ID NO: 618496 - RNA, 14 nt, Escherichia coli CFT073
uaauccacagcaau

SEQ ID NO: 618497 - RNA, 23 nt, Escherichia coli CFT073
uaauccagacugcgcauuaaaua

SEQ ID NO: 618498 - RNA, 23 nt, Escherichia coli CFT073
uaauccagcgucgccagcagaga

SEQ ID NO: 618499 - RNA, 12 nt, Escherichia coli CFT073
uaauccacuuuc

SEQ ID NO: 618500 - RNA, 17 nt, Escherichia coli CFT073
uaauccacuuucuuaaa

SEQ ID NO: 618501 - RNA, 21 nt, Escherichia coli CFT073
uaauccauaguguguuccucu

SEQ ID NO: 618502 - RNA, 19 nt, Escherichia coli CFT073
uaauccaggacauaucagg

SEQ ID NO: 618503 - RNA, 19 nt, Escherichia coli CFT073
uaauccauugcaacuggcu

SEQ ID NO: 618504 - RNA, 22 nt, Escherichia coli CFT073
uaaucccuccaaccagauaucc

SEQ ID NO: 618505 - RNA, 20 nt, Escherichia coli CFT073
uaaucaaucuuuacacacaa

SEQ ID NO: 618506 - RNA, 18 nt, Escherichia coli CFT073
uaaucagaucguugaccu

SEQ ID NO: 618507 - RNA, 13 nt, Escherichia coli CFT073
uaaucacgcuguu

SEQ ID NO: 618508 - RNA, 12 nt, Escherichia coli CFT073
uaaucaccagca

SEQ ID NO: 618509 - RNA, 21 nt, Escherichia coli CFT073
uaaucauacucccagcguacc

SEQ ID NO: 618510 - RNA, 14 nt, Escherichia coli CFT073
uaaucauaaaacac

SEQ ID NO: 618511 - RNA, 12 nt, Escherichia coli CFT073
uaaucagcacaa

SEQ ID NO: 618512 - RNA, 13 nt, Escherichia coli CFT073
uaaucaggcuauc

SEQ ID NO: 618513 - RNA, 14 nt, Escherichia coli CFT073
uaaucaggcuaucu

SEQ ID NO: 618514 - RNA, 17 nt, Escherichia coli CFT073
uaauauugagauccauu

SEQ ID NO: 618515 - RNA, 13 nt, Escherichia coli CFT073
uaauauuuaucuu

SEQ ID NO: 618516 - RNA, 15 nt, Escherichia coli CFT073
uaaucaacaaaccaa

SEQ ID NO: 618517 - RNA, 15 nt, Escherichia coli CFT073
uaaucaaauaaauaa

SEQ ID NO: 618518 - RNA, 19 nt, Escherichia coli CFT073
uaaucaaauaaauaaucuc

SEQ ID NO: 618519 - RNA, 20 nt, Escherichia coli CFT073
uaaucaaauaaauaaucucu

SEQ ID NO: 618520 - RNA, 21 nt, Escherichia coli CFT073
uaaucaacaaaccaaaaccgc

SEQ ID NO: 618521 - RNA, 14 nt, Escherichia coli CFT073
uaaucaacaggaac

SEQ ID NO: 618522 - RNA, 19 nt, Escherichia coli CFT073
uaauauuuugugauuuauu

SEQ ID NO: 618523 - RNA, 14 nt, Escherichia coli CFT073
uaauaugcaauuca

SEQ ID NO: 618524 - RNA, 15 nt, Escherichia coli CFT073
uaauaugcaauucac

SEQ ID NO: 618525 - RNA, 16 nt, Escherichia coli CFT073
uaauaugcaauucaca

SEQ ID NO: 618526 - RNA, 21 nt, Escherichia coli CFT073
uaauaugcucaacaauaaacu

SEQ ID NO: 618527 - RNA, 23 nt, Escherichia coli CFT073
uaauauccccagccuaagccauu

SEQ ID NO: 618528 - RNA, 19 nt, Escherichia coli CFT073
uaauaucgcgcagaaauuc

SEQ ID NO: 618529 - RNA, 22 nt, Escherichia coli CFT073
uaauauccccagccuaagccau

SEQ ID NO: 618530 - RNA, 13 nt, Escherichia coli CFT073
uaauaucaacgcu

SEQ ID NO: 618531 - RNA, 15 nt, Escherichia coli CFT073
uaauauauaacagaa

SEQ ID NO: 618532 - RNA, 14 nt, Escherichia coli CFT073
uaauauauauuauc

SEQ ID NO: 618533 - RNA, 15 nt, Escherichia coli CFT073
uaauuucuuuucaua

SEQ ID NO: 618534 - RNA, 20 nt, Escherichia coli CFT073
uaauuucacaccaucaacaa

SEQ ID NO: 618535 - RNA, 14 nt, Escherichia coli CFT073
uaauuucagcaucg

SEQ ID NO: 618536 - RNA, 22 nt, Escherichia coli CFT073
uaauuugaaaugacgcuuuauu

SEQ ID NO: 618537 - RNA, 23 nt, Escherichia coli CFT073
uaauugccagcuugcuuuccagc

SEQ ID NO: 618538 - RNA, 18 nt, Escherichia coli CFT073
uaauugagcagcaaaaug

SEQ ID NO: 618539 - RNA, 15 nt, Escherichia coli CFT073
uaauuuugaaauaaa

SEQ ID NO: 618540 - RNA, 15 nt, Escherichia coli CFT073
uaauuuuuugcgcca

SEQ ID NO: 618541 - RNA, 14 nt, Escherichia coli CFT073
uacaaaaauaaguc

SEQ ID NO: 618542 - RNA, 19 nt, Escherichia coli CFT073
uacaacucgcuuaagccau

SEQ ID NO: 618543 - RNA, 20 nt, Escherichia coli CFT073
uacaacucgcuuaagccauc

SEQ ID NO: 618544 - RNA, 13 nt, Escherichia coli CFT073
uacaagcagagag

SEQ ID NO: 618545 - RNA, 22 nt, Escherichia coli CFT073
uacaagccacaucgccauauug

SEQ ID NO: 618546 - RNA, 20 nt, Escherichia coli CFT073
uacaacugcuuuuugcucuc

SEQ ID NO: 618547 - RNA, 13 nt, Escherichia coli CFT073
uacaaauagccaa

SEQ ID NO: 618548 - RNA, 21 nt, Escherichia coli CFT073
uacaaauagccaauucccagu

SEQ ID NO: 618549 - RNA, 19 nt, Escherichia coli CFT073
uacaaagccaacagcagcc

SEQ ID NO: 618550 - RNA, 23 nt, Escherichia coli CFT073
uacaaagccaacagcagccacac

SEQ ID NO: 618551 - RNA, 12 nt, Escherichia coli CFT073
uacaaaggcacg

SEQ ID NO: 618552 - RNA, 13 nt, Escherichia coli CFT073
uacaaaggcacgc

SEQ ID NO: 618553 - RNA, 15 nt, Escherichia coli CFT073
uacaaaggcacgcca

SEQ ID NO: 618554 - RNA, 19 nt, Escherichia coli CFT073
uacaaagggcuaacgugca

SEQ ID NO: 618555 - RNA, 15 nt, Escherichia coli CFT073
uacaaacgccauaaa

SEQ ID NO: 618556 - RNA, 14 nt, Escherichia coli CFT073
uacaaacauaaagc

SEQ ID NO: 618557 - RNA, 20 nt, Escherichia coli CFT073
uacaaacauccaucugcuuu

SEQ ID NO: 618558 - RNA, 16 nt, Escherichia coli CFT073
uacaaaagcaauaauu

SEQ ID NO: 618559 - RNA, 13 nt, Escherichia coli CFT073
uacaaaagcaccg

SEQ ID NO: 618560 - RNA, 14 nt, Escherichia coli CFT073
uacaaacaaugcca

SEQ ID NO: 618561 - RNA, 17 nt, Escherichia coli CFT073
uaaugccuuuuccagcg

SEQ ID NO: 618562 - RNA, 15 nt, Escherichia coli CFT073
uaaugcgcuuccggc

SEQ ID NO: 618563 - RNA, 14 nt, Escherichia coli CFT073
uaaugcgcuuuuac

SEQ ID NO: 618564 - RNA, 15 nt, Escherichia coli CFT073
uaaugcaaaaugccg

SEQ ID NO: 618565 - RNA, 24 nt, Escherichia coli CFT073
uaaugcagauaacuuaguuaauca

SEQ ID NO: 618566 - RNA, 16 nt, Escherichia coli CFT073
uaaugccucuccccag

SEQ ID NO: 618567 - RNA, 17 nt, Escherichia coli CFT073
uaaugucgcuggccgga

SEQ ID NO: 618568 - RNA, 17 nt, Escherichia coli CFT073
uaaugucgacauaauca

SEQ ID NO: 618569 - RNA, 18 nt, Escherichia coli CFT073
uaaucgccagcaaaauca

SEQ ID NO: 618570 - RNA, 21 nt, Escherichia coli CFT073
uaaucgccagcaaaaucacca

SEQ ID NO: 618571 - RNA, 22 nt, Escherichia coli CFT073
uaaucgcaaagcuguuaucgau

SEQ ID NO: 618572 - RNA, 18 nt, Escherichia coli CFT073
uaaugaucugaucaaacu

SEQ ID NO: 618573 - RNA, 22 nt, Escherichia coli CFT073
uaaugauggugaaagcaaaaaa

SEQ ID NO: 618574 - RNA, 13 nt, Escherichia coli CFT073
uaaugauucauaa

SEQ ID NO: 618575 - RNA, 11 nt, Escherichia coli CFT073
uaaugauuuug

SEQ ID NO: 618576 - RNA, 13 nt, Escherichia coli CFT073
uaaugauuuccag

SEQ ID NO: 618577 - RNA, 18 nt, Escherichia coli CFT073
uaauuccagaauucuauu

SEQ ID NO: 618578 - RNA, 11 nt, Escherichia coli CFT073
uaauuccagcg

SEQ ID NO: 618579 - RNA, 21 nt, Escherichia coli CFT073
uaauuccaucuuuaacugcuc

SEQ ID NO: 618580 - RNA, 15 nt, Escherichia coli CFT073
uaauucaaaaaccug

SEQ ID NO: 618581 - RNA, 14 nt, Escherichia coli CFT073
uaauuccacaccaa

SEQ ID NO: 618582 - RNA, 16 nt, Escherichia coli CFT073
uaauuccugaagagaa

SEQ ID NO: 618583 - RNA, 15 nt, Escherichia coli CFT073
uaauugaccagaucu

SEQ ID NO: 618584 - RNA, 19 nt, Escherichia coli CFT073
uaauuaugccgaucaucau

SEQ ID NO: 618585 - RNA, 13 nt, Escherichia coli CFT073
uaauguggcuggg

SEQ ID NO: 618586 - RNA, 14 nt, Escherichia coli CFT073
uaauguggcugggg

SEQ ID NO: 618587 - RNA, 14 nt, Escherichia coli CFT073
uaauguguucaacu

SEQ ID NO: 618588 - RNA, 13 nt, Escherichia coli CFT073
uaauguuuucagu

SEQ ID NO: 618589 - RNA, 16 nt, Escherichia coli CFT073
uaauguucguugcauu

SEQ ID NO: 618590 - RNA, 17 nt, Escherichia coli CFT073
uaauguucguugcauuc

SEQ ID NO: 618591 - RNA, 21 nt, Escherichia coli CFT073
uaauuaaacagcccuuugauu

SEQ ID NO: 618592 - RNA, 17 nt, Escherichia coli CFT073
uaauuaccccauccauu

SEQ ID NO: 618593 - RNA, 23 nt, Escherichia coli CFT073
aaaucccacauccgaccaaagaa

SEQ ID NO: 618594 - RNA, 23 nt, Escherichia coli CFT073
aaaucccagcguuuaucaauauc

SEQ ID NO: 618595 - RNA, 17 nt, Escherichia coli CFT073
uaacugacgggcuuuuu

SEQ ID NO: 618596 - RNA, 20 nt, Escherichia coli CFT073
aaaucccuuaggucggauaa

SEQ ID NO: 618597 - RNA, 20 nt, Escherichia coli CFT073
uaacugaucacguuuuccuu

SEQ ID NO: 618598 - RNA, 21 nt, Escherichia coli CFT073
uaacugauggcaaaugcaaca

SEQ ID NO: 618599 - RNA, 17 nt, Escherichia coli CFT073
uaacugcccgcaucaag

SEQ ID NO: 618600 - RNA, 21 nt, Escherichia coli CFT073
uaacugccuccugcaaaugcu

SEQ ID NO: 618601 - RNA, 19 nt, Escherichia coli CFT073
uaacugcgcgguagucaau

SEQ ID NO: 618602 - RNA, 11 nt, Escherichia coli CFT073
uaacugcucuc

SEQ ID NO: 618603 - RNA, 13 nt, Escherichia coli CFT073
uaacuuccauccc

SEQ ID NO: 618604 - RNA, 17 nt, Escherichia coli CFT073
uaacuuccccuuucaca

SEQ ID NO: 618605 - RNA, 11 nt, Escherichia coli CFT073
uaacuuccugc

SEQ ID NO: 618606 - RNA, 13 nt, Escherichia coli CFT073
uaacuuccugcug

SEQ ID NO: 618607 - RNA, 23 nt, Escherichia coli CFT073
uaacuuccugcuggcuguaaaau

SEQ ID NO: 618608 - RNA, 23 nt, Escherichia coli CFT073
uaacuguuaaauaacggccuggc

SEQ ID NO: 618609 - RNA, 13 nt, Escherichia coli CFT073
uaacugugccaaa

SEQ ID NO: 618610 - RNA, 16 nt, Escherichia coli CFT073
uaacguuaauccugau

SEQ ID NO: 618611 - RNA, 15 nt, Escherichia coli CFT073
uaacguggcagcagg

SEQ ID NO: 618612 - RNA, 18 nt, Escherichia coli CFT073
uaacguauaacucgccuu

SEQ ID NO: 618613 - RNA, 15 nt, Escherichia coli CFT073
uaacguauugggaug

SEQ ID NO: 618614 - RNA, 16 nt, Escherichia coli CFT073
uaacguagcccugccg

SEQ ID NO: 618615 - RNA, 17 nt, Escherichia coli CFT073
uaacguacuacuuuguu

SEQ ID NO: 618616 - RNA, 13 nt, Escherichia coli CFT073
uaacguaaaccaa

SEQ ID NO: 618617 - RNA, 22 nt, Escherichia coli CFT073
uaacguuuagcgguggcaagca

SEQ ID NO: 618618 - RNA, 19 nt, Escherichia coli CFT073
uaacguugaaccgccccac

SEQ ID NO: 618619 - RNA, 18 nt, Escherichia coli CFT073
uaacguuugccagccaca

SEQ ID NO: 618620 - RNA, 19 nt, Escherichia coli CFT073
uaacguuugccagccacac

SEQ ID NO: 618621 - RNA, 21 nt, Escherichia coli CFT073
uaacguuugccagccacacca

SEQ ID NO: 618622 - RNA, 21 nt, Escherichia coli CFT073
uaacuaacgguagccugcaau

SEQ ID NO: 618623 - RNA, 20 nt, Escherichia coli CFT073
uaacuccugcgucggaacau

SEQ ID NO: 618624 - RNA, 22 nt, Escherichia coli CFT073
uaacuccuucuaaagcaacucc

SEQ ID NO: 618625 - RNA, 18 nt, Escherichia coli CFT073
uaacucgaauuauucaga

SEQ ID NO: 618626 - RNA, 15 nt, Escherichia coli CFT073
uaacucgcagcuuug

SEQ ID NO: 618627 - RNA, 14 nt, Escherichia coli CFT073
uaacucggaaaaug

SEQ ID NO: 618628 - RNA, 22 nt, Escherichia coli CFT073
uaacucggaaaaugcauucuua

SEQ ID NO: 618629 - RNA, 12 nt, Escherichia coli CFT073
uaacucaccauc

SEQ ID NO: 618630 - RNA, 14 nt, Escherichia coli CFT073
uaacucaccaucaa

SEQ ID NO: 618631 - RNA, 18 nt, Escherichia coli CFT073
uaacucauugauuuucaa

SEQ ID NO: 618632 - RNA, 19 nt, Escherichia coli CFT073
uaacucauugccagcccua

SEQ ID NO: 618633 - RNA, 19 nt, Escherichia coli CFT073
uaacuauaugacucauaaa

SEQ ID NO: 618634 - RNA, 23 nt, Escherichia coli CFT073
uaagaacugacuuccacuuccug

SEQ ID NO: 618635 - RNA, 17 nt, Escherichia coli CFT073
uaagaaaguucgacaac

SEQ ID NO: 618636 - RNA, 19 nt, Escherichia coli CFT073
uaagaaagauacaaaacau

SEQ ID NO: 618637 - RNA, 16 nt, Escherichia coli CFT073
uaagaagggcuggcca

SEQ ID NO: 618638 - RNA, 16 nt, Escherichia coli CFT073
uaacuuugaucgcguu

SEQ ID NO: 618639 - RNA, 19 nt, Escherichia coli CFT073
uaacuuuguaaggaguuuu

SEQ ID NO: 618640 - RNA, 17 nt, Escherichia coli CFT073
uaacuuuuaguaaacaa

SEQ ID NO: 618641 - RNA, 18 nt, Escherichia coli CFT073
uaagaaaacggaagcuca

SEQ ID NO: 618642 - RNA, 23 nt, Escherichia coli CFT073
uaacuucuuuacuggcuuucauu

SEQ ID NO: 618643 - RNA, 22 nt, Escherichia coli CFT073
uaacuucuuuacuggcuuucau

SEQ ID NO: 618644 - RNA, 15 nt, Escherichia coli CFT073
uaacuuaucuguaau

SEQ ID NO: 618645 - RNA, 22 nt, Escherichia coli CFT073
uaacuucuaccugaugcuuuuu

SEQ ID NO: 618646 - RNA, 23 nt, Escherichia coli CFT073
uaacuuuaauuuugugcagcaca

SEQ ID NO: 618647 - RNA, 15 nt, Escherichia coli CFT073
uaacuuuaauuuugu

SEQ ID NO: 618648 - RNA, 14 nt, Escherichia coli CFT073
uaagauaaaagcaa

SEQ ID NO: 618649 - RNA, 19 nt, Escherichia coli CFT073
uaagauaccccagcgcaag

SEQ ID NO: 618650 - RNA, 21 nt, Escherichia coli CFT073
uaagauagacuguugaaauac

SEQ ID NO: 618651 - RNA, 14 nt, Escherichia coli CFT073
uaagaucagaagca

SEQ ID NO: 618652 - RNA, 16 nt, Escherichia coli CFT073
uaagaugaagaaaaua

SEQ ID NO: 618653 - RNA, 17 nt, Escherichia coli CFT073
uaagauuccuuccagua

SEQ ID NO: 618654 - RNA, 17 nt, Escherichia coli CFT073
uaagaugcgaguaaaca

SEQ ID NO: 618655 - RNA, 17 nt, Escherichia coli CFT073
uaagagaugaauuuaua

SEQ ID NO: 618656 - RNA, 17 nt, Escherichia coli CFT073
uaagaguuucaacauca

SEQ ID NO: 618657 - RNA, 21 nt, Escherichia coli CFT073
uaagaggcuaaccuuauggug

SEQ ID NO: 618658 - RNA, 19 nt, Escherichia coli CFT073
uaagaccgugagcaaugca

SEQ ID NO: 618659 - RNA, 18 nt, Escherichia coli CFT073
uaagacgcgucagcgccg

SEQ ID NO: 618660 - RNA, 17 nt, Escherichia coli CFT073
uaagaccugucucuuau

SEQ ID NO: 618661 - RNA, 22 nt, Escherichia coli CFT073
uaaguaucugcuaauauuuugu

SEQ ID NO: 618662 - RNA, 23 nt, Escherichia coli CFT073
uaaguacuuuccauuuuggaaua

SEQ ID NO: 618663 - RNA, 14 nt, Escherichia coli CFT073
uaaguacauuaaaa

SEQ ID NO: 618664 - RNA, 23 nt, Escherichia coli CFT073
uaagucugcgucaucggcagcau

SEQ ID NO: 618665 - RNA, 16 nt, Escherichia coli CFT073
uaagucacuaauugca

SEQ ID NO: 618666 - RNA, 18 nt, Escherichia coli CFT073
uaagguguucacgccgca

SEQ ID NO: 618667 - RNA, 21 nt, Escherichia coli CFT073
uaagguguucacgccgcaucc

SEQ ID NO: 618668 - RNA, 18 nt, Escherichia coli CFT073
uaagguucacuuaaucuc

SEQ ID NO: 618669 - RNA, 13 nt, Escherichia coli CFT073
uaaguaacaauau

SEQ ID NO: 618670 - RNA, 16 nt, Escherichia coli CFT073
uaaguaaacaaacaug

SEQ ID NO: 618671 - RNA, 11 nt, Escherichia coli CFT073
uaagguuuuuu

SEQ ID NO: 618672 - RNA, 21 nt, Escherichia coli CFT073
uaaggguugcugaccaaaucu

SEQ ID NO: 618673 - RNA, 19 nt, Escherichia coli CFT073
uaagguaucgcgaaaaaaa

SEQ ID NO: 618674 - RNA, 22 nt, Escherichia coli CFT073
uaagguaucgcgaaaaaaaaga

SEQ ID NO: 618675 - RNA, 14 nt, Escherichia coli CFT073
uaaggguauagaaa

SEQ ID NO: 618676 - RNA, 15 nt, Escherichia coli CFT073
uaaggguauagaaac

SEQ ID NO: 618677 - RNA, 18 nt, Escherichia coli CFT073
uaagggugaaagggugcg

SEQ ID NO: 618678 - RNA, 16 nt, Escherichia coli CFT073
uaagggcugacaguug

SEQ ID NO: 618679 - RNA, 18 nt, Escherichia coli CFT073
uaagggaucauguaguaa

SEQ ID NO: 618680 - RNA, 21 nt, Escherichia coli CFT073
uaaguguauguuggcuuuaua

SEQ ID NO: 618681 - RNA, 14 nt, Escherichia coli CFT073
uaagugacaguguc

SEQ ID NO: 618682 - RNA, 17 nt, Escherichia coli CFT073
uaaguggcaauauauuu

SEQ ID NO: 618683 - RNA, 21 nt, Escherichia coli CFT073
uaaguuacuaaaaguaaauaa

SEQ ID NO: 618684 - RNA, 21 nt, Escherichia coli CFT073
uaaguuagacggaaaagacua

SEQ ID NO: 618685 - RNA, 15 nt, Escherichia coli CFT073
uaaguuauguauucg

SEQ ID NO: 618686 - RNA, 16 nt, Escherichia coli CFT073
uaaguucaaguaaaac

SEQ ID NO: 618687 - RNA, 21 nt, Escherichia coli CFT073
uaaguucaaguaaaacagccu

SEQ ID NO: 618688 - RNA, 19 nt, Escherichia coli CFT073
uaaguucaaguuugcuuca

SEQ ID NO: 618689 - RNA, 21 nt, Escherichia coli CFT073
uaauaacagacuuuguaagaa

SEQ ID NO: 618690 - RNA, 16 nt, Escherichia coli CFT073
uaauaaauauuauugu

SEQ ID NO: 618691 - RNA, 22 nt, Escherichia coli CFT073
uaauaaagcacccuguuugucu

SEQ ID NO: 618692 - RNA, 15 nt, Escherichia coli CFT073
uaauaaaaaaccgga

SEQ ID NO: 618693 - RNA, 12 nt, Escherichia coli CFT073
uaauaaaaaggu

SEQ ID NO: 618694 - RNA, 14 nt, Escherichia coli CFT073
uaauaaacauuggu

SEQ ID NO: 618695 - RNA, 20 nt, Escherichia coli CFT073
uaauaaacucacuuaaagcc

SEQ ID NO: 618696 - RNA, 13 nt, Escherichia coli CFT073
uaaggccaaauac

SEQ ID NO: 618697 - RNA, 17 nt, Escherichia coli CFT073
uaaggcaacgccccuuc

SEQ ID NO: 618698 - RNA, 15 nt, Escherichia coli CFT073
uaaggcuguucccac

SEQ ID NO: 618699 - RNA, 18 nt, Escherichia coli CFT073
uaaggcucucuuaccagc

SEQ ID NO: 618700 - RNA, 12 nt, Escherichia coli CFT073
uaaggcguucaa

SEQ ID NO: 618701 - RNA, 19 nt, Escherichia coli CFT073
uaaggccugguucaucgcu

SEQ ID NO: 618702 - RNA, 14 nt, Escherichia coli CFT073
uaaggagcaauaau

SEQ ID NO: 618703 - RNA, 12 nt, Escherichia coli CFT073
uaaggauaaaaa

SEQ ID NO: 618704 - RNA, 22 nt, Escherichia coli CFT073
uaaggaacggggguuuuacuuu

SEQ ID NO: 618705 - RNA, 16 nt, Escherichia coli CFT073
uaagcuuuuucugcuu

SEQ ID NO: 618706 - RNA, 22 nt, Escherichia coli CFT073
uaagcguugugcaucaggcaaa

SEQ ID NO: 618707 - RNA, 14 nt, Escherichia coli CFT073
uaagcguagcgcau

SEQ ID NO: 618708 - RNA, 17 nt, Escherichia coli CFT073
uaagcggcuccggucca

SEQ ID NO: 618709 - RNA, 21 nt, Escherichia coli CFT073
uaagcggccucgauuggggag

SEQ ID NO: 618710 - RNA, 21 nt, Escherichia coli CFT073
uaagcgcguuucugcgcuucu

SEQ ID NO: 618711 - RNA, 22 nt, Escherichia coli CFT073
uaagcgccugauacagccaaau

SEQ ID NO: 618712 - RNA, 13 nt, Escherichia coli CFT073
uaagcuggaaucc

SEQ ID NO: 618713 - RNA, 17 nt, Escherichia coli CFT073
uaagccgcaaccaccug

SEQ ID NO: 618714 - RNA, 16 nt, Escherichia coli CFT073
uaagccgcugugugua

SEQ ID NO: 618715 - RNA, 13 nt, Escherichia coli CFT073
uaagccgucccua

SEQ ID NO: 618716 - RNA, 19 nt, Escherichia coli CFT073
uaagccucacgguucauua

SEQ ID NO: 618717 - RNA, 14 nt, Escherichia coli CFT073
uaagccucuuucag

SEQ ID NO: 618718 - RNA, 14 nt, Escherichia coli CFT073
uaagcgaaggugcc

SEQ ID NO: 618719 - RNA, 12 nt, Escherichia coli CFT073
uaagccuuccgc

SEQ ID NO: 618720 - RNA, 15 nt, Escherichia coli CFT073
uaagccuuccgcuga

SEQ ID NO: 618721 - RNA, 14 nt, Escherichia coli CFT073
uaagcgcaaaggcc

SEQ ID NO: 618722 - RNA, 18 nt, Escherichia coli CFT073
uaagccauauuuaacucc

SEQ ID NO: 618723 - RNA, 23 nt, Escherichia coli CFT073
uaagccaguucucaccaaaggca

SEQ ID NO: 618724 - RNA, 17 nt, Escherichia coli CFT073
uaagcccuuaagaaaac

SEQ ID NO: 618725 - RNA, 17 nt, Escherichia coli CFT073
uaagccauuuaacucac

SEQ ID NO: 618726 - RNA, 14 nt, Escherichia coli CFT073
uaagcauuggcaug

SEQ ID NO: 618727 - RNA, 11 nt, Escherichia coli CFT073
uaagccagacc

SEQ ID NO: 618728 - RNA, 22 nt, Escherichia coli CFT073
uaagcaccgaacaagaaacaga

SEQ ID NO: 618729 - RNA, 17 nt, Escherichia coli CFT073
uaagcaguccagcgccu

SEQ ID NO: 618730 - RNA, 18 nt, Escherichia coli CFT073
uaagcaacgccaaauuua

SEQ ID NO: 618731 - RNA, 20 nt, Escherichia coli CFT073
uaagcaaauaauuccccacc

SEQ ID NO: 618732 - RNA, 21 nt, Escherichia coli CFT073
uaagcaacugacuggcucuuu

SEQ ID NO: 618733 - RNA, 23 nt, Escherichia coli CFT073
uaacgcagaaucuucuucucagc

SEQ ID NO: 618734 - RNA, 15 nt, Escherichia coli CFT073
uaacgccccaaucca

SEQ ID NO: 618735 - RNA, 12 nt, Escherichia coli CFT073
uaacgccccaca

SEQ ID NO: 618736 - RNA, 20 nt, Escherichia coli CFT073
uaacgccagacucgccaggc

SEQ ID NO: 618737 - RNA, 14 nt, Escherichia coli CFT073
uaacgccagccaca

SEQ ID NO: 618738 - RNA, 14 nt, Escherichia coli CFT073
uaacgccagugaug

SEQ ID NO: 618739 - RNA, 14 nt, Escherichia coli CFT073
uaacgccagacucg

SEQ ID NO: 618740 - RNA, 20 nt, Escherichia coli CFT073
uaacgcauucgccguuacca

SEQ ID NO: 618741 - RNA, 17 nt, Escherichia coli CFT073
uaacgcagcgauagcuu

SEQ ID NO: 618742 - RNA, 21 nt, Escherichia coli CFT073
uaacgccaauucauuccuuga

SEQ ID NO: 618743 - RNA, 23 nt, Escherichia coli CFT073
uaacgccaauucauuccuugaaa

SEQ ID NO: 618744 - RNA, 18 nt, Escherichia coli CFT073
uaaccguugguuauccug

SEQ ID NO: 618745 - RNA, 17 nt, Escherichia coli CFT073
uaaccgagaauuuccag

SEQ ID NO: 618746 - RNA, 21 nt, Escherichia coli CFT073
uaaccgaccgguccacuuccu

SEQ ID NO: 618747 - RNA, 23 nt, Escherichia coli CFT073
uaaccgaccgguccacuuccugc

SEQ ID NO: 618748 - RNA, 22 nt, Escherichia coli CFT073
uaaccggccuugcggaaagcca

SEQ ID NO: 618749 - RNA, 15 nt, Escherichia coli CFT073
uaaccgggagauuuu

SEQ ID NO: 618750 - RNA, 22 nt, Escherichia coli CFT073
uaaccgggagauuuucuccugc

SEQ ID NO: 618751 - RNA, 19 nt, Escherichia coli CFT073
uaaccgggguuucacccac

SEQ ID NO: 618752 - RNA, 21 nt, Escherichia coli CFT073
uaacgguaaagcccucaccga

SEQ ID NO: 618753 - RNA, 23 nt, Escherichia coli CFT073
uaacgguggugcuguuuucuccc

SEQ ID NO: 618754 - RNA, 12 nt, Escherichia coli CFT073
uaacguaauucg

SEQ ID NO: 618755 - RNA, 19 nt, Escherichia coli CFT073
uaacggagaauccagcccc

SEQ ID NO: 618756 - RNA, 16 nt, Escherichia coli CFT073
uaacgcgcuuucuucg

SEQ ID NO: 618757 - RNA, 18 nt, Escherichia coli CFT073
uaacgccuggcaguggug

SEQ ID NO: 618758 - RNA, 16 nt, Escherichia coli CFT073
uaacgccuucccuuuc

SEQ ID NO: 618759 - RNA, 19 nt, Escherichia coli CFT073
uaacgccuucccuuucagc

SEQ ID NO: 618760 - RNA, 23 nt, Escherichia coli CFT073
uaacgcugauacccggcacacaa

SEQ ID NO: 618761 - RNA, 18 nt, Escherichia coli CFT073
uaacgcuggcagcaagug

SEQ ID NO: 618762 - RNA, 21 nt, Escherichia coli CFT073
uaacgcggcagcaaccgcuuc

SEQ ID NO: 618763 - RNA, 23 nt, Escherichia coli CFT073
uaacgcguuagcuuaauaagaaa

SEQ ID NO: 618764 - RNA, 23 nt, Escherichia coli CFT073
uaacacgacggcauucgccacug

SEQ ID NO: 618765 - RNA, 13 nt, Escherichia coli CFT073
uaacacuucugcc

SEQ ID NO: 618766 - RNA, 17 nt, Escherichia coli CFT073
uaacagaauacugccgu

SEQ ID NO: 618767 - RNA, 23 nt, Escherichia coli CFT073
uaacacuuucgccugcggcgcau

SEQ ID NO: 618768 - RNA, 18 nt, Escherichia coli CFT073
uaaccaccaguaaauugu

SEQ ID NO: 618769 - RNA, 15 nt, Escherichia coli CFT073
uaaccaccagcacug

SEQ ID NO: 618770 - RNA, 13 nt, Escherichia coli CFT073
uaacauggcggua

SEQ ID NO: 618771 - RNA, 16 nt, Escherichia coli CFT073
uaacauggugaaagca

SEQ ID NO: 618772 - RNA, 18 nt, Escherichia coli CFT073
uaacaucgcaaaauacac

SEQ ID NO: 618773 - RNA, 14 nt, Escherichia coli CFT073
uaacaucuuaauag

SEQ ID NO: 618774 - RNA, 19 nt, Escherichia coli CFT073
uaacaucuuaauagcugcc

SEQ ID NO: 618775 - RNA, 13 nt, Escherichia coli CFT073
uaacccuuccaga

SEQ ID NO: 618776 - RNA, 15 nt, Escherichia coli CFT073
uaacccgagaucuuu

SEQ ID NO: 618777 - RNA, 12 nt, Escherichia coli CFT073
uaaccaucagcu

SEQ ID NO: 618778 - RNA, 15 nt, Escherichia coli CFT073
uaaccaucagcuccg

SEQ ID NO: 618779 - RNA, 20 nt, Escherichia coli CFT073
uaaccauccauauuuggcau

SEQ ID NO: 618780 - RNA, 22 nt, Escherichia coli CFT073
uaaccauccgagcagcaaugcu

SEQ ID NO: 618781 - RNA, 17 nt, Escherichia coli CFT073
uaaccaguuuaucaaug

SEQ ID NO: 618782 - RNA, 16 nt, Escherichia coli CFT073
uaaccacuucuucuug

SEQ ID NO: 618783 - RNA, 17 nt, Escherichia coli CFT073
uaaccaccguuuguugc

SEQ ID NO: 618784 - RNA, 18 nt, Escherichia coli CFT073
uaaccaccuccacgccca

SEQ ID NO: 618785 - RNA, 20 nt, Escherichia coli CFT073
uaaccagagagcuuauccag

SEQ ID NO: 618786 - RNA, 20 nt, Escherichia coli CFT073
uaaccagacgccccaguaaa

SEQ ID NO: 618787 - RNA, 18 nt, Escherichia coli CFT073
uaaccagacgauuuuccc

SEQ ID NO: 618788 - RNA, 19 nt, Escherichia coli CFT073
uaaccagacgauuuucccu

SEQ ID NO: 618789 - RNA, 15 nt, Escherichia coli CFT073
uaaccagaaaccgug

SEQ ID NO: 618790 - RNA, 11 nt, Escherichia coli CFT073
uaaccagcacc

SEQ ID NO: 618791 - RNA, 12 nt, Escherichia coli CFT073
uaaccagcacca

SEQ ID NO: 618792 - RNA, 20 nt, Escherichia coli CFT073
uaaccagaugucgcgcacug

SEQ ID NO: 618793 - RNA, 14 nt, Escherichia coli CFT073
uaaccagccaaaua

SEQ ID NO: 618794 - RNA, 18 nt, Escherichia coli CFT073
uaaccagccaaauaaaau

SEQ ID NO: 618795 - RNA, 15 nt, Escherichia coli CFT073
uaaccagcgcagaca

SEQ ID NO: 618796 - RNA, 20 nt, Escherichia coli CFT073
uaaccagcgcagacaccaga

SEQ ID NO: 618797 - RNA, 21 nt, Escherichia coli CFT073
uaaccagcgcagacaccagaa

SEQ ID NO: 618798 - RNA, 23 nt, Escherichia coli CFT073
uaaccagcgcagacaccagaaua

SEQ ID NO: 618799 - RNA, 16 nt, Escherichia coli CFT073
uaaccagcguuuccag

SEQ ID NO: 618800 - RNA, 12 nt, Escherichia coli CFT073
uaaccaggcaag

SEQ ID NO: 618801 - RNA, 17 nt, Escherichia coli CFT073
uaaccagguaaagacca

SEQ ID NO: 618802 - RNA, 14 nt, Escherichia coli CFT073
uaacaauuuaucag

SEQ ID NO: 618803 - RNA, 18 nt, Escherichia coli CFT073
uaacaauuuaucagacaa

SEQ ID NO: 618804 - RNA, 20 nt, Escherichia coli CFT073
uaacaauuuaucagacaauc

SEQ ID NO: 618805 - RNA, 24 nt, Escherichia coli CFT073
uaacaauaaauucgccagacagug

SEQ ID NO: 618806 - RNA, 14 nt, Escherichia coli CFT073
uaacaauaacaauu

SEQ ID NO: 618807 - RNA, 12 nt, Escherichia coli CFT073
uaacaauaagau

SEQ ID NO: 618808 - RNA, 16 nt, Escherichia coli CFT073
uaacaccggcgcacug

SEQ ID NO: 618809 - RNA, 16 nt, Escherichia coli CFT073
uaacaccaguuuccag

SEQ ID NO: 618810 - RNA, 13 nt, Escherichia coli CFT073
uaacaccaucagu

SEQ ID NO: 618811 - RNA, 13 nt, Escherichia coli CFT073
uaacaaaaugccg

SEQ ID NO: 618812 - RNA, 23 nt, Escherichia coli CFT073
uaacaaacuccccgcaaaccaga

SEQ ID NO: 618813 - RNA, 23 nt, Escherichia coli CFT073
uaaauuauuugcguagucugacc

SEQ ID NO: 618814 - RNA, 13 nt, Escherichia coli CFT073
uaaauuccacgcg

SEQ ID NO: 618815 - RNA, 13 nt, Escherichia coli CFT073
uaaauccugccaa

SEQ ID NO: 618816 - RNA, 14 nt, Escherichia coli CFT073
uaaauccuuuguac

SEQ ID NO: 618817 - RNA, 14 nt, Escherichia coli CFT073
uaaauccauaagau

SEQ ID NO: 618818 - RNA, 14 nt, Escherichia coli CFT073
uaaauggcacagug

SEQ ID NO: 618819 - RNA, 19 nt, Escherichia coli CFT073
uaaaugcuugacucugugg

SEQ ID NO: 618820 - RNA, 14 nt, Escherichia coli CFT073
uaaaugccuggaug

SEQ ID NO: 618821 - RNA, 21 nt, Escherichia coli CFT073
uaaaugcguagguuaacccag

SEQ ID NO: 618822 - RNA, 17 nt, Escherichia coli CFT073
uaaaccgcucgucacau

SEQ ID NO: 618823 - RNA, 22 nt, Escherichia coli CFT073
uaaaccaaagccacccacaccg

SEQ ID NO: 618824 - RNA, 17 nt, Escherichia coli CFT073
uaaaccaacaaaacuca

SEQ ID NO: 618825 - RNA, 14 nt, Escherichia coli CFT073
uaaaccaaucaauu

SEQ ID NO: 618826 - RNA, 12 nt, Escherichia coli CFT073
uaaaccaauggu

SEQ ID NO: 618827 - RNA, 14 nt, Escherichia coli CFT073
uaaacacucacauc

SEQ ID NO: 618828 - RNA, 22 nt, Escherichia coli CFT073
uaaacagcccuuugauuugucu

SEQ ID NO: 618829 - RNA, 13 nt, Escherichia coli CFT073
uaaacaacaaaau

SEQ ID NO: 618830 - RNA, 13 nt, Escherichia coli CFT073
uaaacaaacauga

SEQ ID NO: 618831 - RNA, 16 nt, Escherichia coli CFT073
guuuuuccccugccag

SEQ ID NO: 618832 - RNA, 13 nt, Escherichia coli CFT073
guuuuuccagcuu

SEQ ID NO: 618833 - RNA, 19 nt, Escherichia coli CFT073
guuuuucagcgccagcgcg

SEQ ID NO: 618834 - RNA, 15 nt, Escherichia coli CFT073
guuuuuaucuucaca

SEQ ID NO: 618835 - RNA, 22 nt, Escherichia coli CFT073
guuuuuauuauuaaaccaggaa

SEQ ID NO: 618836 - RNA, 15 nt, Escherichia coli CFT073
uaaacuggaaaaccg

SEQ ID NO: 618837 - RNA, 16 nt, Escherichia coli CFT073
uaaacugggcgcggcc

SEQ ID NO: 618838 - RNA, 18 nt, Escherichia coli CFT073
uaaacugggcgcggccca

SEQ ID NO: 618839 - RNA, 12 nt, Escherichia coli CFT073
uaaacugucaac

SEQ ID NO: 618840 - RNA, 21 nt, Escherichia coli CFT073
uaaacugucaacaccagggaa

SEQ ID NO: 618841 - RNA, 16 nt, Escherichia coli CFT073
uaaacugaucuuuauc

SEQ ID NO: 618842 - RNA, 20 nt, Escherichia coli CFT073
uaaacuuacugacaucaaac

SEQ ID NO: 618843 - RNA, 12 nt, Escherichia coli CFT073
uaaacuucaacg

SEQ ID NO: 618844 - RNA, 14 nt, Escherichia coli CFT073
uaaagaaugaaauu

SEQ ID NO: 618845 - RNA, 22 nt, Escherichia coli CFT073
uaaagaccauugaugcucuccg

SEQ ID NO: 618846 - RNA, 16 nt, Escherichia coli CFT073
uaaagauaaugccagc

SEQ ID NO: 618847 - RNA, 22 nt, Escherichia coli CFT073
uaaagauaaugccagccugcaa

SEQ ID NO: 618848 - RNA, 18 nt, Escherichia coli CFT073
uaaacggaacauacggca

SEQ ID NO: 618849 - RNA, 21 nt, Escherichia coli CFT073
uaaacggcauaaauuucaggc

SEQ ID NO: 618850 - RNA, 19 nt, Escherichia coli CFT073
uaaacggcugggaaaucac

SEQ ID NO: 618851 - RNA, 19 nt, Escherichia coli CFT073
uaaacucgcugcggacaaa

SEQ ID NO: 618852 - RNA, 20 nt, Escherichia coli CFT073
uaaacucaccuuguguuuug

SEQ ID NO: 618853 - RNA, 15 nt, Escherichia coli CFT073
uaaaccgggucagcc

SEQ ID NO: 618854 - RNA, 20 nt, Escherichia coli CFT073
uaaaccguccccaaaaaagc

SEQ ID NO: 618855 - RNA, 21 nt, Escherichia coli CFT073
uaaacgccugcuuaucgcccu

SEQ ID NO: 618856 - RNA, 14 nt, Escherichia coli CFT073
uaaacgccuuaucc

SEQ ID NO: 618857 - RNA, 19 nt, Escherichia coli CFT073
uaaacgccugcuuaucgcc

SEQ ID NO: 618858 - RNA, 23 nt, Escherichia coli CFT073
uaaacgcgcuaaccuguuuucga

SEQ ID NO: 618859 - RNA, 16 nt, Escherichia coli CFT073
uaaaguuuuuauauuu

SEQ ID NO: 618860 - RNA, 20 nt, Escherichia coli CFT073
uaaauaguuuuuuacgaugc

SEQ ID NO: 618861 - RNA, 13 nt, Escherichia coli CFT073
uaaauaauaagua

SEQ ID NO: 618862 - RNA, 15 nt, Escherichia coli CFT073
uaaauaauauuuccc

SEQ ID NO: 618863 - RNA, 17 nt, Escherichia coli CFT073
uaaauaauauuucccca

SEQ ID NO: 618864 - RNA, 14 nt, Escherichia coli CFT073
uaaauaauaaauua

SEQ ID NO: 618865 - RNA, 23 nt, Escherichia coli CFT073
uaaaucaucugguuccuaaauaa

SEQ ID NO: 618866 - RNA, 22 nt, Escherichia coli CFT073
uaaaucaggaaaacgugccacu

SEQ ID NO: 618867 - RNA, 11 nt, Escherichia coli CFT073
uaaauauccuc

SEQ ID NO: 618868 - RNA, 13 nt, Escherichia coli CFT073
uaaauaucaaaaa

SEQ ID NO: 618869 - RNA, 15 nt, Escherichia coli CFT073
uaaaucacgcuuauc

SEQ ID NO: 618870 - RNA, 13 nt, Escherichia coli CFT073
uaaauauuauaug

SEQ ID NO: 618871 - RNA, 20 nt, Escherichia coli CFT073
uaaaucacgcuuaucgcccu

SEQ ID NO: 618872 - RNA, 19 nt, Escherichia coli CFT073
uaaaguuaccuguggcgua

SEQ ID NO: 618873 - RNA, 15 nt, Escherichia coli CFT073
uaaagugcgcuuugu

SEQ ID NO: 618874 - RNA, 16 nt, Escherichia coli CFT073
uaaaguaguaaguagc

SEQ ID NO: 618875 - RNA, 21 nt, Escherichia coli CFT073
uaaaguaguaaguagcaccga

SEQ ID NO: 618876 - RNA, 22 nt, Escherichia coli CFT073
uaaagucagcguuauagcgcau

SEQ ID NO: 618877 - RNA, 23 nt, Escherichia coli CFT073
uaaaguccgguaauggagauugu

SEQ ID NO: 618878 - RNA, 14 nt, Escherichia coli CFT073
uaaagcaucagacu

SEQ ID NO: 618879 - RNA, 20 nt, Escherichia coli CFT073
uaaagauuguucuuuauccg

SEQ ID NO: 618880 - RNA, 22 nt, Escherichia coli CFT073
uaaagaugaaaacgccaccaga

SEQ ID NO: 618881 - RNA, 23 nt, Escherichia coli CFT073
uaaagaugaaaacgccaccagau

SEQ ID NO: 618882 - RNA, 23 nt, Escherichia coli CFT073
uaaagcuuuuuauuacucuccag

SEQ ID NO: 618883 - RNA, 13 nt, Escherichia coli CFT073
uaaagcuuuaaua

SEQ ID NO: 618884 - RNA, 19 nt, Escherichia coli CFT073
uaaagcugccuugccaggu

SEQ ID NO: 618885 - RNA, 23 nt, Escherichia coli CFT073
uaaagcugcggauccugagcaaa

SEQ ID NO: 618886 - RNA, 14 nt, Escherichia coli CFT073
uaaagcuaucccuu

SEQ ID NO: 618887 - RNA, 19 nt, Escherichia coli CFT073
uaaagcccccacaacauug

SEQ ID NO: 618888 - RNA, 20 nt, Escherichia coli CFT073
uaaagcccgcagcguccagc

SEQ ID NO: 618889 - RNA, 21 nt, Escherichia coli CFT073
uaaagcccgcuucaaacgcug

SEQ ID NO: 618890 - RNA, 21 nt, Escherichia coli CFT073
uaaagcccucaccgaagcgag

SEQ ID NO: 618891 - RNA, 16 nt, Escherichia coli CFT073
ucacaugcggcgugcc

SEQ ID NO: 618892 - RNA, 19 nt, Escherichia coli CFT073
ucacaucguagacauaacc

SEQ ID NO: 618893 - RNA, 18 nt, Escherichia coli CFT073
ucacaugauaauaaaaac

SEQ ID NO: 618894 - RNA, 15 nt, Escherichia coli CFT073
ucaccaccagcaccg

SEQ ID NO: 618895 - RNA, 22 nt, Escherichia coli CFT073
ucaccaccagcggaauaucaga

SEQ ID NO: 618896 - RNA, 20 nt, Escherichia coli CFT073
ucaccacccagcgguaaaau

SEQ ID NO: 618897 - RNA, 14 nt, Escherichia coli CFT073
ucacauccugccag

SEQ ID NO: 618898 - RNA, 15 nt, Escherichia coli CFT073
ucacauccaccagcg

SEQ ID NO: 618899 - RNA, 18 nt, Escherichia coli CFT073
ucacauccaguacgccuu

SEQ ID NO: 618900 - RNA, 15 nt, Escherichia coli CFT073
ucacaucaaaucccc

SEQ ID NO: 618901 - RNA, 19 nt, Escherichia coli CFT073
ucacaucaauuacaccauc

SEQ ID NO: 618902 - RNA, 14 nt, Escherichia coli CFT073
ucacaucaccaaca

SEQ ID NO: 618903 - RNA, 18 nt, Escherichia coli CFT073
ucacaucagaacagcccc

SEQ ID NO: 618904 - RNA, 14 nt, Escherichia coli CFT073
ucacaucagaacgu

SEQ ID NO: 618905 - RNA, 14 nt, Escherichia coli CFT073
ucacaucagcgcau

SEQ ID NO: 618906 - RNA, 23 nt, Escherichia coli CFT073
ucacaucagcgcauuuaccaggc

SEQ ID NO: 618907 - RNA, 17 nt, Escherichia coli CFT073
ucaccaccuggcggcgu

SEQ ID NO: 618908 - RNA, 15 nt, Escherichia coli CFT073
ucaccaccuggguga

SEQ ID NO: 618909 - RNA, 23 nt, Escherichia coli CFT073
ucaccacgccccacgccauaacc

SEQ ID NO: 618910 - RNA, 22 nt, Escherichia coli CFT073
ucaccagcgcgaggaucacgca

SEQ ID NO: 618911 - RNA, 17 nt, Escherichia coli CFT073
ucaccauauucagcagc

SEQ ID NO: 618912 - RNA, 20 nt, Escherichia coli CFT073
ucaccaguaaggcaucuucu

SEQ ID NO: 618913 - RNA, 23 nt, Escherichia coli CFT073
ucaccaguaaggcaucuucuuca

SEQ ID NO: 618914 - RNA, 22 nt, Escherichia coli CFT073
ucaccaguaccgccgccauaaa

SEQ ID NO: 618915 - RNA, 17 nt, Escherichia coli CFT073
ucaccaguugugaugcc

SEQ ID NO: 618916 - RNA, 20 nt, Escherichia coli CFT073
ucaccaguugugaugccacu

SEQ ID NO: 618917 - RNA, 22 nt, Escherichia coli CFT073
ucaccaguuguugcgugaaagu

SEQ ID NO: 618918 - RNA, 21 nt, Escherichia coli CFT073
ucaccauaaaacgcgcuacug

SEQ ID NO: 618919 - RNA, 15 nt, Escherichia coli CFT073
ucaccaucagcagca

SEQ ID NO: 618920 - RNA, 19 nt, Escherichia coli CFT073
ucaccauccugaucgccau

SEQ ID NO: 618921 - RNA, 21 nt, Escherichia coli CFT073
ucaccaucgcaaacagcacau

SEQ ID NO: 618922 - RNA, 20 nt, Escherichia coli CFT073
ucaccaucuucacuguccgc

SEQ ID NO: 618923 - RNA, 14 nt, Escherichia coli CFT073
aaaucgccaagauu

SEQ ID NO: 618924 - RNA, 13 nt, Escherichia coli CFT073
aaaucgcacuggu

SEQ ID NO: 618925 - RNA, 23 nt, Escherichia coli CFT073
aaaucgcccgucaguucauccau

SEQ ID NO: 618926 - RNA, 22 nt, Escherichia coli CFT073
aaaucgccggaugcggcaggcg

SEQ ID NO: 618927 - RNA, 21 nt, Escherichia coli CFT073
aaaucgccgggauauauguca

SEQ ID NO: 618928 - RNA, 17 nt, Escherichia coli CFT073
aaaucggggaucauuaa

SEQ ID NO: 618929 - RNA, 19 nt, Escherichia coli CFT073
aaaucggggaucauuaacc

SEQ ID NO: 618930 - RNA, 15 nt, Escherichia coli CFT073
ucacauaauacguuu

SEQ ID NO: 618931 - RNA, 15 nt, Escherichia coli CFT073
ucacauagauaaagc

SEQ ID NO: 618932 - RNA, 17 nt, Escherichia coli CFT073
ucacaguaauuuccugc

SEQ ID NO: 618933 - RNA, 20 nt, Escherichia coli CFT073
ucacaggucgcaaacggcga

SEQ ID NO: 618934 - RNA, 18 nt, Escherichia coli CFT073
ucacagguggucacaguc

SEQ ID NO: 618935 - RNA, 22 nt, Escherichia coli CFT073
ucacaguuaaccaguuuuagug

SEQ ID NO: 618936 - RNA, 17 nt, Escherichia coli CFT073
ucacauaacggcccggc

SEQ ID NO: 618937 - RNA, 14 nt, Escherichia coli CFT073
ucacauaacugccu

SEQ ID NO: 618938 - RNA, 19 nt, Escherichia coli CFT073
aaaucgcaacgguucugcu

SEQ ID NO: 618939 - RNA, 20 nt, Escherichia coli CFT073
aaaucgcacguugccagcaa

SEQ ID NO: 618940 - RNA, 17 nt, Escherichia coli CFT073
ucaauuuuuuguuggcc

SEQ ID NO: 618941 - RNA, 13 nt, Escherichia coli CFT073
ucacaaaauaagu

SEQ ID NO: 618942 - RNA, 19 nt, Escherichia coli CFT073
ucacaaaauuuauccagcg

SEQ ID NO: 618943 - RNA, 17 nt, Escherichia coli CFT073
ucacagaguauuuccag

SEQ ID NO: 618944 - RNA, 19 nt, Escherichia coli CFT073
ucacagaguauuuccagcu

SEQ ID NO: 618945 - RNA, 21 nt, Escherichia coli CFT073
ucacagcuaaucaucaucagc

SEQ ID NO: 618946 - RNA, 17 nt, Escherichia coli CFT073
ucacaggcacaccgccg

SEQ ID NO: 618947 - RNA, 19 nt, Escherichia coli CFT073
ucaauagcgugcuuaccuu

SEQ ID NO: 618948 - RNA, 20 nt, Escherichia coli CFT073
ucaauaccauagacaaugua

SEQ ID NO: 618949 - RNA, 19 nt, Escherichia coli CFT073
ucaauacgcaucaccucac

SEQ ID NO: 618950 - RNA, 22 nt, Escherichia coli CFT073
ucaauacgacagcuauguuuua

SEQ ID NO: 618951 - RNA, 14 nt, Escherichia coli CFT073
ucaauacuuuccag

SEQ ID NO: 618952 - RNA, 17 nt, Escherichia coli CFT073
ucaauaaacccuucacu

SEQ ID NO: 618953 - RNA, 19 nt, Escherichia coli CFT073
ucaauaaauugcaggaacu

SEQ ID NO: 618954 - RNA, 17 nt, Escherichia coli CFT073
ucaauaaaaacggcgcu

SEQ ID NO: 618955 - RNA, 15 nt, Escherichia coli CFT073
ucaauaauaaccaaa

SEQ ID NO: 618956 - RNA, 17 nt, Escherichia coli CFT073
ucaauaacauaccaggu

SEQ ID NO: 618957 - RNA, 19 nt, Escherichia coli CFT073
ucaauaacaaagggaaacg

SEQ ID NO: 618958 - RNA, 16 nt, Escherichia coli CFT073
ucaauggucagcgcca

SEQ ID NO: 618959 - RNA, 17 nt, Escherichia coli CFT073
ucaauggugucuucguu

SEQ ID NO: 618960 - RNA, 16 nt, Escherichia coli CFT073
ucaaugguguuuucca

SEQ ID NO: 618961 - RNA, 20 nt, Escherichia coli CFT073
ucaauggcgcugcaaagcug

SEQ ID NO: 618962 - RNA, 21 nt, Escherichia coli CFT073
ucaaugauaauucaacagauu

SEQ ID NO: 618963 - RNA, 15 nt, Escherichia coli CFT073
ucaaugacgcgaacu

SEQ ID NO: 618964 - RNA, 17 nt, Escherichia coli CFT073
ucaaucaccgcuucacu

SEQ ID NO: 618965 - RNA, 20 nt, Escherichia coli CFT073
ucaaucagccccuucgccag

SEQ ID NO: 618966 - RNA, 22 nt, Escherichia coli CFT073
ucaaucagcgucgcguuuuucu

SEQ ID NO: 618967 - RNA, 19 nt, Escherichia coli CFT073
ucaaugaaucgcagucucu

SEQ ID NO: 618968 - RNA, 17 nt, Escherichia coli CFT073
ucaauucagaaauaauc

SEQ ID NO: 618969 - RNA, 13 nt, Escherichia coli CFT073
ucaauuccuucug

SEQ ID NO: 618970 - RNA, 18 nt, Escherichia coli CFT073
ucaauuccuucugggcgc

SEQ ID NO: 618971 - RNA, 18 nt, Escherichia coli CFT073
ucaauucgucuaucagcu

SEQ ID NO: 618972 - RNA, 18 nt, Escherichia coli CFT073
ucaauuccuuugcugcuc

SEQ ID NO: 618973 - RNA, 20 nt, Escherichia coli CFT073
ucaauuccuuugcugcucua

SEQ ID NO: 618974 - RNA, 22 nt, Escherichia coli CFT073
ucaauugaugcuuuuugcccuu

SEQ ID NO: 618975 - RNA, 13 nt, Escherichia coli CFT073
ucaauugcaggaa

SEQ ID NO: 618976 - RNA, 20 nt, Escherichia coli CFT073
ucaauugcguuaaaaucagc

SEQ ID NO: 618977 - RNA, 15 nt, Escherichia coli CFT073
ucaauugcuucaaua

SEQ ID NO: 618978 - RNA, 14 nt, Escherichia coli CFT073
ucaacgaugucaau

SEQ ID NO: 618979 - RNA, 17 nt, Escherichia coli CFT073
ucaacgcccauacucau

SEQ ID NO: 618980 - RNA, 21 nt, Escherichia coli CFT073
ucaacgccgcuaucagauucg

SEQ ID NO: 618981 - RNA, 18 nt, Escherichia coli CFT073
ucaaccgccggauagcua

SEQ ID NO: 618982 - RNA, 23 nt, Escherichia coli CFT073
ucaacccagaaacaggcggcgcg

SEQ ID NO: 618983 - RNA, 13 nt, Escherichia coli CFT073
ucaaccugaggcc

SEQ ID NO: 618984 - RNA, 21 nt, Escherichia coli CFT073
ucaaccguuugauugaaaaac

SEQ ID NO: 618985 - RNA, 14 nt, Escherichia coli CFT073
ucaaccugcacuga

SEQ ID NO: 618986 - RNA, 18 nt, Escherichia coli CFT073
ucaacucacacaacgagu

SEQ ID NO: 618987 - RNA, 13 nt, Escherichia coli CFT073
ucaacucaucaaa

SEQ ID NO: 618988 - RNA, 16 nt, Escherichia coli CFT073
ucaacuucagcagcag

SEQ ID NO: 618989 - RNA, 21 nt, Escherichia coli CFT073
ucaacuucgaguacauccacu

SEQ ID NO: 618990 - RNA, 23 nt, Escherichia coli CFT073
ucaacgcucaggccgauuucaug

SEQ ID NO: 618991 - RNA, 22 nt, Escherichia coli CFT073
ucaacgcgccgacgaauuucau

SEQ ID NO: 618992 - RNA, 22 nt, Escherichia coli CFT073
ucaacuacggcuuuuuucauuu

SEQ ID NO: 618993 - RNA, 15 nt, Escherichia coli CFT073
ucaacguugaauuuc

SEQ ID NO: 618994 - RNA, 19 nt, Escherichia coli CFT073
ucaacuaaaaucaauguaa

SEQ ID NO: 618995 - RNA, 22 nt, Escherichia coli CFT073
ucaacguuuacccaauccccca

SEQ ID NO: 618996 - RNA, 17 nt, Escherichia coli CFT073
ucaacaccgugacaaau

SEQ ID NO: 618997 - RNA, 17 nt, Escherichia coli CFT073
ucaacaccgaggcaauc

SEQ ID NO: 618998 - RNA, 15 nt, Escherichia coli CFT073
ucaacacaugcacau

SEQ ID NO: 618999 - RNA, 19 nt, Escherichia coli CFT073
ucaacaacacucucugcag

SEQ ID NO: 619000 - RNA, 13 nt, Escherichia coli CFT073
ucaacaaccaggc

SEQ ID NO: 619001 - RNA, 16 nt, Escherichia coli CFT073
ucaacaaccuugcguu

SEQ ID NO: 619002 - RNA, 18 nt, Escherichia coli CFT073
ucaacaacgaaaauuacc

SEQ ID NO: 619003 - RNA, 20 nt, Escherichia coli CFT073
ucaacaaacguucauacgca

SEQ ID NO: 619004 - RNA, 23 nt, Escherichia coli CFT073
ucaacaaacguucauacgcaaug

SEQ ID NO: 619005 - RNA, 14 nt, Escherichia coli CFT073
ucaacaauccauuc

SEQ ID NO: 619006 - RNA, 14 nt, Escherichia coli CFT073
ucaacaauucccag

SEQ ID NO: 619007 - RNA, 21 nt, Escherichia coli CFT073
ucaacaauucguugauuuugu

SEQ ID NO: 619008 - RNA, 14 nt, Escherichia coli CFT073
ucaacaucacacca

SEQ ID NO: 619009 - RNA, 14 nt, Escherichia coli CFT073
ucaacagccagaag

SEQ ID NO: 619010 - RNA, 13 nt, Escherichia coli CFT073
ucaacaggaacau

SEQ ID NO: 619011 - RNA, 18 nt, Escherichia coli CFT073
ucaacagggcagacauuc

SEQ ID NO: 619012 - RNA, 20 nt, Escherichia coli CFT073
ucaacauaacgcaucccguu

SEQ ID NO: 619013 - RNA, 20 nt, Escherichia coli CFT073
ucaaccagaucggacuucau

SEQ ID NO: 619014 - RNA, 15 nt, Escherichia coli CFT073
ucaaccagcggcgca

SEQ ID NO: 619015 - RNA, 23 nt, Escherichia coli CFT073
ucaaccauaucgcauaccaucca

SEQ ID NO: 619016 - RNA, 22 nt, Escherichia coli CFT073
ucaaaagcguaccgccaauuac

SEQ ID NO: 619017 - RNA, 20 nt, Escherichia coli CFT073
ucaaaacuggugguaagaau

SEQ ID NO: 619018 - RNA, 16 nt, Escherichia coli CFT073
ucaaaacuuuucacca

SEQ ID NO: 619019 - RNA, 14 nt, Escherichia coli CFT073
ucaaaauucauaaa

SEQ ID NO: 619020 - RNA, 22 nt, Escherichia coli CFT073
ucaaaaugaucgaagguuccug

SEQ ID NO: 619021 - RNA, 17 nt, Escherichia coli CFT073
ucaaaaugaacauuggc

SEQ ID NO: 619022 - RNA, 18 nt, Escherichia coli CFT073
ucaaaaugaacauuggca

SEQ ID NO: 619023 - RNA, 16 nt, Escherichia coli CFT073
ucaaaaggcuccacuu

SEQ ID NO: 619024 - RNA, 20 nt, Escherichia coli CFT073
ucaaacacaggcagaacacu

SEQ ID NO: 619025 - RNA, 21 nt, Escherichia coli CFT073
ucaaacaaccguucacgcauu

SEQ ID NO: 619026 - RNA, 14 nt, Escherichia coli CFT073
ucaaacagaaaaac

SEQ ID NO: 619027 - RNA, 12 nt, Escherichia coli CFT073
ucaaacaggcug

SEQ ID NO: 619028 - RNA, 20 nt, Escherichia coli CFT073
ucaaaccaauggcguuggca

SEQ ID NO: 619029 - RNA, 17 nt, Escherichia coli CFT073
ucaaacucggcuucgcu

SEQ ID NO: 619030 - RNA, 20 nt, Escherichia coli CFT073
ucaaacgugcggcaggcaca

SEQ ID NO: 619031 - RNA, 18 nt, Escherichia coli CFT073
ucaaaugcgccugcauaa

SEQ ID NO: 619032 - RNA, 17 nt, Escherichia coli CFT073
ucaacaaaaccacacuu

SEQ ID NO: 619033 - RNA, 23 nt, Escherichia coli CFT073
ucaacaaaaccacacuucuucag

SEQ ID NO: 619034 - RNA, 23 nt, Escherichia coli CFT073
ucaacaaaaguggacauguuuuu

SEQ ID NO: 619035 - RNA, 11 nt, Escherichia coli CFT073
ucaacaaacca

SEQ ID NO: 619036 - RNA, 13 nt, Escherichia coli CFT073
ucaacaaaccaaa

SEQ ID NO: 619037 - RNA, 23 nt, Escherichia coli CFT073
ucaaauuugucgccaacuucaug

SEQ ID NO: 619038 - RNA, 22 nt, Escherichia coli CFT073
ucaaauuugucgccaacuucau

SEQ ID NO: 619039 - RNA, 16 nt, Escherichia coli CFT073
ucaaauuucuucagcc

SEQ ID NO: 619040 - RNA, 13 nt, Escherichia coli CFT073
ucaaauuucauaa

SEQ ID NO: 619041 - RNA, 18 nt, Escherichia coli CFT073
ucaaauugcucuuugguu

SEQ ID NO: 619042 - RNA, 13 nt, Escherichia coli CFT073
ucaaacugcagca

SEQ ID NO: 619043 - RNA, 13 nt, Escherichia coli CFT073
ucaaacuggcggc

SEQ ID NO: 619044 - RNA, 19 nt, Escherichia coli CFT073
ucaaacuggcggcggcggu

SEQ ID NO: 619045 - RNA, 21 nt, Escherichia coli CFT073
ucaaacuggcugaugcuggca

SEQ ID NO: 619046 - RNA, 20 nt, Escherichia coli CFT073
ucaaacugaccuuuagcgcg

SEQ ID NO: 619047 - RNA, 17 nt, Escherichia coli CFT073
ucaaacuucgccacagc

SEQ ID NO: 619048 - RNA, 14 nt, Escherichia coli CFT073
ucaaacuuuuaaau

SEQ ID NO: 619049 - RNA, 18 nt, Escherichia coli CFT073
ucaaacuuuuaaauugaa

SEQ ID NO: 619050 - RNA, 23 nt, Escherichia coli CFT073
ucaaagaugcaggaguagaacgg

SEQ ID NO: 619051 - RNA, 17 nt, Escherichia coli CFT073
ucaaagcggucauguac

SEQ ID NO: 619052 - RNA, 16 nt, Escherichia coli CFT073
ucaaaucacuaaaccc

SEQ ID NO: 619053 - RNA, 16 nt, Escherichia coli CFT073
ucaaaucaacaaccug

SEQ ID NO: 619054 - RNA, 20 nt, Escherichia coli CFT073
ucaaaucaacaaccugcauu

SEQ ID NO: 619055 - RNA, 18 nt, Escherichia coli CFT073
ucaaauagccugccagug

SEQ ID NO: 619056 - RNA, 17 nt, Escherichia coli CFT073
ucacgccgaagugcgca

SEQ ID NO: 619057 - RNA, 15 nt, Escherichia coli CFT073
ucacgcccgccccag

SEQ ID NO: 619058 - RNA, 20 nt, Escherichia coli CFT073
ucacgcauuugcagcaaaua

SEQ ID NO: 619059 - RNA, 21 nt, Escherichia coli CFT073
ucacgcauuugcagcaaauag

SEQ ID NO: 619060 - RNA, 15 nt, Escherichia coli CFT073
ucacgccaauaaucg

SEQ ID NO: 619061 - RNA, 13 nt, Escherichia coli CFT073
ucacgcccagucc

SEQ ID NO: 619062 - RNA, 13 nt, Escherichia coli CFT073
ucacggcaccagc

SEQ ID NO: 619063 - RNA, 14 nt, Escherichia coli CFT073
ucacggcaccagcc

SEQ ID NO: 619064 - RNA, 15 nt, Escherichia coli CFT073
ucacgccgcaucugg

SEQ ID NO: 619065 - RNA, 13 nt, Escherichia coli CFT073
ucacgcaucugcu

SEQ ID NO: 619066 - RNA, 14 nt, Escherichia coli CFT073
ucacccuuuucgau

SEQ ID NO: 619067 - RNA, 19 nt, Escherichia coli CFT073
ucacccggaucaauuaauc

SEQ ID NO: 619068 - RNA, 22 nt, Escherichia coli CFT073
ucacggcgaaagcgucagcuuu

SEQ ID NO: 619069 - RNA, 14 nt, Escherichia coli CFT073
ucacggcggcagua

SEQ ID NO: 619070 - RNA, 18 nt, Escherichia coli CFT073
ucacgggcaaccacagug

SEQ ID NO: 619071 - RNA, 18 nt, Escherichia coli CFT073
ucacggcuguagccagcu

SEQ ID NO: 619072 - RNA, 16 nt, Escherichia coli CFT073
ucacgucaccgcagca

SEQ ID NO: 619073 - RNA, 19 nt, Escherichia coli CFT073
ucacgucaccgcagcaucg

SEQ ID NO: 619074 - RNA, 16 nt, Escherichia coli CFT073
ucacuauacuccugau

SEQ ID NO: 619075 - RNA, 18 nt, Escherichia coli CFT073
ucacguugcgacaaacca

SEQ ID NO: 619076 - RNA, 16 nt, Escherichia coli CFT073
ucacguuuuccuucaa

SEQ ID NO: 619077 - RNA, 18 nt, Escherichia coli CFT073
ucacuuucgagcaauuuu

SEQ ID NO: 619078 - RNA, 20 nt, Escherichia coli CFT073
ucacuuucccuggcaugauu

SEQ ID NO: 619079 - RNA, 13 nt, Escherichia coli CFT073
ucacuuugcuguc

SEQ ID NO: 619080 - RNA, 12 nt, Escherichia coli CFT073
ucacuuuguagg

SEQ ID NO: 619081 - RNA, 16 nt, Escherichia coli CFT073
ucacuuuguaggccug

SEQ ID NO: 619082 - RNA, 21 nt, Escherichia coli CFT073
ucacuuuguaggccugauaag

SEQ ID NO: 619083 - RNA, 22 nt, Escherichia coli CFT073
ucacuuuguaggccugauaaga

SEQ ID NO: 619084 - RNA, 15 nt, Escherichia coli CFT073
ucacuuuuauauaau

SEQ ID NO: 619085 - RNA, 19 nt, Escherichia coli CFT073
ucacuuuuauauaaugaaa

SEQ ID NO: 619086 - RNA, 22 nt, Escherichia coli CFT073
ucacuuuuauauaaugaaaacu

SEQ ID NO: 619087 - RNA, 11 nt, Escherichia coli CFT073
ucacuuuuccg

SEQ ID NO: 619088 - RNA, 18 nt, Escherichia coli CFT073
ucacuuuucuuaauugca

SEQ ID NO: 619089 - RNA, 12 nt, Escherichia coli CFT073
ucacuuuucuuc

SEQ ID NO: 619090 - RNA, 20 nt, Escherichia coli CFT073
ucagaaacaaauacaugaug

SEQ ID NO: 619091 - RNA, 16 nt, Escherichia coli CFT073
ucagaaagcgccagca

SEQ ID NO: 619092 - RNA, 16 nt, Escherichia coli CFT073
ucagaaagugccacgc

SEQ ID NO: 619093 - RNA, 17 nt, Escherichia coli CFT073
ucagaaauaaucaccug

SEQ ID NO: 619094 - RNA, 13 nt, Escherichia coli CFT073
ucagaaagaaauu

SEQ ID NO: 619095 - RNA, 15 nt, Escherichia coli CFT073
ucagaaagaaauuuc

SEQ ID NO: 619096 - RNA, 22 nt, Escherichia coli CFT073
ucagaaacgcucauaaauugca

SEQ ID NO: 619097 - RNA, 18 nt, Escherichia coli CFT073
ucagaacacuucuucugu

SEQ ID NO: 619098 - RNA, 18 nt, Escherichia coli CFT073
ucacuuuaccuuuaaacu

SEQ ID NO: 619099 - RNA, 21 nt, Escherichia coli CFT073
ucacuucagcgaaaucacgca

SEQ ID NO: 619100 - RNA, 16 nt, Escherichia coli CFT073
ucacuuccggcaaggc

SEQ ID NO: 619101 - RNA, 18 nt, Escherichia coli CFT073
ucacuucgauccagugau

SEQ ID NO: 619102 - RNA, 12 nt, Escherichia coli CFT073
ucacuuccucaa

SEQ ID NO: 619103 - RNA, 14 nt, Escherichia coli CFT073
ucacuuccugaucc

SEQ ID NO: 619104 - RNA, 23 nt, Escherichia coli CFT073
ucacuucugaguucggcaugggg

SEQ ID NO: 619105 - RNA, 13 nt, Escherichia coli CFT073
ucacugcaaauac

SEQ ID NO: 619106 - RNA, 20 nt, Escherichia coli CFT073
ucacugccagcaucagaccc

SEQ ID NO: 619107 - RNA, 21 nt, Escherichia coli CFT073
ucacugcgguguaaaccagcu

SEQ ID NO: 619108 - RNA, 17 nt, Escherichia coli CFT073
ucacuggccucuucucu

SEQ ID NO: 619109 - RNA, 22 nt, Escherichia coli CFT073
ucacugggcgauuaauaaaauu

SEQ ID NO: 619110 - RNA, 14 nt, Escherichia coli CFT073
aaaucguaagcagg

SEQ ID NO: 619111 - RNA, 23 nt, Escherichia coli CFT073
aaaucgugacagcauaccuucac

SEQ ID NO: 619112 - RNA, 18 nt, Escherichia coli CFT073
ucagcaaaauaacaggga

SEQ ID NO: 619113 - RNA, 22 nt, Escherichia coli CFT073
ucagcaaaguaccaucguccag

SEQ ID NO: 619114 - RNA, 13 nt, Escherichia coli CFT073
ucagcaacaucac

SEQ ID NO: 619115 - RNA, 14 nt, Escherichia coli CFT073
ucagcaacgcugac

SEQ ID NO: 619116 - RNA, 20 nt, Escherichia coli CFT073
ucagauuauucaaaaacaga

SEQ ID NO: 619117 - RNA, 18 nt, Escherichia coli CFT073
ucagauucggauccagca

SEQ ID NO: 619118 - RNA, 19 nt, Escherichia coli CFT073
ucagauucggauccagcac

SEQ ID NO: 619119 - RNA, 18 nt, Escherichia coli CFT073
ucagauuggcuucacuga

SEQ ID NO: 619120 - RNA, 20 nt, Escherichia coli CFT073
ucagauuggcuucacugauu

SEQ ID NO: 619121 - RNA, 23 nt, Escherichia coli CFT073
ucagauuguagugauccugcaua

SEQ ID NO: 619122 - RNA, 21 nt, Escherichia coli CFT073
ucagaucgaaaucuuuuuacu

SEQ ID NO: 619123 - RNA, 20 nt, Escherichia coli CFT073
ucagaucguugaccuggaug

SEQ ID NO: 619124 - RNA, 22 nt, Escherichia coli CFT073
ucagaugaacgugucaacgcuu

SEQ ID NO: 619125 - RNA, 17 nt, Escherichia coli CFT073
ucagaugcugugcaauc

SEQ ID NO: 619126 - RNA, 16 nt, Escherichia coli CFT073
ucagauggcggcuggc

SEQ ID NO: 619127 - RNA, 17 nt, Escherichia coli CFT073
ucagauccagugcuuua

SEQ ID NO: 619128 - RNA, 21 nt, Escherichia coli CFT073
ucagauauacguucgcccauc

SEQ ID NO: 619129 - RNA, 13 nt, Escherichia coli CFT073
ucagauaugcgcu

SEQ ID NO: 619130 - RNA, 15 nt, Escherichia coli CFT073
ucagaucacgcauca

SEQ ID NO: 619131 - RNA, 19 nt, Escherichia coli CFT073
ucagaucacgcaucacccg

SEQ ID NO: 619132 - RNA, 20 nt, Escherichia coli CFT073
ucagaucagccacuuccugc

SEQ ID NO: 619133 - RNA, 21 nt, Escherichia coli CFT073
ucagauaccaauuuauuuuau

SEQ ID NO: 619134 - RNA, 13 nt, Escherichia coli CFT073
ucagauaaaugca

SEQ ID NO: 619135 - RNA, 18 nt, Escherichia coli CFT073
ucagaaugagguucagcc

SEQ ID NO: 619136 - RNA, 18 nt, Escherichia coli CFT073
ucagaaugcgcucuuccg

SEQ ID NO: 619137 - RNA, 18 nt, Escherichia coli CFT073
ucagaauccggugccuua

SEQ ID NO: 619138 - RNA, 16 nt, Escherichia coli CFT073
ucagaaucgcgcccca

SEQ ID NO: 619139 - RNA, 17 nt, Escherichia coli CFT073
ucagaccaaaaccacau

SEQ ID NO: 619140 - RNA, 14 nt, Escherichia coli CFT073
ucagacccacccaa

SEQ ID NO: 619141 - RNA, 18 nt, Escherichia coli CFT073
ucagacccacccaacaug

SEQ ID NO: 619142 - RNA, 14 nt, Escherichia coli CFT073
ucagacccagaacc

SEQ ID NO: 619143 - RNA, 18 nt, Escherichia coli CFT073
ucagaccgccaaucagca

SEQ ID NO: 619144 - RNA, 13 nt, Escherichia coli CFT073
ucagaauacuggu

SEQ ID NO: 619145 - RNA, 16 nt, Escherichia coli CFT073
ucagaauaucgccaag

SEQ ID NO: 619146 - RNA, 21 nt, Escherichia coli CFT073
ucagaaucacgccaacaaaua

SEQ ID NO: 619147 - RNA, 11 nt, Escherichia coli CFT073
ucagaaucaga

SEQ ID NO: 619148 - RNA, 22 nt, Escherichia coli CFT073
ucagagccugccaauggcagga

SEQ ID NO: 619149 - RNA, 19 nt, Escherichia coli CFT073
ucagagcggccuucuucuu

SEQ ID NO: 619150 - RNA, 14 nt, Escherichia coli CFT073
ucagagaagcaccg

SEQ ID NO: 619151 - RNA, 14 nt, Escherichia coli CFT073
ucagagagccagcc

SEQ ID NO: 619152 - RNA, 22 nt, Escherichia coli CFT073
ucagagagccagccccacagca

SEQ ID NO: 619153 - RNA, 14 nt, Escherichia coli CFT073
ucagaguacagauu

SEQ ID NO: 619154 - RNA, 13 nt, Escherichia coli CFT073
ucagaguuugcca

SEQ ID NO: 619155 - RNA, 22 nt, Escherichia coli CFT073
ucagaguuugccaccaacagua

SEQ ID NO: 619156 - RNA, 12 nt, Escherichia coli CFT073
ucagagugccca

SEQ ID NO: 619157 - RNA, 13 nt, Escherichia coli CFT073
ucagagugcccac

SEQ ID NO: 619158 - RNA, 22 nt, Escherichia coli CFT073
ucagacguuuguaacccaccau

SEQ ID NO: 619159 - RNA, 14 nt, Escherichia coli CFT073
ucagacgggccaug

SEQ ID NO: 619160 - RNA, 16 nt, Escherichia coli CFT073
ucagacugcuuuuccc

SEQ ID NO: 619161 - RNA, 17 nt, Escherichia coli CFT073
ucagacugcuuuucccu

SEQ ID NO: 619162 - RNA, 21 nt, Escherichia coli CFT073
ucagaccuccguuuuucuguu

SEQ ID NO: 619163 - RNA, 18 nt, Escherichia coli CFT073
ucagacgacugucuuccu

SEQ ID NO: 619164 - RNA, 13 nt, Escherichia coli CFT073
ucagacgccacuu

SEQ ID NO: 619165 - RNA, 15 nt, Escherichia coli CFT073
ucagacgcucugguu

SEQ ID NO: 619166 - RNA, 12 nt, Escherichia coli CFT073
ucagacgcugca

SEQ ID NO: 619167 - RNA, 11 nt, Escherichia coli CFT073
ucagugcugac

SEQ ID NO: 619168 - RNA, 21 nt, Escherichia coli CFT073
ucaguggguuaugaaacucca

SEQ ID NO: 619169 - RNA, 20 nt, Escherichia coli CFT073
ucagugagcugucugucaaa

SEQ ID NO: 619170 - RNA, 15 nt, Escherichia coli CFT073
ucagugaccgaaccu

SEQ ID NO: 619171 - RNA, 20 nt, Escherichia coli CFT073
ucagugauaucgcucugguu

SEQ ID NO: 619172 - RNA, 18 nt, Escherichia coli CFT073
ucagugcaaucagcggcg

SEQ ID NO: 619173 - RNA, 17 nt, Escherichia coli CFT073
ucagucuuaagcggcua

SEQ ID NO: 619174 - RNA, 17 nt, Escherichia coli CFT073
ucagugaaucucaggca

SEQ ID NO: 619175 - RNA, 19 nt, Escherichia coli CFT073
ucaguacggcaaagauauu

SEQ ID NO: 619176 - RNA, 15 nt, Escherichia coli CFT073
ucaguagaauaaucu

SEQ ID NO: 619177 - RNA, 15 nt, Escherichia coli CFT073
ucaguagcaguaauu

SEQ ID NO: 619178 - RNA, 14 nt, Escherichia coli CFT073
ucaggucguucagu

SEQ ID NO: 619179 - RNA, 23 nt, Escherichia coli CFT073
ucaggucggugugaaugaccagg

SEQ ID NO: 619180 - RNA, 20 nt, Escherichia coli CFT073
ucaggucacccaugcgcgcc

SEQ ID NO: 619181 - RNA, 23 nt, Escherichia coli CFT073
ucagguccacgccaucguaaguc

SEQ ID NO: 619182 - RNA, 20 nt, Escherichia coli CFT073
ucagguauucguuaaaacca

SEQ ID NO: 619183 - RNA, 16 nt, Escherichia coli CFT073
ucaggcucucauuuuu

SEQ ID NO: 619184 - RNA, 14 nt, Escherichia coli CFT073
ucaggcguuucuuc

SEQ ID NO: 619185 - RNA, 15 nt, Escherichia coli CFT073
ucaggcggcucaccu

SEQ ID NO: 619186 - RNA, 16 nt, Escherichia coli CFT073
ucaggcggcucaccug

SEQ ID NO: 619187 - RNA, 21 nt, Escherichia coli CFT073
ucaggcgcgugaaugccugag

SEQ ID NO: 619188 - RNA, 15 nt, Escherichia coli CFT073
ucaggaauggaaaua

SEQ ID NO: 619189 - RNA, 18 nt, Escherichia coli CFT073
ucaggcagaagagaagaa

SEQ ID NO: 619190 - RNA, 18 nt, Escherichia coli CFT073
ucaggcagauacaaccaa

SEQ ID NO: 619191 - RNA, 12 nt, Escherichia coli CFT073
ucaggcagucug

SEQ ID NO: 619192 - RNA, 17 nt, Escherichia coli CFT073
ucaggcaguuuugcguu

SEQ ID NO: 619193 - RNA, 17 nt, Escherichia coli CFT073
ucaggcauugugucuga

SEQ ID NO: 619194 - RNA, 20 nt, Escherichia coli CFT073
ucaggccaaacuacgcugcg

SEQ ID NO: 619195 - RNA, 12 nt, Escherichia coli CFT073
aaaucuccagau

SEQ ID NO: 619196 - RNA, 22 nt, Escherichia coli CFT073
aaaucucacccgguacaucaau

SEQ ID NO: 619197 - RNA, 21 nt, Escherichia coli CFT073
ucaggccuacgugauuccugc

SEQ ID NO: 619198 - RNA, 19 nt, Escherichia coli CFT073
ucaggcgagugguaugacu

SEQ ID NO: 619199 - RNA, 18 nt, Escherichia coli CFT073
ucaggccuacaugccauc

SEQ ID NO: 619200 - RNA, 15 nt, Escherichia coli CFT073
ucaggccgauuucau

SEQ ID NO: 619201 - RNA, 12 nt, Escherichia coli CFT073
ucagcaugacaa

SEQ ID NO: 619202 - RNA, 16 nt, Escherichia coli CFT073
ucagcaucccaggcau

SEQ ID NO: 619203 - RNA, 18 nt, Escherichia coli CFT073
ucagcauaaucaccagua

SEQ ID NO: 619204 - RNA, 18 nt, Escherichia coli CFT073
ucagcauaugcuucuucc

SEQ ID NO: 619205 - RNA, 14 nt, Escherichia coli CFT073
ucagcaucagggag

SEQ ID NO: 619206 - RNA, 15 nt, Escherichia coli CFT073
ucagcaugacaaaaa

SEQ ID NO: 619207 - RNA, 16 nt, Escherichia coli CFT073
ucagcaugacaaaaaa

SEQ ID NO: 619208 - RNA, 22 nt, Escherichia coli CFT073
ucagcaugucuugccucccugc

SEQ ID NO: 619209 - RNA, 23 nt, Escherichia coli CFT073
ucagcaugucuugccucccugca

SEQ ID NO: 619210 - RNA, 16 nt, Escherichia coli CFT073
ucagcagcguucccag

SEQ ID NO: 619211 - RNA, 18 nt, Escherichia coli CFT073
ucagcagcguucccagcc

SEQ ID NO: 619212 - RNA, 18 nt, Escherichia coli CFT073
ucagcagcagaauuggca

SEQ ID NO: 619213 - RNA, 20 nt, Escherichia coli CFT073
ucagcagugaaguaauaauc

SEQ ID NO: 619214 - RNA, 15 nt, Escherichia coli CFT073
ucagcagauggcaga

SEQ ID NO: 619215 - RNA, 16 nt, Escherichia coli CFT073
ucagcagcaauauguu

SEQ ID NO: 619216 - RNA, 14 nt, Escherichia coli CFT073
ucagcagcaccacc

SEQ ID NO: 619217 - RNA, 14 nt, Escherichia coli CFT073
ucagcacuacugcc

SEQ ID NO: 619218 - RNA, 18 nt, Escherichia coli CFT073
ucagcacucacgccaggc

SEQ ID NO: 619219 - RNA, 21 nt, Escherichia coli CFT073
ucagcaaggaagcugauuuua

SEQ ID NO: 619220 - RNA, 12 nt, Escherichia coli CFT073
ucagcaaggcuu

SEQ ID NO: 619221 - RNA, 16 nt, Escherichia coli CFT073
ucagcaauaaaaaaau

SEQ ID NO: 619222 - RNA, 16 nt, Escherichia coli CFT073
ucagcaaucucuucaa

SEQ ID NO: 619223 - RNA, 18 nt, Escherichia coli CFT073
ucagcaagaguuuuaaaa

SEQ ID NO: 619224 - RNA, 17 nt, Escherichia coli CFT073
ucagcaccagacgcaac

SEQ ID NO: 619225 - RNA, 12 nt, Escherichia coli CFT073
ucagcaccagau

SEQ ID NO: 619226 - RNA, 14 nt, Escherichia coli CFT073
ucagcaaugccaga

SEQ ID NO: 619227 - RNA, 22 nt, Escherichia coli CFT073
ucagcaaugguucgugcaacuu

SEQ ID NO: 619228 - RNA, 19 nt, Escherichia coli CFT073
ucagcaauuuuaauaucca

SEQ ID NO: 619229 - RNA, 23 nt, Escherichia coli CFT073
ucagccccagacguuucgccagc

SEQ ID NO: 619230 - RNA, 20 nt, Escherichia coli CFT073
ucagcauuucgcgauauugc

SEQ ID NO: 619231 - RNA, 20 nt, Escherichia coli CFT073
ucagcccuucccggugcgca

SEQ ID NO: 619232 - RNA, 22 nt, Escherichia coli CFT073
ucagcccuucccggugcgcaga

SEQ ID NO: 619233 - RNA, 21 nt, Escherichia coli CFT073
ucagcgcaucguagauuucau

SEQ ID NO: 619234 - RNA, 16 nt, Escherichia coli CFT073
ucagcgcaaucugcuu

SEQ ID NO: 619235 - RNA, 16 nt, Escherichia coli CFT073
ucagcgcaccacacau

SEQ ID NO: 619236 - RNA, 23 nt, Escherichia coli CFT073
ucagcgcacuuucacccugacug

SEQ ID NO: 619237 - RNA, 16 nt, Escherichia coli CFT073
ucagcgcagcacccag

SEQ ID NO: 619238 - RNA, 16 nt, Escherichia coli CFT073
ucagccgagcuucaau

SEQ ID NO: 619239 - RNA, 17 nt, Escherichia coli CFT073
ucagcgcuaccagagcc

SEQ ID NO: 619240 - RNA, 19 nt, Escherichia coli CFT073
ucagcgcuaccagagccgc

SEQ ID NO: 619241 - RNA, 14 nt, Escherichia coli CFT073
ucagcgccaccaca

SEQ ID NO: 619242 - RNA, 13 nt, Escherichia coli CFT073
ucagcgccaaccc

SEQ ID NO: 619243 - RNA, 15 nt, Escherichia coli CFT073
ucagcgccagcgcga

SEQ ID NO: 619244 - RNA, 23 nt, Escherichia coli CFT073
ucagcuccacaagaaugccugcc

SEQ ID NO: 619245 - RNA, 16 nt, Escherichia coli CFT073
ucagcgguggugaaaa

SEQ ID NO: 619246 - RNA, 21 nt, Escherichia coli CFT073
ucagcguaaaaaaacaaaaac

SEQ ID NO: 619247 - RNA, 15 nt, Escherichia coli CFT073
ucagcguauccagca

SEQ ID NO: 619248 - RNA, 15 nt, Escherichia coli CFT073
ucagcguaucccagu

SEQ ID NO: 619249 - RNA, 20 nt, Escherichia coli CFT073
ucagcgucgcaucuggcaua

SEQ ID NO: 619250 - RNA, 22 nt, Escherichia coli CFT073
ucagcgucgccaauggaauagc

SEQ ID NO: 619251 - RNA, 16 nt, Escherichia coli CFT073
ucagcgucgcguuuuu

SEQ ID NO: 619252 - RNA, 18 nt, Escherichia coli CFT073
ucagcgucgcguuuuucu

SEQ ID NO: 619253 - RNA, 17 nt, Escherichia coli CFT073
ucagcgggcagggcauc

SEQ ID NO: 619254 - RNA, 15 nt, Escherichia coli CFT073
ucagcgggcagggca

SEQ ID NO: 619255 - RNA, 19 nt, Escherichia coli CFT073
ucagcggugccgcgauacc

SEQ ID NO: 619256 - RNA, 15 nt, Escherichia coli CFT073
uaugucagugguggc

SEQ ID NO: 619257 - RNA, 14 nt, Escherichia coli CFT073
uaugucauaaaaau

SEQ ID NO: 619258 - RNA, 15 nt, Escherichia coli CFT073
uaugucauugaaugu

SEQ ID NO: 619259 - RNA, 23 nt, Escherichia coli CFT073
uaugucccucuuacaccugcucc

SEQ ID NO: 619260 - RNA, 18 nt, Escherichia coli CFT073
uaugucuggcgagcucca

SEQ ID NO: 619261 - RNA, 13 nt, Escherichia coli CFT073
uauggugaagaag

SEQ ID NO: 619262 - RNA, 21 nt, Escherichia coli CFT073
uaugguuucccugauaauguc

SEQ ID NO: 619263 - RNA, 14 nt, Escherichia coli CFT073
uauguuuuuaaacc

SEQ ID NO: 619264 - RNA, 20 nt, Escherichia coli CFT073
uauguuuacgcguuuuucag

SEQ ID NO: 619265 - RNA, 18 nt, Escherichia coli CFT073
uaugugcuucuagcauga

SEQ ID NO: 619266 - RNA, 18 nt, Escherichia coli CFT073
uaugugguauugcagcuc

SEQ ID NO: 619267 - RNA, 14 nt, Escherichia coli CFT073
uauguguaagaaag

SEQ ID NO: 619268 - RNA, 15 nt, Escherichia coli CFT073
uauguguaagaaagg

SEQ ID NO: 619269 - RNA, 13 nt, Escherichia coli CFT073
uauguugaaaagc

SEQ ID NO: 619270 - RNA, 22 nt, Escherichia coli CFT073
uauguucagaaagcgccagcaa

SEQ ID NO: 619271 - RNA, 14 nt, Escherichia coli CFT073
uauuaauauauauu

SEQ ID NO: 619272 - RNA, 17 nt, Escherichia coli CFT073
uauuaaaccaggaacag

SEQ ID NO: 619273 - RNA, 12 nt, Escherichia coli CFT073
uauuaaauauua

SEQ ID NO: 619274 - RNA, 13 nt, Escherichia coli CFT073
uauuaaauauuau

SEQ ID NO: 619275 - RNA, 13 nt, Escherichia coli CFT073
uauuaaauggccc

SEQ ID NO: 619276 - RNA, 21 nt, Escherichia coli CFT073
uauuaacccgcaacagcaaua

SEQ ID NO: 619277 - RNA, 14 nt, Escherichia coli CFT073
uauuaacaagaugu

SEQ ID NO: 619278 - RNA, 20 nt, Escherichia coli CFT073
uauuaacgagucauuguaaa

SEQ ID NO: 619279 - RNA, 12 nt, Escherichia coli CFT073
uauuaacugugg

SEQ ID NO: 619280 - RNA, 15 nt, Escherichia coli CFT073
uauuacccuauuuaa

SEQ ID NO: 619281 - RNA, 17 nt, Escherichia coli CFT073
uauuggccgaacaggau

SEQ ID NO: 619282 - RNA, 16 nt, Escherichia coli CFT073
uauuggaugacaaacc

SEQ ID NO: 619283 - RNA, 17 nt, Escherichia coli CFT073
uauuguuuuuauuguca

SEQ ID NO: 619284 - RNA, 20 nt, Escherichia coli CFT073
uauuguucgugcaauucggc

SEQ ID NO: 619285 - RNA, 16 nt, Escherichia coli CFT073
uauuguugaauuccga

SEQ ID NO: 619286 - RNA, 11 nt, Escherichia coli CFT073
uauugcauuaa

SEQ ID NO: 619287 - RNA, 16 nt, Escherichia coli CFT073
aaauccuggugaaagu

SEQ ID NO: 619288 - RNA, 19 nt, Escherichia coli CFT073
uauugauuguuuuaaauau

SEQ ID NO: 619289 - RNA, 12 nt, Escherichia coli CFT073
uauugaagccca

SEQ ID NO: 619290 - RNA, 14 nt, Escherichia coli CFT073
aaauccggggcaau

SEQ ID NO: 619291 - RNA, 12 nt, Escherichia coli CFT073
uauucaaaaaca

SEQ ID NO: 619292 - RNA, 13 nt, Escherichia coli CFT073
uauucaaaaacag

SEQ ID NO: 619293 - RNA, 16 nt, Escherichia coli CFT073
uauucaaaaacagauu

SEQ ID NO: 619294 - RNA, 19 nt, Escherichia coli CFT073
uauuccgagcagcuccgga

SEQ ID NO: 619295 - RNA, 11 nt, Escherichia coli CFT073
uauuccccaga

SEQ ID NO: 619296 - RNA, 17 nt, Escherichia coli CFT073
uauuccauccugcucaa

SEQ ID NO: 619297 - RNA, 15 nt, Escherichia coli CFT073
uauucggcuccagau

SEQ ID NO: 619298 - RNA, 15 nt, Escherichia coli CFT073
uauucuuauuauauu

SEQ ID NO: 619299 - RNA, 17 nt, Escherichia coli CFT073
uauucuuacuucaacac

SEQ ID NO: 619300 - RNA, 23 nt, Escherichia coli CFT073
uauucuugcugauacuauucauu

SEQ ID NO: 619301 - RNA, 21 nt, Escherichia coli CFT073
uauucuuuaagaauagccugg

SEQ ID NO: 619302 - RNA, 12 nt, Escherichia coli CFT073
uauucuuugauc

SEQ ID NO: 619303 - RNA, 16 nt, Escherichia coli CFT073
uaugcggugccauuaa

SEQ ID NO: 619304 - RNA, 22 nt, Escherichia coli CFT073
uaugcgcaucaaggccaggcag

SEQ ID NO: 619305 - RNA, 13 nt, Escherichia coli CFT073
uaugcgccagacu

SEQ ID NO: 619306 - RNA, 21 nt, Escherichia coli CFT073
uaugcgcugucauucauucag

SEQ ID NO: 619307 - RNA, 17 nt, Escherichia coli CFT073
uaugcgcgucagagauu

SEQ ID NO: 619308 - RNA, 17 nt, Escherichia coli CFT073
uaugcuguaaacaacau

SEQ ID NO: 619309 - RNA, 14 nt, Escherichia coli CFT073
uaugcccagcgcag

SEQ ID NO: 619310 - RNA, 13 nt, Escherichia coli CFT073
uaugcccagggca

SEQ ID NO: 619311 - RNA, 13 nt, Escherichia coli CFT073
uaugcccuggauc

SEQ ID NO: 619312 - RNA, 17 nt, Escherichia coli CFT073
uaugccuguccucuuca

SEQ ID NO: 619313 - RNA, 19 nt, Escherichia coli CFT073
uaugccggguuauccaacc

SEQ ID NO: 619314 - RNA, 21 nt, Escherichia coli CFT073
uauggcaaucuuccucgccag

SEQ ID NO: 619315 - RNA, 20 nt, Escherichia coli CFT073
uauggcccagccuuuccagc

SEQ ID NO: 619316 - RNA, 21 nt, Escherichia coli CFT073
uauggcccagccuuuccagca

SEQ ID NO: 619317 - RNA, 14 nt, Escherichia coli CFT073
uaugcuugcucagu

SEQ ID NO: 619318 - RNA, 20 nt, Escherichia coli CFT073
uaugggauauuuuuuuccua

SEQ ID NO: 619319 - RNA, 18 nt, Escherichia coli CFT073
uaugggcagcucuaucug

SEQ ID NO: 619320 - RNA, 15 nt, Escherichia coli CFT073
uaugggcauuucuuu

SEQ ID NO: 619321 - RNA, 16 nt, Escherichia coli CFT073
uauggcuugaagcaau

SEQ ID NO: 619322 - RNA, 15 nt, Escherichia coli CFT073
uauggcuuuuuucuu

SEQ ID NO: 619323 - RNA, 17 nt, Escherichia coli CFT073
uaugacauaaccgagaa

SEQ ID NO: 619324 - RNA, 17 nt, Escherichia coli CFT073
uaugacgaaagcgcagu

SEQ ID NO: 619325 - RNA, 20 nt, Escherichia coli CFT073
uaugacucauaaaaauauau

SEQ ID NO: 619326 - RNA, 13 nt, Escherichia coli CFT073
uaugagagaggac

SEQ ID NO: 619327 - RNA, 19 nt, Escherichia coli CFT073
uaugauccagcuugucaga

SEQ ID NO: 619328 - RNA, 13 nt, Escherichia coli CFT073
uaugauguauauu

SEQ ID NO: 619329 - RNA, 14 nt, Escherichia coli CFT073
uaugauguauauuu

SEQ ID NO: 619330 - RNA, 21 nt, Escherichia coli CFT073
uaugcaauuguuuacuaaaag

SEQ ID NO: 619331 - RNA, 17 nt, Escherichia coli CFT073
uaugcaaggcuuuggau

SEQ ID NO: 619332 - RNA, 13 nt, Escherichia coli CFT073
uaugauuuuccug

SEQ ID NO: 619333 - RNA, 23 nt, Escherichia coli CFT073
uaucugaugcgcuucgcuuacca

SEQ ID NO: 619334 - RNA, 20 nt, Escherichia coli CFT073
uaucugauuuaaaaaugcca

SEQ ID NO: 619335 - RNA, 14 nt, Escherichia coli CFT073
uaucugaaaguugu

SEQ ID NO: 619336 - RNA, 12 nt, Escherichia coli CFT073
uaucuggaggug

SEQ ID NO: 619337 - RNA, 17 nt, Escherichia coli CFT073
uaucuaaaaugucaccu

SEQ ID NO: 619338 - RNA, 18 nt, Escherichia coli CFT073
uaucguuagcauggguau

SEQ ID NO: 619339 - RNA, 20 nt, Escherichia coli CFT073
uaucuaaccggauaucuaau

SEQ ID NO: 619340 - RNA, 14 nt, Escherichia coli CFT073
uaucuaauaaacau

SEQ ID NO: 619341 - RNA, 14 nt, Escherichia coli CFT073
uaucuaaugccauu

SEQ ID NO: 619342 - RNA, 14 nt, Escherichia coli CFT073
uaucuaauuauuac

SEQ ID NO: 619343 - RNA, 16 nt, Escherichia coli CFT073
uaucuaccacugccug

SEQ ID NO: 619344 - RNA, 12 nt, Escherichia coli CFT073
uaucuaucacua

SEQ ID NO: 619345 - RNA, 18 nt, Escherichia coli CFT073
uaucuaucacuauaaaua

SEQ ID NO: 619346 - RNA, 23 nt, Escherichia coli CFT073
uaucugugcuuguaaaacagcca

SEQ ID NO: 619347 - RNA, 21 nt, Escherichia coli CFT073
uaucugucagacuaucuuugg

SEQ ID NO: 619348 - RNA, 15 nt, Escherichia coli CFT073
uaucuguacaguuaa

SEQ ID NO: 619349 - RNA, 20 nt, Escherichia coli CFT073
uaucuguacaguuaagcccu

SEQ ID NO: 619350 - RNA, 17 nt, Escherichia coli CFT073
uaucuguacuuaaaacu

SEQ ID NO: 619351 - RNA, 12 nt, Escherichia coli CFT073
uaucuuauugaa

SEQ ID NO: 619352 - RNA, 22 nt, Escherichia coli CFT073
uaucuucugaaggugccuuuau

SEQ ID NO: 619353 - RNA, 13 nt, Escherichia coli CFT073
uaucuucccagcc

SEQ ID NO: 619354 - RNA, 18 nt, Escherichia coli CFT073
uaucuucacgauuauuaa

SEQ ID NO: 619355 - RNA, 21 nt, Escherichia coli CFT073
uaucuuuuucguaagucagau

SEQ ID NO: 619356 - RNA, 12 nt, Escherichia coli CFT073
uaucuuuccagc

SEQ ID NO: 619357 - RNA, 15 nt, Escherichia coli CFT073
uaugaacuugcucau

SEQ ID NO: 619358 - RNA, 16 nt, Escherichia coli CFT073
uaucgauuuucaaaau

SEQ ID NO: 619359 - RNA, 16 nt, Escherichia coli CFT073
uaucgaacguuuucac

SEQ ID NO: 619360 - RNA, 17 nt, Escherichia coli CFT073
uaucgauaaauggcgca

SEQ ID NO: 619361 - RNA, 12 nt, Escherichia coli CFT073
uaucgaacaugc

SEQ ID NO: 619362 - RNA, 18 nt, Escherichia coli CFT073
uauccuucugcguuuuug

SEQ ID NO: 619363 - RNA, 16 nt, Escherichia coli CFT073
uauccugaacagaaau

SEQ ID NO: 619364 - RNA, 23 nt, Escherichia coli CFT073
uauccugaguaucgaaaacauca

SEQ ID NO: 619365 - RNA, 20 nt, Escherichia coli CFT073
uauccugcccgcuccagcua

SEQ ID NO: 619366 - RNA, 16 nt, Escherichia coli CFT073
uauccugggagaugau

SEQ ID NO: 619367 - RNA, 12 nt, Escherichia coli CFT073
uauccuggucaa

SEQ ID NO: 619368 - RNA, 14 nt, Escherichia coli CFT073
uaucggccauaugu

SEQ ID NO: 619369 - RNA, 13 nt, Escherichia coli CFT073
uaucggcaaaaau

SEQ ID NO: 619370 - RNA, 17 nt, Escherichia coli CFT073
uaucggaggcuuguuca

SEQ ID NO: 619371 - RNA, 16 nt, Escherichia coli CFT073
uaucggcgcagagccc

SEQ ID NO: 619372 - RNA, 16 nt, Escherichia coli CFT073
uaucgguguuuuccac

SEQ ID NO: 619373 - RNA, 23 nt, Escherichia coli CFT073
uaucguagccccagucuuccugc

SEQ ID NO: 619374 - RNA, 23 nt, Escherichia coli CFT073
uaucgucuggcgcgugaugugga

SEQ ID NO: 619375 - RNA, 19 nt, Escherichia coli CFT073
uaucgcgaaaaaaaagaug

SEQ ID NO: 619376 - RNA, 15 nt, Escherichia coli CFT073
uaucgcauuaucaaa

SEQ ID NO: 619377 - RNA, 11 nt, Escherichia coli CFT073
uaucgcccacg

SEQ ID NO: 619378 - RNA, 23 nt, Escherichia coli CFT073
uaucgcggggauauggugguaag

SEQ ID NO: 619379 - RNA, 18 nt, Escherichia coli CFT073
uaucgcgccaucaaaucu

SEQ ID NO: 619380 - RNA, 22 nt, Escherichia coli CFT073
uaucgcgucaacagggcagaca

SEQ ID NO: 619381 - RNA, 23 nt, Escherichia coli CFT073
uaucgcugauauacccuucauca

SEQ ID NO: 619382 - RNA, 14 nt, Escherichia coli CFT073
uauccgggcaaaaa

SEQ ID NO: 619383 - RNA, 18 nt, Escherichia coli CFT073
uauccgggcauccaggcc

SEQ ID NO: 619384 - RNA, 13 nt, Escherichia coli CFT073
uauccgguucacu

SEQ ID NO: 619385 - RNA, 21 nt, Escherichia coli CFT073
uauccggccuacauuggucug

SEQ ID NO: 619386 - RNA, 14 nt, Escherichia coli CFT073
uaucccugcugucc

SEQ ID NO: 619387 - RNA, 16 nt, Escherichia coli CFT073
uaucccugcuguccug

SEQ ID NO: 619388 - RNA, 19 nt, Escherichia coli CFT073
uauccggcaugaacaaaac

SEQ ID NO: 619389 - RNA, 18 nt, Escherichia coli CFT073
uauccgucgcguuucucc

SEQ ID NO: 619390 - RNA, 10 nt, Escherichia coli CFT073
uaucccauuu

SEQ ID NO: 619391 - RNA, 16 nt, Escherichia coli CFT073
uaucccauuucuccac

SEQ ID NO: 619392 - RNA, 20 nt, Escherichia coli CFT073
uaucccauuucuccacuggg

SEQ ID NO: 619393 - RNA, 20 nt, Escherichia coli CFT073
uaucccccgauaaaacauua

SEQ ID NO: 619394 - RNA, 19 nt, Escherichia coli CFT073
uaucccgccagcaccagca

SEQ ID NO: 619395 - RNA, 13 nt, Escherichia coli CFT073
uaucccaaaucgc

SEQ ID NO: 619396 - RNA, 20 nt, Escherichia coli CFT073
uaucccaacgcaaaaccaag

SEQ ID NO: 619397 - RNA, 23 nt, Escherichia coli CFT073
uaucccaacgcaaaaccaagcug

SEQ ID NO: 619398 - RNA, 21 nt, Escherichia coli CFT073
uauccaggcuaauccaguccu

SEQ ID NO: 619399 - RNA, 16 nt, Escherichia coli CFT073
uauccagguuacgcau

SEQ ID NO: 619400 - RNA, 13 nt, Escherichia coli CFT073
uauccccagccua

SEQ ID NO: 619401 - RNA, 21 nt, Escherichia coli CFT073
uaucccaccagcgccgcccac

SEQ ID NO: 619402 - RNA, 21 nt, Escherichia coli CFT073
uaucccaggcaaaauccuucc

SEQ ID NO: 619403 - RNA, 22 nt, Escherichia coli CFT073
uaucagcgccaccacaaaagcg

SEQ ID NO: 619404 - RNA, 23 nt, Escherichia coli CFT073
uaucagcccaaaaauugccccca

SEQ ID NO: 619405 - RNA, 17 nt, Escherichia coli CFT073
uauccagcaaagcguca

SEQ ID NO: 619406 - RNA, 13 nt, Escherichia coli CFT073
uauccagcaccac

SEQ ID NO: 619407 - RNA, 16 nt, Escherichia coli CFT073
uauccagcagccagag

SEQ ID NO: 619408 - RNA, 21 nt, Escherichia coli CFT073
uauccagcaucggguaaggga

SEQ ID NO: 619409 - RNA, 12 nt, Escherichia coli CFT073
uauccagccagg

SEQ ID NO: 619410 - RNA, 22 nt, Escherichia coli CFT073
uauccagcgcaguuuuuccuuu

SEQ ID NO: 619411 - RNA, 12 nt, Escherichia coli CFT073
uauccagcgcau

SEQ ID NO: 619412 - RNA, 22 nt, Escherichia coli CFT073
uauccagcgcggcgaaggugcc

SEQ ID NO: 619413 - RNA, 23 nt, Escherichia coli CFT073
uauccagcguuauaaaacacauu

SEQ ID NO: 619414 - RNA, 20 nt, Escherichia coli CFT073
uauccagaccgcgcuugccg

SEQ ID NO: 619415 - RNA, 13 nt, Escherichia coli CFT073
uauauuucaucaa

SEQ ID NO: 619416 - RNA, 13 nt, Escherichia coli CFT073
uauauuauuauuc

SEQ ID NO: 619417 - RNA, 21 nt, Escherichia coli CFT073
uauaugccaucgccagcagcc

SEQ ID NO: 619418 - RNA, 19 nt, Escherichia coli CFT073
uauaugagaagacugugau

SEQ ID NO: 619419 - RNA, 13 nt, Escherichia coli CFT073
uaucaagcaccaa

SEQ ID NO: 619420 - RNA, 18 nt, Escherichia coli CFT073
uaucagauuggcuucacu

SEQ ID NO: 619421 - RNA, 21 nt, Escherichia coli CFT073
uaucagcaaauuuggcaucga

SEQ ID NO: 619422 - RNA, 20 nt, Escherichia coli CFT073
uaucagcauggccgcaagag

SEQ ID NO: 619423 - RNA, 15 nt, Escherichia coli CFT073
uaucagcagcacaaa

SEQ ID NO: 619424 - RNA, 17 nt, Escherichia coli CFT073
uaucaauuuugauuucc

SEQ ID NO: 619425 - RNA, 13 nt, Escherichia coli CFT073
uaucaccaaacca

SEQ ID NO: 619426 - RNA, 14 nt, Escherichia coli CFT073
uaucaccaaucaca

SEQ ID NO: 619427 - RNA, 15 nt, Escherichia coli CFT073
uaucaccaaugauaa

SEQ ID NO: 619428 - RNA, 19 nt, Escherichia coli CFT073
uaucaccgacaaacagcga

SEQ ID NO: 619429 - RNA, 20 nt, Escherichia coli CFT073
uauaguaagaagcaagguag

SEQ ID NO: 619430 - RNA, 16 nt, Escherichia coli CFT073
uauacagacucaaacc

SEQ ID NO: 619431 - RNA, 16 nt, Escherichia coli CFT073
uauacaaccaauaacu

SEQ ID NO: 619432 - RNA, 19 nt, Escherichia coli CFT073
uauacaaccaauaacucaa

SEQ ID NO: 619433 - RNA, 17 nt, Escherichia coli CFT073
uauacaaccagauaacc

SEQ ID NO: 619434 - RNA, 19 nt, Escherichia coli CFT073
uauaauuuuuuuaaucuau

SEQ ID NO: 619435 - RNA, 15 nt, Escherichia coli CFT073
uauauaaaacacuga

SEQ ID NO: 619436 - RNA, 20 nt, Escherichia coli CFT073
uauaucgcugauaucaaaau

SEQ ID NO: 619437 - RNA, 21 nt, Escherichia coli CFT073
uauaucccucacgcuucugaa

SEQ ID NO: 619438 - RNA, 19 nt, Escherichia coli CFT073
uauaucucagauaaaugca

SEQ ID NO: 619439 - RNA, 22 nt, Escherichia coli CFT073
uauaucucagauaaaugcaaac

SEQ ID NO: 619440 - RNA, 12 nt, Escherichia coli CFT073
uauaucuucuuu

SEQ ID NO: 619441 - RNA, 12 nt, Escherichia coli CFT073
uaguugauuuua

SEQ ID NO: 619442 - RNA, 22 nt, Escherichia coli CFT073
uaguugcgcugguggcaggcaa

SEQ ID NO: 619443 - RNA, 21 nt, Escherichia coli CFT073
uauaaacauaucacuuuuaua

SEQ ID NO: 619444 - RNA, 18 nt, Escherichia coli CFT073
uauaaauauacauacugu

SEQ ID NO: 619445 - RNA, 19 nt, Escherichia coli CFT073
uauaaaucgagaagacaau

SEQ ID NO: 619446 - RNA, 23 nt, Escherichia coli CFT073
uauaacauggugaaagcauggca

SEQ ID NO: 619447 - RNA, 20 nt, Escherichia coli CFT073
uauaagauagucgaaucagu

SEQ ID NO: 619448 - RNA, 19 nt, Escherichia coli CFT073
uauaaccagacgauuuucc

SEQ ID NO: 619449 - RNA, 21 nt, Escherichia coli CFT073
uauaaccagacgauuuucccu

SEQ ID NO: 619450 - RNA, 12 nt, Escherichia coli CFT073
uauaacccagua

SEQ ID NO: 619451 - RNA, 18 nt, Escherichia coli CFT073
uauaaccggcaacagaac

SEQ ID NO: 619452 - RNA, 22 nt, Escherichia coli CFT073
uauaaguggagcccucaagcca

SEQ ID NO: 619453 - RNA, 13 nt, Escherichia coli CFT073
uauaauaagaaua

SEQ ID NO: 619454 - RNA, 12 nt, Escherichia coli CFT073
uauaauacgcuu

SEQ ID NO: 619455 - RNA, 23 nt, Escherichia coli CFT073
uagguggcaaagaaaucaacaaa

SEQ ID NO: 619456 - RNA, 17 nt, Escherichia coli CFT073
uagguguaaauaucagg

SEQ ID NO: 619457 - RNA, 16 nt, Escherichia coli CFT073
uaggugguauagaaug

SEQ ID NO: 619458 - RNA, 18 nt, Escherichia coli CFT073
uagucagguauuuuguca

SEQ ID NO: 619459 - RNA, 23 nt, Escherichia coli CFT073
uagucagguggggcuuuucucug

SEQ ID NO: 619460 - RNA, 13 nt, Escherichia coli CFT073
uagucacaaaucu

SEQ ID NO: 619461 - RNA, 22 nt, Escherichia coli CFT073
uaguaaugcguaacguuucuuu

SEQ ID NO: 619462 - RNA, 18 nt, Escherichia coli CFT073
uaguacgccaaucugcaa

SEQ ID NO: 619463 - RNA, 22 nt, Escherichia coli CFT073
uaguacgggcaauuucacgcuc

SEQ ID NO: 619464 - RNA, 20 nt, Escherichia coli CFT073
uaguacaggcggcaauggcg

SEQ ID NO: 619465 - RNA, 17 nt, Escherichia coli CFT073
uaguacauuguuuucca

SEQ ID NO: 619466 - RNA, 18 nt, Escherichia coli CFT073
uagugcuuucagcgaaaa

SEQ ID NO: 619467 - RNA, 15 nt, Escherichia coli CFT073
uaguuacgaaaagga

SEQ ID NO: 619468 - RNA, 22 nt, Escherichia coli CFT073
uaguuacgaaaaggauaaauaa

SEQ ID NO: 619469 - RNA, 23 nt, Escherichia coli CFT073
uaguuacgaaaaggauaaauaaa

SEQ ID NO: 619470 - RNA, 16 nt, Escherichia coli CFT073
uaguguaaaugcaaau

SEQ ID NO: 619471 - RNA, 14 nt, Escherichia coli CFT073
uagucugaauugaa

SEQ ID NO: 619472 - RNA, 14 nt, Escherichia coli CFT073
uagugaauugccca

SEQ ID NO: 619473 - RNA, 19 nt, Escherichia coli CFT073
uagucuccaaccaucacca

SEQ ID NO: 619474 - RNA, 15 nt, Escherichia coli CFT073
uagucggacaaacac

SEQ ID NO: 619475 - RNA, 23 nt, Escherichia coli CFT073
uagucgcccaucuucguaccaaa

SEQ ID NO: 619476 - RNA, 15 nt, Escherichia coli CFT073
uccgggauauaaacc

SEQ ID NO: 619477 - RNA, 21 nt, Escherichia coli CFT073
uccgggaugcggauaauaugu

SEQ ID NO: 619478 - RNA, 16 nt, Escherichia coli CFT073
uccggcuguuccagca

SEQ ID NO: 619479 - RNA, 14 nt, Escherichia coli CFT073
uccgggccaccaug

SEQ ID NO: 619480 - RNA, 17 nt, Escherichia coli CFT073
uccgggagcaauuugua

SEQ ID NO: 619481 - RNA, 19 nt, Escherichia coli CFT073
uccgggccgaacaucagau

SEQ ID NO: 619482 - RNA, 14 nt, Escherichia coli CFT073
uccgggggcgauuu

SEQ ID NO: 619483 - RNA, 15 nt, Escherichia coli CFT073
uccgggcuaucaugc

SEQ ID NO: 619484 - RNA, 22 nt, Escherichia coli CFT073
uccgggcuguuuuccagcacca

SEQ ID NO: 619485 - RNA, 17 nt, Escherichia coli CFT073
uccgggcuaacacccgu

SEQ ID NO: 619486 - RNA, 14 nt, Escherichia coli CFT073
uccggguuuucaac

SEQ ID NO: 619487 - RNA, 15 nt, Escherichia coli CFT073
uccggguagcgcggc

SEQ ID NO: 619488 - RNA, 19 nt, Escherichia coli CFT073
uccggucgggaagaucacc

SEQ ID NO: 619489 - RNA, 15 nt, Escherichia coli CFT073
uccgguacuuuccuu

SEQ ID NO: 619490 - RNA, 21 nt, Escherichia coli CFT073
uccggcuauauugcaggagcg

SEQ ID NO: 619491 - RNA, 22 nt, Escherichia coli CFT073
uccggcuguuuuuugcagugcu

SEQ ID NO: 619492 - RNA, 20 nt, Escherichia coli CFT073
uccggcuuaaugcacggcag

SEQ ID NO: 619493 - RNA, 14 nt, Escherichia coli CFT073
uccggcgcguugau

SEQ ID NO: 619494 - RNA, 16 nt, Escherichia coli CFT073
uccggcgcucaucagg

SEQ ID NO: 619495 - RNA, 20 nt, Escherichia coli CFT073
uccggccuacauuggucugg

SEQ ID NO: 619496 - RNA, 15 nt, Escherichia coli CFT073
uccggcgacacaucu

SEQ ID NO: 619497 - RNA, 14 nt, Escherichia coli CFT073
uccggcgacaggaa

SEQ ID NO: 619498 - RNA, 15 nt, Escherichia coli CFT073
uccggacguucagcc

SEQ ID NO: 619499 - RNA, 14 nt, Escherichia coli CFT073
uccggauuuuucgc

SEQ ID NO: 619500 - RNA, 23 nt, Escherichia coli CFT073
uccggcaaauuaagaagcggcua

SEQ ID NO: 619501 - RNA, 16 nt, Escherichia coli CFT073
uccggauuauccagcc

SEQ ID NO: 619502 - RNA, 17 nt, Escherichia coli CFT073
uccggauucaaaccuaa

SEQ ID NO: 619503 - RNA, 15 nt, Escherichia coli CFT073
uccggauucaagcau

SEQ ID NO: 619504 - RNA, 12 nt, Escherichia coli CFT073
uccgcucugccc

SEQ ID NO: 619505 - RNA, 15 nt, Escherichia coli CFT073
uccgcucuguaaccc

SEQ ID NO: 619506 - RNA, 19 nt, Escherichia coli CFT073
uccgcucuucaucuuccag

SEQ ID NO: 619507 - RNA, 20 nt, Escherichia coli CFT073
uccgcugguggauguuugca

SEQ ID NO: 619508 - RNA, 15 nt, Escherichia coli CFT073
uccgcuuaccuguuu

SEQ ID NO: 619509 - RNA, 20 nt, Escherichia coli CFT073
uccgcuuaucaggccuacaa

SEQ ID NO: 619510 - RNA, 13 nt, Escherichia coli CFT073
uccgcuucaaucu

SEQ ID NO: 619511 - RNA, 18 nt, Escherichia coli CFT073
uccgcuuucaacgcgcua

SEQ ID NO: 619512 - RNA, 15 nt, Escherichia coli CFT073
uccggaaccaccaga

SEQ ID NO: 619513 - RNA, 13 nt, Escherichia coli CFT073
uccggcagccagg

SEQ ID NO: 619514 - RNA, 15 nt, Escherichia coli CFT073
uccggcagccaggau

SEQ ID NO: 619515 - RNA, 13 nt, Escherichia coli CFT073
uccggcagcgaac

SEQ ID NO: 619516 - RNA, 22 nt, Escherichia coli CFT073
uccggcagcgcauaagccacaa

SEQ ID NO: 619517 - RNA, 19 nt, Escherichia coli CFT073
uccggcacgccguuaccuu

SEQ ID NO: 619518 - RNA, 15 nt, Escherichia coli CFT073
uccggcacuuuuuca

SEQ ID NO: 619519 - RNA, 21 nt, Escherichia coli CFT073
uccggcaaucaacagauaaau

SEQ ID NO: 619520 - RNA, 15 nt, Escherichia coli CFT073
uccggcaauggcugc

SEQ ID NO: 619521 - RNA, 18 nt, Escherichia coli CFT073
uccggcaaugguguccaa

SEQ ID NO: 619522 - RNA, 12 nt, Escherichia coli CFT073
uccggcaauuac

SEQ ID NO: 619523 - RNA, 22 nt, Escherichia coli CFT073
uccggcacaucgccgaagcuug

SEQ ID NO: 619524 - RNA, 15 nt, Escherichia coli CFT073
uccggcacauuucau

SEQ ID NO: 619525 - RNA, 18 nt, Escherichia coli CFT073
uccggcacauuucauuca

SEQ ID NO: 619526 - RNA, 22 nt, Escherichia coli CFT073
uccggcacauuucauucacgcc

SEQ ID NO: 619527 - RNA, 13 nt, Escherichia coli CFT073
uccggcaccagcg

SEQ ID NO: 619528 - RNA, 16 nt, Escherichia coli CFT073
uccggcauaaacacag

SEQ ID NO: 619529 - RNA, 20 nt, Escherichia coli CFT073
uccggcagcuuuaccggcuu

SEQ ID NO: 619530 - RNA, 14 nt, Escherichia coli CFT073
uccggcaguuucau

SEQ ID NO: 619531 - RNA, 15 nt, Escherichia coli CFT073
uccggcaugaacaaa

SEQ ID NO: 619532 - RNA, 19 nt, Escherichia coli CFT073
uccggcauuaucacaucag

SEQ ID NO: 619533 - RNA, 19 nt, Escherichia coli CFT073
uccggccagcaugccugug

SEQ ID NO: 619534 - RNA, 20 nt, Escherichia coli CFT073
uccggccagcaugccugugg

SEQ ID NO: 619535 - RNA, 15 nt, Escherichia coli CFT073
uccguaucugucaga

SEQ ID NO: 619536 - RNA, 15 nt, Escherichia coli CFT073
uccguauuugucucg

SEQ ID NO: 619537 - RNA, 19 nt, Escherichia coli CFT073
uccgucaccggaauaauaa

SEQ ID NO: 619538 - RNA, 22 nt, Escherichia coli CFT073
uccgucagcggcagcucuuucu

SEQ ID NO: 619539 - RNA, 20 nt, Escherichia coli CFT073
uccgucgaaagcccaucauc

SEQ ID NO: 619540 - RNA, 18 nt, Escherichia coli CFT073
uccgucaugucucucaga

SEQ ID NO: 619541 - RNA, 20 nt, Escherichia coli CFT073
uccgguucauggucgccaag

SEQ ID NO: 619542 - RNA, 19 nt, Escherichia coli CFT073
uccggugguuaacgcugcc

SEQ ID NO: 619543 - RNA, 14 nt, Escherichia coli CFT073
uccggugccaaagu

SEQ ID NO: 619544 - RNA, 21 nt, Escherichia coli CFT073
uccguaaaugggggagagcca

SEQ ID NO: 619545 - RNA, 14 nt, Escherichia coli CFT073
uccgguuguucaac

SEQ ID NO: 619546 - RNA, 21 nt, Escherichia coli CFT073
uccgguuuaaucgauuuagaa

SEQ ID NO: 619547 - RNA, 15 nt, Escherichia coli CFT073
uccgguuuacucaau

SEQ ID NO: 619548 - RNA, 15 nt, Escherichia coli CFT073
uccgguuucaucagc

SEQ ID NO: 619549 - RNA, 14 nt, Escherichia coli CFT073
uccguuuuccagcc

SEQ ID NO: 619550 - RNA, 20 nt, Escherichia coli CFT073
uccguugucuguaaugucca

SEQ ID NO: 619551 - RNA, 20 nt, Escherichia coli CFT073
uccguuguaacuucuuuacu

SEQ ID NO: 619552 - RNA, 19 nt, Escherichia coli CFT073
uccgugucuuuauuuccau

SEQ ID NO: 619553 - RNA, 13 nt, Escherichia coli CFT073
uccgucuggccag

SEQ ID NO: 619554 - RNA, 22 nt, Escherichia coli CFT073
uccgucgggcgguauuuaaacu

SEQ ID NO: 619555 - RNA, 19 nt, Escherichia coli CFT073
uccuaaaggcaaaaugcca

SEQ ID NO: 619556 - RNA, 15 nt, Escherichia coli CFT073
uccuaacaaccaucc

SEQ ID NO: 619557 - RNA, 20 nt, Escherichia coli CFT073
uccuauuggagaauauguuu

SEQ ID NO: 619558 - RNA, 18 nt, Escherichia coli CFT073
uccucacuuaaagcaaca

SEQ ID NO: 619559 - RNA, 22 nt, Escherichia coli CFT073
uccucacuuaaagcaacaccau

SEQ ID NO: 619560 - RNA, 12 nt, Escherichia coli CFT073
uccucaauaaua

SEQ ID NO: 619561 - RNA, 18 nt, Escherichia coli CFT073
uccucaaucggaaaacaa

SEQ ID NO: 619562 - RNA, 22 nt, Escherichia coli CFT073
uccucaaugaaucgcagucucu

SEQ ID NO: 619563 - RNA, 21 nt, Escherichia coli CFT073
uccucaaacgugcggcaggca

SEQ ID NO: 619564 - RNA, 17 nt, Escherichia coli CFT073
uccucaacaucuucacc

SEQ ID NO: 619565 - RNA, 14 nt, Escherichia coli CFT073
uccucaacgccgca

SEQ ID NO: 619566 - RNA, 17 nt, Escherichia coli CFT073
uccuguugcguuaagcc

SEQ ID NO: 619567 - RNA, 17 nt, Escherichia coli CFT073
uccuguuccauggugua

SEQ ID NO: 619568 - RNA, 22 nt, Escherichia coli CFT073
uccuguucgaacauuagcgcau

SEQ ID NO: 619569 - RNA, 21 nt, Escherichia coli CFT073
uccugucuaaccgccugccuu

SEQ ID NO: 619570 - RNA, 14 nt, Escherichia coli CFT073
uccuguaauggcug

SEQ ID NO: 619571 - RNA, 17 nt, Escherichia coli CFT073
uccuguagcggaaaauc

SEQ ID NO: 619572 - RNA, 15 nt, Escherichia coli CFT073
uccuggucaaagugg

SEQ ID NO: 619573 - RNA, 20 nt, Escherichia coli CFT073
uccuggucacguaagcgccg

SEQ ID NO: 619574 - RNA, 18 nt, Escherichia coli CFT073
uccuguaacgcaggaugu

SEQ ID NO: 619575 - RNA, 18 nt, Escherichia coli CFT073
uccuggggauucaucacc

SEQ ID NO: 619576 - RNA, 19 nt, Escherichia coli CFT073
uccuuauugggugccagaa

SEQ ID NO: 619577 - RNA, 22 nt, Escherichia coli CFT073
uccuuaugcagcggaauaaucu

SEQ ID NO: 619578 - RNA, 12 nt, Escherichia coli CFT073
uccuucaucuuu

SEQ ID NO: 619579 - RNA, 13 nt, Escherichia coli CFT073
uccuguuucacuu

SEQ ID NO: 619580 - RNA, 19 nt, Escherichia coli CFT073
uccuuaacuucaucggcaa

SEQ ID NO: 619581 - RNA, 22 nt, Escherichia coli CFT073
uccuggcgaucgggcauuucca

SEQ ID NO: 619582 - RNA, 20 nt, Escherichia coli CFT073
uccuggcgguugauaaugau

SEQ ID NO: 619583 - RNA, 22 nt, Escherichia coli CFT073
uccuggcuaugguuaccuguuc

SEQ ID NO: 619584 - RNA, 19 nt, Escherichia coli CFT073
uccugcugcacgcccugau

SEQ ID NO: 619585 - RNA, 18 nt, Escherichia coli CFT073
uccugcucggcaaacugc

SEQ ID NO: 619586 - RNA, 18 nt, Escherichia coli CFT073
uccugcucaaguaauaaa

SEQ ID NO: 619587 - RNA, 15 nt, Escherichia coli CFT073
uccugcgucccuacu

SEQ ID NO: 619588 - RNA, 15 nt, Escherichia coli CFT073
uccugcuacaccauu

SEQ ID NO: 619589 - RNA, 16 nt, Escherichia coli CFT073
uccugcuacaccauug

SEQ ID NO: 619590 - RNA, 16 nt, Escherichia coli CFT073
uccuggaacacgcgca

SEQ ID NO: 619591 - RNA, 15 nt, Escherichia coli CFT073
uccugcagcguugcc

SEQ ID NO: 619592 - RNA, 14 nt, Escherichia coli CFT073
uccugcaagccaac

SEQ ID NO: 619593 - RNA, 16 nt, Escherichia coli CFT073
uccugcagaaaaucca

SEQ ID NO: 619594 - RNA, 19 nt, Escherichia coli CFT073
uccugcagaaaauccagcg

SEQ ID NO: 619595 - RNA, 21 nt, Escherichia coli CFT073
uccugcacugucccaaaaugu

SEQ ID NO: 619596 - RNA, 23 nt, Escherichia coli CFT073
uccugcacugucccaaaaugucg

SEQ ID NO: 619597 - RNA, 23 nt, Escherichia coli CFT073
uccugcacuucaaauuucauaau

SEQ ID NO: 619598 - RNA, 22 nt, Escherichia coli CFT073
uccugcgggagcgcuuuuuccu

SEQ ID NO: 619599 - RNA, 22 nt, Escherichia coli CFT073
uccugcgguugaaacacagcgc

SEQ ID NO: 619600 - RNA, 20 nt, Escherichia coli CFT073
uccugcgcuuccaguuccau

SEQ ID NO: 619601 - RNA, 18 nt, Escherichia coli CFT073
uccugcgcuuucugcuuc

SEQ ID NO: 619602 - RNA, 16 nt, Escherichia coli CFT073
uccugcauuagccagg

SEQ ID NO: 619603 - RNA, 21 nt, Escherichia coli CFT073
uccugccaacgcaccguaacc

SEQ ID NO: 619604 - RNA, 16 nt, Escherichia coli CFT073
uccugccaguuuuucc

SEQ ID NO: 619605 - RNA, 16 nt, Escherichia coli CFT073
uccugaacagaaaucu

SEQ ID NO: 619606 - RNA, 15 nt, Escherichia coli CFT073
uccugaaauuccuga

SEQ ID NO: 619607 - RNA, 17 nt, Escherichia coli CFT073
uccugaaauuccugaga

SEQ ID NO: 619608 - RNA, 13 nt, Escherichia coli CFT073
uccugaauuaacu

SEQ ID NO: 619609 - RNA, 19 nt, Escherichia coli CFT073
uccugaaucacaauccgcu

SEQ ID NO: 619610 - RNA, 22 nt, Escherichia coli CFT073
uccugacggugauacagcaaaa

SEQ ID NO: 619611 - RNA, 19 nt, Escherichia coli CFT073
uccugauaaccuuccagcu

SEQ ID NO: 619612 - RNA, 23 nt, Escherichia coli CFT073
uccugauaaccuuccagcuucgc

SEQ ID NO: 619613 - RNA, 19 nt, Escherichia coli CFT073
uccugacuuaccuccuguc

SEQ ID NO: 619614 - RNA, 20 nt, Escherichia coli CFT073
uccugacuuuguaccagcgg

SEQ ID NO: 619615 - RNA, 22 nt, Escherichia coli CFT073
uccugauccgcuuuacgcaguu

SEQ ID NO: 619616 - RNA, 14 nt, Escherichia coli CFT073
uccugauggucggc

SEQ ID NO: 619617 - RNA, 17 nt, Escherichia coli CFT073
uccugauccugcaacaa

SEQ ID NO: 619618 - RNA, 21 nt, Escherichia coli CFT073
uccugcaaacaguaacccagc

SEQ ID NO: 619619 - RNA, 14 nt, Escherichia coli CFT073
uccugcaaauucaa

SEQ ID NO: 619620 - RNA, 16 nt, Escherichia coli CFT073
uccugcaacaacacca

SEQ ID NO: 619621 - RNA, 14 nt, Escherichia coli CFT073
uccucaucaauauu

SEQ ID NO: 619622 - RNA, 15 nt, Escherichia coli CFT073
uccucaucauccucu

SEQ ID NO: 619623 - RNA, 17 nt, Escherichia coli CFT073
uccucaucauccucuuc

SEQ ID NO: 619624 - RNA, 21 nt, Escherichia coli CFT073
uccuccuggaacacgcgcaua

SEQ ID NO: 619625 - RNA, 13 nt, Escherichia coli CFT073
uccuccgcagcca

SEQ ID NO: 619626 - RNA, 19 nt, Escherichia coli CFT073
uccucuaaaccccaaccac

SEQ ID NO: 619627 - RNA, 22 nt, Escherichia coli CFT073
uccucgauacagaccccggcau

SEQ ID NO: 619628 - RNA, 16 nt, Escherichia coli CFT073
uccucgccguuaauga

SEQ ID NO: 619629 - RNA, 22 nt, Escherichia coli CFT073
ucgcagggaucauccacccgca

SEQ ID NO: 619630 - RNA, 15 nt, Escherichia coli CFT073
ucgcagacaaggcga

SEQ ID NO: 619631 - RNA, 22 nt, Escherichia coli CFT073
ucgcagagaucauacagaugcu

SEQ ID NO: 619632 - RNA, 13 nt, Escherichia coli CFT073
ucgcagccagcgc

SEQ ID NO: 619633 - RNA, 13 nt, Escherichia coli CFT073
ucgcaacaauguc

SEQ ID NO: 619634 - RNA, 12 nt, Escherichia coli CFT073
ucgcaaccagcc

SEQ ID NO: 619635 - RNA, 15 nt, Escherichia coli CFT073
ucgcaaucaccuuac

SEQ ID NO: 619636 - RNA, 23 nt, Escherichia coli CFT073
ucgcaacgcaucuuuuucaaucc

SEQ ID NO: 619637 - RNA, 13 nt, Escherichia coli CFT073
ucgcacaugucag

SEQ ID NO: 619638 - RNA, 16 nt, Escherichia coli CFT073
ucgcacgccuggcagc

SEQ ID NO: 619639 - RNA, 17 nt, Escherichia coli CFT073
ucgcaauucuucauucc

SEQ ID NO: 619640 - RNA, 15 nt, Escherichia coli CFT073
ucgaugccaaagugu

SEQ ID NO: 619641 - RNA, 15 nt, Escherichia coli CFT073
ucgaugcguaccauu

SEQ ID NO: 619642 - RNA, 14 nt, Escherichia coli CFT073
ucgauccccugccc

SEQ ID NO: 619643 - RNA, 15 nt, Escherichia coli CFT073
ucgauccccugcccg

SEQ ID NO: 619644 - RNA, 14 nt, Escherichia coli CFT073
ucgaucucuuccac

SEQ ID NO: 619645 - RNA, 19 nt, Escherichia coli CFT073
ucgauuuuuuccagcgcau

SEQ ID NO: 619646 - RNA, 16 nt, Escherichia coli CFT073
ucgcaaaacucaccuu

SEQ ID NO: 619647 - RNA, 16 nt, Escherichia coli CFT073
ucgauuuuauaaaggg

SEQ ID NO: 619648 - RNA, 19 nt, Escherichia coli CFT073
ucgauugcacaaagguuuc

SEQ ID NO: 619649 - RNA, 22 nt, Escherichia coli CFT073
ucgauucgccgucucuuucaug

SEQ ID NO: 619650 - RNA, 20 nt, Escherichia coli CFT073
ucgauucgguucggcucaau

SEQ ID NO: 619651 - RNA, 15 nt, Escherichia coli CFT073
ucgauuaaguuuucc

SEQ ID NO: 619652 - RNA, 14 nt, Escherichia coli CFT073
ucgauguagcgauu

SEQ ID NO: 619653 - RNA, 20 nt, Escherichia coli CFT073
ucgauguagcgauuuacuau

SEQ ID NO: 619654 - RNA, 14 nt, Escherichia coli CFT073
ucgauaaacagcgu

SEQ ID NO: 619655 - RNA, 12 nt, Escherichia coli CFT073
ucgauaacugcu

SEQ ID NO: 619656 - RNA, 18 nt, Escherichia coli CFT073
ucgagguuaguaauguuu

SEQ ID NO: 619657 - RNA, 20 nt, Escherichia coli CFT073
ucgaggcgauacgcaguggc

SEQ ID NO: 619658 - RNA, 22 nt, Escherichia coli CFT073
ucgaggccgcggcucaggcgca

SEQ ID NO: 619659 - RNA, 23 nt, Escherichia coli CFT073
ucgaggccaauuuggcugccaug

SEQ ID NO: 619660 - RNA, 20 nt, Escherichia coli CFT073
ucgauaucuuuuaaaucauc

SEQ ID NO: 619661 - RNA, 12 nt, Escherichia coli CFT073
ucgauauacaaa

SEQ ID NO: 619662 - RNA, 15 nt, Escherichia coli CFT073
ucgauauacaccggc

SEQ ID NO: 619663 - RNA, 16 nt, Escherichia coli CFT073
ucgauauacaccggca

SEQ ID NO: 619664 - RNA, 15 nt, Escherichia coli CFT073
ucgauaucaggcaaa

SEQ ID NO: 619665 - RNA, 13 nt, Escherichia coli CFT073
ucgaucaguucag

SEQ ID NO: 619666 - RNA, 15 nt, Escherichia coli CFT073
ucgaucaguucagca

SEQ ID NO: 619667 - RNA, 18 nt, Escherichia coli CFT073
ucgauauggccuucuuca

SEQ ID NO: 619668 - RNA, 15 nt, Escherichia coli CFT073
ucgauaugaccauug

SEQ ID NO: 619669 - RNA, 16 nt, Escherichia coli CFT073
ucgagcagcuccugcu

SEQ ID NO: 619670 - RNA, 20 nt, Escherichia coli CFT073
ucgagcagcuccugcucuga

SEQ ID NO: 619671 - RNA, 17 nt, Escherichia coli CFT073
ucgagcaguaauccagc

SEQ ID NO: 619672 - RNA, 22 nt, Escherichia coli CFT073
ucgagaauauacagcgucugcc

SEQ ID NO: 619673 - RNA, 15 nt, Escherichia coli CFT073
ucgagauaacgagca

SEQ ID NO: 619674 - RNA, 20 nt, Escherichia coli CFT073
ucgagauucauccaguucca

SEQ ID NO: 619675 - RNA, 20 nt, Escherichia coli CFT073
ucgacuucuucauucauccg

SEQ ID NO: 619676 - RNA, 21 nt, Escherichia coli CFT073
ucgacuuuagucgcuugcagg

SEQ ID NO: 619677 - RNA, 12 nt, Escherichia coli CFT073
ucgacuuuuucc

SEQ ID NO: 619678 - RNA, 14 nt, Escherichia coli CFT073
ucgacuaacuucug

SEQ ID NO: 619679 - RNA, 16 nt, Escherichia coli CFT073
ucgacaucacauuaaa

SEQ ID NO: 619680 - RNA, 15 nt, Escherichia coli CFT073
ucgacaguugcugcg

SEQ ID NO: 619681 - RNA, 19 nt, Escherichia coli CFT073
ucgacauaaaucauuccgu

SEQ ID NO: 619682 - RNA, 14 nt, Escherichia coli CFT073
ucgacauaacgacc

SEQ ID NO: 619683 - RNA, 14 nt, Escherichia coli CFT073
ucgaccaaacuuau

SEQ ID NO: 619684 - RNA, 14 nt, Escherichia coli CFT073
ucgacauugaccag

SEQ ID NO: 619685 - RNA, 14 nt, Escherichia coli CFT073
ucgaccgucaccag

SEQ ID NO: 619686 - RNA, 17 nt, Escherichia coli CFT073
ucgaccgucaccagucc

SEQ ID NO: 619687 - RNA, 14 nt, Escherichia coli CFT073
ucgaccuuacgcag

SEQ ID NO: 619688 - RNA, 17 nt, Escherichia coli CFT073
ucgacgccaucauucgc

SEQ ID NO: 619689 - RNA, 18 nt, Escherichia coli CFT073
ucgacgagaauuuccuuc

SEQ ID NO: 619690 - RNA, 17 nt, Escherichia coli CFT073
ucgacgagaauuuccuu

SEQ ID NO: 619691 - RNA, 19 nt, Escherichia coli CFT073
ucgacguaguacccucugc

SEQ ID NO: 619692 - RNA, 17 nt, Escherichia coli CFT073
ucgacguccaaucagca

SEQ ID NO: 619693 - RNA, 15 nt, Escherichia coli CFT073
ucgaaugccgcagca

SEQ ID NO: 619694 - RNA, 21 nt, Escherichia coli CFT073
ucgaauccuucccccaccacc

SEQ ID NO: 619695 - RNA, 15 nt, Escherichia coli CFT073
ucgaaucgguuguuc

SEQ ID NO: 619696 - RNA, 14 nt, Escherichia coli CFT073
ucgaauccucccgg

SEQ ID NO: 619697 - RNA, 23 nt, Escherichia coli CFT073
ucgacaacguuuucaacaaucca

SEQ ID NO: 619698 - RNA, 17 nt, Escherichia coli CFT073
ucgacaaaaucagaaac

SEQ ID NO: 619699 - RNA, 18 nt, Escherichia coli CFT073
ucgacaaaaucagaaaca

SEQ ID NO: 619700 - RNA, 20 nt, Escherichia coli CFT073
ucgacaaugguuaaauugaa

SEQ ID NO: 619701 - RNA, 15 nt, Escherichia coli CFT073
ucgacaagacgucca

SEQ ID NO: 619702 - RNA, 20 nt, Escherichia coli CFT073
ucgacaagcguaauuauucc

SEQ ID NO: 619703 - RNA, 12 nt, Escherichia coli CFT073
ucgacaccagcc

SEQ ID NO: 619704 - RNA, 13 nt, Escherichia coli CFT073
ucgaacgcagagg

SEQ ID NO: 619705 - RNA, 22 nt, Escherichia coli CFT073
ucgaacggguuaaaucccgucu

SEQ ID NO: 619706 - RNA, 18 nt, Escherichia coli CFT073
ucgaacgguaacaggaaa

SEQ ID NO: 619707 - RNA, 20 nt, Escherichia coli CFT073
ucgaacgguaacaggaaaca

SEQ ID NO: 619708 - RNA, 23 nt, Escherichia coli CFT073
ucgaacguccagccggggaucag

SEQ ID NO: 619709 - RNA, 19 nt, Escherichia coli CFT073
ucgaagaaaaacuggauga

SEQ ID NO: 619710 - RNA, 17 nt, Escherichia coli CFT073
ucgaaguuuuccucagu

SEQ ID NO: 619711 - RNA, 19 nt, Escherichia coli CFT073
ucgaagccccauuuugaug

SEQ ID NO: 619712 - RNA, 15 nt, Escherichia coli CFT073
uccuuucaugcauuu

SEQ ID NO: 619713 - RNA, 12 nt, Escherichia coli CFT073
uccuuuguacca

SEQ ID NO: 619714 - RNA, 22 nt, Escherichia coli CFT073
uccuuuggacucauuaaaccac

SEQ ID NO: 619715 - RNA, 15 nt, Escherichia coli CFT073
uccuuuucaccuuca

SEQ ID NO: 619716 - RNA, 19 nt, Escherichia coli CFT073
uccuuuucaccuucaaaau

SEQ ID NO: 619717 - RNA, 16 nt, Escherichia coli CFT073
uccuuuuggugccgga

SEQ ID NO: 619718 - RNA, 15 nt, Escherichia coli CFT073
ucgaaauaucacuga

SEQ ID NO: 619719 - RNA, 18 nt, Escherichia coli CFT073
ucgaaaccacaguucaau

SEQ ID NO: 619720 - RNA, 22 nt, Escherichia coli CFT073
ucgaacaaggcaauuaaaaauu

SEQ ID NO: 619721 - RNA, 18 nt, Escherichia coli CFT073
uccuugcguacaccaaca

SEQ ID NO: 619722 - RNA, 15 nt, Escherichia coli CFT073
uccuuuaucugcccu

SEQ ID NO: 619723 - RNA, 14 nt, Escherichia coli CFT073
uccuugaaaaagag

SEQ ID NO: 619724 - RNA, 18 nt, Escherichia coli CFT073
uccuucgggaucaaccgc

SEQ ID NO: 619725 - RNA, 12 nt, Escherichia coli CFT073
uccuuccagcuc

SEQ ID NO: 619726 - RNA, 15 nt, Escherichia coli CFT073
uccuucccccaccac

SEQ ID NO: 619727 - RNA, 20 nt, Escherichia coli CFT073
uccgcuaaaaauaguucuga

SEQ ID NO: 619728 - RNA, 15 nt, Escherichia coli CFT073
uccgcgugacgcugg

SEQ ID NO: 619729 - RNA, 20 nt, Escherichia coli CFT073
uccgcucaucaccgcaaagu

SEQ ID NO: 619730 - RNA, 13 nt, Escherichia coli CFT073
uccgcuaugugua

SEQ ID NO: 619731 - RNA, 18 nt, Escherichia coli CFT073
uccgcuauguguaagaaa

SEQ ID NO: 619732 - RNA, 20 nt, Escherichia coli CFT073
uccgcgugacgcuggcagaa

SEQ ID NO: 619733 - RNA, 23 nt, Escherichia coli CFT073
uccgcgugacgcuggcagaaagu

SEQ ID NO: 619734 - RNA, 19 nt, Escherichia coli CFT073
uccgcgucauugacgcugg

SEQ ID NO: 619735 - RNA, 17 nt, Escherichia coli CFT073
uccgcgaacagccgcgg

SEQ ID NO: 619736 - RNA, 14 nt, Escherichia coli CFT073
uccgccucgcucag

SEQ ID NO: 619737 - RNA, 17 nt, Escherichia coli CFT073
uccgccgauggugcagc

SEQ ID NO: 619738 - RNA, 11 nt, Escherichia coli CFT073
uccgccgccag

SEQ ID NO: 619739 - RNA, 21 nt, Escherichia coli CFT073
uccgccgccauugacguuccc

SEQ ID NO: 619740 - RNA, 14 nt, Escherichia coli CFT073
uccgcauuggcaua

SEQ ID NO: 619741 - RNA, 14 nt, Escherichia coli CFT073
uccgccaauuucau

SEQ ID NO: 619742 - RNA, 14 nt, Escherichia coli CFT073
uccgccacacucuc

SEQ ID NO: 619743 - RNA, 23 nt, Escherichia coli CFT073
uccgcaggugacgcuggcagcag

SEQ ID NO: 619744 - RNA, 20 nt, Escherichia coli CFT073
uccgcacuugaguaauuaau

SEQ ID NO: 619745 - RNA, 21 nt, Escherichia coli CFT073
uccgcacuuucuccggcagcu

SEQ ID NO: 619746 - RNA, 18 nt, Escherichia coli CFT073
uccgcaccugccagcgcc

SEQ ID NO: 619747 - RNA, 12 nt, Escherichia coli CFT073
uccgcagcgcgg

SEQ ID NO: 619748 - RNA, 15 nt, Escherichia coli CFT073
uccgcagcuccagcc

SEQ ID NO: 619749 - RNA, 16 nt, Escherichia coli CFT073
uccgcaggggauggau

SEQ ID NO: 619750 - RNA, 19 nt, Escherichia coli CFT073
uccgccagacaauccagcg

SEQ ID NO: 619751 - RNA, 15 nt, Escherichia coli CFT073
uccgccagcaacuga

SEQ ID NO: 619752 - RNA, 17 nt, Escherichia coli CFT073
uccgccagcaucauaaa

SEQ ID NO: 619753 - RNA, 23 nt, Escherichia coli CFT073
uccgccagaauccggugauugcu

SEQ ID NO: 619754 - RNA, 14 nt, Escherichia coli CFT073
uccgccaucaaucg

SEQ ID NO: 619755 - RNA, 18 nt, Escherichia coli CFT073
uccgccauaucaccaccg

SEQ ID NO: 619756 - RNA, 13 nt, Escherichia coli CFT073
uccgccagcgcca

SEQ ID NO: 619757 - RNA, 17 nt, Escherichia coli CFT073
uccgccagcgccaaagc

SEQ ID NO: 619758 - RNA, 13 nt, Escherichia coli CFT073
uccgccagcgccu

SEQ ID NO: 619759 - RNA, 15 nt, Escherichia coli CFT073
uccgcaacgccgcca

SEQ ID NO: 619760 - RNA, 18 nt, Escherichia coli CFT073
uccgcaccaacuccacuu

SEQ ID NO: 619761 - RNA, 22 nt, Escherichia coli CFT073
uccgcaccaacuccacuucacc

SEQ ID NO: 619762 - RNA, 22 nt, Escherichia coli CFT073
uccgauuguacuuuaaaauaag

SEQ ID NO: 619763 - RNA, 22 nt, Escherichia coli CFT073
uccgauuguuccugcucaucag

SEQ ID NO: 619764 - RNA, 15 nt, Escherichia coli CFT073
uccgagguuaauauu

SEQ ID NO: 619765 - RNA, 18 nt, Escherichia coli CFT073
aaaucugcgccuacggca

SEQ ID NO: 619766 - RNA, 19 nt, Escherichia coli CFT073
aaaucugcccguuaaccau

SEQ ID NO: 619767 - RNA, 18 nt, Escherichia coli CFT073
aaaucugauuaauauuga

SEQ ID NO: 619768 - RNA, 21 nt, Escherichia coli CFT073
uccgaccgcccuuuuucuuau

SEQ ID NO: 619769 - RNA, 20 nt, Escherichia coli CFT073
uccgagaaucgacaccaguu

SEQ ID NO: 619770 - RNA, 22 nt, Escherichia coli CFT073
uccgagaaucgacaccaguuca

SEQ ID NO: 619771 - RNA, 15 nt, Escherichia coli CFT073
uccgagcggcaccac

SEQ ID NO: 619772 - RNA, 16 nt, Escherichia coli CFT073
aaaucuguugaaauua

SEQ ID NO: 619773 - RNA, 17 nt, Escherichia coli CFT073
aaaucuguugaaauuau

SEQ ID NO: 619774 - RNA, 23 nt, Escherichia coli CFT073
uccgaccuacagggaacacaugu

SEQ ID NO: 619775 - RNA, 18 nt, Escherichia coli CFT073
uccgacauuucugcugcc

SEQ ID NO: 619776 - RNA, 20 nt, Escherichia coli CFT073
uccgacauuucugcugccua

SEQ ID NO: 619777 - RNA, 14 nt, Escherichia coli CFT073
uccgaccaaagaau

SEQ ID NO: 619778 - RNA, 23 nt, Escherichia coli CFT073
uccgaccuacaaaaucaugcaaa

SEQ ID NO: 619779 - RNA, 18 nt, Escherichia coli CFT073
uccgacaucccgccagcc

SEQ ID NO: 619780 - RNA, 21 nt, Escherichia coli CFT073
uccgaaguucauccauaccac

SEQ ID NO: 619781 - RNA, 13 nt, Escherichia coli CFT073
uccgaaaaccgau

SEQ ID NO: 619782 - RNA, 22 nt, Escherichia coli CFT073
ucccuuucagcaaaccacugau

SEQ ID NO: 619783 - RNA, 14 nt, Escherichia coli CFT073
ucccuuucuccauu

SEQ ID NO: 619784 - RNA, 13 nt, Escherichia coli CFT073
ucccuuugccugc

SEQ ID NO: 619785 - RNA, 16 nt, Escherichia coli CFT073
ucccuugcucugguuc

SEQ ID NO: 619786 - RNA, 18 nt, Escherichia coli CFT073
ucccuuguugugccagac

SEQ ID NO: 619787 - RNA, 22 nt, Escherichia coli CFT073
uccgaaacgcggguaaucaguu

SEQ ID NO: 619788 - RNA, 14 nt, Escherichia coli CFT073
ucccucauuuucaa

SEQ ID NO: 619789 - RNA, 19 nt, Escherichia coli CFT073
ucccuaacagcguggugac

SEQ ID NO: 619790 - RNA, 22 nt, Escherichia coli CFT073
ucccucacccccacucccgcau

SEQ ID NO: 619791 - RNA, 17 nt, Escherichia coli CFT073
ucccucacgcuucugaa

SEQ ID NO: 619792 - RNA, 20 nt, Escherichia coli CFT073
ucccucacgcuucugaauau

SEQ ID NO: 619793 - RNA, 14 nt, Escherichia coli CFT073
ucccuuccugcccu

SEQ ID NO: 619794 - RNA, 17 nt, Escherichia coli CFT073
ucccuucugccaccagg

SEQ ID NO: 619795 - RNA, 18 nt, Escherichia coli CFT073
ucccuucugccaccaggu

SEQ ID NO: 619796 - RNA, 21 nt, Escherichia coli CFT073
ucccuucugccaccagguuca

SEQ ID NO: 619797 - RNA, 12 nt, Escherichia coli CFT073
ucccuucuccac

SEQ ID NO: 619798 - RNA, 14 nt, Escherichia coli CFT073
ucccuucucuucaa

SEQ ID NO: 619799 - RNA, 17 nt, Escherichia coli CFT073
ucccuucgagcgggggg

SEQ ID NO: 619800 - RNA, 22 nt, Escherichia coli CFT073
ucccuuccgcuuuuaacaucuu

SEQ ID NO: 619801 - RNA, 20 nt, Escherichia coli CFT073
ucccuuccggugcgaucagu

SEQ ID NO: 619802 - RNA, 13 nt, Escherichia coli CFT073
ucccuucaauuau

SEQ ID NO: 619803 - RNA, 13 nt, Escherichia coli CFT073
ucccuggcaugau

SEQ ID NO: 619804 - RNA, 16 nt, Escherichia coli CFT073
ucccugcucuuucagc

SEQ ID NO: 619805 - RNA, 16 nt, Escherichia coli CFT073
ucccugguacagcaga

SEQ ID NO: 619806 - RNA, 20 nt, Escherichia coli CFT073
ucccugcagggcuuuuuaau

SEQ ID NO: 619807 - RNA, 19 nt, Escherichia coli CFT073
ucccugcagucaccugccc

SEQ ID NO: 619808 - RNA, 16 nt, Escherichia coli CFT073
ucccugccuccaugaa

SEQ ID NO: 619809 - RNA, 20 nt, Escherichia coli CFT073
ucccugcgcaaggcauugag

SEQ ID NO: 619810 - RNA, 21 nt, Escherichia coli CFT073
ucccgcgacaaucgcccccau

SEQ ID NO: 619811 - RNA, 14 nt, Escherichia coli CFT073
ucccgccugcugcg

SEQ ID NO: 619812 - RNA, 23 nt, Escherichia coli CFT073
ucccgccgaagacgcuuacucuu

SEQ ID NO: 619813 - RNA, 14 nt, Escherichia coli CFT073
ucccgccagcacca

SEQ ID NO: 619814 - RNA, 19 nt, Escherichia coli CFT073
ucccgcagccacgucaccu

SEQ ID NO: 619815 - RNA, 22 nt, Escherichia coli CFT073
ucccgcagccacgucaccugcc

SEQ ID NO: 619816 - RNA, 23 nt, Escherichia coli CFT073
ucccgcuguuuguucaucaugaa

SEQ ID NO: 619817 - RNA, 14 nt, Escherichia coli CFT073
ucccggaagccacc

SEQ ID NO: 619818 - RNA, 14 nt, Escherichia coli CFT073
ucccgcgccagcgc

SEQ ID NO: 619819 - RNA, 23 nt, Escherichia coli CFT073
ucccgcgccgcagccggaaaacc

SEQ ID NO: 619820 - RNA, 21 nt, Escherichia coli CFT073
ucccgcgcacgaggugccacc

SEQ ID NO: 619821 - RNA, 13 nt, Escherichia coli CFT073
ucccggcucaucc

SEQ ID NO: 619822 - RNA, 19 nt, Escherichia coli CFT073
ucccggauaaaucuccauu

SEQ ID NO: 619823 - RNA, 21 nt, Escherichia coli CFT073
ucccggauggcaacagcagcc

SEQ ID NO: 619824 - RNA, 13 nt, Escherichia coli CFT073
ucccggcaaaaaa

SEQ ID NO: 619825 - RNA, 15 nt, Escherichia coli CFT073
ucccggcaaaaaaca

SEQ ID NO: 619826 - RNA, 16 nt, Escherichia coli CFT073
ucccggaugcaccauc

SEQ ID NO: 619827 - RNA, 19 nt, Escherichia coli CFT073
ucccguugccacucaggca

SEQ ID NO: 619828 - RNA, 21 nt, Escherichia coli CFT073
ucccgguauaacuugccaggc

SEQ ID NO: 619829 - RNA, 17 nt, Escherichia coli CFT073
ucccggucaguagaaua

SEQ ID NO: 619830 - RNA, 17 nt, Escherichia coli CFT073
ucccguagcaggaaaua

SEQ ID NO: 619831 - RNA, 15 nt, Escherichia coli CFT073
uccccuucagcaagg

SEQ ID NO: 619832 - RNA, 24 nt, Escherichia coli CFT073
uccccuucagcaaggcuuuccaga

SEQ ID NO: 619833 - RNA, 21 nt, Escherichia coli CFT073
uccccuuucacauugaugaag

SEQ ID NO: 619834 - RNA, 19 nt, Escherichia coli CFT073
uccccuuuugccuucugag

SEQ ID NO: 619835 - RNA, 22 nt, Escherichia coli CFT073
uccccuuuugccuucugagccc

SEQ ID NO: 619836 - RNA, 18 nt, Escherichia coli CFT073
uccccugagcauacauug

SEQ ID NO: 619837 - RNA, 21 nt, Escherichia coli CFT073
ucccgaacucgaccugcaacu

SEQ ID NO: 619838 - RNA, 23 nt, Escherichia coli CFT073
ucccgaccaauuacacacaacac

SEQ ID NO: 619839 - RNA, 14 nt, Escherichia coli CFT073
ucccgacacacugc

SEQ ID NO: 619840 - RNA, 18 nt, Escherichia coli CFT073
ucccgacacggcucaacc

SEQ ID NO: 619841 - RNA, 23 nt, Escherichia coli CFT073
uccccucagggcggcuaucccaa

SEQ ID NO: 619842 - RNA, 16 nt, Escherichia coli CFT073
uccccuccagcgagcu

SEQ ID NO: 619843 - RNA, 15 nt, Escherichia coli CFT073
uccccuacucucugu

SEQ ID NO: 619844 - RNA, 17 nt, Escherichia coli CFT073
uccccuaacucuuucaa

SEQ ID NO: 619845 - RNA, 16 nt, Escherichia coli CFT073
uccccggugaaaagac

SEQ ID NO: 619846 - RNA, 17 nt, Escherichia coli CFT073
uccccggugaaaagacg

SEQ ID NO: 619847 - RNA, 23 nt, Escherichia coli CFT073
uccccguaaagcggcaacuuuau

SEQ ID NO: 619848 - RNA, 21 nt, Escherichia coli CFT073
uccccggagcccuacaaacca

SEQ ID NO: 619849 - RNA, 23 nt, Escherichia coli CFT073
uccccggagcccuacaaaccauc

SEQ ID NO: 619850 - RNA, 17 nt, Escherichia coli CFT073
uccccggauucauacug

SEQ ID NO: 619851 - RNA, 15 nt, Escherichia coli CFT073
uccccggcacuguca

SEQ ID NO: 619852 - RNA, 14 nt, Escherichia coli CFT073
uccccgccagcguu

SEQ ID NO: 619853 - RNA, 12 nt, Escherichia coli CFT073
ucccccuccccc

SEQ ID NO: 619854 - RNA, 15 nt, Escherichia coli CFT073
uccccgccucaccgc

SEQ ID NO: 619855 - RNA, 13 nt, Escherichia coli CFT073
uccccgcucucga

SEQ ID NO: 619856 - RNA, 16 nt, Escherichia coli CFT073
uccccgcuucgcccgc

SEQ ID NO: 619857 - RNA, 16 nt, Escherichia coli CFT073
ucccaccucgugcacc

SEQ ID NO: 619858 - RNA, 19 nt, Escherichia coli CFT073
ucccacgcggcaacggcuu

SEQ ID NO: 619859 - RNA, 18 nt, Escherichia coli CFT073
ucccacgguauagcucaa

SEQ ID NO: 619860 - RNA, 22 nt, Escherichia coli CFT073
ucccagaagaugcguucaccua

SEQ ID NO: 619861 - RNA, 22 nt, Escherichia coli CFT073
ucccagaagguuucgccgcugc

SEQ ID NO: 619862 - RNA, 17 nt, Escherichia coli CFT073
ucccacuuuuauuucac

SEQ ID NO: 619863 - RNA, 16 nt, Escherichia coli CFT073
ucccacuuuucaguua

SEQ ID NO: 619864 - RNA, 13 nt, Escherichia coli CFT073
ucccagcagagau

SEQ ID NO: 619865 - RNA, 17 nt, Escherichia coli CFT073
ucccagagcgggcagac

SEQ ID NO: 619866 - RNA, 14 nt, Escherichia coli CFT073
ucccagccaguccu

SEQ ID NO: 619867 - RNA, 16 nt, Escherichia coli CFT073
ucccagccaguccugu

SEQ ID NO: 619868 - RNA, 19 nt, Escherichia coli CFT073
ucccagccaguccuguuca

SEQ ID NO: 619869 - RNA, 13 nt, Escherichia coli CFT073
ucccagcccagcg

SEQ ID NO: 619870 - RNA, 19 nt, Escherichia coli CFT073
ucccagcgaugcugacgaa

SEQ ID NO: 619871 - RNA, 13 nt, Escherichia coli CFT073
ucccaucagacgg

SEQ ID NO: 619872 - RNA, 14 nt, Escherichia coli CFT073
ucccagucgaagau

SEQ ID NO: 619873 - RNA, 13 nt, Escherichia coli CFT073
ucccagugcagca

SEQ ID NO: 619874 - RNA, 20 nt, Escherichia coli CFT073
ucccaggcuacgccagaucc

SEQ ID NO: 619875 - RNA, 19 nt, Escherichia coli CFT073
ucccaggucgacaauccag

SEQ ID NO: 619876 - RNA, 16 nt, Escherichia coli CFT073
ucccagcucaaagcag

SEQ ID NO: 619877 - RNA, 23 nt, Escherichia coli CFT073
uccccaaaaaaucaacgacaaaa

SEQ ID NO: 619878 - RNA, 14 nt, Escherichia coli CFT073
ucccauuucuccac

SEQ ID NO: 619879 - RNA, 13 nt, Escherichia coli CFT073
ucccaugucagac

SEQ ID NO: 619880 - RNA, 22 nt, Escherichia coli CFT073
ucccaucuucugaaucagauca

SEQ ID NO: 619881 - RNA, 19 nt, Escherichia coli CFT073
uccccaagaucaauacaac

SEQ ID NO: 619882 - RNA, 20 nt, Escherichia coli CFT073
uccccacaggcgaugcacau

SEQ ID NO: 619883 - RNA, 12 nt, Escherichia coli CFT073
uccccacaucag

SEQ ID NO: 619884 - RNA, 14 nt, Escherichia coli CFT073
uccccacaccugac

SEQ ID NO: 619885 - RNA, 16 nt, Escherichia coli CFT073
uccccacagaaacaau

SEQ ID NO: 619886 - RNA, 22 nt, Escherichia coli CFT073
uccccacgggacgcugcacgga

SEQ ID NO: 619887 - RNA, 14 nt, Escherichia coli CFT073
uccccagaagcuuu

SEQ ID NO: 619888 - RNA, 18 nt, Escherichia coli CFT073
uccccagacgagagugac

SEQ ID NO: 619889 - RNA, 13 nt, Escherichia coli CFT073
uccccauucugcg

SEQ ID NO: 619890 - RNA, 23 nt, Escherichia coli CFT073
uccccauucugcgcugacucuac

SEQ ID NO: 619891 - RNA, 15 nt, Escherichia coli CFT073
uccccauaucccgga

SEQ ID NO: 619892 - RNA, 16 nt, Escherichia coli CFT073
uccccaguuuuccauc

SEQ ID NO: 619893 - RNA, 23 nt, Escherichia coli CFT073
uccccagggaagauguuggcagc

SEQ ID NO: 619894 - RNA, 18 nt, Escherichia coli CFT073
uccccagcgucagcagca

SEQ ID NO: 619895 - RNA, 22 nt, Escherichia coli CFT073
uccccagcggaaaauaucacca

SEQ ID NO: 619896 - RNA, 17 nt, Escherichia coli CFT073
uccccccggcagcugcc

SEQ ID NO: 619897 - RNA, 19 nt, Escherichia coli CFT073
ucccccgcacacuccauga

SEQ ID NO: 619898 - RNA, 16 nt, Escherichia coli CFT073
ucccccugccagacca

SEQ ID NO: 619899 - RNA, 13 nt, Escherichia coli CFT073
ucccccaccacca

SEQ ID NO: 619900 - RNA, 20 nt, Escherichia coli CFT073
ucccccacagcucugcuguc

SEQ ID NO: 619901 - RNA, 22 nt, Escherichia coli CFT073
uccauugcuuugguaaauggcu

SEQ ID NO: 619902 - RNA, 18 nt, Escherichia coli CFT073
uccauugucuccagggcg

SEQ ID NO: 619903 - RNA, 18 nt, Escherichia coli CFT073
uccauugucuuuucgcuu

SEQ ID NO: 619904 - RNA, 15 nt, Escherichia coli CFT073
uccauugagaaaauc

SEQ ID NO: 619905 - RNA, 16 nt, Escherichia coli CFT073
uccauugcgaauaaga

SEQ ID NO: 619906 - RNA, 14 nt, Escherichia coli CFT073
uccauucgaugaga

SEQ ID NO: 619907 - RNA, 16 nt, Escherichia coli CFT073
uccauucaaggacaaa

SEQ ID NO: 619908 - RNA, 18 nt, Escherichia coli CFT073
uccauucaucacgcacug

SEQ ID NO: 619909 - RNA, 21 nt, Escherichia coli CFT073
uccauucaucacgcacugcaa

SEQ ID NO: 619910 - RNA, 12 nt, Escherichia coli CFT073
ucccaaagauca

SEQ ID NO: 619911 - RNA, 21 nt, Escherichia coli CFT073
ucccaacgcaaaaccaagcug

SEQ ID NO: 619912 - RNA, 17 nt, Escherichia coli CFT073
ucccacaucacauccag

SEQ ID NO: 619913 - RNA, 23 nt, Escherichia coli CFT073
ucccacaugaauucgacuuucuc

SEQ ID NO: 619914 - RNA, 14 nt, Escherichia coli CFT073
ucccaccagcgccg

SEQ ID NO: 619915 - RNA, 17 nt, Escherichia coli CFT073
ucccaccagcgccgccc

SEQ ID NO: 619916 - RNA, 15 nt, Escherichia coli CFT073
ucccaaugcggcgcu

SEQ ID NO: 619917 - RNA, 19 nt, Escherichia coli CFT073
ucccacaauguucaaaugu

SEQ ID NO: 619918 - RNA, 17 nt, Escherichia coli CFT073
uccauccggcaacauca

SEQ ID NO: 619919 - RNA, 21 nt, Escherichia coli CFT073
uccauccggcaacaucaaauc

SEQ ID NO: 619920 - RNA, 14 nt, Escherichia coli CFT073
uccauccaccagcc

SEQ ID NO: 619921 - RNA, 18 nt, Escherichia coli CFT073
uccauccauacgggcaug

SEQ ID NO: 619922 - RNA, 23 nt, Escherichia coli CFT073
uccaucgacucgcgaaucgccgu

SEQ ID NO: 619923 - RNA, 16 nt, Escherichia coli CFT073
uccauccgguacuuuc

SEQ ID NO: 619924 - RNA, 20 nt, Escherichia coli CFT073
uccauccgguacuuuccuuc

SEQ ID NO: 619925 - RNA, 20 nt, Escherichia coli CFT073
uccaucguugaauacauuca

SEQ ID NO: 619926 - RNA, 19 nt, Escherichia coli CFT073
uccaucgcuacaggcuauc

SEQ ID NO: 619927 - RNA, 17 nt, Escherichia coli CFT073
uccaucggcauuaaucu

SEQ ID NO: 619928 - RNA, 22 nt, Escherichia coli CFT073
uccaucgcgcuuagcaaagaac

SEQ ID NO: 619929 - RNA, 13 nt, Escherichia coli CFT073
uccaucgcgguaa

SEQ ID NO: 619930 - RNA, 14 nt, Escherichia coli CFT073
uccaugaaaauaga

SEQ ID NO: 619931 - RNA, 22 nt, Escherichia coli CFT073
uccaucucguccaacaguucca

SEQ ID NO: 619932 - RNA, 16 nt, Escherichia coli CFT073
uccaugaagcaaugau

SEQ ID NO: 619933 - RNA, 15 nt, Escherichia coli CFT073
uccauuaacccgaga

SEQ ID NO: 619934 - RNA, 16 nt, Escherichia coli CFT073
uccaugugagucagau

SEQ ID NO: 619935 - RNA, 18 nt, Escherichia coli CFT073
uccauguggcauugguau

SEQ ID NO: 619936 - RNA, 17 nt, Escherichia coli CFT073
uccauggcagaugauca

SEQ ID NO: 619937 - RNA, 17 nt, Escherichia coli CFT073
uccauggaaucaccgcc

SEQ ID NO: 619938 - RNA, 21 nt, Escherichia coli CFT073
uccaugcugcgggcgaucaua

SEQ ID NO: 619939 - RNA, 14 nt, Escherichia coli CFT073
uccaugacgaugca

SEQ ID NO: 619940 - RNA, 14 nt, Escherichia coli CFT073
uccaugccaucugc

SEQ ID NO: 619941 - RNA, 20 nt, Escherichia coli CFT073
uccagucuuucgccauccac

SEQ ID NO: 619942 - RNA, 21 nt, Escherichia coli CFT073
uccagugccgccguuaaaugg

SEQ ID NO: 619943 - RNA, 20 nt, Escherichia coli CFT073
uccagugccggaugauucac

SEQ ID NO: 619944 - RNA, 21 nt, Escherichia coli CFT073
uccagugccggaugauucaca

SEQ ID NO: 619945 - RNA, 21 nt, Escherichia coli CFT073
uccagugcgcuuuauucagau

SEQ ID NO: 619946 - RNA, 21 nt, Escherichia coli CFT073
uccagugcguacccagcgugu

SEQ ID NO: 619947 - RNA, 14 nt, Escherichia coli CFT073
uccaguaacacuuc

SEQ ID NO: 619948 - RNA, 20 nt, Escherichia coli CFT073
uccaguaacacuuccggguc

SEQ ID NO: 619949 - RNA, 22 nt, Escherichia coli CFT073
uccagucggcguaauccugaaa

SEQ ID NO: 619950 - RNA, 19 nt, Escherichia coli CFT073
uccagucguuaugcacgcu

SEQ ID NO: 619951 - RNA, 19 nt, Escherichia coli CFT073
uccaggcgaagacaaaacc

SEQ ID NO: 619952 - RNA, 18 nt, Escherichia coli CFT073
uccaggccagauacugcc

SEQ ID NO: 619953 - RNA, 23 nt, Escherichia coli CFT073
uccagguuaugguugaacacauc

SEQ ID NO: 619954 - RNA, 23 nt, Escherichia coli CFT073
uccauaguguguuccucugcucc

SEQ ID NO: 619955 - RNA, 18 nt, Escherichia coli CFT073
uccauauauaaaaucaua

SEQ ID NO: 619956 - RNA, 12 nt, Escherichia coli CFT073
uccauauucagc

SEQ ID NO: 619957 - RNA, 17 nt, Escherichia coli CFT073
uccauauuucgucgcau

SEQ ID NO: 619958 - RNA, 19 nt, Escherichia coli CFT073
uccauauuucgucgcauca

SEQ ID NO: 619959 - RNA, 17 nt, Escherichia coli CFT073
uccauauuuggcauauu

SEQ ID NO: 619960 - RNA, 19 nt, Escherichia coli CFT073
uccauauuuuuugaaaaau

SEQ ID NO: 619961 - RNA, 16 nt, Escherichia coli CFT073
uccaguuccaguuuau

SEQ ID NO: 619962 - RNA, 13 nt, Escherichia coli CFT073
uccaguuccaucc

SEQ ID NO: 619963 - RNA, 20 nt, Escherichia coli CFT073
uccaguuaucacgauacacc

SEQ ID NO: 619964 - RNA, 19 nt, Escherichia coli CFT073
uccaguucaaucucuucac

SEQ ID NO: 619965 - RNA, 17 nt, Escherichia coli CFT073
uccaguuuauaucuuuc

SEQ ID NO: 619966 - RNA, 14 nt, Escherichia coli CFT073
uccaguugguugau

SEQ ID NO: 619967 - RNA, 16 nt, Escherichia coli CFT073
uccacuuguccgucaa

SEQ ID NO: 619968 - RNA, 18 nt, Escherichia coli CFT073
uccacuuugcuuucagau

SEQ ID NO: 619969 - RNA, 15 nt, Escherichia coli CFT073
uccagaaaaaaagca

SEQ ID NO: 619970 - RNA, 20 nt, Escherichia coli CFT073
uccagaaaaaaagcaucugc

SEQ ID NO: 619971 - RNA, 18 nt, Escherichia coli CFT073
uccagcaucgaccaggau

SEQ ID NO: 619972 - RNA, 17 nt, Escherichia coli CFT073
uccagcauucccgccac

SEQ ID NO: 619973 - RNA, 15 nt, Escherichia coli CFT073
uccagcauaccuucc

SEQ ID NO: 619974 - RNA, 22 nt, Escherichia coli CFT073
uccagcauaccuuccagcgcgu

SEQ ID NO: 619975 - RNA, 19 nt, Escherichia coli CFT073
uccagcauauguuuacgcu

SEQ ID NO: 619976 - RNA, 15 nt, Escherichia coli CFT073
uccagcagugcugca

SEQ ID NO: 619977 - RNA, 15 nt, Escherichia coli CFT073
uccagcauaaugacu

SEQ ID NO: 619978 - RNA, 17 nt, Escherichia coli CFT073
uccagcgguaaaucauu

SEQ ID NO: 619979 - RNA, 23 nt, Escherichia coli CFT073
uccagcgguaacuuaucuguaau

SEQ ID NO: 619980 - RNA, 19 nt, Escherichia coli CFT073
uccagcggccagacaccgg

SEQ ID NO: 619981 - RNA, 14 nt, Escherichia coli CFT073
uccagcggcaggcc

SEQ ID NO: 619982 - RNA, 20 nt, Escherichia coli CFT073
uccagcgcggcgaaggugcc

SEQ ID NO: 619983 - RNA, 15 nt, Escherichia coli CFT073
uccagcgccgcgcgu

SEQ ID NO: 619984 - RNA, 13 nt, Escherichia coli CFT073
uccagcgccgcca

SEQ ID NO: 619985 - RNA, 18 nt, Escherichia coli CFT073
uccagcgccugaauaauc

SEQ ID NO: 619986 - RNA, 22 nt, Escherichia coli CFT073
uccagcgccugaauaaucagau

SEQ ID NO: 619987 - RNA, 23 nt, Escherichia coli CFT073
uccagcgccugacggaucggcuc

SEQ ID NO: 619988 - RNA, 23 nt, Escherichia coli CFT073
uccagcgccaguaauucuucaau

SEQ ID NO: 619989 - RNA, 15 nt, Escherichia coli CFT073
uccagcaugcucacu

SEQ ID NO: 619990 - RNA, 13 nt, Escherichia coli CFT073
uccaccagcgccu

SEQ ID NO: 619991 - RNA, 17 nt, Escherichia coli CFT073
uccaccaggaacucagc

SEQ ID NO: 619992 - RNA, 14 nt, Escherichia coli CFT073
uccacccgcagcca

SEQ ID NO: 619993 - RNA, 17 nt, Escherichia coli CFT073
uccacccgcagcaagcg

SEQ ID NO: 619994 - RNA, 13 nt, Escherichia coli CFT073
uccacuucaucaa

SEQ ID NO: 619995 - RNA, 14 nt, Escherichia coli CFT073
uccacuuccaccac

SEQ ID NO: 619996 - RNA, 16 nt, Escherichia coli CFT073
uccacuuccaccacuu

SEQ ID NO: 619997 - RNA, 13 nt, Escherichia coli CFT073
uccacuuccugcg

SEQ ID NO: 619998 - RNA, 18 nt, Escherichia coli CFT073
uccacgguucuccacucu

SEQ ID NO: 619999 - RNA, 13 nt, Escherichia coli CFT073
uccacgucacagg

SEQ ID NO: 620000 - RNA, 17 nt, Escherichia coli CFT073
uccacguuucuucuaau

SEQ ID NO: 620001 - RNA, 14 nt, Escherichia coli CFT073
uccacuaacuguuu

SEQ ID NO: 620002 - RNA, 17 nt, Escherichia coli CFT073
uccacgacagaacccgg

SEQ ID NO: 620003 - RNA, 17 nt, Escherichia coli CFT073
uccacgcaucugcacaa

SEQ ID NO: 620004 - RNA, 17 nt, Escherichia coli CFT073
uccacgccuuuuuucac

SEQ ID NO: 620005 - RNA, 17 nt, Escherichia coli CFT073
uccacgcccagcgcagg

SEQ ID NO: 620006 - RNA, 17 nt, Escherichia coli CFT073
uccacgcgccacgcacg

SEQ ID NO: 620007 - RNA, 19 nt, Escherichia coli CFT073
uccaaucaggcgaauaaau

SEQ ID NO: 620008 - RNA, 16 nt, Escherichia coli CFT073
uccaacuccacgaucu

SEQ ID NO: 620009 - RNA, 17 nt, Escherichia coli CFT073
uccaaccagcuguuccu

SEQ ID NO: 620010 - RNA, 21 nt, Escherichia coli CFT073
uccaacauagcuaaaaauaau

SEQ ID NO: 620011 - RNA, 12 nt, Escherichia coli CFT073
uccaagaugggc

SEQ ID NO: 620012 - RNA, 23 nt, Escherichia coli CFT073
uccaacugauuuucaucuucuuc

SEQ ID NO: 620013 - RNA, 12 nt, Escherichia coli CFT073
ucauuuucucuu

SEQ ID NO: 620014 - RNA, 18 nt, Escherichia coli CFT073
uccaaaccgacugccugc

SEQ ID NO: 620015 - RNA, 12 nt, Escherichia coli CFT073
ucauuuuguagg

SEQ ID NO: 620016 - RNA, 16 nt, Escherichia coli CFT073
ucauuuuguaggccug

SEQ ID NO: 620017 - RNA, 17 nt, Escherichia coli CFT073
ucauuuuguaggccuga

SEQ ID NO: 620018 - RNA, 16 nt, Escherichia coli CFT073
ucauuuuuaacagugu

SEQ ID NO: 620019 - RNA, 16 nt, Escherichia coli CFT073
ucauuguuaucagcaa

SEQ ID NO: 620020 - RNA, 22 nt, Escherichia coli CFT073
ucauuguguacauccuaaaggc

SEQ ID NO: 620021 - RNA, 17 nt, Escherichia coli CFT073
ucauuguccgucugaaa

SEQ ID NO: 620022 - RNA, 18 nt, Escherichia coli CFT073
ucauuguugguuaaauaa

SEQ ID NO: 620023 - RNA, 23 nt, Escherichia coli CFT073
ucauuguugguuaaauaauauuu

SEQ ID NO: 620024 - RNA, 16 nt, Escherichia coli CFT073
ucauugauaauaacgu

SEQ ID NO: 620025 - RNA, 18 nt, Escherichia coli CFT073
ucauugauauagcgaucu

SEQ ID NO: 620026 - RNA, 22 nt, Escherichia coli CFT073
ucauugaugcugccaucaucuu

SEQ ID NO: 620027 - RNA, 17 nt, Escherichia coli CFT073
ucauugauggcaaaauc

SEQ ID NO: 620028 - RNA, 13 nt, Escherichia coli CFT073
ucauuucugcaau

SEQ ID NO: 620029 - RNA, 14 nt, Escherichia coli CFT073
ucauuuucaugcug

SEQ ID NO: 620030 - RNA, 23 nt, Escherichia coli CFT073
ucaguguguuauugccuggcaug

SEQ ID NO: 620031 - RNA, 13 nt, Escherichia coli CFT073
ucaguucuuucag

SEQ ID NO: 620032 - RNA, 17 nt, Escherichia coli CFT073
ucaguugguagagcacg

SEQ ID NO: 620033 - RNA, 23 nt, Escherichia coli CFT073
ucaguugguagagcacgaccuug

SEQ ID NO: 620034 - RNA, 21 nt, Escherichia coli CFT073
ucaguugcaccugauccagcu

SEQ ID NO: 620035 - RNA, 17 nt, Escherichia coli CFT073
ucaguuuaaccgggaga

SEQ ID NO: 620036 - RNA, 18 nt, Escherichia coli CFT073
ucaguuuauagaacggca

SEQ ID NO: 620037 - RNA, 14 nt, Escherichia coli CFT073
ucaguuggcagcaa

SEQ ID NO: 620038 - RNA, 18 nt, Escherichia coli CFT073
ucaugucucucagagaau

SEQ ID NO: 620039 - RNA, 14 nt, Escherichia coli CFT073
ucauguuuauucac

SEQ ID NO: 620040 - RNA, 17 nt, Escherichia coli CFT073
ucauguuuauucacaua

SEQ ID NO: 620041 - RNA, 13 nt, Escherichia coli CFT073
ucauuacuuaucu

SEQ ID NO: 620042 - RNA, 15 nt, Escherichia coli CFT073
ucauucagaaaaacu

SEQ ID NO: 620043 - RNA, 22 nt, Escherichia coli CFT073
ucauucacgccguuaacuucac

SEQ ID NO: 620044 - RNA, 16 nt, Escherichia coli CFT073
ucauuaguuaauucau

SEQ ID NO: 620045 - RNA, 18 nt, Escherichia coli CFT073
ucauuccuuaugcugcuu

SEQ ID NO: 620046 - RNA, 23 nt, Escherichia coli CFT073
ucauuccguagcguuuuuucauu

SEQ ID NO: 620047 - RNA, 22 nt, Escherichia coli CFT073
ucauucccuacgcgauaaaaaa

SEQ ID NO: 620048 - RNA, 18 nt, Escherichia coli CFT073
ugaaaaggucgccugucu

SEQ ID NO: 620049 - RNA, 20 nt, Escherichia coli CFT073
ugaaaagguuacucccggau

SEQ ID NO: 620050 - RNA, 23 nt, Escherichia coli CFT073
ugaaaagugcuguaaagcacaga

SEQ ID NO: 620051 - RNA, 12 nt, Escherichia coli CFT073
ugaaaaauaaaa

SEQ ID NO: 620052 - RNA, 15 nt, Escherichia coli CFT073
ugaaaaaucuccagc

SEQ ID NO: 620053 - RNA, 12 nt, Escherichia coli CFT073
ugaaaaaugagc

SEQ ID NO: 620054 - RNA, 15 nt, Escherichia coli CFT073
ugaaaacccugcgca

SEQ ID NO: 620055 - RNA, 15 nt, Escherichia coli CFT073
ugaaaacgcauacca

SEQ ID NO: 620056 - RNA, 19 nt, Escherichia coli CFT073
ugaaaacgcauaccagucg

SEQ ID NO: 620057 - RNA, 14 nt, Escherichia coli CFT073
ugaaaaaagcaaga

SEQ ID NO: 620058 - RNA, 17 nt, Escherichia coli CFT073
ucuuuuuuuaccugaau

SEQ ID NO: 620059 - RNA, 19 nt, Escherichia coli CFT073
ugaaacgcggcguaaccac

SEQ ID NO: 620060 - RNA, 23 nt, Escherichia coli CFT073
ugaaacucaagcuaaaccaauaa

SEQ ID NO: 620061 - RNA, 14 nt, Escherichia coli CFT073
ugaaacaaaucacu

SEQ ID NO: 620062 - RNA, 15 nt, Escherichia coli CFT073
ugaaaauucaauaaa

SEQ ID NO: 620063 - RNA, 21 nt, Escherichia coli CFT073
ugaaacagaagguauacugca

SEQ ID NO: 620064 - RNA, 19 nt, Escherichia coli CFT073
ugaaaguuggcguucacug

SEQ ID NO: 620065 - RNA, 23 nt, Escherichia coli CFT073
ugaaaggcacucauuuucucuuu

SEQ ID NO: 620066 - RNA, 23 nt, Escherichia coli CFT073
ugaaaucccgcugaauuccccuc

SEQ ID NO: 620067 - RNA, 15 nt, Escherichia coli CFT073
ugaaauaaugcagcg

SEQ ID NO: 620068 - RNA, 12 nt, Escherichia coli CFT073
ugaaagcaaaaa

SEQ ID NO: 620069 - RNA, 16 nt, Escherichia coli CFT073
ugaaagcaaaaaaaga

SEQ ID NO: 620070 - RNA, 14 nt, Escherichia coli CFT073
ugaaagcaaaaaag

SEQ ID NO: 620071 - RNA, 18 nt, Escherichia coli CFT073
ugaaagcaugucaggcag

SEQ ID NO: 620072 - RNA, 20 nt, Escherichia coli CFT073
ugaaagcugagaaaauguau

SEQ ID NO: 620073 - RNA, 19 nt, Escherichia coli CFT073
ugaaagcguuguguuuuuu

SEQ ID NO: 620074 - RNA, 17 nt, Escherichia coli CFT073
ugaacagcuuuuuccug

SEQ ID NO: 620075 - RNA, 13 nt, Escherichia coli CFT073
ugaacagccugug

SEQ ID NO: 620076 - RNA, 12 nt, Escherichia coli CFT073
ugaacagccaga

SEQ ID NO: 620077 - RNA, 15 nt, Escherichia coli CFT073
ugaacaguuuucgca

SEQ ID NO: 620078 - RNA, 18 nt, Escherichia coli CFT073
ugaacaguuuaccgagcg

SEQ ID NO: 620079 - RNA, 20 nt, Escherichia coli CFT073
ugaacucuuaagguucacuu

SEQ ID NO: 620080 - RNA, 16 nt, Escherichia coli CFT073
ugaacugaaccccaaa

SEQ ID NO: 620081 - RNA, 16 nt, Escherichia coli CFT073
ugaacugacugauugc

SEQ ID NO: 620082 - RNA, 21 nt, Escherichia coli CFT073
ugaacguuuggccacaccauc

SEQ ID NO: 620083 - RNA, 18 nt, Escherichia coli CFT073
ugaacgugcaaaaucaaa

SEQ ID NO: 620084 - RNA, 17 nt, Escherichia coli CFT073
ugaaggaauuaaucccu

SEQ ID NO: 620085 - RNA, 20 nt, Escherichia coli CFT073
ugaaggcgcauugcuggcug

SEQ ID NO: 620086 - RNA, 16 nt, Escherichia coli CFT073
ugaaguauuuaaaaau

SEQ ID NO: 620087 - RNA, 16 nt, Escherichia coli CFT073
ugaagucaggggcuuc

SEQ ID NO: 620088 - RNA, 17 nt, Escherichia coli CFT073
ugaagucucauauauuu

SEQ ID NO: 620089 - RNA, 18 nt, Escherichia coli CFT073
ugaagucgcgcucaucag

SEQ ID NO: 620090 - RNA, 22 nt, Escherichia coli CFT073
ugaaguuuguuaaccaccagua

SEQ ID NO: 620091 - RNA, 15 nt, Escherichia coli CFT073
ugaauaaaaaaacuu

SEQ ID NO: 620092 - RNA, 20 nt, Escherichia coli CFT073
ugaauaaaaaaacuuuuguc

SEQ ID NO: 620093 - RNA, 18 nt, Escherichia coli CFT073
ugaagacaacauugauuu

SEQ ID NO: 620094 - RNA, 18 nt, Escherichia coli CFT073
ugaacugguuaaauuuaa

SEQ ID NO: 620095 - RNA, 16 nt, Escherichia coli CFT073
ugaagacugcauacug

SEQ ID NO: 620096 - RNA, 20 nt, Escherichia coli CFT073
ugaagcaauccauaccagca

SEQ ID NO: 620097 - RNA, 22 nt, Escherichia coli CFT073
ugaagcaauccauaccagcaca

SEQ ID NO: 620098 - RNA, 14 nt, Escherichia coli CFT073
ugaagcagcgcugg

SEQ ID NO: 620099 - RNA, 18 nt, Escherichia coli CFT073
ugaagcagcgcuggagag

SEQ ID NO: 620100 - RNA, 17 nt, Escherichia coli CFT073
ugaagcaugaguaaccc

SEQ ID NO: 620101 - RNA, 20 nt, Escherichia coli CFT073
ugaagccaaccgggccgcag

SEQ ID NO: 620102 - RNA, 19 nt, Escherichia coli CFT073
ugaagcccaguaccgccag

SEQ ID NO: 620103 - RNA, 14 nt, Escherichia coli CFT073
ucuuugaugccuuc

SEQ ID NO: 620104 - RNA, 19 nt, Escherichia coli CFT073
ucuuugccgcuuuuaugug

SEQ ID NO: 620105 - RNA, 22 nt, Escherichia coli CFT073
ucuuugcgcccccgauccagcg

SEQ ID NO: 620106 - RNA, 17 nt, Escherichia coli CFT073
ucuuugcgguuaaagca

SEQ ID NO: 620107 - RNA, 17 nt, Escherichia coli CFT073
ucuuugcguuuggcauc

SEQ ID NO: 620108 - RNA, 18 nt, Escherichia coli CFT073
ucuuugcuaaaacgugaa

SEQ ID NO: 620109 - RNA, 17 nt, Escherichia coli CFT073
ucuuucuuuuuuucacu

SEQ ID NO: 620110 - RNA, 17 nt, Escherichia coli CFT073
ucuuugaaauaauauug

SEQ ID NO: 620111 - RNA, 17 nt, Escherichia coli CFT073
ucuuugacuguccgcau

SEQ ID NO: 620112 - RNA, 21 nt, Escherichia coli CFT073
ucuuucacgccaucauccuga

SEQ ID NO: 620113 - RNA, 17 nt, Escherichia coli CFT073
ucuuucacgcccagucc

SEQ ID NO: 620114 - RNA, 14 nt, Escherichia coli CFT073
ucuuucacuuugcu

SEQ ID NO: 620115 - RNA, 23 nt, Escherichia coli CFT073
ucuuucagacgacugucuuccug

SEQ ID NO: 620116 - RNA, 16 nt, Escherichia coli CFT073
ucuuucugaaaugggc

SEQ ID NO: 620117 - RNA, 21 nt, Escherichia coli CFT073
ucuuucucgcugacaucaaca

SEQ ID NO: 620118 - RNA, 19 nt, Escherichia coli CFT073
ucuuucucagucauaacgu

SEQ ID NO: 620119 - RNA, 15 nt, Escherichia coli CFT073
ucuuuccguuuucac

SEQ ID NO: 620120 - RNA, 16 nt, Escherichia coli CFT073
ucuuucgccacaaagc

SEQ ID NO: 620121 - RNA, 15 nt, Escherichia coli CFT073
ucuuuuugauaagau

SEQ ID NO: 620122 - RNA, 21 nt, Escherichia coli CFT073
ucuuuuugauaagauuccuuc

SEQ ID NO: 620123 - RNA, 14 nt, Escherichia coli CFT073
ucuuuugcagcagc

SEQ ID NO: 620124 - RNA, 15 nt, Escherichia coli CFT073
ucuuuguaggccuga

SEQ ID NO: 620125 - RNA, 18 nt, Escherichia coli CFT073
ucuuuuaaaucauccuga

SEQ ID NO: 620126 - RNA, 14 nt, Escherichia coli CFT073
ucuuuguucuucug

SEQ ID NO: 620127 - RNA, 14 nt, Escherichia coli CFT073
ucuuuuauuauaau

SEQ ID NO: 620128 - RNA, 14 nt, Escherichia coli CFT073
ucuuucaauuugca

SEQ ID NO: 620129 - RNA, 14 nt, Escherichia coli CFT073
ucuuucaccaacug

SEQ ID NO: 620130 - RNA, 13 nt, Escherichia coli CFT073
ucuuucaccagug

SEQ ID NO: 620131 - RNA, 17 nt, Escherichia coli CFT073
ucuuucaccucuucauu

SEQ ID NO: 620132 - RNA, 13 nt, Escherichia coli CFT073
ucuuuauguaaua

SEQ ID NO: 620133 - RNA, 19 nt, Escherichia coli CFT073
ucuuuauggguuucuaauu

SEQ ID NO: 620134 - RNA, 15 nt, Escherichia coli CFT073
ucuuuaucaaucagc

SEQ ID NO: 620135 - RNA, 23 nt, Escherichia coli CFT073
ucuuuaucaccaaugauaaguuu

SEQ ID NO: 620136 - RNA, 18 nt, Escherichia coli CFT073
ucuuuauccagcaccacu

SEQ ID NO: 620137 - RNA, 15 nt, Escherichia coli CFT073
ucuuuauccagcagc

SEQ ID NO: 620138 - RNA, 16 nt, Escherichia coli CFT073
ucuuuaucgacauaaa

SEQ ID NO: 620139 - RNA, 11 nt, Escherichia coli CFT073
ucuuuaucugc

SEQ ID NO: 620140 - RNA, 13 nt, Escherichia coli CFT073
ucuuuacacacaa

SEQ ID NO: 620141 - RNA, 16 nt, Escherichia coli CFT073
ucuuuacaucauucaa

SEQ ID NO: 620142 - RNA, 16 nt, Escherichia coli CFT073
ucuuuagcauucagcg

SEQ ID NO: 620143 - RNA, 18 nt, Escherichia coli CFT073
ucuuuauaaauaucaaaa

SEQ ID NO: 620144 - RNA, 16 nt, Escherichia coli CFT073
ucuuuaguuaauuucg

SEQ ID NO: 620145 - RNA, 16 nt, Escherichia coli CFT073
ucuuuaacggccugac

SEQ ID NO: 620146 - RNA, 23 nt, Escherichia coli CFT073
ucuuuaauagauaauuuugaaau

SEQ ID NO: 620147 - RNA, 21 nt, Escherichia coli CFT073
ucuuguucauagugccugaug

SEQ ID NO: 620148 - RNA, 14 nt, Escherichia coli CFT073
ucuuguugaacaga

SEQ ID NO: 620149 - RNA, 20 nt, Escherichia coli CFT073
ucuuggcgugcucacugaaa

SEQ ID NO: 620150 - RNA, 21 nt, Escherichia coli CFT073
ucuugucaggccggaauaacu

SEQ ID NO: 620151 - RNA, 19 nt, Escherichia coli CFT073
ucuugguagagauuuuucc

SEQ ID NO: 620152 - RNA, 22 nt, Escherichia coli CFT073
ucuuguaacgaguacaaaaaua

SEQ ID NO: 620153 - RNA, 14 nt, Escherichia coli CFT073
ucuugccucccugc

SEQ ID NO: 620154 - RNA, 16 nt, Escherichia coli CFT073
ucuugcagcuuaauca

SEQ ID NO: 620155 - RNA, 12 nt, Escherichia coli CFT073
ucuucuuucagg

SEQ ID NO: 620156 - RNA, 13 nt, Escherichia coli CFT073
ucuucuuucaggu

SEQ ID NO: 620157 - RNA, 14 nt, Escherichia coli CFT073
ucuucuuucaucau

SEQ ID NO: 620158 - RNA, 15 nt, Escherichia coli CFT073
ucuucuuucaucaug

SEQ ID NO: 620159 - RNA, 13 nt, Escherichia coli CFT073
ucuucuuuaauua

SEQ ID NO: 620160 - RNA, 13 nt, Escherichia coli CFT073
ucuucuuuaaaac

SEQ ID NO: 620161 - RNA, 12 nt, Escherichia coli CFT073
ucuucucaccgc

SEQ ID NO: 620162 - RNA, 17 nt, Escherichia coli CFT073
ucuucucacugcccugc

SEQ ID NO: 620163 - RNA, 19 nt, Escherichia coli CFT073
ucuucuccagcugcgcgcg

SEQ ID NO: 620164 - RNA, 17 nt, Escherichia coli CFT073
ucuucgaccgucaccag

SEQ ID NO: 620165 - RNA, 16 nt, Escherichia coli CFT073
ucuuccggagcugcuc

SEQ ID NO: 620166 - RNA, 20 nt, Escherichia coli CFT073
ucuucgacaaucgcaaauau

SEQ ID NO: 620167 - RNA, 15 nt, Escherichia coli CFT073
ucuucgccugaaaca

SEQ ID NO: 620168 - RNA, 22 nt, Escherichia coli CFT073
ucuucgccgucaguugugccag

SEQ ID NO: 620169 - RNA, 19 nt, Escherichia coli CFT073
ucuucgcacuuaccuucac

SEQ ID NO: 620170 - RNA, 15 nt, Escherichia coli CFT073
ucuucugaaaagguu

SEQ ID NO: 620171 - RNA, 15 nt, Escherichia coli CFT073
ucuucugaauaucau

SEQ ID NO: 620172 - RNA, 17 nt, Escherichia coli CFT073
ucuucugaaucagauca

SEQ ID NO: 620173 - RNA, 20 nt, Escherichia coli CFT073
ucuucugaaucagaucaagu

SEQ ID NO: 620174 - RNA, 15 nt, Escherichia coli CFT073
ucuucucgcacuucu

SEQ ID NO: 620175 - RNA, 12 nt, Escherichia coli CFT073
ucuucucucauc

SEQ ID NO: 620176 - RNA, 18 nt, Escherichia coli CFT073
ucuucugcagucaccugc

SEQ ID NO: 620177 - RNA, 17 nt, Escherichia coli CFT073
ucuucugcuuuacccac

SEQ ID NO: 620178 - RNA, 20 nt, Escherichia coli CFT073
ucuucuggaucaaagucauc

SEQ ID NO: 620179 - RNA, 11 nt, Escherichia coli CFT073
ucuucuucaug

SEQ ID NO: 620180 - RNA, 20 nt, Escherichia coli CFT073
ucuucuugcagcuuaaucau

SEQ ID NO: 620181 - RNA, 15 nt, Escherichia coli CFT073
ucuuaacgucgcaag

SEQ ID NO: 620182 - RNA, 21 nt, Escherichia coli CFT073
ucuuaacgucggguauauaaa

SEQ ID NO: 620183 - RNA, 20 nt, Escherichia coli CFT073
ucuuaaggcauauaugaaua

SEQ ID NO: 620184 - RNA, 20 nt, Escherichia coli CFT073
ucuuaagguucacuuaaucu

SEQ ID NO: 620185 - RNA, 16 nt, Escherichia coli CFT073
ucuuaagguuuuuucc

SEQ ID NO: 620186 - RNA, 19 nt, Escherichia coli CFT073
ucuguuugcgucaugguau

SEQ ID NO: 620187 - RNA, 15 nt, Escherichia coli CFT073
ucuguuuucaauguc

SEQ ID NO: 620188 - RNA, 16 nt, Escherichia coli CFT073
ucuggguugccugaug

SEQ ID NO: 620189 - RNA, 17 nt, Escherichia coli CFT073
ucuuaauagcuucuucu

SEQ ID NO: 620190 - RNA, 20 nt, Escherichia coli CFT073
ucuuaauagcuucuucuuua

SEQ ID NO: 620191 - RNA, 13 nt, Escherichia coli CFT073
ucuuacuucaaca

SEQ ID NO: 620192 - RNA, 16 nt, Escherichia coli CFT073
ucuuauugaguaaauu

SEQ ID NO: 620193 - RNA, 19 nt, Escherichia coli CFT073
ucuuauugaguaaauucau

SEQ ID NO: 620194 - RNA, 15 nt, Escherichia coli CFT073
ucuuauuuaauguaa

SEQ ID NO: 620195 - RNA, 20 nt, Escherichia coli CFT073
ucuuauuauauugucuuaaa

SEQ ID NO: 620196 - RNA, 22 nt, Escherichia coli CFT073
ucuuauuuuuugcgcauaacau

SEQ ID NO: 620197 - RNA, 17 nt, Escherichia coli CFT073
ucuucaaaaaagucaga

SEQ ID NO: 620198 - RNA, 16 nt, Escherichia coli CFT073
ucuucaaacugaagau

SEQ ID NO: 620199 - RNA, 19 nt, Escherichia coli CFT073
ucuucaacaccaacugccu

SEQ ID NO: 620200 - RNA, 13 nt, Escherichia coli CFT073
ucuucaaauaaac

SEQ ID NO: 620201 - RNA, 16 nt, Escherichia coli CFT073
ucuucagcuuucacca

SEQ ID NO: 620202 - RNA, 22 nt, Escherichia coli CFT073
ucuucaggaggagauauuuaac

SEQ ID NO: 620203 - RNA, 13 nt, Escherichia coli CFT073
ucuucaggaguag

SEQ ID NO: 620204 - RNA, 21 nt, Escherichia coli CFT073
ucuucaggaguagaaauaacc

SEQ ID NO: 620205 - RNA, 23 nt, Escherichia coli CFT073
ucuucagcguccgggaaauccuc

SEQ ID NO: 620206 - RNA, 23 nt, Escherichia coli CFT073
ucuucccgagacaucccuuuauu

SEQ ID NO: 620207 - RNA, 13 nt, Escherichia coli CFT073
ucuucccuuucug

SEQ ID NO: 620208 - RNA, 14 nt, Escherichia coli CFT073
ucuuccgcuucaau

SEQ ID NO: 620209 - RNA, 21 nt, Escherichia coli CFT073
ucuucccugcugaauccccuu

SEQ ID NO: 620210 - RNA, 24 nt, Escherichia coli CFT073
ucuucccgaggcauuccuuuacuu

SEQ ID NO: 620211 - RNA, 13 nt, Escherichia coli CFT073
ucuucccgcagcc

SEQ ID NO: 620212 - RNA, 15 nt, Escherichia coli CFT073
ucuucauuaccuuca

SEQ ID NO: 620213 - RNA, 18 nt, Escherichia coli CFT073
ucuucaucgcgcaaaauu

SEQ ID NO: 620214 - RNA, 19 nt, Escherichia coli CFT073
ucuucaucgcgcaaaauuu

SEQ ID NO: 620215 - RNA, 21 nt, Escherichia coli CFT073
ucuucaucgcgcaaaauuucu

SEQ ID NO: 620216 - RNA, 13 nt, Escherichia coli CFT073
ucuucaucaccga

SEQ ID NO: 620217 - RNA, 20 nt, Escherichia coli CFT073
ucugcgcauuucccagcaag

SEQ ID NO: 620218 - RNA, 13 nt, Escherichia coli CFT073
ucugcgccagcga

SEQ ID NO: 620219 - RNA, 15 nt, Escherichia coli CFT073
ucugcgcccagcaac

SEQ ID NO: 620220 - RNA, 21 nt, Escherichia coli CFT073
ucugcgaauugagaugacgcc

SEQ ID NO: 620221 - RNA, 13 nt, Escherichia coli CFT073
ucugcgacagcca

SEQ ID NO: 620222 - RNA, 21 nt, Escherichia coli CFT073
ucugcgacuguucgccaaaag

SEQ ID NO: 620223 - RNA, 19 nt, Escherichia coli CFT073
ucugcgacgugcccuuuca

SEQ ID NO: 620224 - RNA, 21 nt, Escherichia coli CFT073
ucugcgagcuuucgaccagcc

SEQ ID NO: 620225 - RNA, 13 nt, Escherichia coli CFT073
ucugccgcaauuc

SEQ ID NO: 620226 - RNA, 22 nt, Escherichia coli CFT073
ucugccgggaagcucucuucca

SEQ ID NO: 620227 - RNA, 16 nt, Escherichia coli CFT073
ucugccuggucaaaga

SEQ ID NO: 620228 - RNA, 17 nt, Escherichia coli CFT073
ucugccugaucuuucug

SEQ ID NO: 620229 - RNA, 13 nt, Escherichia coli CFT073
ucugccucccauu

SEQ ID NO: 620230 - RNA, 15 nt, Escherichia coli CFT073
ucugauuuucuucca

SEQ ID NO: 620231 - RNA, 22 nt, Escherichia coli CFT073
ucugcaaaauaccaauaaucaa

SEQ ID NO: 620232 - RNA, 19 nt, Escherichia coli CFT073
ucugauucccugccugaca

SEQ ID NO: 620233 - RNA, 19 nt, Escherichia coli CFT073
ucugauuccgggccaccau

SEQ ID NO: 620234 - RNA, 18 nt, Escherichia coli CFT073
ucugcaaauuaugccuga

SEQ ID NO: 620235 - RNA, 19 nt, Escherichia coli CFT073
ucugccaggugcagcccau

SEQ ID NO: 620236 - RNA, 18 nt, Escherichia coli CFT073
ucugccaguacugcaggu

SEQ ID NO: 620237 - RNA, 21 nt, Escherichia coli CFT073
ucugccaucauggcauccugu

SEQ ID NO: 620238 - RNA, 23 nt, Escherichia coli CFT073
ucugccauccguaauuauuacuc

SEQ ID NO: 620239 - RNA, 21 nt, Escherichia coli CFT073
ucugccauuguugcuggaucc

SEQ ID NO: 620240 - RNA, 22 nt, Escherichia coli CFT073
ucugccgcauggaaccaguuca

SEQ ID NO: 620241 - RNA, 19 nt, Escherichia coli CFT073
ucugccccgccaacagugc

SEQ ID NO: 620242 - RNA, 12 nt, Escherichia coli CFT073
ucugcccggcau

SEQ ID NO: 620243 - RNA, 23 nt, Escherichia coli CFT073
ucugcccaaaauugacuaucuga

SEQ ID NO: 620244 - RNA, 15 nt, Escherichia coli CFT073
ucuggcgaauuuaua

SEQ ID NO: 620245 - RNA, 20 nt, Escherichia coli CFT073
ucuggcgcaacacccugaug

SEQ ID NO: 620246 - RNA, 13 nt, Escherichia coli CFT073
ucuggaagaauag

SEQ ID NO: 620247 - RNA, 19 nt, Escherichia coli CFT073
ucuggaagaauagucauca

SEQ ID NO: 620248 - RNA, 20 nt, Escherichia coli CFT073
ucuggaaauuaagcggcaaa

SEQ ID NO: 620249 - RNA, 13 nt, Escherichia coli CFT073
ucuggagaaauau

SEQ ID NO: 620250 - RNA, 11 nt, Escherichia coli CFT073
ucuggauauac

SEQ ID NO: 620251 - RNA, 12 nt, Escherichia coli CFT073
ucugcuggcaaa

SEQ ID NO: 620252 - RNA, 16 nt, Escherichia coli CFT073
ucugcuaauaauguaa

SEQ ID NO: 620253 - RNA, 23 nt, Escherichia coli CFT073
ucugcgcuauccagcgcauagcu

SEQ ID NO: 620254 - RNA, 13 nt, Escherichia coli CFT073
ucugaugaaagca

SEQ ID NO: 620255 - RNA, 23 nt, Escherichia coli CFT073
ucugaugacugauauccagccag

SEQ ID NO: 620256 - RNA, 17 nt, Escherichia coli CFT073
ucugaugauauuuuucc

SEQ ID NO: 620257 - RNA, 20 nt, Escherichia coli CFT073
ucugagcaucacauaaucga

SEQ ID NO: 620258 - RNA, 22 nt, Escherichia coli CFT073
ucugagcccacuguuugaucug

SEQ ID NO: 620259 - RNA, 15 nt, Escherichia coli CFT073
ucugaauauguuugg

SEQ ID NO: 620260 - RNA, 21 nt, Escherichia coli CFT073
ucugaauauucggcuccagau

SEQ ID NO: 620261 - RNA, 22 nt, Escherichia coli CFT073
ucugaauugaauagauauagcc

SEQ ID NO: 620262 - RNA, 22 nt, Escherichia coli CFT073
ucugaauuuuaaguaugggauc

SEQ ID NO: 620263 - RNA, 23 nt, Escherichia coli CFT073
ucugacaaaaucaauauaaacag

SEQ ID NO: 620264 - RNA, 21 nt, Escherichia coli CFT073
ucugacguucagccgcuuuau

SEQ ID NO: 620265 - RNA, 15 nt, Escherichia coli CFT073
ucucuuucuuugaau

SEQ ID NO: 620266 - RNA, 13 nt, Escherichia coli CFT073
ucugaagacgccu

SEQ ID NO: 620267 - RNA, 15 nt, Escherichia coli CFT073
ucugaaguaaagaaa

SEQ ID NO: 620268 - RNA, 18 nt, Escherichia coli CFT073
ucucgucacuuuucuuaa

SEQ ID NO: 620269 - RNA, 22 nt, Escherichia coli CFT073
ucucgggaaggcccuuucccuu

SEQ ID NO: 620270 - RNA, 15 nt, Escherichia coli CFT073
ucucggcuuugguau

SEQ ID NO: 620271 - RNA, 18 nt, Escherichia coli CFT073
ucgcauuucgcaucaaug

SEQ ID NO: 620272 - RNA, 14 nt, Escherichia coli CFT073
ucgcaugccagcgc

SEQ ID NO: 620273 - RNA, 20 nt, Escherichia coli CFT073
ucgcauccggcaauucucac

SEQ ID NO: 620274 - RNA, 19 nt, Escherichia coli CFT073
ucgcauccggcauuaucac

SEQ ID NO: 620275 - RNA, 16 nt, Escherichia coli CFT073
ucgcaucuggucagau

SEQ ID NO: 620276 - RNA, 21 nt, Escherichia coli CFT073
ucgcaucaggccuacaugcca

SEQ ID NO: 620277 - RNA, 16 nt, Escherichia coli CFT073
ucgcaucaggcaugau

SEQ ID NO: 620278 - RNA, 11 nt, Escherichia coli CFT073
ucucuucccac

SEQ ID NO: 620279 - RNA, 17 nt, Escherichia coli CFT073
ucucuucaccugccugc

SEQ ID NO: 620280 - RNA, 14 nt, Escherichia coli CFT073
ucucuucagccaac

SEQ ID NO: 620281 - RNA, 24 nt, Escherichia coli CFT073
ucucuucaacacgacgcauugcca

SEQ ID NO: 620282 - RNA, 22 nt, Escherichia coli CFT073
ucucuaagucuuucugugcaau

SEQ ID NO: 620283 - RNA, 20 nt, Escherichia coli CFT073
ugaccaaagaaguucuccau

SEQ ID NO: 620284 - RNA, 18 nt, Escherichia coli CFT073
ugacauuaucagacaccg

SEQ ID NO: 620285 - RNA, 20 nt, Escherichia coli CFT073
ugacauucugacuggucagu

SEQ ID NO: 620286 - RNA, 22 nt, Escherichia coli CFT073
ugacaucgcccucuuucaccag

SEQ ID NO: 620287 - RNA, 15 nt, Escherichia coli CFT073
ugacaucgcccugau

SEQ ID NO: 620288 - RNA, 23 nt, Escherichia coli CFT073
ugacaucgcuuaguuaaaccagc

SEQ ID NO: 620289 - RNA, 20 nt, Escherichia coli CFT073
ugacauggcaauagcuucuu

SEQ ID NO: 620290 - RNA, 19 nt, Escherichia coli CFT073
ugacaugaaugucauacca

SEQ ID NO: 620291 - RNA, 23 nt, Escherichia coli CFT073
ugacaugaaugucauaccacaua

SEQ ID NO: 620292 - RNA, 12 nt, Escherichia coli CFT073
ugaauaacuucc

SEQ ID NO: 620293 - RNA, 13 nt, Escherichia coli CFT073
ugaauaacuuccu

SEQ ID NO: 620294 - RNA, 14 nt, Escherichia coli CFT073
ugaauaacuuccug

SEQ ID NO: 620295 - RNA, 23 nt, Escherichia coli CFT073
ugaauaacuuccuguaaccaccg

SEQ ID NO: 620296 - RNA, 22 nt, Escherichia coli CFT073
ugacauccacguuucuucuaau

SEQ ID NO: 620297 - RNA, 19 nt, Escherichia coli CFT073
ugacauccagaucacgcag

SEQ ID NO: 620298 - RNA, 18 nt, Escherichia coli CFT073
ugacccagaccgauacac

SEQ ID NO: 620299 - RNA, 12 nt, Escherichia coli CFT073
ugacccagaccg

SEQ ID NO: 620300 - RNA, 16 nt, Escherichia coli CFT073
ugaccacuuugcgcuc

SEQ ID NO: 620301 - RNA, 13 nt, Escherichia coli CFT073
ugaccacaaagca

SEQ ID NO: 620302 - RNA, 16 nt, Escherichia coli CFT073
ugaccaccaacccaac

SEQ ID NO: 620303 - RNA, 22 nt, Escherichia coli CFT073
ugaccaccaacccaacuuauug

SEQ ID NO: 620304 - RNA, 22 nt, Escherichia coli CFT073
ugaccaccaauaaccggcacuu

SEQ ID NO: 620305 - RNA, 21 nt, Escherichia coli CFT073
ugaccaccaccaccugcaucu

SEQ ID NO: 620306 - RNA, 12 nt, Escherichia coli CFT073
ugaccaccagca

SEQ ID NO: 620307 - RNA, 13 nt, Escherichia coli CFT073
ugacccagcacca

SEQ ID NO: 620308 - RNA, 15 nt, Escherichia coli CFT073
ugaccccggcggcua

SEQ ID NO: 620309 - RNA, 18 nt, Escherichia coli CFT073
ugacccgcagccagcacu

SEQ ID NO: 620310 - RNA, 19 nt, Escherichia coli CFT073
ugacccgcagccagcacug

SEQ ID NO: 620311 - RNA, 18 nt, Escherichia coli CFT073
ugacccucucggcauaua

SEQ ID NO: 620312 - RNA, 15 nt, Escherichia coli CFT073
ugacgcagcagaccg

SEQ ID NO: 620313 - RNA, 19 nt, Escherichia coli CFT073
ugacgccaucaacgaaaga

SEQ ID NO: 620314 - RNA, 14 nt, Escherichia coli CFT073
ugacgccacaacga

SEQ ID NO: 620315 - RNA, 15 nt, Escherichia coli CFT073
ugacgccacuggcug

SEQ ID NO: 620316 - RNA, 22 nt, Escherichia coli CFT073
ugacgauaggucauaucaucaa

SEQ ID NO: 620317 - RNA, 14 nt, Escherichia coli CFT073
ugacgaugauuguc

SEQ ID NO: 620318 - RNA, 14 nt, Escherichia coli CFT073
ugacgccauucuca

SEQ ID NO: 620319 - RNA, 16 nt, Escherichia coli CFT073
ugacgccauucucacc

SEQ ID NO: 620320 - RNA, 22 nt, Escherichia coli CFT073
ugacgccccuggcgaugccccc

SEQ ID NO: 620321 - RNA, 16 nt, Escherichia coli CFT073
ugacgccugcuccauc

SEQ ID NO: 620322 - RNA, 21 nt, Escherichia coli CFT073
ugacgcucucaacgcccugua

SEQ ID NO: 620323 - RNA, 14 nt, Escherichia coli CFT073
ugacgcucugcuuu

SEQ ID NO: 620324 - RNA, 21 nt, Escherichia coli CFT073
ugacgcggugcuuccggaaca

SEQ ID NO: 620325 - RNA, 23 nt, Escherichia coli CFT073
ugaccucagguucaaccgcagcu

SEQ ID NO: 620326 - RNA, 18 nt, Escherichia coli CFT073
ugacgacaccugcuauuc

SEQ ID NO: 620327 - RNA, 18 nt, Escherichia coli CFT073
ugacgauaaaagugcaga

SEQ ID NO: 620328 - RNA, 13 nt, Escherichia coli CFT073
ugacgaccagucc

SEQ ID NO: 620329 - RNA, 23 nt, Escherichia coli CFT073
ugacgaccaugcgcgugauacug

SEQ ID NO: 620330 - RNA, 22 nt, Escherichia coli CFT073
ugaccuagcaaacuaucugugu

SEQ ID NO: 620331 - RNA, 17 nt, Escherichia coli CFT073
ugaccuauuucauucag

SEQ ID NO: 620332 - RNA, 18 nt, Escherichia coli CFT073
ugaccgucaaacaugccg

SEQ ID NO: 620333 - RNA, 19 nt, Escherichia coli CFT073
ugaccgguugcuggaucaa

SEQ ID NO: 620334 - RNA, 19 nt, Escherichia coli CFT073
ugaccgaaccuguuuucac

SEQ ID NO: 620335 - RNA, 20 nt, Escherichia coli CFT073
ugaccgacaccggcagagau

SEQ ID NO: 620336 - RNA, 15 nt, Escherichia coli CFT073
ugaccgggauuuuca

SEQ ID NO: 620337 - RNA, 22 nt, Escherichia coli CFT073
ugaccgauaugaauaauuucgg

SEQ ID NO: 620338 - RNA, 19 nt, Escherichia coli CFT073
ugagacgguuaaaaacagc

SEQ ID NO: 620339 - RNA, 21 nt, Escherichia coli CFT073
ugagaggacaaauaaggaaaa

SEQ ID NO: 620340 - RNA, 21 nt, Escherichia coli CFT073
ugagaacuucggcagagaaag

SEQ ID NO: 620341 - RNA, 13 nt, Escherichia coli CFT073
ugagaccagacca

SEQ ID NO: 620342 - RNA, 20 nt, Escherichia coli CFT073
ugagaccagaccauacagug

SEQ ID NO: 620343 - RNA, 17 nt, Escherichia coli CFT073
ugagaaauauuuucagg

SEQ ID NO: 620344 - RNA, 18 nt, Escherichia coli CFT073
ugagaacacgaccugcca

SEQ ID NO: 620345 - RNA, 20 nt, Escherichia coli CFT073
ugacucggcugcugccagca

SEQ ID NO: 620346 - RNA, 17 nt, Escherichia coli CFT073
ugacuccugacagguau

SEQ ID NO: 620347 - RNA, 21 nt, Escherichia coli CFT073
ugacucgccgcaaaacccagg

SEQ ID NO: 620348 - RNA, 17 nt, Escherichia coli CFT073
ugacucauaaaaauaua

SEQ ID NO: 620349 - RNA, 22 nt, Escherichia coli CFT073
ugacucaggaaccgaucagauu

SEQ ID NO: 620350 - RNA, 14 nt, Escherichia coli CFT073
ugacugaagaaauc

SEQ ID NO: 620351 - RNA, 17 nt, Escherichia coli CFT073
ugacucggguucuacaa

SEQ ID NO: 620352 - RNA, 15 nt, Escherichia coli CFT073
ugacuuccgccacca

SEQ ID NO: 620353 - RNA, 17 nt, Escherichia coli CFT073
ugacuguuuuuccagcu

SEQ ID NO: 620354 - RNA, 13 nt, Escherichia coli CFT073
ugacuuaaaucuc

SEQ ID NO: 620355 - RNA, 17 nt, Escherichia coli CFT073
ugacuuacuuccugucu

SEQ ID NO: 620356 - RNA, 21 nt, Escherichia coli CFT073
ugacugaaucaggaaccacaa

SEQ ID NO: 620357 - RNA, 15 nt, Escherichia coli CFT073
ugacugacagacugc

SEQ ID NO: 620358 - RNA, 12 nt, Escherichia coli CFT073
ugacgcugcuca

SEQ ID NO: 620359 - RNA, 16 nt, Escherichia coli CFT073
ugacgcugcucaggcg

SEQ ID NO: 620360 - RNA, 16 nt, Escherichia coli CFT073
ugacgcuggcagaaag

SEQ ID NO: 620361 - RNA, 16 nt, Escherichia coli CFT073
ugacgcuggcagcaga

SEQ ID NO: 620362 - RNA, 17 nt, Escherichia coli CFT073
ugacgcuggcagcagaa

SEQ ID NO: 620363 - RNA, 20 nt, Escherichia coli CFT073
ugacggaucuuccagcgcau

SEQ ID NO: 620364 - RNA, 14 nt, Escherichia coli CFT073
ugacguccagaacc

SEQ ID NO: 620365 - RNA, 19 nt, Escherichia coli CFT073
ugacguagcagcuccgcca

SEQ ID NO: 620366 - RNA, 19 nt, Escherichia coli CFT073
ugacuaagcguuuucugcc

SEQ ID NO: 620367 - RNA, 15 nt, Escherichia coli CFT073
ugacuacaaaaaaag

SEQ ID NO: 620368 - RNA, 19 nt, Escherichia coli CFT073
ugacuacaaaaaaagccac

SEQ ID NO: 620369 - RNA, 13 nt, Escherichia coli CFT073
ugacuagcagcau

SEQ ID NO: 620370 - RNA, 16 nt, Escherichia coli CFT073
ugacuaucugacuuuc

SEQ ID NO: 620371 - RNA, 21 nt, Escherichia coli CFT073
ugacgugugauaaugucagac

SEQ ID NO: 620372 - RNA, 13 nt, Escherichia coli CFT073
ugacgugauuggu

SEQ ID NO: 620373 - RNA, 15 nt, Escherichia coli CFT073
ugacgugcacaaacu

SEQ ID NO: 620374 - RNA, 14 nt, Escherichia coli CFT073
ugacgucucaauca

SEQ ID NO: 620375 - RNA, 14 nt, Escherichia coli CFT073
ugacguuauuggug

SEQ ID NO: 620376 - RNA, 21 nt, Escherichia coli CFT073
ugaucgcgcaguuuaugcagu

SEQ ID NO: 620377 - RNA, 18 nt, Escherichia coli CFT073
ugaucgcaauucuucauu

SEQ ID NO: 620378 - RNA, 15 nt, Escherichia coli CFT073
ugaucgauaagccag

SEQ ID NO: 620379 - RNA, 16 nt, Escherichia coli CFT073
ugaucgauaagccagc

SEQ ID NO: 620380 - RNA, 15 nt, Escherichia coli CFT073
ugaucugcaaauuca

SEQ ID NO: 620381 - RNA, 15 nt, Escherichia coli CFT073
ugaucugccccauag

SEQ ID NO: 620382 - RNA, 21 nt, Escherichia coli CFT073
ugaucugugugguuuuguagu

SEQ ID NO: 620383 - RNA, 20 nt, Escherichia coli CFT073
ugaugaagucaggugaaauu

SEQ ID NO: 620384 - RNA, 15 nt, Escherichia coli CFT073
ugaucuucucuuaua

SEQ ID NO: 620385 - RNA, 18 nt, Escherichia coli CFT073
ugaugaaguugaaaucac

SEQ ID NO: 620386 - RNA, 12 nt, Escherichia coli CFT073
ugaucuuccuga

SEQ ID NO: 620387 - RNA, 19 nt, Escherichia coli CFT073
ugauauguucucuaaucuc

SEQ ID NO: 620388 - RNA, 18 nt, Escherichia coli CFT073
ugauauguuuuaaagcga

SEQ ID NO: 620389 - RNA, 15 nt, Escherichia coli CFT073
ugaucagccacaguu

SEQ ID NO: 620390 - RNA, 21 nt, Escherichia coli CFT073
ugaucagccacaguuuuccgc

SEQ ID NO: 620391 - RNA, 17 nt, Escherichia coli CFT073
ugaucagccucucucug

SEQ ID NO: 620392 - RNA, 23 nt, Escherichia coli CFT073
ugaucagccucucucugagggug

SEQ ID NO: 620393 - RNA, 23 nt, Escherichia coli CFT073
ugaucaguucuuugauuucgucc

SEQ ID NO: 620394 - RNA, 14 nt, Escherichia coli CFT073
ugauccgugaugau

SEQ ID NO: 620395 - RNA, 14 nt, Escherichia coli CFT073
ugauccucuauaaa

SEQ ID NO: 620396 - RNA, 12 nt, Escherichia coli CFT073
ugauccugagcu

SEQ ID NO: 620397 - RNA, 17 nt, Escherichia coli CFT073
ugauccugcaacaacac

SEQ ID NO: 620398 - RNA, 21 nt, Escherichia coli CFT073
ugauccugcaacaacaccagc

SEQ ID NO: 620399 - RNA, 17 nt, Escherichia coli CFT073
ugauccuggauuucuuc

SEQ ID NO: 620400 - RNA, 18 nt, Escherichia coli CFT073
ugaucgacaguugcugcg

SEQ ID NO: 620401 - RNA, 11 nt, Escherichia coli CFT073
ugaucaucauu

SEQ ID NO: 620402 - RNA, 23 nt, Escherichia coli CFT073
ugaucauccgccucuaacagauc

SEQ ID NO: 620403 - RNA, 17 nt, Escherichia coli CFT073
ugauauccagccagguc

SEQ ID NO: 620404 - RNA, 22 nt, Escherichia coli CFT073
ugauaucccguacaguuuccuu

SEQ ID NO: 620405 - RNA, 14 nt, Escherichia coli CFT073
ugauauaccguaga

SEQ ID NO: 620406 - RNA, 22 nt, Escherichia coli CFT073
ugauauaccguagauucgggcu

SEQ ID NO: 620407 - RNA, 22 nt, Escherichia coli CFT073
ugauagcaaugccaucaccaac

SEQ ID NO: 620408 - RNA, 22 nt, Escherichia coli CFT073
ugauagcccaacgaucccaacu

SEQ ID NO: 620409 - RNA, 15 nt, Escherichia coli CFT073
ugauacuauucauug

SEQ ID NO: 620410 - RNA, 19 nt, Escherichia coli CFT073
ugauacucaacucacacaa

SEQ ID NO: 620411 - RNA, 19 nt, Escherichia coli CFT073
ugauacgggaggucaucag

SEQ ID NO: 620412 - RNA, 23 nt, Escherichia coli CFT073
ugauacgagcaaaagccuuaucc

SEQ ID NO: 620413 - RNA, 19 nt, Escherichia coli CFT073
ugauacgcgcaccggaaca

SEQ ID NO: 620414 - RNA, 20 nt, Escherichia coli CFT073
ugauacgcgccaaucggcaa

SEQ ID NO: 620415 - RNA, 15 nt, Escherichia coli CFT073
ugauaauaauucaga

SEQ ID NO: 620416 - RNA, 14 nt, Escherichia coli CFT073
ugauaccgugcagc

SEQ ID NO: 620417 - RNA, 21 nt, Escherichia coli CFT073
ugagugccagauugaagcaga

SEQ ID NO: 620418 - RNA, 15 nt, Escherichia coli CFT073
ugagugaggcguggc

SEQ ID NO: 620419 - RNA, 15 nt, Escherichia coli CFT073
ugagugcgaaacaga

SEQ ID NO: 620420 - RNA, 21 nt, Escherichia coli CFT073
ugaggucugaccguucgcccc

SEQ ID NO: 620421 - RNA, 21 nt, Escherichia coli CFT073
ugaggcguuucaacucccacc

SEQ ID NO: 620422 - RNA, 13 nt, Escherichia coli CFT073
ugagggcaauaau

SEQ ID NO: 620423 - RNA, 16 nt, Escherichia coli CFT073
ugaggguauccaggcc

SEQ ID NO: 620424 - RNA, 12 nt, Escherichia coli CFT073
ugauaaaaaacc

SEQ ID NO: 620425 - RNA, 15 nt, Escherichia coli CFT073
ugauaaaaaacccgc

SEQ ID NO: 620426 - RNA, 16 nt, Escherichia coli CFT073
ugauaaaccuccagca

SEQ ID NO: 620427 - RNA, 16 nt, Escherichia coli CFT073
ugaguuaauuaaaucc

SEQ ID NO: 620428 - RNA, 13 nt, Escherichia coli CFT073
ugaguuaccugau

SEQ ID NO: 620429 - RNA, 16 nt, Escherichia coli CFT073
ugaguuagcacaacca

SEQ ID NO: 620430 - RNA, 14 nt, Escherichia coli CFT073
ugaguuauuucauu

SEQ ID NO: 620431 - RNA, 14 nt, Escherichia coli CFT073
ugaguucaccgcca

SEQ ID NO: 620432 - RNA, 15 nt, Escherichia coli CFT073
ugagauuucaccaau

SEQ ID NO: 620433 - RNA, 23 nt, Escherichia coli CFT073
ugagcaaacagucgcccgaccau

SEQ ID NO: 620434 - RNA, 13 nt, Escherichia coli CFT073
ugagcaaacaguu

SEQ ID NO: 620435 - RNA, 20 nt, Escherichia coli CFT073
ugagcaaacaguucugcagc

SEQ ID NO: 620436 - RNA, 13 nt, Escherichia coli CFT073
ugagcgucauuau

SEQ ID NO: 620437 - RNA, 18 nt, Escherichia coli CFT073
ugagcaaggcauaggcuu

SEQ ID NO: 620438 - RNA, 17 nt, Escherichia coli CFT073
ugagcggagcacaucag

SEQ ID NO: 620439 - RNA, 20 nt, Escherichia coli CFT073
ugagcugcgcgacucccuga

SEQ ID NO: 620440 - RNA, 19 nt, Escherichia coli CFT073
ugagcucgugcaucugaag

SEQ ID NO: 620441 - RNA, 22 nt, Escherichia coli CFT073
ugagcgugagguuaucgcccug

SEQ ID NO: 620442 - RNA, 22 nt, Escherichia coli CFT073
ugaggacgguaaauacugguca

SEQ ID NO: 620443 - RNA, 23 nt, Escherichia coli CFT073
ugaggcggucuguauuuggcugc

SEQ ID NO: 620444 - RNA, 16 nt, Escherichia coli CFT073
ugaggcguaauauaaa

SEQ ID NO: 620445 - RNA, 18 nt, Escherichia coli CFT073
ugcauucggcgaccagcg

SEQ ID NO: 620446 - RNA, 17 nt, Escherichia coli CFT073
ugcauugcgcugaacau

SEQ ID NO: 620447 - RNA, 22 nt, Escherichia coli CFT073
ugcauuccaguccacaucaacc

SEQ ID NO: 620448 - RNA, 19 nt, Escherichia coli CFT073
ugcauugaaggcaauugca

SEQ ID NO: 620449 - RNA, 22 nt, Escherichia coli CFT073
ugcauuccagaugaacggcuuu

SEQ ID NO: 620450 - RNA, 20 nt, Escherichia coli CFT073
ugcauuccaguccacaucaa

SEQ ID NO: 620451 - RNA, 14 nt, Escherichia coli CFT073
ugcaucuucauuaa

SEQ ID NO: 620452 - RNA, 20 nt, Escherichia coli CFT073
ugcaucuacgcucucuucaa

SEQ ID NO: 620453 - RNA, 18 nt, Escherichia coli CFT073
ugcaucuauagcacucuc

SEQ ID NO: 620454 - RNA, 21 nt, Escherichia coli CFT073
ugcaucuccggcgcauccaug

SEQ ID NO: 620455 - RNA, 23 nt, Escherichia coli CFT073
ugcaucuccggcgcauccaugau

SEQ ID NO: 620456 - RNA, 22 nt, Escherichia coli CFT073
ugcaucuccugauuuucuucau

SEQ ID NO: 620457 - RNA, 11 nt, Escherichia coli CFT073
ugcaucggcaa

SEQ ID NO: 620458 - RNA, 18 nt, Escherichia coli CFT073
ugcaucggggaauugugc

SEQ ID NO: 620459 - RNA, 14 nt, Escherichia coli CFT073
ugcaucaucaaggu

SEQ ID NO: 620460 - RNA, 19 nt, Escherichia coli CFT073
ugcauuugaacuggaaaaa

SEQ ID NO: 620461 - RNA, 17 nt, Escherichia coli CFT073
ugccaaucggcggcacu

SEQ ID NO: 620462 - RNA, 21 nt, Escherichia coli CFT073
ugccaaucuucacaucaucau

SEQ ID NO: 620463 - RNA, 13 nt, Escherichia coli CFT073
ugcauugucagug

SEQ ID NO: 620464 - RNA, 19 nt, Escherichia coli CFT073
ugcauuuccgcugauucaa

SEQ ID NO: 620465 - RNA, 12 nt, Escherichia coli CFT073
ugcauuucugga

SEQ ID NO: 620466 - RNA, 13 nt, Escherichia coli CFT073
ugccaccaggcag

SEQ ID NO: 620467 - RNA, 17 nt, Escherichia coli CFT073
ugccaccagguucaaca

SEQ ID NO: 620468 - RNA, 14 nt, Escherichia coli CFT073
ugccaccagugccg

SEQ ID NO: 620469 - RNA, 19 nt, Escherichia coli CFT073
ugccaccauccccaccaaa

SEQ ID NO: 620470 - RNA, 19 nt, Escherichia coli CFT073
ugccaccauucccuggcgu

SEQ ID NO: 620471 - RNA, 17 nt, Escherichia coli CFT073
ugccaccagcauuccua

SEQ ID NO: 620472 - RNA, 19 nt, Escherichia coli CFT073
ugccaccagcauuccuaaa

SEQ ID NO: 620473 - RNA, 15 nt, Escherichia coli CFT073
ugccaccagcgcaau

SEQ ID NO: 620474 - RNA, 19 nt, Escherichia coli CFT073
ugcagcucauauuccugca

SEQ ID NO: 620475 - RNA, 15 nt, Escherichia coli CFT073
ugcagcuccccacac

SEQ ID NO: 620476 - RNA, 17 nt, Escherichia coli CFT073
ugcagcucgcacgccac

SEQ ID NO: 620477 - RNA, 14 nt, Escherichia coli CFT073
ugcagguucuuuua

SEQ ID NO: 620478 - RNA, 21 nt, Escherichia coli CFT073
ugcagugaucgugugccacca

SEQ ID NO: 620479 - RNA, 16 nt, Escherichia coli CFT073
ugcaguaacugcugua

SEQ ID NO: 620480 - RNA, 14 nt, Escherichia coli CFT073
ugcaguagcagcag

SEQ ID NO: 620481 - RNA, 23 nt, Escherichia coli CFT073
ugcaguagcagcaggaauaauca

SEQ ID NO: 620482 - RNA, 13 nt, Escherichia coli CFT073
ugcaguagccagu

SEQ ID NO: 620483 - RNA, 15 nt, Escherichia coli CFT073
ugcaguaaaccacau

SEQ ID NO: 620484 - RNA, 17 nt, Escherichia coli CFT073
ugcagucaccugcccuc

SEQ ID NO: 620485 - RNA, 14 nt, Escherichia coli CFT073
ugcagucagccagc

SEQ ID NO: 620486 - RNA, 15 nt, Escherichia coli CFT073
ugcauaaaugccgca

SEQ ID NO: 620487 - RNA, 22 nt, Escherichia coli CFT073
ugcauaagucccgaccacacaa

SEQ ID NO: 620488 - RNA, 23 nt, Escherichia coli CFT073
ugcauaaucgcuacgccuuccgu

SEQ ID NO: 620489 - RNA, 16 nt, Escherichia coli CFT073
ugcauaaacaccugcg

SEQ ID NO: 620490 - RNA, 14 nt, Escherichia coli CFT073
ugcauaaaaauugc

SEQ ID NO: 620491 - RNA, 17 nt, Escherichia coli CFT073
ugcauacucgcgucugg

SEQ ID NO: 620492 - RNA, 21 nt, Escherichia coli CFT073
ugcauacucgcgucuggcauu

SEQ ID NO: 620493 - RNA, 13 nt, Escherichia coli CFT073
ugcauacauaaau

SEQ ID NO: 620494 - RNA, 11 nt, Escherichia coli CFT073
ugcaucaacca

SEQ ID NO: 620495 - RNA, 17 nt, Escherichia coli CFT073
ugcaucacgcucgcagg

SEQ ID NO: 620496 - RNA, 14 nt, Escherichia coli CFT073
ugcacagcucugaa

SEQ ID NO: 620497 - RNA, 23 nt, Escherichia coli CFT073
ugcacagcucugaauaaacggua

SEQ ID NO: 620498 - RNA, 22 nt, Escherichia coli CFT073
ugcaccaacccuaacccaacau

SEQ ID NO: 620499 - RNA, 17 nt, Escherichia coli CFT073
ugcaccaaguucuucac

SEQ ID NO: 620500 - RNA, 20 nt, Escherichia coli CFT073
ugcacauccacgccuuuuuu

SEQ ID NO: 620501 - RNA, 22 nt, Escherichia coli CFT073
ugcacaagcggcaguuucagcc

SEQ ID NO: 620502 - RNA, 20 nt, Escherichia coli CFT073
ugcacaccgcggaacgcacu

SEQ ID NO: 620503 - RNA, 20 nt, Escherichia coli CFT073
ugcacagacuuaauauugcc

SEQ ID NO: 620504 - RNA, 16 nt, Escherichia coli CFT073
ugcacagagcuaugaa

SEQ ID NO: 620505 - RNA, 18 nt, Escherichia coli CFT073
ugcaccguuggacggucu

SEQ ID NO: 620506 - RNA, 21 nt, Escherichia coli CFT073
ugcaccucauccugacaggcc

SEQ ID NO: 620507 - RNA, 18 nt, Escherichia coli CFT073
ugcaccugauccagcucu

SEQ ID NO: 620508 - RNA, 23 nt, Escherichia coli CFT073
ugcaccugauccagcucuuccuc

SEQ ID NO: 620509 - RNA, 16 nt, Escherichia coli CFT073
ugcaccagcaauaagc

SEQ ID NO: 620510 - RNA, 22 nt, Escherichia coli CFT073
ugcaccacuguuuuucagcacg

SEQ ID NO: 620511 - RNA, 16 nt, Escherichia coli CFT073
ugcaccagaacucccu

SEQ ID NO: 620512 - RNA, 18 nt, Escherichia coli CFT073
ugcaccaucaggcauauu

SEQ ID NO: 620513 - RNA, 18 nt, Escherichia coli CFT073
ugcacuucuucacaucaa

SEQ ID NO: 620514 - RNA, 21 nt, Escherichia coli CFT073
ugcagaucgccagagucagca

SEQ ID NO: 620515 - RNA, 19 nt, Escherichia coli CFT073
ugcagauuugccaguaccg

SEQ ID NO: 620516 - RNA, 18 nt, Escherichia coli CFT073
ugcagcaaauaguaagaa

SEQ ID NO: 620517 - RNA, 15 nt, Escherichia coli CFT073
ugcacuucaaauuuc

SEQ ID NO: 620518 - RNA, 17 nt, Escherichia coli CFT073
ugcacugucccaaaaug

SEQ ID NO: 620519 - RNA, 20 nt, Escherichia coli CFT073
ugcacugucccaaaaugucg

SEQ ID NO: 620520 - RNA, 15 nt, Escherichia coli CFT073
ugcacugcucauuaa

SEQ ID NO: 620521 - RNA, 22 nt, Escherichia coli CFT073
ugcacuacgcagggauauuuca

SEQ ID NO: 620522 - RNA, 20 nt, Escherichia coli CFT073
ugcacucagguaacagggaa

SEQ ID NO: 620523 - RNA, 14 nt, Escherichia coli CFT073
ugcacucguaacau

SEQ ID NO: 620524 - RNA, 11 nt, Escherichia coli CFT073
ugcagcagcaa

SEQ ID NO: 620525 - RNA, 18 nt, Escherichia coli CFT073
ugcagcacucgauuccaa

SEQ ID NO: 620526 - RNA, 14 nt, Escherichia coli CFT073
ugcagcacugauaa

SEQ ID NO: 620527 - RNA, 16 nt, Escherichia coli CFT073
ugcagccauuuuacuc

SEQ ID NO: 620528 - RNA, 22 nt, Escherichia coli CFT073
ugcagccauuuuacucauggaa

SEQ ID NO: 620529 - RNA, 16 nt, Escherichia coli CFT073
ugcagcagacgcugca

SEQ ID NO: 620530 - RNA, 20 nt, Escherichia coli CFT073
ugcagcaagccacucagccc

SEQ ID NO: 620531 - RNA, 22 nt, Escherichia coli CFT073
ugcagcaacucugcuaacucau

SEQ ID NO: 620532 - RNA, 20 nt, Escherichia coli CFT073
ugcagcacacgauuccaacg

SEQ ID NO: 620533 - RNA, 22 nt, Escherichia coli CFT073
ugcagcguugcccccugaagca

SEQ ID NO: 620534 - RNA, 18 nt, Escherichia coli CFT073
ugcagcggccaguagcuu

SEQ ID NO: 620535 - RNA, 17 nt, Escherichia coli CFT073
ugcagcggguuaauuuc

SEQ ID NO: 620536 - RNA, 17 nt, Escherichia coli CFT073
ugcagccgucgcccaca

SEQ ID NO: 620537 - RNA, 20 nt, Escherichia coli CFT073
ugcagccguggaaugauuaa

SEQ ID NO: 620538 - RNA, 15 nt, Escherichia coli CFT073
ugcagccggagcuuc

SEQ ID NO: 620539 - RNA, 14 nt, Escherichia coli CFT073
ugcaauucggcuuu

SEQ ID NO: 620540 - RNA, 17 nt, Escherichia coli CFT073
ugcacaaacuucuucag

SEQ ID NO: 620541 - RNA, 22 nt, Escherichia coli CFT073
ugcaauuugugcgucauuuuca

SEQ ID NO: 620542 - RNA, 13 nt, Escherichia coli CFT073
ugcaauuuuuaua

SEQ ID NO: 620543 - RNA, 21 nt, Escherichia coli CFT073
ugcaauuguuuacuaaaaguu

SEQ ID NO: 620544 - RNA, 20 nt, Escherichia coli CFT073
ugcaaucuuuccugcacaau

SEQ ID NO: 620545 - RNA, 21 nt, Escherichia coli CFT073
ugcaaucuccuguugugaugc

SEQ ID NO: 620546 - RNA, 24 nt, Escherichia coli CFT073
ugcaaucuacaaaagauuauugcu

SEQ ID NO: 620547 - RNA, 21 nt, Escherichia coli CFT073
ugcaaucaguacguuaucacc

SEQ ID NO: 620548 - RNA, 17 nt, Escherichia coli CFT073
ugcaauccacaagcaca

SEQ ID NO: 620549 - RNA, 22 nt, Escherichia coli CFT073
ugcaauaauggaaccuaacgcu

SEQ ID NO: 620550 - RNA, 20 nt, Escherichia coli CFT073
ugcaauagcgccugcugcug

SEQ ID NO: 620551 - RNA, 21 nt, Escherichia coli CFT073
ugcaauauauugaauuagcaa

SEQ ID NO: 620552 - RNA, 22 nt, Escherichia coli CFT073
ugcaauaugguuauuaccaaaa

SEQ ID NO: 620553 - RNA, 19 nt, Escherichia coli CFT073
ugcaaucacugccaccagg

SEQ ID NO: 620554 - RNA, 16 nt, Escherichia coli CFT073
ugcaaguggaaauccc

SEQ ID NO: 620555 - RNA, 18 nt, Escherichia coli CFT073
ugcaagugagucggcuuu

SEQ ID NO: 620556 - RNA, 22 nt, Escherichia coli CFT073
ugcaagguggucagacggaaca

SEQ ID NO: 620557 - RNA, 20 nt, Escherichia coli CFT073
ugcaaguaguggaugaaucu

SEQ ID NO: 620558 - RNA, 20 nt, Escherichia coli CFT073
ugcaagaucgcgcaucagcu

SEQ ID NO: 620559 - RNA, 15 nt, Escherichia coli CFT073
ugcaaggagagccag

SEQ ID NO: 620560 - RNA, 16 nt, Escherichia coli CFT073
ugcaaggagagccagu

SEQ ID NO: 620561 - RNA, 20 nt, Escherichia coli CFT073
ugcaagccgcggaauuggcc

SEQ ID NO: 620562 - RNA, 17 nt, Escherichia coli CFT073
ugcaaggccaucggcag

SEQ ID NO: 620563 - RNA, 16 nt, Escherichia coli CFT073
ugcaaggcaacgcagc

SEQ ID NO: 620564 - RNA, 17 nt, Escherichia coli CFT073
ugcaaggcaacgcagcc

SEQ ID NO: 620565 - RNA, 13 nt, Escherichia coli CFT073
ugcaacguuuuaa

SEQ ID NO: 620566 - RNA, 17 nt, Escherichia coli CFT073
ugcaaccuuuuccauug

SEQ ID NO: 620567 - RNA, 20 nt, Escherichia coli CFT073
ugcaacugcccaggcaaaaa

SEQ ID NO: 620568 - RNA, 14 nt, Escherichia coli CFT073
ugcaacuggcugcc

SEQ ID NO: 620569 - RNA, 17 nt, Escherichia coli CFT073
ugcaacuguuuuaccaa

SEQ ID NO: 620570 - RNA, 18 nt, Escherichia coli CFT073
ugcaacuugaaguaugac

SEQ ID NO: 620571 - RNA, 16 nt, Escherichia coli CFT073
ugcaacuuuacuaaaa

SEQ ID NO: 620572 - RNA, 13 nt, Escherichia coli CFT073
ugcaacuuucaau

SEQ ID NO: 620573 - RNA, 17 nt, Escherichia coli CFT073
ugcaaaucggcaaucuc

SEQ ID NO: 620574 - RNA, 13 nt, Escherichia coli CFT073
ugcaaauuuuuaa

SEQ ID NO: 620575 - RNA, 11 nt, Escherichia coli CFT073
ugcaacaacac

SEQ ID NO: 620576 - RNA, 14 nt, Escherichia coli CFT073
ugcaacaacaccag

SEQ ID NO: 620577 - RNA, 19 nt, Escherichia coli CFT073
ugcaacaacucuaauucau

SEQ ID NO: 620578 - RNA, 21 nt, Escherichia coli CFT073
ugcaacacucguuucaaauuu

SEQ ID NO: 620579 - RNA, 15 nt, Escherichia coli CFT073
ugauugauuuuucca

SEQ ID NO: 620580 - RNA, 22 nt, Escherichia coli CFT073
ugauugccccuccgcacagggg

SEQ ID NO: 620581 - RNA, 19 nt, Escherichia coli CFT073
ugauugcacucgaccuuaa

SEQ ID NO: 620582 - RNA, 15 nt, Escherichia coli CFT073
ugauugaagaaauca

SEQ ID NO: 620583 - RNA, 16 nt, Escherichia coli CFT073
ugauugaagaaaucag

SEQ ID NO: 620584 - RNA, 17 nt, Escherichia coli CFT073
ugauuguuuuaaauauu

SEQ ID NO: 620585 - RNA, 17 nt, Escherichia coli CFT073
ugaugauaucacuggug

SEQ ID NO: 620586 - RNA, 14 nt, Escherichia coli CFT073
ugaugauugaccau

SEQ ID NO: 620587 - RNA, 22 nt, Escherichia coli CFT073
ugaugaucggcguacccagcgu

SEQ ID NO: 620588 - RNA, 20 nt, Escherichia coli CFT073
ugauuccggguagagaucuu

SEQ ID NO: 620589 - RNA, 19 nt, Escherichia coli CFT073
ugauucgacuaucuuauaa

SEQ ID NO: 620590 - RNA, 18 nt, Escherichia coli CFT073
ugauucccugccugacag

SEQ ID NO: 620591 - RNA, 12 nt, Escherichia coli CFT073
ugauucccagca

SEQ ID NO: 620592 - RNA, 19 nt, Escherichia coli CFT073
ugauuuuuuccaacaggcg

SEQ ID NO: 620593 - RNA, 18 nt, Escherichia coli CFT073
ugauuuuucguuuuaaug

SEQ ID NO: 620594 - RNA, 17 nt, Escherichia coli CFT073
ugauuuuucguuuuaau

SEQ ID NO: 620595 - RNA, 22 nt, Escherichia coli CFT073
ugcaaaaaaauuucauuuucag

SEQ ID NO: 620596 - RNA, 21 nt, Escherichia coli CFT073
ugauuuugacgcuaaauugaa

SEQ ID NO: 620597 - RNA, 18 nt, Escherichia coli CFT073
ugauuuucaccagcaucg

SEQ ID NO: 620598 - RNA, 19 nt, Escherichia coli CFT073
ugauuuuguaaucaacaaa

SEQ ID NO: 620599 - RNA, 19 nt, Escherichia coli CFT073
ugcaaacaguaacccagca

SEQ ID NO: 620600 - RNA, 20 nt, Escherichia coli CFT073
ugcaaacaacgcuucaaacc

SEQ ID NO: 620601 - RNA, 22 nt, Escherichia coli CFT073
ugcaaaaucuguugaaauuauu

SEQ ID NO: 620602 - RNA, 16 nt, Escherichia coli CFT073
ugcaaacgauuaucaa

SEQ ID NO: 620603 - RNA, 18 nt, Escherichia coli CFT073
ugcaaacgcguuaagccc

SEQ ID NO: 620604 - RNA, 22 nt, Escherichia coli CFT073
ugcaaaagcaggagcaauuuuc

SEQ ID NO: 620605 - RNA, 14 nt, Escherichia coli CFT073
ugcaaaucaccaca

SEQ ID NO: 620606 - RNA, 16 nt, Escherichia coli CFT073
ugcaaauacccaaaaa

SEQ ID NO: 620607 - RNA, 19 nt, Escherichia coli CFT073
ugcaaaggcugugaaaguu

SEQ ID NO: 620608 - RNA, 19 nt, Escherichia coli CFT073
ugcaaagcugauaaucauc

SEQ ID NO: 620609 - RNA, 19 nt, Escherichia coli CFT073
ugcaaagagaacugagcga

SEQ ID NO: 620610 - RNA, 12 nt, Escherichia coli CFT073
ugccugaaaaau

SEQ ID NO: 620611 - RNA, 13 nt, Escherichia coli CFT073
ugccugaaaaaug

SEQ ID NO: 620612 - RNA, 20 nt, Escherichia coli CFT073
ugccucuuugccgcuuuuau

SEQ ID NO: 620613 - RNA, 21 nt, Escherichia coli CFT073
ugccugacagaccacucucug

SEQ ID NO: 620614 - RNA, 22 nt, Escherichia coli CFT073
ugccugacagaccacucucugg

SEQ ID NO: 620615 - RNA, 16 nt, Escherichia coli CFT073
ugccugacgaugcguc

SEQ ID NO: 620616 - RNA, 17 nt, Escherichia coli CFT073
ugccugauggccugcuc

SEQ ID NO: 620617 - RNA, 13 nt, Escherichia coli CFT073
ugccugauucagc

SEQ ID NO: 620618 - RNA, 17 nt, Escherichia coli CFT073
ugccugccagcuugcga

SEQ ID NO: 620619 - RNA, 21 nt, Escherichia coli CFT073
ugccugcagcugcucauuaca

SEQ ID NO: 620620 - RNA, 22 nt, Escherichia coli CFT073
ugccugcaggaaaucaaugcca

SEQ ID NO: 620621 - RNA, 13 nt, Escherichia coli CFT073
ugccugcagcugc

SEQ ID NO: 620622 - RNA, 17 nt, Escherichia coli CFT073
ugccugcacuuuguguc

SEQ ID NO: 620623 - RNA, 18 nt, Escherichia coli CFT073
ugccugcacuuuguguca

SEQ ID NO: 620624 - RNA, 17 nt, Escherichia coli CFT073
ugccugccgccuuuugc

SEQ ID NO: 620625 - RNA, 20 nt, Escherichia coli CFT073
ugccugguuucucuccgugu

SEQ ID NO: 620626 - RNA, 13 nt, Escherichia coli CFT073
ugccugccaugcc

SEQ ID NO: 620627 - RNA, 16 nt, Escherichia coli CFT073
ugccugccaugccaaa

SEQ ID NO: 620628 - RNA, 13 nt, Escherichia coli CFT073
ugccugcccagcc

SEQ ID NO: 620629 - RNA, 22 nt, Escherichia coli CFT073
ugccucuccccagcggaaaaua

SEQ ID NO: 620630 - RNA, 17 nt, Escherichia coli CFT073
ugccucugcgcccagca

SEQ ID NO: 620631 - RNA, 19 nt, Escherichia coli CFT073
ugccucgggauccaugcac

SEQ ID NO: 620632 - RNA, 23 nt, Escherichia coli CFT073
ugccgucuucguuuugcuguucc

SEQ ID NO: 620633 - RNA, 14 nt, Escherichia coli CFT073
ugccucccugcaaa

SEQ ID NO: 620634 - RNA, 19 nt, Escherichia coli CFT073
ugccgucugccacuucuuc

SEQ ID NO: 620635 - RNA, 21 nt, Escherichia coli CFT073
ugccgucugggcaaaaucauc

SEQ ID NO: 620636 - RNA, 23 nt, Escherichia coli CFT073
ugccgucugggcaaaaucaucac

SEQ ID NO: 620637 - RNA, 21 nt, Escherichia coli CFT073
ugccuguccucuucagcauca

SEQ ID NO: 620638 - RNA, 22 nt, Escherichia coli CFT073
ugccugugcaaccuuuuccauu

SEQ ID NO: 620639 - RNA, 21 nt, Escherichia coli CFT073
ugccugugcgauuuccuucag

SEQ ID NO: 620640 - RNA, 16 nt, Escherichia coli CFT073
ugccuguucgccgccg

SEQ ID NO: 620641 - RNA, 12 nt, Escherichia coli CFT073
ugccuguuucau

SEQ ID NO: 620642 - RNA, 21 nt, Escherichia coli CFT073
ugccuugauauguauuauaag

SEQ ID NO: 620643 - RNA, 14 nt, Escherichia coli CFT073
ugccuuccuccggc

SEQ ID NO: 620644 - RNA, 21 nt, Escherichia coli CFT073
ugccuucacaggccgccaggc

SEQ ID NO: 620645 - RNA, 20 nt, Escherichia coli CFT073
ugccuucaguuuccagcaaa

SEQ ID NO: 620646 - RNA, 14 nt, Escherichia coli CFT073
ugccuuccaucccu

SEQ ID NO: 620647 - RNA, 16 nt, Escherichia coli CFT073
ugccuucccuucucuu

SEQ ID NO: 620648 - RNA, 16 nt, Escherichia coli CFT073
ugccagagcacugcau

SEQ ID NO: 620649 - RNA, 18 nt, Escherichia coli CFT073
ugccagaccgaacagcau

SEQ ID NO: 620650 - RNA, 19 nt, Escherichia coli CFT073
ugccagaauccccacugca

SEQ ID NO: 620651 - RNA, 18 nt, Escherichia coli CFT073
ugccagacaacaugagaa

SEQ ID NO: 620652 - RNA, 12 nt, Escherichia coli CFT073
ugccagaaacau

SEQ ID NO: 620653 - RNA, 18 nt, Escherichia coli CFT073
ugccagaagcagaaugaa

SEQ ID NO: 620654 - RNA, 15 nt, Escherichia coli CFT073
ugccacccauuacac

SEQ ID NO: 620655 - RNA, 19 nt, Escherichia coli CFT073
ugccaccgggagauccagc

SEQ ID NO: 620656 - RNA, 14 nt, Escherichia coli CFT073
ugccagauagccag

SEQ ID NO: 620657 - RNA, 21 nt, Escherichia coli CFT073
ugccggcaucaaacgguugau

SEQ ID NO: 620658 - RNA, 16 nt, Escherichia coli CFT073
ugccagauaauggcug

SEQ ID NO: 620659 - RNA, 20 nt, Escherichia coli CFT073
ugccagaguuccugcauauc

SEQ ID NO: 620660 - RNA, 21 nt, Escherichia coli CFT073
ugccgggugauuucaaaauua

SEQ ID NO: 620661 - RNA, 14 nt, Escherichia coli CFT073
ugccgguaaugcug

SEQ ID NO: 620662 - RNA, 23 nt, Escherichia coli CFT073
ugccggugggaugaagcaacugg

SEQ ID NO: 620663 - RNA, 21 nt, Escherichia coli CFT073
ugccggucuuguuaccggcau

SEQ ID NO: 620664 - RNA, 16 nt, Escherichia coli CFT073
ugccggugagauggug

SEQ ID NO: 620665 - RNA, 22 nt, Escherichia coli CFT073
ugccgucgggauucaguuucug

SEQ ID NO: 620666 - RNA, 13 nt, Escherichia coli CFT073
ugccgguuccagc

SEQ ID NO: 620667 - RNA, 18 nt, Escherichia coli CFT073
ugcgccgcauucagggca

SEQ ID NO: 620668 - RNA, 14 nt, Escherichia coli CFT073
ugcgcccuguucug

SEQ ID NO: 620669 - RNA, 22 nt, Escherichia coli CFT073
ugcgccauaccaugcaccaacc

SEQ ID NO: 620670 - RNA, 12 nt, Escherichia coli CFT073
ugcgccaauacc

SEQ ID NO: 620671 - RNA, 13 nt, Escherichia coli CFT073
ugcgccaaucgcc

SEQ ID NO: 620672 - RNA, 18 nt, Escherichia coli CFT073
ugcgccaacgucugccug

SEQ ID NO: 620673 - RNA, 12 nt, Escherichia coli CFT073
ugcgccacaucc

SEQ ID NO: 620674 - RNA, 22 nt, Escherichia coli CFT073
ugcgccagacgugcacgcagca

SEQ ID NO: 620675 - RNA, 20 nt, Escherichia coli CFT073
ugcgccagagcccguuaccc

SEQ ID NO: 620676 - RNA, 23 nt, Escherichia coli CFT073
ugcgccagagcccguuacccugg

SEQ ID NO: 620677 - RNA, 23 nt, Escherichia coli CFT073
ugcgccagcaaaucagccauugc

SEQ ID NO: 620678 - RNA, 16 nt, Escherichia coli CFT073
ugcgauguucccccag

SEQ ID NO: 620679 - RNA, 17 nt, Escherichia coli CFT073
ugcgaugaucgccgcca

SEQ ID NO: 620680 - RNA, 11 nt, Escherichia coli CFT073
ugcgcaccagg

SEQ ID NO: 620681 - RNA, 16 nt, Escherichia coli CFT073
ugcgcaccaggcgugg

SEQ ID NO: 620682 - RNA, 14 nt, Escherichia coli CFT073
ugcgauauggcugc

SEQ ID NO: 620683 - RNA, 14 nt, Escherichia coli CFT073
ugcgauccugcaga

SEQ ID NO: 620684 - RNA, 14 nt, Escherichia coli CFT073
ugcgagcucaauau

SEQ ID NO: 620685 - RNA, 16 nt, Escherichia coli CFT073
ugcgauaaccaggcag

SEQ ID NO: 620686 - RNA, 18 nt, Escherichia coli CFT073
ugcgauaaccaggcaguu

SEQ ID NO: 620687 - RNA, 15 nt, Escherichia coli CFT073
ugcgaguccgcuucc

SEQ ID NO: 620688 - RNA, 13 nt, Escherichia coli CFT073
ugcgaagcuuugc

SEQ ID NO: 620689 - RNA, 13 nt, Escherichia coli CFT073
ugcgacaaaccag

SEQ ID NO: 620690 - RNA, 14 nt, Escherichia coli CFT073
ugcgacaccagcau

SEQ ID NO: 620691 - RNA, 21 nt, Escherichia coli CFT073
ugcgacaccagcauguuccau

SEQ ID NO: 620692 - RNA, 22 nt, Escherichia coli CFT073
ugcgacagagauauucagcccg

SEQ ID NO: 620693 - RNA, 16 nt, Escherichia coli CFT073
ugcgaauaaugguauc

SEQ ID NO: 620694 - RNA, 17 nt, Escherichia coli CFT073
ugcgaaguuuuuccgcc

SEQ ID NO: 620695 - RNA, 21 nt, Escherichia coli CFT073
ugcgaagacgaguagaagcga

SEQ ID NO: 620696 - RNA, 13 nt, Escherichia coli CFT073
ugcgaaacuucuu

SEQ ID NO: 620697 - RNA, 13 nt, Escherichia coli CFT073
ugcgaaaaauaaa

SEQ ID NO: 620698 - RNA, 19 nt, Escherichia coli CFT073
ugcgaaaaaaauuacucau

SEQ ID NO: 620699 - RNA, 22 nt, Escherichia coli CFT073
ugcgaaaacgauguuugcugcg

SEQ ID NO: 620700 - RNA, 16 nt, Escherichia coli CFT073
ugccuugcgauauccc

SEQ ID NO: 620701 - RNA, 13 nt, Escherichia coli CFT073
ugccuugcucuuc

SEQ ID NO: 620702 - RNA, 12 nt, Escherichia coli CFT073
ugccuuuauuca

SEQ ID NO: 620703 - RNA, 15 nt, Escherichia coli CFT073
ugccuuucccuuucu

SEQ ID NO: 620704 - RNA, 14 nt, Escherichia coli CFT073
ugccuuuuccagcg

SEQ ID NO: 620705 - RNA, 16 nt, Escherichia coli CFT073
ugccuuucuuuguucu

SEQ ID NO: 620706 - RNA, 20 nt, Escherichia coli CFT073
ugcucaggaguaaacuuucc

SEQ ID NO: 620707 - RNA, 12 nt, Escherichia coli CFT073
ugcucaggcaga

SEQ ID NO: 620708 - RNA, 21 nt, Escherichia coli CFT073
ugcucagaaucacgccaacaa

SEQ ID NO: 620709 - RNA, 22 nt, Escherichia coli CFT073
ugcucgaacauccccacagaaa

SEQ ID NO: 620710 - RNA, 17 nt, Escherichia coli CFT073
ugcucgacuagauacug

SEQ ID NO: 620711 - RNA, 19 nt, Escherichia coli CFT073
ugcucgaauuaaaggauau

SEQ ID NO: 620712 - RNA, 22 nt, Escherichia coli CFT073
ugcuccuuucagguacagacua

SEQ ID NO: 620713 - RNA, 23 nt, Escherichia coli CFT073
ugcuccgguuuuuuauuauccgc

SEQ ID NO: 620714 - RNA, 19 nt, Escherichia coli CFT073
ugcuccgccagugacugcg

SEQ ID NO: 620715 - RNA, 13 nt, Escherichia coli CFT073
ugcuccgaaguga

SEQ ID NO: 620716 - RNA, 16 nt, Escherichia coli CFT073
ugcucccugagcaaca

SEQ ID NO: 620717 - RNA, 13 nt, Escherichia coli CFT073
ugcuccccagacc

SEQ ID NO: 620718 - RNA, 15 nt, Escherichia coli CFT073
ugcuccgcucaucag

SEQ ID NO: 620719 - RNA, 13 nt, Escherichia coli CFT073
ugcuccagcagau

SEQ ID NO: 620720 - RNA, 18 nt, Escherichia coli CFT073
ugcucauuagcccggcaa

SEQ ID NO: 620721 - RNA, 13 nt, Escherichia coli CFT073
ugcucauuccgcc

SEQ ID NO: 620722 - RNA, 14 nt, Escherichia coli CFT073
ugcuccaucauccg

SEQ ID NO: 620723 - RNA, 14 nt, Escherichia coli CFT073
ugcucccagcgcau

SEQ ID NO: 620724 - RNA, 14 nt, Escherichia coli CFT073
ugcuacccacuucc

SEQ ID NO: 620725 - RNA, 16 nt, Escherichia coli CFT073
ugcguuuuuaucuuca

SEQ ID NO: 620726 - RNA, 18 nt, Escherichia coli CFT073
ugcuaaaugucaucccuu

SEQ ID NO: 620727 - RNA, 22 nt, Escherichia coli CFT073
ugcuaaccaacaauacaaaaua

SEQ ID NO: 620728 - RNA, 20 nt, Escherichia coli CFT073
ugcuaugggcggucccacaa

SEQ ID NO: 620729 - RNA, 13 nt, Escherichia coli CFT073
ugcuauuccuuga

SEQ ID NO: 620730 - RNA, 16 nt, Escherichia coli CFT073
ugcgguuucagcucac

SEQ ID NO: 620731 - RNA, 17 nt, Escherichia coli CFT073
ugcguaaaaccugccaa

SEQ ID NO: 620732 - RNA, 21 nt, Escherichia coli CFT073
ugcgggaguugcuccacugcu

SEQ ID NO: 620733 - RNA, 21 nt, Escherichia coli CFT073
ugcggcuuuuuuauugcugca

SEQ ID NO: 620734 - RNA, 13 nt, Escherichia coli CFT073
ugcgggaaauaac

SEQ ID NO: 620735 - RNA, 16 nt, Escherichia coli CFT073
ugcggucgcugccgcc

SEQ ID NO: 620736 - RNA, 19 nt, Escherichia coli CFT073
ugcggucuggcagcuaaug

SEQ ID NO: 620737 - RNA, 15 nt, Escherichia coli CFT073
ugcguuuggcaucag

SEQ ID NO: 620738 - RNA, 13 nt, Escherichia coli CFT073
ugcgugcuggcug

SEQ ID NO: 620739 - RNA, 21 nt, Escherichia coli CFT073
ugcguggcagauuaggauuaa

SEQ ID NO: 620740 - RNA, 17 nt, Escherichia coli CFT073
ugcgugcgcccaucauu

SEQ ID NO: 620741 - RNA, 15 nt, Escherichia coli CFT073
ugcgugauauuacau

SEQ ID NO: 620742 - RNA, 22 nt, Escherichia coli CFT073
ugcgugauauuacauaccagca

SEQ ID NO: 620743 - RNA, 17 nt, Escherichia coli CFT073
ugcgugcaguuccugcu

SEQ ID NO: 620744 - RNA, 17 nt, Escherichia coli CFT073
ugcgucuuaucaggccu

SEQ ID NO: 620745 - RNA, 14 nt, Escherichia coli CFT073
ugcgucuuauuggc

SEQ ID NO: 620746 - RNA, 12 nt, Escherichia coli CFT073
ugcgucuuccac

SEQ ID NO: 620747 - RNA, 17 nt, Escherichia coli CFT073
ugcgucgcauccggcaa

SEQ ID NO: 620748 - RNA, 22 nt, Escherichia coli CFT073
ugcgucgcauccggcaauucuc

SEQ ID NO: 620749 - RNA, 14 nt, Escherichia coli CFT073
ugcgucgcacucuc

SEQ ID NO: 620750 - RNA, 13 nt, Escherichia coli CFT073
ugcgucagcuuca

SEQ ID NO: 620751 - RNA, 15 nt, Escherichia coli CFT073
ugcgccggcgcaccg

SEQ ID NO: 620752 - RNA, 14 nt, Escherichia coli CFT073
ugcgcuucugccac

SEQ ID NO: 620753 - RNA, 16 nt, Escherichia coli CFT073
ugcgcuuccaguucca

SEQ ID NO: 620754 - RNA, 21 nt, Escherichia coli CFT073
ugcgcuuccaguuccauccac

SEQ ID NO: 620755 - RNA, 15 nt, Escherichia coli CFT073
ugcgcugguggcagg

SEQ ID NO: 620756 - RNA, 22 nt, Escherichia coli CFT073
ugcggacaaaucgugacagcau

SEQ ID NO: 620757 - RNA, 16 nt, Escherichia coli CFT073
ugcgcuuuauucagau

SEQ ID NO: 620758 - RNA, 14 nt, Escherichia coli CFT073
ugcgcuugcagacg

SEQ ID NO: 620759 - RNA, 17 nt, Escherichia coli CFT073
ugcgcuucuuccagcau

SEQ ID NO: 620760 - RNA, 22 nt, Escherichia coli CFT073
ugcgcuuguucauaauguuaug

SEQ ID NO: 620761 - RNA, 12 nt, Escherichia coli CFT073
ugcggcucgucc

SEQ ID NO: 620762 - RNA, 20 nt, Escherichia coli CFT073
ugcggcugguuacucaccag

SEQ ID NO: 620763 - RNA, 22 nt, Escherichia coli CFT073
ugcggcgaaagcgggcuugauc

SEQ ID NO: 620764 - RNA, 14 nt, Escherichia coli CFT073
ugcggcauuuccag

SEQ ID NO: 620765 - RNA, 13 nt, Escherichia coli CFT073
ugcggcagcucca

SEQ ID NO: 620766 - RNA, 20 nt, Escherichia coli CFT073
ugcggcacccauuuauccag

SEQ ID NO: 620767 - RNA, 17 nt, Escherichia coli CFT073
uggaaugaccgcuaaua

SEQ ID NO: 620768 - RNA, 18 nt, Escherichia coli CFT073
uggaagugaucuuucagc

SEQ ID NO: 620769 - RNA, 15 nt, Escherichia coli CFT073
uggaaguuacucaaa

SEQ ID NO: 620770 - RNA, 15 nt, Escherichia coli CFT073
uggaauagcgaagaa

SEQ ID NO: 620771 - RNA, 19 nt, Escherichia coli CFT073
uggaaucacucaucaugca

SEQ ID NO: 620772 - RNA, 14 nt, Escherichia coli CFT073
uggaaucaauaauu

SEQ ID NO: 620773 - RNA, 23 nt, Escherichia coli CFT073
uggaccaauucaaugccccacag

SEQ ID NO: 620774 - RNA, 12 nt, Escherichia coli CFT073
uggaccagaacg

SEQ ID NO: 620775 - RNA, 19 nt, Escherichia coli CFT073
uggacccgaugaucaaaaa

SEQ ID NO: 620776 - RNA, 19 nt, Escherichia coli CFT073
uggacgauuucacccagcg

SEQ ID NO: 620777 - RNA, 17 nt, Escherichia coli CFT073
uggacauagcucugcca

SEQ ID NO: 620778 - RNA, 19 nt, Escherichia coli CFT073
uggacauguuuuuauuaaa

SEQ ID NO: 620779 - RNA, 13 nt, Escherichia coli CFT073
uggacauucuccg

SEQ ID NO: 620780 - RNA, 13 nt, Escherichia coli CFT073
uggaaaaaaugcc

SEQ ID NO: 620781 - RNA, 21 nt, Escherichia coli CFT073
uggaaacagccaaucauaaac

SEQ ID NO: 620782 - RNA, 23 nt, Escherichia coli CFT073
uggaaaauuuuuucagauaaaag

SEQ ID NO: 620783 - RNA, 14 nt, Escherichia coli CFT073
uggaaaucaaauac

SEQ ID NO: 620784 - RNA, 18 nt, Escherichia coli CFT073
uggaaacgcccccaaaau

SEQ ID NO: 620785 - RNA, 18 nt, Escherichia coli CFT073
uggaaaggccgcgaacca

SEQ ID NO: 620786 - RNA, 13 nt, Escherichia coli CFT073
uggaacagcugca

SEQ ID NO: 620787 - RNA, 18 nt, Escherichia coli CFT073
uggaacucgaaaauauug

SEQ ID NO: 620788 - RNA, 17 nt, Escherichia coli CFT073
uggaacggcagauccaa

SEQ ID NO: 620789 - RNA, 17 nt, Escherichia coli CFT073
uggaacaaaauuuucag

SEQ ID NO: 620790 - RNA, 15 nt, Escherichia coli CFT073
uggaagaaacgcuua

SEQ ID NO: 620791 - RNA, 13 nt, Escherichia coli CFT073
uggaacugaaagg

SEQ ID NO: 620792 - RNA, 20 nt, Escherichia coli CFT073
uggaagcauaauaagcuuuu

SEQ ID NO: 620793 - RNA, 20 nt, Escherichia coli CFT073
ugcuuucagcacuuaucucu

SEQ ID NO: 620794 - RNA, 15 nt, Escherichia coli CFT073
ugcuuucucaacaaa

SEQ ID NO: 620795 - RNA, 15 nt, Escherichia coli CFT073
ugcuuuuaaaugccc

SEQ ID NO: 620796 - RNA, 15 nt, Escherichia coli CFT073
ugcuuugaugugcaa

SEQ ID NO: 620797 - RNA, 17 nt, Escherichia coli CFT073
ugcuuuucccuuucaga

SEQ ID NO: 620798 - RNA, 21 nt, Escherichia coli CFT073
ugcuuuuuccugagucagcag

SEQ ID NO: 620799 - RNA, 20 nt, Escherichia coli CFT073
ugcuugccggaagcaaaaua

SEQ ID NO: 620800 - RNA, 23 nt, Escherichia coli CFT073
ugcuuuaucagcucauaggccug

SEQ ID NO: 620801 - RNA, 19 nt, Escherichia coli CFT073
ugcuuuaaaugucauacua

SEQ ID NO: 620802 - RNA, 18 nt, Escherichia coli CFT073
ugcuugacgcgucuuauc

SEQ ID NO: 620803 - RNA, 22 nt, Escherichia coli CFT073
ugcuugaugcgcugacuguuag

SEQ ID NO: 620804 - RNA, 19 nt, Escherichia coli CFT073
ugcuucuaacaucaugauu

SEQ ID NO: 620805 - RNA, 22 nt, Escherichia coli CFT073
ugcuucuaacaucaugauuuua

SEQ ID NO: 620806 - RNA, 13 nt, Escherichia coli CFT073
ugcuucuagugcc

SEQ ID NO: 620807 - RNA, 15 nt, Escherichia coli CFT073
ugcuuccggcaagca

SEQ ID NO: 620808 - RNA, 21 nt, Escherichia coli CFT073
ugcuuccggcaagcaaauuaa

SEQ ID NO: 620809 - RNA, 16 nt, Escherichia coli CFT073
ugcuucggucagcacg

SEQ ID NO: 620810 - RNA, 19 nt, Escherichia coli CFT073
ugcuucguuaacgugucau

SEQ ID NO: 620811 - RNA, 21 nt, Escherichia coli CFT073
ugcuucacgcggguugccacc

SEQ ID NO: 620812 - RNA, 14 nt, Escherichia coli CFT073
ugcuucaaauauug

SEQ ID NO: 620813 - RNA, 17 nt, Escherichia coli CFT073
ugcuucagugagcuguc

SEQ ID NO: 620814 - RNA, 16 nt, Escherichia coli CFT073
ugcuucaguuccugau

SEQ ID NO: 620815 - RNA, 20 nt, Escherichia coli CFT073
ugcuucagccagaggcggca

SEQ ID NO: 620816 - RNA, 12 nt, Escherichia coli CFT073
ugcuucagaaga

SEQ ID NO: 620817 - RNA, 15 nt, Escherichia coli CFT073
ugcuucagcacuucu

SEQ ID NO: 620818 - RNA, 15 nt, Escherichia coli CFT073
ugcuucagccaaagc

SEQ ID NO: 620819 - RNA, 13 nt, Escherichia coli CFT073
ugcuucagccaga

SEQ ID NO: 620820 - RNA, 17 nt, Escherichia coli CFT073
ugcuuauuaaugcuuuc

SEQ ID NO: 620821 - RNA, 20 nt, Escherichia coli CFT073
ugcuuauuaaugcuuucagu

SEQ ID NO: 620822 - RNA, 22 nt, Escherichia coli CFT073
ugcuggucuucguacaugguaa

SEQ ID NO: 620823 - RNA, 22 nt, Escherichia coli CFT073
ugcugggcgaucggcaggaaaa

SEQ ID NO: 620824 - RNA, 12 nt, Escherichia coli CFT073
ugcuguaaacaa

SEQ ID NO: 620825 - RNA, 21 nt, Escherichia coli CFT073
ugcuguaaagucuggaagacc

SEQ ID NO: 620826 - RNA, 12 nt, Escherichia coli CFT073
ugcuuaaauggc

SEQ ID NO: 620827 - RNA, 23 nt, Escherichia coli CFT073
ugcuuaaauuucuuaccacuacc

SEQ ID NO: 620828 - RNA, 23 nt, Escherichia coli CFT073
ugcuuaagacguuguugaauagu

SEQ ID NO: 620829 - RNA, 12 nt, Escherichia coli CFT073
ugcuguuuuaca

SEQ ID NO: 620830 - RNA, 22 nt, Escherichia coli CFT073
ugcuguccagaucgggccuggc

SEQ ID NO: 620831 - RNA, 15 nt, Escherichia coli CFT073
ugcugugaagcaccu

SEQ ID NO: 620832 - RNA, 16 nt, Escherichia coli CFT073
aaauguauuucaucau

SEQ ID NO: 620833 - RNA, 16 nt, Escherichia coli CFT073
aaaugucaaacaguuc

SEQ ID NO: 620834 - RNA, 14 nt, Escherichia coli CFT073
aaaugucaucccuu

SEQ ID NO: 620835 - RNA, 17 nt, Escherichia coli CFT073
aaaugucaucccuuccu

SEQ ID NO: 620836 - RNA, 18 nt, Escherichia coli CFT073
aaaugucaugacauucau

SEQ ID NO: 620837 - RNA, 22 nt, Escherichia coli CFT073
aaaugucauuacgaucaagaau

SEQ ID NO: 620838 - RNA, 23 nt, Escherichia coli CFT073
aaaugucagggacguaccaauga

SEQ ID NO: 620839 - RNA, 18 nt, Escherichia coli CFT073
ugcuggcaugaaugguca

SEQ ID NO: 620840 - RNA, 17 nt, Escherichia coli CFT073
ugcuggcguugucaucg

SEQ ID NO: 620841 - RNA, 14 nt, Escherichia coli CFT073
ugcuggcggccuga

SEQ ID NO: 620842 - RNA, 18 nt, Escherichia coli CFT073
ugcugcuuuaucagauca

SEQ ID NO: 620843 - RNA, 18 nt, Escherichia coli CFT073
ugcugcuggcaucaccaa

SEQ ID NO: 620844 - RNA, 22 nt, Escherichia coli CFT073
ugcugcuggaaaagguaaggau

SEQ ID NO: 620845 - RNA, 19 nt, Escherichia coli CFT073
ugcuggaucaaggauugca

SEQ ID NO: 620846 - RNA, 20 nt, Escherichia coli CFT073
ugcuggacgauuucacccag

SEQ ID NO: 620847 - RNA, 23 nt, Escherichia coli CFT073
ugcugcuccagcguaccugccgc

SEQ ID NO: 620848 - RNA, 21 nt, Escherichia coli CFT073
ugcugcuccugcgacugcauu

SEQ ID NO: 620849 - RNA, 15 nt, Escherichia coli CFT073
ugcugcucuugaucc

SEQ ID NO: 620850 - RNA, 20 nt, Escherichia coli CFT073
ugcugcgccauauaccgcgg

SEQ ID NO: 620851 - RNA, 17 nt, Escherichia coli CFT073
ugcugauacuauucauu

SEQ ID NO: 620852 - RNA, 21 nt, Escherichia coli CFT073
ugcugacguaucuuacagagc

SEQ ID NO: 620853 - RNA, 15 nt, Escherichia coli CFT073
ugcugacugaugaga

SEQ ID NO: 620854 - RNA, 22 nt, Escherichia coli CFT073
ugcugagaacauaaacacccac

SEQ ID NO: 620855 - RNA, 16 nt, Escherichia coli CFT073
ugcucuuuuugcauaa

SEQ ID NO: 620856 - RNA, 18 nt, Escherichia coli CFT073
ugcugaagggcaucagcc

SEQ ID NO: 620857 - RNA, 16 nt, Escherichia coli CFT073
ugcugaauccccuucu

SEQ ID NO: 620858 - RNA, 18 nt, Escherichia coli CFT073
ugcugaccgaagucagua

SEQ ID NO: 620859 - RNA, 13 nt, Escherichia coli CFT073
ugcugcaccagca

SEQ ID NO: 620860 - RNA, 14 nt, Escherichia coli CFT073
ugcugcacgaaauu

SEQ ID NO: 620861 - RNA, 12 nt, Escherichia coli CFT073
ugcugcacacca

SEQ ID NO: 620862 - RNA, 15 nt, Escherichia coli CFT073
ugcugcaccccacaa

SEQ ID NO: 620863 - RNA, 22 nt, Escherichia coli CFT073
ugcugcaccccacaaacagaau

SEQ ID NO: 620864 - RNA, 17 nt, Escherichia coli CFT073
ugcugauuuuauuucac

SEQ ID NO: 620865 - RNA, 16 nt, Escherichia coli CFT073
ugcugcaauugcggca

SEQ ID NO: 620866 - RNA, 16 nt, Escherichia coli CFT073
ugcugccaucaucuuc

SEQ ID NO: 620867 - RNA, 16 nt, Escherichia coli CFT073
ugcugccacucuccug

SEQ ID NO: 620868 - RNA, 18 nt, Escherichia coli CFT073
ugcugcaucucuuugcug

SEQ ID NO: 620869 - RNA, 22 nt, Escherichia coli CFT073
ugcucgcagaaauaccccgcca

SEQ ID NO: 620870 - RNA, 22 nt, Escherichia coli CFT073
ugcucguaaagcaucagacugc

SEQ ID NO: 620871 - RNA, 16 nt, Escherichia coli CFT073
ugcucgcuggcaggcc

SEQ ID NO: 620872 - RNA, 15 nt, Escherichia coli CFT073
ugcucuaacccuucc

SEQ ID NO: 620873 - RNA, 17 nt, Escherichia coli CFT073
ugcucucgggcaguaaa

SEQ ID NO: 620874 - RNA, 23 nt, Escherichia coli CFT073
ugcucuauugccguaaucgccuc

SEQ ID NO: 620875 - RNA, 18 nt, Escherichia coli CFT073
ugcucuaccagccccauc

SEQ ID NO: 620876 - RNA, 19 nt, Escherichia coli CFT073
ugcucuucgcguaauguuu

SEQ ID NO: 620877 - RNA, 23 nt, Escherichia coli CFT073
ugcucuucguuaauuucugcuuu

SEQ ID NO: 620878 - RNA, 14 nt, Escherichia coli CFT073
ugcucuucuuucau

SEQ ID NO: 620879 - RNA, 16 nt, Escherichia coli CFT073
ugcucuuucagcaccg

SEQ ID NO: 620880 - RNA, 22 nt, Escherichia coli CFT073
ugcucuuuguaggccugauaag

SEQ ID NO: 620881 - RNA, 14 nt, Escherichia coli CFT073
ugcucuuucacuuu

SEQ ID NO: 620882 - RNA, 22 nt, Escherichia coli CFT073
ugcucugaaguuuguuaaccac

SEQ ID NO: 620883 - RNA, 23 nt, Escherichia coli CFT073
ugucuuuugaucugcuaaacgua

SEQ ID NO: 620884 - RNA, 12 nt, Escherichia coli CFT073
ugugaaaauaac

SEQ ID NO: 620885 - RNA, 19 nt, Escherichia coli CFT073
ugugaauaauugugcaauu

SEQ ID NO: 620886 - RNA, 15 nt, Escherichia coli CFT073
ugugaacucaggcug

SEQ ID NO: 620887 - RNA, 23 nt, Escherichia coli CFT073
ugugaacucaggcugccagauca

SEQ ID NO: 620888 - RNA, 13 nt, Escherichia coli CFT073
ugugaagaauaaa

SEQ ID NO: 620889 - RNA, 20 nt, Escherichia coli CFT073
ugugaagcaugaguaacccg

SEQ ID NO: 620890 - RNA, 19 nt, Escherichia coli CFT073
ugugaaggggcgcaauuaa

SEQ ID NO: 620891 - RNA, 20 nt, Escherichia coli CFT073
ugugaaggugauucccagca

SEQ ID NO: 620892 - RNA, 19 nt, Escherichia coli CFT073
ugucugagauuacauuggg

SEQ ID NO: 620893 - RNA, 12 nt, Escherichia coli CFT073
ugucuuccugcg

SEQ ID NO: 620894 - RNA, 15 nt, Escherichia coli CFT073
ugucuuuacccggac

SEQ ID NO: 620895 - RNA, 21 nt, Escherichia coli CFT073
ugugcaauguggugaaaugcc

SEQ ID NO: 620896 - RNA, 19 nt, Escherichia coli CFT073
ugugcaaaggccaaugguu

SEQ ID NO: 620897 - RNA, 15 nt, Escherichia coli CFT073
ugugcaaccuuuucc

SEQ ID NO: 620898 - RNA, 19 nt, Escherichia coli CFT073
ugugcacgugccagauguu

SEQ ID NO: 620899 - RNA, 18 nt, Escherichia coli CFT073
ugugccagcucgugcaga

SEQ ID NO: 620900 - RNA, 21 nt, Escherichia coli CFT073
ugugccaucgccacaccagua

SEQ ID NO: 620901 - RNA, 18 nt, Escherichia coli CFT073
ugugauuucugacuuccc

SEQ ID NO: 620902 - RNA, 16 nt, Escherichia coli CFT073
ugugauugaugugcuu

SEQ ID NO: 620903 - RNA, 18 nt, Escherichia coli CFT073
ugugaucauaucccggcu

SEQ ID NO: 620904 - RNA, 16 nt, Escherichia coli CFT073
ugucgugguacugccg

SEQ ID NO: 620905 - RNA, 17 nt, Escherichia coli CFT073
ugucgugguacugccgg

SEQ ID NO: 620906 - RNA, 18 nt, Escherichia coli CFT073
ugucgucgguuuucuugu

SEQ ID NO: 620907 - RNA, 17 nt, Escherichia coli CFT073
ugucggcccgcauuauu

SEQ ID NO: 620908 - RNA, 20 nt, Escherichia coli CFT073
ugucggcccgcauuauucag

SEQ ID NO: 620909 - RNA, 18 nt, Escherichia coli CFT073
ugucggcauaaagcugcg

SEQ ID NO: 620910 - RNA, 13 nt, Escherichia coli CFT073
ugucggcacugac

SEQ ID NO: 620911 - RNA, 17 nt, Escherichia coli CFT073
ugucgacauagccaucc

SEQ ID NO: 620912 - RNA, 19 nt, Escherichia coli CFT073
ugucgacggaauaaaccca

SEQ ID NO: 620913 - RNA, 21 nt, Escherichia coli CFT073
ugucgaggccaauuuggcugc

SEQ ID NO: 620914 - RNA, 22 nt, Escherichia coli CFT073
uguccgcauccccuacucucug

SEQ ID NO: 620915 - RNA, 15 nt, Escherichia coli CFT073
uguccggucgccauu

SEQ ID NO: 620916 - RNA, 14 nt, Escherichia coli CFT073
uguccggcaauaaa

SEQ ID NO: 620917 - RNA, 16 nt, Escherichia coli CFT073
uguccuauuggagaau

SEQ ID NO: 620918 - RNA, 16 nt, Escherichia coli CFT073
ugucaggaucaccaau

SEQ ID NO: 620919 - RNA, 16 nt, Escherichia coli CFT073
ugucagggacguacca

SEQ ID NO: 620920 - RNA, 15 nt, Escherichia coli CFT073
ugucagcucauccag

SEQ ID NO: 620921 - RNA, 18 nt, Escherichia coli CFT073
ugucagcaugucuugccu

SEQ ID NO: 620922 - RNA, 13 nt, Escherichia coli CFT073
ugucagcccuucc

SEQ ID NO: 620923 - RNA, 20 nt, Escherichia coli CFT073
ugucagcccuucccggugcg

SEQ ID NO: 620924 - RNA, 21 nt, Escherichia coli CFT073
ugucaccagccggucauuggc

SEQ ID NO: 620925 - RNA, 22 nt, Escherichia coli CFT073
ugucaccauuggcauugguauc

SEQ ID NO: 620926 - RNA, 20 nt, Escherichia coli CFT073
ugucagcaaaauaacaggga

SEQ ID NO: 620927 - RNA, 12 nt, Escherichia coli CFT073
uguaucuuucau

SEQ ID NO: 620928 - RNA, 13 nt, Escherichia coli CFT073
uguauucaugccc

SEQ ID NO: 620929 - RNA, 12 nt, Escherichia coli CFT073
uguaucuucauc

SEQ ID NO: 620930 - RNA, 21 nt, Escherichia coli CFT073
uguaucuucgccguguucuua

SEQ ID NO: 620931 - RNA, 14 nt, Escherichia coli CFT073
uguaucguaaaaug

SEQ ID NO: 620932 - RNA, 22 nt, Escherichia coli CFT073
uguaucgaugcuguuauacaca

SEQ ID NO: 620933 - RNA, 17 nt, Escherichia coli CFT073
uguaucgcaucaggcau

SEQ ID NO: 620934 - RNA, 19 nt, Escherichia coli CFT073
uguagauuuugcagaucac

SEQ ID NO: 620935 - RNA, 15 nt, Escherichia coli CFT073
uguacuguuacucau

SEQ ID NO: 620936 - RNA, 20 nt, Escherichia coli CFT073
uguagcgauuucacgcucag

SEQ ID NO: 620937 - RNA, 21 nt, Escherichia coli CFT073
uguauucuuugaucgccgcca

SEQ ID NO: 620938 - RNA, 17 nt, Escherichia coli CFT073
uguauuccgggaacgau

SEQ ID NO: 620939 - RNA, 17 nt, Escherichia coli CFT073
uguauucaugcccugcc

SEQ ID NO: 620940 - RNA, 18 nt, Escherichia coli CFT073
uguauuugaauuucaaau

SEQ ID NO: 620941 - RNA, 18 nt, Escherichia coli CFT073
ugucacaaucccuuccac

SEQ ID NO: 620942 - RNA, 16 nt, Escherichia coli CFT073
uggucgguuucagcca

SEQ ID NO: 620943 - RNA, 17 nt, Escherichia coli CFT073
ugggucuauccagugcc

SEQ ID NO: 620944 - RNA, 15 nt, Escherichia coli CFT073
uggguagcuuccugc

SEQ ID NO: 620945 - RNA, 17 nt, Escherichia coli CFT073
uggguagaaacccgcaa

SEQ ID NO: 620946 - RNA, 22 nt, Escherichia coli CFT073
ugggucccagaagaaaaucaau

SEQ ID NO: 620947 - RNA, 17 nt, Escherichia coli CFT073
uggugagggcaaacaga

SEQ ID NO: 620948 - RNA, 20 nt, Escherichia coli CFT073
uggugacuuuugcccggcau

SEQ ID NO: 620949 - RNA, 13 nt, Escherichia coli CFT073
uggugaugccauc

SEQ ID NO: 620950 - RNA, 19 nt, Escherichia coli CFT073
uggugccgggaauauuuac

SEQ ID NO: 620951 - RNA, 21 nt, Escherichia coli CFT073
uggugcuaauugcaccauccc

SEQ ID NO: 620952 - RNA, 22 nt, Escherichia coli CFT073
uggugcuaauuugaaaugacgc

SEQ ID NO: 620953 - RNA, 18 nt, Escherichia coli CFT073
ugguuaccaguaaccaga

SEQ ID NO: 620954 - RNA, 18 nt, Escherichia coli CFT073
ugguuacaucaacaagca

SEQ ID NO: 620955 - RNA, 18 nt, Escherichia coli CFT073
ugguuaccgaauccagca

SEQ ID NO: 620956 - RNA, 13 nt, Escherichia coli CFT073
ugguuaaauuuaa

SEQ ID NO: 620957 - RNA, 17 nt, Escherichia coli CFT073
ugguuaaauuuaauauc

SEQ ID NO: 620958 - RNA, 23 nt, Escherichia coli CFT073
ugguuaaacgugaauuuuuacuu

SEQ ID NO: 620959 - RNA, 20 nt, Escherichia coli CFT073
ugguguuauaggccccagcc

SEQ ID NO: 620960 - RNA, 23 nt, Escherichia coli CFT073
ugguuagcggcgguaaaaucauc

SEQ ID NO: 620961 - RNA, 21 nt, Escherichia coli CFT073
ugguuagcaaggaugccauuu

SEQ ID NO: 620962 - RNA, 19 nt, Escherichia coli CFT073
ugguuagcggcgguaaaau

SEQ ID NO: 620963 - RNA, 19 nt, Escherichia coli CFT073
ugguuacgcaagccaggua

SEQ ID NO: 620964 - RNA, 21 nt, Escherichia coli CFT073
ugguuagagcacaucacucau

SEQ ID NO: 620965 - RNA, 22 nt, Escherichia coli CFT073
ugguucagacgccacuuuuuuc

SEQ ID NO: 620966 - RNA, 21 nt, Escherichia coli CFT073
ugguuauccagcaaccaggua

SEQ ID NO: 620967 - RNA, 19 nt, Escherichia coli CFT073
ugguuaucuuccaccacca

SEQ ID NO: 620968 - RNA, 13 nt, Escherichia coli CFT073
ugguuauucaaag

SEQ ID NO: 620969 - RNA, 17 nt, Escherichia coli CFT073
ugguuauuucacuucaa

SEQ ID NO: 620970 - RNA, 22 nt, Escherichia coli CFT073
ugguuauuucacuucaaccaca

SEQ ID NO: 620971 - RNA, 18 nt, Escherichia coli CFT073
ugguguauuuacccggau

SEQ ID NO: 620972 - RNA, 18 nt, Escherichia coli CFT073
uggugucgcaccuuucaa

SEQ ID NO: 620973 - RNA, 19 nt, Escherichia coli CFT073
uggugucgcaccuuucaac

SEQ ID NO: 620974 - RNA, 23 nt, Escherichia coli CFT073
ugguguggagugcagcacucgau

SEQ ID NO: 620975 - RNA, 21 nt, Escherichia coli CFT073
ugguggccgccacgcgugagc

SEQ ID NO: 620976 - RNA, 16 nt, Escherichia coli CFT073
uggugcuguuuucucc

SEQ ID NO: 620977 - RNA, 19 nt, Escherichia coli CFT073
uggugcuugccagagcagc

SEQ ID NO: 620978 - RNA, 14 nt, Escherichia coli CFT073
ugguggcagccagc

SEQ ID NO: 620979 - RNA, 13 nt, Escherichia coli CFT073
ugguuguaaucca

SEQ ID NO: 620980 - RNA, 23 nt, Escherichia coli CFT073
ugguugaucaauucgagcaucau

SEQ ID NO: 620981 - RNA, 14 nt, Escherichia coli CFT073
ugguugcaugauga

SEQ ID NO: 620982 - RNA, 16 nt, Escherichia coli CFT073
ugguucugcacagcuu

SEQ ID NO: 620983 - RNA, 15 nt, Escherichia coli CFT073
ugguugaaauaaacc

SEQ ID NO: 620984 - RNA, 15 nt, Escherichia coli CFT073
ugguuccauucaagg

SEQ ID NO: 620985 - RNA, 22 nt, Escherichia coli CFT073
ugguuccauucaaggacaaacc

SEQ ID NO: 620986 - RNA, 15 nt, Escherichia coli CFT073
ugguuccacucugcc

SEQ ID NO: 620987 - RNA, 13 nt, Escherichia coli CFT073
uguaaauauuggu

SEQ ID NO: 620988 - RNA, 14 nt, Escherichia coli CFT073
uguaaaugaacuca

SEQ ID NO: 620989 - RNA, 14 nt, Escherichia coli CFT073
uguaaaguacgugu

SEQ ID NO: 620990 - RNA, 14 nt, Escherichia coli CFT073
uguaaagucacauu

SEQ ID NO: 620991 - RNA, 20 nt, Escherichia coli CFT073
uguaaaguaacgaauaaucc

SEQ ID NO: 620992 - RNA, 17 nt, Escherichia coli CFT073
uguaaauaauugaauaa

SEQ ID NO: 620993 - RNA, 17 nt, Escherichia coli CFT073
ugguuuucaauuaucac

SEQ ID NO: 620994 - RNA, 14 nt, Escherichia coli CFT073
ugguuugcauccac

SEQ ID NO: 620995 - RNA, 14 nt, Escherichia coli CFT073
ugguuuggaucugu

SEQ ID NO: 620996 - RNA, 15 nt, Escherichia coli CFT073
uguaauuacgcagcg

SEQ ID NO: 620997 - RNA, 12 nt, Escherichia coli CFT073
uguaauuucagc

SEQ ID NO: 620998 - RNA, 16 nt, Escherichia coli CFT073
uguacaggauauauuu

SEQ ID NO: 620999 - RNA, 17 nt, Escherichia coli CFT073
uguacucaauugcuucg

SEQ ID NO: 621000 - RNA, 18 nt, Escherichia coli CFT073
uguacucaccaacgcaga

SEQ ID NO: 621001 - RNA, 18 nt, Escherichia coli CFT073
uguacgcucauccugugg

SEQ ID NO: 621002 - RNA, 18 nt, Escherichia coli CFT073
uguaagggcuaaucugaa

SEQ ID NO: 621003 - RNA, 15 nt, Escherichia coli CFT073
uguaagccgccgcca

SEQ ID NO: 621004 - RNA, 15 nt, Escherichia coli CFT073
uguaagccucuuuca

SEQ ID NO: 621005 - RNA, 22 nt, Escherichia coli CFT073
uguaagccaagcgccgccucag

SEQ ID NO: 621006 - RNA, 16 nt, Escherichia coli CFT073
uguaaaugcaaauuuc

SEQ ID NO: 621007 - RNA, 13 nt, Escherichia coli CFT073
uguaaaugcugcu

SEQ ID NO: 621008 - RNA, 20 nt, Escherichia coli CFT073
uguaagaccugucucuuaua

SEQ ID NO: 621009 - RNA, 14 nt, Escherichia coli CFT073
uguaauaaaccugc

SEQ ID NO: 621010 - RNA, 14 nt, Escherichia coli CFT073
uguaauaacgcuua

SEQ ID NO: 621011 - RNA, 13 nt, Escherichia coli CFT073
uguaauaagaggu

SEQ ID NO: 621012 - RNA, 21 nt, Escherichia coli CFT073
uguaauacaaacucacugcca

SEQ ID NO: 621013 - RNA, 22 nt, Escherichia coli CFT073
uggcgcaucagcagauaccaac

SEQ ID NO: 621014 - RNA, 13 nt, Escherichia coli CFT073
uggcgcauccagc

SEQ ID NO: 621015 - RNA, 19 nt, Escherichia coli CFT073
uggcgcauuaacucacugg

SEQ ID NO: 621016 - RNA, 21 nt, Escherichia coli CFT073
uggcgcauuaacucacuggcg

SEQ ID NO: 621017 - RNA, 22 nt, Escherichia coli CFT073
uggcgcaggggcagaaacaacc

SEQ ID NO: 621018 - RNA, 14 nt, Escherichia coli CFT073
uggcgcagcaguuc

SEQ ID NO: 621019 - RNA, 21 nt, Escherichia coli CFT073
uggcgcagcaguucgccgccg

SEQ ID NO: 621020 - RNA, 16 nt, Escherichia coli CFT073
uggcgcaaucaguuug

SEQ ID NO: 621021 - RNA, 20 nt, Escherichia coli CFT073
uggcgacggcgaaucaaccg

SEQ ID NO: 621022 - RNA, 16 nt, Escherichia coli CFT073
uggcgauguaauucag

SEQ ID NO: 621023 - RNA, 18 nt, Escherichia coli CFT073
uggcgauguaauucagcc

SEQ ID NO: 621024 - RNA, 13 nt, Escherichia coli CFT073
uggcgaugcugcg

SEQ ID NO: 621025 - RNA, 16 nt, Escherichia coli CFT073
uggcgauggaagaggu

SEQ ID NO: 621026 - RNA, 13 nt, Escherichia coli CFT073
uggcgagcagcaa

SEQ ID NO: 621027 - RNA, 21 nt, Escherichia coli CFT073
uggcgauucauaugcgccagc

SEQ ID NO: 621028 - RNA, 22 nt, Escherichia coli CFT073
uggcgcaacacccugaugugca

SEQ ID NO: 621029 - RNA, 20 nt, Escherichia coli CFT073
uggcgcaacugcgccgcgag

SEQ ID NO: 621030 - RNA, 22 nt, Escherichia coli CFT073
uggccccuggcuggucagcaau

SEQ ID NO: 621031 - RNA, 13 nt, Escherichia coli CFT073
uggcccgcgcagc

SEQ ID NO: 621032 - RNA, 15 nt, Escherichia coli CFT073
uggccuucuucaucg

SEQ ID NO: 621033 - RNA, 16 nt, Escherichia coli CFT073
uggccuggugaguggc

SEQ ID NO: 621034 - RNA, 11 nt, Escherichia coli CFT073
uggccuggccc

SEQ ID NO: 621035 - RNA, 16 nt, Escherichia coli CFT073
uggcgcguccggcguc

SEQ ID NO: 621036 - RNA, 16 nt, Escherichia coli CFT073
uggcgccccacuucau

SEQ ID NO: 621037 - RNA, 18 nt, Escherichia coli CFT073
uggcucagauugaacgcu

SEQ ID NO: 621038 - RNA, 15 nt, Escherichia coli CFT073
uggcucagccagacg

SEQ ID NO: 621039 - RNA, 15 nt, Escherichia coli CFT073
uggcguaguugcugc

SEQ ID NO: 621040 - RNA, 23 nt, Escherichia coli CFT073
uggcgucagaccggcaaccagca

SEQ ID NO: 621041 - RNA, 13 nt, Escherichia coli CFT073
uggcguacagcug

SEQ ID NO: 621042 - RNA, 16 nt, Escherichia coli CFT073
uggcguacccaucaac

SEQ ID NO: 621043 - RNA, 15 nt, Escherichia coli CFT073
uggcguuuucuuuuu

SEQ ID NO: 621044 - RNA, 14 nt, Escherichia coli CFT073
uggcugcacuuuca

SEQ ID NO: 621045 - RNA, 19 nt, Escherichia coli CFT073
uggcugcgcgaaaacccuc

SEQ ID NO: 621046 - RNA, 20 nt, Escherichia coli CFT073
uggcugcgcgaaaacccucg

SEQ ID NO: 621047 - RNA, 12 nt, Escherichia coli CFT073
uggcugauggaa

SEQ ID NO: 621048 - RNA, 20 nt, Escherichia coli CFT073
uggcucguuauagguauucg

SEQ ID NO: 621049 - RNA, 19 nt, Escherichia coli CFT073
uggcugaccgucgcagcca

SEQ ID NO: 621050 - RNA, 21 nt, Escherichia coli CFT073
uggcugaccgucgcagccagc

SEQ ID NO: 621051 - RNA, 16 nt, Escherichia coli CFT073
uggcuccuguuugcau

SEQ ID NO: 621052 - RNA, 20 nt, Escherichia coli CFT073
uggcuccgggugugacaaca

SEQ ID NO: 621053 - RNA, 22 nt, Escherichia coli CFT073
uggcucauuaguuaauucaugu

SEQ ID NO: 621054 - RNA, 14 nt, Escherichia coli CFT073
ugggaaaugacauu

SEQ ID NO: 621055 - RNA, 16 nt, Escherichia coli CFT073
ugggaaauggcugguc

SEQ ID NO: 621056 - RNA, 19 nt, Escherichia coli CFT073
uggcuguuucgcuucuuca

SEQ ID NO: 621057 - RNA, 18 nt, Escherichia coli CFT073
uggcuguuuucagcacca

SEQ ID NO: 621058 - RNA, 21 nt, Escherichia coli CFT073
uggcugugaauuacugcugcg

SEQ ID NO: 621059 - RNA, 16 nt, Escherichia coli CFT073
uggcuguauuuuucca

SEQ ID NO: 621060 - RNA, 20 nt, Escherichia coli CFT073
ugggaccaccgcgcuaaggc

SEQ ID NO: 621061 - RNA, 12 nt, Escherichia coli CFT073
ugggcugguugg

SEQ ID NO: 621062 - RNA, 15 nt, Escherichia coli CFT073
ugggcgaucggcagg

SEQ ID NO: 621063 - RNA, 14 nt, Escherichia coli CFT073
ugggccuuucgcuu

SEQ ID NO: 621064 - RNA, 22 nt, Escherichia coli CFT073
ugggcgacaaaguugaagccga

SEQ ID NO: 621065 - RNA, 17 nt, Escherichia coli CFT073
uggggaaaaaacacaaa

SEQ ID NO: 621066 - RNA, 19 nt, Escherichia coli CFT073
ugggcuucauccagcagcg

SEQ ID NO: 621067 - RNA, 23 nt, Escherichia coli CFT073
ugggagcagagcauucccgccau

SEQ ID NO: 621068 - RNA, 18 nt, Escherichia coli CFT073
ugggcagcucuaucugca

SEQ ID NO: 621069 - RNA, 24 nt, Escherichia coli CFT073
ugggcaucgcgacagugcauaaau

SEQ ID NO: 621070 - RNA, 17 nt, Escherichia coli CFT073
ugggcauuggcaaucac

SEQ ID NO: 621071 - RNA, 13 nt, Escherichia coli CFT073
ugggccugauaag

SEQ ID NO: 621072 - RNA, 19 nt, Escherichia coli CFT073
uggauguugccaacaauca

SEQ ID NO: 621073 - RNA, 12 nt, Escherichia coli CFT073
uggauuacucua

SEQ ID NO: 621074 - RNA, 13 nt, Escherichia coli CFT073
uggauuaucuuca

SEQ ID NO: 621075 - RNA, 14 nt, Escherichia coli CFT073
uggauuaucuucac

SEQ ID NO: 621076 - RNA, 13 nt, Escherichia coli CFT073
uggauuuuucgcg

SEQ ID NO: 621077 - RNA, 17 nt, Escherichia coli CFT073
uggauucauccggcaac

SEQ ID NO: 621078 - RNA, 14 nt, Escherichia coli CFT073
uggcaaaaucaaaa

SEQ ID NO: 621079 - RNA, 20 nt, Escherichia coli CFT073
uggcaacgacgguaaaccac

SEQ ID NO: 621080 - RNA, 21 nt, Escherichia coli CFT073
uggauuuuuguuucacacuga

SEQ ID NO: 621081 - RNA, 22 nt, Escherichia coli CFT073
uggauuuuuguuucacacugac

SEQ ID NO: 621082 - RNA, 13 nt, Escherichia coli CFT073
uggcaaaaccaaa

SEQ ID NO: 621083 - RNA, 18 nt, Escherichia coli CFT073
uggcaaaaauaaggcgga

SEQ ID NO: 621084 - RNA, 19 nt, Escherichia coli CFT073
uggcaaaaauaaggcggau

SEQ ID NO: 621085 - RNA, 14 nt, Escherichia coli CFT073
uggcaaaagaagca

SEQ ID NO: 621086 - RNA, 15 nt, Escherichia coli CFT073
uggcaaaagaagcac

SEQ ID NO: 621087 - RNA, 15 nt, Escherichia coli CFT073
uggcagugguaucaa

SEQ ID NO: 621088 - RNA, 13 nt, Escherichia coli CFT073
uggcagucuuaau

SEQ ID NO: 621089 - RNA, 20 nt, Escherichia coli CFT073
uggcaguagcgccucuucca

SEQ ID NO: 621090 - RNA, 16 nt, Escherichia coli CFT073
uggcagacuuuuccuu

SEQ ID NO: 621091 - RNA, 19 nt, Escherichia coli CFT073
uggcagaguaucgccaucc

SEQ ID NO: 621092 - RNA, 16 nt, Escherichia coli CFT073
uggcaacuuuaauaau

SEQ ID NO: 621093 - RNA, 16 nt, Escherichia coli CFT073
uggcaauaauauccca

SEQ ID NO: 621094 - RNA, 19 nt, Escherichia coli CFT073
uggcacuaauuaagacuga

SEQ ID NO: 621095 - RNA, 21 nt, Escherichia coli CFT073
uggcacuaauuaagacugaug

SEQ ID NO: 621096 - RNA, 14 nt, Escherichia coli CFT073
uggcacucuuccag

SEQ ID NO: 621097 - RNA, 14 nt, Escherichia coli CFT073
uggcacuucaagau

SEQ ID NO: 621098 - RNA, 22 nt, Escherichia coli CFT073
uggcacuggguucaucuuccag

SEQ ID NO: 621099 - RNA, 21 nt, Escherichia coli CFT073
uggcacuguggucaacccaac

SEQ ID NO: 621100 - RNA, 18 nt, Escherichia coli CFT073
uggcagaaugguuucauu

SEQ ID NO: 621101 - RNA, 22 nt, Escherichia coli CFT073
uggcagaauuugaggaagcugc

SEQ ID NO: 621102 - RNA, 13 nt, Escherichia coli CFT073
uggcauccuugcu

SEQ ID NO: 621103 - RNA, 22 nt, Escherichia coli CFT073
uggcauccuugcuaaccaacaa

SEQ ID NO: 621104 - RNA, 18 nt, Escherichia coli CFT073
uggcauaacgcagaaaaa

SEQ ID NO: 621105 - RNA, 22 nt, Escherichia coli CFT073
uggcauuauuuacgcgucaguu

SEQ ID NO: 621106 - RNA, 20 nt, Escherichia coli CFT073
uggcaucugauaagcccagc

SEQ ID NO: 621107 - RNA, 17 nt, Escherichia coli CFT073
uggcaucuggugccagc

SEQ ID NO: 621108 - RNA, 19 nt, Escherichia coli CFT073
uggcauuaaauucagcaaa

SEQ ID NO: 621109 - RNA, 17 nt, Escherichia coli CFT073
uggccccaggcauagaa

SEQ ID NO: 621110 - RNA, 13 nt, Escherichia coli CFT073
uggaguggcccag

SEQ ID NO: 621111 - RNA, 14 nt, Escherichia coli CFT073
uggauaaccuguug

SEQ ID NO: 621112 - RNA, 18 nt, Escherichia coli CFT073
uggauaaccuguugacca

SEQ ID NO: 621113 - RNA, 15 nt, Escherichia coli CFT073
uggauaaauaugacg

SEQ ID NO: 621114 - RNA, 21 nt, Escherichia coli CFT073
uggauaaggccaccagcggca

SEQ ID NO: 621115 - RNA, 21 nt, Escherichia coli CFT073
uggauauaauucaucacgcca

SEQ ID NO: 621116 - RNA, 17 nt, Escherichia coli CFT073
uggauauaauuuuuuua

SEQ ID NO: 621117 - RNA, 18 nt, Escherichia coli CFT073
uggauauacgcuuucagc

SEQ ID NO: 621118 - RNA, 14 nt, Escherichia coli CFT073
uggaucuuccccuu

SEQ ID NO: 621119 - RNA, 20 nt, Escherichia coli CFT073
uggaugcgauguucccccag

SEQ ID NO: 621120 - RNA, 23 nt, Escherichia coli CFT073
uggaugcgauguucccccagcca

SEQ ID NO: 621121 - RNA, 19 nt, Escherichia coli CFT073
uggaucagcguuucuucca

SEQ ID NO: 621122 - RNA, 22 nt, Escherichia coli CFT073
uggaucaauuucguugaccugu

SEQ ID NO: 621123 - RNA, 15 nt, Escherichia coli CFT073
uggaucccagaagau

SEQ ID NO: 621124 - RNA, 15 nt, Escherichia coli CFT073
uggagccaucaccau

SEQ ID NO: 621125 - RNA, 13 nt, Escherichia coli CFT073
uggagcaggaaua

SEQ ID NO: 621126 - RNA, 17 nt, Escherichia coli CFT073
uggagaguugcaccagc

SEQ ID NO: 621127 - RNA, 20 nt, Escherichia coli CFT073
uggagaguugcaccagcaau

SEQ ID NO: 621128 - RNA, 20 nt, Escherichia coli CFT073
uggaggccgagcuaauaauc

SEQ ID NO: 621129 - RNA, 14 nt, Escherichia coli CFT073
uggacgcacaucgc

SEQ ID NO: 621130 - RNA, 15 nt, Escherichia coli CFT073
uggagacagauuuau

SEQ ID NO: 621131 - RNA, 20 nt, Escherichia coli CFT073
uggacuucuuuauaacccug

SEQ ID NO: 621132 - RNA, 15 nt, Escherichia coli CFT073
uuccuuugcugcucu

SEQ ID NO: 621133 - RNA, 18 nt, Escherichia coli CFT073
uuccuuuacuuugcaaug

SEQ ID NO: 621134 - RNA, 21 nt, Escherichia coli CFT073
uuccuugcugauuuuauuuca

SEQ ID NO: 621135 - RNA, 16 nt, Escherichia coli CFT073
uucgcuggaauaaucg

SEQ ID NO: 621136 - RNA, 15 nt, Escherichia coli CFT073
uucgcugacaguacc

SEQ ID NO: 621137 - RNA, 18 nt, Escherichia coli CFT073
uucgcugacgccugccag

SEQ ID NO: 621138 - RNA, 16 nt, Escherichia coli CFT073
uucgcugccacaccau

SEQ ID NO: 621139 - RNA, 15 nt, Escherichia coli CFT073
uucgcugccgcucug

SEQ ID NO: 621140 - RNA, 23 nt, Escherichia coli CFT073
uucgccguguucuuacccacugu

SEQ ID NO: 621141 - RNA, 23 nt, Escherichia coli CFT073
uucgccgcgcccgcguuccugac

SEQ ID NO: 621142 - RNA, 15 nt, Escherichia coli CFT073
uucgccugaaauaau

SEQ ID NO: 621143 - RNA, 15 nt, Escherichia coli CFT073
uucgccgccagaucc

SEQ ID NO: 621144 - RNA, 20 nt, Escherichia coli CFT073
uucgccgcccugcaacauca

SEQ ID NO: 621145 - RNA, 13 nt, Escherichia coli CFT073
uucgcuucaagca

SEQ ID NO: 621146 - RNA, 15 nt, Escherichia coli CFT073
uucgcuuuuauuucu

SEQ ID NO: 621147 - RNA, 16 nt, Escherichia coli CFT073
uucgcuuaccaugcca

SEQ ID NO: 621148 - RNA, 20 nt, Escherichia coli CFT073
uucgcuguguaaacccagcc

SEQ ID NO: 621149 - RNA, 17 nt, Escherichia coli CFT073
uucgcuguguucugggc

SEQ ID NO: 621150 - RNA, 16 nt, Escherichia coli CFT073
uucgcuucgauuccca

SEQ ID NO: 621151 - RNA, 21 nt, Escherichia coli CFT073
uucgcuucgauucccagcuuu

SEQ ID NO: 621152 - RNA, 13 nt, Escherichia coli CFT073
uucgcuucuucag

SEQ ID NO: 621153 - RNA, 15 nt, Escherichia coli CFT073
uucgguugccagcgc

SEQ ID NO: 621154 - RNA, 22 nt, Escherichia coli CFT073
uucguaacggccaggcgcuuuu

SEQ ID NO: 621155 - RNA, 17 nt, Escherichia coli CFT073
uucggugguaucaaaau

SEQ ID NO: 621156 - RNA, 14 nt, Escherichia coli CFT073
uucguaauaaauca

SEQ ID NO: 621157 - RNA, 21 nt, Escherichia coli CFT073
uucguaccaaaugaaccguga

SEQ ID NO: 621158 - RNA, 17 nt, Escherichia coli CFT073
uucgugucgggaaagca

SEQ ID NO: 621159 - RNA, 20 nt, Escherichia coli CFT073
uucguguuuaagcacuuuau

SEQ ID NO: 621160 - RNA, 16 nt, Escherichia coli CFT073
uucguuaaaaccaaug

SEQ ID NO: 621161 - RNA, 19 nt, Escherichia coli CFT073
uucgugcaauucggcuuuu

SEQ ID NO: 621162 - RNA, 13 nt, Escherichia coli CFT073
uucgucacuuugc

SEQ ID NO: 621163 - RNA, 18 nt, Escherichia coli CFT073
uucgucaaagauauuauu

SEQ ID NO: 621164 - RNA, 12 nt, Escherichia coli CFT073
uucguauuuaaa

SEQ ID NO: 621165 - RNA, 19 nt, Escherichia coli CFT073
uucucguuggguugccagc

SEQ ID NO: 621166 - RNA, 19 nt, Escherichia coli CFT073
uucucucauccgccaaaac

SEQ ID NO: 621167 - RNA, 23 nt, Escherichia coli CFT073
uucucugauacucaacucacaca

SEQ ID NO: 621168 - RNA, 14 nt, Escherichia coli CFT073
uucucuucugcuuu

SEQ ID NO: 621169 - RNA, 14 nt, Escherichia coli CFT073
uucucuuucagcgc

SEQ ID NO: 621170 - RNA, 14 nt, Escherichia coli CFT073
uucugauaugcagu

SEQ ID NO: 621171 - RNA, 12 nt, Escherichia coli CFT073
uucugauugguu

SEQ ID NO: 621172 - RNA, 11 nt, Escherichia coli CFT073
uucugauuuug

SEQ ID NO: 621173 - RNA, 14 nt, Escherichia coli CFT073
uucugcaaccagaa

SEQ ID NO: 621174 - RNA, 16 nt, Escherichia coli CFT073
uucugcaaccagaaag

SEQ ID NO: 621175 - RNA, 13 nt, Escherichia coli CFT073
uucugcacacaca

SEQ ID NO: 621176 - RNA, 21 nt, Escherichia coli CFT073
uucugcacgguuuuuccagcu

SEQ ID NO: 621177 - RNA, 15 nt, Escherichia coli CFT073
uucucguaaauuccc

SEQ ID NO: 621178 - RNA, 18 nt, Escherichia coli CFT073
uucucgccguugcuggca

SEQ ID NO: 621179 - RNA, 18 nt, Escherichia coli CFT073
uucucauauaucccuucc

SEQ ID NO: 621180 - RNA, 20 nt, Escherichia coli CFT073
uucucaccaucaaacagccc

SEQ ID NO: 621181 - RNA, 23 nt, Escherichia coli CFT073
uucucaccgauagucguugccac

SEQ ID NO: 621182 - RNA, 24 nt, Escherichia coli CFT073
uucucaccuacagccacaccuucu

SEQ ID NO: 621183 - RNA, 16 nt, Escherichia coli CFT073
uucucacugauuaccc

SEQ ID NO: 621184 - RNA, 12 nt, Escherichia coli CFT073
uucuaauugugc

SEQ ID NO: 621185 - RNA, 22 nt, Escherichia coli CFT073
uucuaauugugcugcauuaucc

SEQ ID NO: 621186 - RNA, 15 nt, Escherichia coli CFT073
uucuacaagcagaga

SEQ ID NO: 621187 - RNA, 14 nt, Escherichia coli CFT073
uucuacaagcagag

SEQ ID NO: 621188 - RNA, 22 nt, Escherichia coli CFT073
uucuaccagguuucgcaauaac

SEQ ID NO: 621189 - RNA, 15 nt, Escherichia coli CFT073
uucuaccauccgcug

SEQ ID NO: 621190 - RNA, 22 nt, Escherichia coli CFT073
uucuaccgggcugaguccccca

SEQ ID NO: 621191 - RNA, 17 nt, Escherichia coli CFT073
uucuacgcgaccuuuuu

SEQ ID NO: 621192 - RNA, 17 nt, Escherichia coli CFT073
uucucaaugaugccgcc

SEQ ID NO: 621193 - RNA, 13 nt, Escherichia coli CFT073
uuccaccugcaac

SEQ ID NO: 621194 - RNA, 18 nt, Escherichia coli CFT073
uuccacgcuauacagcag

SEQ ID NO: 621195 - RNA, 17 nt, Escherichia coli CFT073
uuccacgucacaggcca

SEQ ID NO: 621196 - RNA, 16 nt, Escherichia coli CFT073
uuccacucugcccuuc

SEQ ID NO: 621197 - RNA, 14 nt, Escherichia coli CFT073
uuccacucuuucag

SEQ ID NO: 621198 - RNA, 21 nt, Escherichia coli CFT073
uuccaccccauagcggagcaa

SEQ ID NO: 621199 - RNA, 14 nt, Escherichia coli CFT073
uuccaccguaucca

SEQ ID NO: 621200 - RNA, 13 nt, Escherichia coli CFT073
uucagguacagac

SEQ ID NO: 621201 - RNA, 15 nt, Escherichia coli CFT073
uucagguacagacua

SEQ ID NO: 621202 - RNA, 15 nt, Escherichia coli CFT073
uuccacaauaccaau

SEQ ID NO: 621203 - RNA, 20 nt, Escherichia coli CFT073
uucaggguuuacaggcucuc

SEQ ID NO: 621204 - RNA, 17 nt, Escherichia coli CFT073
uucaggccgcgcaguuc

SEQ ID NO: 621205 - RNA, 13 nt, Escherichia coli CFT073
uucaggcugucag

SEQ ID NO: 621206 - RNA, 19 nt, Escherichia coli CFT073
uuccagcauaaugacucuc

SEQ ID NO: 621207 - RNA, 15 nt, Escherichia coli CFT073
uuccagcaucagcag

SEQ ID NO: 621208 - RNA, 12 nt, Escherichia coli CFT073
uuccagcaaauc

SEQ ID NO: 621209 - RNA, 14 nt, Escherichia coli CFT073
uuccagcaacgcug

SEQ ID NO: 621210 - RNA, 20 nt, Escherichia coli CFT073
uuccagcaaacgcacuuuua

SEQ ID NO: 621211 - RNA, 22 nt, Escherichia coli CFT073
uuccagcaugaugcucucccaa

SEQ ID NO: 621212 - RNA, 22 nt, Escherichia coli CFT073
uuccagcgccgccagaagggaa

SEQ ID NO: 621213 - RNA, 19 nt, Escherichia coli CFT073
uuccagaagcgguuugccg

SEQ ID NO: 621214 - RNA, 12 nt, Escherichia coli CFT073
uuccacuucauc

SEQ ID NO: 621215 - RNA, 12 nt, Escherichia coli CFT073
uuccacuuuguc

SEQ ID NO: 621216 - RNA, 23 nt, Escherichia coli CFT073
uuccagaucaccgcagaagcgau

SEQ ID NO: 621217 - RNA, 13 nt, Escherichia coli CFT073
uuccagauggaca

SEQ ID NO: 621218 - RNA, 17 nt, Escherichia coli CFT073
uuccagauguggugcca

SEQ ID NO: 621219 - RNA, 21 nt, Escherichia coli CFT073
uuccagauguggugccagugc

SEQ ID NO: 621220 - RNA, 19 nt, Escherichia coli CFT073
uuccagaaugccucaauca

SEQ ID NO: 621221 - RNA, 14 nt, Escherichia coli CFT073
uuccagaccaaaca

SEQ ID NO: 621222 - RNA, 22 nt, Escherichia coli CFT073
uuccauccggcaacaucaaauc

SEQ ID NO: 621223 - RNA, 23 nt, Escherichia coli CFT073
uuccauccggcaacaucaaauca

SEQ ID NO: 621224 - RNA, 19 nt, Escherichia coli CFT073
uuccaucgcgcuuagcaaa

SEQ ID NO: 621225 - RNA, 14 nt, Escherichia coli CFT073
uuccaucuccagcu

SEQ ID NO: 621226 - RNA, 23 nt, Escherichia coli CFT073
uuccauaccggcugcaaacccug

SEQ ID NO: 621227 - RNA, 19 nt, Escherichia coli CFT073
uuccauucuccgcucuuca

SEQ ID NO: 621228 - RNA, 17 nt, Escherichia coli CFT073
uuccauugccugcaacg

SEQ ID NO: 621229 - RNA, 14 nt, Escherichia coli CFT073
uuccauuguccacc

SEQ ID NO: 621230 - RNA, 16 nt, Escherichia coli CFT073
uuccauuucaucgcca

SEQ ID NO: 621231 - RNA, 19 nt, Escherichia coli CFT073
uuccaguuugcucaaaucc

SEQ ID NO: 621232 - RNA, 17 nt, Escherichia coli CFT073
uuccaguugaacaaucu

SEQ ID NO: 621233 - RNA, 16 nt, Escherichia coli CFT073
uuccaggucaauccca

SEQ ID NO: 621234 - RNA, 18 nt, Escherichia coli CFT073
uuccagguuaacccacag

SEQ ID NO: 621235 - RNA, 20 nt, Escherichia coli CFT073
uuccagucacccugcccggc

SEQ ID NO: 621236 - RNA, 23 nt, Escherichia coli CFT073
uuccagcucuucuacauuucugu

SEQ ID NO: 621237 - RNA, 23 nt, Escherichia coli CFT073
uuccagcuucagauuagccgcag

SEQ ID NO: 621238 - RNA, 18 nt, Escherichia coli CFT073
uuccagcuuccaggcaau

SEQ ID NO: 621239 - RNA, 19 nt, Escherichia coli CFT073
uuccagcuucgcuaccuga

SEQ ID NO: 621240 - RNA, 16 nt, Escherichia coli CFT073
uuccagcggcaggccg

SEQ ID NO: 621241 - RNA, 18 nt, Escherichia coli CFT073
uuccagcgguaacuuauc

SEQ ID NO: 621242 - RNA, 21 nt, Escherichia coli CFT073
uuccagcguagugaaggcaaa

SEQ ID NO: 621243 - RNA, 18 nt, Escherichia coli CFT073
uuccagcucaaccagauu

SEQ ID NO: 621244 - RNA, 22 nt, Escherichia coli CFT073
uuccagcuccagccgcuccccu

SEQ ID NO: 621245 - RNA, 11 nt, Escherichia coli CFT073
uucccuuucag

SEQ ID NO: 621246 - RNA, 23 nt, Escherichia coli CFT073
uucccgcgcuaccacuucccaac

SEQ ID NO: 621247 - RNA, 13 nt, Escherichia coli CFT073
uuccgagcagcuc

SEQ ID NO: 621248 - RNA, 18 nt, Escherichia coli CFT073
uuccgcaacgccgccaac

SEQ ID NO: 621249 - RNA, 22 nt, Escherichia coli CFT073
uuccgcaacgucagugacugcu

SEQ ID NO: 621250 - RNA, 14 nt, Escherichia coli CFT073
uuccgcaauacagc

SEQ ID NO: 621251 - RNA, 14 nt, Escherichia coli CFT073
uuccccaacacagg

SEQ ID NO: 621252 - RNA, 12 nt, Escherichia coli CFT073
uuccccaccuga

SEQ ID NO: 621253 - RNA, 20 nt, Escherichia coli CFT073
uucccgagacaucccuuuau

SEQ ID NO: 621254 - RNA, 12 nt, Escherichia coli CFT073
uucccgacguaa

SEQ ID NO: 621255 - RNA, 21 nt, Escherichia coli CFT073
uucccgaggcauuccuuuacu

SEQ ID NO: 621256 - RNA, 23 nt, Escherichia coli CFT073
uucccgauaagggagcaggccag

SEQ ID NO: 621257 - RNA, 21 nt, Escherichia coli CFT073
uucccgcagaccuucugccag

SEQ ID NO: 621258 - RNA, 21 nt, Escherichia coli CFT073
uucccgcaagcggcccggaga

SEQ ID NO: 621259 - RNA, 15 nt, Escherichia coli CFT073
uucccaaaucaaauc

SEQ ID NO: 621260 - RNA, 16 nt, Escherichia coli CFT073
uucccaaaucaaauca

SEQ ID NO: 621261 - RNA, 15 nt, Escherichia coli CFT073
uucccagucaggcac

SEQ ID NO: 621262 - RNA, 18 nt, Escherichia coli CFT073
uucccagcaccgcagaga

SEQ ID NO: 621263 - RNA, 13 nt, Escherichia coli CFT073
uucccagcaacag

SEQ ID NO: 621264 - RNA, 15 nt, Escherichia coli CFT073
uucccagcaagaacc

SEQ ID NO: 621265 - RNA, 19 nt, Escherichia coli CFT073
uucccagcaggaucaauac

SEQ ID NO: 621266 - RNA, 21 nt, Escherichia coli CFT073
uuccuguauuugaauuucaaa

SEQ ID NO: 621267 - RNA, 21 nt, Escherichia coli CFT073
uuccuggaaccagugaauacu

SEQ ID NO: 621268 - RNA, 22 nt, Escherichia coli CFT073
uuccuggcgguugauaaugauu

SEQ ID NO: 621269 - RNA, 23 nt, Escherichia coli CFT073
uuccuggcuggcgcuacugaagc

SEQ ID NO: 621270 - RNA, 22 nt, Escherichia coli CFT073
uuccuguaaagagugugaauau

SEQ ID NO: 621271 - RNA, 13 nt, Escherichia coli CFT073
uuccugcucauca

SEQ ID NO: 621272 - RNA, 22 nt, Escherichia coli CFT073
uuccugcucggcaaacugcuga

SEQ ID NO: 621273 - RNA, 18 nt, Escherichia coli CFT073
uuccugcgcuuucugcuu

SEQ ID NO: 621274 - RNA, 23 nt, Escherichia coli CFT073
uuccugcggcagacgcucgccau

SEQ ID NO: 621275 - RNA, 23 nt, Escherichia coli CFT073
uuccugcguaacuguucgaggua

SEQ ID NO: 621276 - RNA, 22 nt, Escherichia coli CFT073
uuccugcagcgugauccacccu

SEQ ID NO: 621277 - RNA, 14 nt, Escherichia coli CFT073
uuccugcaucgccu

SEQ ID NO: 621278 - RNA, 17 nt, Escherichia coli CFT073
uuccugaucaauaaucu

SEQ ID NO: 621279 - RNA, 14 nt, Escherichia coli CFT073
uuccugaugaaaaa

SEQ ID NO: 621280 - RNA, 23 nt, Escherichia coli CFT073
uuccucaucgucaaaugaauaac

SEQ ID NO: 621281 - RNA, 15 nt, Escherichia coli CFT073
uuccucaacaucuuc

SEQ ID NO: 621282 - RNA, 12 nt, Escherichia coli CFT073
uuccggagucaa

SEQ ID NO: 621283 - RNA, 22 nt, Escherichia coli CFT073
uuccggaucgccaaagcggcag

SEQ ID NO: 621284 - RNA, 22 nt, Escherichia coli CFT073
uuccgcuuuuuucccaauaauu

SEQ ID NO: 621285 - RNA, 18 nt, Escherichia coli CFT073
uuccggcaaucaacagau

SEQ ID NO: 621286 - RNA, 17 nt, Escherichia coli CFT073
uuccgcuuacugguuuu

SEQ ID NO: 621287 - RNA, 17 nt, Escherichia coli CFT073
uugccggacgcugagca

SEQ ID NO: 621288 - RNA, 17 nt, Escherichia coli CFT073
uugccggaugugaugca

SEQ ID NO: 621289 - RNA, 18 nt, Escherichia coli CFT073
uugccgcgcucuuuaaag

SEQ ID NO: 621290 - RNA, 15 nt, Escherichia coli CFT073
uugcccgcagaucca

SEQ ID NO: 621291 - RNA, 18 nt, Escherichia coli CFT073
uugcccggugucaacuca

SEQ ID NO: 621292 - RNA, 22 nt, Escherichia coli CFT073
uugcccggugucaacucacugu

SEQ ID NO: 621293 - RNA, 21 nt, Escherichia coli CFT073
uugcccucugaauaacaccca

SEQ ID NO: 621294 - RNA, 13 nt, Escherichia coli CFT073
uugcccugacgcu

SEQ ID NO: 621295 - RNA, 16 nt, Escherichia coli CFT073
uugcccugaucaccca

SEQ ID NO: 621296 - RNA, 15 nt, Escherichia coli CFT073
uugccgacgcuccug

SEQ ID NO: 621297 - RNA, 23 nt, Escherichia coli CFT073
uugccgagaagauuuuuugccag

SEQ ID NO: 621298 - RNA, 16 nt, Escherichia coli CFT073
uugccgaugauuccca

SEQ ID NO: 621299 - RNA, 14 nt, Escherichia coli CFT073
uugccgcaccaacc

SEQ ID NO: 621300 - RNA, 14 nt, Escherichia coli CFT073
uugccgcacucuga

SEQ ID NO: 621301 - RNA, 23 nt, Escherichia coli CFT073
uugccgaauggcugcacuuucag

SEQ ID NO: 621302 - RNA, 16 nt, Escherichia coli CFT073
uugcauuucugacgau

SEQ ID NO: 621303 - RNA, 17 nt, Escherichia coli CFT073
uugccaaccgaugccac

SEQ ID NO: 621304 - RNA, 19 nt, Escherichia coli CFT073
uugcaccagaucuuccagc

SEQ ID NO: 621305 - RNA, 23 nt, Escherichia coli CFT073
uugcaccagaucuuccagcggca

SEQ ID NO: 621306 - RNA, 21 nt, Escherichia coli CFT073
uugcaccagcaauaagccagu

SEQ ID NO: 621307 - RNA, 13 nt, Escherichia coli CFT073
uugcaccaggccg

SEQ ID NO: 621308 - RNA, 23 nt, Escherichia coli CFT073
uugcacagguggcaaacgccacc

SEQ ID NO: 621309 - RNA, 17 nt, Escherichia coli CFT073
uugcaccgaggccaaaa

SEQ ID NO: 621310 - RNA, 15 nt, Escherichia coli CFT073
uugcaccuaaagcgc

SEQ ID NO: 621311 - RNA, 16 nt, Escherichia coli CFT073
uugcacgagauuguau

SEQ ID NO: 621312 - RNA, 21 nt, Escherichia coli CFT073
uugcccccugaagcaguuuca

SEQ ID NO: 621313 - RNA, 13 nt, Escherichia coli CFT073
uugccaaggucgg

SEQ ID NO: 621314 - RNA, 23 nt, Escherichia coli CFT073
uugcgcccgacaauaugcagcag

SEQ ID NO: 621315 - RNA, 17 nt, Escherichia coli CFT073
uugcgccgaacaacagu

SEQ ID NO: 621316 - RNA, 20 nt, Escherichia coli CFT073
uugcgccguacaaguccuga

SEQ ID NO: 621317 - RNA, 18 nt, Escherichia coli CFT073
uugcguucaucaguucca

SEQ ID NO: 621318 - RNA, 16 nt, Escherichia coli CFT073
uugcgucagcuucaga

SEQ ID NO: 621319 - RNA, 22 nt, Escherichia coli CFT073
uugcguccacuggucugacgcu

SEQ ID NO: 621320 - RNA, 15 nt, Escherichia coli CFT073
uugcgucuuaucagg

SEQ ID NO: 621321 - RNA, 19 nt, Escherichia coli CFT073
uugcgucuuaucaggccua

SEQ ID NO: 621322 - RNA, 12 nt, Escherichia coli CFT073
uugccugcagga

SEQ ID NO: 621323 - RNA, 15 nt, Escherichia coli CFT073
uugccugccgccuuu

SEQ ID NO: 621324 - RNA, 17 nt, Escherichia coli CFT073
uugccuugaugaaaaaa

SEQ ID NO: 621325 - RNA, 21 nt, Escherichia coli CFT073
uugccuguuguggguaacguu

SEQ ID NO: 621326 - RNA, 15 nt, Escherichia coli CFT073
uugcgcaacuuuuuc

SEQ ID NO: 621327 - RNA, 15 nt, Escherichia coli CFT073
uugcgcauucagaau

SEQ ID NO: 621328 - RNA, 15 nt, Escherichia coli CFT073
uugcgcauucuacuu

SEQ ID NO: 621329 - RNA, 14 nt, Escherichia coli CFT073
uugcugaaaaggcu

SEQ ID NO: 621330 - RNA, 15 nt, Escherichia coli CFT073
uugcucuuucacuuu

SEQ ID NO: 621331 - RNA, 19 nt, Escherichia coli CFT073
uugcucuucgcguaauguu

SEQ ID NO: 621332 - RNA, 16 nt, Escherichia coli CFT073
uugcucucgggcagua

SEQ ID NO: 621333 - RNA, 20 nt, Escherichia coli CFT073
uugcucugguuccccauucu

SEQ ID NO: 621334 - RNA, 13 nt, Escherichia coli CFT073
uugcucuguuuuc

SEQ ID NO: 621335 - RNA, 14 nt, Escherichia coli CFT073
uugcucguuuucaa

SEQ ID NO: 621336 - RNA, 16 nt, Escherichia coli CFT073
uugcuccacgcucaga

SEQ ID NO: 621337 - RNA, 19 nt, Escherichia coli CFT073
uugcucagaaucacgccaa

SEQ ID NO: 621338 - RNA, 20 nt, Escherichia coli CFT073
uugcucagugucagguacug

SEQ ID NO: 621339 - RNA, 21 nt, Escherichia coli CFT073
uugcguucuuccaucaccgcc

SEQ ID NO: 621340 - RNA, 21 nt, Escherichia coli CFT073
uugcguuccggcggcacagcc

SEQ ID NO: 621341 - RNA, 16 nt, Escherichia coli CFT073
uugcaaacccacagag

SEQ ID NO: 621342 - RNA, 20 nt, Escherichia coli CFT073
uugcaaagagaacugagcga

SEQ ID NO: 621343 - RNA, 16 nt, Escherichia coli CFT073
uugcaaauauuccauc

SEQ ID NO: 621344 - RNA, 20 nt, Escherichia coli CFT073
uugcaauaguuugaugaccg

SEQ ID NO: 621345 - RNA, 19 nt, Escherichia coli CFT073
uugcaaucucugacauaaa

SEQ ID NO: 621346 - RNA, 17 nt, Escherichia coli CFT073
uugcaaugcaucagcug

SEQ ID NO: 621347 - RNA, 19 nt, Escherichia coli CFT073
uugaugccaccaggcagca

SEQ ID NO: 621348 - RNA, 22 nt, Escherichia coli CFT073
uugaugcgaguaaucaggcuau

SEQ ID NO: 621349 - RNA, 18 nt, Escherichia coli CFT073
uugaugaguuggcuacuc

SEQ ID NO: 621350 - RNA, 17 nt, Escherichia coli CFT073
uugauuggcuuuaaaag

SEQ ID NO: 621351 - RNA, 17 nt, Escherichia coli CFT073
uugauuguuuuaaauau

SEQ ID NO: 621352 - RNA, 14 nt, Escherichia coli CFT073
uugauucuguucag

SEQ ID NO: 621353 - RNA, 19 nt, Escherichia coli CFT073
uugauuuuuuugauaaacc

SEQ ID NO: 621354 - RNA, 20 nt, Escherichia coli CFT073
uugaugaccgguucuacauc

SEQ ID NO: 621355 - RNA, 18 nt, Escherichia coli CFT073
uugaucccggcuuccugc

SEQ ID NO: 621356 - RNA, 19 nt, Escherichia coli CFT073
uugaucccugcaccaauga

SEQ ID NO: 621357 - RNA, 16 nt, Escherichia coli CFT073
uugaucaauucgagca

SEQ ID NO: 621358 - RNA, 16 nt, Escherichia coli CFT073
uugaucacuuccagca

SEQ ID NO: 621359 - RNA, 18 nt, Escherichia coli CFT073
uugauauuuauuuccuuc

SEQ ID NO: 621360 - RNA, 12 nt, Escherichia coli CFT073
uugauauguauu

SEQ ID NO: 621361 - RNA, 24 nt, Escherichia coli CFT073
uugacuguccgcauccccuacucu

SEQ ID NO: 621362 - RNA, 19 nt, Escherichia coli CFT073
uugaguuuuucaucccucu

SEQ ID NO: 621363 - RNA, 24 nt, Escherichia coli CFT073
uugagauuguuggucacaaugcgu

SEQ ID NO: 621364 - RNA, 15 nt, Escherichia coli CFT073
uugagauuuaccgga

SEQ ID NO: 621365 - RNA, 22 nt, Escherichia coli CFT073
uugagauaagcaacaaacucau

SEQ ID NO: 621366 - RNA, 14 nt, Escherichia coli CFT073
uugagauccugcca

SEQ ID NO: 621367 - RNA, 12 nt, Escherichia coli CFT073
uugaauuucaaa

SEQ ID NO: 621368 - RNA, 24 nt, Escherichia coli CFT073
uugacagaccguugcucagaauca

SEQ ID NO: 621369 - RNA, 19 nt, Escherichia coli CFT073
uugacagcuuuuacaaaau

SEQ ID NO: 621370 - RNA, 16 nt, Escherichia coli CFT073
uugaccagugcagacu

SEQ ID NO: 621371 - RNA, 17 nt, Escherichia coli CFT073
uugaccaagaacgucaa

SEQ ID NO: 621372 - RNA, 22 nt, Escherichia coli CFT073
uugacgucccacaguuguccau

SEQ ID NO: 621373 - RNA, 15 nt, Escherichia coli CFT073
uugaccauaucauca

SEQ ID NO: 621374 - RNA, 14 nt, Escherichia coli CFT073
uugaccauauuaac

SEQ ID NO: 621375 - RNA, 19 nt, Escherichia coli CFT073
uugaaggaauuaaucccuu

SEQ ID NO: 621376 - RNA, 15 nt, Escherichia coli CFT073
uugaagcugaacagu

SEQ ID NO: 621377 - RNA, 13 nt, Escherichia coli CFT073
uugaaggaaaaau

SEQ ID NO: 621378 - RNA, 13 nt, Escherichia coli CFT073
uugaagcaaucca

SEQ ID NO: 621379 - RNA, 18 nt, Escherichia coli CFT073
uugaagcagcgcuggaga

SEQ ID NO: 621380 - RNA, 13 nt, Escherichia coli CFT073
uugaacugguuaa

SEQ ID NO: 621381 - RNA, 13 nt, Escherichia coli CFT073
uugaagaaaucag

SEQ ID NO: 621382 - RNA, 13 nt, Escherichia coli CFT073
uugaauguugacg

SEQ ID NO: 621383 - RNA, 23 nt, Escherichia coli CFT073
uugaauguugcgcgguuagaaaa

SEQ ID NO: 621384 - RNA, 22 nt, Escherichia coli CFT073
uugaauaacggccccagagcua

SEQ ID NO: 621385 - RNA, 18 nt, Escherichia coli CFT073
uugaagugaccgaaaucc

SEQ ID NO: 621386 - RNA, 18 nt, Escherichia coli CFT073
uucuuuaaaacgcuucuc

SEQ ID NO: 621387 - RNA, 20 nt, Escherichia coli CFT073
uucuugaacauugacaguaa

SEQ ID NO: 621388 - RNA, 22 nt, Escherichia coli CFT073
uucuugacuaucacucccucau

SEQ ID NO: 621389 - RNA, 16 nt, Escherichia coli CFT073
uucugcgccugguuuu

SEQ ID NO: 621390 - RNA, 17 nt, Escherichia coli CFT073
uucugcgcgaaauuauc

SEQ ID NO: 621391 - RNA, 18 nt, Escherichia coli CFT073
uucugccuggucaaagac

SEQ ID NO: 621392 - RNA, 15 nt, Escherichia coli CFT073
uucuuuaccaccaaa

SEQ ID NO: 621393 - RNA, 17 nt, Escherichia coli CFT073
uucuuuaguugagcuuu

SEQ ID NO: 621394 - RNA, 22 nt, Escherichia coli CFT073
uucuuuaguugagcuuuuuccg

SEQ ID NO: 621395 - RNA, 21 nt, Escherichia coli CFT073
uucuuuauaucugguuugcca

SEQ ID NO: 621396 - RNA, 22 nt, Escherichia coli CFT073
uucuuucaggugaccaaagaag

SEQ ID NO: 621397 - RNA, 16 nt, Escherichia coli CFT073
uucuuucaucagauca

SEQ ID NO: 621398 - RNA, 15 nt, Escherichia coli CFT073
uucuuucucuuucuu

SEQ ID NO: 621399 - RNA, 17 nt, Escherichia coli CFT073
uucuuucucgccuuucu

SEQ ID NO: 621400 - RNA, 20 nt, Escherichia coli CFT073
uucuuuguuuccccugguuc

SEQ ID NO: 621401 - RNA, 13 nt, Escherichia coli CFT073
uucuuugcgguaa

SEQ ID NO: 621402 - RNA, 13 nt, Escherichia coli CFT073
uucuuuuuuucau

SEQ ID NO: 621403 - RNA, 13 nt, Escherichia coli CFT073
uugaaaaaaggcu

SEQ ID NO: 621404 - RNA, 12 nt, Escherichia coli CFT073
uugaaauacaaa

SEQ ID NO: 621405 - RNA, 13 nt, Escherichia coli CFT073
uugaaauaaacca

SEQ ID NO: 621406 - RNA, 19 nt, Escherichia coli CFT073
uugaaagagccgauaaaca

SEQ ID NO: 621407 - RNA, 13 nt, Escherichia coli CFT073
uugaaagaugcug

SEQ ID NO: 621408 - RNA, 18 nt, Escherichia coli CFT073
uugaacauugacaguaaa

SEQ ID NO: 621409 - RNA, 19 nt, Escherichia coli CFT073
uugaacccggcaucaacca

SEQ ID NO: 621410 - RNA, 13 nt, Escherichia coli CFT073
uugaaaucgaaca

SEQ ID NO: 621411 - RNA, 17 nt, Escherichia coli CFT073
uugaaaucgaacagguu

SEQ ID NO: 621412 - RNA, 14 nt, Escherichia coli CFT073
uugaaaugagaaaa

SEQ ID NO: 621413 - RNA, 17 nt, Escherichia coli CFT073
uucaacgacauaugcgu

SEQ ID NO: 621414 - RNA, 22 nt, Escherichia coli CFT073
uucaagacgaauaccuucuucc

SEQ ID NO: 621415 - RNA, 23 nt, Escherichia coli CFT073
uucaagacgaauaccuucuuccu

SEQ ID NO: 621416 - RNA, 20 nt, Escherichia coli CFT073
uucaauaaccgcugccaggc

SEQ ID NO: 621417 - RNA, 21 nt, Escherichia coli CFT073
uucaauaccgccugcaaauaa

SEQ ID NO: 621418 - RNA, 22 nt, Escherichia coli CFT073
uucaauaccgccugcaaauaaa

SEQ ID NO: 621419 - RNA, 23 nt, Escherichia coli CFT073
uucaauaccgccugcaaauaaau

SEQ ID NO: 621420 - RNA, 16 nt, Escherichia coli CFT073
uucaaaauuuaacauu

SEQ ID NO: 621421 - RNA, 18 nt, Escherichia coli CFT073
uucaaaagccccugaauu

SEQ ID NO: 621422 - RNA, 19 nt, Escherichia coli CFT073
uucaaccucaagcacagcc

SEQ ID NO: 621423 - RNA, 16 nt, Escherichia coli CFT073
uucaacaucauuuccc

SEQ ID NO: 621424 - RNA, 19 nt, Escherichia coli CFT073
uucaaacgccacagcaauu

SEQ ID NO: 621425 - RNA, 23 nt, Escherichia coli CFT073
uuauuagcccgggauuugguucu

SEQ ID NO: 621426 - RNA, 23 nt, Escherichia coli CFT073
uuauuacugcgaauuuccugcca

SEQ ID NO: 621427 - RNA, 21 nt, Escherichia coli CFT073
uuauucuuuuuugauuccagu

SEQ ID NO: 621428 - RNA, 16 nt, Escherichia coli CFT073
uuauugugcacaggua

SEQ ID NO: 621429 - RNA, 16 nt, Escherichia coli CFT073
uuauuuaauguaaaua

SEQ ID NO: 621430 - RNA, 14 nt, Escherichia coli CFT073
uuauuuaaacugaa

SEQ ID NO: 621431 - RNA, 16 nt, Escherichia coli CFT073
uuauuuaaacugaaga

SEQ ID NO: 621432 - RNA, 19 nt, Escherichia coli CFT073
uuauuugacauuuuuucau

SEQ ID NO: 621433 - RNA, 16 nt, Escherichia coli CFT073
uuauuuuuauaacuau

SEQ ID NO: 621434 - RNA, 17 nt, Escherichia coli CFT073
uucaaaaaccugaccua

SEQ ID NO: 621435 - RNA, 21 nt, Escherichia coli CFT073
uucagccauacguugcauaaa

SEQ ID NO: 621436 - RNA, 21 nt, Escherichia coli CFT073
uucagccagggauaagccaga

SEQ ID NO: 621437 - RNA, 14 nt, Escherichia coli CFT073
uucagcucaagaau

SEQ ID NO: 621438 - RNA, 19 nt, Escherichia coli CFT073
uucagccguuuaauugccu

SEQ ID NO: 621439 - RNA, 14 nt, Escherichia coli CFT073
uucaggauugguaa

SEQ ID NO: 621440 - RNA, 15 nt, Escherichia coli CFT073
uucaggcaacaaaaa

SEQ ID NO: 621441 - RNA, 17 nt, Escherichia coli CFT073
uucaggcaacaaaaaac

SEQ ID NO: 621442 - RNA, 17 nt, Escherichia coli CFT073
uucaggaugugagcugg

SEQ ID NO: 621443 - RNA, 14 nt, Escherichia coli CFT073
uucaggaaauaaau

SEQ ID NO: 621444 - RNA, 18 nt, Escherichia coli CFT073
uucaggaacugcauacuc

SEQ ID NO: 621445 - RNA, 21 nt, Escherichia coli CFT073
uucagcugccaguuucgucag

SEQ ID NO: 621446 - RNA, 17 nt, Escherichia coli CFT073
uucagcuuauucaucaa

SEQ ID NO: 621447 - RNA, 13 nt, Escherichia coli CFT073
uucagaccaauaa

SEQ ID NO: 621448 - RNA, 14 nt, Escherichia coli CFT073
uucagaccaauaau

SEQ ID NO: 621449 - RNA, 17 nt, Escherichia coli CFT073
uucagaagauucgaaau

SEQ ID NO: 621450 - RNA, 9 nt, Escherichia coli CFT073
uucagaaua

SEQ ID NO: 621451 - RNA, 18 nt, Escherichia coli CFT073
uucagcaauaacuccccu

SEQ ID NO: 621452 - RNA, 22 nt, Escherichia coli CFT073
uucagcaagaguuuuaaaacca

SEQ ID NO: 621453 - RNA, 22 nt, Escherichia coli CFT073
uucagcacgaucccuucgauau

SEQ ID NO: 621454 - RNA, 12 nt, Escherichia coli CFT073
uucagcagagca

SEQ ID NO: 621455 - RNA, 16 nt, Escherichia coli CFT073
uucagcacuuaucucu

SEQ ID NO: 621456 - RNA, 14 nt, Escherichia coli CFT073
uucagcaauuuguu

SEQ ID NO: 621457 - RNA, 17 nt, Escherichia coli CFT073
uucagcaaucucuucaa

SEQ ID NO: 621458 - RNA, 12 nt, Escherichia coli CFT073
uucagcaccaga

SEQ ID NO: 621459 - RNA, 17 nt, Escherichia coli CFT073
uucaauacgcucgaaca

SEQ ID NO: 621460 - RNA, 16 nt, Escherichia coli CFT073
uucacauauugcagcu

SEQ ID NO: 621461 - RNA, 19 nt, Escherichia coli CFT073
uucacaggccgccaggcag

SEQ ID NO: 621462 - RNA, 23 nt, Escherichia coli CFT073
uucacaggccgccaggcagagcu

SEQ ID NO: 621463 - RNA, 15 nt, Escherichia coli CFT073
uucacacucugccag

SEQ ID NO: 621464 - RNA, 13 nt, Escherichia coli CFT073
uucacccaacucu

SEQ ID NO: 621465 - RNA, 23 nt, Escherichia coli CFT073
uucacauccacacacagauaaau

SEQ ID NO: 621466 - RNA, 15 nt, Escherichia coli CFT073
uucaccgccugcuga

SEQ ID NO: 621467 - RNA, 23 nt, Escherichia coli CFT073
uucaccgcguaugcccagcgcag

SEQ ID NO: 621468 - RNA, 20 nt, Escherichia coli CFT073
uucaccgguaguaagcguuu

SEQ ID NO: 621469 - RNA, 15 nt, Escherichia coli CFT073
uucaccguccaucca

SEQ ID NO: 621470 - RNA, 17 nt, Escherichia coli CFT073
uucaccguucaauuccg

SEQ ID NO: 621471 - RNA, 13 nt, Escherichia coli CFT073
uucacgagagcgg

SEQ ID NO: 621472 - RNA, 20 nt, Escherichia coli CFT073
uucacgauuugcguaaaacc

SEQ ID NO: 621473 - RNA, 14 nt, Escherichia coli CFT073
uucacguccggcag

SEQ ID NO: 621474 - RNA, 20 nt, Escherichia coli CFT073
uucacguccggcagcagaaa

SEQ ID NO: 621475 - RNA, 16 nt, Escherichia coli CFT073
uucacgcaccauaaua

SEQ ID NO: 621476 - RNA, 20 nt, Escherichia coli CFT073
uucaccucuucauuaaacca

SEQ ID NO: 621477 - RNA, 19 nt, Escherichia coli CFT073
uucaccucuuucaccaacu

SEQ ID NO: 621478 - RNA, 18 nt, Escherichia coli CFT073
uuauagaucaggaaaaac

SEQ ID NO: 621479 - RNA, 17 nt, Escherichia coli CFT073
uuauagcgauuuuucau

SEQ ID NO: 621480 - RNA, 19 nt, Escherichia coli CFT073
uuauauacucuaaauaauu

SEQ ID NO: 621481 - RNA, 13 nt, Escherichia coli CFT073
uuauauucaugaa

SEQ ID NO: 621482 - RNA, 18 nt, Escherichia coli CFT073
uuauaucuguacaguuaa

SEQ ID NO: 621483 - RNA, 14 nt, Escherichia coli CFT073
uuaucaacaauaaa

SEQ ID NO: 621484 - RNA, 14 nt, Escherichia coli CFT073
uuaucaacacauug

SEQ ID NO: 621485 - RNA, 22 nt, Escherichia coli CFT073
uuaucaacguagaauaaaagca

SEQ ID NO: 621486 - RNA, 13 nt, Escherichia coli CFT073
uuaucacgaaaca

SEQ ID NO: 621487 - RNA, 22 nt, Escherichia coli CFT073
uuaucagacaccgauugccccu

SEQ ID NO: 621488 - RNA, 23 nt, Escherichia coli CFT073
uuaucaaucuccgccucgcucag

SEQ ID NO: 621489 - RNA, 23 nt, Escherichia coli CFT073
uuaucaaucucugcaagagauaa

SEQ ID NO: 621490 - RNA, 18 nt, Escherichia coli CFT073
uuaucauugcucuuaauc

SEQ ID NO: 621491 - RNA, 14 nt, Escherichia coli CFT073
uuaucaugcccuuu

SEQ ID NO: 621492 - RNA, 12 nt, Escherichia coli CFT073
uuauccgaccua

SEQ ID NO: 621493 - RNA, 12 nt, Escherichia coli CFT073
uuauccgaccug

SEQ ID NO: 621494 - RNA, 14 nt, Escherichia coli CFT073
uuauccgacuuguc

SEQ ID NO: 621495 - RNA, 21 nt, Escherichia coli CFT073
uuauccgacuugucaggcgga

SEQ ID NO: 621496 - RNA, 20 nt, Escherichia coli CFT073
uuauccggccaacaaaaaau

SEQ ID NO: 621497 - RNA, 12 nt, Escherichia coli CFT073
uuaucccggcaa

SEQ ID NO: 621498 - RNA, 17 nt, Escherichia coli CFT073
uuauccaucaaagguuu

SEQ ID NO: 621499 - RNA, 12 nt, Escherichia coli CFT073
uuauccugcaaa

SEQ ID NO: 621500 - RNA, 17 nt, Escherichia coli CFT073
uuauccugcaaauaacg

SEQ ID NO: 621501 - RNA, 11 nt, Escherichia coli CFT073
uuauccggccu

SEQ ID NO: 621502 - RNA, 17 nt, Escherichia coli CFT073
uuauccggccuacauug

SEQ ID NO: 621503 - RNA, 22 nt, Escherichia coli CFT073
uuauccggccuacguagaucac

SEQ ID NO: 621504 - RNA, 13 nt, Escherichia coli CFT073
uuauccggcuaua

SEQ ID NO: 621505 - RNA, 14 nt, Escherichia coli CFT073
uuauccugcccgcu

SEQ ID NO: 621506 - RNA, 20 nt, Escherichia coli CFT073
uuauccugcguuuguccgcc

SEQ ID NO: 621507 - RNA, 17 nt, Escherichia coli CFT073
uuaugcguagccaggcu

SEQ ID NO: 621508 - RNA, 22 nt, Escherichia coli CFT073
uuaugccggaugguaugccauc

SEQ ID NO: 621509 - RNA, 15 nt, Escherichia coli CFT073
uuaugcgaaauagcg

SEQ ID NO: 621510 - RNA, 19 nt, Escherichia coli CFT073
uuaugcaccgacaauccag

SEQ ID NO: 621511 - RNA, 22 nt, Escherichia coli CFT073
uuaugcagccuucauucaggua

SEQ ID NO: 621512 - RNA, 15 nt, Escherichia coli CFT073
uuaugcccucagccu

SEQ ID NO: 621513 - RNA, 16 nt, Escherichia coli CFT073
uuauggugacaaacac

SEQ ID NO: 621514 - RNA, 17 nt, Escherichia coli CFT073
uuauggcgcaguugccg

SEQ ID NO: 621515 - RNA, 15 nt, Escherichia coli CFT073
uuauggugugcaucc

SEQ ID NO: 621516 - RNA, 11 nt, Escherichia coli CFT073
uuaugucagua

SEQ ID NO: 621517 - RNA, 24 nt, Escherichia coli CFT073
uuaugucgcauccugcacuguccc

SEQ ID NO: 621518 - RNA, 17 nt, Escherichia coli CFT073
uuauuaccgucagaaau

SEQ ID NO: 621519 - RNA, 15 nt, Escherichia coli CFT073
uuauuacuauggaua

SEQ ID NO: 621520 - RNA, 17 nt, Escherichia coli CFT073
uuauuacuauggauaua

SEQ ID NO: 621521 - RNA, 21 nt, Escherichia coli CFT073
uuaugugcuucuagcaugaug

SEQ ID NO: 621522 - RNA, 15 nt, Escherichia coli CFT073
uuaugugcaauuuca

SEQ ID NO: 621523 - RNA, 16 nt, Escherichia coli CFT073
uuauguugauucauuu

SEQ ID NO: 621524 - RNA, 20 nt, Escherichia coli CFT073
uuaucuguucuuuuauauuc

SEQ ID NO: 621525 - RNA, 11 nt, Escherichia coli CFT073
uuaucuucaca

SEQ ID NO: 621526 - RNA, 14 nt, Escherichia coli CFT073
uuaucuucaccaaa

SEQ ID NO: 621527 - RNA, 15 nt, Escherichia coli CFT073
uuaucuucccagccc

SEQ ID NO: 621528 - RNA, 15 nt, Escherichia coli CFT073
uuaucugauuuaaaa

SEQ ID NO: 621529 - RNA, 17 nt, Escherichia coli CFT073
uuaucuggcauuugcac

SEQ ID NO: 621530 - RNA, 18 nt, Escherichia coli CFT073
uuaucuggcuaaaacuga

SEQ ID NO: 621531 - RNA, 22 nt, Escherichia coli CFT073
uuaucuggucaguuaacaauaa

SEQ ID NO: 621532 - RNA, 21 nt, Escherichia coli CFT073
uuaucuguaauuaaauuauca

SEQ ID NO: 621533 - RNA, 19 nt, Escherichia coli CFT073
uuaugaccgauaaugaucc

SEQ ID NO: 621534 - RNA, 13 nt, Escherichia coli CFT073
uuaugaggaugca

SEQ ID NO: 621535 - RNA, 14 nt, Escherichia coli CFT073
uuaugauccagcuu

SEQ ID NO: 621536 - RNA, 22 nt, Escherichia coli CFT073
uuaucgcuucgcuaacauuuua

SEQ ID NO: 621537 - RNA, 17 nt, Escherichia coli CFT073
uuaucgcgcugaauaau

SEQ ID NO: 621538 - RNA, 20 nt, Escherichia coli CFT073
uuaucgcauuaucaaagaug

SEQ ID NO: 621539 - RNA, 15 nt, Escherichia coli CFT073
uuaucgcccacgcac

SEQ ID NO: 621540 - RNA, 20 nt, Escherichia coli CFT073
uuaucgcccugcuccagcag

SEQ ID NO: 621541 - RNA, 13 nt, Escherichia coli CFT073
uuaucgagauauu

SEQ ID NO: 621542 - RNA, 15 nt, Escherichia coli CFT073
uuaucgauuaccgcc

SEQ ID NO: 621543 - RNA, 15 nt, Escherichia coli CFT073
uuaucucaacacacg

SEQ ID NO: 621544 - RNA, 17 nt, Escherichia coli CFT073
uuaucuaauaaacauug

SEQ ID NO: 621545 - RNA, 16 nt, Escherichia coli CFT073
uuacuccacuuccugc

SEQ ID NO: 621546 - RNA, 22 nt, Escherichia coli CFT073
uuacucccggauaaaucuccau

SEQ ID NO: 621547 - RNA, 14 nt, Escherichia coli CFT073
uuacucccuugccu

SEQ ID NO: 621548 - RNA, 14 nt, Escherichia coli CFT073
uuacugacaugcac

SEQ ID NO: 621549 - RNA, 18 nt, Escherichia coli CFT073
uuacugccagcucaccuc

SEQ ID NO: 621550 - RNA, 22 nt, Escherichia coli CFT073
uuacuggaguaaaucagaggau

SEQ ID NO: 621551 - RNA, 23 nt, Escherichia coli CFT073
uuacuugcugcucugaaguuugu

SEQ ID NO: 621552 - RNA, 14 nt, Escherichia coli CFT073
uuacuugcugcucu

SEQ ID NO: 621553 - RNA, 23 nt, Escherichia coli CFT073
uuacuucugcugcacgaaauuac

SEQ ID NO: 621554 - RNA, 17 nt, Escherichia coli CFT073
uuacuggcuuucauuuu

SEQ ID NO: 621555 - RNA, 17 nt, Escherichia coli CFT073
uuaccgaauccagcaag

SEQ ID NO: 621556 - RNA, 14 nt, Escherichia coli CFT073
uuaccgaauccugg

SEQ ID NO: 621557 - RNA, 17 nt, Escherichia coli CFT073
uuaccgcaccaccagca

SEQ ID NO: 621558 - RNA, 21 nt, Escherichia coli CFT073
uuaccgaguccgccauuauua

SEQ ID NO: 621559 - RNA, 11 nt, Escherichia coli CFT073
uuaccgcccau

SEQ ID NO: 621560 - RNA, 15 nt, Escherichia coli CFT073
uuacgucgccaguuu

SEQ ID NO: 621561 - RNA, 16 nt, Escherichia coli CFT073
uuacguucgacugcgc

SEQ ID NO: 621562 - RNA, 19 nt, Escherichia coli CFT073
uuacuaauuaauaauauaa

SEQ ID NO: 621563 - RNA, 17 nt, Escherichia coli CFT073
uuacuaaaaguaaauaa

SEQ ID NO: 621564 - RNA, 17 nt, Escherichia coli CFT073
uuacucacaucugacaa

SEQ ID NO: 621565 - RNA, 21 nt, Escherichia coli CFT073
uuacucauccccugacugucg

SEQ ID NO: 621566 - RNA, 13 nt, Escherichia coli CFT073
uuaggggacauuu

SEQ ID NO: 621567 - RNA, 15 nt, Escherichia coli CFT073
uuagcauuaacagua

SEQ ID NO: 621568 - RNA, 16 nt, Escherichia coli CFT073
uuagcauggguauccu

SEQ ID NO: 621569 - RNA, 19 nt, Escherichia coli CFT073
uuagccaaccucaaaaaga

SEQ ID NO: 621570 - RNA, 21 nt, Escherichia coli CFT073
uuagccauauggcugcaucca

SEQ ID NO: 621571 - RNA, 16 nt, Escherichia coli CFT073
uuagcaucaagaaaaa

SEQ ID NO: 621572 - RNA, 17 nt, Escherichia coli CFT073
uuagcaucaagaaaaau

SEQ ID NO: 621573 - RNA, 13 nt, Escherichia coli CFT073
uuagcaguucuua

SEQ ID NO: 621574 - RNA, 15 nt, Escherichia coli CFT073
uuagacggaaaagac

SEQ ID NO: 621575 - RNA, 22 nt, Escherichia coli CFT073
uuauaagauagucgaaucagua

SEQ ID NO: 621576 - RNA, 13 nt, Escherichia coli CFT073
uuauaacugucuu

SEQ ID NO: 621577 - RNA, 17 nt, Escherichia coli CFT073
uuauaaccagacgauuu

SEQ ID NO: 621578 - RNA, 14 nt, Escherichia coli CFT073
uuauaaaguaaaac

SEQ ID NO: 621579 - RNA, 20 nt, Escherichia coli CFT073
uuauacauugagcaaagacg

SEQ ID NO: 621580 - RNA, 12 nt, Escherichia coli CFT073
uuaguaaccacu

SEQ ID NO: 621581 - RNA, 22 nt, Escherichia coli CFT073
uuagguacaaagccaacagcag

SEQ ID NO: 621582 - RNA, 18 nt, Escherichia coli CFT073
uuaguaggccugauaagc

SEQ ID NO: 621583 - RNA, 20 nt, Escherichia coli CFT073
uuaguauuuuauggcagaau

SEQ ID NO: 621584 - RNA, 18 nt, Escherichia coli CFT073
uuagucccaaacagcaga

SEQ ID NO: 621585 - RNA, 20 nt, Escherichia coli CFT073
uuagugcacuucuucacauc

SEQ ID NO: 621586 - RNA, 23 nt, Escherichia coli CFT073
uuagugcugcuggaaaagguaag

SEQ ID NO: 621587 - RNA, 23 nt, Escherichia coli CFT073
uuagucugggcgagguccagcuc

SEQ ID NO: 621588 - RNA, 16 nt, Escherichia coli CFT073
uuagucuuauuuaaug

SEQ ID NO: 621589 - RNA, 18 nt, Escherichia coli CFT073
uuagucuuauuuaaugua

SEQ ID NO: 621590 - RNA, 18 nt, Escherichia coli CFT073
uuaguuagcagauuaauu

SEQ ID NO: 621591 - RNA, 17 nt, Escherichia coli CFT073
uuaauuaaacaaauaaa

SEQ ID NO: 621592 - RNA, 15 nt, Escherichia coli CFT073
uuaauucuuaacacc

SEQ ID NO: 621593 - RNA, 23 nt, Escherichia coli CFT073
uuaauugcccaaagccaaucugu

SEQ ID NO: 621594 - RNA, 19 nt, Escherichia coli CFT073
uuaauugccucuucugaua

SEQ ID NO: 621595 - RNA, 17 nt, Escherichia coli CFT073
uuaaugagauaaucaaa

SEQ ID NO: 621596 - RNA, 14 nt, Escherichia coli CFT073
uuaaucuaggcucu

SEQ ID NO: 621597 - RNA, 16 nt, Escherichia coli CFT073
uuaaucuauauauguu

SEQ ID NO: 621598 - RNA, 11 nt, Escherichia coli CFT073
uuaaugccagu

SEQ ID NO: 621599 - RNA, 13 nt, Escherichia coli CFT073
uuaaugcgcuuuu

SEQ ID NO: 621600 - RNA, 19 nt, Escherichia coli CFT073
uuaaugcuccccuuucuua

SEQ ID NO: 621601 - RNA, 17 nt, Escherichia coli CFT073
uuaaugugucugaaagc

SEQ ID NO: 621602 - RNA, 14 nt, Escherichia coli CFT073
uuaaugguuugccc

SEQ ID NO: 621603 - RNA, 14 nt, Escherichia coli CFT073
uuaauguaaauauu

SEQ ID NO: 621604 - RNA, 17 nt, Escherichia coli CFT073
uuaauguaugugcgaaa

SEQ ID NO: 621605 - RNA, 21 nt, Escherichia coli CFT073
uuaaugggaagcaaguucccg

SEQ ID NO: 621606 - RNA, 18 nt, Escherichia coli CFT073
uuaccaaauugguaaaau

SEQ ID NO: 621607 - RNA, 22 nt, Escherichia coli CFT073
uuaccaaauaaacgaaucugca

SEQ ID NO: 621608 - RNA, 12 nt, Escherichia coli CFT073
uuaccaccagcg

SEQ ID NO: 621609 - RNA, 12 nt, Escherichia coli CFT073
uuaccccaucca

SEQ ID NO: 621610 - RNA, 13 nt, Escherichia coli CFT073
uuaccccauccau

SEQ ID NO: 621611 - RNA, 17 nt, Escherichia coli CFT073
uuacccccguguuuuug

SEQ ID NO: 621612 - RNA, 19 nt, Escherichia coli CFT073
uuaccacaccggcaauaau

SEQ ID NO: 621613 - RNA, 19 nt, Escherichia coli CFT073
uuacaggcaucuuccagcg

SEQ ID NO: 621614 - RNA, 20 nt, Escherichia coli CFT073
uuacaggugaaucuuacuuc

SEQ ID NO: 621615 - RNA, 14 nt, Escherichia coli CFT073
uuacaauaaccauu

SEQ ID NO: 621616 - RNA, 20 nt, Escherichia coli CFT073
uuacaaucgucugguuuucc

SEQ ID NO: 621617 - RNA, 22 nt, Escherichia coli CFT073
uuacagauucucgccguugcug

SEQ ID NO: 621618 - RNA, 14 nt, Escherichia coli CFT073
uuacagagcgauua

SEQ ID NO: 621619 - RNA, 15 nt, Escherichia coli CFT073
uuaaggaaaaacgaa

SEQ ID NO: 621620 - RNA, 16 nt, Escherichia coli CFT073
uuaauaagcaggccau

SEQ ID NO: 621621 - RNA, 19 nt, Escherichia coli CFT073
uuaauaaccauuaaauagu

SEQ ID NO: 621622 - RNA, 14 nt, Escherichia coli CFT073
uuaauaugcucaac

SEQ ID NO: 621623 - RNA, 19 nt, Escherichia coli CFT073
uuaauaugcucaacaauaa

SEQ ID NO: 621624 - RNA, 19 nt, Escherichia coli CFT073
uuaauacucacgacguggc

SEQ ID NO: 621625 - RNA, 18 nt, Escherichia coli CFT073
uuaaucggaugaucaucc

SEQ ID NO: 621626 - RNA, 22 nt, Escherichia coli CFT073
uuaaucgccgcauaauaucuuu

SEQ ID NO: 621627 - RNA, 17 nt, Escherichia coli CFT073
uuaaucgccuuccggca

SEQ ID NO: 621628 - RNA, 18 nt, Escherichia coli CFT073
uuaauccugauuuauacc

SEQ ID NO: 621629 - RNA, 23 nt, Escherichia coli CFT073
uuaauccgcaaauaacguaaaaa

SEQ ID NO: 621630 - RNA, 14 nt, Escherichia coli CFT073
uuaaucaacucacg

SEQ ID NO: 621631 - RNA, 14 nt, Escherichia coli CFT073
uuaacgguaucuuu

SEQ ID NO: 621632 - RNA, 16 nt, Escherichia coli CFT073
uuaacgguuucaacca

SEQ ID NO: 621633 - RNA, 21 nt, Escherichia coli CFT073
uuaaccaggcaaguucuuuug

SEQ ID NO: 621634 - RNA, 20 nt, Escherichia coli CFT073
uuaaccgcuucgcuggcagc

SEQ ID NO: 621635 - RNA, 17 nt, Escherichia coli CFT073
uuaacccgcaacagcaa

SEQ ID NO: 621636 - RNA, 14 nt, Escherichia coli CFT073
ugugcuuugugacc

SEQ ID NO: 621637 - RNA, 15 nt, Escherichia coli CFT073
ugugcuuguaaaaca

SEQ ID NO: 621638 - RNA, 23 nt, Escherichia coli CFT073
ugugcuuuguuugcaauaugguu

SEQ ID NO: 621639 - RNA, 17 nt, Escherichia coli CFT073
uguggaaauuccagcgg

SEQ ID NO: 621640 - RNA, 14 nt, Escherichia coli CFT073
uguggagcuucaac

SEQ ID NO: 621641 - RNA, 19 nt, Escherichia coli CFT073
uuaagcguucugcaauuug

SEQ ID NO: 621642 - RNA, 14 nt, Escherichia coli CFT073
uuaagccgcugugu

SEQ ID NO: 621643 - RNA, 22 nt, Escherichia coli CFT073
uuaagcgcaucgacgccaucau

SEQ ID NO: 621644 - RNA, 18 nt, Escherichia coli CFT073
uuaacuccuucuaaagca

SEQ ID NO: 621645 - RNA, 20 nt, Escherichia coli CFT073
uuaagaauuucucaguuguu

SEQ ID NO: 621646 - RNA, 16 nt, Escherichia coli CFT073
uuucauuuaagccacu

SEQ ID NO: 621647 - RNA, 21 nt, Escherichia coli CFT073
uuuccacgaaacgguguugag

SEQ ID NO: 621648 - RNA, 10 nt, Escherichia coli CFT073
uuuccagaac

SEQ ID NO: 621649 - RNA, 22 nt, Escherichia coli CFT073
uuuccagacugaugugcuccau

SEQ ID NO: 621650 - RNA, 17 nt, Escherichia coli CFT073
uuuccacucacacagcu

SEQ ID NO: 621651 - RNA, 22 nt, Escherichia coli CFT073
uuuccacgcuauacagcagcca

SEQ ID NO: 621652 - RNA, 21 nt, Escherichia coli CFT073
uuuccagcucaaccagauucg

SEQ ID NO: 621653 - RNA, 15 nt, Escherichia coli CFT073
uuuccagcauuucuu

SEQ ID NO: 621654 - RNA, 15 nt, Escherichia coli CFT073
uuucaucccucucau

SEQ ID NO: 621655 - RNA, 16 nt, Escherichia coli CFT073
uuucaucaucaggcau

SEQ ID NO: 621656 - RNA, 16 nt, Escherichia coli CFT073
uuucaugcuauuccuu

SEQ ID NO: 621657 - RNA, 16 nt, Escherichia coli CFT073
uuucauuccaguaagg

SEQ ID NO: 621658 - RNA, 22 nt, Escherichia coli CFT073
uuucauucagaacacuucuucu

SEQ ID NO: 621659 - RNA, 12 nt, Escherichia coli CFT073
uuucaguuuuag

SEQ ID NO: 621660 - RNA, 19 nt, Escherichia coli CFT073
uuucagugcugacugauga

SEQ ID NO: 621661 - RNA, 15 nt, Escherichia coli CFT073
uuucaguuugccgcu

SEQ ID NO: 621662 - RNA, 18 nt, Escherichia coli CFT073
uuucaguggguuaugaaa

SEQ ID NO: 621663 - RNA, 14 nt, Escherichia coli CFT073
uuucaguuggcagc

SEQ ID NO: 621664 - RNA, 19 nt, Escherichia coli CFT073
uuucauaucugccagauaa

SEQ ID NO: 621665 - RNA, 19 nt, Escherichia coli CFT073
uuucaguacuggaugacga

SEQ ID NO: 621666 - RNA, 22 nt, Escherichia coli CFT073
uuucaguagcaugaacauugcu

SEQ ID NO: 621667 - RNA, 21 nt, Escherichia coli CFT073
uuucagaucaggcuuguguac

SEQ ID NO: 621668 - RNA, 14 nt, Escherichia coli CFT073
uuucagcaccagau

SEQ ID NO: 621669 - RNA, 19 nt, Escherichia coli CFT073
uuucagcaccagauaauga

SEQ ID NO: 621670 - RNA, 13 nt, Escherichia coli CFT073
uuucagcauccca

SEQ ID NO: 621671 - RNA, 12 nt, Escherichia coli CFT073
uuucagccaguc

SEQ ID NO: 621672 - RNA, 18 nt, Escherichia coli CFT073
uuucagcggcguguuauu

SEQ ID NO: 621673 - RNA, 19 nt, Escherichia coli CFT073
uuucagaaaacgguugaua

SEQ ID NO: 621674 - RNA, 15 nt, Escherichia coli CFT073
uuucacuucaguaaa

SEQ ID NO: 621675 - RNA, 19 nt, Escherichia coli CFT073
uuucacuucaguaaauacu

SEQ ID NO: 621676 - RNA, 20 nt, Escherichia coli CFT073
uuucacuucgucagaaaugg

SEQ ID NO: 621677 - RNA, 17 nt, Escherichia coli CFT073
uuucacuuucagaugca

SEQ ID NO: 621678 - RNA, 19 nt, Escherichia coli CFT073
uuucaacguacucugccac

SEQ ID NO: 621679 - RNA, 15 nt, Escherichia coli CFT073
uuucaaaucaccaaa

SEQ ID NO: 621680 - RNA, 12 nt, Escherichia coli CFT073
uuucaaacgcca

SEQ ID NO: 621681 - RNA, 17 nt, Escherichia coli CFT073
uuuauuugacauuuuuu

SEQ ID NO: 621682 - RNA, 18 nt, Escherichia coli CFT073
uuuauuuguuuuucagga

SEQ ID NO: 621683 - RNA, 13 nt, Escherichia coli CFT073
uuuauucauaauc

SEQ ID NO: 621684 - RNA, 18 nt, Escherichia coli CFT073
uuuauuucaaaauuaucu

SEQ ID NO: 621685 - RNA, 13 nt, Escherichia coli CFT073
uuuauuucauaau

SEQ ID NO: 621686 - RNA, 15 nt, Escherichia coli CFT073
uuuauuucauaaucc

SEQ ID NO: 621687 - RNA, 14 nt, Escherichia coli CFT073
uuuauucaccagua

SEQ ID NO: 621688 - RNA, 19 nt, Escherichia coli CFT073
uuuauaccaacaaaaaacg

SEQ ID NO: 621689 - RNA, 16 nt, Escherichia coli CFT073
uuuauaaauugcaauu

SEQ ID NO: 621690 - RNA, 19 nt, Escherichia coli CFT073
uuuauagcuuauucuuauu

SEQ ID NO: 621691 - RNA, 22 nt, Escherichia coli CFT073
uuucaauccagggguuguuauu

SEQ ID NO: 621692 - RNA, 13 nt, Escherichia coli CFT073
uuucaaugccuuu

SEQ ID NO: 621693 - RNA, 22 nt, Escherichia coli CFT073
uuucaaugccuuucuuuguucu

SEQ ID NO: 621694 - RNA, 19 nt, Escherichia coli CFT073
uuucaaugcuuuuugcauu

SEQ ID NO: 621695 - RNA, 16 nt, Escherichia coli CFT073
uuucaauugauaauaa

SEQ ID NO: 621696 - RNA, 18 nt, Escherichia coli CFT073
uuucacggucggccagua

SEQ ID NO: 621697 - RNA, 16 nt, Escherichia coli CFT073
uuucacgcaauaccug

SEQ ID NO: 621698 - RNA, 15 nt, Escherichia coli CFT073
uuucacgcucaccca

SEQ ID NO: 621699 - RNA, 19 nt, Escherichia coli CFT073
uuucacgcucagcaacaug

SEQ ID NO: 621700 - RNA, 22 nt, Escherichia coli CFT073
uuucacgcucagcaacauggcg

SEQ ID NO: 621701 - RNA, 16 nt, Escherichia coli CFT073
uuucaccgacgacaaa

SEQ ID NO: 621702 - RNA, 17 nt, Escherichia coli CFT073
uuucaccgaugcacaga

SEQ ID NO: 621703 - RNA, 17 nt, Escherichia coli CFT073
uuucaauuugcaggcua

SEQ ID NO: 621704 - RNA, 20 nt, Escherichia coli CFT073
uuucaccaacgaugaagaga

SEQ ID NO: 621705 - RNA, 22 nt, Escherichia coli CFT073
uuucacauauucauuacuuauc

SEQ ID NO: 621706 - RNA, 12 nt, Escherichia coli CFT073
uuuaauuccugc

SEQ ID NO: 621707 - RNA, 22 nt, Escherichia coli CFT073
uuuaacgcccugaugcaucaac

SEQ ID NO: 621708 - RNA, 16 nt, Escherichia coli CFT073
uuuaacuaucaggucu

SEQ ID NO: 621709 - RNA, 20 nt, Escherichia coli CFT073
uuuaccaccaaaugcagcaa

SEQ ID NO: 621710 - RNA, 20 nt, Escherichia coli CFT073
uuuaccaccgucaauaaaaa

SEQ ID NO: 621711 - RNA, 13 nt, Escherichia coli CFT073
uuuaccagcagcc

SEQ ID NO: 621712 - RNA, 16 nt, Escherichia coli CFT073
uuuacccaauccccca

SEQ ID NO: 621713 - RNA, 14 nt, Escherichia coli CFT073
uuuacgaacauuaa

SEQ ID NO: 621714 - RNA, 21 nt, Escherichia coli CFT073
uuuacgaagaaaucgacauug

SEQ ID NO: 621715 - RNA, 14 nt, Escherichia coli CFT073
uuuaccuuucucgu

SEQ ID NO: 621716 - RNA, 16 nt, Escherichia coli CFT073
uuuacaaauaauuucu

SEQ ID NO: 621717 - RNA, 13 nt, Escherichia coli CFT073
uuuauaaaguaaa

SEQ ID NO: 621718 - RNA, 16 nt, Escherichia coli CFT073
uuuaguuuacauuaau

SEQ ID NO: 621719 - RNA, 13 nt, Escherichia coli CFT073
uuuauaaaaucca

SEQ ID NO: 621720 - RNA, 22 nt, Escherichia coli CFT073
uuuacgccgcauccgacaucaa

SEQ ID NO: 621721 - RNA, 18 nt, Escherichia coli CFT073
uuuacgaugcaauuauca

SEQ ID NO: 621722 - RNA, 20 nt, Escherichia coli CFT073
uuuacucacaucugacaaaa

SEQ ID NO: 621723 - RNA, 12 nt, Escherichia coli CFT073
uuuagcucagaa

SEQ ID NO: 621724 - RNA, 17 nt, Escherichia coli CFT073
uuuaacaauuuaucaga

SEQ ID NO: 621725 - RNA, 18 nt, Escherichia coli CFT073
uuuaaauauuguuuuuau

SEQ ID NO: 621726 - RNA, 20 nt, Escherichia coli CFT073
uuuaaauauuguuuuuauug

SEQ ID NO: 621727 - RNA, 21 nt, Escherichia coli CFT073
uuuaaaauugauaaccaauag

SEQ ID NO: 621728 - RNA, 21 nt, Escherichia coli CFT073
uuuaaacggcauaaauuucag

SEQ ID NO: 621729 - RNA, 13 nt, Escherichia coli CFT073
uuuaaauaacaua

SEQ ID NO: 621730 - RNA, 13 nt, Escherichia coli CFT073
uuuaaaaaaauua

SEQ ID NO: 621731 - RNA, 23 nt, Escherichia coli CFT073
uuguuucuucgauggcuggggua

SEQ ID NO: 621732 - RNA, 20 nt, Escherichia coli CFT073
uuguuucccccacugugcac

SEQ ID NO: 621733 - RNA, 13 nt, Escherichia coli CFT073
uuguugccggaug

SEQ ID NO: 621734 - RNA, 19 nt, Escherichia coli CFT073
uuguugcgucgaaaccaca

SEQ ID NO: 621735 - RNA, 19 nt, Escherichia coli CFT073
uuguugccgcccguuuucu

SEQ ID NO: 621736 - RNA, 18 nt, Escherichia coli CFT073
uuguuggcgcugcugggc

SEQ ID NO: 621737 - RNA, 23 nt, Escherichia coli CFT073
uuguuauauucacuugccugcug

SEQ ID NO: 621738 - RNA, 15 nt, Escherichia coli CFT073
uuguugcaggaacag

SEQ ID NO: 621739 - RNA, 14 nt, Escherichia coli CFT073
uugcugcaccaggc

SEQ ID NO: 621740 - RNA, 10 nt, Escherichia coli CFT073
uugcugccag

SEQ ID NO: 621741 - RNA, 20 nt, Escherichia coli CFT073
uugcugcgcccgcagcggcg

SEQ ID NO: 621742 - RNA, 16 nt, Escherichia coli CFT073
uugcugcgcuucguug

SEQ ID NO: 621743 - RNA, 20 nt, Escherichia coli CFT073
uugcugcggcguuccccagu

SEQ ID NO: 621744 - RNA, 21 nt, Escherichia coli CFT073
uuugccaucaaucacuuugcg

SEQ ID NO: 621745 - RNA, 16 nt, Escherichia coli CFT073
uuugccaucucugcaa

SEQ ID NO: 621746 - RNA, 16 nt, Escherichia coli CFT073
uuugccaugcauaucc

SEQ ID NO: 621747 - RNA, 22 nt, Escherichia coli CFT073
uuugcccuucacagguggucac

SEQ ID NO: 621748 - RNA, 19 nt, Escherichia coli CFT073
uuugcccaucaggccaggc

SEQ ID NO: 621749 - RNA, 21 nt, Escherichia coli CFT073
uuugccccauugcucuuucac

SEQ ID NO: 621750 - RNA, 17 nt, Escherichia coli CFT073
uuugccaguucguuaua

SEQ ID NO: 621751 - RNA, 15 nt, Escherichia coli CFT073
uuugccccuggcugg

SEQ ID NO: 621752 - RNA, 22 nt, Escherichia coli CFT073
uuugccggauacguuugauguc

SEQ ID NO: 621753 - RNA, 19 nt, Escherichia coli CFT073
uuugccgcuuuuaugugca

SEQ ID NO: 621754 - RNA, 21 nt, Escherichia coli CFT073
uuugccugccgccuuuugccu

SEQ ID NO: 621755 - RNA, 19 nt, Escherichia coli CFT073
uuugccuggcggcagauag

SEQ ID NO: 621756 - RNA, 19 nt, Escherichia coli CFT073
uuugccugugcaaccuuuu

SEQ ID NO: 621757 - RNA, 21 nt, Escherichia coli CFT073
uuugccuuuauucauuucgau

SEQ ID NO: 621758 - RNA, 20 nt, Escherichia coli CFT073
uuugccuccgcaacauauaa

SEQ ID NO: 621759 - RNA, 14 nt, Escherichia coli CFT073
uuugccgugaacaa

SEQ ID NO: 621760 - RNA, 19 nt, Escherichia coli CFT073
uuugcaggucguccugcaa

SEQ ID NO: 621761 - RNA, 13 nt, Escherichia coli CFT073
uuugcaggccgga

SEQ ID NO: 621762 - RNA, 15 nt, Escherichia coli CFT073
uuugcaggccugaua

SEQ ID NO: 621763 - RNA, 20 nt, Escherichia coli CFT073
uuugcagugaucgugugcca

SEQ ID NO: 621764 - RNA, 16 nt, Escherichia coli CFT073
uuugcagugcuuguua

SEQ ID NO: 621765 - RNA, 14 nt, Escherichia coli CFT073
uuugcauaauuucc

SEQ ID NO: 621766 - RNA, 17 nt, Escherichia coli CFT073
uuugcauccacaacccg

SEQ ID NO: 621767 - RNA, 22 nt, Escherichia coli CFT073
uuugccaguaauaacccgucag

SEQ ID NO: 621768 - RNA, 18 nt, Escherichia coli CFT073
uuugcauuacugcuaucu

SEQ ID NO: 621769 - RNA, 20 nt, Escherichia coli CFT073
uuugccaauagcguuuugcg

SEQ ID NO: 621770 - RNA, 21 nt, Escherichia coli CFT073
uuugcaugagugccagauuga

SEQ ID NO: 621771 - RNA, 24 nt, Escherichia coli CFT073
uuugcauuacugcuaucugucaga

SEQ ID NO: 621772 - RNA, 19 nt, Escherichia coli CFT073
uuugcauuuggauugcuau

SEQ ID NO: 621773 - RNA, 15 nt, Escherichia coli CFT073
uuugccaaacgcguc

SEQ ID NO: 621774 - RNA, 14 nt, Escherichia coli CFT073
uuugcgcgugcugg

SEQ ID NO: 621775 - RNA, 18 nt, Escherichia coli CFT073
uuugcgcucgcugaugga

SEQ ID NO: 621776 - RNA, 21 nt, Escherichia coli CFT073
uuugcgguaacguaauucgga

SEQ ID NO: 621777 - RNA, 18 nt, Escherichia coli CFT073
uuugcgauauauuuugua

SEQ ID NO: 621778 - RNA, 19 nt, Escherichia coli CFT073
uuugcgauauauuuuguac

SEQ ID NO: 621779 - RNA, 13 nt, Escherichia coli CFT073
uuugcgccaucaa

SEQ ID NO: 621780 - RNA, 15 nt, Escherichia coli CFT073
uuugcgccaucaacc

SEQ ID NO: 621781 - RNA, 20 nt, Escherichia coli CFT073
uuugcgacaaagcucaccug

SEQ ID NO: 621782 - RNA, 20 nt, Escherichia coli CFT073
uuugcgaguccgcuuccgcu

SEQ ID NO: 621783 - RNA, 22 nt, Escherichia coli CFT073
uuugcguaacguaauccugcgg

SEQ ID NO: 621784 - RNA, 18 nt, Escherichia coli CFT073
uuugcucuucuuucauca

SEQ ID NO: 621785 - RNA, 13 nt, Escherichia coli CFT073
uuugcuccagaaa

SEQ ID NO: 621786 - RNA, 14 nt, Escherichia coli CFT073
uuugauaaguacau

SEQ ID NO: 621787 - RNA, 15 nt, Escherichia coli CFT073
uuugaguggucgaca

SEQ ID NO: 621788 - RNA, 14 nt, Escherichia coli CFT073
uuugaguucacugc

SEQ ID NO: 621789 - RNA, 15 nt, Escherichia coli CFT073
uuugaggaagcugcc

SEQ ID NO: 621790 - RNA, 12 nt, Escherichia coli CFT073
uuugaugccacc

SEQ ID NO: 621791 - RNA, 18 nt, Escherichia coli CFT073
uuugauguacucaauugc

SEQ ID NO: 621792 - RNA, 16 nt, Escherichia coli CFT073
uuugaugccuucaguu

SEQ ID NO: 621793 - RNA, 13 nt, Escherichia coli CFT073
uuugauauucauu

SEQ ID NO: 621794 - RNA, 17 nt, Escherichia coli CFT073
uuugcagaggugcgacc

SEQ ID NO: 621795 - RNA, 22 nt, Escherichia coli CFT073
uuugcagaggugcgaccagcaa

SEQ ID NO: 621796 - RNA, 16 nt, Escherichia coli CFT073
uuugcacauuccagau

SEQ ID NO: 621797 - RNA, 13 nt, Escherichia coli CFT073
uuugcaauuugca

SEQ ID NO: 621798 - RNA, 15 nt, Escherichia coli CFT073
uuugcaauuugcagc

SEQ ID NO: 621799 - RNA, 17 nt, Escherichia coli CFT073
uuugcaaacaacgcuuc

SEQ ID NO: 621800 - RNA, 23 nt, Escherichia coli CFT073
uuugauuugcugcucacggugag

SEQ ID NO: 621801 - RNA, 14 nt, Escherichia coli CFT073
uuucuuuuaacaaa

SEQ ID NO: 621802 - RNA, 13 nt, Escherichia coli CFT073
uuucuuucaucag

SEQ ID NO: 621803 - RNA, 13 nt, Escherichia coli CFT073
uuucuuguugccu

SEQ ID NO: 621804 - RNA, 12 nt, Escherichia coli CFT073
uuucuuuaauug

SEQ ID NO: 621805 - RNA, 20 nt, Escherichia coli CFT073
uuucuucuaauugugcugca

SEQ ID NO: 621806 - RNA, 15 nt, Escherichia coli CFT073
uuucuuccagguuaa

SEQ ID NO: 621807 - RNA, 23 nt, Escherichia coli CFT073
uuucuucaggccagccugaucca

SEQ ID NO: 621808 - RNA, 16 nt, Escherichia coli CFT073
uuucuucaguucagcu

SEQ ID NO: 621809 - RNA, 17 nt, Escherichia coli CFT073
uuucuuaagauaagaau

SEQ ID NO: 621810 - RNA, 13 nt, Escherichia coli CFT073
uuucuguugccag

SEQ ID NO: 621811 - RNA, 21 nt, Escherichia coli CFT073
uuugacugaagguaagcaaca

SEQ ID NO: 621812 - RNA, 14 nt, Escherichia coli CFT073
uuugacgccugcag

SEQ ID NO: 621813 - RNA, 23 nt, Escherichia coli CFT073
uuugaauuagcacgauuuuguag

SEQ ID NO: 621814 - RNA, 19 nt, Escherichia coli CFT073
uuugacagccccugugcca

SEQ ID NO: 621815 - RNA, 22 nt, Escherichia coli CFT073
uuugaacauaucagcgcaaaga

SEQ ID NO: 621816 - RNA, 20 nt, Escherichia coli CFT073
uuucucgcgcccaaccagca

SEQ ID NO: 621817 - RNA, 20 nt, Escherichia coli CFT073
uuucuccggcagcuuuaccg

SEQ ID NO: 621818 - RNA, 12 nt, Escherichia coli CFT073
uuucucuaaaaa

SEQ ID NO: 621819 - RNA, 20 nt, Escherichia coli CFT073
uuucucgucugaaagauauu

SEQ ID NO: 621820 - RNA, 20 nt, Escherichia coli CFT073
uuucuccccaaggacgcguc

SEQ ID NO: 621821 - RNA, 10 nt, Escherichia coli CFT073
uuucuccccu

SEQ ID NO: 621822 - RNA, 19 nt, Escherichia coli CFT073
uuucucccgccugcugcgu

SEQ ID NO: 621823 - RNA, 19 nt, Escherichia coli CFT073
uuucuccgagcauuuucag

SEQ ID NO: 621824 - RNA, 18 nt, Escherichia coli CFT073
uuucucaaaauacugccu

SEQ ID NO: 621825 - RNA, 20 nt, Escherichia coli CFT073
uuucucaaaauacugccuau

SEQ ID NO: 621826 - RNA, 12 nt, Escherichia coli CFT073
uuucucuuucac

SEQ ID NO: 621827 - RNA, 21 nt, Escherichia coli CFT073
uuucugaccaauagauauuca

SEQ ID NO: 621828 - RNA, 20 nt, Escherichia coli CFT073
uuucugaccaugcauauaag

SEQ ID NO: 621829 - RNA, 12 nt, Escherichia coli CFT073
uuucucuuucuu

SEQ ID NO: 621830 - RNA, 17 nt, Escherichia coli CFT073
uuucucuuucuucagca

SEQ ID NO: 621831 - RNA, 18 nt, Escherichia coli CFT073
uuucugaaaccaccauuu

SEQ ID NO: 621832 - RNA, 18 nt, Escherichia coli CFT073
uuucuggaugccaucgca

SEQ ID NO: 621833 - RNA, 23 nt, Escherichia coli CFT073
uuucugcgggggcggcaaucgcu

SEQ ID NO: 621834 - RNA, 19 nt, Escherichia coli CFT073
uuucuggaaauagauuuuc

SEQ ID NO: 621835 - RNA, 20 nt, Escherichia coli CFT073
uuucuggaaauagauuuuca

SEQ ID NO: 621836 - RNA, 21 nt, Escherichia coli CFT073
uuucuggauauacgcuuucag

SEQ ID NO: 621837 - RNA, 16 nt, Escherichia coli CFT073
uuucuggaugccaucg

SEQ ID NO: 621838 - RNA, 23 nt, Escherichia coli CFT073
uuucugcuucgccaucuccauca

SEQ ID NO: 621839 - RNA, 18 nt, Escherichia coli CFT073
uuucuaucaaccugaggc

SEQ ID NO: 621840 - RNA, 20 nt, Escherichia coli CFT073
uuucuacguuaucgcgccau

SEQ ID NO: 621841 - RNA, 13 nt, Escherichia coli CFT073
uuucuacuucuuu

SEQ ID NO: 621842 - RNA, 15 nt, Escherichia coli CFT073
uuucuacuuuuucuu

SEQ ID NO: 621843 - RNA, 13 nt, Escherichia coli CFT073
uuucuaccagguu

SEQ ID NO: 621844 - RNA, 22 nt, Escherichia coli CFT073
uuucgcuucaaccaccucagua

SEQ ID NO: 621845 - RNA, 17 nt, Escherichia coli CFT073
uuucgcuuuacucccgu

SEQ ID NO: 621846 - RNA, 18 nt, Escherichia coli CFT073
uuucgucaacuucuuuag

SEQ ID NO: 621847 - RNA, 22 nt, Escherichia coli CFT073
uuucgucugguucgccaaaugu

SEQ ID NO: 621848 - RNA, 17 nt, Escherichia coli CFT073
uuucgucgcaucacaga

SEQ ID NO: 621849 - RNA, 13 nt, Escherichia coli CFT073
uuucguuaaacgc

SEQ ID NO: 621850 - RNA, 19 nt, Escherichia coli CFT073
uuuccugcggaugcgccau

SEQ ID NO: 621851 - RNA, 15 nt, Escherichia coli CFT073
uuuccuggacuucuu

SEQ ID NO: 621852 - RNA, 20 nt, Escherichia coli CFT073
uuuccugcucggcaaacugc

SEQ ID NO: 621853 - RNA, 20 nt, Escherichia coli CFT073
uuuccucaacaucuucacca

SEQ ID NO: 621854 - RNA, 16 nt, Escherichia coli CFT073
uuuccguuuuccagcc

SEQ ID NO: 621855 - RNA, 18 nt, Escherichia coli CFT073
uuuccuaaacuccucgcc

SEQ ID NO: 621856 - RNA, 20 nt, Escherichia coli CFT073
uuuccgucagcggcagcucu

SEQ ID NO: 621857 - RNA, 19 nt, Escherichia coli CFT073
uuuccguugugcgauccac

SEQ ID NO: 621858 - RNA, 12 nt, Escherichia coli CFT073
uuucgcacugca

SEQ ID NO: 621859 - RNA, 18 nt, Escherichia coli CFT073
uuucgcauguaacugccu

SEQ ID NO: 621860 - RNA, 17 nt, Escherichia coli CFT073
uuucgcggcauaacaga

SEQ ID NO: 621861 - RNA, 19 nt, Escherichia coli CFT073
uuucgcggcauaacagaau

SEQ ID NO: 621862 - RNA, 18 nt, Escherichia coli CFT073
uuucgcgucaaucacacu

SEQ ID NO: 621863 - RNA, 16 nt, Escherichia coli CFT073
uuucgcugauuuguua

SEQ ID NO: 621864 - RNA, 13 nt, Escherichia coli CFT073
uuucgauaaucaa

SEQ ID NO: 621865 - RNA, 14 nt, Escherichia coli CFT073
uuucgauaaucaaa

SEQ ID NO: 621866 - RNA, 14 nt, Escherichia coli CFT073
uuucgauauguucc

SEQ ID NO: 621867 - RNA, 19 nt, Escherichia coli CFT073
uuucccgggcgagcaaugu

SEQ ID NO: 621868 - RNA, 18 nt, Escherichia coli CFT073
uuucccgcuccaaaauuu

SEQ ID NO: 621869 - RNA, 16 nt, Escherichia coli CFT073
uuucccgguuaucacc

SEQ ID NO: 621870 - RNA, 13 nt, Escherichia coli CFT073
uuucccuucuugu

SEQ ID NO: 621871 - RNA, 18 nt, Escherichia coli CFT073
uuucccugacuugcgaac

SEQ ID NO: 621872 - RNA, 22 nt, Escherichia coli CFT073
uuucccuucacucugcugccac

SEQ ID NO: 621873 - RNA, 18 nt, Escherichia coli CFT073
uuuccggaucgccaaagc

SEQ ID NO: 621874 - RNA, 21 nt, Escherichia coli CFT073
uuuccggaaaaaucaaaaacu

SEQ ID NO: 621875 - RNA, 21 nt, Escherichia coli CFT073
uuuccgcgaauuaugcagccu

SEQ ID NO: 621876 - RNA, 19 nt, Escherichia coli CFT073
uuuccgccauucagauuga

SEQ ID NO: 621877 - RNA, 20 nt, Escherichia coli CFT073
uuuccgcacguuuuuccagu

SEQ ID NO: 621878 - RNA, 14 nt, Escherichia coli CFT073
uuuccgggcuucuc

SEQ ID NO: 621879 - RNA, 20 nt, Escherichia coli CFT073
uuuccggaugcgcuucuuua

SEQ ID NO: 621880 - RNA, 14 nt, Escherichia coli CFT073
uuuccggcagaagc

SEQ ID NO: 621881 - RNA, 17 nt, Escherichia coli CFT073
uuuccgggagcaauuug

SEQ ID NO: 621882 - RNA, 18 nt, Escherichia coli CFT073
uuuccggcagaagcaguc

SEQ ID NO: 621883 - RNA, 14 nt, Escherichia coli CFT073
uuucccaacaguuu

SEQ ID NO: 621884 - RNA, 16 nt, Escherichia coli CFT073
uuuccaugccaucugc

SEQ ID NO: 621885 - RNA, 13 nt, Escherichia coli CFT073
uuucccaccacua

SEQ ID NO: 621886 - RNA, 14 nt, Escherichia coli CFT073
uuuccccauuccga

SEQ ID NO: 621887 - RNA, 23 nt, Escherichia coli CFT073
uuucccccacagcucugcuguca

SEQ ID NO: 621888 - RNA, 13 nt, Escherichia coli CFT073
uuuccccaauuca

SEQ ID NO: 621889 - RNA, 22 nt, Escherichia coli CFT073
uuucccgauaaccuucuucauu

SEQ ID NO: 621890 - RNA, 20 nt, Escherichia coli CFT073
uuuccaucuccagcugcucg

SEQ ID NO: 621891 - RNA, 21 nt, Escherichia coli CFT073
uuuccauccgguacuuuccuu

SEQ ID NO: 621892 - RNA, 18 nt, Escherichia coli CFT073
uuuccaucgucagacgcu

SEQ ID NO: 621893 - RNA, 22 nt, Escherichia coli CFT073
uuuccaucgucagacgcucugg

SEQ ID NO: 621894 - RNA, 14 nt, Escherichia coli CFT073
uuuccaguugaaca

SEQ ID NO: 621895 - RNA, 23 nt, Escherichia coli CFT073
uuuccaguugaacaaucugguuu

SEQ ID NO: 621896 - RNA, 18 nt, Escherichia coli CFT073
aaauguugccggauggca

SEQ ID NO: 621897 - RNA, 15 nt, Escherichia coli CFT073
aaauguugcgccuca

SEQ ID NO: 621898 - RNA, 18 nt, Escherichia coli CFT073
aaauguugaauugcaggg

SEQ ID NO: 621899 - RNA, 21 nt, Escherichia coli CFT073
aaaugugccggaugcaucaca

SEQ ID NO: 621900 - RNA, 18 nt, Escherichia coli CFT073
uuuuucuccgagcauuuu

SEQ ID NO: 621901 - RNA, 19 nt, Escherichia coli CFT073
uuuuucuggcaccugaacc

SEQ ID NO: 621902 - RNA, 15 nt, Escherichia coli CFT073
uuuuucguaccagug

SEQ ID NO: 621903 - RNA, 11 nt, Escherichia coli CFT073
uuuuugaagcg

SEQ ID NO: 621904 - RNA, 11 nt, Escherichia coli CFT073
uuuuucuuauu

SEQ ID NO: 621905 - RNA, 23 nt, Escherichia coli CFT073
uuuuugcauaauuuccagcagug

SEQ ID NO: 621906 - RNA, 16 nt, Escherichia coli CFT073
uuuuugccaauaaaac

SEQ ID NO: 621907 - RNA, 16 nt, Escherichia coli CFT073
uuuuugcgcauaacau

SEQ ID NO: 621908 - RNA, 20 nt, Escherichia coli CFT073
uuuuuggguuaauucggccu

SEQ ID NO: 621909 - RNA, 20 nt, Escherichia coli CFT073
uuuuuggaggugaagguaag

SEQ ID NO: 621910 - RNA, 21 nt, Escherichia coli CFT073
uuuuuggcgaucucggcggcu

SEQ ID NO: 621911 - RNA, 23 nt, Escherichia coli CFT073
aaauuacucucgugccagagcau

SEQ ID NO: 621912 - RNA, 16 nt, Escherichia coli CFT073
aaauuaccaccagcga

SEQ ID NO: 621913 - RNA, 22 nt, Escherichia coli CFT073
aaauuaccgcaccaccagcagc

SEQ ID NO: 621914 - RNA, 23 nt, Escherichia coli CFT073
aaauuaccgcaccaccagcagcu

SEQ ID NO: 621915 - RNA, 18 nt, Escherichia coli CFT073
aaauuacgaaagcaaaau

SEQ ID NO: 621916 - RNA, 20 nt, Escherichia coli CFT073
aaauuacgaaagcaaaauua

SEQ ID NO: 621917 - RNA, 12 nt, Escherichia coli CFT073
aaauuacgaucc

SEQ ID NO: 621918 - RNA, 13 nt, Escherichia coli CFT073
aaauuaccuuuac

SEQ ID NO: 621919 - RNA, 14 nt, Escherichia coli CFT073
aaauuaccuuuaca

SEQ ID NO: 621920 - RNA, 13 nt, Escherichia coli CFT073
uuuuuucuuccca

SEQ ID NO: 621921 - RNA, 20 nt, Escherichia coli CFT073
aaauuaggucaaagaaucaa

SEQ ID NO: 621922 - RNA, 19 nt, Escherichia coli CFT073
aaauuaucaacguagaaua

SEQ ID NO: 621923 - RNA, 13 nt, Escherichia coli CFT073
aaauuauuuuaaa

SEQ ID NO: 621924 - RNA, 21 nt, Escherichia coli CFT073
aaauuauugccuugaugaaaa

SEQ ID NO: 621925 - RNA, 19 nt, Escherichia coli CFT073
aaauuccgcucuguaaccc

SEQ ID NO: 621926 - RNA, 18 nt, Escherichia coli CFT073
aaauucccggccucaaca

SEQ ID NO: 621927 - RNA, 22 nt, Escherichia coli CFT073
aaauucuccgcggucagcgcaa

SEQ ID NO: 621928 - RNA, 15 nt, Escherichia coli CFT073
aaauuauuuuaaauu

SEQ ID NO: 621929 - RNA, 19 nt, Escherichia coli CFT073
aaauucaauguguugauaa

SEQ ID NO: 621930 - RNA, 13 nt, Escherichia coli CFT073
aaauucacgcagg

SEQ ID NO: 621931 - RNA, 12 nt, Escherichia coli CFT073
aaauucaccacc

SEQ ID NO: 621932 - RNA, 14 nt, Escherichia coli CFT073
aaauucagcaaauu

SEQ ID NO: 621933 - RNA, 15 nt, Escherichia coli CFT073
aaauucagcauuacc

SEQ ID NO: 621934 - RNA, 19 nt, Escherichia coli CFT073
aaauucauccaguagaaua

SEQ ID NO: 621935 - RNA, 22 nt, Escherichia coli CFT073
aaauucauccaguagaauaaug

SEQ ID NO: 621936 - RNA, 14 nt, Escherichia coli CFT073
aaauuccagcggca

SEQ ID NO: 621937 - RNA, 21 nt, Escherichia coli CFT073
aaauucaguucgucacaguua

SEQ ID NO: 621938 - RNA, 12 nt, Escherichia coli CFT073
uuuugcgacccg

SEQ ID NO: 621939 - RNA, 20 nt, Escherichia coli CFT073
uuuugcgauuguaauuucac

SEQ ID NO: 621940 - RNA, 17 nt, Escherichia coli CFT073
uuuugcaucggcaaagc

SEQ ID NO: 621941 - RNA, 18 nt, Escherichia coli CFT073
uuuugcaucuucagucgc

SEQ ID NO: 621942 - RNA, 23 nt, Escherichia coli CFT073
uuuugccaggcuaaccaguaaaa

SEQ ID NO: 621943 - RNA, 20 nt, Escherichia coli CFT073
uuuugcccggcaacaacagg

SEQ ID NO: 621944 - RNA, 15 nt, Escherichia coli CFT073
uuuugcccuuucagc

SEQ ID NO: 621945 - RNA, 22 nt, Escherichia coli CFT073
uuuuggaauacguugcaaauau

SEQ ID NO: 621946 - RNA, 20 nt, Escherichia coli CFT073
uuuuggaauaguaaaaggca

SEQ ID NO: 621947 - RNA, 21 nt, Escherichia coli CFT073
uuuuggcgcguucccuuguug

SEQ ID NO: 621948 - RNA, 22 nt, Escherichia coli CFT073
uuuugcuucugaaucucuaagc

SEQ ID NO: 621949 - RNA, 21 nt, Escherichia coli CFT073
uuuugcucggcaaucucuucc

SEQ ID NO: 621950 - RNA, 19 nt, Escherichia coli CFT073
uuuugacguuuaauugcag

SEQ ID NO: 621951 - RNA, 15 nt, Escherichia coli CFT073
uuuugauacucaguc

SEQ ID NO: 621952 - RNA, 19 nt, Escherichia coli CFT073
uuuucuuucacgccaucau

SEQ ID NO: 621953 - RNA, 11 nt, Escherichia coli CFT073
uuuugaacaga

SEQ ID NO: 621954 - RNA, 12 nt, Escherichia coli CFT073
uuuugaacagac

SEQ ID NO: 621955 - RNA, 12 nt, Escherichia coli CFT073
uuuucuucaguu

SEQ ID NO: 621956 - RNA, 16 nt, Escherichia coli CFT073
uuuucugccagacaaa

SEQ ID NO: 621957 - RNA, 19 nt, Escherichia coli CFT073
uuuucugccagacaaaacu

SEQ ID NO: 621958 - RNA, 19 nt, Escherichia coli CFT073
uuuugugggccugauaaga

SEQ ID NO: 621959 - RNA, 15 nt, Escherichia coli CFT073
uuuugugauuuauuu

SEQ ID NO: 621960 - RNA, 12 nt, Escherichia coli CFT073
uuuuguagaccu

SEQ ID NO: 621961 - RNA, 13 nt, Escherichia coli CFT073
uuuuuaaauaaca

SEQ ID NO: 621962 - RNA, 20 nt, Escherichia coli CFT073
uuuuuaauguggcuggggua

SEQ ID NO: 621963 - RNA, 16 nt, Escherichia coli CFT073
uuuuuaaccgucacgu

SEQ ID NO: 621964 - RNA, 14 nt, Escherichia coli CFT073
uuuuuaagguuuaa

SEQ ID NO: 621965 - RNA, 22 nt, Escherichia coli CFT073
uuuuuaauaacuuuuaguaaac

SEQ ID NO: 621966 - RNA, 20 nt, Escherichia coli CFT073
uuuuuaauauuucauucucc

SEQ ID NO: 621967 - RNA, 16 nt, Escherichia coli CFT073
uuuuuaaucagaacaa

SEQ ID NO: 621968 - RNA, 17 nt, Escherichia coli CFT073
uuuuuaugaugcacuuc

SEQ ID NO: 621969 - RNA, 18 nt, Escherichia coli CFT073
uuuuuaugcccuggaucg

SEQ ID NO: 621970 - RNA, 23 nt, Escherichia coli CFT073
uuuuuaucccggcaaaaaacacu

SEQ ID NO: 621971 - RNA, 19 nt, Escherichia coli CFT073
uuuuuacaucaucagaaau

SEQ ID NO: 621972 - RNA, 18 nt, Escherichia coli CFT073
uuuuuagauuguuuucaa

SEQ ID NO: 621973 - RNA, 11 nt, Escherichia coli CFT073
uuuuuccagcu

SEQ ID NO: 621974 - RNA, 23 nt, Escherichia coli CFT073
uuuuuccagaucggcuucaaucu

SEQ ID NO: 621975 - RNA, 14 nt, Escherichia coli CFT073
uuuuucauuucucc

SEQ ID NO: 621976 - RNA, 15 nt, Escherichia coli CFT073
uuuuucauuucuccu

SEQ ID NO: 621977 - RNA, 23 nt, Escherichia coli CFT073
uuuuucauuucccgaauauggga

SEQ ID NO: 621978 - RNA, 18 nt, Escherichia coli CFT073
uuuuucauagcaaauucc

SEQ ID NO: 621979 - RNA, 17 nt, Escherichia coli CFT073
uuuuucauccagcggca

SEQ ID NO: 621980 - RNA, 12 nt, Escherichia coli CFT073
uuuuucaucccu

SEQ ID NO: 621981 - RNA, 12 nt, Escherichia coli CFT073
uuuucaaaugcg

SEQ ID NO: 621982 - RNA, 19 nt, Escherichia coli CFT073
uuuucaacgugucuuuuac

SEQ ID NO: 621983 - RNA, 14 nt, Escherichia coli CFT073
uuuucaacucauca

SEQ ID NO: 621984 - RNA, 18 nt, Escherichia coli CFT073
uuuucaucauacugauaa

SEQ ID NO: 621985 - RNA, 19 nt, Escherichia coli CFT073
uuuucagcguuuucuucaa

SEQ ID NO: 621986 - RNA, 21 nt, Escherichia coli CFT073
uuuucagguuacgcccuuccc

SEQ ID NO: 621987 - RNA, 18 nt, Escherichia coli CFT073
uuuucaccuucaaaauuu

SEQ ID NO: 621988 - RNA, 16 nt, Escherichia coli CFT073
uuuucaccaucgccau

SEQ ID NO: 621989 - RNA, 22 nt, Escherichia coli CFT073
uuuucacaguaauuuccugcca

SEQ ID NO: 621990 - RNA, 17 nt, Escherichia coli CFT073
uuuucagauaaaagcuu

SEQ ID NO: 621991 - RNA, 17 nt, Escherichia coli CFT073
uuuucagcaauuuuaau

SEQ ID NO: 621992 - RNA, 18 nt, Escherichia coli CFT073
uuuucccaacuaucaacc

SEQ ID NO: 621993 - RNA, 16 nt, Escherichia coli CFT073
uuuuccagcugugcca

SEQ ID NO: 621994 - RNA, 17 nt, Escherichia coli CFT073
uuuuccagcugugccag

SEQ ID NO: 621995 - RNA, 21 nt, Escherichia coli CFT073
uuuuccagaucggcuucaauc

SEQ ID NO: 621996 - RNA, 11 nt, Escherichia coli CFT073
uuuuccagcac

SEQ ID NO: 621997 - RNA, 18 nt, Escherichia coli CFT073
uuuucccuuccgccauca

SEQ ID NO: 621998 - RNA, 20 nt, Escherichia coli CFT073
uuuucccgauauaaccaucc

SEQ ID NO: 621999 - RNA, 23 nt, Escherichia coli CFT073
uuuuccgcacauacuggacacug

SEQ ID NO: 622000 - RNA, 14 nt, Escherichia coli CFT073
uuuucccaauaauu

SEQ ID NO: 622001 - RNA, 14 nt, Escherichia coli CFT073
uuuucccacuaacu

SEQ ID NO: 622002 - RNA, 21 nt, Escherichia coli CFT073
uuuucccacuaacugcgcgcu

SEQ ID NO: 622003 - RNA, 19 nt, Escherichia coli CFT073
uuuuccgggccaaaaaccg

SEQ ID NO: 622004 - RNA, 17 nt, Escherichia coli CFT073
uuuuccgccucaucauc

SEQ ID NO: 622005 - RNA, 21 nt, Escherichia coli CFT073
uuuucgcgucaaucacacuga

SEQ ID NO: 622006 - RNA, 17 nt, Escherichia coli CFT073
uuuucgcuaccagcaaa

SEQ ID NO: 622007 - RNA, 18 nt, Escherichia coli CFT073
uuuucgcuggaauuucug

SEQ ID NO: 622008 - RNA, 16 nt, Escherichia coli CFT073
uuuucgccacuucagc

SEQ ID NO: 622009 - RNA, 17 nt, Escherichia coli CFT073
uuuuccuugaaaaagag

SEQ ID NO: 622010 - RNA, 16 nt, Escherichia coli CFT073
uuuuccugguaucaau

SEQ ID NO: 622011 - RNA, 22 nt, Escherichia coli CFT073
uuuucgaugcguaccauuucuu

SEQ ID NO: 622012 - RNA, 16 nt, Escherichia coli CFT073
uuuucgcaaucaccuu

SEQ ID NO: 622013 - RNA, 21 nt, Escherichia coli CFT073
uuuuaucccggcaaaaaacac

SEQ ID NO: 622014 - RNA, 13 nt, Escherichia coli CFT073
uuuuaucccuucu

SEQ ID NO: 622015 - RNA, 14 nt, Escherichia coli CFT073
uuuuaucaauucuu

SEQ ID NO: 622016 - RNA, 20 nt, Escherichia coli CFT073
uuuuaucauuaacgauaauu

SEQ ID NO: 622017 - RNA, 13 nt, Escherichia coli CFT073
uuuuauauucaug

SEQ ID NO: 622018 - RNA, 15 nt, Escherichia coli CFT073
uuuuaucugugaacu

SEQ ID NO: 622019 - RNA, 17 nt, Escherichia coli CFT073
uuuuauugacauguuga

SEQ ID NO: 622020 - RNA, 15 nt, Escherichia coli CFT073
uuuuauugauuguuu

SEQ ID NO: 622021 - RNA, 19 nt, Escherichia coli CFT073
uuuuauugcguaaucuuuu

SEQ ID NO: 622022 - RNA, 15 nt, Escherichia coli CFT073
uuuuauucgacucug

SEQ ID NO: 622023 - RNA, 22 nt, Escherichia coli CFT073
uuuuauggcagaauacuucaca

SEQ ID NO: 622024 - RNA, 21 nt, Escherichia coli CFT073
uuuuauuauccgcuaaucaau

SEQ ID NO: 622025 - RNA, 12 nt, Escherichia coli CFT073
uuuuauuaaaua

SEQ ID NO: 622026 - RNA, 16 nt, Escherichia coli CFT073
uuuuauuaaauauuau

SEQ ID NO: 622027 - RNA, 22 nt, Escherichia coli CFT073
uuuuauaacuauaugacucaua

SEQ ID NO: 622028 - RNA, 23 nt, Escherichia coli CFT073
uuuuauacucuguuucugguggc

SEQ ID NO: 622029 - RNA, 14 nt, Escherichia coli CFT073
uuuuagacuuuguc

SEQ ID NO: 622030 - RNA, 18 nt, Escherichia coli CFT073
uuuuagauuguuuucaau

SEQ ID NO: 622031 - RNA, 18 nt, Escherichia coli CFT073
uuuuacgccugcaauuua

SEQ ID NO: 622032 - RNA, 18 nt, Escherichia coli CFT073
uuuuacgcgggcagugcg

SEQ ID NO: 622033 - RNA, 18 nt, Escherichia coli CFT073
uuuuacucuucuuuaauu

SEQ ID NO: 622034 - RNA, 20 nt, Escherichia coli CFT073
uuuuacucuucuuuaauuaa

SEQ ID NO: 622035 - RNA, 18 nt, Escherichia coli CFT073
uuuuacaggaaaaacuuu

SEQ ID NO: 622036 - RNA, 22 nt, Escherichia coli CFT073
uuuuaccauauaaacauaucac

SEQ ID NO: 622037 - RNA, 14 nt, Escherichia coli CFT073
uuuuaccguuuacu

SEQ ID NO: 622038 - RNA, 21 nt, Escherichia coli CFT073
uuuuacgaugcaauuaucauu

SEQ ID NO: 622039 - RNA, 21 nt, Escherichia coli CFT073
uuuuaagccauuaaaucagcc

SEQ ID NO: 622040 - RNA, 14 nt, Escherichia coli CFT073
uuuuaagcaaauaa

SEQ ID NO: 622041 - RNA, 20 nt, Escherichia coli CFT073
uuuuaagauccaguugaccu

SEQ ID NO: 622042 - RNA, 12 nt, Escherichia coli CFT073
uuuuaagugaug

SEQ ID NO: 622043 - RNA, 13 nt, Escherichia coli CFT073
uuuuaauauuuca

SEQ ID NO: 622044 - RNA, 13 nt, Escherichia coli CFT073
uuuuaaauugaag

SEQ ID NO: 622045 - RNA, 11 nt, Escherichia coli CFT073
uuuuaacuuac

SEQ ID NO: 622046 - RNA, 13 nt, Escherichia coli CFT073
uuuuaacuuuaau

SEQ ID NO: 622047 - RNA, 21 nt, Escherichia coli CFT073
uuuuaaaugcccgacaaaaau

SEQ ID NO: 622048 - RNA, 22 nt, Escherichia coli CFT073
uuuuaaaugcccgacaaaaauu

SEQ ID NO: 622049 - RNA, 22 nt, Escherichia coli CFT073
uuuuaaaucauccugaaucgcu

SEQ ID NO: 622050 - RNA, 22 nt, Escherichia coli CFT073
uuuuaaacggcauaaauuucag

SEQ ID NO: 622051 - RNA, 20 nt, Escherichia coli CFT073
uuuuaaaaacagaguagaaa

SEQ ID NO: 622052 - RNA, 14 nt, Escherichia coli CFT073
uuuguuuuucagga

SEQ ID NO: 622053 - RNA, 19 nt, Escherichia coli CFT073
uuuguuuuucaggaaauaa

SEQ ID NO: 622054 - RNA, 14 nt, Escherichia coli CFT073
uuuguuuucaucca

SEQ ID NO: 622055 - RNA, 13 nt, Escherichia coli CFT073
uuuguuucacacu

SEQ ID NO: 622056 - RNA, 16 nt, Escherichia coli CFT073
uuuguuguuuaccaac

SEQ ID NO: 622057 - RNA, 19 nt, Escherichia coli CFT073
uuuguugauaaacaaacag

SEQ ID NO: 622058 - RNA, 12 nt, Escherichia coli CFT073
uuuguuauucac

SEQ ID NO: 622059 - RNA, 13 nt, Escherichia coli CFT073
uuuguucaucaug

SEQ ID NO: 622060 - RNA, 15 nt, Escherichia coli CFT073
uuuggacaugcccgu

SEQ ID NO: 622061 - RNA, 16 nt, Escherichia coli CFT073
uuuggacuguugugaa

SEQ ID NO: 622062 - RNA, 14 nt, Escherichia coli CFT073
uuugcuuuguaaag

SEQ ID NO: 622063 - RNA, 17 nt, Escherichia coli CFT073
uuugcuggcaccgugaa

SEQ ID NO: 622064 - RNA, 16 nt, Escherichia coli CFT073
uuugcugugaagcacc

SEQ ID NO: 622065 - RNA, 15 nt, Escherichia coli CFT073
uuugcuguuccagca

SEQ ID NO: 622066 - RNA, 19 nt, Escherichia coli CFT073
uuugcuugccggaagcaaa

SEQ ID NO: 622067 - RNA, 22 nt, Escherichia coli CFT073
uuugcuugccgguuauuuugcu

SEQ ID NO: 622068 - RNA, 18 nt, Escherichia coli CFT073
uuuggucuggcaaaaaua

SEQ ID NO: 622069 - RNA, 19 nt, Escherichia coli CFT073
uuuggcaccguuagugauu

SEQ ID NO: 622070 - RNA, 20 nt, Escherichia coli CFT073
uuuggcaccguuagugauuu

SEQ ID NO: 622071 - RNA, 17 nt, Escherichia coli CFT073
uuuggcaucgaguaucu

SEQ ID NO: 622072 - RNA, 14 nt, Escherichia coli CFT073
uuugugcggaauua

SEQ ID NO: 622073 - RNA, 23 nt, Escherichia coli CFT073
uuugucguaccagugcagaugca

SEQ ID NO: 622074 - RNA, 23 nt, Escherichia coli CFT073
uuugucgccaucguuaaaaaaca

SEQ ID NO: 622075 - RNA, 16 nt, Escherichia coli CFT073
uuugucgaacagguua

SEQ ID NO: 622076 - RNA, 20 nt, Escherichia coli CFT073
uuugucgaugggggagguca

SEQ ID NO: 622077 - RNA, 20 nt, Escherichia coli CFT073
uuugucgccaacuucaugac

SEQ ID NO: 622078 - RNA, 16 nt, Escherichia coli CFT073
uuuguccucaccuaaa

SEQ ID NO: 622079 - RNA, 19 nt, Escherichia coli CFT073
uuugucagcaaaauaacag

SEQ ID NO: 622080 - RNA, 20 nt, Escherichia coli CFT073
uuugucagcaaacugaaaaa

SEQ ID NO: 622081 - RNA, 18 nt, Escherichia coli CFT073
uuuguaugguuuuguagg

SEQ ID NO: 622082 - RNA, 13 nt, Escherichia coli CFT073
uuuguauuuuucc

SEQ ID NO: 622083 - RNA, 21 nt, Escherichia coli CFT073
uuuguacaggauauauuucau

SEQ ID NO: 622084 - RNA, 19 nt, Escherichia coli CFT073
uuuguaccguacagauaca

SEQ ID NO: 622085 - RNA, 17 nt, Escherichia coli CFT073
uuuguaaggaguuuugu

SEQ ID NO: 622086 - RNA, 18 nt, Escherichia coli CFT073
uuuguaaggaguuuuguc

SEQ ID NO: 622087 - RNA, 14 nt, Escherichia coli CFT073
aagauauuauuaaa

SEQ ID NO: 622088 - RNA, 21 nt, Escherichia coli CFT073
aagauauuggggguaauuccc

SEQ ID NO: 622089 - RNA, 15 nt, Escherichia coli CFT073
aagauaguaaccguu

SEQ ID NO: 622090 - RNA, 21 nt, Escherichia coli CFT073
aagauagacuguugaaauaca

SEQ ID NO: 622091 - RNA, 13 nt, Escherichia coli CFT073
aagauaaugccag

SEQ ID NO: 622092 - RNA, 15 nt, Escherichia coli CFT073
aagauaauccaggac

SEQ ID NO: 622093 - RNA, 11 nt, Escherichia coli CFT073
aagaucaccac

SEQ ID NO: 622094 - RNA, 22 nt, Escherichia coli CFT073
aagaucagcaaauaauucaucu

SEQ ID NO: 622095 - RNA, 20 nt, Escherichia coli CFT073
aagaucaugccgacaaacag

SEQ ID NO: 622096 - RNA, 22 nt, Escherichia coli CFT073
aagauccagauuacguaccaga

SEQ ID NO: 622097 - RNA, 11 nt, Escherichia coli CFT073
aagauccauga

SEQ ID NO: 622098 - RNA, 17 nt, Escherichia coli CFT073
aagaucgugcagcaccg

SEQ ID NO: 622099 - RNA, 21 nt, Escherichia coli CFT073
aagaucgcccuuuuuugcuuu

SEQ ID NO: 622100 - RNA, 17 nt, Escherichia coli CFT073
aagaucuguuuauugag

SEQ ID NO: 622101 - RNA, 20 nt, Escherichia coli CFT073
aagaucuguuuauugaggau

SEQ ID NO: 622102 - RNA, 19 nt, Escherichia coli CFT073
aagaucuuugcgcuuauac

SEQ ID NO: 622103 - RNA, 23 nt, Escherichia coli CFT073
aagaucuuauugccauuuucacg

SEQ ID NO: 622104 - RNA, 14 nt, Escherichia coli CFT073
aagaugaaacuuau

SEQ ID NO: 622105 - RNA, 22 nt, Escherichia coli CFT073
aagaugaaauaaaaaagcccug

SEQ ID NO: 622106 - RNA, 16 nt, Escherichia coli CFT073
aagauucguauuuaaa

SEQ ID NO: 622107 - RNA, 17 nt, Escherichia coli CFT073
aagauucggcuucuucc

SEQ ID NO: 622108 - RNA, 18 nt, Escherichia coli CFT073
aagauucgauaacauucg

SEQ ID NO: 622109 - RNA, 16 nt, Escherichia coli CFT073
aagauucgcccauuaa

SEQ ID NO: 622110 - RNA, 22 nt, Escherichia coli CFT073
aagauucgcccauuaacaaccg

SEQ ID NO: 622111 - RNA, 15 nt, Escherichia coli CFT073
aagauuuaauucacc

SEQ ID NO: 622112 - RNA, 22 nt, Escherichia coli CFT073
aagauugucaauauccagcagg

SEQ ID NO: 622113 - RNA, 23 nt, Escherichia coli CFT073
aagauguuuugccugaaaaauga

SEQ ID NO: 622114 - RNA, 19 nt, Escherichia coli CFT073
aagauguuggcagcggcaa

SEQ ID NO: 622115 - RNA, 22 nt, Escherichia coli CFT073
aagauuaagagaaccagcugcc

SEQ ID NO: 622116 - RNA, 18 nt, Escherichia coli CFT073
aagauuagccaucauuuc

SEQ ID NO: 622117 - RNA, 22 nt, Escherichia coli CFT073
aagaugggccagcacguugugc

SEQ ID NO: 622118 - RNA, 18 nt, Escherichia coli CFT073
aagaugccagaaucccca

SEQ ID NO: 622119 - RNA, 14 nt, Escherichia coli CFT073
aagaugcguuaagc

SEQ ID NO: 622120 - RNA, 15 nt, Escherichia coli CFT073
aagcaucauuuugug

SEQ ID NO: 622121 - RNA, 20 nt, Escherichia coli CFT073
aagcaucauuuuguggguuu

SEQ ID NO: 622122 - RNA, 12 nt, Escherichia coli CFT073
aagcaucccgcc

SEQ ID NO: 622123 - RNA, 20 nt, Escherichia coli CFT073
aagcaugucauacaugguuu

SEQ ID NO: 622124 - RNA, 21 nt, Escherichia coli CFT073
aagcaugaauaucaaguuuau

SEQ ID NO: 622125 - RNA, 19 nt, Escherichia coli CFT073
aagcauuaccuucaagaau

SEQ ID NO: 622126 - RNA, 15 nt, Escherichia coli CFT073
aagcauucucccgcc

SEQ ID NO: 622127 - RNA, 17 nt, Escherichia coli CFT073
aagcauucguaaugaau

SEQ ID NO: 622128 - RNA, 16 nt, Escherichia coli CFT073
aagcauugauuuuaau

SEQ ID NO: 622129 - RNA, 18 nt, Escherichia coli CFT073
aagcauuggcaugcacgu

SEQ ID NO: 622130 - RNA, 17 nt, Escherichia coli CFT073
aagcauuuucucacugg

SEQ ID NO: 622131 - RNA, 12 nt, Escherichia coli CFT073
aagcaguccagc

SEQ ID NO: 622132 - RNA, 21 nt, Escherichia coli CFT073
aagcaguccagcgccugacgc

SEQ ID NO: 622133 - RNA, 15 nt, Escherichia coli CFT073
aagcaguuuauaaaa

SEQ ID NO: 622134 - RNA, 15 nt, Escherichia coli CFT073
aagcaguuucaccag

SEQ ID NO: 622135 - RNA, 23 nt, Escherichia coli CFT073
aagcagguagcgccuuuacugac

SEQ ID NO: 622136 - RNA, 12 nt, Escherichia coli CFT073
aagcaggcaccg

SEQ ID NO: 622137 - RNA, 16 nt, Escherichia coli CFT073
aagcagggcagggaag

SEQ ID NO: 622138 - RNA, 16 nt, Escherichia coli CFT073
aagcagggccaaacag

SEQ ID NO: 622139 - RNA, 15 nt, Escherichia coli CFT073
aagcaggcuucacgc

SEQ ID NO: 622140 - RNA, 15 nt, Escherichia coli CFT073
aagcagcuugagaaa

SEQ ID NO: 622141 - RNA, 16 nt, Escherichia coli CFT073
aagcagcuugagaaaa

SEQ ID NO: 622142 - RNA, 23 nt, Escherichia coli CFT073
aagcagagugugaaacaguaagu

SEQ ID NO: 622143 - RNA, 14 nt, Escherichia coli CFT073
aagcagaaugaaug

SEQ ID NO: 622144 - RNA, 15 nt, Escherichia coli CFT073
aagcagauaacccag

SEQ ID NO: 622145 - RNA, 16 nt, Escherichia coli CFT073
aagcagauaacccagc

SEQ ID NO: 622146 - RNA, 16 nt, Escherichia coli CFT073
aagcagauucuucgau

SEQ ID NO: 622147 - RNA, 23 nt, Escherichia coli CFT073
aagcacuugcaggaacaaugccu

SEQ ID NO: 622148 - RNA, 14 nt, Escherichia coli CFT073
aagcaccggcaccg

SEQ ID NO: 622149 - RNA, 22 nt, Escherichia coli CFT073
aagcacagggcaacggccaaaa

SEQ ID NO: 622150 - RNA, 17 nt, Escherichia coli CFT073
aagcaccgaacaagaaa

SEQ ID NO: 622151 - RNA, 16 nt, Escherichia coli CFT073
aagcacccaaugccau

SEQ ID NO: 622152 - RNA, 15 nt, Escherichia coli CFT073
aagcacccagcaauc

SEQ ID NO: 622153 - RNA, 16 nt, Escherichia coli CFT073
aagcacccagcaaucc

SEQ ID NO: 622154 - RNA, 17 nt, Escherichia coli CFT073
aagcaccauaaacaccg

SEQ ID NO: 622155 - RNA, 20 nt, Escherichia coli CFT073
aagcaaaaaaagaaucuauu

SEQ ID NO: 622156 - RNA, 18 nt, Escherichia coli CFT073
aagcaaaaaagaaggaaa

SEQ ID NO: 622157 - RNA, 14 nt, Escherichia coli CFT073
aagcaaacugugca

SEQ ID NO: 622158 - RNA, 12 nt, Escherichia coli CFT073
aagcaacaaacu

SEQ ID NO: 622159 - RNA, 15 nt, Escherichia coli CFT073
aagcaacaaaguuug

SEQ ID NO: 622160 - RNA, 20 nt, Escherichia coli CFT073
aagcaacaaccaccacaccu

SEQ ID NO: 622161 - RNA, 20 nt, Escherichia coli CFT073
aagcaaguugcgcaaucgaa

SEQ ID NO: 622162 - RNA, 14 nt, Escherichia coli CFT073
aagcaauaaaccau

SEQ ID NO: 622163 - RNA, 15 nt, Escherichia coli CFT073
aagcaauaaaccaua

SEQ ID NO: 622164 - RNA, 16 nt, Escherichia coli CFT073
aagcaauaaaccauaa

SEQ ID NO: 622165 - RNA, 21 nt, Escherichia coli CFT073
aagcaacugguuaucacgaaa

SEQ ID NO: 622166 - RNA, 22 nt, Escherichia coli CFT073
aagcaagaccaacacccacagc

SEQ ID NO: 622167 - RNA, 15 nt, Escherichia coli CFT073
aagcaauuaacagug

SEQ ID NO: 622168 - RNA, 21 nt, Escherichia coli CFT073
aagcaauccauaccagcacau

SEQ ID NO: 622169 - RNA, 17 nt, Escherichia coli CFT073
aagcaaucaagcccugg

SEQ ID NO: 622170 - RNA, 23 nt, Escherichia coli CFT073
aagaguugccccucuaacucuuc

SEQ ID NO: 622171 - RNA, 20 nt, Escherichia coli CFT073
aagaguuccugaugaaaaau

SEQ ID NO: 622172 - RNA, 18 nt, Escherichia coli CFT073
aagaguuucaacaucauu

SEQ ID NO: 622173 - RNA, 20 nt, Escherichia coli CFT073
aagaguuuucuuaagauaag

SEQ ID NO: 622174 - RNA, 21 nt, Escherichia coli CFT073
aagauaaguggcaauauauuu

SEQ ID NO: 622175 - RNA, 14 nt, Escherichia coli CFT073
aagauaaccucauu

SEQ ID NO: 622176 - RNA, 23 nt, Escherichia coli CFT073
aagagugguuagccggauaagca

SEQ ID NO: 622177 - RNA, 18 nt, Escherichia coli CFT073
aagagguguaauacguuu

SEQ ID NO: 622178 - RNA, 21 nt, Escherichia coli CFT073
aagaggcggagguuuuuuccu

SEQ ID NO: 622179 - RNA, 16 nt, Escherichia coli CFT073
aagaggaggacagcca

SEQ ID NO: 622180 - RNA, 17 nt, Escherichia coli CFT073
aagagcgacaaucccug

SEQ ID NO: 622181 - RNA, 15 nt, Escherichia coli CFT073
aagagcgacaauccc

SEQ ID NO: 622182 - RNA, 16 nt, Escherichia coli CFT073
aagacgcguuaagcgu

SEQ ID NO: 622183 - RNA, 15 nt, Escherichia coli CFT073
aagacgcauccacca

SEQ ID NO: 622184 - RNA, 22 nt, Escherichia coli CFT073
aagacugaguuuuauucuuuuu

SEQ ID NO: 622185 - RNA, 16 nt, Escherichia coli CFT073
aagagaaccagcugcc

SEQ ID NO: 622186 - RNA, 13 nt, Escherichia coli CFT073
aagagaacugagc

SEQ ID NO: 622187 - RNA, 17 nt, Escherichia coli CFT073
aagagagcaguccaaga

SEQ ID NO: 622188 - RNA, 18 nt, Escherichia coli CFT073
aagagacuaacauccgaa

SEQ ID NO: 622189 - RNA, 13 nt, Escherichia coli CFT073
aagagcaaauaaa

SEQ ID NO: 622190 - RNA, 16 nt, Escherichia coli CFT073
aagagaucaaagucuc

SEQ ID NO: 622191 - RNA, 15 nt, Escherichia coli CFT073
aagagaugaaugaau

SEQ ID NO: 622192 - RNA, 19 nt, Escherichia coli CFT073
aagagauaaacgaccacuc

SEQ ID NO: 622193 - RNA, 16 nt, Escherichia coli CFT073
aagaccauugaugcuc

SEQ ID NO: 622194 - RNA, 22 nt, Escherichia coli CFT073
aagaccaauccgccagccaauu

SEQ ID NO: 622195 - RNA, 17 nt, Escherichia coli CFT073
aagacagcgucacauca

SEQ ID NO: 622196 - RNA, 14 nt, Escherichia coli CFT073
aagaccuuccagaa

SEQ ID NO: 622197 - RNA, 22 nt, Escherichia coli CFT073
aagacgaaccggcacccaaucc

SEQ ID NO: 622198 - RNA, 20 nt, Escherichia coli CFT073
aagaccgcgaccacuggguu

SEQ ID NO: 622199 - RNA, 16 nt, Escherichia coli CFT073
aagaccgugagcaaug

SEQ ID NO: 622200 - RNA, 20 nt, Escherichia coli CFT073
aagaccgugagcaaugcaca

SEQ ID NO: 622201 - RNA, 22 nt, Escherichia coli CFT073
aagaccgugagcaaugcacaca

SEQ ID NO: 622202 - RNA, 17 nt, Escherichia coli CFT073
aagaauuuucgcuggaa

SEQ ID NO: 622203 - RNA, 19 nt, Escherichia coli CFT073
aagacaauacuugccggag

SEQ ID NO: 622204 - RNA, 12 nt, Escherichia coli CFT073
aagacaaacaug

SEQ ID NO: 622205 - RNA, 16 nt, Escherichia coli CFT073
aagacaacauugauuu

SEQ ID NO: 622206 - RNA, 16 nt, Escherichia coli CFT073
aagacacgccaguguc

SEQ ID NO: 622207 - RNA, 21 nt, Escherichia coli CFT073
aagaauuucuuuacugacagg

SEQ ID NO: 622208 - RNA, 17 nt, Escherichia coli CFT073
aagaauaaaacgccuga

SEQ ID NO: 622209 - RNA, 21 nt, Escherichia coli CFT073
aaauugagauaagcaacaaac

SEQ ID NO: 622210 - RNA, 13 nt, Escherichia coli CFT073
aagaauagccugg

SEQ ID NO: 622211 - RNA, 21 nt, Escherichia coli CFT073
aagaaucuauuaaccaauaag

SEQ ID NO: 622212 - RNA, 22 nt, Escherichia coli CFT073
aagaaugacacuuucagcgcag

SEQ ID NO: 622213 - RNA, 16 nt, Escherichia coli CFT073
aagaaugcgaaaacga

SEQ ID NO: 622214 - RNA, 15 nt, Escherichia coli CFT073
aagaaugcagucagu

SEQ ID NO: 622215 - RNA, 20 nt, Escherichia coli CFT073
aagaaugaaauucgagagaa

SEQ ID NO: 622216 - RNA, 18 nt, Escherichia coli CFT073
aagucacaaaauucgcca

SEQ ID NO: 622217 - RNA, 21 nt, Escherichia coli CFT073
aagguuuuuucuguauucauc

SEQ ID NO: 622218 - RNA, 21 nt, Escherichia coli CFT073
aaguaaccuuuaucacgcagc

SEQ ID NO: 622219 - RNA, 19 nt, Escherichia coli CFT073
aaguaaccuuugaacagcc

SEQ ID NO: 622220 - RNA, 23 nt, Escherichia coli CFT073
aaguaaggcagagccaaauaauc

SEQ ID NO: 622221 - RNA, 15 nt, Escherichia coli CFT073
aagucucagaaagua

SEQ ID NO: 622222 - RNA, 14 nt, Escherichia coli CFT073
aagucuaaugacaa

SEQ ID NO: 622223 - RNA, 17 nt, Escherichia coli CFT073
aaguccgguaauggaga

SEQ ID NO: 622224 - RNA, 22 nt, Escherichia coli CFT073
aaguccgaggaaggcacguaca

SEQ ID NO: 622225 - RNA, 18 nt, Escherichia coli CFT073
aagucccgaccacacaaa

SEQ ID NO: 622226 - RNA, 16 nt, Escherichia coli CFT073
aaguccagcaccguca

SEQ ID NO: 622227 - RNA, 17 nt, Escherichia coli CFT073
aagucagcacauccagu

SEQ ID NO: 622228 - RNA, 21 nt, Escherichia coli CFT073
aagucagcgcgaaaucgcccu

SEQ ID NO: 622229 - RNA, 19 nt, Escherichia coli CFT073
aagugaaaaacaccccauu

SEQ ID NO: 622230 - RNA, 23 nt, Escherichia coli CFT073
aagucuuccggugcaucaacaua

SEQ ID NO: 622231 - RNA, 13 nt, Escherichia coli CFT073
aagucucauauau

SEQ ID NO: 622232 - RNA, 18 nt, Escherichia coli CFT073
aagugaaucggaucaauc

SEQ ID NO: 622233 - RNA, 18 nt, Escherichia coli CFT073
aaguggguaaugucacac

SEQ ID NO: 622234 - RNA, 19 nt, Escherichia coli CFT073
aaguguucgaccaccgguu

SEQ ID NO: 622235 - RNA, 21 nt, Escherichia coli CFT073
aaguggaaauccccaucaggu

SEQ ID NO: 622236 - RNA, 23 nt, Escherichia coli CFT073
aauaaacgcuccugcuacaccau

SEQ ID NO: 622237 - RNA, 18 nt, Escherichia coli CFT073
aauaaacccuucacugua

SEQ ID NO: 622238 - RNA, 20 nt, Escherichia coli CFT073
aauaaacagcagauggcagc

SEQ ID NO: 622239 - RNA, 14 nt, Escherichia coli CFT073
aauaaacaaugauu

SEQ ID NO: 622240 - RNA, 12 nt, Escherichia coli CFT073
aauaaaccacac

SEQ ID NO: 622241 - RNA, 18 nt, Escherichia coli CFT073
aauaaaccaguaagguuu

SEQ ID NO: 622242 - RNA, 13 nt, Escherichia coli CFT073
aauaaaaucagca

SEQ ID NO: 622243 - RNA, 15 nt, Escherichia coli CFT073
aauaaaaucuauuau

SEQ ID NO: 622244 - RNA, 13 nt, Escherichia coli CFT073
aauaaaauaucuu

SEQ ID NO: 622245 - RNA, 14 nt, Escherichia coli CFT073
aauaaaauaucuuc

SEQ ID NO: 622246 - RNA, 20 nt, Escherichia coli CFT073
aauaaaaaccugucuggauu

SEQ ID NO: 622247 - RNA, 21 nt, Escherichia coli CFT073
aaguuuuuugcgaaaaauaaa

SEQ ID NO: 622248 - RNA, 16 nt, Escherichia coli CFT073
aauaaaacaagcagcu

SEQ ID NO: 622249 - RNA, 14 nt, Escherichia coli CFT073
aaguucuuccggca

SEQ ID NO: 622250 - RNA, 15 nt, Escherichia coli CFT073
aaguucgguaggccg

SEQ ID NO: 622251 - RNA, 13 nt, Escherichia coli CFT073
aaguugaaaucac

SEQ ID NO: 622252 - RNA, 23 nt, Escherichia coli CFT073
aaguugaagccgaacagucgcug

SEQ ID NO: 622253 - RNA, 21 nt, Escherichia coli CFT073
aaguuuaauccguauuccuga

SEQ ID NO: 622254 - RNA, 16 nt, Escherichia coli CFT073
aaguuuaauucuuuga

SEQ ID NO: 622255 - RNA, 20 nt, Escherichia coli CFT073
aaguuggugauguauaucgg

SEQ ID NO: 622256 - RNA, 16 nt, Escherichia coli CFT073
aaguuugcaaacccac

SEQ ID NO: 622257 - RNA, 22 nt, Escherichia coli CFT073
aaguuuggaagaccuuccagaa

SEQ ID NO: 622258 - RNA, 14 nt, Escherichia coli CFT073
aaguuuuucaacac

SEQ ID NO: 622259 - RNA, 16 nt, Escherichia coli CFT073
aaguuuuuaaauaaca

SEQ ID NO: 622260 - RNA, 23 nt, Escherichia coli CFT073
aaguuuuuauauuuuuugcuugu

SEQ ID NO: 622261 - RNA, 22 nt, Escherichia coli CFT073
aaguuugugccgccggaaucaa

SEQ ID NO: 622262 - RNA, 22 nt, Escherichia coli CFT073
aaguuuuccgcuucuucuucca

SEQ ID NO: 622263 - RNA, 23 nt, Escherichia coli CFT073
aaguuuuccguacucaaugccag

SEQ ID NO: 622264 - RNA, 22 nt, Escherichia coli CFT073
aaggccaacgaaaaauggggga

SEQ ID NO: 622265 - RNA, 12 nt, Escherichia coli CFT073
aaggcaguucag

SEQ ID NO: 622266 - RNA, 13 nt, Escherichia coli CFT073
aaggcaucagcca

SEQ ID NO: 622267 - RNA, 18 nt, Escherichia coli CFT073
aaggcacucauuuucucu

SEQ ID NO: 622268 - RNA, 20 nt, Escherichia coli CFT073
aaggcaacgccccuucugcc

SEQ ID NO: 622269 - RNA, 21 nt, Escherichia coli CFT073
aaggcaauugcauuugaacug

SEQ ID NO: 622270 - RNA, 15 nt, Escherichia coli CFT073
aaggcaccuggaaau

SEQ ID NO: 622271 - RNA, 14 nt, Escherichia coli CFT073
aaggcaauuaaaaa

SEQ ID NO: 622272 - RNA, 21 nt, Escherichia coli CFT073
aaggcaauuaaaaauuucccc

SEQ ID NO: 622273 - RNA, 21 nt, Escherichia coli CFT073
aaggccgcgaaccagaccagc

SEQ ID NO: 622274 - RNA, 18 nt, Escherichia coli CFT073
aaggccagcaauccccag

SEQ ID NO: 622275 - RNA, 19 nt, Escherichia coli CFT073
aaggcgacaauaaauacaa

SEQ ID NO: 622276 - RNA, 16 nt, Escherichia coli CFT073
aaggcgcgucaagcgu

SEQ ID NO: 622277 - RNA, 15 nt, Escherichia coli CFT073
aaggugcgaaaaaaa

SEQ ID NO: 622278 - RNA, 22 nt, Escherichia coli CFT073
aaggugcgaccuacacaccuuc

SEQ ID NO: 622279 - RNA, 17 nt, Escherichia coli CFT073
aaggugauucccagcaa

SEQ ID NO: 622280 - RNA, 19 nt, Escherichia coli CFT073
aaggugauucccagcaaca

SEQ ID NO: 622281 - RNA, 19 nt, Escherichia coli CFT073
aaggugcauugaaggcaau

SEQ ID NO: 622282 - RNA, 13 nt, Escherichia coli CFT073
aaggugccacagc

SEQ ID NO: 622283 - RNA, 22 nt, Escherichia coli CFT073
aagguggucagacggaacaucu

SEQ ID NO: 622284 - RNA, 20 nt, Escherichia coli CFT073
aaggugguuaccgccagcac

SEQ ID NO: 622285 - RNA, 14 nt, Escherichia coli CFT073
aagguuaugcaagu

SEQ ID NO: 622286 - RNA, 19 nt, Escherichia coli CFT073
aagguucacuuaaucucug

SEQ ID NO: 622287 - RNA, 14 nt, Escherichia coli CFT073
aagguugccgggga

SEQ ID NO: 622288 - RNA, 15 nt, Escherichia coli CFT073
aagguuucaguaaca

SEQ ID NO: 622289 - RNA, 19 nt, Escherichia coli CFT073
aaggucuuaauuuugguaa

SEQ ID NO: 622290 - RNA, 17 nt, Escherichia coli CFT073
aagguaucgcgaaaaaa

SEQ ID NO: 622291 - RNA, 22 nt, Escherichia coli CFT073
aagguaucgcgaaaaaaaagau

SEQ ID NO: 622292 - RNA, 20 nt, Escherichia coli CFT073
aagguaaugcgcgagccaua

SEQ ID NO: 622293 - RNA, 18 nt, Escherichia coli CFT073
aagguaaggauaaaaaag

SEQ ID NO: 622294 - RNA, 16 nt, Escherichia coli CFT073
aaggcugugaaaguug

SEQ ID NO: 622295 - RNA, 12 nt, Escherichia coli CFT073
aaggcgcaacau

SEQ ID NO: 622296 - RNA, 14 nt, Escherichia coli CFT073
aaggcugccagagu

SEQ ID NO: 622297 - RNA, 15 nt, Escherichia coli CFT073
aaggaaugaaauauu

SEQ ID NO: 622298 - RNA, 23 nt, Escherichia coli CFT073
aaggaagccugaaagggaaggga

SEQ ID NO: 622299 - RNA, 19 nt, Escherichia coli CFT073
aaggaagacguagcaagca

SEQ ID NO: 622300 - RNA, 23 nt, Escherichia coli CFT073
aaggaagcugauuuuauuucaaa

SEQ ID NO: 622301 - RNA, 14 nt, Escherichia coli CFT073
aaggaagcuuucgc

SEQ ID NO: 622302 - RNA, 22 nt, Escherichia coli CFT073
aaggaguuuuuccuuucugaua

SEQ ID NO: 622303 - RNA, 17 nt, Escherichia coli CFT073
aaggauaauuaauccuu

SEQ ID NO: 622304 - RNA, 11 nt, Escherichia coli CFT073
aaggauaagac

SEQ ID NO: 622305 - RNA, 18 nt, Escherichia coli CFT073
aaggauuggguuaagccg

SEQ ID NO: 622306 - RNA, 16 nt, Escherichia coli CFT073
aagcugccuugccagg

SEQ ID NO: 622307 - RNA, 18 nt, Escherichia coli CFT073
aagcugccgcuccuucac

SEQ ID NO: 622308 - RNA, 19 nt, Escherichia coli CFT073
aagcugauuuuauuucaaa

SEQ ID NO: 622309 - RNA, 22 nt, Escherichia coli CFT073
aagcugcugacggugauaauca

SEQ ID NO: 622310 - RNA, 19 nt, Escherichia coli CFT073
aagcuuuccggaaaaauca

SEQ ID NO: 622311 - RNA, 15 nt, Escherichia coli CFT073
aagcuguuucagugu

SEQ ID NO: 622312 - RNA, 16 nt, Escherichia coli CFT073
aagcugugccugaaua

SEQ ID NO: 622313 - RNA, 15 nt, Escherichia coli CFT073
aagcuguucagauac

SEQ ID NO: 622314 - RNA, 17 nt, Escherichia coli CFT073
aagcuccgcugaaacgu

SEQ ID NO: 622315 - RNA, 23 nt, Escherichia coli CFT073
aagcucugguguggagugcagca

SEQ ID NO: 622316 - RNA, 16 nt, Escherichia coli CFT073
aagcucucuuccaguu

SEQ ID NO: 622317 - RNA, 18 nt, Escherichia coli CFT073
aagcgugaaacaaaucac

SEQ ID NO: 622318 - RNA, 17 nt, Escherichia coli CFT073
aagcuaccggcaaacgg

SEQ ID NO: 622319 - RNA, 13 nt, Escherichia coli CFT073
aagcgcugugaaa

SEQ ID NO: 622320 - RNA, 17 nt, Escherichia coli CFT073
aagcgcugugaaacacc

SEQ ID NO: 622321 - RNA, 13 nt, Escherichia coli CFT073
aagccaccacgcc

SEQ ID NO: 622322 - RNA, 16 nt, Escherichia coli CFT073
aagccaccgaacaaaa

SEQ ID NO: 622323 - RNA, 13 nt, Escherichia coli CFT073
aagccaagccaga

SEQ ID NO: 622324 - RNA, 15 nt, Escherichia coli CFT073
aagccaaauccagca

SEQ ID NO: 622325 - RNA, 18 nt, Escherichia coli CFT073
aagccaacagcagccaca

SEQ ID NO: 622326 - RNA, 14 nt, Escherichia coli CFT073
aagcggaugcgauu

SEQ ID NO: 622327 - RNA, 19 nt, Escherichia coli CFT073
aagcggccgucagaucgcc

SEQ ID NO: 622328 - RNA, 13 nt, Escherichia coli CFT073
aagcggcagagga

SEQ ID NO: 622329 - RNA, 22 nt, Escherichia coli CFT073
aagcggcagaggaggagagcag

SEQ ID NO: 622330 - RNA, 13 nt, Escherichia coli CFT073
aagcggcacugcu

SEQ ID NO: 622331 - RNA, 17 nt, Escherichia coli CFT073
aagcguauccaucacua

SEQ ID NO: 622332 - RNA, 13 nt, Escherichia coli CFT073
aagcgucagcuuu

SEQ ID NO: 622333 - RNA, 16 nt, Escherichia coli CFT073
aauguguuaauaaugc

SEQ ID NO: 622334 - RNA, 18 nt, Escherichia coli CFT073
aauguguuuauaagccau

SEQ ID NO: 622335 - RNA, 15 nt, Escherichia coli CFT073
aaugugcugagaaca

SEQ ID NO: 622336 - RNA, 17 nt, Escherichia coli CFT073
aauguggugaaaugccu

SEQ ID NO: 622337 - RNA, 21 nt, Escherichia coli CFT073
aauguucaauaagcuuagucu

SEQ ID NO: 622338 - RNA, 13 nt, Escherichia coli CFT073
aauguucgccggg

SEQ ID NO: 622339 - RNA, 14 nt, Escherichia coli CFT073
aauuaaacaaauaa

SEQ ID NO: 622340 - RNA, 22 nt, Escherichia coli CFT073
aauuaaacgccucugucagaaa

SEQ ID NO: 622341 - RNA, 15 nt, Escherichia coli CFT073
aauuaaguuuuccgc

SEQ ID NO: 622342 - RNA, 16 nt, Escherichia coli CFT073
aauuaccugaugcgcu

SEQ ID NO: 622343 - RNA, 19 nt, Escherichia coli CFT073
aauuaccuuuuuaccaaca

SEQ ID NO: 622344 - RNA, 22 nt, Escherichia coli CFT073
aauuaccccauccauugcauaa

SEQ ID NO: 622345 - RNA, 15 nt, Escherichia coli CFT073
aauuaccagcgcagg

SEQ ID NO: 622346 - RNA, 18 nt, Escherichia coli CFT073
aauuaccgcaugacaauc

SEQ ID NO: 622347 - RNA, 19 nt, Escherichia coli CFT073
aaugucauaccacauacau

SEQ ID NO: 622348 - RNA, 19 nt, Escherichia coli CFT073
aaugucauacuauugccau

SEQ ID NO: 622349 - RNA, 23 nt, Escherichia coli CFT073
aaugucaucucuggcacgagauc

SEQ ID NO: 622350 - RNA, 20 nt, Escherichia coli CFT073
aaugucauuacgaucaagaa

SEQ ID NO: 622351 - RNA, 14 nt, Escherichia coli CFT073
aauguccauauaua

SEQ ID NO: 622352 - RNA, 19 nt, Escherichia coli CFT073
aauguccauauauaaaauc

SEQ ID NO: 622353 - RNA, 22 nt, Escherichia coli CFT073
aaugucgacguuuuucaggcug

SEQ ID NO: 622354 - RNA, 18 nt, Escherichia coli CFT073
aauguccguaacauaaca

SEQ ID NO: 622355 - RNA, 18 nt, Escherichia coli CFT073
aaugucggcccgcauuau

SEQ ID NO: 622356 - RNA, 21 nt, Escherichia coli CFT073
aaugucucgguagagaaaacc

SEQ ID NO: 622357 - RNA, 20 nt, Escherichia coli CFT073
aaugucuuuuaugguagaaa

SEQ ID NO: 622358 - RNA, 15 nt, Escherichia coli CFT073
aauggcuggcagcag

SEQ ID NO: 622359 - RNA, 13 nt, Escherichia coli CFT073
aauggcuuccagu

SEQ ID NO: 622360 - RNA, 21 nt, Escherichia coli CFT073
aauggcuaucgaaaucaaagu

SEQ ID NO: 622361 - RNA, 22 nt, Escherichia coli CFT073
aauggcugaccggaauuuaccc

SEQ ID NO: 622362 - RNA, 20 nt, Escherichia coli CFT073
aauggcugcgcgaaaacccu

SEQ ID NO: 622363 - RNA, 18 nt, Escherichia coli CFT073
aaugggcgucuaaaucgu

SEQ ID NO: 622364 - RNA, 20 nt, Escherichia coli CFT073
aaugguaaucagcgacugcu

SEQ ID NO: 622365 - RNA, 18 nt, Escherichia coli CFT073
aauggucauuuuucacuc

SEQ ID NO: 622366 - RNA, 21 nt, Escherichia coli CFT073
aauggucauuuuucacucccc

SEQ ID NO: 622367 - RNA, 18 nt, Escherichia coli CFT073
aaugguccgugacccgga

SEQ ID NO: 622368 - RNA, 19 nt, Escherichia coli CFT073
aauggguuuuuuguugccu

SEQ ID NO: 622369 - RNA, 17 nt, Escherichia coli CFT073
aaugguaacuuucugcc

SEQ ID NO: 622370 - RNA, 22 nt, Escherichia coli CFT073
aauggugugcaugguguucaga

SEQ ID NO: 622371 - RNA, 23 nt, Escherichia coli CFT073
aaugguccgugacccggaauaaa

SEQ ID NO: 622372 - RNA, 16 nt, Escherichia coli CFT073
aauggucacacacaac

SEQ ID NO: 622373 - RNA, 12 nt, Escherichia coli CFT073
aauggugaaguu

SEQ ID NO: 622374 - RNA, 17 nt, Escherichia coli CFT073
aauguaucuuucaucau

SEQ ID NO: 622375 - RNA, 17 nt, Escherichia coli CFT073
aauguaugugcgaaaau

SEQ ID NO: 622376 - RNA, 18 nt, Escherichia coli CFT073
aaugccauuaacaucccu

SEQ ID NO: 622377 - RNA, 13 nt, Escherichia coli CFT073
aaugccauaaaag

SEQ ID NO: 622378 - RNA, 17 nt, Escherichia coli CFT073
aaugccaguucaguaaa

SEQ ID NO: 622379 - RNA, 13 nt, Escherichia coli CFT073
aaugccagccugc

SEQ ID NO: 622380 - RNA, 17 nt, Escherichia coli CFT073
aaugccaggcuccagau

SEQ ID NO: 622381 - RNA, 17 nt, Escherichia coli CFT073
aaugcacuuccagcggc

SEQ ID NO: 622382 - RNA, 18 nt, Escherichia coli CFT073
aaugccagcaacuggcuu

SEQ ID NO: 622383 - RNA, 13 nt, Escherichia coli CFT073
aaugccagcagca

SEQ ID NO: 622384 - RNA, 20 nt, Escherichia coli CFT073
aaugccccaccacucugugg

SEQ ID NO: 622385 - RNA, 13 nt, Escherichia coli CFT073
aaugccccagaau

SEQ ID NO: 622386 - RNA, 15 nt, Escherichia coli CFT073
aaugcccgacaaaaa

SEQ ID NO: 622387 - RNA, 23 nt, Escherichia coli CFT073
aaugcccgacaaaaauuauugcc

SEQ ID NO: 622388 - RNA, 22 nt, Escherichia coli CFT073
aaugcuccccagaccaauugcc

SEQ ID NO: 622389 - RNA, 19 nt, Escherichia coli CFT073
aaugcuccccuuucuuauu

SEQ ID NO: 622390 - RNA, 20 nt, Escherichia coli CFT073
aaugcuccccuuucuuauuu

SEQ ID NO: 622391 - RNA, 17 nt, Escherichia coli CFT073
aaugcugguaauggcuu

SEQ ID NO: 622392 - RNA, 15 nt, Escherichia coli CFT073
aaugcugcaaucauu

SEQ ID NO: 622393 - RNA, 23 nt, Escherichia coli CFT073
aaugcugcaccccacaaacagaa

SEQ ID NO: 622394 - RNA, 22 nt, Escherichia coli CFT073
aaugcugcucgcaaaauaaaaa

SEQ ID NO: 622395 - RNA, 14 nt, Escherichia coli CFT073
aaugcugaaagcag

SEQ ID NO: 622396 - RNA, 11 nt, Escherichia coli CFT073
aauggcagcau

SEQ ID NO: 622397 - RNA, 17 nt, Escherichia coli CFT073
aauggcgucaacaacac

SEQ ID NO: 622398 - RNA, 15 nt, Escherichia coli CFT073
aauggcguugcuggc

SEQ ID NO: 622399 - RNA, 20 nt, Escherichia coli CFT073
aauggcaauggucuugacau

SEQ ID NO: 622400 - RNA, 13 nt, Escherichia coli CFT073
aaucgcagcgcaa

SEQ ID NO: 622401 - RNA, 18 nt, Escherichia coli CFT073
aaucgcauauuucaacga

SEQ ID NO: 622402 - RNA, 22 nt, Escherichia coli CFT073
aaucgcuucugccggaauaauc

SEQ ID NO: 622403 - RNA, 23 nt, Escherichia coli CFT073
aaucguucugugccgucugcccc

SEQ ID NO: 622404 - RNA, 20 nt, Escherichia coli CFT073
aaucggaaaacaaccgccau

SEQ ID NO: 622405 - RNA, 14 nt, Escherichia coli CFT073
aaucggcaccgccg

SEQ ID NO: 622406 - RNA, 22 nt, Escherichia coli CFT073
aaucgggaucccuuuguaagca

SEQ ID NO: 622407 - RNA, 20 nt, Escherichia coli CFT073
aaucgggaaaaucugcggga

SEQ ID NO: 622408 - RNA, 17 nt, Escherichia coli CFT073
aaucgggaaaaucugcg

SEQ ID NO: 622409 - RNA, 21 nt, Escherichia coli CFT073
aaucauccugcggcagcucca

SEQ ID NO: 622410 - RNA, 19 nt, Escherichia coli CFT073
aaucauccuguucauuuuu

SEQ ID NO: 622411 - RNA, 13 nt, Escherichia coli CFT073
aaucaucaucagc

SEQ ID NO: 622412 - RNA, 13 nt, Escherichia coli CFT073
aaucgaaaucaac

SEQ ID NO: 622413 - RNA, 18 nt, Escherichia coli CFT073
aaucaucgacauugacca

SEQ ID NO: 622414 - RNA, 17 nt, Escherichia coli CFT073
aaucaucgacuccagcg

SEQ ID NO: 622415 - RNA, 17 nt, Escherichia coli CFT073
aaucgauaacugcucuc

SEQ ID NO: 622416 - RNA, 13 nt, Escherichia coli CFT073
aaucgagcaauaa

SEQ ID NO: 622417 - RNA, 21 nt, Escherichia coli CFT073
aaucgacggccaguuugacau

SEQ ID NO: 622418 - RNA, 21 nt, Escherichia coli CFT073
aaucgaaccaaacagcgccag

SEQ ID NO: 622419 - RNA, 14 nt, Escherichia coli CFT073
aaucgacaaaauca

SEQ ID NO: 622420 - RNA, 23 nt, Escherichia coli CFT073
aaucgaccaggccaucagcagcg

SEQ ID NO: 622421 - RNA, 16 nt, Escherichia coli CFT073
aaucgacgaggaaaau

SEQ ID NO: 622422 - RNA, 21 nt, Escherichia coli CFT073
aaucgacgaggaaaaugauca

SEQ ID NO: 622423 - RNA, 19 nt, Escherichia coli CFT073
aaucgacucugaaugccag

SEQ ID NO: 622424 - RNA, 20 nt, Escherichia coli CFT073
aaucgacucugaaugccagu

SEQ ID NO: 622425 - RNA, 22 nt, Escherichia coli CFT073
aaucguuuuuuucgcaaaacac

SEQ ID NO: 622426 - RNA, 14 nt, Escherichia coli CFT073
aaucuccagaugac

SEQ ID NO: 622427 - RNA, 18 nt, Escherichia coli CFT073
aaucucguggucaauauc

SEQ ID NO: 622428 - RNA, 16 nt, Escherichia coli CFT073
aaucucuaacaaccuc

SEQ ID NO: 622429 - RNA, 17 nt, Escherichia coli CFT073
aaucucucccguugcuu

SEQ ID NO: 622430 - RNA, 18 nt, Escherichia coli CFT073
aaucugacuuccugccuc

SEQ ID NO: 622431 - RNA, 14 nt, Escherichia coli CFT073
aaucugauauuuag

SEQ ID NO: 622432 - RNA, 20 nt, Escherichia coli CFT073
aaucucuuuccauucuuucc

SEQ ID NO: 622433 - RNA, 16 nt, Escherichia coli CFT073
aaucugaacggcugca

SEQ ID NO: 622434 - RNA, 21 nt, Escherichia coli CFT073
aaucucuucgagaauaucuuc

SEQ ID NO: 622435 - RNA, 14 nt, Escherichia coli CFT073
aaugaucacuggaa

SEQ ID NO: 622436 - RNA, 15 nt, Escherichia coli CFT073
aaugauauuuucugc

SEQ ID NO: 622437 - RNA, 19 nt, Escherichia coli CFT073
aaugauaugugcagaagcc

SEQ ID NO: 622438 - RNA, 15 nt, Escherichia coli CFT073
aaugauggugaaagc

SEQ ID NO: 622439 - RNA, 16 nt, Escherichia coli CFT073
aaugauggugaaagca

SEQ ID NO: 622440 - RNA, 15 nt, Escherichia coli CFT073
aaugauagccaggcg

SEQ ID NO: 622441 - RNA, 14 nt, Escherichia coli CFT073
aaugcaacugccca

SEQ ID NO: 622442 - RNA, 20 nt, Escherichia coli CFT073
aaugcaacugcccaggcaaa

SEQ ID NO: 622443 - RNA, 22 nt, Escherichia coli CFT073
aaugcaacugcccaggcaaaaa

SEQ ID NO: 622444 - RNA, 15 nt, Escherichia coli CFT073
aaugcacacaaaauu

SEQ ID NO: 622445 - RNA, 18 nt, Escherichia coli CFT073
aaugauucauaaacaaua

SEQ ID NO: 622446 - RNA, 14 nt, Escherichia coli CFT073
aaugaccaccaaau

SEQ ID NO: 622447 - RNA, 23 nt, Escherichia coli CFT073
aaugacaucgcccucuuucacca

SEQ ID NO: 622448 - RNA, 14 nt, Escherichia coli CFT073
aaugacaucugcau

SEQ ID NO: 622449 - RNA, 18 nt, Escherichia coli CFT073
aaugacuucgcuuucgcc

SEQ ID NO: 622450 - RNA, 17 nt, Escherichia coli CFT073
aaugacugguuuugugg

SEQ ID NO: 622451 - RNA, 14 nt, Escherichia coli CFT073
aaugagucaguaaa

SEQ ID NO: 622452 - RNA, 18 nt, Escherichia coli CFT073
aaugauaaguuucacugg

SEQ ID NO: 622453 - RNA, 21 nt, Escherichia coli CFT073
aaugauaauucaacagauuuc

SEQ ID NO: 622454 - RNA, 15 nt, Escherichia coli CFT073
aaucuucaaauaaac

SEQ ID NO: 622455 - RNA, 19 nt, Escherichia coli CFT073
aaucuugccauuccacaaa

SEQ ID NO: 622456 - RNA, 14 nt, Escherichia coli CFT073
aaucuugcugacgu

SEQ ID NO: 622457 - RNA, 22 nt, Escherichia coli CFT073
aaucuucucgaaacgcuuuuaa

SEQ ID NO: 622458 - RNA, 22 nt, Escherichia coli CFT073
aaucugcgggaacauaugcaca

SEQ ID NO: 622459 - RNA, 19 nt, Escherichia coli CFT073
aaucugcccguuaaccaua

SEQ ID NO: 622460 - RNA, 19 nt, Escherichia coli CFT073
aaucugccguaacugcgcc

SEQ ID NO: 622461 - RNA, 16 nt, Escherichia coli CFT073
aaugacauaaugcaaa

SEQ ID NO: 622462 - RNA, 12 nt, Escherichia coli CFT073
aaugacaacauu

SEQ ID NO: 622463 - RNA, 15 nt, Escherichia coli CFT073
aaugacaauuacaaa

SEQ ID NO: 622464 - RNA, 15 nt, Escherichia coli CFT073
aaugaagucaccaaa

SEQ ID NO: 622465 - RNA, 18 nt, Escherichia coli CFT073
aaugaacgccaccccaca

SEQ ID NO: 622466 - RNA, 18 nt, Escherichia coli CFT073
aaugaagaaccgcaccag

SEQ ID NO: 622467 - RNA, 13 nt, Escherichia coli CFT073
aaucuuuacacca

SEQ ID NO: 622468 - RNA, 18 nt, Escherichia coli CFT073
aauaaagacacugcuguu

SEQ ID NO: 622469 - RNA, 11 nt, Escherichia coli CFT073
aauaaagauga

SEQ ID NO: 622470 - RNA, 16 nt, Escherichia coli CFT073
aauaaagccgcccauu

SEQ ID NO: 622471 - RNA, 11 nt, Escherichia coli CFT073
aauacacauca

SEQ ID NO: 622472 - RNA, 11 nt, Escherichia coli CFT073
aauacagcaau

SEQ ID NO: 622473 - RNA, 18 nt, Escherichia coli CFT073
aauacagcaauggaaaaa

SEQ ID NO: 622474 - RNA, 19 nt, Escherichia coli CFT073
aauacagcaauggaaaaag

SEQ ID NO: 622475 - RNA, 23 nt, Escherichia coli CFT073
aauacagcaauggaaaaaguuug

SEQ ID NO: 622476 - RNA, 20 nt, Escherichia coli CFT073
aauacagcuuaaucaccagc

SEQ ID NO: 622477 - RNA, 12 nt, Escherichia coli CFT073
aauacaggaaau

SEQ ID NO: 622478 - RNA, 22 nt, Escherichia coli CFT073
aauacaggaaauaagaagccau

SEQ ID NO: 622479 - RNA, 16 nt, Escherichia coli CFT073
aauacauaagcaccga

SEQ ID NO: 622480 - RNA, 23 nt, Escherichia coli CFT073
aauacaucaauuuucccuucuga

SEQ ID NO: 622481 - RNA, 17 nt, Escherichia coli CFT073
aauacauauagccaaaa

SEQ ID NO: 622482 - RNA, 17 nt, Escherichia coli CFT073
aauacuaaauaugaaaa

SEQ ID NO: 622483 - RNA, 20 nt, Escherichia coli CFT073
aauacguugcaaauauucca

SEQ ID NO: 622484 - RNA, 23 nt, Escherichia coli CFT073
aauacguugcaaauauuccauca

SEQ ID NO: 622485 - RNA, 22 nt, Escherichia coli CFT073
aauacucauuaauuucaggcug

SEQ ID NO: 622486 - RNA, 20 nt, Escherichia coli CFT073
aauacgauccugagcagcaa

SEQ ID NO: 622487 - RNA, 19 nt, Escherichia coli CFT073
aauacguugugauuucuga

SEQ ID NO: 622488 - RNA, 22 nt, Escherichia coli CFT073
aauacguugugauuucugacuu

SEQ ID NO: 622489 - RNA, 22 nt, Escherichia coli CFT073
aauaccagcaucaggaugauac

SEQ ID NO: 622490 - RNA, 19 nt, Escherichia coli CFT073
aauacccagcaaugccagg

SEQ ID NO: 622491 - RNA, 16 nt, Escherichia coli CFT073
aauaccccagcggcaa

SEQ ID NO: 622492 - RNA, 18 nt, Escherichia coli CFT073
aauaguacacagacgaag

SEQ ID NO: 622493 - RNA, 11 nt, Escherichia coli CFT073
aauaguacauu

SEQ ID NO: 622494 - RNA, 20 nt, Escherichia coli CFT073
aauaguauccaacugugaau

SEQ ID NO: 622495 - RNA, 14 nt, Escherichia coli CFT073
aauagucaguucac

SEQ ID NO: 622496 - RNA, 14 nt, Escherichia coli CFT073
aauagcugccagcc

SEQ ID NO: 622497 - RNA, 23 nt, Escherichia coli CFT073
aauagcugccagccccucagcgg

SEQ ID NO: 622498 - RNA, 19 nt, Escherichia coli CFT073
aauagcuuaacuacugcuu

SEQ ID NO: 622499 - RNA, 11 nt, Escherichia coli CFT073
aauagagaaau

SEQ ID NO: 622500 - RNA, 15 nt, Escherichia coli CFT073
aauagaccggagaaa

SEQ ID NO: 622501 - RNA, 21 nt, Escherichia coli CFT073
aauagacugcacugaauggca

SEQ ID NO: 622502 - RNA, 17 nt, Escherichia coli CFT073
aauagcgugcuuaccuu

SEQ ID NO: 622503 - RNA, 14 nt, Escherichia coli CFT073
aauagcucugcuaa

SEQ ID NO: 622504 - RNA, 14 nt, Escherichia coli CFT073
aauagcucaaugaa

SEQ ID NO: 622505 - RNA, 23 nt, Escherichia coli CFT073
aauauauuccccggucagcagca

SEQ ID NO: 622506 - RNA, 22 nt, Escherichia coli CFT073
aauauauuccccggucagcagc

SEQ ID NO: 622507 - RNA, 13 nt, Escherichia coli CFT073
aauauaagguucu

SEQ ID NO: 622508 - RNA, 21 nt, Escherichia coli CFT073
aauaucagcccaaaaauugcc

SEQ ID NO: 622509 - RNA, 22 nt, Escherichia coli CFT073
aauauccuguggacgcagcuca

SEQ ID NO: 622510 - RNA, 12 nt, Escherichia coli CFT073
aauauccuugca

SEQ ID NO: 622511 - RNA, 16 nt, Escherichia coli CFT073
aauauccuugcagaua

SEQ ID NO: 622512 - RNA, 14 nt, Escherichia coli CFT073
aauaucgacauuca

SEQ ID NO: 622513 - RNA, 13 nt, Escherichia coli CFT073
aauaucaccaaua

SEQ ID NO: 622514 - RNA, 21 nt, Escherichia coli CFT073
aauaucacucggggcuuuucu

SEQ ID NO: 622515 - RNA, 11 nt, Escherichia coli CFT073
aauaucuuccu

SEQ ID NO: 622516 - RNA, 16 nt, Escherichia coli CFT073
aauaucuuccuggcgu

SEQ ID NO: 622517 - RNA, 16 nt, Escherichia coli CFT073
aauaucggccugggcc

SEQ ID NO: 622518 - RNA, 21 nt, Escherichia coli CFT073
aauaucguauccgguuuucca

SEQ ID NO: 622519 - RNA, 22 nt, Escherichia coli CFT073
aauaucguuguuggcuuccugc

SEQ ID NO: 622520 - RNA, 13 nt, Escherichia coli CFT073
aauauuuucaggg

SEQ ID NO: 622521 - RNA, 17 nt, Escherichia coli CFT073
aauauuuaucuucccag

SEQ ID NO: 622522 - RNA, 16 nt, Escherichia coli CFT073
aaucaacgaugucaau

SEQ ID NO: 622523 - RNA, 19 nt, Escherichia coli CFT073
aaucaacaccaaacccgga

SEQ ID NO: 622524 - RNA, 17 nt, Escherichia coli CFT073
aaucaacacuucuuuga

SEQ ID NO: 622525 - RNA, 14 nt, Escherichia coli CFT073
aaucaacagauaaa

SEQ ID NO: 622526 - RNA, 15 nt, Escherichia coli CFT073
aaucaacagauaaau

SEQ ID NO: 622527 - RNA, 22 nt, Escherichia coli CFT073
aaucaacagauaaauggcacag

SEQ ID NO: 622528 - RNA, 13 nt, Escherichia coli CFT073
aaucaaacuuccg

SEQ ID NO: 622529 - RNA, 15 nt, Escherichia coli CFT073
aaucaaauaaauaau

SEQ ID NO: 622530 - RNA, 12 nt, Escherichia coli CFT073
aaucaaauacau

SEQ ID NO: 622531 - RNA, 12 nt, Escherichia coli CFT073
aaucaaaugacu

SEQ ID NO: 622532 - RNA, 13 nt, Escherichia coli CFT073
aaucaacaaaagu

SEQ ID NO: 622533 - RNA, 14 nt, Escherichia coli CFT073
aaucaacaaaccaa

SEQ ID NO: 622534 - RNA, 18 nt, Escherichia coli CFT073
aaucaaaagaacacaacg

SEQ ID NO: 622535 - RNA, 14 nt, Escherichia coli CFT073
aauauuacuucaga

SEQ ID NO: 622536 - RNA, 13 nt, Escherichia coli CFT073
aauauuaaugcug

SEQ ID NO: 622537 - RNA, 21 nt, Escherichia coli CFT073
aauaugacccacgccuuuuuc

SEQ ID NO: 622538 - RNA, 23 nt, Escherichia coli CFT073
aauaugacccacgccuuuuucuc

SEQ ID NO: 622539 - RNA, 21 nt, Escherichia coli CFT073
aauaugcaauucacacaguga

SEQ ID NO: 622540 - RNA, 14 nt, Escherichia coli CFT073
aauaugcauaaacc

SEQ ID NO: 622541 - RNA, 17 nt, Escherichia coli CFT073
aauauugucucccgacu

SEQ ID NO: 622542 - RNA, 19 nt, Escherichia coli CFT073
aauauugguguugugaagu

SEQ ID NO: 622543 - RNA, 19 nt, Escherichia coli CFT073
aauauugcugcuaaaucgg

SEQ ID NO: 622544 - RNA, 23 nt, Escherichia coli CFT073
aauauuggagagcgauaauuuau

SEQ ID NO: 622545 - RNA, 14 nt, Escherichia coli CFT073
aauauugaugcaca

SEQ ID NO: 622546 - RNA, 17 nt, Escherichia coli CFT073
aauauugaugcacacca

SEQ ID NO: 622547 - RNA, 18 nt, Escherichia coli CFT073
aauauugaugcacaccau

SEQ ID NO: 622548 - RNA, 18 nt, Escherichia coli CFT073
aauauugagcaggaugac

SEQ ID NO: 622549 - RNA, 19 nt, Escherichia coli CFT073
aauauugagcaggaugaca

SEQ ID NO: 622550 - RNA, 11 nt, Escherichia coli CFT073
aaucacacuga

SEQ ID NO: 622551 - RNA, 17 nt, Escherichia coli CFT073
aaucacagggcauugcu

SEQ ID NO: 622552 - RNA, 12 nt, Escherichia coli CFT073
aaucacauccac

SEQ ID NO: 622553 - RNA, 14 nt, Escherichia coli CFT073
aaucacaucaccau

SEQ ID NO: 622554 - RNA, 16 nt, Escherichia coli CFT073
aaucacaucaccauaa

SEQ ID NO: 622555 - RNA, 14 nt, Escherichia coli CFT073
aaucaccaaaccaa

SEQ ID NO: 622556 - RNA, 19 nt, Escherichia coli CFT073
aaucaccaaaccaacaagc

SEQ ID NO: 622557 - RNA, 20 nt, Escherichia coli CFT073
aaucaccaaaccaacaagca

SEQ ID NO: 622558 - RNA, 15 nt, Escherichia coli CFT073
aaucaccagcaacac

SEQ ID NO: 622559 - RNA, 22 nt, Escherichia coli CFT073
aaucaccauauucagcagcaga

SEQ ID NO: 622560 - RNA, 21 nt, Escherichia coli CFT073
aaucaccaucagcagcaacaa

SEQ ID NO: 622561 - RNA, 15 nt, Escherichia coli CFT073
aaucaccgccaacaa

SEQ ID NO: 622562 - RNA, 17 nt, Escherichia coli CFT073
aaucaccaucagcagca

SEQ ID NO: 622563 - RNA, 12 nt, Escherichia coli CFT073
aaucaauucucg

SEQ ID NO: 622564 - RNA, 15 nt, Escherichia coli CFT073
aaucaauugcaggaa

SEQ ID NO: 622565 - RNA, 18 nt, Escherichia coli CFT073
aaucaauugcaggaaggu

SEQ ID NO: 622566 - RNA, 17 nt, Escherichia coli CFT073
aaucaaugccaccagaa

SEQ ID NO: 622567 - RNA, 21 nt, Escherichia coli CFT073
aaucaauggcccauucagcau

SEQ ID NO: 622568 - RNA, 21 nt, Escherichia coli CFT073
aaucaauccggcaaucaacau

SEQ ID NO: 622569 - RNA, 19 nt, Escherichia coli CFT073
aaucaauaauuaaucuggu

SEQ ID NO: 622570 - RNA, 20 nt, Escherichia coli CFT073
aaucaauauaaacagccccu

SEQ ID NO: 622571 - RNA, 13 nt, Escherichia coli CFT073
aaucaauaugcau

SEQ ID NO: 622572 - RNA, 16 nt, Escherichia coli CFT073
aaucaagguugcacaa

SEQ ID NO: 622573 - RNA, 19 nt, Escherichia coli CFT073
aaucaagguugcacaacca

SEQ ID NO: 622574 - RNA, 21 nt, Escherichia coli CFT073
aaucaacgcgaaaaugcccca

SEQ ID NO: 622575 - RNA, 20 nt, Escherichia coli CFT073
aaucaacgcuacguuauuua

SEQ ID NO: 622576 - RNA, 19 nt, Escherichia coli CFT073
aaucaacgccaccaucacu

SEQ ID NO: 622577 - RNA, 15 nt, Escherichia coli CFT073
aaucaccuuacauca

SEQ ID NO: 622578 - RNA, 20 nt, Escherichia coli CFT073
aaucaccuuacaucaaaaaa

SEQ ID NO: 622579 - RNA, 22 nt, Escherichia coli CFT073
aaucaccucaucaccacagaca

SEQ ID NO: 622580 - RNA, 19 nt, Escherichia coli CFT073
aaucaccugaccgagccag

SEQ ID NO: 622581 - RNA, 13 nt, Escherichia coli CFT073
aaucacucaucau

SEQ ID NO: 622582 - RNA, 18 nt, Escherichia coli CFT073
aaucacgucauauucgcc

SEQ ID NO: 622583 - RNA, 23 nt, Escherichia coli CFT073
aaucacgcacucgacgcagcaga

SEQ ID NO: 622584 - RNA, 23 nt, Escherichia coli CFT073
aaucagaccgauagcagcccaga

SEQ ID NO: 622585 - RNA, 18 nt, Escherichia coli CFT073
aaucagacuuugaauaaa

SEQ ID NO: 622586 - RNA, 12 nt, Escherichia coli CFT073
aaucagauaaaa

SEQ ID NO: 622587 - RNA, 19 nt, Escherichia coli CFT073
aaucagauacaccgcgaag

SEQ ID NO: 622588 - RNA, 15 nt, Escherichia coli CFT073
aaucagauugaucau

SEQ ID NO: 622589 - RNA, 14 nt, Escherichia coli CFT073
aaucacuuucugcg

SEQ ID NO: 622590 - RNA, 16 nt, Escherichia coli CFT073
aaucagaaacaaauac

SEQ ID NO: 622591 - RNA, 19 nt, Escherichia coli CFT073
aaucacuugcgcauaauaa

SEQ ID NO: 622592 - RNA, 15 nt, Escherichia coli CFT073
aaucacugccagaau

SEQ ID NO: 622593 - RNA, 15 nt, Escherichia coli CFT073
aaucagcacagagau

SEQ ID NO: 622594 - RNA, 19 nt, Escherichia coli CFT073
aaucagcacagagauaaaa

SEQ ID NO: 622595 - RNA, 20 nt, Escherichia coli CFT073
aaucagcaucucauccauca

SEQ ID NO: 622596 - RNA, 18 nt, Escherichia coli CFT073
aaucagccaguaaaccaa

SEQ ID NO: 622597 - RNA, 21 nt, Escherichia coli CFT073
aaucagcgucgcguuuuucuc

SEQ ID NO: 622598 - RNA, 19 nt, Escherichia coli CFT073
aaucagcggaaaugcagag

SEQ ID NO: 622599 - RNA, 22 nt, Escherichia coli CFT073
aaucagcggcguagggcaggcg

SEQ ID NO: 622600 - RNA, 18 nt, Escherichia coli CFT073
aaucagcggugccgcgau

SEQ ID NO: 622601 - RNA, 22 nt, Escherichia coli CFT073
aaucagcguaacgauggcaauu

SEQ ID NO: 622602 - RNA, 15 nt, Escherichia coli CFT073
aaucagcgccagcgc

SEQ ID NO: 622603 - RNA, 22 nt, Escherichia coli CFT073
aaucagcgccguagccauuacc

SEQ ID NO: 622604 - RNA, 15 nt, Escherichia coli CFT073
aaucaucaaugccag

SEQ ID NO: 622605 - RNA, 20 nt, Escherichia coli CFT073
aaucaucacgcgguuacgca

SEQ ID NO: 622606 - RNA, 14 nt, Escherichia coli CFT073
aaucauaaaacacc

SEQ ID NO: 622607 - RNA, 15 nt, Escherichia coli CFT073
aaucaucaagcacuu

SEQ ID NO: 622608 - RNA, 18 nt, Escherichia coli CFT073
aaucaguucguugaucaa

SEQ ID NO: 622609 - RNA, 22 nt, Escherichia coli CFT073
aaucaguuugcgggacaacuug

SEQ ID NO: 622610 - RNA, 19 nt, Escherichia coli CFT073
accgauaccuaacgccagc

SEQ ID NO: 622611 - RNA, 21 nt, Escherichia coli CFT073
accgauaccuaacgccagcgc

SEQ ID NO: 622612 - RNA, 14 nt, Escherichia coli CFT073
accgauacacgaaa

SEQ ID NO: 622613 - RNA, 20 nt, Escherichia coli CFT073
accgauagcagcccagauca

SEQ ID NO: 622614 - RNA, 15 nt, Escherichia coli CFT073
accgaucaccacaau

SEQ ID NO: 622615 - RNA, 16 nt, Escherichia coli CFT073
accgcagauaagacca

SEQ ID NO: 622616 - RNA, 17 nt, Escherichia coli CFT073
accgcaaucgcggcagc

SEQ ID NO: 622617 - RNA, 18 nt, Escherichia coli CFT073
accgcaaaaccaacgccu

SEQ ID NO: 622618 - RNA, 20 nt, Escherichia coli CFT073
accgcaaccgccaacagcag

SEQ ID NO: 622619 - RNA, 14 nt, Escherichia coli CFT073
accgcaacgacuac

SEQ ID NO: 622620 - RNA, 19 nt, Escherichia coli CFT073
accgcaagaauucaauaua

SEQ ID NO: 622621 - RNA, 16 nt, Escherichia coli CFT073
accgcagugaaauuuc

SEQ ID NO: 622622 - RNA, 20 nt, Escherichia coli CFT073
accgcaucacgacagcacca

SEQ ID NO: 622623 - RNA, 15 nt, Escherichia coli CFT073
accgcauccggcauc

SEQ ID NO: 622624 - RNA, 20 nt, Escherichia coli CFT073
accgccagcacagccagccu

SEQ ID NO: 622625 - RNA, 23 nt, Escherichia coli CFT073
accgccagcacagccagccucca

SEQ ID NO: 622626 - RNA, 16 nt, Escherichia coli CFT073
accgccgccacuucug

SEQ ID NO: 622627 - RNA, 16 nt, Escherichia coli CFT073
accgccgccaaacugu

SEQ ID NO: 622628 - RNA, 22 nt, Escherichia coli CFT073
accgcccugcuguacaguaauc

SEQ ID NO: 622629 - RNA, 15 nt, Escherichia coli CFT073
accgccgagcacaaa

SEQ ID NO: 622630 - RNA, 21 nt, Escherichia coli CFT073
accgcuuggcgauaccccaac

SEQ ID NO: 622631 - RNA, 17 nt, Escherichia coli CFT073
accgcuuuugccagcag

SEQ ID NO: 622632 - RNA, 16 nt, Escherichia coli CFT073
accggaacaacccagc

SEQ ID NO: 622633 - RNA, 16 nt, Escherichia coli CFT073
accggaaccagcgccu

SEQ ID NO: 622634 - RNA, 18 nt, Escherichia coli CFT073
accggaauggucaguuuc

SEQ ID NO: 622635 - RNA, 13 nt, Escherichia coli CFT073
accggacaauaaa

SEQ ID NO: 622636 - RNA, 15 nt, Escherichia coli CFT073
accggacggcucacu

SEQ ID NO: 622637 - RNA, 14 nt, Escherichia coli CFT073
accgcuaccgcccu

SEQ ID NO: 622638 - RNA, 22 nt, Escherichia coli CFT073
accgcgguucccagcgucggaa

SEQ ID NO: 622639 - RNA, 15 nt, Escherichia coli CFT073
accgcgagauaucca

SEQ ID NO: 622640 - RNA, 17 nt, Escherichia coli CFT073
accgcgagauauccaca

SEQ ID NO: 622641 - RNA, 14 nt, Escherichia coli CFT073
accgcgagcaaaau

SEQ ID NO: 622642 - RNA, 14 nt, Escherichia coli CFT073
accgcgccaagccu

SEQ ID NO: 622643 - RNA, 18 nt, Escherichia coli CFT073
accgcgggcaaucgccag

SEQ ID NO: 622644 - RNA, 22 nt, Escherichia coli CFT073
acccguuuacauaaauggguuu

SEQ ID NO: 622645 - RNA, 14 nt, Escherichia coli CFT073
acccguugcuucac

SEQ ID NO: 622646 - RNA, 18 nt, Escherichia coli CFT073
acccguugguuugauagc

SEQ ID NO: 622647 - RNA, 23 nt, Escherichia coli CFT073
acccguugguuugauagcaaugc

SEQ ID NO: 622648 - RNA, 23 nt, Escherichia coli CFT073
acccguucgaugcgauaaccagg

SEQ ID NO: 622649 - RNA, 22 nt, Escherichia coli CFT073
acccguugaucuucucuuauau

SEQ ID NO: 622650 - RNA, 18 nt, Escherichia coli CFT073
acccucaaaauuucucuu

SEQ ID NO: 622651 - RNA, 19 nt, Escherichia coli CFT073
acccucacgcauucucuuu

SEQ ID NO: 622652 - RNA, 13 nt, Escherichia coli CFT073
acccucacgcauu

SEQ ID NO: 622653 - RNA, 23 nt, Escherichia coli CFT073
acccuucauauuccugacccagc

SEQ ID NO: 622654 - RNA, 13 nt, Escherichia coli CFT073
acccuuacucacu

SEQ ID NO: 622655 - RNA, 21 nt, Escherichia coli CFT073
acccuuacucacuaaauuagg

SEQ ID NO: 622656 - RNA, 22 nt, Escherichia coli CFT073
acccugacuguuuuuccagcuu

SEQ ID NO: 622657 - RNA, 15 nt, Escherichia coli CFT073
acccugcaucagaac

SEQ ID NO: 622658 - RNA, 13 nt, Escherichia coli CFT073
acccugccacagu

SEQ ID NO: 622659 - RNA, 14 nt, Escherichia coli CFT073
acccugccagaauc

SEQ ID NO: 622660 - RNA, 17 nt, Escherichia coli CFT073
accgacccggcaucuau

SEQ ID NO: 622661 - RNA, 17 nt, Escherichia coli CFT073
accgacgaucaacagaa

SEQ ID NO: 622662 - RNA, 18 nt, Escherichia coli CFT073
accgacgaucaacagaau

SEQ ID NO: 622663 - RNA, 16 nt, Escherichia coli CFT073
accgacacuacaaauu

SEQ ID NO: 622664 - RNA, 15 nt, Escherichia coli CFT073
accgaccaucggcac

SEQ ID NO: 622665 - RNA, 16 nt, Escherichia coli CFT073
accgaccagacaauca

SEQ ID NO: 622666 - RNA, 13 nt, Escherichia coli CFT073
accgagcacaccu

SEQ ID NO: 622667 - RNA, 21 nt, Escherichia coli CFT073
accgagaugguaaagcaccug

SEQ ID NO: 622668 - RNA, 16 nt, Escherichia coli CFT073
accgagauaaaugcca

SEQ ID NO: 622669 - RNA, 22 nt, Escherichia coli CFT073
accgagauaaaugccaaagaau

SEQ ID NO: 622670 - RNA, 15 nt, Escherichia coli CFT073
accgagaaaaucauc

SEQ ID NO: 622671 - RNA, 15 nt, Escherichia coli CFT073
accgacgggccugca

SEQ ID NO: 622672 - RNA, 19 nt, Escherichia coli CFT073
accgagcagccacugcggc

SEQ ID NO: 622673 - RNA, 15 nt, Escherichia coli CFT073
acccuuucugcugcu

SEQ ID NO: 622674 - RNA, 16 nt, Escherichia coli CFT073
acccuuucugcugcuu

SEQ ID NO: 622675 - RNA, 15 nt, Escherichia coli CFT073
acccuuucacuuuac

SEQ ID NO: 622676 - RNA, 21 nt, Escherichia coli CFT073
accgaaacuugcgugauauua

SEQ ID NO: 622677 - RNA, 14 nt, Escherichia coli CFT073
accgaacaagaaac

SEQ ID NO: 622678 - RNA, 17 nt, Escherichia coli CFT073
accgaacaagaaacaga

SEQ ID NO: 622679 - RNA, 14 nt, Escherichia coli CFT073
accgaacagcauac

SEQ ID NO: 622680 - RNA, 18 nt, Escherichia coli CFT073
accgaaauaaacaagcag

SEQ ID NO: 622681 - RNA, 15 nt, Escherichia coli CFT073
accgaaaaucacgcu

SEQ ID NO: 622682 - RNA, 21 nt, Escherichia coli CFT073
accgaauccuuauauaaaaca

SEQ ID NO: 622683 - RNA, 17 nt, Escherichia coli CFT073
accgacaauauugaugc

SEQ ID NO: 622684 - RNA, 15 nt, Escherichia coli CFT073
accgaagaguaacca

SEQ ID NO: 622685 - RNA, 15 nt, Escherichia coli CFT073
accgaagaagcuuuu

SEQ ID NO: 622686 - RNA, 15 nt, Escherichia coli CFT073
accgaagucaguaau

SEQ ID NO: 622687 - RNA, 13 nt, Escherichia coli CFT073
accgaaccagggc

SEQ ID NO: 622688 - RNA, 16 nt, Escherichia coli CFT073
accgaaccuguuuuca

SEQ ID NO: 622689 - RNA, 15 nt, Escherichia coli CFT073
accgaacggagucgg

SEQ ID NO: 622690 - RNA, 18 nt, Escherichia coli CFT073
accgaacggagucggguc

SEQ ID NO: 622691 - RNA, 19 nt, Escherichia coli CFT073
acccaugaagaaaauucca

SEQ ID NO: 622692 - RNA, 16 nt, Escherichia coli CFT073
acccauuuaaaaauca

SEQ ID NO: 622693 - RNA, 21 nt, Escherichia coli CFT073
acccauuuauccagcggcagc

SEQ ID NO: 622694 - RNA, 15 nt, Escherichia coli CFT073
acccauccagcagag

SEQ ID NO: 622695 - RNA, 16 nt, Escherichia coli CFT073
acccauccagcagaga

SEQ ID NO: 622696 - RNA, 15 nt, Escherichia coli CFT073
accccguauccaccg

SEQ ID NO: 622697 - RNA, 19 nt, Escherichia coli CFT073
accccguaauaaccaccac

SEQ ID NO: 622698 - RNA, 19 nt, Escherichia coli CFT073
acccgacagauaaaucauc

SEQ ID NO: 622699 - RNA, 14 nt, Escherichia coli CFT073
acccgaauaccuuu

SEQ ID NO: 622700 - RNA, 13 nt, Escherichia coli CFT073
acccgagcgccag

SEQ ID NO: 622701 - RNA, 15 nt, Escherichia coli CFT073
acccgaugaucaaaa

SEQ ID NO: 622702 - RNA, 17 nt, Escherichia coli CFT073
acccgauggcgugcccg

SEQ ID NO: 622703 - RNA, 17 nt, Escherichia coli CFT073
acccgcaguccugcagg

SEQ ID NO: 622704 - RNA, 13 nt, Escherichia coli CFT073
acccgccagaauc

SEQ ID NO: 622705 - RNA, 23 nt, Escherichia coli CFT073
acccgccagaauccccggcagga

SEQ ID NO: 622706 - RNA, 15 nt, Escherichia coli CFT073
acccgcacggucacu

SEQ ID NO: 622707 - RNA, 14 nt, Escherichia coli CFT073
acccgcagccagca

SEQ ID NO: 622708 - RNA, 20 nt, Escherichia coli CFT073
acccgcacaaauagccagca

SEQ ID NO: 622709 - RNA, 20 nt, Escherichia coli CFT073
acccgcaaagagcagcaacc

SEQ ID NO: 622710 - RNA, 15 nt, Escherichia coli CFT073
acccgcggcugcagc

SEQ ID NO: 622711 - RNA, 14 nt, Escherichia coli CFT073
acccgccguggaga

SEQ ID NO: 622712 - RNA, 13 nt, Escherichia coli CFT073
acccgccugauag

SEQ ID NO: 622713 - RNA, 20 nt, Escherichia coli CFT073
acccggauuuuucagcgcca

SEQ ID NO: 622714 - RNA, 14 nt, Escherichia coli CFT073
acccgcugguaaac

SEQ ID NO: 622715 - RNA, 14 nt, Escherichia coli CFT073
acccggccacagcg

SEQ ID NO: 622716 - RNA, 22 nt, Escherichia coli CFT073
acccggcgcuaauucaacgccu

SEQ ID NO: 622717 - RNA, 14 nt, Escherichia coli CFT073
acccggcguuuuca

SEQ ID NO: 622718 - RNA, 15 nt, Escherichia coli CFT073
acccggcguuuucag

SEQ ID NO: 622719 - RNA, 16 nt, Escherichia coli CFT073
acccggcuaacagucu

SEQ ID NO: 622720 - RNA, 20 nt, Escherichia coli CFT073
acccgguacaucaauaccau

SEQ ID NO: 622721 - RNA, 19 nt, Escherichia coli CFT073
acccgguccgcgaaucucu

SEQ ID NO: 622722 - RNA, 13 nt, Escherichia coli CFT073
acccgggucauca

SEQ ID NO: 622723 - RNA, 16 nt, Escherichia coli CFT073
acccgguaaacaaaaa

SEQ ID NO: 622724 - RNA, 14 nt, Escherichia coli CFT073
accauuucugcgag

SEQ ID NO: 622725 - RNA, 13 nt, Escherichia coli CFT073
acccaccgcagcc

SEQ ID NO: 622726 - RNA, 16 nt, Escherichia coli CFT073
acccaaaaaauagcaa

SEQ ID NO: 622727 - RNA, 17 nt, Escherichia coli CFT073
acccaaaaaauagcaaa

SEQ ID NO: 622728 - RNA, 21 nt, Escherichia coli CFT073
acccacuaacugaucacguuu

SEQ ID NO: 622729 - RNA, 15 nt, Escherichia coli CFT073
acccaggccaucaga

SEQ ID NO: 622730 - RNA, 20 nt, Escherichia coli CFT073
acccaguuuaccgaaaauca

SEQ ID NO: 622731 - RNA, 22 nt, Escherichia coli CFT073
acccaguaacgggccgcccaua

SEQ ID NO: 622732 - RNA, 17 nt, Escherichia coli CFT073
acccagugaauccagca

SEQ ID NO: 622733 - RNA, 18 nt, Escherichia coli CFT073
acccaucaacaacuggcg

SEQ ID NO: 622734 - RNA, 23 nt, Escherichia coli CFT073
accaggcaauuggcacaucuagc

SEQ ID NO: 622735 - RNA, 16 nt, Escherichia coli CFT073
accaggcaagaauccg

SEQ ID NO: 622736 - RNA, 15 nt, Escherichia coli CFT073
accaggcauauucac

SEQ ID NO: 622737 - RNA, 15 nt, Escherichia coli CFT073
accauauucagcagc

SEQ ID NO: 622738 - RNA, 11 nt, Escherichia coli CFT073
accagcugccg

SEQ ID NO: 622739 - RNA, 19 nt, Escherichia coli CFT073
accagcuguuuugguaaac

SEQ ID NO: 622740 - RNA, 19 nt, Escherichia coli CFT073
accagcuuguuguccgguc

SEQ ID NO: 622741 - RNA, 14 nt, Escherichia coli CFT073
accaggaaacccaa

SEQ ID NO: 622742 - RNA, 11 nt, Escherichia coli CFT073
accaucaaucc

SEQ ID NO: 622743 - RNA, 16 nt, Escherichia coli CFT073
accauccccuuuucac

SEQ ID NO: 622744 - RNA, 22 nt, Escherichia coli CFT073
accaucaaguagcagguaaucu

SEQ ID NO: 622745 - RNA, 18 nt, Escherichia coli CFT073
accaucaacaaacgccag

SEQ ID NO: 622746 - RNA, 14 nt, Escherichia coli CFT073
accaucaaccuuca

SEQ ID NO: 622747 - RNA, 16 nt, Escherichia coli CFT073
accauauucagcagca

SEQ ID NO: 622748 - RNA, 20 nt, Escherichia coli CFT073
accauauugauccauaaggg

SEQ ID NO: 622749 - RNA, 16 nt, Escherichia coli CFT073
accaucaaacagcccc

SEQ ID NO: 622750 - RNA, 17 nt, Escherichia coli CFT073
accaugagccaguucuu

SEQ ID NO: 622751 - RNA, 15 nt, Escherichia coli CFT073
accaugauuccccag

SEQ ID NO: 622752 - RNA, 19 nt, Escherichia coli CFT073
accaugauuccccagccac

SEQ ID NO: 622753 - RNA, 23 nt, Escherichia coli CFT073
accaugauuucguauacugcagc

SEQ ID NO: 622754 - RNA, 14 nt, Escherichia coli CFT073
accaugcaaucacu

SEQ ID NO: 622755 - RNA, 21 nt, Escherichia coli CFT073
accaugacgcaccuuguucau

SEQ ID NO: 622756 - RNA, 15 nt, Escherichia coli CFT073
accaucuuuuuuuug

SEQ ID NO: 622757 - RNA, 14 nt, Escherichia coli CFT073
accaugaauuucac

SEQ ID NO: 622758 - RNA, 21 nt, Escherichia coli CFT073
accaucgcuacauaacgcagc

SEQ ID NO: 622759 - RNA, 19 nt, Escherichia coli CFT073
accaucuauccgaugcaaa

SEQ ID NO: 622760 - RNA, 17 nt, Escherichia coli CFT073
accaucuuccagcugca

SEQ ID NO: 622761 - RNA, 20 nt, Escherichia coli CFT073
accaucuuccagcugcacgc

SEQ ID NO: 622762 - RNA, 17 nt, Escherichia coli CFT073
accacgcucagcaaucg

SEQ ID NO: 622763 - RNA, 21 nt, Escherichia coli CFT073
accacgccgauggcagaaauc

SEQ ID NO: 622764 - RNA, 24 nt, Escherichia coli CFT073
accacgccuuguucuuguuuggca

SEQ ID NO: 622765 - RNA, 17 nt, Escherichia coli CFT073
accacgccagccgccag

SEQ ID NO: 622766 - RNA, 18 nt, Escherichia coli CFT073
accacgccagccgccagc

SEQ ID NO: 622767 - RNA, 16 nt, Escherichia coli CFT073
accacgccgauaauca

SEQ ID NO: 622768 - RNA, 22 nt, Escherichia coli CFT073
accacgucgccgggauaaugcg

SEQ ID NO: 622769 - RNA, 18 nt, Escherichia coli CFT073
accacuucccaacgcugc

SEQ ID NO: 622770 - RNA, 13 nt, Escherichia coli CFT073
accacuucaugcc

SEQ ID NO: 622771 - RNA, 14 nt, Escherichia coli CFT073
accacuguuuuuca

SEQ ID NO: 622772 - RNA, 13 nt, Escherichia coli CFT073
accaccuuacaua

SEQ ID NO: 622773 - RNA, 21 nt, Escherichia coli CFT073
accaccugaagaaaauccuca

SEQ ID NO: 622774 - RNA, 19 nt, Escherichia coli CFT073
accaccugauugcugcugc

SEQ ID NO: 622775 - RNA, 16 nt, Escherichia coli CFT073
accaccucacccgccg

SEQ ID NO: 622776 - RNA, 14 nt, Escherichia coli CFT073
accacccaccagcg

SEQ ID NO: 622777 - RNA, 12 nt, Escherichia coli CFT073
accaccagcagc

SEQ ID NO: 622778 - RNA, 21 nt, Escherichia coli CFT073
accaccagcgacagccagccc

SEQ ID NO: 622779 - RNA, 12 nt, Escherichia coli CFT073
accaccagcacg

SEQ ID NO: 622780 - RNA, 13 nt, Escherichia coli CFT073
accaccagcacug

SEQ ID NO: 622781 - RNA, 21 nt, Escherichia coli CFT073
accacagugacccgcagccag

SEQ ID NO: 622782 - RNA, 17 nt, Escherichia coli CFT073
accacauacauaauaau

SEQ ID NO: 622783 - RNA, 22 nt, Escherichia coli CFT073
accacagugaggguuucuucaa

SEQ ID NO: 622784 - RNA, 21 nt, Escherichia coli CFT073
accagcugaaaucaccgccac

SEQ ID NO: 622785 - RNA, 14 nt, Escherichia coli CFT073
accagcuccagcag

SEQ ID NO: 622786 - RNA, 15 nt, Escherichia coli CFT073
accagcuccagcagu

SEQ ID NO: 622787 - RNA, 21 nt, Escherichia coli CFT073
accagcgucaucaauccugca

SEQ ID NO: 622788 - RNA, 19 nt, Escherichia coli CFT073
accagccguaaacgugcgc

SEQ ID NO: 622789 - RNA, 16 nt, Escherichia coli CFT073
accagcggcuuccagc

SEQ ID NO: 622790 - RNA, 20 nt, Escherichia coli CFT073
accagcggguuaucuuccag

SEQ ID NO: 622791 - RNA, 17 nt, Escherichia coli CFT073
accagcggcaacaucau

SEQ ID NO: 622792 - RNA, 13 nt, Escherichia coli CFT073
accagcggcugaa

SEQ ID NO: 622793 - RNA, 23 nt, Escherichia coli CFT073
accagccccuggaaaaaaugccc

SEQ ID NO: 622794 - RNA, 21 nt, Escherichia coli CFT073
accagccgccaacuccaccaa

SEQ ID NO: 622795 - RNA, 18 nt, Escherichia coli CFT073
accacuuuacgcaaaaua

SEQ ID NO: 622796 - RNA, 20 nt, Escherichia coli CFT073
accagauucggcgcaaugau

SEQ ID NO: 622797 - RNA, 23 nt, Escherichia coli CFT073
accagcaacgcuucguagaagcc

SEQ ID NO: 622798 - RNA, 16 nt, Escherichia coli CFT073
accagcaauaaaaaac

SEQ ID NO: 622799 - RNA, 12 nt, Escherichia coli CFT073
accagcaaugcc

SEQ ID NO: 622800 - RNA, 13 nt, Escherichia coli CFT073
accagcaaugcca

SEQ ID NO: 622801 - RNA, 15 nt, Escherichia coli CFT073
accagcacaucauca

SEQ ID NO: 622802 - RNA, 15 nt, Escherichia coli CFT073
accagcaccagcaac

SEQ ID NO: 622803 - RNA, 20 nt, Escherichia coli CFT073
accagcaccagcaacaacaa

SEQ ID NO: 622804 - RNA, 18 nt, Escherichia coli CFT073
accagcaccgccagcagc

SEQ ID NO: 622805 - RNA, 19 nt, Escherichia coli CFT073
accagcaggaaucccauca

SEQ ID NO: 622806 - RNA, 17 nt, Escherichia coli CFT073
accagccaggccgccag

SEQ ID NO: 622807 - RNA, 19 nt, Escherichia coli CFT073
accagccaguagaacaauu

SEQ ID NO: 622808 - RNA, 21 nt, Escherichia coli CFT073
accagccaguagaacaauuaa

SEQ ID NO: 622809 - RNA, 13 nt, Escherichia coli CFT073
accagcagcauca

SEQ ID NO: 622810 - RNA, 14 nt, Escherichia coli CFT073
accagcagcaucac

SEQ ID NO: 622811 - RNA, 16 nt, Escherichia coli CFT073
accagcagcaucacca

SEQ ID NO: 622812 - RNA, 18 nt, Escherichia coli CFT073
accaauaaguaagcauua

SEQ ID NO: 622813 - RNA, 16 nt, Escherichia coli CFT073
accaauaaacgccagg

SEQ ID NO: 622814 - RNA, 13 nt, Escherichia coli CFT073
accaauaaucaau

SEQ ID NO: 622815 - RNA, 22 nt, Escherichia coli CFT073
accaauaccgcccacuaccagc

SEQ ID NO: 622816 - RNA, 17 nt, Escherichia coli CFT073
accaaucuucaacacuu

SEQ ID NO: 622817 - RNA, 18 nt, Escherichia coli CFT073
accaaucuucaacacuuc

SEQ ID NO: 622818 - RNA, 14 nt, Escherichia coli CFT073
accaaugacagccc

SEQ ID NO: 622819 - RNA, 21 nt, Escherichia coli CFT073
accaaugacagccccaccagc

SEQ ID NO: 622820 - RNA, 15 nt, Escherichia coli CFT073
accaauaccagcauc

SEQ ID NO: 622821 - RNA, 16 nt, Escherichia coli CFT073
accaagccaagccaga

SEQ ID NO: 622822 - RNA, 20 nt, Escherichia coli CFT073
accaagccaagccagagcag

SEQ ID NO: 622823 - RNA, 20 nt, Escherichia coli CFT073
accaagcccgaugaucauca

SEQ ID NO: 622824 - RNA, 22 nt, Escherichia coli CFT073
accaagcccgaugaucaucauc

SEQ ID NO: 622825 - RNA, 19 nt, Escherichia coli CFT073
accaagaccaauccgccag

SEQ ID NO: 622826 - RNA, 14 nt, Escherichia coli CFT073
accaagacuauuaa

SEQ ID NO: 622827 - RNA, 22 nt, Escherichia coli CFT073
accaagacuauuaauauauauu

SEQ ID NO: 622828 - RNA, 19 nt, Escherichia coli CFT073
accaacaauauuggguugu

SEQ ID NO: 622829 - RNA, 13 nt, Escherichia coli CFT073
accaaugccaccc

SEQ ID NO: 622830 - RNA, 19 nt, Escherichia coli CFT073
accaauggucgugguaaug

SEQ ID NO: 622831 - RNA, 16 nt, Escherichia coli CFT073
accaauguggaaagcc

SEQ ID NO: 622832 - RNA, 20 nt, Escherichia coli CFT073
accaauguucaguuugccca

SEQ ID NO: 622833 - RNA, 18 nt, Escherichia coli CFT073
accacaaagcagacaacc

SEQ ID NO: 622834 - RNA, 15 nt, Escherichia coli CFT073
accacaaaggcgcga

SEQ ID NO: 622835 - RNA, 19 nt, Escherichia coli CFT073
accacaacauucccaucag

SEQ ID NO: 622836 - RNA, 21 nt, Escherichia coli CFT073
accacaacccagacaaauaac

SEQ ID NO: 622837 - RNA, 18 nt, Escherichia coli CFT073
accacaaccucagcaguu

SEQ ID NO: 622838 - RNA, 14 nt, Escherichia coli CFT073
accacacuucuuca

SEQ ID NO: 622839 - RNA, 15 nt, Escherichia coli CFT073
accacaccagaccag

SEQ ID NO: 622840 - RNA, 16 nt, Escherichia coli CFT073
accacacccgcaagac

SEQ ID NO: 622841 - RNA, 20 nt, Escherichia coli CFT073
accacacccgcaagacgaac

SEQ ID NO: 622842 - RNA, 21 nt, Escherichia coli CFT073
accacaaugguauugcccuga

SEQ ID NO: 622843 - RNA, 20 nt, Escherichia coli CFT073
accacaccgccuaccgccag

SEQ ID NO: 622844 - RNA, 21 nt, Escherichia coli CFT073
accacacgacgcgccagcagc

SEQ ID NO: 622845 - RNA, 11 nt, Escherichia coli CFT073
acauuucucug

SEQ ID NO: 622846 - RNA, 14 nt, Escherichia coli CFT073
acauuucugcugcc

SEQ ID NO: 622847 - RNA, 15 nt, Escherichia coli CFT073
acauuucccccuucc

SEQ ID NO: 622848 - RNA, 19 nt, Escherichia coli CFT073
acauuucccgcauaaagag

SEQ ID NO: 622849 - RNA, 19 nt, Escherichia coli CFT073
acauuuccguaauaucuuc

SEQ ID NO: 622850 - RNA, 18 nt, Escherichia coli CFT073
acauuggcucaucaaaca

SEQ ID NO: 622851 - RNA, 16 nt, Escherichia coli CFT073
accaaaucgaaaugau

SEQ ID NO: 622852 - RNA, 11 nt, Escherichia coli CFT073
accaaaccuca

SEQ ID NO: 622853 - RNA, 20 nt, Escherichia coli CFT073
accaaaccuucguuagcuaa

SEQ ID NO: 622854 - RNA, 12 nt, Escherichia coli CFT073
accaaaccagcc

SEQ ID NO: 622855 - RNA, 20 nt, Escherichia coli CFT073
accaaaugacucguuauugu

SEQ ID NO: 622856 - RNA, 15 nt, Escherichia coli CFT073
accaaaugcagcaac

SEQ ID NO: 622857 - RNA, 23 nt, Escherichia coli CFT073
accaacaaaacauaucccaccag

SEQ ID NO: 622858 - RNA, 13 nt, Escherichia coli CFT073
accaacaagcacc

SEQ ID NO: 622859 - RNA, 16 nt, Escherichia coli CFT073
accaaaaucaucaauu

SEQ ID NO: 622860 - RNA, 14 nt, Escherichia coli CFT073
accaaacagcgcca

SEQ ID NO: 622861 - RNA, 22 nt, Escherichia coli CFT073
acaucuuucugcgcaucuuccc

SEQ ID NO: 622862 - RNA, 13 nt, Escherichia coli CFT073
acaugaacaucaa

SEQ ID NO: 622863 - RNA, 19 nt, Escherichia coli CFT073
acaucgucuccagcgaauc

SEQ ID NO: 622864 - RNA, 21 nt, Escherichia coli CFT073
acaucgucaggaagaagccca

SEQ ID NO: 622865 - RNA, 22 nt, Escherichia coli CFT073
acaucgucaggaagaagcccau

SEQ ID NO: 622866 - RNA, 14 nt, Escherichia coli CFT073
acaucgucaggggc

SEQ ID NO: 622867 - RNA, 14 nt, Escherichia coli CFT073
acaucgucgccaga

SEQ ID NO: 622868 - RNA, 15 nt, Escherichia coli CFT073
acaucggcaggaaca

SEQ ID NO: 622869 - RNA, 15 nt, Escherichia coli CFT073
acaugccugcauaaa

SEQ ID NO: 622870 - RNA, 19 nt, Escherichia coli CFT073
acaugcggcgugccuucac

SEQ ID NO: 622871 - RNA, 18 nt, Escherichia coli CFT073
acaugcgggucuuacugg

SEQ ID NO: 622872 - RNA, 16 nt, Escherichia coli CFT073
acaugcggugauuuug

SEQ ID NO: 622873 - RNA, 23 nt, Escherichia coli CFT073
acaugcgguucacgcgccagaga

SEQ ID NO: 622874 - RNA, 14 nt, Escherichia coli CFT073
acaugcuaaaaauc

SEQ ID NO: 622875 - RNA, 18 nt, Escherichia coli CFT073
acauuaaguaacaauauc

SEQ ID NO: 622876 - RNA, 23 nt, Escherichia coli CFT073
acauguugcuuaaugcgggaagg

SEQ ID NO: 622877 - RNA, 16 nt, Escherichia coli CFT073
acauguuuuuauuaaa

SEQ ID NO: 622878 - RNA, 18 nt, Escherichia coli CFT073
acauguuuuccagcacau

SEQ ID NO: 622879 - RNA, 19 nt, Escherichia coli CFT073
acauucgcgcacggugcau

SEQ ID NO: 622880 - RNA, 14 nt, Escherichia coli CFT073
acauugagcaaaga

SEQ ID NO: 622881 - RNA, 16 nt, Escherichia coli CFT073
acauugauagcccaac

SEQ ID NO: 622882 - RNA, 23 nt, Escherichia coli CFT073
acauugaccagugcagacucacc

SEQ ID NO: 622883 - RNA, 20 nt, Escherichia coli CFT073
acauugauuucuuauucaua

SEQ ID NO: 622884 - RNA, 19 nt, Escherichia coli CFT073
acauugccaguuuuaaauu

SEQ ID NO: 622885 - RNA, 18 nt, Escherichia coli CFT073
acauugccgaauggcugc

SEQ ID NO: 622886 - RNA, 19 nt, Escherichia coli CFT073
acauugccgaauggcugca

SEQ ID NO: 622887 - RNA, 21 nt, Escherichia coli CFT073
acauugcgggcgagauuuuac

SEQ ID NO: 622888 - RNA, 15 nt, Escherichia coli CFT073
acauugcugcacauc

SEQ ID NO: 622889 - RNA, 12 nt, Escherichia coli CFT073
acauugcugcug

SEQ ID NO: 622890 - RNA, 16 nt, Escherichia coli CFT073
acauuggcaaaaccaa

SEQ ID NO: 622891 - RNA, 14 nt, Escherichia coli CFT073
acauucaucauuuc

SEQ ID NO: 622892 - RNA, 19 nt, Escherichia coli CFT073
acauuccagaugcgccagu

SEQ ID NO: 622893 - RNA, 12 nt, Escherichia coli CFT073
acauucccauca

SEQ ID NO: 622894 - RNA, 11 nt, Escherichia coli CFT073
acauuccuguu

SEQ ID NO: 622895 - RNA, 14 nt, Escherichia coli CFT073
acauucccugcagu

SEQ ID NO: 622896 - RNA, 19 nt, Escherichia coli CFT073
acauuacguccaucacaau

SEQ ID NO: 622897 - RNA, 17 nt, Escherichia coli CFT073
acauuacuaaacauuua

SEQ ID NO: 622898 - RNA, 18 nt, Escherichia coli CFT073
acauuacuaauuaauaau

SEQ ID NO: 622899 - RNA, 19 nt, Escherichia coli CFT073
acauuacuaauuaauaaua

SEQ ID NO: 622900 - RNA, 23 nt, Escherichia coli CFT073
acauuagcgcaugaccagugagg

SEQ ID NO: 622901 - RNA, 15 nt, Escherichia coli CFT073
acauuaauuuucaau

SEQ ID NO: 622902 - RNA, 13 nt, Escherichia coli CFT073
acauuaucagaca

SEQ ID NO: 622903 - RNA, 18 nt, Escherichia coli CFT073
acauaucacuuuuauaua

SEQ ID NO: 622904 - RNA, 14 nt, Escherichia coli CFT073
acauauaucgaaaa

SEQ ID NO: 622905 - RNA, 13 nt, Escherichia coli CFT073
acaucaacccaga

SEQ ID NO: 622906 - RNA, 14 nt, Escherichia coli CFT073
acaucaacgccuga

SEQ ID NO: 622907 - RNA, 20 nt, Escherichia coli CFT073
acaucaauggaugcaucuuc

SEQ ID NO: 622908 - RNA, 15 nt, Escherichia coli CFT073
acaucaagucagaug

SEQ ID NO: 622909 - RNA, 18 nt, Escherichia coli CFT073
acaucaauuacaccauca

SEQ ID NO: 622910 - RNA, 22 nt, Escherichia coli CFT073
acaucaauuacaccaucacgcc

SEQ ID NO: 622911 - RNA, 19 nt, Escherichia coli CFT073
acaucacaccauccagcaa

SEQ ID NO: 622912 - RNA, 22 nt, Escherichia coli CFT073
acaucacaccauccagcaacaa

SEQ ID NO: 622913 - RNA, 21 nt, Escherichia coli CFT073
acaucaccguucagcuugcgu

SEQ ID NO: 622914 - RNA, 16 nt, Escherichia coli CFT073
acaucacgauuuuucc

SEQ ID NO: 622915 - RNA, 17 nt, Escherichia coli CFT073
acauccgaccaaagaau

SEQ ID NO: 622916 - RNA, 14 nt, Escherichia coli CFT073
acauccaucugcuu

SEQ ID NO: 622917 - RNA, 13 nt, Escherichia coli CFT073
acaucccagcaga

SEQ ID NO: 622918 - RNA, 14 nt, Escherichia coli CFT073
acaucccagcagag

SEQ ID NO: 622919 - RNA, 19 nt, Escherichia coli CFT073
acauccccauaucccggaa

SEQ ID NO: 622920 - RNA, 21 nt, Escherichia coli CFT073
acauccccauaucccggaagg

SEQ ID NO: 622921 - RNA, 21 nt, Escherichia coli CFT073
acauccgggcgagcuuauaua

SEQ ID NO: 622922 - RNA, 23 nt, Escherichia coli CFT073
acauccgguuucaucagccaauu

SEQ ID NO: 622923 - RNA, 15 nt, Escherichia coli CFT073
acauccggcaaugaa

SEQ ID NO: 622924 - RNA, 18 nt, Escherichia coli CFT073
acauccggcaaugaaacu

SEQ ID NO: 622925 - RNA, 14 nt, Escherichia coli CFT073
acaucauccccaca

SEQ ID NO: 622926 - RNA, 14 nt, Escherichia coli CFT073
acaucauccccauc

SEQ ID NO: 622927 - RNA, 15 nt, Escherichia coli CFT073
acaucaucacgcaga

SEQ ID NO: 622928 - RNA, 23 nt, Escherichia coli CFT073
acaucaugauuuuaaacggcaua

SEQ ID NO: 622929 - RNA, 13 nt, Escherichia coli CFT073
acauccagaucac

SEQ ID NO: 622930 - RNA, 17 nt, Escherichia coli CFT073
acauccaguacgccuuc

SEQ ID NO: 622931 - RNA, 17 nt, Escherichia coli CFT073
acauccaguauauugcu

SEQ ID NO: 622932 - RNA, 23 nt, Escherichia coli CFT073
acauccagcucgcguucugucag

SEQ ID NO: 622933 - RNA, 23 nt, Escherichia coli CFT073
acauaagcugaauguucuucuuc

SEQ ID NO: 622934 - RNA, 21 nt, Escherichia coli CFT073
acauaagcaccgaacaagaaa

SEQ ID NO: 622935 - RNA, 13 nt, Escherichia coli CFT073
acauaccagcagc

SEQ ID NO: 622936 - RNA, 18 nt, Escherichia coli CFT073
acagccaaaucaucagua

SEQ ID NO: 622937 - RNA, 19 nt, Escherichia coli CFT073
acagccaaaucaucaguac

SEQ ID NO: 622938 - RNA, 15 nt, Escherichia coli CFT073
acagccaaaucauca

SEQ ID NO: 622939 - RNA, 13 nt, Escherichia coli CFT073
acagcaugcguuu

SEQ ID NO: 622940 - RNA, 17 nt, Escherichia coli CFT073
acagcauuugcugucaa

SEQ ID NO: 622941 - RNA, 24 nt, Escherichia coli CFT073
acaguuuuucaccguugcucaugu

SEQ ID NO: 622942 - RNA, 13 nt, Escherichia coli CFT073
acauagccacuca

SEQ ID NO: 622943 - RNA, 16 nt, Escherichia coli CFT073
acauagcuaaaaauaa

SEQ ID NO: 622944 - RNA, 22 nt, Escherichia coli CFT073
acauagcaaccggaucgauaaa

SEQ ID NO: 622945 - RNA, 14 nt, Escherichia coli CFT073
acauagauaaagcc

SEQ ID NO: 622946 - RNA, 22 nt, Escherichia coli CFT073
acauacggcauaauaccgcgag

SEQ ID NO: 622947 - RNA, 18 nt, Escherichia coli CFT073
acauacggcgguucuuuc

SEQ ID NO: 622948 - RNA, 15 nt, Escherichia coli CFT073
acauaccuaaaagca

SEQ ID NO: 622949 - RNA, 22 nt, Escherichia coli CFT073
acauaccuaaaagcacgccaga

SEQ ID NO: 622950 - RNA, 14 nt, Escherichia coli CFT073
acagaaaucagagu

SEQ ID NO: 622951 - RNA, 20 nt, Escherichia coli CFT073
acagaaaguagcggaaccgc

SEQ ID NO: 622952 - RNA, 22 nt, Escherichia coli CFT073
acagaaacgccauccagccggg

SEQ ID NO: 622953 - RNA, 18 nt, Escherichia coli CFT073
acagaacuggcgcgaaga

SEQ ID NO: 622954 - RNA, 18 nt, Escherichia coli CFT073
acacuacucguaauaauu

SEQ ID NO: 622955 - RNA, 19 nt, Escherichia coli CFT073
acacuacucguaauaauua

SEQ ID NO: 622956 - RNA, 14 nt, Escherichia coli CFT073
acacguucguccuc

SEQ ID NO: 622957 - RNA, 22 nt, Escherichia coli CFT073
acacggcuuucugcaaccagaa

SEQ ID NO: 622958 - RNA, 22 nt, Escherichia coli CFT073
acacggugcgaugcaaaaucag

SEQ ID NO: 622959 - RNA, 17 nt, Escherichia coli CFT073
acacggcgaacauuccc

SEQ ID NO: 622960 - RNA, 20 nt, Escherichia coli CFT073
acacgcugcaaggcaacgca

SEQ ID NO: 622961 - RNA, 20 nt, Escherichia coli CFT073
acacgccgccagaccaauag

SEQ ID NO: 622962 - RNA, 18 nt, Escherichia coli CFT073
acacgccugcaagcgucg

SEQ ID NO: 622963 - RNA, 20 nt, Escherichia coli CFT073
acacgcucuggcaggcuuca

SEQ ID NO: 622964 - RNA, 12 nt, Escherichia coli CFT073
acacggcucgcc

SEQ ID NO: 622965 - RNA, 20 nt, Escherichia coli CFT073
acagcauccgaacgcugaca

SEQ ID NO: 622966 - RNA, 21 nt, Escherichia coli CFT073
acagcaguacgccgagaauaa

SEQ ID NO: 622967 - RNA, 12 nt, Escherichia coli CFT073
acagcaaaacac

SEQ ID NO: 622968 - RNA, 21 nt, Escherichia coli CFT073
acagauuuugcaggccugaua

SEQ ID NO: 622969 - RNA, 17 nt, Escherichia coli CFT073
acagcaggaaaaugaga

SEQ ID NO: 622970 - RNA, 14 nt, Escherichia coli CFT073
acagcaagcagccg

SEQ ID NO: 622971 - RNA, 14 nt, Escherichia coli CFT073
acagauaaacuaca

SEQ ID NO: 622972 - RNA, 22 nt, Escherichia coli CFT073
acagagugaauggugaaguuau

SEQ ID NO: 622973 - RNA, 15 nt, Escherichia coli CFT073
acagauaauaaaaaa

SEQ ID NO: 622974 - RNA, 13 nt, Escherichia coli CFT073
acagaagaggaga

SEQ ID NO: 622975 - RNA, 18 nt, Escherichia coli CFT073
acagacucaaaccaaugg

SEQ ID NO: 622976 - RNA, 22 nt, Escherichia coli CFT073
acagacgcuggggauuuucugc

SEQ ID NO: 622977 - RNA, 12 nt, Escherichia coli CFT073
acagacggcaga

SEQ ID NO: 622978 - RNA, 19 nt, Escherichia coli CFT073
acagaauacccagcaaugc

SEQ ID NO: 622979 - RNA, 23 nt, Escherichia coli CFT073
acagaauacccagcaaugccagg

SEQ ID NO: 622980 - RNA, 15 nt, Escherichia coli CFT073
acagaaucagcagcg

SEQ ID NO: 622981 - RNA, 20 nt, Escherichia coli CFT073
acaccacuucauugguuuuc

SEQ ID NO: 622982 - RNA, 20 nt, Escherichia coli CFT073
acaccaccgcccgguuuuuu

SEQ ID NO: 622983 - RNA, 14 nt, Escherichia coli CFT073
acaccaacugccuc

SEQ ID NO: 622984 - RNA, 14 nt, Escherichia coli CFT073
acaccaacuucaug

SEQ ID NO: 622985 - RNA, 14 nt, Escherichia coli CFT073
acaccaagcaccau

SEQ ID NO: 622986 - RNA, 20 nt, Escherichia coli CFT073
acaccaagcaccauaaacac

SEQ ID NO: 622987 - RNA, 14 nt, Escherichia coli CFT073
acaccaccacaagc

SEQ ID NO: 622988 - RNA, 18 nt, Escherichia coli CFT073
acaccaccacaagccacc

SEQ ID NO: 622989 - RNA, 12 nt, Escherichia coli CFT073
acaccaaaauaa

SEQ ID NO: 622990 - RNA, 14 nt, Escherichia coli CFT073
acaccaugccagaa

SEQ ID NO: 622991 - RNA, 16 nt, Escherichia coli CFT073
acacccacagccaugg

SEQ ID NO: 622992 - RNA, 16 nt, Escherichia coli CFT073
acaccagugacgcagc

SEQ ID NO: 622993 - RNA, 19 nt, Escherichia coli CFT073
acaccagugacgcagcgau

SEQ ID NO: 622994 - RNA, 22 nt, Escherichia coli CFT073
acaccaggcuaaauugcauugg

SEQ ID NO: 622995 - RNA, 15 nt, Escherichia coli CFT073
acaccaucacccaac

SEQ ID NO: 622996 - RNA, 14 nt, Escherichia coli CFT073
acaccauccagcaa

SEQ ID NO: 622997 - RNA, 21 nt, Escherichia coli CFT073
acaccauccagcaacaacagc

SEQ ID NO: 622998 - RNA, 20 nt, Escherichia coli CFT073
acaccaucgauuuacugcca

SEQ ID NO: 622999 - RNA, 16 nt, Escherichia coli CFT073
acaccaucgcauacgg

SEQ ID NO: 623000 - RNA, 17 nt, Escherichia coli CFT073
acaccauauccagcgca

SEQ ID NO: 623001 - RNA, 19 nt, Escherichia coli CFT073
acaccagccaguagcaccu

SEQ ID NO: 623002 - RNA, 18 nt, Escherichia coli CFT073
acaccagcaguaaaccac

SEQ ID NO: 623003 - RNA, 22 nt, Escherichia coli CFT073
acaccagcaguaaaccacccac

SEQ ID NO: 623004 - RNA, 12 nt, Escherichia coli CFT073
acaccagcagca

SEQ ID NO: 623005 - RNA, 17 nt, Escherichia coli CFT073
acaccagauccugccau

SEQ ID NO: 623006 - RNA, 17 nt, Escherichia coli CFT073
acaccagcacaucauca

SEQ ID NO: 623007 - RNA, 17 nt, Escherichia coli CFT073
acaccgccuaccgccag

SEQ ID NO: 623008 - RNA, 14 nt, Escherichia coli CFT073
acaccgcuuuaauc

SEQ ID NO: 623009 - RNA, 17 nt, Escherichia coli CFT073
acaccgguauucuccug

SEQ ID NO: 623010 - RNA, 17 nt, Escherichia coli CFT073
acaccggugaccaucag

SEQ ID NO: 623011 - RNA, 23 nt, Escherichia coli CFT073
acaccggugaccaucagcaugac

SEQ ID NO: 623012 - RNA, 18 nt, Escherichia coli CFT073
acaccgucagccagcacu

SEQ ID NO: 623013 - RNA, 23 nt, Escherichia coli CFT073
acaccguccggcgggcaaauucu

SEQ ID NO: 623014 - RNA, 16 nt, Escherichia coli CFT073
acaccgauugccccug

SEQ ID NO: 623015 - RNA, 21 nt, Escherichia coli CFT073
acaccgcagccgccacaauaa

SEQ ID NO: 623016 - RNA, 15 nt, Escherichia coli CFT073
acaccgauagaacca

SEQ ID NO: 623017 - RNA, 17 nt, Escherichia coli CFT073
acaccgaaccgaaaugg

SEQ ID NO: 623018 - RNA, 21 nt, Escherichia coli CFT073
acaccgaaccgaaauggcugc

SEQ ID NO: 623019 - RNA, 23 nt, Escherichia coli CFT073
acaccuuuccccggcagcaucag

SEQ ID NO: 623020 - RNA, 19 nt, Escherichia coli CFT073
acaccuucguccagcauca

SEQ ID NO: 623021 - RNA, 18 nt, Escherichia coli CFT073
acaccuguaaaaaaggca

SEQ ID NO: 623022 - RNA, 20 nt, Escherichia coli CFT073
acaccuucagcgaagcccac

SEQ ID NO: 623023 - RNA, 22 nt, Escherichia coli CFT073
acaccugggcaauggugaacug

SEQ ID NO: 623024 - RNA, 13 nt, Escherichia coli CFT073
acaccucaacccg

SEQ ID NO: 623025 - RNA, 12 nt, Escherichia coli CFT073
acacgaaucagg

SEQ ID NO: 623026 - RNA, 21 nt, Escherichia coli CFT073
acacgaccaugggcaauuucu

SEQ ID NO: 623027 - RNA, 12 nt, Escherichia coli CFT073
acacgacgccag

SEQ ID NO: 623028 - RNA, 15 nt, Escherichia coli CFT073
acaauaacucuugaa

SEQ ID NO: 623029 - RNA, 16 nt, Escherichia coli CFT073
acaauacgcccacgcu

SEQ ID NO: 623030 - RNA, 15 nt, Escherichia coli CFT073
acaauacgcccggug

SEQ ID NO: 623031 - RNA, 16 nt, Escherichia coli CFT073
acaauaauaucuuucu

SEQ ID NO: 623032 - RNA, 14 nt, Escherichia coli CFT073
acaauaauaucuuu

SEQ ID NO: 623033 - RNA, 18 nt, Escherichia coli CFT073
acaaguggcgacaaagug

SEQ ID NO: 623034 - RNA, 22 nt, Escherichia coli CFT073
acaaggugcgaaaaaaauuacu

SEQ ID NO: 623035 - RNA, 13 nt, Escherichia coli CFT073
acaagcucauuuc

SEQ ID NO: 623036 - RNA, 22 nt, Escherichia coli CFT073
acaagggaaauaagaaaagcga

SEQ ID NO: 623037 - RNA, 20 nt, Escherichia coli CFT073
acaagguaguagaaaucagc

SEQ ID NO: 623038 - RNA, 18 nt, Escherichia coli CFT073
acaaggcaauuaaaaauu

SEQ ID NO: 623039 - RNA, 17 nt, Escherichia coli CFT073
acaaggcgcuaaaagca

SEQ ID NO: 623040 - RNA, 20 nt, Escherichia coli CFT073
acaaggcuauccucuaaacc

SEQ ID NO: 623041 - RNA, 13 nt, Escherichia coli CFT073
acaauauuaacaa

SEQ ID NO: 623042 - RNA, 16 nt, Escherichia coli CFT073
acaauauuaauuacuu

SEQ ID NO: 623043 - RNA, 15 nt, Escherichia coli CFT073
acaauaucaucauua

SEQ ID NO: 623044 - RNA, 21 nt, Escherichia coli CFT073
acaauaucaucauuauuaaua

SEQ ID NO: 623045 - RNA, 15 nt, Escherichia coli CFT073
acaauaucuaaaaug

SEQ ID NO: 623046 - RNA, 16 nt, Escherichia coli CFT073
acaauaucuaaaaugu

SEQ ID NO: 623047 - RNA, 15 nt, Escherichia coli CFT073
acaauccaaaugccu

SEQ ID NO: 623048 - RNA, 20 nt, Escherichia coli CFT073
acaaucccguugaaaaugcu

SEQ ID NO: 623049 - RNA, 20 nt, Escherichia coli CFT073
acaaucccuuaguaacgcca

SEQ ID NO: 623050 - RNA, 22 nt, Escherichia coli CFT073
acaauccgauauaaaaaauacg

SEQ ID NO: 623051 - RNA, 14 nt, Escherichia coli CFT073
acaauccccgccag

SEQ ID NO: 623052 - RNA, 13 nt, Escherichia coli CFT073
acaaucaaauccu

SEQ ID NO: 623053 - RNA, 23 nt, Escherichia coli CFT073
acaaugauuacucucuuucgcuu

SEQ ID NO: 623054 - RNA, 15 nt, Escherichia coli CFT073
acaaucuuaggggac

SEQ ID NO: 623055 - RNA, 22 nt, Escherichia coli CFT073
acaaucuugccauuccacaaaa

SEQ ID NO: 623056 - RNA, 14 nt, Escherichia coli CFT073
acaauccuucccug

SEQ ID NO: 623057 - RNA, 17 nt, Escherichia coli CFT073
acaaucgcccccaucac

SEQ ID NO: 623058 - RNA, 18 nt, Escherichia coli CFT073
acaaucgcccccaucacc

SEQ ID NO: 623059 - RNA, 14 nt, Escherichia coli CFT073
acaaucgcucacaa

SEQ ID NO: 623060 - RNA, 21 nt, Escherichia coli CFT073
acaaucgcucacaacaauauc

SEQ ID NO: 623061 - RNA, 14 nt, Escherichia coli CFT073
acaaucgcuuaauc

SEQ ID NO: 623062 - RNA, 14 nt, Escherichia coli CFT073
acaaucgucugguu

SEQ ID NO: 623063 - RNA, 17 nt, Escherichia coli CFT073
acaaucggcgggaaaaa

SEQ ID NO: 623064 - RNA, 14 nt, Escherichia coli CFT073
acaauguaucuuuc

SEQ ID NO: 623065 - RNA, 15 nt, Escherichia coli CFT073
acaauguucaaaugu

SEQ ID NO: 623066 - RNA, 14 nt, Escherichia coli CFT073
acaauuacaaaaug

SEQ ID NO: 623067 - RNA, 15 nt, Escherichia coli CFT073
acaauuacaaaauga

SEQ ID NO: 623068 - RNA, 17 nt, Escherichia coli CFT073
acaaugcguaaauugcu

SEQ ID NO: 623069 - RNA, 16 nt, Escherichia coli CFT073
acaaugcccggaaugu

SEQ ID NO: 623070 - RNA, 16 nt, Escherichia coli CFT073
acaaugccagaaacau

SEQ ID NO: 623071 - RNA, 19 nt, Escherichia coli CFT073
acaauggcauaaccgauac

SEQ ID NO: 623072 - RNA, 21 nt, Escherichia coli CFT073
acaaugguuaaauugaaauuu

SEQ ID NO: 623073 - RNA, 20 nt, Escherichia coli CFT073
acaaugggcgugaaaggugc

SEQ ID NO: 623074 - RNA, 19 nt, Escherichia coli CFT073
acaauuccgccugcagagg

SEQ ID NO: 623075 - RNA, 14 nt, Escherichia coli CFT073
acaauugcauauca

SEQ ID NO: 623076 - RNA, 19 nt, Escherichia coli CFT073
acaauucgugugguaaaac

SEQ ID NO: 623077 - RNA, 20 nt, Escherichia coli CFT073
acaauugcgggccaaagacc

SEQ ID NO: 623078 - RNA, 16 nt, Escherichia coli CFT073
acaauuucagcaauaa

SEQ ID NO: 623079 - RNA, 13 nt, Escherichia coli CFT073
acacaaacggcgc

SEQ ID NO: 623080 - RNA, 22 nt, Escherichia coli CFT073
acacaguacgaugauugccaca

SEQ ID NO: 623081 - RNA, 14 nt, Escherichia coli CFT073
acacauacauguau

SEQ ID NO: 623082 - RNA, 19 nt, Escherichia coli CFT073
acacauaccuggucugaac

SEQ ID NO: 623083 - RNA, 21 nt, Escherichia coli CFT073
acacagugaaucucuuaucau

SEQ ID NO: 623084 - RNA, 19 nt, Escherichia coli CFT073
acacaguucuucaaaaaua

SEQ ID NO: 623085 - RNA, 15 nt, Escherichia coli CFT073
acacauaaauaacau

SEQ ID NO: 623086 - RNA, 23 nt, Escherichia coli CFT073
acacaucagugauacaucuggua

SEQ ID NO: 623087 - RNA, 19 nt, Escherichia coli CFT073
acacaucaacccagaaaca

SEQ ID NO: 623088 - RNA, 20 nt, Escherichia coli CFT073
acacagcggcagcaucucgc

SEQ ID NO: 623089 - RNA, 17 nt, Escherichia coli CFT073
acacagcgugcauagca

SEQ ID NO: 623090 - RNA, 15 nt, Escherichia coli CFT073
acacaggcagcaauc

SEQ ID NO: 623091 - RNA, 17 nt, Escherichia coli CFT073
acacaaccgaggcucaa

SEQ ID NO: 623092 - RNA, 21 nt, Escherichia coli CFT073
acacaacgugucguugaguuu

SEQ ID NO: 623093 - RNA, 21 nt, Escherichia coli CFT073
acacaagcguaagagaacaga

SEQ ID NO: 623094 - RNA, 15 nt, Escherichia coli CFT073
acacaaguccagcac

SEQ ID NO: 623095 - RNA, 16 nt, Escherichia coli CFT073
acacaaguccagcacc

SEQ ID NO: 623096 - RNA, 19 nt, Escherichia coli CFT073
acacaauauugcggauaaa

SEQ ID NO: 623097 - RNA, 15 nt, Escherichia coli CFT073
acacaaucaaauccu

SEQ ID NO: 623098 - RNA, 13 nt, Escherichia coli CFT073
acacaauccgcug

SEQ ID NO: 623099 - RNA, 14 nt, Escherichia coli CFT073
acacaauuuguggc

SEQ ID NO: 623100 - RNA, 17 nt, Escherichia coli CFT073
acacacaacacaucgcc

SEQ ID NO: 623101 - RNA, 12 nt, Escherichia coli CFT073
acacagauaaac

SEQ ID NO: 623102 - RNA, 13 nt, Escherichia coli CFT073
acacacuuuccag

SEQ ID NO: 623103 - RNA, 19 nt, Escherichia coli CFT073
acacaccgcaaacugcugu

SEQ ID NO: 623104 - RNA, 21 nt, Escherichia coli CFT073
acaacgggcaccgccgccacu

SEQ ID NO: 623105 - RNA, 16 nt, Escherichia coli CFT073
acaacgucgccagucc

SEQ ID NO: 623106 - RNA, 17 nt, Escherichia coli CFT073
acaacgucgccaguccu

SEQ ID NO: 623107 - RNA, 15 nt, Escherichia coli CFT073
acaacgccgauuaau

SEQ ID NO: 623108 - RNA, 16 nt, Escherichia coli CFT073
acaacgauaauccagc

SEQ ID NO: 623109 - RNA, 15 nt, Escherichia coli CFT073
acaaccgaggcucaa

SEQ ID NO: 623110 - RNA, 18 nt, Escherichia coli CFT073
acaaccgucagccacugg

SEQ ID NO: 623111 - RNA, 22 nt, Escherichia coli CFT073
acaacagcaucgguaucgaaua

SEQ ID NO: 623112 - RNA, 23 nt, Escherichia coli CFT073
acaacagccagguuuugcucugg

SEQ ID NO: 623113 - RNA, 13 nt, Escherichia coli CFT073
acaacacucucug

SEQ ID NO: 623114 - RNA, 17 nt, Escherichia coli CFT073
acaacaucacaccugcu

SEQ ID NO: 623115 - RNA, 20 nt, Escherichia coli CFT073
acaaccauggaacucuuucu

SEQ ID NO: 623116 - RNA, 22 nt, Escherichia coli CFT073
acaaccauggaacucuuucuga

SEQ ID NO: 623117 - RNA, 18 nt, Escherichia coli CFT073
acaacccagacaaauaac

SEQ ID NO: 623118 - RNA, 21 nt, Escherichia coli CFT073
acaacccgugagucuccuuua

SEQ ID NO: 623119 - RNA, 14 nt, Escherichia coli CFT073
acaacauugauuuc

SEQ ID NO: 623120 - RNA, 23 nt, Escherichia coli CFT073
acaacaugccgaauccgggaagg

SEQ ID NO: 623121 - RNA, 17 nt, Escherichia coli CFT073
acaacauuuugcggcua

SEQ ID NO: 623122 - RNA, 17 nt, Escherichia coli CFT073
acaaccaauaacucaag

SEQ ID NO: 623123 - RNA, 13 nt, Escherichia coli CFT073
acaacucauuccc

SEQ ID NO: 623124 - RNA, 23 nt, Escherichia coli CFT073
acaacugcgaccguacaaccaaa

SEQ ID NO: 623125 - RNA, 23 nt, Escherichia coli CFT073
acaacucgcuuaagccaucauca

SEQ ID NO: 623126 - RNA, 21 nt, Escherichia coli CFT073
acaacuucaacguugaauuuc

SEQ ID NO: 623127 - RNA, 15 nt, Escherichia coli CFT073
acaagcguaagagaa

SEQ ID NO: 623128 - RNA, 22 nt, Escherichia coli CFT073
acaagcgucauauccgacacua

SEQ ID NO: 623129 - RNA, 14 nt, Escherichia coli CFT073
acaagccaaaucca

SEQ ID NO: 623130 - RNA, 17 nt, Escherichia coli CFT073
acaagccaaauccagca

SEQ ID NO: 623131 - RNA, 13 nt, Escherichia coli CFT073
acaagacaucacu

SEQ ID NO: 623132 - RNA, 16 nt, Escherichia coli CFT073
acaagaaucaugccaa

SEQ ID NO: 623133 - RNA, 23 nt, Escherichia coli CFT073
acaagaaugccugccagcuugcg

SEQ ID NO: 623134 - RNA, 16 nt, Escherichia coli CFT073
acaagacugacaauca

SEQ ID NO: 623135 - RNA, 13 nt, Escherichia coli CFT073
acaagcagcugcc

SEQ ID NO: 623136 - RNA, 13 nt, Escherichia coli CFT073
acaagcagcuuga

SEQ ID NO: 623137 - RNA, 21 nt, Escherichia coli CFT073
acaaaucuuucacuuuugcca

SEQ ID NO: 623138 - RNA, 15 nt, Escherichia coli CFT073
acaaaucgugacagc

SEQ ID NO: 623139 - RNA, 15 nt, Escherichia coli CFT073
acaaauagauaaaau

SEQ ID NO: 623140 - RNA, 18 nt, Escherichia coli CFT073
acaaauaucuuucuacca

SEQ ID NO: 623141 - RNA, 15 nt, Escherichia coli CFT073
acaaauagccaauuc

SEQ ID NO: 623142 - RNA, 14 nt, Escherichia coli CFT073
acaaaugugccauu

SEQ ID NO: 623143 - RNA, 21 nt, Escherichia coli CFT073
acaaauguguucagcgacaga

SEQ ID NO: 623144 - RNA, 15 nt, Escherichia coli CFT073
acaacaaacgcaaac

SEQ ID NO: 623145 - RNA, 16 nt, Escherichia coli CFT073
acaaauuugugcucug

SEQ ID NO: 623146 - RNA, 18 nt, Escherichia coli CFT073
acaacaacuucuaauuuu

SEQ ID NO: 623147 - RNA, 18 nt, Escherichia coli CFT073
acaacacgccgauaauca

SEQ ID NO: 623148 - RNA, 19 nt, Escherichia coli CFT073
acaacaccgauagaaccaa

SEQ ID NO: 623149 - RNA, 21 nt, Escherichia coli CFT073
acaacaccgauagaaccaaag

SEQ ID NO: 623150 - RNA, 20 nt, Escherichia coli CFT073
acaacaccgguacuaacagg

SEQ ID NO: 623151 - RNA, 16 nt, Escherichia coli CFT073
acaacaccaucgaaau

SEQ ID NO: 623152 - RNA, 20 nt, Escherichia coli CFT073
acaaagugcgaggaucaucg

SEQ ID NO: 623153 - RNA, 22 nt, Escherichia coli CFT073
acaaaggcggacucauaauccg

SEQ ID NO: 623154 - RNA, 16 nt, Escherichia coli CFT073
acaaaggcuugcugca

SEQ ID NO: 623155 - RNA, 14 nt, Escherichia coli CFT073
acaaaggcacgcca

SEQ ID NO: 623156 - RNA, 18 nt, Escherichia coli CFT073
acaaagacgccaucaauu

SEQ ID NO: 623157 - RNA, 18 nt, Escherichia coli CFT073
acaaagcucaccugagua

SEQ ID NO: 623158 - RNA, 13 nt, Escherichia coli CFT073
acaaacuaaccag

SEQ ID NO: 623159 - RNA, 17 nt, Escherichia coli CFT073
acaaacuuccagaauau

SEQ ID NO: 623160 - RNA, 20 nt, Escherichia coli CFT073
acaaacgccgugcacaccga

SEQ ID NO: 623161 - RNA, 15 nt, Escherichia coli CFT073
acaaacgcugacaua

SEQ ID NO: 623162 - RNA, 20 nt, Escherichia coli CFT073
acaaacgccauaaacuucau

SEQ ID NO: 623163 - RNA, 22 nt, Escherichia coli CFT073
acaaacgccggauggcacauga

SEQ ID NO: 623164 - RNA, 17 nt, Escherichia coli CFT073
acaaacgcaauccagug

SEQ ID NO: 623165 - RNA, 17 nt, Escherichia coli CFT073
acaaacgcugacauauu

SEQ ID NO: 623166 - RNA, 16 nt, Escherichia coli CFT073
acaaacacugcuuuua

SEQ ID NO: 623167 - RNA, 24 nt, Escherichia coli CFT073
acaaacagcguauaaaccauauca

SEQ ID NO: 623168 - RNA, 22 nt, Escherichia coli CFT073
acaaacagcucgacaccaaaca

SEQ ID NO: 623169 - RNA, 16 nt, Escherichia coli CFT073
acaaacaucauccagu

SEQ ID NO: 623170 - RNA, 20 nt, Escherichia coli CFT073
acaaacaucauccagugccg

SEQ ID NO: 623171 - RNA, 12 nt, Escherichia coli CFT073
acaaacagaaug

SEQ ID NO: 623172 - RNA, 19 nt, Escherichia coli CFT073
acaaacagucucaagcacc

SEQ ID NO: 623173 - RNA, 13 nt, Escherichia coli CFT073
acaaacaucaucc

SEQ ID NO: 623174 - RNA, 18 nt, Escherichia coli CFT073
acaaaccauaagguggga

SEQ ID NO: 623175 - RNA, 19 nt, Escherichia coli CFT073
acaaaccaugauuccccag

SEQ ID NO: 623176 - RNA, 22 nt, Escherichia coli CFT073
acaaaccaccgaagaucaccac

SEQ ID NO: 623177 - RNA, 16 nt, Escherichia coli CFT073
acaaaaaaagccacgg

SEQ ID NO: 623178 - RNA, 15 nt, Escherichia coli CFT073
acaaaaaacccauca

SEQ ID NO: 623179 - RNA, 19 nt, Escherichia coli CFT073
acaaaaacuuuuguauuuu

SEQ ID NO: 623180 - RNA, 21 nt, Escherichia coli CFT073
acaaaaaguaguuccagcaug

SEQ ID NO: 623181 - RNA, 12 nt, Escherichia coli CFT073
acaaaagcaaag

SEQ ID NO: 623182 - RNA, 16 nt, Escherichia coli CFT073
acaaaaauaccaccaa

SEQ ID NO: 623183 - RNA, 22 nt, Escherichia coli CFT073
acaaaaccaacgcauagacagc

SEQ ID NO: 623184 - RNA, 19 nt, Escherichia coli CFT073
acaaaaauuauugccuuga

SEQ ID NO: 623185 - RNA, 16 nt, Escherichia coli CFT073
acaaaagcgaagcgaa

SEQ ID NO: 623186 - RNA, 18 nt, Escherichia coli CFT073
acaaaagcgaagcgaaca

SEQ ID NO: 623187 - RNA, 20 nt, Escherichia coli CFT073
acaaaauaaccgccaccagg

SEQ ID NO: 623188 - RNA, 17 nt, Escherichia coli CFT073
acaaaauaggcaaaaaa

SEQ ID NO: 623189 - RNA, 17 nt, Escherichia coli CFT073
acaaaaucagaaacaaa

SEQ ID NO: 623190 - RNA, 18 nt, Escherichia coli CFT073
acaaaaucagaaacaaau

SEQ ID NO: 623191 - RNA, 19 nt, Escherichia coli CFT073
acaaaauggggacaucaaa

SEQ ID NO: 623192 - RNA, 15 nt, Escherichia coli CFT073
acaaaaucuucguua

SEQ ID NO: 623193 - RNA, 22 nt, Escherichia coli CFT073
acaaaaugccguacagcagaau

SEQ ID NO: 623194 - RNA, 15 nt, Escherichia coli CFT073
acaaacaaugccaga

SEQ ID NO: 623195 - RNA, 12 nt, Escherichia coli CFT073
acaaaauugccg

SEQ ID NO: 623196 - RNA, 15 nt, Escherichia coli CFT073
acaaaauugccgcua

SEQ ID NO: 623197 - RNA, 16 nt, Escherichia coli CFT073
acaaaauuuucagcgu

SEQ ID NO: 623198 - RNA, 21 nt, Escherichia coli CFT073
aauuuuuccagcauuucuucc

SEQ ID NO: 623199 - RNA, 14 nt, Escherichia coli CFT073
aauuuuuacuucuu

SEQ ID NO: 623200 - RNA, 19 nt, Escherichia coli CFT073
aauuuuuuuaaucuauaua

SEQ ID NO: 623201 - RNA, 14 nt, Escherichia coli CFT073
aauuuugaacagaa

SEQ ID NO: 623202 - RNA, 18 nt, Escherichia coli CFT073
aauuuugaacagaacugg

SEQ ID NO: 623203 - RNA, 15 nt, Escherichia coli CFT073
aauuuugcagcauuc

SEQ ID NO: 623204 - RNA, 22 nt, Escherichia coli CFT073
aauuuugcagucccaucuucug

SEQ ID NO: 623205 - RNA, 15 nt, Escherichia coli CFT073
aauuuugcugugcuu

SEQ ID NO: 623206 - RNA, 15 nt, Escherichia coli CFT073
aauuuucaaugcccc

SEQ ID NO: 623207 - RNA, 16 nt, Escherichia coli CFT073
aauuuuccuugaaaaa

SEQ ID NO: 623208 - RNA, 19 nt, Escherichia coli CFT073
aauuuuccuugaaaaagag

SEQ ID NO: 623209 - RNA, 20 nt, Escherichia coli CFT073
aauuuuccuugaaaaagagg

SEQ ID NO: 623210 - RNA, 19 nt, Escherichia coli CFT073
aauuuucgccaucucaaaa

SEQ ID NO: 623211 - RNA, 20 nt, Escherichia coli CFT073
aauuugcgcucaauaaucaa

SEQ ID NO: 623212 - RNA, 20 nt, Escherichia coli CFT073
aauuugccagcguaaauccu

SEQ ID NO: 623213 - RNA, 23 nt, Escherichia coli CFT073
aauuugcagccguuuguucugca

SEQ ID NO: 623214 - RNA, 18 nt, Escherichia coli CFT073
aauuugcaggcuaaaaac

SEQ ID NO: 623215 - RNA, 13 nt, Escherichia coli CFT073
aauuugaggaagc

SEQ ID NO: 623216 - RNA, 14 nt, Escherichia coli CFT073
aauuugaggaagcu

SEQ ID NO: 623217 - RNA, 18 nt, Escherichia coli CFT073
aauuucuuucgcacuggu

SEQ ID NO: 623218 - RNA, 13 nt, Escherichia coli CFT073
aauuuguuaacaa

SEQ ID NO: 623219 - RNA, 17 nt, Escherichia coli CFT073
aauuuguuaacaauauu

SEQ ID NO: 623220 - RNA, 18 nt, Escherichia coli CFT073
aauuuguaggccugauaa

SEQ ID NO: 623221 - RNA, 17 nt, Escherichia coli CFT073
aauuuguccacccauag

SEQ ID NO: 623222 - RNA, 15 nt, Escherichia coli CFT073
aauuuuaggaugcug

SEQ ID NO: 623223 - RNA, 23 nt, Escherichia coli CFT073
aauuucgcguaguuaugaaaaua

SEQ ID NO: 623224 - RNA, 15 nt, Escherichia coli CFT073
aauuuccucuucccg

SEQ ID NO: 623225 - RNA, 18 nt, Escherichia coli CFT073
aauuucauuuucagggca

SEQ ID NO: 623226 - RNA, 21 nt, Escherichia coli CFT073
aauuucauccuguaugacaaa

SEQ ID NO: 623227 - RNA, 22 nt, Escherichia coli CFT073
aauuucaucgcugaauuucgcc

SEQ ID NO: 623228 - RNA, 18 nt, Escherichia coli CFT073
aauuuccgcgaccugauc

SEQ ID NO: 623229 - RNA, 16 nt, Escherichia coli CFT073
aauuauaauaaauauu

SEQ ID NO: 623230 - RNA, 19 nt, Escherichia coli CFT073
aauuauaauacgcuugauu

SEQ ID NO: 623231 - RNA, 17 nt, Escherichia coli CFT073
acucuuggcaccgccuu

SEQ ID NO: 623232 - RNA, 12 nt, Escherichia coli CFT073
acucuuucccgg

SEQ ID NO: 623233 - RNA, 20 nt, Escherichia coli CFT073
acucuuucccuccucaaauc

SEQ ID NO: 623234 - RNA, 19 nt, Escherichia coli CFT073
acucuuccgggaaaacauc

SEQ ID NO: 623235 - RNA, 14 nt, Escherichia coli CFT073
acucuucugaccag

SEQ ID NO: 623236 - RNA, 20 nt, Escherichia coli CFT073
acucuucaagauuaaagcag

SEQ ID NO: 623237 - RNA, 15 nt, Escherichia coli CFT073
acucuccuguuuaau

SEQ ID NO: 623238 - RNA, 17 nt, Escherichia coli CFT073
acugaacccggguaggc

SEQ ID NO: 623239 - RNA, 11 nt, Escherichia coli CFT073
acugaacccgg

SEQ ID NO: 623240 - RNA, 16 nt, Escherichia coli CFT073
acugaauaauacacac

SEQ ID NO: 623241 - RNA, 22 nt, Escherichia coli CFT073
acugaauaccguaaaacucaca

SEQ ID NO: 623242 - RNA, 17 nt, Escherichia coli CFT073
acugaagcgaccaccac

SEQ ID NO: 623243 - RNA, 19 nt, Escherichia coli CFT073
acugaaggcgcauugcugg

SEQ ID NO: 623244 - RNA, 23 nt, Escherichia coli CFT073
acugacaucgcuuaguuaaacca

SEQ ID NO: 623245 - RNA, 15 nt, Escherichia coli CFT073
acugaccaccaccac

SEQ ID NO: 623246 - RNA, 19 nt, Escherichia coli CFT073
acugaaugaucacuuguuc

SEQ ID NO: 623247 - RNA, 15 nt, Escherichia coli CFT073
acugacaaucaaucc

SEQ ID NO: 623248 - RNA, 19 nt, Escherichia coli CFT073
acuccgccccggcaauaaa

SEQ ID NO: 623249 - RNA, 22 nt, Escherichia coli CFT073
acuccgcauuuguaggcaggau

SEQ ID NO: 623250 - RNA, 18 nt, Escherichia coli CFT073
acucgauuuuauaaaggg

SEQ ID NO: 623251 - RNA, 23 nt, Escherichia coli CFT073
acucgcacguucaguuuugggga

SEQ ID NO: 623252 - RNA, 17 nt, Escherichia coli CFT073
acucgcagcuuuguuga

SEQ ID NO: 623253 - RNA, 18 nt, Escherichia coli CFT073
acucgcguucuguugccg

SEQ ID NO: 623254 - RNA, 18 nt, Escherichia coli CFT073
acucgccgcaaaacccag

SEQ ID NO: 623255 - RNA, 19 nt, Escherichia coli CFT073
acucgccgcaaaacccagg

SEQ ID NO: 623256 - RNA, 17 nt, Escherichia coli CFT073
acucccuugccugcagg

SEQ ID NO: 623257 - RNA, 20 nt, Escherichia coli CFT073
acucccuuucugccacgcca

SEQ ID NO: 623258 - RNA, 17 nt, Escherichia coli CFT073
acuccccgcaaaccaga

SEQ ID NO: 623259 - RNA, 19 nt, Escherichia coli CFT073
acuccccgcaaaccagaca

SEQ ID NO: 623260 - RNA, 15 nt, Escherichia coli CFT073
acuccauugucuuuu

SEQ ID NO: 623261 - RNA, 20 nt, Escherichia coli CFT073
acuccccgcauuuacucuca

SEQ ID NO: 623262 - RNA, 19 nt, Escherichia coli CFT073
acucuaaauaauucgaguu

SEQ ID NO: 623263 - RNA, 13 nt, Escherichia coli CFT073
acucguuguguga

SEQ ID NO: 623264 - RNA, 13 nt, Escherichia coli CFT073
acucgcuaaccac

SEQ ID NO: 623265 - RNA, 22 nt, Escherichia coli CFT073
acucggcgucgguaaagaaaau

SEQ ID NO: 623266 - RNA, 20 nt, Escherichia coli CFT073
acucgucgcgcacgcccauc

SEQ ID NO: 623267 - RNA, 15 nt, Escherichia coli CFT073
acucguaagaggcgu

SEQ ID NO: 623268 - RNA, 13 nt, Escherichia coli CFT073
acucacacaaaua

SEQ ID NO: 623269 - RNA, 23 nt, Escherichia coli CFT073
acucacacagcuuucucaaaaua

SEQ ID NO: 623270 - RNA, 16 nt, Escherichia coli CFT073
acuaucuucaaagcca

SEQ ID NO: 623271 - RNA, 16 nt, Escherichia coli CFT073
acucacaucaacaacg

SEQ ID NO: 623272 - RNA, 21 nt, Escherichia coli CFT073
acucacaucaacaacgaaaau

SEQ ID NO: 623273 - RNA, 13 nt, Escherichia coli CFT073
acucaccagcauc

SEQ ID NO: 623274 - RNA, 13 nt, Escherichia coli CFT073
acucaccauccug

SEQ ID NO: 623275 - RNA, 12 nt, Escherichia coli CFT073
acucaccaaucg

SEQ ID NO: 623276 - RNA, 17 nt, Escherichia coli CFT073
acucaccacggugauuc

SEQ ID NO: 623277 - RNA, 13 nt, Escherichia coli CFT073
acucaccuuuaaa

SEQ ID NO: 623278 - RNA, 20 nt, Escherichia coli CFT073
acucacgaaucgccucacga

SEQ ID NO: 623279 - RNA, 14 nt, Escherichia coli CFT073
acucaccugauuac

SEQ ID NO: 623280 - RNA, 15 nt, Escherichia coli CFT073
acucaccugauuacc

SEQ ID NO: 623281 - RNA, 19 nt, Escherichia coli CFT073
acucaccgaugaucgccau

SEQ ID NO: 623282 - RNA, 20 nt, Escherichia coli CFT073
acucaccgagcagcacaaug

SEQ ID NO: 623283 - RNA, 17 nt, Escherichia coli CFT073
acucagcgccugcugca

SEQ ID NO: 623284 - RNA, 20 nt, Escherichia coli CFT073
acucagcgggucauucuucg

SEQ ID NO: 623285 - RNA, 15 nt, Escherichia coli CFT073
acucaggaugagaaa

SEQ ID NO: 623286 - RNA, 22 nt, Escherichia coli CFT073
acucaggaugagaaaagagaug

SEQ ID NO: 623287 - RNA, 18 nt, Escherichia coli CFT073
acucauaaguuucccagc

SEQ ID NO: 623288 - RNA, 13 nt, Escherichia coli CFT073
acucauaaaaaua

SEQ ID NO: 623289 - RNA, 14 nt, Escherichia coli CFT073
acucauaaaaauau

SEQ ID NO: 623290 - RNA, 15 nt, Escherichia coli CFT073
acucauaaaaauaua

SEQ ID NO: 623291 - RNA, 12 nt, Escherichia coli CFT073
acucagguggcg

SEQ ID NO: 623292 - RNA, 19 nt, Escherichia coli CFT073
acucagguggcgguauuug

SEQ ID NO: 623293 - RNA, 20 nt, Escherichia coli CFT073
acucacgauuguuaaucaca

SEQ ID NO: 623294 - RNA, 12 nt, Escherichia coli CFT073
acucacgcugcg

SEQ ID NO: 623295 - RNA, 19 nt, Escherichia coli CFT073
acucacuaccagugccaga

SEQ ID NO: 623296 - RNA, 22 nt, Escherichia coli CFT073
acucacuaccagugccagaaca

SEQ ID NO: 623297 - RNA, 23 nt, Escherichia coli CFT073
acuccacaugguuuucaauuauc

SEQ ID NO: 623298 - RNA, 14 nt, Escherichia coli CFT073
acuccaccagcacc

SEQ ID NO: 623299 - RNA, 22 nt, Escherichia coli CFT073
acuccacgcuaugugcuucauc

SEQ ID NO: 623300 - RNA, 12 nt, Escherichia coli CFT073
acuccacccgga

SEQ ID NO: 623301 - RNA, 17 nt, Escherichia coli CFT073
acuccacccggagcaag

SEQ ID NO: 623302 - RNA, 11 nt, Escherichia coli CFT073
acuccagcccu

SEQ ID NO: 623303 - RNA, 14 nt, Escherichia coli CFT073
acuccaguagcgcc

SEQ ID NO: 623304 - RNA, 17 nt, Escherichia coli CFT073
acucaugcccacgcaaa

SEQ ID NO: 623305 - RNA, 15 nt, Escherichia coli CFT073
acucauggaaucuuu

SEQ ID NO: 623306 - RNA, 20 nt, Escherichia coli CFT073
acucauggaaucuuuaauga

SEQ ID NO: 623307 - RNA, 20 nt, Escherichia coli CFT073
acucauuaaucaauuuuuug

SEQ ID NO: 623308 - RNA, 17 nt, Escherichia coli CFT073
acuccaacucuuuuacc

SEQ ID NO: 623309 - RNA, 14 nt, Escherichia coli CFT073
acucauuccccgga

SEQ ID NO: 623310 - RNA, 12 nt, Escherichia coli CFT073
acucauugccag

SEQ ID NO: 623311 - RNA, 20 nt, Escherichia coli CFT073
acucauuguuaucagcaaua

SEQ ID NO: 623312 - RNA, 18 nt, Escherichia coli CFT073
acucaucgccuuucagau

SEQ ID NO: 623313 - RNA, 22 nt, Escherichia coli CFT073
acucaucagcuuacgguaggca

SEQ ID NO: 623314 - RNA, 16 nt, Escherichia coli CFT073
acucauacugagcaag

SEQ ID NO: 623315 - RNA, 18 nt, Escherichia coli CFT073
acucauacugagcaaggc

SEQ ID NO: 623316 - RNA, 16 nt, Escherichia coli CFT073
acucauagccucugcc

SEQ ID NO: 623317 - RNA, 18 nt, Escherichia coli CFT073
acuagucccuccgcacaa

SEQ ID NO: 623318 - RNA, 16 nt, Escherichia coli CFT073
acuaguagcaugaagu

SEQ ID NO: 623319 - RNA, 13 nt, Escherichia coli CFT073
acuauaucccuca

SEQ ID NO: 623320 - RNA, 21 nt, Escherichia coli CFT073
acuaucgguucugugguuggu

SEQ ID NO: 623321 - RNA, 14 nt, Escherichia coli CFT073
acuagugauaacca

SEQ ID NO: 623322 - RNA, 24 nt, Escherichia coli CFT073
acuacagaggguuuuuuauacuca

SEQ ID NO: 623323 - RNA, 22 nt, Escherichia coli CFT073
acuacagaugaaauaccacuca

SEQ ID NO: 623324 - RNA, 14 nt, Escherichia coli CFT073
acuacaaacaaugc

SEQ ID NO: 623325 - RNA, 17 nt, Escherichia coli CFT073
acuacaaaaaaagccac

SEQ ID NO: 623326 - RNA, 21 nt, Escherichia coli CFT073
acuacgugaucgucuucaacc

SEQ ID NO: 623327 - RNA, 17 nt, Escherichia coli CFT073
acuacuggagacagauu

SEQ ID NO: 623328 - RNA, 20 nt, Escherichia coli CFT073
acuacuggagacagauuuau

SEQ ID NO: 623329 - RNA, 16 nt, Escherichia coli CFT073
acuagcagcauuucaa

SEQ ID NO: 623330 - RNA, 21 nt, Escherichia coli CFT073
acguucuucgcugacaguacc

SEQ ID NO: 623331 - RNA, 18 nt, Escherichia coli CFT073
acguugaacugacuguuu

SEQ ID NO: 623332 - RNA, 21 nt, Escherichia coli CFT073
acguugcaacugcgacacugu

SEQ ID NO: 623333 - RNA, 13 nt, Escherichia coli CFT073
acguugccagcaa

SEQ ID NO: 623334 - RNA, 13 nt, Escherichia coli CFT073
acguugccaguac

SEQ ID NO: 623335 - RNA, 20 nt, Escherichia coli CFT073
acguugccggauacgaucuc

SEQ ID NO: 623336 - RNA, 21 nt, Escherichia coli CFT073
acguugccguaagcaacgcca

SEQ ID NO: 623337 - RNA, 18 nt, Escherichia coli CFT073
acguugcucaaggguuuc

SEQ ID NO: 623338 - RNA, 16 nt, Escherichia coli CFT073
acguucgacugcgccu

SEQ ID NO: 623339 - RNA, 13 nt, Escherichia coli CFT073
acguucgcccacu

SEQ ID NO: 623340 - RNA, 16 nt, Escherichia coli CFT073
acguucguccucaaug

SEQ ID NO: 623341 - RNA, 23 nt, Escherichia coli CFT073
acuaaauuuuaagccauuaaauc

SEQ ID NO: 623342 - RNA, 13 nt, Escherichia coli CFT073
acuaacagcacau

SEQ ID NO: 623343 - RNA, 17 nt, Escherichia coli CFT073
acuaaccaugcgcccau

SEQ ID NO: 623344 - RNA, 22 nt, Escherichia coli CFT073
acuaaucgggccgacaaaauca

SEQ ID NO: 623345 - RNA, 18 nt, Escherichia coli CFT073
acuaaucacuucaucaac

SEQ ID NO: 623346 - RNA, 16 nt, Escherichia coli CFT073
acuaauagcaaaauau

SEQ ID NO: 623347 - RNA, 13 nt, Escherichia coli CFT073
acuaacuucugau

SEQ ID NO: 623348 - RNA, 19 nt, Escherichia coli CFT073
acuaacugacuuucuuuuc

SEQ ID NO: 623349 - RNA, 23 nt, Escherichia coli CFT073
acuaacuucugaucuacagccuu

SEQ ID NO: 623350 - RNA, 18 nt, Escherichia coli CFT073
acgggaaacucugcuggc

SEQ ID NO: 623351 - RNA, 19 nt, Escherichia coli CFT073
acggcuuuuuucauuuccc

SEQ ID NO: 623352 - RNA, 13 nt, Escherichia coli CFT073
acgggaacagugc

SEQ ID NO: 623353 - RNA, 15 nt, Escherichia coli CFT073
acgggaacagugcuu

SEQ ID NO: 623354 - RNA, 15 nt, Escherichia coli CFT073
acgggccauccauca

SEQ ID NO: 623355 - RNA, 19 nt, Escherichia coli CFT073
acguaguguaaaugcaaau

SEQ ID NO: 623356 - RNA, 18 nt, Escherichia coli CFT073
acguaggccucagguuga

SEQ ID NO: 623357 - RNA, 23 nt, Escherichia coli CFT073
acgucagugacugcuuuuucaau

SEQ ID NO: 623358 - RNA, 22 nt, Escherichia coli CFT073
acgucaguguguuauugccugg

SEQ ID NO: 623359 - RNA, 16 nt, Escherichia coli CFT073
acgucaucagcaauuu

SEQ ID NO: 623360 - RNA, 17 nt, Escherichia coli CFT073
acgucauauacccugcc

SEQ ID NO: 623361 - RNA, 15 nt, Escherichia coli CFT073
acgucauauucgcca

SEQ ID NO: 623362 - RNA, 23 nt, Escherichia coli CFT073
acgucauauucgccaucagccac

SEQ ID NO: 623363 - RNA, 14 nt, Escherichia coli CFT073
acgucaucuguaag

SEQ ID NO: 623364 - RNA, 16 nt, Escherichia coli CFT073
acguaucaacaucaca

SEQ ID NO: 623365 - RNA, 18 nt, Escherichia coli CFT073
acguauggcgauagccca

SEQ ID NO: 623366 - RNA, 18 nt, Escherichia coli CFT073
acgucacuggugugucau

SEQ ID NO: 623367 - RNA, 22 nt, Escherichia coli CFT073
acgucacaggccaucacauccu

SEQ ID NO: 623368 - RNA, 14 nt, Escherichia coli CFT073
acguucagccgcuu

SEQ ID NO: 623369 - RNA, 12 nt, Escherichia coli CFT073
acguuccagcaa

SEQ ID NO: 623370 - RNA, 12 nt, Escherichia coli CFT073
acguucacuuuu

SEQ ID NO: 623371 - RNA, 16 nt, Escherichia coli CFT073
acguuaaaacacacua

SEQ ID NO: 623372 - RNA, 16 nt, Escherichia coli CFT073
acguuaauccgcucug

SEQ ID NO: 623373 - RNA, 15 nt, Escherichia coli CFT073
acguuacccagcacg

SEQ ID NO: 623374 - RNA, 16 nt, Escherichia coli CFT073
acguuaaguucauuuu

SEQ ID NO: 623375 - RNA, 16 nt, Escherichia coli CFT073
acguucacgcagcuca

SEQ ID NO: 623376 - RNA, 19 nt, Escherichia coli CFT073
acguggucgaauccccuca

SEQ ID NO: 623377 - RNA, 17 nt, Escherichia coli CFT073
acgugguuuaccaccag

SEQ ID NO: 623378 - RNA, 18 nt, Escherichia coli CFT073
acgugucaacgcuucagc

SEQ ID NO: 623379 - RNA, 22 nt, Escherichia coli CFT073
acgugaaaucaacguuaccaag

SEQ ID NO: 623380 - RNA, 16 nt, Escherichia coli CFT073
acgucauugcaaucuc

SEQ ID NO: 623381 - RNA, 21 nt, Escherichia coli CFT073
acgucauugcaaucuccuguu

SEQ ID NO: 623382 - RNA, 13 nt, Escherichia coli CFT073
acgugauugguuu

SEQ ID NO: 623383 - RNA, 15 nt, Escherichia coli CFT073
acgugcaaaaucaaa

SEQ ID NO: 623384 - RNA, 18 nt, Escherichia coli CFT073
acgugcaaaaucaaacag

SEQ ID NO: 623385 - RNA, 17 nt, Escherichia coli CFT073
acgcgacauuuuuauga

SEQ ID NO: 623386 - RNA, 20 nt, Escherichia coli CFT073
acgcgaccuuuuuugcacgc

SEQ ID NO: 623387 - RNA, 20 nt, Escherichia coli CFT073
acgcgcaauggaccagaacg

SEQ ID NO: 623388 - RNA, 13 nt, Escherichia coli CFT073
acgcgauggcuuu

SEQ ID NO: 623389 - RNA, 23 nt, Escherichia coli CFT073
acgcgcagaccccccaggcgcac

SEQ ID NO: 623390 - RNA, 22 nt, Escherichia coli CFT073
acgcgcagggugcagaaucaau

SEQ ID NO: 623391 - RNA, 15 nt, Escherichia coli CFT073
acgcgccaccgacca

SEQ ID NO: 623392 - RNA, 21 nt, Escherichia coli CFT073
acgcgccagagagaacugugc

SEQ ID NO: 623393 - RNA, 22 nt, Escherichia coli CFT073
acgcgccagagcuggcaccgca

SEQ ID NO: 623394 - RNA, 17 nt, Escherichia coli CFT073
acgcgccacgcacgccu

SEQ ID NO: 623395 - RNA, 22 nt, Escherichia coli CFT073
acgcgcccguagucggugccau

SEQ ID NO: 623396 - RNA, 16 nt, Escherichia coli CFT073
acgcgccagcaucgca

SEQ ID NO: 623397 - RNA, 18 nt, Escherichia coli CFT073
acgcgccgccaccgccag

SEQ ID NO: 623398 - RNA, 15 nt, Escherichia coli CFT073
acgcgccgccagcca

SEQ ID NO: 623399 - RNA, 17 nt, Escherichia coli CFT073
acgcgccgccagccaca

SEQ ID NO: 623400 - RNA, 14 nt, Escherichia coli CFT073
acgcgccuuaaaaa

SEQ ID NO: 623401 - RNA, 15 nt, Escherichia coli CFT073
acgcgcgcaggcaac

SEQ ID NO: 623402 - RNA, 16 nt, Escherichia coli CFT073
acgcgcuuucuucgca

SEQ ID NO: 623403 - RNA, 22 nt, Escherichia coli CFT073
acgcgcuuucuucgcagcaaau

SEQ ID NO: 623404 - RNA, 17 nt, Escherichia coli CFT073
acgcgcuuugaugcguu

SEQ ID NO: 623405 - RNA, 22 nt, Escherichia coli CFT073
acgcgcuuugaugcguucuuca

SEQ ID NO: 623406 - RNA, 19 nt, Escherichia coli CFT073
acgcggcaaaacccugcgc

SEQ ID NO: 623407 - RNA, 17 nt, Escherichia coli CFT073
acgcggcacuccgccac

SEQ ID NO: 623408 - RNA, 13 nt, Escherichia coli CFT073
acgcgguuacgca

SEQ ID NO: 623409 - RNA, 16 nt, Escherichia coli CFT073
acgcgggguaaaaccc

SEQ ID NO: 623410 - RNA, 20 nt, Escherichia coli CFT073
acgcgguaaaagcccaucau

SEQ ID NO: 623411 - RNA, 14 nt, Escherichia coli CFT073
acgcucagcaacau

SEQ ID NO: 623412 - RNA, 19 nt, Escherichia coli CFT073
acgcucagcaaucgcauau

SEQ ID NO: 623413 - RNA, 17 nt, Escherichia coli CFT073
acgcucauuuucuuuca

SEQ ID NO: 623414 - RNA, 15 nt, Escherichia coli CFT073
acgcucccucaauau

SEQ ID NO: 623415 - RNA, 19 nt, Escherichia coli CFT073
acgcuccgcacuugaguaa

SEQ ID NO: 623416 - RNA, 16 nt, Escherichia coli CFT073
acgcucgaacagcugg

SEQ ID NO: 623417 - RNA, 19 nt, Escherichia coli CFT073
acgcucuggugagugacaa

SEQ ID NO: 623418 - RNA, 21 nt, Escherichia coli CFT073
acgcucuguucugcgccuggu

SEQ ID NO: 623419 - RNA, 18 nt, Escherichia coli CFT073
acgcucuuucaccagugg

SEQ ID NO: 623420 - RNA, 12 nt, Escherichia coli CFT073
acgcucuucacg

SEQ ID NO: 623421 - RNA, 19 nt, Escherichia coli CFT073
acgcugaauaauccccaca

SEQ ID NO: 623422 - RNA, 18 nt, Escherichia coli CFT073
acgcugaaugcugccuuc

SEQ ID NO: 623423 - RNA, 15 nt, Escherichia coli CFT073
acgcugacgcgucuu

SEQ ID NO: 623424 - RNA, 16 nt, Escherichia coli CFT073
acgcuauuugcugaau

SEQ ID NO: 623425 - RNA, 21 nt, Escherichia coli CFT073
acgcucaauauuugcaccuaa

SEQ ID NO: 623426 - RNA, 16 nt, Escherichia coli CFT073
acgcucacaucugcaa

SEQ ID NO: 623427 - RNA, 16 nt, Escherichia coli CFT073
acgcucaaacagcgua

SEQ ID NO: 623428 - RNA, 19 nt, Escherichia coli CFT073
acgcguugcgcaugaccuu

SEQ ID NO: 623429 - RNA, 20 nt, Escherichia coli CFT073
acgcgugguuacgccgggcg

SEQ ID NO: 623430 - RNA, 16 nt, Escherichia coli CFT073
acgcgucagugucuua

SEQ ID NO: 623431 - RNA, 16 nt, Escherichia coli CFT073
acgcgucugaccgucu

SEQ ID NO: 623432 - RNA, 13 nt, Escherichia coli CFT073
acgcgucaagcgu

SEQ ID NO: 623433 - RNA, 14 nt, Escherichia coli CFT073
acgcguaaauccag

SEQ ID NO: 623434 - RNA, 15 nt, Escherichia coli CFT073
acgcguaaauccagc

SEQ ID NO: 623435 - RNA, 17 nt, Escherichia coli CFT073
acgcguaaauccagcac

SEQ ID NO: 623436 - RNA, 20 nt, Escherichia coli CFT073
acgcguaccuaacaguucac

SEQ ID NO: 623437 - RNA, 13 nt, Escherichia coli CFT073
acgcugauugcau

SEQ ID NO: 623438 - RNA, 23 nt, Escherichia coli CFT073
acgcugcaaggcucuauacgcau

SEQ ID NO: 623439 - RNA, 16 nt, Escherichia coli CFT073
acgcugcgcuugcugc

SEQ ID NO: 623440 - RNA, 22 nt, Escherichia coli CFT073
acgcuucaucugccauuguugc

SEQ ID NO: 623441 - RNA, 21 nt, Escherichia coli CFT073
acgcuucggcaauuucagugc

SEQ ID NO: 623442 - RNA, 20 nt, Escherichia coli CFT073
acgcuucaaaccuucaucca

SEQ ID NO: 623443 - RNA, 15 nt, Escherichia coli CFT073
acgcuucaaccaguu

SEQ ID NO: 623444 - RNA, 19 nt, Escherichia coli CFT073
acgcuucaaucugauauuu

SEQ ID NO: 623445 - RNA, 20 nt, Escherichia coli CFT073
acgcuucaaucugauauuua

SEQ ID NO: 623446 - RNA, 18 nt, Escherichia coli CFT073
acggagcugccaggccgc

SEQ ID NO: 623447 - RNA, 22 nt, Escherichia coli CFT073
acgcuuucaacaaccuugcguu

SEQ ID NO: 623448 - RNA, 15 nt, Escherichia coli CFT073
acggcagaagcagca

SEQ ID NO: 623449 - RNA, 18 nt, Escherichia coli CFT073
acggcagagaaaccacau

SEQ ID NO: 623450 - RNA, 14 nt, Escherichia coli CFT073
acggcagcaacagc

SEQ ID NO: 623451 - RNA, 19 nt, Escherichia coli CFT073
acggcagcaacagcaguuu

SEQ ID NO: 623452 - RNA, 18 nt, Escherichia coli CFT073
acggcugcuucggucagc

SEQ ID NO: 623453 - RNA, 18 nt, Escherichia coli CFT073
acggcugucauccagcag

SEQ ID NO: 623454 - RNA, 19 nt, Escherichia coli CFT073
acggcugucauccagcagu

SEQ ID NO: 623455 - RNA, 12 nt, Escherichia coli CFT073
acggcuguugca

SEQ ID NO: 623456 - RNA, 20 nt, Escherichia coli CFT073
acggcuugcgcgcaaucagc

SEQ ID NO: 623457 - RNA, 22 nt, Escherichia coli CFT073
acggcucgugcgguaucaccac

SEQ ID NO: 623458 - RNA, 14 nt, Escherichia coli CFT073
acggcucagcucug

SEQ ID NO: 623459 - RNA, 14 nt, Escherichia coli CFT073
acggcguugcugcc

SEQ ID NO: 623460 - RNA, 23 nt, Escherichia coli CFT073
acggcaggagagauaccccugcc

SEQ ID NO: 623461 - RNA, 15 nt, Escherichia coli CFT073
acggcgcaccagaau

SEQ ID NO: 623462 - RNA, 14 nt, Escherichia coli CFT073
acggcauuaacgaa

SEQ ID NO: 623463 - RNA, 16 nt, Escherichia coli CFT073
acggcaucaaugccgg

SEQ ID NO: 623464 - RNA, 15 nt, Escherichia coli CFT073
acggcgucagccaca

SEQ ID NO: 623465 - RNA, 17 nt, Escherichia coli CFT073
acggcgucagccacaac

SEQ ID NO: 623466 - RNA, 19 nt, Escherichia coli CFT073
acggcgcuaaaaagcgccg

SEQ ID NO: 623467 - RNA, 17 nt, Escherichia coli CFT073
acgccgguugcgacaga

SEQ ID NO: 623468 - RNA, 22 nt, Escherichia coli CFT073
acgccggugauuaaaccaacca

SEQ ID NO: 623469 - RNA, 16 nt, Escherichia coli CFT073
acgccgucgccuucau

SEQ ID NO: 623470 - RNA, 21 nt, Escherichia coli CFT073
acgccguuuuuacccagcagc

SEQ ID NO: 623471 - RNA, 17 nt, Escherichia coli CFT073
acgccuaacucuugcca

SEQ ID NO: 623472 - RNA, 13 nt, Escherichia coli CFT073
acgccucaggcgc

SEQ ID NO: 623473 - RNA, 23 nt, Escherichia coli CFT073
acgccgcugucuaccagcaccug

SEQ ID NO: 623474 - RNA, 17 nt, Escherichia coli CFT073
acgccgcuuuuuuacgc

SEQ ID NO: 623475 - RNA, 15 nt, Escherichia coli CFT073
acgccggaugcggag

SEQ ID NO: 623476 - RNA, 20 nt, Escherichia coli CFT073
acgccggauggcacaugacu

SEQ ID NO: 623477 - RNA, 22 nt, Escherichia coli CFT073
acgccggauggcacaugacuuc

SEQ ID NO: 623478 - RNA, 18 nt, Escherichia coli CFT073
acgccgggaaauuuuucc

SEQ ID NO: 623479 - RNA, 24 nt, Escherichia coli CFT073
acgccgggaaauuuuuccguuuuc

SEQ ID NO: 623480 - RNA, 15 nt, Escherichia coli CFT073
acgccugcaagcguc

SEQ ID NO: 623481 - RNA, 16 nt, Escherichia coli CFT073
acgccugcaccagccu

SEQ ID NO: 623482 - RNA, 15 nt, Escherichia coli CFT073
acgccugccagcucu

SEQ ID NO: 623483 - RNA, 18 nt, Escherichia coli CFT073
acgcgacaauaccgguua

SEQ ID NO: 623484 - RNA, 14 nt, Escherichia coli CFT073
acgcgaagcacaca

SEQ ID NO: 623485 - RNA, 17 nt, Escherichia coli CFT073
acgccuuuuucuccgag

SEQ ID NO: 623486 - RNA, 16 nt, Escherichia coli CFT073
acgcgaaauaaucaaa

SEQ ID NO: 623487 - RNA, 14 nt, Escherichia coli CFT073
acgccuucccuuuc

SEQ ID NO: 623488 - RNA, 16 nt, Escherichia coli CFT073
acgccuucaauaugga

SEQ ID NO: 623489 - RNA, 15 nt, Escherichia coli CFT073
acgccuuauccgacu

SEQ ID NO: 623490 - RNA, 20 nt, Escherichia coli CFT073
acgccuuauucggccuacca

SEQ ID NO: 623491 - RNA, 15 nt, Escherichia coli CFT073
acgccuuauccgacc

SEQ ID NO: 623492 - RNA, 15 nt, Escherichia coli CFT073
acgccgaccagaccg

SEQ ID NO: 623493 - RNA, 17 nt, Escherichia coli CFT073
acgccgacgcccugcgc

SEQ ID NO: 623494 - RNA, 11 nt, Escherichia coli CFT073
acgcccuuccc

SEQ ID NO: 623495 - RNA, 13 nt, Escherichia coli CFT073
acgcccuuccccc

SEQ ID NO: 623496 - RNA, 16 nt, Escherichia coli CFT073
acgccgaaccauguca

SEQ ID NO: 623497 - RNA, 19 nt, Escherichia coli CFT073
acgccgauaauucucauca

SEQ ID NO: 623498 - RNA, 15 nt, Escherichia coli CFT073
acgccgcauccgaca

SEQ ID NO: 623499 - RNA, 19 nt, Escherichia coli CFT073
acgccgcauccgacaaaau

SEQ ID NO: 623500 - RNA, 18 nt, Escherichia coli CFT073
acgccgagcgccagccau

SEQ ID NO: 623501 - RNA, 15 nt, Escherichia coli CFT073
acgccgcguuugcgc

SEQ ID NO: 623502 - RNA, 20 nt, Escherichia coli CFT073
acgccgccgggucagcgggg

SEQ ID NO: 623503 - RNA, 16 nt, Escherichia coli CFT073
acgccgccagaccaau

SEQ ID NO: 623504 - RNA, 21 nt, Escherichia coli CFT073
acgccgccagaccaauagaaa

SEQ ID NO: 623505 - RNA, 23 nt, Escherichia coli CFT073
acgccgcauccggcgacaggaac

SEQ ID NO: 623506 - RNA, 12 nt, Escherichia coli CFT073
acgcccacgcca

SEQ ID NO: 623507 - RNA, 12 nt, Escherichia coli CFT073
acgcccagcgca

SEQ ID NO: 623508 - RNA, 13 nt, Escherichia coli CFT073
acgcccaguucaa

SEQ ID NO: 623509 - RNA, 21 nt, Escherichia coli CFT073
acgcccauaaauacgucuuua

SEQ ID NO: 623510 - RNA, 21 nt, Escherichia coli CFT073
acgcccccaaaauaaagggua

SEQ ID NO: 623511 - RNA, 15 nt, Escherichia coli CFT073
acgccccagauugcc

SEQ ID NO: 623512 - RNA, 21 nt, Escherichia coli CFT073
acgcccugaugcaucaacauc

SEQ ID NO: 623513 - RNA, 15 nt, Escherichia coli CFT073
acgccaugccaaaga

SEQ ID NO: 623514 - RNA, 16 nt, Escherichia coli CFT073
acgccaugaagauggu

SEQ ID NO: 623515 - RNA, 22 nt, Escherichia coli CFT073
acgccagucgcgaugcagcucg

SEQ ID NO: 623516 - RNA, 19 nt, Escherichia coli CFT073
acgccagugaugucugauu

SEQ ID NO: 623517 - RNA, 15 nt, Escherichia coli CFT073
acgccagcgaagcca

SEQ ID NO: 623518 - RNA, 16 nt, Escherichia coli CFT073
acgccagcgaagccag

SEQ ID NO: 623519 - RNA, 13 nt, Escherichia coli CFT073
acgccagccacaa

SEQ ID NO: 623520 - RNA, 17 nt, Escherichia coli CFT073
acgccacuuuuuucacc

SEQ ID NO: 623521 - RNA, 16 nt, Escherichia coli CFT073
acgccacuggcaauaa

SEQ ID NO: 623522 - RNA, 13 nt, Escherichia coli CFT073
acgccagaaucaa

SEQ ID NO: 623523 - RNA, 18 nt, Escherichia coli CFT073
acgccagaaucaaacugc

SEQ ID NO: 623524 - RNA, 11 nt, Escherichia coli CFT073
acgccaauaau

SEQ ID NO: 623525 - RNA, 17 nt, Escherichia coli CFT073
acgccaagaaacaccag

SEQ ID NO: 623526 - RNA, 15 nt, Escherichia coli CFT073
acgccaaccagcuga

SEQ ID NO: 623527 - RNA, 17 nt, Escherichia coli CFT073
acgccaccaacgcacca

SEQ ID NO: 623528 - RNA, 14 nt, Escherichia coli CFT073
acgccaaucugcaa

SEQ ID NO: 623529 - RNA, 21 nt, Escherichia coli CFT073
acgccaaucugcaaaauacca

SEQ ID NO: 623530 - RNA, 21 nt, Escherichia coli CFT073
acgccaauugccugguuuuuu

SEQ ID NO: 623531 - RNA, 21 nt, Escherichia coli CFT073
acgccaauuuaagugguauug

SEQ ID NO: 623532 - RNA, 15 nt, Escherichia coli CFT073
acgccaccccacacc

SEQ ID NO: 623533 - RNA, 17 nt, Escherichia coli CFT073
acgccaccccacaccag

SEQ ID NO: 623534 - RNA, 17 nt, Escherichia coli CFT073
acgcauccaccagauaa

SEQ ID NO: 623535 - RNA, 16 nt, Escherichia coli CFT073
acgcauaucuucugaa

SEQ ID NO: 623536 - RNA, 19 nt, Escherichia coli CFT073
acgcauucgccguuaccag

SEQ ID NO: 623537 - RNA, 21 nt, Escherichia coli CFT073
acgcauucucuuuucacgcaa

SEQ ID NO: 623538 - RNA, 15 nt, Escherichia coli CFT073
acgcauggucaguug

SEQ ID NO: 623539 - RNA, 21 nt, Escherichia coli CFT073
acgcagacggcuuucuucagc

SEQ ID NO: 623540 - RNA, 17 nt, Escherichia coli CFT073
acgcagagugcgcagca

SEQ ID NO: 623541 - RNA, 14 nt, Escherichia coli CFT073
acgcagaccaaccg

SEQ ID NO: 623542 - RNA, 16 nt, Escherichia coli CFT073
acgcagcaaaagcagg

SEQ ID NO: 623543 - RNA, 23 nt, Escherichia coli CFT073
acgcagaucccacucaucaagca

SEQ ID NO: 623544 - RNA, 17 nt, Escherichia coli CFT073
acgcaggagcagaacag

SEQ ID NO: 623545 - RNA, 16 nt, Escherichia coli CFT073
acgcagcggcggcacu

SEQ ID NO: 623546 - RNA, 19 nt, Escherichia coli CFT073
acgcagcgucaucggccac

SEQ ID NO: 623547 - RNA, 18 nt, Escherichia coli CFT073
acgcagcgauaccggcuc

SEQ ID NO: 623548 - RNA, 17 nt, Escherichia coli CFT073
acgcaguaaacgccagg

SEQ ID NO: 623549 - RNA, 11 nt, Escherichia coli CFT073
acgcaggcugg

SEQ ID NO: 623550 - RNA, 18 nt, Escherichia coli CFT073
acgcaggcggcuggcauc

SEQ ID NO: 623551 - RNA, 14 nt, Escherichia coli CFT073
acgcauaauccagg

SEQ ID NO: 623552 - RNA, 16 nt, Escherichia coli CFT073
acgcauaauccaggca

SEQ ID NO: 623553 - RNA, 16 nt, Escherichia coli CFT073
acgcauacugauuacc

SEQ ID NO: 623554 - RNA, 16 nt, Escherichia coli CFT073
acgcaguugcugacga

SEQ ID NO: 623555 - RNA, 23 nt, Escherichia coli CFT073
acgcaguugcugacgaucggcau

SEQ ID NO: 623556 - RNA, 15 nt, Escherichia coli CFT073
acgcauaaacaucuu

SEQ ID NO: 623557 - RNA, 15 nt, Escherichia coli CFT073
acgcacgccugcauc

SEQ ID NO: 623558 - RNA, 17 nt, Escherichia coli CFT073
acgcaccgggcagggua

SEQ ID NO: 623559 - RNA, 23 nt, Escherichia coli CFT073
acgcacuucuuccgggcuauaca

SEQ ID NO: 623560 - RNA, 21 nt, Escherichia coli CFT073
acgcagaccgaagucaaacug

SEQ ID NO: 623561 - RNA, 13 nt, Escherichia coli CFT073
acgcaccaccagc

SEQ ID NO: 623562 - RNA, 15 nt, Escherichia coli CFT073
acgcaccaugcacgg

SEQ ID NO: 623563 - RNA, 20 nt, Escherichia coli CFT073
acgcacagcccgccgccauc

SEQ ID NO: 623564 - RNA, 12 nt, Escherichia coli CFT073
accggagcugca

SEQ ID NO: 623565 - RNA, 13 nt, Escherichia coli CFT073
accggagcugcag

SEQ ID NO: 623566 - RNA, 14 nt, Escherichia coli CFT073
accggagcugcagc

SEQ ID NO: 623567 - RNA, 23 nt, Escherichia coli CFT073
accggauauagcguaaagccagc

SEQ ID NO: 623568 - RNA, 17 nt, Escherichia coli CFT073
accggaucgaugccaaa

SEQ ID NO: 623569 - RNA, 13 nt, Escherichia coli CFT073
acuguacaacaca

SEQ ID NO: 623570 - RNA, 14 nt, Escherichia coli CFT073
acuguagguaaaac

SEQ ID NO: 623571 - RNA, 19 nt, Escherichia coli CFT073
acugacgauuacguaauuc

SEQ ID NO: 623572 - RNA, 17 nt, Escherichia coli CFT073
acugacgcgcagugccu

SEQ ID NO: 623573 - RNA, 12 nt, Escherichia coli CFT073
acugacgcucug

SEQ ID NO: 623574 - RNA, 16 nt, Escherichia coli CFT073
acugacgcucugcuuu

SEQ ID NO: 623575 - RNA, 20 nt, Escherichia coli CFT073
acugacgggaaacucugcug

SEQ ID NO: 623576 - RNA, 23 nt, Escherichia coli CFT073
acuguaucgacguaguacccucu

SEQ ID NO: 623577 - RNA, 23 nt, Escherichia coli CFT073
acuguauacgggcuuuuuaauuc

SEQ ID NO: 623578 - RNA, 19 nt, Escherichia coli CFT073
acuguccacgacagaaccc

SEQ ID NO: 623579 - RNA, 14 nt, Escherichia coli CFT073
acugucccauccac

SEQ ID NO: 623580 - RNA, 17 nt, Escherichia coli CFT073
acuuaaugccaguucag

SEQ ID NO: 623581 - RNA, 17 nt, Escherichia coli CFT073
acuguuuauuguugauu

SEQ ID NO: 623582 - RNA, 20 nt, Escherichia coli CFT073
acuguuggcuugugcgcccg

SEQ ID NO: 623583 - RNA, 15 nt, Escherichia coli CFT073
acuguuucgcggcaa

SEQ ID NO: 623584 - RNA, 18 nt, Escherichia coli CFT073
acuguuugaucugcugcc

SEQ ID NO: 623585 - RNA, 23 nt, Escherichia coli CFT073
acuuaccuccugucuaaccgccu

SEQ ID NO: 623586 - RNA, 14 nt, Escherichia coli CFT073
acuuaccuucacga

SEQ ID NO: 623587 - RNA, 13 nt, Escherichia coli CFT073
acuuacucauuaa

SEQ ID NO: 623588 - RNA, 19 nt, Escherichia coli CFT073
acuuaaugguucugcacag

SEQ ID NO: 623589 - RNA, 21 nt, Escherichia coli CFT073
acuuacaucugucugauaaaa

SEQ ID NO: 623590 - RNA, 22 nt, Escherichia coli CFT073
acuuacuuagugcacuucuuca

SEQ ID NO: 623591 - RNA, 13 nt, Escherichia coli CFT073
acuuacuuuccua

SEQ ID NO: 623592 - RNA, 15 nt, Escherichia coli CFT073
acuuaugcagcugcu

SEQ ID NO: 623593 - RNA, 19 nt, Escherichia coli CFT073
acuuaugcccgcuauccuc

SEQ ID NO: 623594 - RNA, 13 nt, Escherichia coli CFT073
acuuauucaccac

SEQ ID NO: 623595 - RNA, 22 nt, Escherichia coli CFT073
acuuauucaccaccaucaaaug

SEQ ID NO: 623596 - RNA, 18 nt, Escherichia coli CFT073
acuuauugaaagcaaaaa

SEQ ID NO: 623597 - RNA, 22 nt, Escherichia coli CFT073
acuucauccggauacagcccca

SEQ ID NO: 623598 - RNA, 22 nt, Escherichia coli CFT073
acuucauacauugccagacggg

SEQ ID NO: 623599 - RNA, 20 nt, Escherichia coli CFT073
acuucauuaucuucuuucuc

SEQ ID NO: 623600 - RNA, 15 nt, Escherichia coli CFT073
acuucauucagaaaa

SEQ ID NO: 623601 - RNA, 17 nt, Escherichia coli CFT073
acuucauucagaaaaac

SEQ ID NO: 623602 - RNA, 22 nt, Escherichia coli CFT073
acuucauuugucucaaaacuga

SEQ ID NO: 623603 - RNA, 23 nt, Escherichia coli CFT073
acuucauuugucucaaaacugaa

SEQ ID NO: 623604 - RNA, 22 nt, Escherichia coli CFT073
acuucaugaccuuccagcgcug

SEQ ID NO: 623605 - RNA, 12 nt, Escherichia coli CFT073
acuucaugcccc

SEQ ID NO: 623606 - RNA, 13 nt, Escherichia coli CFT073
acuucaaccacau

SEQ ID NO: 623607 - RNA, 13 nt, Escherichia coli CFT073
acuucaaauuuca

SEQ ID NO: 623608 - RNA, 14 nt, Escherichia coli CFT073
acuucaaccacauu

SEQ ID NO: 623609 - RNA, 14 nt, Escherichia coli CFT073
acuuggucgaauac

SEQ ID NO: 623610 - RNA, 14 nt, Escherichia coli CFT073
acuugccuccagcg

SEQ ID NO: 623611 - RNA, 14 nt, Escherichia coli CFT073
acuugccugugacc

SEQ ID NO: 623612 - RNA, 23 nt, Escherichia coli CFT073
acuugccugugaccgcugcugcc

SEQ ID NO: 623613 - RNA, 14 nt, Escherichia coli CFT073
acuugcggcaccca

SEQ ID NO: 623614 - RNA, 14 nt, Escherichia coli CFT073
acuugcucaagcca

SEQ ID NO: 623615 - RNA, 14 nt, Escherichia coli CFT073
acuucuuuuugaac

SEQ ID NO: 623616 - RNA, 12 nt, Escherichia coli CFT073
acuugccaggcc

SEQ ID NO: 623617 - RNA, 22 nt, Escherichia coli CFT073
acuugccggagauucaaagacu

SEQ ID NO: 623618 - RNA, 15 nt, Escherichia coli CFT073
acuucucuucuuccg

SEQ ID NO: 623619 - RNA, 23 nt, Escherichia coli CFT073
acuucucuucuuccgcuucaauc

SEQ ID NO: 623620 - RNA, 15 nt, Escherichia coli CFT073
acuucuucacaucaa

SEQ ID NO: 623621 - RNA, 16 nt, Escherichia coli CFT073
acuucuucacaucaau

SEQ ID NO: 623622 - RNA, 22 nt, Escherichia coli CFT073
acuucuuagucccaaacagcag

SEQ ID NO: 623623 - RNA, 22 nt, Escherichia coli CFT073
acuucuguuuguagaugcccau

SEQ ID NO: 623624 - RNA, 16 nt, Escherichia coli CFT073
acuucuucuguuucug

SEQ ID NO: 623625 - RNA, 21 nt, Escherichia coli CFT073
acuuccaccagcggcugaaua

SEQ ID NO: 623626 - RNA, 17 nt, Escherichia coli CFT073
acuuccacguuccccag

SEQ ID NO: 623627 - RNA, 15 nt, Escherichia coli CFT073
acuucgguuaccaca

SEQ ID NO: 623628 - RNA, 22 nt, Escherichia coli CFT073
acuucggcagagaaagcaaaaa

SEQ ID NO: 623629 - RNA, 13 nt, Escherichia coli CFT073
acuuccagcuuca

SEQ ID NO: 623630 - RNA, 23 nt, Escherichia coli CFT073
acuuccagcguagugaaggcaaa

SEQ ID NO: 623631 - RNA, 22 nt, Escherichia coli CFT073
acuucgcugguguacugcaacu

SEQ ID NO: 623632 - RNA, 17 nt, Escherichia coli CFT073
acuuugccgucugccac

SEQ ID NO: 623633 - RNA, 12 nt, Escherichia coli CFT073
acuuuguaggcc

SEQ ID NO: 623634 - RNA, 18 nt, Escherichia coli CFT073
acuuuguaggccugauaa

SEQ ID NO: 623635 - RNA, 19 nt, Escherichia coli CFT073
acuuuguaggccugauaag

SEQ ID NO: 623636 - RNA, 13 nt, Escherichia coli CFT073
acuuugcaaugag

SEQ ID NO: 623637 - RNA, 15 nt, Escherichia coli CFT073
acuuugagaaacguu

SEQ ID NO: 623638 - RNA, 20 nt, Escherichia coli CFT073
acuuugaucgcguuuuuugu

SEQ ID NO: 623639 - RNA, 17 nt, Escherichia coli CFT073
acuuugucaucagucag

SEQ ID NO: 623640 - RNA, 21 nt, Escherichia coli CFT073
acuuugucaucagucagagcc

SEQ ID NO: 623641 - RNA, 17 nt, Escherichia coli CFT073
acuuuuaaaucgccaag

SEQ ID NO: 623642 - RNA, 16 nt, Escherichia coli CFT073
acuuuguuccugaauu

SEQ ID NO: 623643 - RNA, 17 nt, Escherichia coli CFT073
acuuuguugaacacaac

SEQ ID NO: 623644 - RNA, 22 nt, Escherichia coli CFT073
acuuuuaguaaacaauugcaua

SEQ ID NO: 623645 - RNA, 16 nt, Escherichia coli CFT073
acuuucucuucaucua

SEQ ID NO: 623646 - RNA, 18 nt, Escherichia coli CFT073
acuuucucuucaucuaua

SEQ ID NO: 623647 - RNA, 12 nt, Escherichia coli CFT073
acuuucuugcca

SEQ ID NO: 623648 - RNA, 13 nt, Escherichia coli CFT073
acuuucuugccac

SEQ ID NO: 623649 - RNA, 14 nt, Escherichia coli CFT073
acuuucgacuucaa

SEQ ID NO: 623650 - RNA, 21 nt, Escherichia coli CFT073
acuuucgagcaauuuuccuug

SEQ ID NO: 623651 - RNA, 13 nt, Escherichia coli CFT073
acuuuccuuccuc

SEQ ID NO: 623652 - RNA, 16 nt, Escherichia coli CFT073
acuuucggauuacugc

SEQ ID NO: 623653 - RNA, 22 nt, Escherichia coli CFT073
acuuucggcagaaaauccacca

SEQ ID NO: 623654 - RNA, 20 nt, Escherichia coli CFT073
acuuuccuaaacuccucgcc

SEQ ID NO: 623655 - RNA, 13 nt, Escherichia coli CFT073
acuuuccagccac

SEQ ID NO: 623656 - RNA, 14 nt, Escherichia coli CFT073
acuuuccagccaca

SEQ ID NO: 623657 - RNA, 20 nt, Escherichia coli CFT073
acuuuccagccacaguucga

SEQ ID NO: 623658 - RNA, 15 nt, Escherichia coli CFT073
acuuuaccugccuga

SEQ ID NO: 623659 - RNA, 15 nt, Escherichia coli CFT073
acuuuauagaucagg

SEQ ID NO: 623660 - RNA, 13 nt, Escherichia coli CFT073
acuuucagaugca

SEQ ID NO: 623661 - RNA, 22 nt, Escherichia coli CFT073
acuuucaguggcuuaucuuccu

SEQ ID NO: 623662 - RNA, 11 nt, Escherichia coli CFT073
acuuucaucaa

SEQ ID NO: 623663 - RNA, 20 nt, Escherichia coli CFT073
acuuucaugcucaagcugac

SEQ ID NO: 623664 - RNA, 21 nt, Escherichia coli CFT073
acuuucaucgcggucagcugc

SEQ ID NO: 623665 - RNA, 18 nt, Escherichia coli CFT073
acuuguuuacaaauaauu

SEQ ID NO: 623666 - RNA, 22 nt, Escherichia coli CFT073
acuuuaaaaaaauuaauuuuuu

SEQ ID NO: 623667 - RNA, 23 nt, Escherichia coli CFT073
acuuuaaaaaaauuaauuuuuua

SEQ ID NO: 623668 - RNA, 14 nt, Escherichia coli CFT073
acuuuaaaauaagc

SEQ ID NO: 623669 - RNA, 23 nt, Escherichia coli CFT073
acuuuaaaauaagcacaaagcaa

SEQ ID NO: 623670 - RNA, 18 nt, Escherichia coli CFT073
acuuuaaaaucuuugaaa

SEQ ID NO: 623671 - RNA, 16 nt, Escherichia coli CFT073
acuuuaaucaccugcc

SEQ ID NO: 623672 - RNA, 16 nt, Escherichia coli CFT073
acuuuaauuuugugca

SEQ ID NO: 623673 - RNA, 20 nt, Escherichia coli CFT073
acuuuaauuuugugcagcac

SEQ ID NO: 623674 - RNA, 16 nt, Escherichia coli CFT073
acuuuaccgguuucaa

SEQ ID NO: 623675 - RNA, 21 nt, Escherichia coli CFT073
acuuuaccgguuucaauccag

SEQ ID NO: 623676 - RNA, 13 nt, Escherichia coli CFT073
acuuuaccgcaau

SEQ ID NO: 623677 - RNA, 18 nt, Escherichia coli CFT073
agaaauagcggaaagcgu

SEQ ID NO: 623678 - RNA, 19 nt, Escherichia coli CFT073
agaaauacgcccugaccgu

SEQ ID NO: 623679 - RNA, 18 nt, Escherichia coli CFT073
agaaauagaccggagaaa

SEQ ID NO: 623680 - RNA, 14 nt, Escherichia coli CFT073
agaaaucaacaaau

SEQ ID NO: 623681 - RNA, 23 nt, Escherichia coli CFT073
agaaaucagacuuugaauaaagc

SEQ ID NO: 623682 - RNA, 15 nt, Escherichia coli CFT073
agaaaucagauaaaa

SEQ ID NO: 623683 - RNA, 15 nt, Escherichia coli CFT073
agaaaucagcaggcu

SEQ ID NO: 623684 - RNA, 17 nt, Escherichia coli CFT073
agaaaucuaucgccggu

SEQ ID NO: 623685 - RNA, 21 nt, Escherichia coli CFT073
agaaaucgacauugaugaaaa

SEQ ID NO: 623686 - RNA, 22 nt, Escherichia coli CFT073
agaaaucccccagcaucacgcc

SEQ ID NO: 623687 - RNA, 22 nt, Escherichia coli CFT073
agaaauccggggcaauuucagu

SEQ ID NO: 623688 - RNA, 15 nt, Escherichia coli CFT073
agaaaccagccacgg

SEQ ID NO: 623689 - RNA, 12 nt, Escherichia coli CFT073
agaaaccacauc

SEQ ID NO: 623690 - RNA, 17 nt, Escherichia coli CFT073
agaaacauccccagcgu

SEQ ID NO: 623691 - RNA, 19 nt, Escherichia coli CFT073
agaaacaucggcaguaaug

SEQ ID NO: 623692 - RNA, 16 nt, Escherichia coli CFT073
agaaaguggcacacac

SEQ ID NO: 623693 - RNA, 21 nt, Escherichia coli CFT073
agaaaguucgacaacuuuugc

SEQ ID NO: 623694 - RNA, 15 nt, Escherichia coli CFT073
agaaaguuuuucaac

SEQ ID NO: 623695 - RNA, 13 nt, Escherichia coli CFT073
agaaaguuguuuu

SEQ ID NO: 623696 - RNA, 16 nt, Escherichia coli CFT073
agaaaaaaagcaucug

SEQ ID NO: 623697 - RNA, 13 nt, Escherichia coli CFT073
acuuuucagauug

SEQ ID NO: 623698 - RNA, 16 nt, Escherichia coli CFT073
acuuuucgcacugcag

SEQ ID NO: 623699 - RNA, 22 nt, Escherichia coli CFT073
agaaaaccaaaaccggcucuau

SEQ ID NO: 623700 - RNA, 15 nt, Escherichia coli CFT073
agaaaacauuuuaaa

SEQ ID NO: 623701 - RNA, 14 nt, Escherichia coli CFT073
agaaacaaaugaaa

SEQ ID NO: 623702 - RNA, 23 nt, Escherichia coli CFT073
agaaaacgaaagcgccaucaaug

SEQ ID NO: 623703 - RNA, 22 nt, Escherichia coli CFT073
agaaaagaacuauugaagccca

SEQ ID NO: 623704 - RNA, 19 nt, Escherichia coli CFT073
agaaaagaccagccagcaa

SEQ ID NO: 623705 - RNA, 13 nt, Escherichia coli CFT073
agaaaagauaagu

SEQ ID NO: 623706 - RNA, 15 nt, Escherichia coli CFT073
agauaagcaacaaac

SEQ ID NO: 623707 - RNA, 12 nt, Escherichia coli CFT073
agauaagcaagg

SEQ ID NO: 623708 - RNA, 22 nt, Escherichia coli CFT073
agauaacuuaguuaaucaguuu

SEQ ID NO: 623709 - RNA, 20 nt, Escherichia coli CFT073
agauaacguugaugcaggca

SEQ ID NO: 623710 - RNA, 19 nt, Escherichia coli CFT073
agauaaccacguucauuuc

SEQ ID NO: 623711 - RNA, 20 nt, Escherichia coli CFT073
agauaaccacuggcacaaga

SEQ ID NO: 623712 - RNA, 16 nt, Escherichia coli CFT073
agauaacccagcagcc

SEQ ID NO: 623713 - RNA, 19 nt, Escherichia coli CFT073
agauaaccuguuuauuaug

SEQ ID NO: 623714 - RNA, 23 nt, Escherichia coli CFT073
agauaacgagcaugauacucagc

SEQ ID NO: 623715 - RNA, 13 nt, Escherichia coli CFT073
agauaaaacacau

SEQ ID NO: 623716 - RNA, 23 nt, Escherichia coli CFT073
agaguuacuggcgaguauugcuu

SEQ ID NO: 623717 - RNA, 22 nt, Escherichia coli CFT073
agauaaaauaaccgucuuugcu

SEQ ID NO: 623718 - RNA, 14 nt, Escherichia coli CFT073
agauaaaaugcgaa

SEQ ID NO: 623719 - RNA, 15 nt, Escherichia coli CFT073
agauaaaaugcgaaa

SEQ ID NO: 623720 - RNA, 20 nt, Escherichia coli CFT073
agaguacguucacuuuucuu

SEQ ID NO: 623721 - RNA, 20 nt, Escherichia coli CFT073
agaguaaugguuuguuuggc

SEQ ID NO: 623722 - RNA, 13 nt, Escherichia coli CFT073
agagugcgcagca

SEQ ID NO: 623723 - RNA, 18 nt, Escherichia coli CFT073
agaguggauuaucuucac

SEQ ID NO: 623724 - RNA, 14 nt, Escherichia coli CFT073
agagguuuucaacu

SEQ ID NO: 623725 - RNA, 22 nt, Escherichia coli CFT073
agagguuaaucccuugagugac

SEQ ID NO: 623726 - RNA, 15 nt, Escherichia coli CFT073
agaggugauaugaau

SEQ ID NO: 623727 - RNA, 17 nt, Escherichia coli CFT073
agaggugauaugaauga

SEQ ID NO: 623728 - RNA, 13 nt, Escherichia coli CFT073
agaggcgagggga

SEQ ID NO: 623729 - RNA, 23 nt, Escherichia coli CFT073
agaggcugaaggcgcuccccugc

SEQ ID NO: 623730 - RNA, 13 nt, Escherichia coli CFT073
agaggaggacagc

SEQ ID NO: 623731 - RNA, 14 nt, Escherichia coli CFT073
agaggaggagagca

SEQ ID NO: 623732 - RNA, 22 nt, Escherichia coli CFT073
agagcuuuuuuguucuguaauc

SEQ ID NO: 623733 - RNA, 20 nt, Escherichia coli CFT073
agaggccgccguaggagugc

SEQ ID NO: 623734 - RNA, 16 nt, Escherichia coli CFT073
agagcucaucagguau

SEQ ID NO: 623735 - RNA, 14 nt, Escherichia coli CFT073
agagcgcugcgcag

SEQ ID NO: 623736 - RNA, 14 nt, Escherichia coli CFT073
agagcggagcaaug

SEQ ID NO: 623737 - RNA, 15 nt, Escherichia coli CFT073
agagcggagcaauga

SEQ ID NO: 623738 - RNA, 19 nt, Escherichia coli CFT073
agagacauuggcaaaacca

SEQ ID NO: 623739 - RNA, 22 nt, Escherichia coli CFT073
agagacauuggcaaaaccaaac

SEQ ID NO: 623740 - RNA, 15 nt, Escherichia coli CFT073
agagccagagacacu

SEQ ID NO: 623741 - RNA, 12 nt, Escherichia coli CFT073
agagcccaugcg

SEQ ID NO: 623742 - RNA, 13 nt, Escherichia coli CFT073
agacuuuucagau

SEQ ID NO: 623743 - RNA, 23 nt, Escherichia coli CFT073
agacuuuuuucaugggugccgga

SEQ ID NO: 623744 - RNA, 12 nt, Escherichia coli CFT073
agagaaaaccac

SEQ ID NO: 623745 - RNA, 13 nt, Escherichia coli CFT073
agagaaaaucaca

SEQ ID NO: 623746 - RNA, 14 nt, Escherichia coli CFT073
agagaaaaucacac

SEQ ID NO: 623747 - RNA, 22 nt, Escherichia coli CFT073
agagaaaaugccgcacaucacc

SEQ ID NO: 623748 - RNA, 15 nt, Escherichia coli CFT073
agagaaaccacauca

SEQ ID NO: 623749 - RNA, 16 nt, Escherichia coli CFT073
agagaaaccacaucaa

SEQ ID NO: 623750 - RNA, 18 nt, Escherichia coli CFT073
agagaaacgccagcagca

SEQ ID NO: 623751 - RNA, 13 nt, Escherichia coli CFT073
agagaauguaaau

SEQ ID NO: 623752 - RNA, 17 nt, Escherichia coli CFT073
agagaauuaaccagaaa

SEQ ID NO: 623753 - RNA, 21 nt, Escherichia coli CFT073
agagaauauuaacggucauuc

SEQ ID NO: 623754 - RNA, 16 nt, Escherichia coli CFT073
agagaacugugccaga

SEQ ID NO: 623755 - RNA, 15 nt, Escherichia coli CFT073
agagaagaaaaccga

SEQ ID NO: 623756 - RNA, 14 nt, Escherichia coli CFT073
agagaaccagcgca

SEQ ID NO: 623757 - RNA, 13 nt, Escherichia coli CFT073
agacgcucuuuca

SEQ ID NO: 623758 - RNA, 23 nt, Escherichia coli CFT073
agacgcugauucacuuucugaag

SEQ ID NO: 623759 - RNA, 21 nt, Escherichia coli CFT073
agacgcugcaccugcucaggc

SEQ ID NO: 623760 - RNA, 19 nt, Escherichia coli CFT073
agacgcggcacuccgccac

SEQ ID NO: 623761 - RNA, 13 nt, Escherichia coli CFT073
agacgcgguggga

SEQ ID NO: 623762 - RNA, 15 nt, Escherichia coli CFT073
agacgcgcugaguca

SEQ ID NO: 623763 - RNA, 22 nt, Escherichia coli CFT073
agacgccccaguaaacacacca

SEQ ID NO: 623764 - RNA, 14 nt, Escherichia coli CFT073
agacucauuaaaac

SEQ ID NO: 623765 - RNA, 12 nt, Escherichia coli CFT073
agacucauugua

SEQ ID NO: 623766 - RNA, 15 nt, Escherichia coli CFT073
agacucauuguaucu

SEQ ID NO: 623767 - RNA, 11 nt, Escherichia coli CFT073
agacuccagca

SEQ ID NO: 623768 - RNA, 14 nt, Escherichia coli CFT073
agacuccgguuuuu

SEQ ID NO: 623769 - RNA, 17 nt, Escherichia coli CFT073
agacucucgccagagau

SEQ ID NO: 623770 - RNA, 16 nt, Escherichia coli CFT073
agacugauagccucuu

SEQ ID NO: 623771 - RNA, 14 nt, Escherichia coli CFT073
agacuguugaaaua

SEQ ID NO: 623772 - RNA, 16 nt, Escherichia coli CFT073
agacuguugaaauaca

SEQ ID NO: 623773 - RNA, 16 nt, Escherichia coli CFT073
agacugcgcauuaaau

SEQ ID NO: 623774 - RNA, 16 nt, Escherichia coli CFT073
agaccugucucuuaua

SEQ ID NO: 623775 - RNA, 15 nt, Escherichia coli CFT073
agaccuucugccaga

SEQ ID NO: 623776 - RNA, 14 nt, Escherichia coli CFT073
agaccuuccgcagg

SEQ ID NO: 623777 - RNA, 14 nt, Escherichia coli CFT073
agaccuuccagaaa

SEQ ID NO: 623778 - RNA, 19 nt, Escherichia coli CFT073
agacgcaucgcccagccau

SEQ ID NO: 623779 - RNA, 17 nt, Escherichia coli CFT073
agacgaaugaagcagaa

SEQ ID NO: 623780 - RNA, 21 nt, Escherichia coli CFT073
agacgccacuuuuuucaccca

SEQ ID NO: 623781 - RNA, 20 nt, Escherichia coli CFT073
agacgccagaaccgagcaca

SEQ ID NO: 623782 - RNA, 17 nt, Escherichia coli CFT073
agacgaaccggcaccca

SEQ ID NO: 623783 - RNA, 16 nt, Escherichia coli CFT073
agaccgcuuuccucau

SEQ ID NO: 623784 - RNA, 13 nt, Escherichia coli CFT073
agaccggcaacca

SEQ ID NO: 623785 - RNA, 18 nt, Escherichia coli CFT073
agaccggcaaccagcacc

SEQ ID NO: 623786 - RNA, 23 nt, Escherichia coli CFT073
agaccggcaaucgcgccagaaca

SEQ ID NO: 623787 - RNA, 19 nt, Escherichia coli CFT073
agacauuccccgccaggaa

SEQ ID NO: 623788 - RNA, 22 nt, Escherichia coli CFT073
agacauuacguccaucacaauc

SEQ ID NO: 623789 - RNA, 19 nt, Escherichia coli CFT073
agacauuggcaaaaccaaa

SEQ ID NO: 623790 - RNA, 20 nt, Escherichia coli CFT073
agacauuggcaaaaccaaac

SEQ ID NO: 623791 - RNA, 17 nt, Escherichia coli CFT073
agaccaaagucaaacug

SEQ ID NO: 623792 - RNA, 18 nt, Escherichia coli CFT073
agaccaacacccacagcc

SEQ ID NO: 623793 - RNA, 21 nt, Escherichia coli CFT073
agaccaaaacgugcagcugcc

SEQ ID NO: 623794 - RNA, 22 nt, Escherichia coli CFT073
agaccaaaacgugcagcugccu

SEQ ID NO: 623795 - RNA, 21 nt, Escherichia coli CFT073
agaccaaacucuucgacaauc

SEQ ID NO: 623796 - RNA, 18 nt, Escherichia coli CFT073
agaccaauccgccagcca

SEQ ID NO: 623797 - RNA, 22 nt, Escherichia coli CFT073
agacaaaugucagaaagaaauu

SEQ ID NO: 623798 - RNA, 19 nt, Escherichia coli CFT073
agacaacauugauuucuua

SEQ ID NO: 623799 - RNA, 21 nt, Escherichia coli CFT073
agacaacauugauuucuuauu

SEQ ID NO: 623800 - RNA, 20 nt, Escherichia coli CFT073
agacaaaacauacccaguuu

SEQ ID NO: 623801 - RNA, 12 nt, Escherichia coli CFT073
agaauuugcucu

SEQ ID NO: 623802 - RNA, 13 nt, Escherichia coli CFT073
agaauuaucauuu

SEQ ID NO: 623803 - RNA, 16 nt, Escherichia coli CFT073
agaauuaaaauaucag

SEQ ID NO: 623804 - RNA, 14 nt, Escherichia coli CFT073
agaauuaacgcuga

SEQ ID NO: 623805 - RNA, 21 nt, Escherichia coli CFT073
agacaauguaucuuucaucau

SEQ ID NO: 623806 - RNA, 22 nt, Escherichia coli CFT073
agacaauguaucuuucaucauu

SEQ ID NO: 623807 - RNA, 13 nt, Escherichia coli CFT073
agacaauuaacac

SEQ ID NO: 623808 - RNA, 17 nt, Escherichia coli CFT073
agacacaacaauaccgu

SEQ ID NO: 623809 - RNA, 23 nt, Escherichia coli CFT073
agacaccaaucagcccugcccag

SEQ ID NO: 623810 - RNA, 15 nt, Escherichia coli CFT073
agacaccauguccau

SEQ ID NO: 623811 - RNA, 15 nt, Escherichia coli CFT073
agacaccggcuuuca

SEQ ID NO: 623812 - RNA, 12 nt, Escherichia coli CFT073
agacacgccagu

SEQ ID NO: 623813 - RNA, 21 nt, Escherichia coli CFT073
agacagauguaaguaauuauu

SEQ ID NO: 623814 - RNA, 14 nt, Escherichia coli CFT073
agacagauuuauaa

SEQ ID NO: 623815 - RNA, 22 nt, Escherichia coli CFT073
agacaucgcccgauucacauaa

SEQ ID NO: 623816 - RNA, 15 nt, Escherichia coli CFT073
agacaucgcuggagg

SEQ ID NO: 623817 - RNA, 15 nt, Escherichia coli CFT073
agacagccuaccaga

SEQ ID NO: 623818 - RNA, 17 nt, Escherichia coli CFT073
agacagcgucacaucag

SEQ ID NO: 623819 - RNA, 13 nt, Escherichia coli CFT073
agaaguucuccau

SEQ ID NO: 623820 - RNA, 22 nt, Escherichia coli CFT073
agaaguguacgaacacgucuuu

SEQ ID NO: 623821 - RNA, 16 nt, Escherichia coli CFT073
agaauaaaacaagcag

SEQ ID NO: 623822 - RNA, 19 nt, Escherichia coli CFT073
agaauaacgcggcaggaga

SEQ ID NO: 623823 - RNA, 22 nt, Escherichia coli CFT073
agaauaacggcugauaacaaua

SEQ ID NO: 623824 - RNA, 19 nt, Escherichia coli CFT073
agaauagcggcuucaucuu

SEQ ID NO: 623825 - RNA, 18 nt, Escherichia coli CFT073
agaauaagcuauaaaaaa

SEQ ID NO: 623826 - RNA, 19 nt, Escherichia coli CFT073
agaauaucguuguuggcuu

SEQ ID NO: 623827 - RNA, 13 nt, Escherichia coli CFT073
agaauauaggcac

SEQ ID NO: 623828 - RNA, 23 nt, Escherichia coli CFT073
agaauauacggaaugauauuggu

SEQ ID NO: 623829 - RNA, 16 nt, Escherichia coli CFT073
agaaucaugccaaaaa

SEQ ID NO: 623830 - RNA, 17 nt, Escherichia coli CFT073
agaaucaugccaaaaau

SEQ ID NO: 623831 - RNA, 16 nt, Escherichia coli CFT073
agaauccagccccacc

SEQ ID NO: 623832 - RNA, 20 nt, Escherichia coli CFT073
agaauccagccccaccagca

SEQ ID NO: 623833 - RNA, 17 nt, Escherichia coli CFT073
agaaugacaucaucgcc

SEQ ID NO: 623834 - RNA, 20 nt, Escherichia coli CFT073
agaaucaucauaucgucauu

SEQ ID NO: 623835 - RNA, 17 nt, Escherichia coli CFT073
agaaucaccggagcugc

SEQ ID NO: 623836 - RNA, 13 nt, Escherichia coli CFT073
agaaucaccucuu

SEQ ID NO: 623837 - RNA, 20 nt, Escherichia coli CFT073
agaaucacgccaacaaauag

SEQ ID NO: 623838 - RNA, 17 nt, Escherichia coli CFT073
agaaugcagcagcaaac

SEQ ID NO: 623839 - RNA, 16 nt, Escherichia coli CFT073
agaaugccgaaaucaa

SEQ ID NO: 623840 - RNA, 13 nt, Escherichia coli CFT073
agaaugugaugcc

SEQ ID NO: 623841 - RNA, 19 nt, Escherichia coli CFT073
agaaauggcuggcagcaga

SEQ ID NO: 623842 - RNA, 11 nt, Escherichia coli CFT073
agaaauuaaac

SEQ ID NO: 623843 - RNA, 14 nt, Escherichia coli CFT073
agaaauuaaacugu

SEQ ID NO: 623844 - RNA, 13 nt, Escherichia coli CFT073
agaagaggagagu

SEQ ID NO: 623845 - RNA, 20 nt, Escherichia coli CFT073
agaagauccaugaagcaaug

SEQ ID NO: 623846 - RNA, 16 nt, Escherichia coli CFT073
agaagugcucuuugcc

SEQ ID NO: 623847 - RNA, 17 nt, Escherichia coli CFT073
agaaguggugauucagu

SEQ ID NO: 623848 - RNA, 12 nt, Escherichia coli CFT073
agaagccaggua

SEQ ID NO: 623849 - RNA, 22 nt, Escherichia coli CFT073
agaagccaguacacgcugaaga

SEQ ID NO: 623850 - RNA, 19 nt, Escherichia coli CFT073
agaagccauuaaacaccag

SEQ ID NO: 623851 - RNA, 17 nt, Escherichia coli CFT073
agaagccgggcagguga

SEQ ID NO: 623852 - RNA, 17 nt, Escherichia coli CFT073
agcaaccggugucauca

SEQ ID NO: 623853 - RNA, 22 nt, Escherichia coli CFT073
agcaaccggauuuuuaugacgc

SEQ ID NO: 623854 - RNA, 13 nt, Escherichia coli CFT073
agcaaccggggca

SEQ ID NO: 623855 - RNA, 16 nt, Escherichia coli CFT073
agcaaccggggcauuc

SEQ ID NO: 623856 - RNA, 13 nt, Escherichia coli CFT073
agcaaccagguua

SEQ ID NO: 623857 - RNA, 16 nt, Escherichia coli CFT073
agcaaccacaaccuca

SEQ ID NO: 623858 - RNA, 12 nt, Escherichia coli CFT073
agcaacaacagc

SEQ ID NO: 623859 - RNA, 11 nt, Escherichia coli CFT073
agcaacaacag

SEQ ID NO: 623860 - RNA, 19 nt, Escherichia coli CFT073
agcaacaauuugcggucca

SEQ ID NO: 623861 - RNA, 22 nt, Escherichia coli CFT073
agcaacacgccagcguuauccc

SEQ ID NO: 623862 - RNA, 13 nt, Escherichia coli CFT073
agcaacagcaaag

SEQ ID NO: 623863 - RNA, 19 nt, Escherichia coli CFT073
agcaacagcaaagagagca

SEQ ID NO: 623864 - RNA, 20 nt, Escherichia coli CFT073
agcaaauuaucccccagcac

SEQ ID NO: 623865 - RNA, 20 nt, Escherichia coli CFT073
agcaaauuccucaaacgugc

SEQ ID NO: 623866 - RNA, 18 nt, Escherichia coli CFT073
agcaaauucuaagcugac

SEQ ID NO: 623867 - RNA, 19 nt, Escherichia coli CFT073
agcaaauucuaagcugacu

SEQ ID NO: 623868 - RNA, 12 nt, Escherichia coli CFT073
agcaaauuuuua

SEQ ID NO: 623869 - RNA, 15 nt, Escherichia coli CFT073
agcaacaaacucauu

SEQ ID NO: 623870 - RNA, 19 nt, Escherichia coli CFT073
agcaacaaacucauuaauc

SEQ ID NO: 623871 - RNA, 23 nt, Escherichia coli CFT073
agcaagaaacugaucauuaucac

SEQ ID NO: 623872 - RNA, 19 nt, Escherichia coli CFT073
agcaacuuaaucaucaaug

SEQ ID NO: 623873 - RNA, 14 nt, Escherichia coli CFT073
agcaagaaccaugc

SEQ ID NO: 623874 - RNA, 13 nt, Escherichia coli CFT073
agcaagagcaaau

SEQ ID NO: 623875 - RNA, 13 nt, Escherichia coli CFT073
agcaacucugcua

SEQ ID NO: 623876 - RNA, 14 nt, Escherichia coli CFT073
agcaacuggcuugc

SEQ ID NO: 623877 - RNA, 21 nt, Escherichia coli CFT073
agcaacuguaacgcagaaggu

SEQ ID NO: 623878 - RNA, 22 nt, Escherichia coli CFT073
agcaacuuaaucaucaaugcca

SEQ ID NO: 623879 - RNA, 18 nt, Escherichia coli CFT073
agcaacgccuaaacugau

SEQ ID NO: 623880 - RNA, 18 nt, Escherichia coli CFT073
agcaacgcugauuucucu

SEQ ID NO: 623881 - RNA, 17 nt, Escherichia coli CFT073
agcaacgcuucaaccag

SEQ ID NO: 623882 - RNA, 15 nt, Escherichia coli CFT073
agcaacggaaaagca

SEQ ID NO: 623883 - RNA, 21 nt, Escherichia coli CFT073
agcaaccugcacguuaucaga

SEQ ID NO: 623884 - RNA, 16 nt, Escherichia coli CFT073
agcaauggacaccagg

SEQ ID NO: 623885 - RNA, 22 nt, Escherichia coli CFT073
agcaauggacaccaggcaagaa

SEQ ID NO: 623886 - RNA, 20 nt, Escherichia coli CFT073
agcaauggcacugucgagau

SEQ ID NO: 623887 - RNA, 20 nt, Escherichia coli CFT073
agcaauguagccuguuuuuu

SEQ ID NO: 623888 - RNA, 17 nt, Escherichia coli CFT073
agcaauuaacagugaca

SEQ ID NO: 623889 - RNA, 12 nt, Escherichia coli CFT073
agcaaugcacac

SEQ ID NO: 623890 - RNA, 16 nt, Escherichia coli CFT073
agcaaugcccugugau

SEQ ID NO: 623891 - RNA, 16 nt, Escherichia coli CFT073
agcaaugcuuacuugc

SEQ ID NO: 623892 - RNA, 19 nt, Escherichia coli CFT073
agcaaugaucucaauaguu

SEQ ID NO: 623893 - RNA, 12 nt, Escherichia coli CFT073
agcaaugccaga

SEQ ID NO: 623894 - RNA, 23 nt, Escherichia coli CFT073
agcaauagccgccauacggaaaa

SEQ ID NO: 623895 - RNA, 16 nt, Escherichia coli CFT073
agcaauaauuucaaca

SEQ ID NO: 623896 - RNA, 22 nt, Escherichia coli CFT073
agcaaucgaccaggccaucagc

SEQ ID NO: 623897 - RNA, 20 nt, Escherichia coli CFT073
agcaaucucuucaagcugcu

SEQ ID NO: 623898 - RNA, 15 nt, Escherichia coli CFT073
agcaauaaacacugc

SEQ ID NO: 623899 - RNA, 16 nt, Escherichia coli CFT073
agcaauaaaugccugg

SEQ ID NO: 623900 - RNA, 14 nt, Escherichia coli CFT073
agcaauaagcacuc

SEQ ID NO: 623901 - RNA, 16 nt, Escherichia coli CFT073
agcaauaagcacucug

SEQ ID NO: 623902 - RNA, 13 nt, Escherichia coli CFT073
agcaauaagccag

SEQ ID NO: 623903 - RNA, 14 nt, Escherichia coli CFT073
agcaauaagccagu

SEQ ID NO: 623904 - RNA, 13 nt, Escherichia coli CFT073
agcaauaaucagu

SEQ ID NO: 623905 - RNA, 14 nt, Escherichia coli CFT073
agcaaggccagguu

SEQ ID NO: 623906 - RNA, 16 nt, Escherichia coli CFT073
agcaagaguuuuaaaa

SEQ ID NO: 623907 - RNA, 17 nt, Escherichia coli CFT073
agcaagaguuuuaaaac

SEQ ID NO: 623908 - RNA, 14 nt, Escherichia coli CFT073
agcaagagcaaaua

SEQ ID NO: 623909 - RNA, 16 nt, Escherichia coli CFT073
agcaagagcaaauaaa

SEQ ID NO: 623910 - RNA, 20 nt, Escherichia coli CFT073
agcaagagcaaauaaaacau

SEQ ID NO: 623911 - RNA, 18 nt, Escherichia coli CFT073
agcaagcgcaucggaaga

SEQ ID NO: 623912 - RNA, 16 nt, Escherichia coli CFT073
agcaagcgcugugaaa

SEQ ID NO: 623913 - RNA, 21 nt, Escherichia coli CFT073
agcaagcgcugugaaacaccu

SEQ ID NO: 623914 - RNA, 19 nt, Escherichia coli CFT073
agcaaggaagcugauuuua

SEQ ID NO: 623915 - RNA, 23 nt, Escherichia coli CFT073
agcaagcugugcgauagcaauga

SEQ ID NO: 623916 - RNA, 21 nt, Escherichia coli CFT073
agcaaacaggcuggcaacgac

SEQ ID NO: 623917 - RNA, 14 nt, Escherichia coli CFT073
agcaaacaguucug

SEQ ID NO: 623918 - RNA, 13 nt, Escherichia coli CFT073
agcaaacaggcug

SEQ ID NO: 623919 - RNA, 17 nt, Escherichia coli CFT073
agcaaacgccgaggcaa

SEQ ID NO: 623920 - RNA, 22 nt, Escherichia coli CFT073
agcaaacuugaacuuaucauca

SEQ ID NO: 623921 - RNA, 23 nt, Escherichia coli CFT073
agcaaagagagauccagcuucgc

SEQ ID NO: 623922 - RNA, 20 nt, Escherichia coli CFT073
agcaaauuaauuacacaaug

SEQ ID NO: 623923 - RNA, 22 nt, Escherichia coli CFT073
agcaaaucaaauaauuacuucg

SEQ ID NO: 623924 - RNA, 16 nt, Escherichia coli CFT073
agcaaaucaaucugau

SEQ ID NO: 623925 - RNA, 17 nt, Escherichia coli CFT073
agcaaauaaaacaucac

SEQ ID NO: 623926 - RNA, 18 nt, Escherichia coli CFT073
agcaaauaauuccccacc

SEQ ID NO: 623927 - RNA, 22 nt, Escherichia coli CFT073
agcaaauaguaagaaccacagc

SEQ ID NO: 623928 - RNA, 20 nt, Escherichia coli CFT073
agcaaauaaaacaucaccaa

SEQ ID NO: 623929 - RNA, 22 nt, Escherichia coli CFT073
agcaaaaugguacucggcacgu

SEQ ID NO: 623930 - RNA, 13 nt, Escherichia coli CFT073
agcaaacaaaaag

SEQ ID NO: 623931 - RNA, 20 nt, Escherichia coli CFT073
agcaaaaauaaaugcuugac

SEQ ID NO: 623932 - RNA, 13 nt, Escherichia coli CFT073
agauuuuuugcca

SEQ ID NO: 623933 - RNA, 13 nt, Escherichia coli CFT073
agcaaaaaaagaa

SEQ ID NO: 623934 - RNA, 14 nt, Escherichia coli CFT073
agcaaaaaaagaau

SEQ ID NO: 623935 - RNA, 16 nt, Escherichia coli CFT073
agauuuauaaaaucca

SEQ ID NO: 623936 - RNA, 15 nt, Escherichia coli CFT073
agauuugccagauua

SEQ ID NO: 623937 - RNA, 17 nt, Escherichia coli CFT073
agauuugccagauuagu

SEQ ID NO: 623938 - RNA, 20 nt, Escherichia coli CFT073
agauuucucuaaaaacucau

SEQ ID NO: 623939 - RNA, 16 nt, Escherichia coli CFT073
agauaauggcaauggu

SEQ ID NO: 623940 - RNA, 14 nt, Escherichia coli CFT073
agauuguuauccag

SEQ ID NO: 623941 - RNA, 18 nt, Escherichia coli CFT073
agauugucggcagccagu

SEQ ID NO: 623942 - RNA, 15 nt, Escherichia coli CFT073
agauaaugagacaca

SEQ ID NO: 623943 - RNA, 17 nt, Escherichia coli CFT073
agauaaucaacccccac

SEQ ID NO: 623944 - RNA, 16 nt, Escherichia coli CFT073
agauaauaauguguuc

SEQ ID NO: 623945 - RNA, 21 nt, Escherichia coli CFT073
agauaagacgcgucagugucu

SEQ ID NO: 623946 - RNA, 15 nt, Escherichia coli CFT073
agauaaggcguucac

SEQ ID NO: 623947 - RNA, 14 nt, Escherichia coli CFT073
agcagagccagaga

SEQ ID NO: 623948 - RNA, 14 nt, Escherichia coli CFT073
agcagagaucuuuc

SEQ ID NO: 623949 - RNA, 16 nt, Escherichia coli CFT073
agcagagaaacgccag

SEQ ID NO: 623950 - RNA, 20 nt, Escherichia coli CFT073
agcagagaaacgccagcagc

SEQ ID NO: 623951 - RNA, 17 nt, Escherichia coli CFT073
agcagauaaaagaccac

SEQ ID NO: 623952 - RNA, 18 nt, Escherichia coli CFT073
agcagauaaaagaccaca

SEQ ID NO: 623953 - RNA, 22 nt, Escherichia coli CFT073
agcagauaaaagaccacaauca

SEQ ID NO: 623954 - RNA, 18 nt, Escherichia coli CFT073
agcagauaacccagcagc

SEQ ID NO: 623955 - RNA, 16 nt, Escherichia coli CFT073
agcagauaucccgcca

SEQ ID NO: 623956 - RNA, 19 nt, Escherichia coli CFT073
agcagauaucccgccagca

SEQ ID NO: 623957 - RNA, 20 nt, Escherichia coli CFT073
agcagauaucccgccagcac

SEQ ID NO: 623958 - RNA, 12 nt, Escherichia coli CFT073
agcagagcguuu

SEQ ID NO: 623959 - RNA, 13 nt, Escherichia coli CFT073
agcagcagcgaau

SEQ ID NO: 623960 - RNA, 14 nt, Escherichia coli CFT073
agcagcaauauagc

SEQ ID NO: 623961 - RNA, 21 nt, Escherichia coli CFT073
agcagcaauauguugauaauc

SEQ ID NO: 623962 - RNA, 15 nt, Escherichia coli CFT073
agcagcaaccauuua

SEQ ID NO: 623963 - RNA, 18 nt, Escherichia coli CFT073
agcagcaccaccgcccgu

SEQ ID NO: 623964 - RNA, 16 nt, Escherichia coli CFT073
agcacuucgcugacau

SEQ ID NO: 623965 - RNA, 17 nt, Escherichia coli CFT073
agcacuucgcugacauu

SEQ ID NO: 623966 - RNA, 17 nt, Escherichia coli CFT073
agcacuugcaggaacaa

SEQ ID NO: 623967 - RNA, 13 nt, Escherichia coli CFT073
agcagaacaucag

SEQ ID NO: 623968 - RNA, 14 nt, Escherichia coli CFT073
agcagaaccaggga

SEQ ID NO: 623969 - RNA, 13 nt, Escherichia coli CFT073
agcagaaagcgac

SEQ ID NO: 623970 - RNA, 16 nt, Escherichia coli CFT073
agcagaccagcaauaa

SEQ ID NO: 623971 - RNA, 13 nt, Escherichia coli CFT073
agcagaagccgag

SEQ ID NO: 623972 - RNA, 15 nt, Escherichia coli CFT073
agcagaccagcaaua

SEQ ID NO: 623973 - RNA, 13 nt, Escherichia coli CFT073
agcagacgcaucg

SEQ ID NO: 623974 - RNA, 20 nt, Escherichia coli CFT073
agcagacgcaucgcccagcc

SEQ ID NO: 623975 - RNA, 21 nt, Escherichia coli CFT073
agcagacgcaucgcccagcca

SEQ ID NO: 623976 - RNA, 18 nt, Escherichia coli CFT073
agcagacgcuccauugcc

SEQ ID NO: 623977 - RNA, 18 nt, Escherichia coli CFT073
agcagaaucauccaggcu

SEQ ID NO: 623978 - RNA, 15 nt, Escherichia coli CFT073
agcagaaugguuuug

SEQ ID NO: 623979 - RNA, 20 nt, Escherichia coli CFT073
agcagaaugaaugauacaga

SEQ ID NO: 623980 - RNA, 23 nt, Escherichia coli CFT073
agcagaaugaaugauacagaaag

SEQ ID NO: 623981 - RNA, 20 nt, Escherichia coli CFT073
agcagaauuggcaucaggcu

SEQ ID NO: 623982 - RNA, 17 nt, Escherichia coli CFT073
agcagaccaaucuggac

SEQ ID NO: 623983 - RNA, 20 nt, Escherichia coli CFT073
agcagaccaauguuacgacc

SEQ ID NO: 623984 - RNA, 13 nt, Escherichia coli CFT073
agcacgccacuca

SEQ ID NO: 623985 - RNA, 18 nt, Escherichia coli CFT073
agcacggauaccgcacgc

SEQ ID NO: 623986 - RNA, 13 nt, Escherichia coli CFT073
agcacgcaggcau

SEQ ID NO: 623987 - RNA, 13 nt, Escherichia coli CFT073
agcacgagugagu

SEQ ID NO: 623988 - RNA, 17 nt, Escherichia coli CFT073
agcacgacuuucucuuc

SEQ ID NO: 623989 - RNA, 17 nt, Escherichia coli CFT073
agcacgaccuugccaag

SEQ ID NO: 623990 - RNA, 18 nt, Escherichia coli CFT073
agcacgaccuugccaagg

SEQ ID NO: 623991 - RNA, 17 nt, Escherichia coli CFT073
agcaccuuuuccagugg

SEQ ID NO: 623992 - RNA, 21 nt, Escherichia coli CFT073
agcacugauuuuuuccaacag

SEQ ID NO: 623993 - RNA, 24 nt, Escherichia coli CFT073
agcacuggcgaauucugcagacug

SEQ ID NO: 623994 - RNA, 19 nt, Escherichia coli CFT073
agcacuggcggcagcaggu

SEQ ID NO: 623995 - RNA, 20 nt, Escherichia coli CFT073
agcacugguggaaugguugg

SEQ ID NO: 623996 - RNA, 14 nt, Escherichia coli CFT073
agcacuaccgcccg

SEQ ID NO: 623997 - RNA, 13 nt, Escherichia coli CFT073
agcacuaccuugc

SEQ ID NO: 623998 - RNA, 14 nt, Escherichia coli CFT073
agcacguugaacug

SEQ ID NO: 623999 - RNA, 13 nt, Escherichia coli CFT073
agcacgguuuugu

SEQ ID NO: 624000 - RNA, 14 nt, Escherichia coli CFT073
agcacgguggcugg

SEQ ID NO: 624001 - RNA, 22 nt, Escherichia coli CFT073
agcaauuuucggggugcuccgg

SEQ ID NO: 624002 - RNA, 21 nt, Escherichia coli CFT073
agcaauuuuccuugaaaaaga

SEQ ID NO: 624003 - RNA, 20 nt, Escherichia coli CFT073
agcaauuccagcgccaguaa

SEQ ID NO: 624004 - RNA, 16 nt, Escherichia coli CFT073
agcacaauaaucagcc

SEQ ID NO: 624005 - RNA, 17 nt, Escherichia coli CFT073
agcacaauaaucagccc

SEQ ID NO: 624006 - RNA, 19 nt, Escherichia coli CFT073
agcacaauccgccaggaca

SEQ ID NO: 624007 - RNA, 13 nt, Escherichia coli CFT073
agcacaaaguggc

SEQ ID NO: 624008 - RNA, 14 nt, Escherichia coli CFT073
agcacacauacaug

SEQ ID NO: 624009 - RNA, 19 nt, Escherichia coli CFT073
agcacacauaacagcggga

SEQ ID NO: 624010 - RNA, 21 nt, Escherichia coli CFT073
agcacaccgucagccagcacu

SEQ ID NO: 624011 - RNA, 16 nt, Escherichia coli CFT073
agcacaucaucaaagc

SEQ ID NO: 624012 - RNA, 18 nt, Escherichia coli CFT073
agcacauagccgaaaaug

SEQ ID NO: 624013 - RNA, 13 nt, Escherichia coli CFT073
agcacauaaaaug

SEQ ID NO: 624014 - RNA, 14 nt, Escherichia coli CFT073
agcacaucucccac

SEQ ID NO: 624015 - RNA, 18 nt, Escherichia coli CFT073
agcaccacauaagaucau

SEQ ID NO: 624016 - RNA, 13 nt, Escherichia coli CFT073
agcaccaacaaag

SEQ ID NO: 624017 - RNA, 13 nt, Escherichia coli CFT073
agcaccaacucgc

SEQ ID NO: 624018 - RNA, 14 nt, Escherichia coli CFT073
agcaccaacucgcc

SEQ ID NO: 624019 - RNA, 14 nt, Escherichia coli CFT073
agcacccagcaauc

SEQ ID NO: 624020 - RNA, 15 nt, Escherichia coli CFT073
agcacccagcaaucc

SEQ ID NO: 624021 - RNA, 21 nt, Escherichia coli CFT073
agcaccauccgcccacaccag

SEQ ID NO: 624022 - RNA, 18 nt, Escherichia coli CFT073
agcacccgcggcugcagc

SEQ ID NO: 624023 - RNA, 16 nt, Escherichia coli CFT073
agcaccccauagccag

SEQ ID NO: 624024 - RNA, 18 nt, Escherichia coli CFT073
agcaccccauagccagcg

SEQ ID NO: 624025 - RNA, 14 nt, Escherichia coli CFT073
agcacccgccagcg

SEQ ID NO: 624026 - RNA, 12 nt, Escherichia coli CFT073
agcaccagcaac

SEQ ID NO: 624027 - RNA, 17 nt, Escherichia coli CFT073
agcacccgguaaacaaa

SEQ ID NO: 624028 - RNA, 16 nt, Escherichia coli CFT073
agcacccugaguuuuc

SEQ ID NO: 624029 - RNA, 20 nt, Escherichia coli CFT073
agcacccugaguuuucagua

SEQ ID NO: 624030 - RNA, 16 nt, Escherichia coli CFT073
agcaccgccagcagca

SEQ ID NO: 624031 - RNA, 13 nt, Escherichia coli CFT073
agcaccgccgcca

SEQ ID NO: 624032 - RNA, 17 nt, Escherichia coli CFT073
agcaccgcgacaaucag

SEQ ID NO: 624033 - RNA, 17 nt, Escherichia coli CFT073
agcaccuaaauccaccg

SEQ ID NO: 624034 - RNA, 14 nt, Escherichia coli CFT073
agcauaacaaaaug

SEQ ID NO: 624035 - RNA, 21 nt, Escherichia coli CFT073
agcaguuugaucgcuuccauu

SEQ ID NO: 624036 - RNA, 21 nt, Escherichia coli CFT073
agcaguuuagcucagaauucu

SEQ ID NO: 624037 - RNA, 21 nt, Escherichia coli CFT073
agcaguugugugccaguaaug

SEQ ID NO: 624038 - RNA, 16 nt, Escherichia coli CFT073
agcaguuucaccagca

SEQ ID NO: 624039 - RNA, 18 nt, Escherichia coli CFT073
agcaguuucaccagcagu

SEQ ID NO: 624040 - RNA, 13 nt, Escherichia coli CFT073
agcauacugcaug

SEQ ID NO: 624041 - RNA, 22 nt, Escherichia coli CFT073
agcauaauugccguuuccuggg

SEQ ID NO: 624042 - RNA, 20 nt, Escherichia coli CFT073
agcauaccgccgaggaacau

SEQ ID NO: 624043 - RNA, 23 nt, Escherichia coli CFT073
agcauaccgccgaggaacauaaa

SEQ ID NO: 624044 - RNA, 15 nt, Escherichia coli CFT073
agcaguuccagcauc

SEQ ID NO: 624045 - RNA, 14 nt, Escherichia coli CFT073
agcaguucagucag

SEQ ID NO: 624046 - RNA, 19 nt, Escherichia coli CFT073
agcaguucagucagcagug

SEQ ID NO: 624047 - RNA, 20 nt, Escherichia coli CFT073
agcaguuagcuuuucuccug

SEQ ID NO: 624048 - RNA, 19 nt, Escherichia coli CFT073
agcagugauuuauuuuuac

SEQ ID NO: 624049 - RNA, 17 nt, Escherichia coli CFT073
agcaguacggcagguca

SEQ ID NO: 624050 - RNA, 22 nt, Escherichia coli CFT073
agcaguaauuuauagauucuac

SEQ ID NO: 624051 - RNA, 13 nt, Escherichia coli CFT073
agcaguacagccg

SEQ ID NO: 624052 - RNA, 22 nt, Escherichia coli CFT073
agcagugaauacccagaaucuc

SEQ ID NO: 624053 - RNA, 17 nt, Escherichia coli CFT073
agcaguccagcgccuga

SEQ ID NO: 624054 - RNA, 19 nt, Escherichia coli CFT073
agcaguccccacaucacac

SEQ ID NO: 624055 - RNA, 22 nt, Escherichia coli CFT073
agcaguccccagguuuucaacg

SEQ ID NO: 624056 - RNA, 20 nt, Escherichia coli CFT073
agcaucaaugaccugacuuc

SEQ ID NO: 624057 - RNA, 22 nt, Escherichia coli CFT073
agcaucacauaaucgaaaacau

SEQ ID NO: 624058 - RNA, 21 nt, Escherichia coli CFT073
agcaucaauacgauuaacgua

SEQ ID NO: 624059 - RNA, 15 nt, Escherichia coli CFT073
agcaucaagaaaaau

SEQ ID NO: 624060 - RNA, 19 nt, Escherichia coli CFT073
agcaucccaggcauccagu

SEQ ID NO: 624061 - RNA, 20 nt, Escherichia coli CFT073
agcaucccaggcauccaguu

SEQ ID NO: 624062 - RNA, 17 nt, Escherichia coli CFT073
agcaucaucucacgcag

SEQ ID NO: 624063 - RNA, 20 nt, Escherichia coli CFT073
agcaucagcgcuaccagagc

SEQ ID NO: 624064 - RNA, 23 nt, Escherichia coli CFT073
agcaucauauggaagaaacgcuu

SEQ ID NO: 624065 - RNA, 16 nt, Escherichia coli CFT073
agcaucucaaauugcu

SEQ ID NO: 624066 - RNA, 23 nt, Escherichia coli CFT073
agcaucgucaacgccgcgugcca

SEQ ID NO: 624067 - RNA, 16 nt, Escherichia coli CFT073
agcaucgucaucagcu

SEQ ID NO: 624068 - RNA, 19 nt, Escherichia coli CFT073
agcaucucauccaucaaau

SEQ ID NO: 624069 - RNA, 21 nt, Escherichia coli CFT073
agcaucgcuagauauauauua

SEQ ID NO: 624070 - RNA, 14 nt, Escherichia coli CFT073
agcaucgccgggag

SEQ ID NO: 624071 - RNA, 21 nt, Escherichia coli CFT073
agcaucgcaacgcaucuuuuu

SEQ ID NO: 624072 - RNA, 22 nt, Escherichia coli CFT073
agcaucggcaacgccagcgaag

SEQ ID NO: 624073 - RNA, 21 nt, Escherichia coli CFT073
agcaucggugaggaucaccag

SEQ ID NO: 624074 - RNA, 16 nt, Escherichia coli CFT073
agcaucgaaaaugcca

SEQ ID NO: 624075 - RNA, 17 nt, Escherichia coli CFT073
agcaucgaccaugcuga

SEQ ID NO: 624076 - RNA, 19 nt, Escherichia coli CFT073
agcaucgcauccggcacuu

SEQ ID NO: 624077 - RNA, 19 nt, Escherichia coli CFT073
agcaucgcccaggcgacca

SEQ ID NO: 624078 - RNA, 21 nt, Escherichia coli CFT073
agcauccgcgcacaggcggcc

SEQ ID NO: 624079 - RNA, 13 nt, Escherichia coli CFT073
agcagcuccgcca

SEQ ID NO: 624080 - RNA, 15 nt, Escherichia coli CFT073
agcagcuccggcucu

SEQ ID NO: 624081 - RNA, 22 nt, Escherichia coli CFT073
agcagcucaaucgccucgccga

SEQ ID NO: 624082 - RNA, 13 nt, Escherichia coli CFT073
agcagcucacgca

SEQ ID NO: 624083 - RNA, 15 nt, Escherichia coli CFT073
agcagcucacgcagc

SEQ ID NO: 624084 - RNA, 13 nt, Escherichia coli CFT073
agcagcuccacuu

SEQ ID NO: 624085 - RNA, 17 nt, Escherichia coli CFT073
agcagcugacugacuuc

SEQ ID NO: 624086 - RNA, 16 nt, Escherichia coli CFT073
agcagcugcucccagc

SEQ ID NO: 624087 - RNA, 16 nt, Escherichia coli CFT073
agcagcgguaagguga

SEQ ID NO: 624088 - RNA, 19 nt, Escherichia coli CFT073
agcagcgguugagagaaga

SEQ ID NO: 624089 - RNA, 22 nt, Escherichia coli CFT073
agcagcgccaacggugaaaaac

SEQ ID NO: 624090 - RNA, 16 nt, Escherichia coli CFT073
agcagcccgagcaaca

SEQ ID NO: 624091 - RNA, 16 nt, Escherichia coli CFT073
agcagcgaagcauuca

SEQ ID NO: 624092 - RNA, 15 nt, Escherichia coli CFT073
agcagcgcaaagccc

SEQ ID NO: 624093 - RNA, 17 nt, Escherichia coli CFT073
agcagccacaccaauca

SEQ ID NO: 624094 - RNA, 12 nt, Escherichia coli CFT073
agcagccagaga

SEQ ID NO: 624095 - RNA, 14 nt, Escherichia coli CFT073
agcagccagcgcuu

SEQ ID NO: 624096 - RNA, 22 nt, Escherichia coli CFT073
agcagccagcgcuuugauggca

SEQ ID NO: 624097 - RNA, 19 nt, Escherichia coli CFT073
agcaguaaaccacccacca

SEQ ID NO: 624098 - RNA, 14 nt, Escherichia coli CFT073
agcagggugcuauc

SEQ ID NO: 624099 - RNA, 21 nt, Escherichia coli CFT073
agcagggugaauaaaagaaau

SEQ ID NO: 624100 - RNA, 16 nt, Escherichia coli CFT073
agcaggguugcagcgg

SEQ ID NO: 624101 - RNA, 23 nt, Escherichia coli CFT073
agcaggcugcgcgcuuucuccag

SEQ ID NO: 624102 - RNA, 21 nt, Escherichia coli CFT073
agcaggcaauuucgccucgcu

SEQ ID NO: 624103 - RNA, 17 nt, Escherichia coli CFT073
agcaggcaccgcgccca

SEQ ID NO: 624104 - RNA, 14 nt, Escherichia coli CFT073
agcaggcacuuggu

SEQ ID NO: 624105 - RNA, 17 nt, Escherichia coli CFT073
agcaggcauccugaucg

SEQ ID NO: 624106 - RNA, 17 nt, Escherichia coli CFT073
agcaggaaucccaucag

SEQ ID NO: 624107 - RNA, 17 nt, Escherichia coli CFT073
agcaggaauaaucagca

SEQ ID NO: 624108 - RNA, 12 nt, Escherichia coli CFT073
agcagcuugaga

SEQ ID NO: 624109 - RNA, 15 nt, Escherichia coli CFT073
agcagcuugagaaaa

SEQ ID NO: 624110 - RNA, 14 nt, Escherichia coli CFT073
agcagcuugcgccg

SEQ ID NO: 624111 - RNA, 21 nt, Escherichia coli CFT073
agccauauggcugcauccaga

SEQ ID NO: 624112 - RNA, 24 nt, Escherichia coli CFT073
agccauaaucacucuuccccgcuu

SEQ ID NO: 624113 - RNA, 15 nt, Escherichia coli CFT073
agccaucuggcuccu

SEQ ID NO: 624114 - RNA, 21 nt, Escherichia coli CFT073
agccaucgacaccagccagac

SEQ ID NO: 624115 - RNA, 21 nt, Escherichia coli CFT073
agccaucgccacugcaaauuu

SEQ ID NO: 624116 - RNA, 19 nt, Escherichia coli CFT073
agccaucccugcagggcuu

SEQ ID NO: 624117 - RNA, 20 nt, Escherichia coli CFT073
agccauauuuaacuccuucu

SEQ ID NO: 624118 - RNA, 15 nt, Escherichia coli CFT073
agccaucauuuuuac

SEQ ID NO: 624119 - RNA, 22 nt, Escherichia coli CFT073
agccaugccacgcugacaucaa

SEQ ID NO: 624120 - RNA, 19 nt, Escherichia coli CFT073
agccaugaaaaaguuaccu

SEQ ID NO: 624121 - RNA, 23 nt, Escherichia coli CFT073
agccaugaaaaaguuaccuggau

SEQ ID NO: 624122 - RNA, 23 nt, Escherichia coli CFT073
agccaugcggcaucuucuccacg

SEQ ID NO: 624123 - RNA, 16 nt, Escherichia coli CFT073
agccauuccugcaccu

SEQ ID NO: 624124 - RNA, 20 nt, Escherichia coli CFT073
agccauucauucaaauuaaa

SEQ ID NO: 624125 - RNA, 19 nt, Escherichia coli CFT073
agccauuaaccagccacug

SEQ ID NO: 624126 - RNA, 17 nt, Escherichia coli CFT073
agccauuaaacaccagu

SEQ ID NO: 624127 - RNA, 13 nt, Escherichia coli CFT073
agccaguaaacca

SEQ ID NO: 624128 - RNA, 18 nt, Escherichia coli CFT073
agccagguuuaccagcag

SEQ ID NO: 624129 - RNA, 15 nt, Escherichia coli CFT073
agccaguagaacaau

SEQ ID NO: 624130 - RNA, 17 nt, Escherichia coli CFT073
agccaguagaacaauua

SEQ ID NO: 624131 - RNA, 13 nt, Escherichia coli CFT073
agccaguagcacc

SEQ ID NO: 624132 - RNA, 15 nt, Escherichia coli CFT073
agccaguagcaccuc

SEQ ID NO: 624133 - RNA, 21 nt, Escherichia coli CFT073
agccaguagcaccucuccacg

SEQ ID NO: 624134 - RNA, 16 nt, Escherichia coli CFT073
agccaguccggcaaug

SEQ ID NO: 624135 - RNA, 17 nt, Escherichia coli CFT073
agccaguauaauauaca

SEQ ID NO: 624136 - RNA, 13 nt, Escherichia coli CFT073
agccauaaagaaa

SEQ ID NO: 624137 - RNA, 14 nt, Escherichia coli CFT073
agccagugcuaccc

SEQ ID NO: 624138 - RNA, 15 nt, Escherichia coli CFT073
agccagugcccgcga

SEQ ID NO: 624139 - RNA, 17 nt, Escherichia coli CFT073
agccaguucgagaaaaa

SEQ ID NO: 624140 - RNA, 19 nt, Escherichia coli CFT073
agccaggcgcugcuggagc

SEQ ID NO: 624141 - RNA, 18 nt, Escherichia coli CFT073
agccagggcaccaguaaa

SEQ ID NO: 624142 - RNA, 23 nt, Escherichia coli CFT073
agccaggagccaacacuuucacu

SEQ ID NO: 624143 - RNA, 12 nt, Escherichia coli CFT073
agccagcugccu

SEQ ID NO: 624144 - RNA, 21 nt, Escherichia coli CFT073
agccagcugccugccaguaaa

SEQ ID NO: 624145 - RNA, 18 nt, Escherichia coli CFT073
agccagcgcaccuucauu

SEQ ID NO: 624146 - RNA, 15 nt, Escherichia coli CFT073
agccagcguaccuug

SEQ ID NO: 624147 - RNA, 16 nt, Escherichia coli CFT073
agccagcguuacccag

SEQ ID NO: 624148 - RNA, 19 nt, Escherichia coli CFT073
agccagcguuacccagaca

SEQ ID NO: 624149 - RNA, 19 nt, Escherichia coli CFT073
agccagccgcuaacuuccu

SEQ ID NO: 624150 - RNA, 15 nt, Escherichia coli CFT073
agccagccccacagc

SEQ ID NO: 624151 - RNA, 17 nt, Escherichia coli CFT073
agccagcagagcaaaaa

SEQ ID NO: 624152 - RNA, 16 nt, Escherichia coli CFT073
agccagcaccaggcuu

SEQ ID NO: 624153 - RNA, 13 nt, Escherichia coli CFT073
agccagcaaugua

SEQ ID NO: 624154 - RNA, 15 nt, Escherichia coli CFT073
agccagcaccaggcu

SEQ ID NO: 624155 - RNA, 16 nt, Escherichia coli CFT073
agccagcagcgaauca

SEQ ID NO: 624156 - RNA, 14 nt, Escherichia coli CFT073
agccagacgugcac

SEQ ID NO: 624157 - RNA, 17 nt, Escherichia coli CFT073
agccagacucagcaaca

SEQ ID NO: 624158 - RNA, 18 nt, Escherichia coli CFT073
agccagaguugaaaaucu

SEQ ID NO: 624159 - RNA, 15 nt, Escherichia coli CFT073
agccacucaccgccg

SEQ ID NO: 624160 - RNA, 23 nt, Escherichia coli CFT073
agccacgguccgccauuuccagc

SEQ ID NO: 624161 - RNA, 19 nt, Escherichia coli CFT073
agccacgucugccacggca

SEQ ID NO: 624162 - RNA, 23 nt, Escherichia coli CFT073
agccacucuuaacgccacucgcc

SEQ ID NO: 624163 - RNA, 13 nt, Escherichia coli CFT073
agccacugcgcau

SEQ ID NO: 624164 - RNA, 13 nt, Escherichia coli CFT073
agccacugcgcca

SEQ ID NO: 624165 - RNA, 12 nt, Escherichia coli CFT073
agccacugcgcg

SEQ ID NO: 624166 - RNA, 20 nt, Escherichia coli CFT073
agccacuuccuuuagaagca

SEQ ID NO: 624167 - RNA, 13 nt, Escherichia coli CFT073
agccagaagaaaa

SEQ ID NO: 624168 - RNA, 16 nt, Escherichia coli CFT073
agccacggcagcaacu

SEQ ID NO: 624169 - RNA, 16 nt, Escherichia coli CFT073
agccacggcuccagca

SEQ ID NO: 624170 - RNA, 20 nt, Escherichia coli CFT073
agccacggcuccagcaaugu

SEQ ID NO: 624171 - RNA, 16 nt, Escherichia coli CFT073
agccacgcaccauccc

SEQ ID NO: 624172 - RNA, 20 nt, Escherichia coli CFT073
agccaccgcguggcagaccu

SEQ ID NO: 624173 - RNA, 20 nt, Escherichia coli CFT073
agccaccuggcugcguuuuc

SEQ ID NO: 624174 - RNA, 18 nt, Escherichia coli CFT073
agccaccgcccagagaau

SEQ ID NO: 624175 - RNA, 17 nt, Escherichia coli CFT073
agccacacaccgcaaac

SEQ ID NO: 624176 - RNA, 16 nt, Escherichia coli CFT073
agccacacagcaaaau

SEQ ID NO: 624177 - RNA, 14 nt, Escherichia coli CFT073
agccacaggccgcu

SEQ ID NO: 624178 - RNA, 22 nt, Escherichia coli CFT073
agccacaggccggucaucccua

SEQ ID NO: 624179 - RNA, 20 nt, Escherichia coli CFT073
agccaccacgccaagaaaca

SEQ ID NO: 624180 - RNA, 17 nt, Escherichia coli CFT073
agccaccacgccaagaa

SEQ ID NO: 624181 - RNA, 13 nt, Escherichia coli CFT073
agccaagccagag

SEQ ID NO: 624182 - RNA, 19 nt, Escherichia coli CFT073
agccaauuaacgaaaucuc

SEQ ID NO: 624183 - RNA, 23 nt, Escherichia coli CFT073
agccaaucaucguaccgauaccu

SEQ ID NO: 624184 - RNA, 13 nt, Escherichia coli CFT073
agccaaucccgga

SEQ ID NO: 624185 - RNA, 23 nt, Escherichia coli CFT073
agccaaaaucaaaguuaguaaaa

SEQ ID NO: 624186 - RNA, 12 nt, Escherichia coli CFT073
agccaaaaauga

SEQ ID NO: 624187 - RNA, 16 nt, Escherichia coli CFT073
agcauuuucucacugg

SEQ ID NO: 624188 - RNA, 17 nt, Escherichia coli CFT073
agcauuuucucacuggc

SEQ ID NO: 624189 - RNA, 18 nt, Escherichia coli CFT073
agcauuuucucacuggcg

SEQ ID NO: 624190 - RNA, 19 nt, Escherichia coli CFT073
agcauuucgcgauauugcu

SEQ ID NO: 624191 - RNA, 16 nt, Escherichia coli CFT073
agccaaacgcccagcu

SEQ ID NO: 624192 - RNA, 13 nt, Escherichia coli CFT073
agccaaauccagc

SEQ ID NO: 624193 - RNA, 16 nt, Escherichia coli CFT073
agccaaauccagcacc

SEQ ID NO: 624194 - RNA, 16 nt, Escherichia coli CFT073
agccaaauccagcgca

SEQ ID NO: 624195 - RNA, 12 nt, Escherichia coli CFT073
agccaacagcag

SEQ ID NO: 624196 - RNA, 19 nt, Escherichia coli CFT073
agccaacagcagccacacc

SEQ ID NO: 624197 - RNA, 22 nt, Escherichia coli CFT073
agccaacgaugaugacguaauc

SEQ ID NO: 624198 - RNA, 22 nt, Escherichia coli CFT073
agccaacgcauuagcaguuacu

SEQ ID NO: 624199 - RNA, 23 nt, Escherichia coli CFT073
agccaacguuucuggaaguaauc

SEQ ID NO: 624200 - RNA, 18 nt, Escherichia coli CFT073
agcauugcgccagcgaga

SEQ ID NO: 624201 - RNA, 20 nt, Escherichia coli CFT073
agcauugucaggaucaccaa

SEQ ID NO: 624202 - RNA, 22 nt, Escherichia coli CFT073
agcauugucaggaucaccaaua

SEQ ID NO: 624203 - RNA, 21 nt, Escherichia coli CFT073
agcauucgucauggcccauga

SEQ ID NO: 624204 - RNA, 23 nt, Escherichia coli CFT073
agcauuacgaaaucggcaccgcc

SEQ ID NO: 624205 - RNA, 20 nt, Escherichia coli CFT073
agcauuacgcguccuuguaa

SEQ ID NO: 624206 - RNA, 22 nt, Escherichia coli CFT073
agcauuauuuuugcuauaugca

SEQ ID NO: 624207 - RNA, 14 nt, Escherichia coli CFT073
agcauguuccaguu

SEQ ID NO: 624208 - RNA, 19 nt, Escherichia coli CFT073
agcaucugguaacccaucc

SEQ ID NO: 624209 - RNA, 19 nt, Escherichia coli CFT073
agcaugaacauugcugcug

SEQ ID NO: 624210 - RNA, 17 nt, Escherichia coli CFT073
agcaugaacauugcugc

SEQ ID NO: 624211 - RNA, 18 nt, Escherichia coli CFT073
agcaugaaguaacagaag

SEQ ID NO: 624212 - RNA, 17 nt, Escherichia coli CFT073
agcaugcugccagguga

SEQ ID NO: 624213 - RNA, 15 nt, Escherichia coli CFT073
agcauggccgcaaga

SEQ ID NO: 624214 - RNA, 15 nt, Escherichia coli CFT073
agcaugucuugccuc

SEQ ID NO: 624215 - RNA, 19 nt, Escherichia coli CFT073
agcaugucuugccucccug

SEQ ID NO: 624216 - RNA, 18 nt, Escherichia coli CFT073
agcauggcuucuuccccg

SEQ ID NO: 624217 - RNA, 12 nt, Escherichia coli CFT073
agcaugguaacg

SEQ ID NO: 624218 - RNA, 15 nt, Escherichia coli CFT073
agcgauuuuucauca

SEQ ID NO: 624219 - RNA, 17 nt, Escherichia coli CFT073
agcgcaaaggccagcaa

SEQ ID NO: 624220 - RNA, 20 nt, Escherichia coli CFT073
agcgcaaaauaccagcaauu

SEQ ID NO: 624221 - RNA, 23 nt, Escherichia coli CFT073
agcgcaacuuuacucauccccug

SEQ ID NO: 624222 - RNA, 19 nt, Escherichia coli CFT073
agcgcacagagcacuaaca

SEQ ID NO: 624223 - RNA, 22 nt, Escherichia coli CFT073
agcgcaaucugcuucuuaccac

SEQ ID NO: 624224 - RNA, 19 nt, Escherichia coli CFT073
agcgcaauagccugaugua

SEQ ID NO: 624225 - RNA, 23 nt, Escherichia coli CFT073
agcgcacaugcagcuucgccauu

SEQ ID NO: 624226 - RNA, 22 nt, Escherichia coli CFT073
agcgcaccaaccacugcucuga

SEQ ID NO: 624227 - RNA, 19 nt, Escherichia coli CFT073
agcgcacugccgccaugcg

SEQ ID NO: 624228 - RNA, 14 nt, Escherichia coli CFT073
agcgcagcagauaa

SEQ ID NO: 624229 - RNA, 13 nt, Escherichia coli CFT073
agcgcagcaccca

SEQ ID NO: 624230 - RNA, 14 nt, Escherichia coli CFT073
agcgcagcaacauc

SEQ ID NO: 624231 - RNA, 15 nt, Escherichia coli CFT073
agcgcagcaacauca

SEQ ID NO: 624232 - RNA, 20 nt, Escherichia coli CFT073
agcgauaacguguuccaguu

SEQ ID NO: 624233 - RNA, 16 nt, Escherichia coli CFT073
agcgagugccggggcc

SEQ ID NO: 624234 - RNA, 11 nt, Escherichia coli CFT073
agcgaguugau

SEQ ID NO: 624235 - RNA, 22 nt, Escherichia coli CFT073
agcgauaaaacgccgcugguga

SEQ ID NO: 624236 - RNA, 14 nt, Escherichia coli CFT073
agcgauccaguucc

SEQ ID NO: 624237 - RNA, 13 nt, Escherichia coli CFT073
agcgaucuguuca

SEQ ID NO: 624238 - RNA, 22 nt, Escherichia coli CFT073
agcgaugguacuucaaucgcca

SEQ ID NO: 624239 - RNA, 23 nt, Escherichia coli CFT073
agcgaugguacuucaaucgccac

SEQ ID NO: 624240 - RNA, 18 nt, Escherichia coli CFT073
agcgauuaccauuucacu

SEQ ID NO: 624241 - RNA, 15 nt, Escherichia coli CFT073
agcgccagacugaca

SEQ ID NO: 624242 - RNA, 20 nt, Escherichia coli CFT073
agcgccagcaagagcaaaua

SEQ ID NO: 624243 - RNA, 22 nt, Escherichia coli CFT073
agcgccagcaagagcaaauaaa

SEQ ID NO: 624244 - RNA, 12 nt, Escherichia coli CFT073
agcgccagcaug

SEQ ID NO: 624245 - RNA, 18 nt, Escherichia coli CFT073
agcgccagacacuggaaa

SEQ ID NO: 624246 - RNA, 15 nt, Escherichia coli CFT073
agcgccaccagcgcc

SEQ ID NO: 624247 - RNA, 20 nt, Escherichia coli CFT073
agcgccaguaguugcucaag

SEQ ID NO: 624248 - RNA, 21 nt, Escherichia coli CFT073
agcgcaucaggcaaucuuguu

SEQ ID NO: 624249 - RNA, 16 nt, Escherichia coli CFT073
agcgcauaagccacaa

SEQ ID NO: 624250 - RNA, 14 nt, Escherichia coli CFT073
agcgcauaaaagcu

SEQ ID NO: 624251 - RNA, 15 nt, Escherichia coli CFT073
agcgcagucaccagc

SEQ ID NO: 624252 - RNA, 20 nt, Escherichia coli CFT073
agcgcagugacauucaccuc

SEQ ID NO: 624253 - RNA, 20 nt, Escherichia coli CFT073
agcgcagcuuccggccagca

SEQ ID NO: 624254 - RNA, 17 nt, Escherichia coli CFT073
agcgcaggggcaaucag

SEQ ID NO: 624255 - RNA, 21 nt, Escherichia coli CFT073
agcgcaggaaagauaagcgaa

SEQ ID NO: 624256 - RNA, 24 nt, Escherichia coli CFT073
agcgcaggaaagauaagcgaacau

SEQ ID NO: 624257 - RNA, 19 nt, Escherichia coli CFT073
agcgcauguugacaaaaau

SEQ ID NO: 624258 - RNA, 14 nt, Escherichia coli CFT073
agcgcaugauuuuc

SEQ ID NO: 624259 - RNA, 16 nt, Escherichia coli CFT073
agcgcaugauuuucau

SEQ ID NO: 624260 - RNA, 14 nt, Escherichia coli CFT073
agcgccaaagccag

SEQ ID NO: 624261 - RNA, 23 nt, Escherichia coli CFT073
agcgccaacgcaacgcgcuuuga

SEQ ID NO: 624262 - RNA, 19 nt, Escherichia coli CFT073
agcgcauuuccaagauuaa

SEQ ID NO: 624263 - RNA, 17 nt, Escherichia coli CFT073
agcgccaauaccaaaaa

SEQ ID NO: 624264 - RNA, 16 nt, Escherichia coli CFT073
agcgccaccacccaga

SEQ ID NO: 624265 - RNA, 21 nt, Escherichia coli CFT073
agcgccugcgcggcaaugcgc

SEQ ID NO: 624266 - RNA, 18 nt, Escherichia coli CFT073
agcgccugcugcacacca

SEQ ID NO: 624267 - RNA, 21 nt, Escherichia coli CFT073
agcgccucuuccaguaaacca

SEQ ID NO: 624268 - RNA, 18 nt, Escherichia coli CFT073
agcgccugauacagccaa

SEQ ID NO: 624269 - RNA, 18 nt, Escherichia coli CFT073
agcgccgggcaaaugcuc

SEQ ID NO: 624270 - RNA, 23 nt, Escherichia coli CFT073
agcgccgucaguuuuucacccgc

SEQ ID NO: 624271 - RNA, 22 nt, Escherichia coli CFT073
agcgccgaguaaaaaaacauca

SEQ ID NO: 624272 - RNA, 20 nt, Escherichia coli CFT073
agcgccgcaacuaccagcag

SEQ ID NO: 624273 - RNA, 21 nt, Escherichia coli CFT073
agcgccgcgauaaaaucccau

SEQ ID NO: 624274 - RNA, 23 nt, Escherichia coli CFT073
agcgccgccagaaucaccucuuu

SEQ ID NO: 624275 - RNA, 16 nt, Escherichia coli CFT073
agcgccgcauccgaca

SEQ ID NO: 624276 - RNA, 20 nt, Escherichia coli CFT073
agcgccgccagaaucaccuc

SEQ ID NO: 624277 - RNA, 21 nt, Escherichia coli CFT073
agcgccaugcuguucgcaacc

SEQ ID NO: 624278 - RNA, 23 nt, Escherichia coli CFT073
agcgccauuacccggugccgccg

SEQ ID NO: 624279 - RNA, 17 nt, Escherichia coli CFT073
agcgcccauaaagaugu

SEQ ID NO: 624280 - RNA, 17 nt, Escherichia coli CFT073
agcgcccgccaagcagu

SEQ ID NO: 624281 - RNA, 15 nt, Escherichia coli CFT073
agcgcccguaaacca

SEQ ID NO: 624282 - RNA, 15 nt, Escherichia coli CFT073
agcggcaaccagcag

SEQ ID NO: 624283 - RNA, 16 nt, Escherichia coli CFT073
agcggcaaccagcagc

SEQ ID NO: 624284 - RNA, 22 nt, Escherichia coli CFT073
agcggaucgccgccggagaggg

SEQ ID NO: 624285 - RNA, 14 nt, Escherichia coli CFT073
agcgcuuuuuccug

SEQ ID NO: 624286 - RNA, 21 nt, Escherichia coli CFT073
agcgcuaauacgaugcaaccg

SEQ ID NO: 624287 - RNA, 20 nt, Escherichia coli CFT073
agcgcugugaaacaccugca

SEQ ID NO: 624288 - RNA, 13 nt, Escherichia coli CFT073
agcgcguucuguu

SEQ ID NO: 624289 - RNA, 21 nt, Escherichia coli CFT073
agcgcgacacaacagaccaga

SEQ ID NO: 624290 - RNA, 19 nt, Escherichia coli CFT073
agcgcgaccggcggcgacu

SEQ ID NO: 624291 - RNA, 11 nt, Escherichia coli CFT073
agcguccagcg

SEQ ID NO: 624292 - RNA, 13 nt, Escherichia coli CFT073
agcgucaguucuc

SEQ ID NO: 624293 - RNA, 17 nt, Escherichia coli CFT073
agcgucaguucucuggc

SEQ ID NO: 624294 - RNA, 13 nt, Escherichia coli CFT073
agcgucagcagca

SEQ ID NO: 624295 - RNA, 15 nt, Escherichia coli CFT073
agcgucagcagcaau

SEQ ID NO: 624296 - RNA, 16 nt, Escherichia coli CFT073
agcgucagcagcaaua

SEQ ID NO: 624297 - RNA, 19 nt, Escherichia coli CFT073
agcgucacuuccuucgccg

SEQ ID NO: 624298 - RNA, 22 nt, Escherichia coli CFT073
agcgucgcauccaacaauaaaa

SEQ ID NO: 624299 - RNA, 22 nt, Escherichia coli CFT073
agcgucgccaauggaauagcga

SEQ ID NO: 624300 - RNA, 15 nt, Escherichia coli CFT073
agcguccggcugcca

SEQ ID NO: 624301 - RNA, 18 nt, Escherichia coli CFT073
agcguccaguccacacug

SEQ ID NO: 624302 - RNA, 19 nt, Escherichia coli CFT073
agcguccauuuacccacag

SEQ ID NO: 624303 - RNA, 20 nt, Escherichia coli CFT073
agcguccauuuacccacaga

SEQ ID NO: 624304 - RNA, 14 nt, Escherichia coli CFT073
agcgucccuaauac

SEQ ID NO: 624305 - RNA, 15 nt, Escherichia coli CFT073
agcguaaagccagcg

SEQ ID NO: 624306 - RNA, 14 nt, Escherichia coli CFT073
agcgguuggagcac

SEQ ID NO: 624307 - RNA, 20 nt, Escherichia coli CFT073
agcgguuuacccugcucgcu

SEQ ID NO: 624308 - RNA, 22 nt, Escherichia coli CFT073
agcgguuuugaucacgucgaga

SEQ ID NO: 624309 - RNA, 14 nt, Escherichia coli CFT073
agcgguuuugccag

SEQ ID NO: 624310 - RNA, 19 nt, Escherichia coli CFT073
agcgucaacuuuagcaaug

SEQ ID NO: 624311 - RNA, 17 nt, Escherichia coli CFT073
agcgucaaacuuuuaaa

SEQ ID NO: 624312 - RNA, 12 nt, Escherichia coli CFT073
agcggcaacuuu

SEQ ID NO: 624313 - RNA, 13 nt, Escherichia coli CFT073
agcggcaggccgu

SEQ ID NO: 624314 - RNA, 21 nt, Escherichia coli CFT073
agcggguuuuuacguuauuug

SEQ ID NO: 624315 - RNA, 17 nt, Escherichia coli CFT073
agcgguaaaauggucag

SEQ ID NO: 624316 - RNA, 16 nt, Escherichia coli CFT073
agcggcauaugaccau

SEQ ID NO: 624317 - RNA, 18 nt, Escherichia coli CFT073
agcggcaucaaccgccgg

SEQ ID NO: 624318 - RNA, 20 nt, Escherichia coli CFT073
agcgggguucuccugagaac

SEQ ID NO: 624319 - RNA, 22 nt, Escherichia coli CFT073
agcuaaaccaauaaagaacccg

SEQ ID NO: 624320 - RNA, 13 nt, Escherichia coli CFT073
agcuaaacagagc

SEQ ID NO: 624321 - RNA, 18 nt, Escherichia coli CFT073
agcuaaacagagcugcaa

SEQ ID NO: 624322 - RNA, 17 nt, Escherichia coli CFT073
agcuacaccgaucaccc

SEQ ID NO: 624323 - RNA, 20 nt, Escherichia coli CFT073
agcuaaacugaucuuuauca

SEQ ID NO: 624324 - RNA, 13 nt, Escherichia coli CFT073
agcuaccagcccc

SEQ ID NO: 624325 - RNA, 20 nt, Escherichia coli CFT073
agcuacgaaggugcauugaa

SEQ ID NO: 624326 - RNA, 15 nt, Escherichia coli CFT073
agcguuguaacaauc

SEQ ID NO: 624327 - RNA, 13 nt, Escherichia coli CFT073
agcguuucaagug

SEQ ID NO: 624328 - RNA, 14 nt, Escherichia coli CFT073
agcguuuucugcca

SEQ ID NO: 624329 - RNA, 15 nt, Escherichia coli CFT073
agcguuuucugccag

SEQ ID NO: 624330 - RNA, 23 nt, Escherichia coli CFT073
agcguugcagagagucacgcagc

SEQ ID NO: 624331 - RNA, 17 nt, Escherichia coli CFT073
agcgugagcagggugaa

SEQ ID NO: 624332 - RNA, 12 nt, Escherichia coli CFT073
agcgugagggaa

SEQ ID NO: 624333 - RNA, 22 nt, Escherichia coli CFT073
agcguucgcacgguucgccauc

SEQ ID NO: 624334 - RNA, 21 nt, Escherichia coli CFT073
agcguucggugauauuuucac

SEQ ID NO: 624335 - RNA, 15 nt, Escherichia coli CFT073
agcgugacaccagca

SEQ ID NO: 624336 - RNA, 22 nt, Escherichia coli CFT073
agcgucuguuuuaucacaucca

SEQ ID NO: 624337 - RNA, 15 nt, Escherichia coli CFT073
agcgucgccagcaga

SEQ ID NO: 624338 - RNA, 18 nt, Escherichia coli CFT073
agcuccgggcugguuuuc

SEQ ID NO: 624339 - RNA, 15 nt, Escherichia coli CFT073
agcuccguccagcca

SEQ ID NO: 624340 - RNA, 19 nt, Escherichia coli CFT073
agcuccgguacucaucaga

SEQ ID NO: 624341 - RNA, 18 nt, Escherichia coli CFT073
agcuccguccagccaccg

SEQ ID NO: 624342 - RNA, 12 nt, Escherichia coli CFT073
agcuccccacac

SEQ ID NO: 624343 - RNA, 13 nt, Escherichia coli CFT073
agcuccccacacc

SEQ ID NO: 624344 - RNA, 21 nt, Escherichia coli CFT073
agcuccccacaccaccaugcu

SEQ ID NO: 624345 - RNA, 13 nt, Escherichia coli CFT073
agcucauuuccca

SEQ ID NO: 624346 - RNA, 20 nt, Escherichia coli CFT073
agcuauauuuugccggacgc

SEQ ID NO: 624347 - RNA, 14 nt, Escherichia coli CFT073
agcuccacacgcuc

SEQ ID NO: 624348 - RNA, 18 nt, Escherichia coli CFT073
agcuccacaagaaugccu

SEQ ID NO: 624349 - RNA, 21 nt, Escherichia coli CFT073
agcuccacaagaaugccugcc

SEQ ID NO: 624350 - RNA, 12 nt, Escherichia coli CFT073
agcuccagagua

SEQ ID NO: 624351 - RNA, 16 nt, Escherichia coli CFT073
agcucgacuccugacu

SEQ ID NO: 624352 - RNA, 17 nt, Escherichia coli CFT073
agcucgacaccaaacag

SEQ ID NO: 624353 - RNA, 19 nt, Escherichia coli CFT073
agcucggcgaucuguuccg

SEQ ID NO: 624354 - RNA, 18 nt, Escherichia coli CFT073
agcucuuuauccagcagc

SEQ ID NO: 624355 - RNA, 19 nt, Escherichia coli CFT073
agcucuuuauccagcagcc

SEQ ID NO: 624356 - RNA, 19 nt, Escherichia coli CFT073
agcucuuucgacagcgauu

SEQ ID NO: 624357 - RNA, 19 nt, Escherichia coli CFT073
agcucgguggcgauguaau

SEQ ID NO: 624358 - RNA, 20 nt, Escherichia coli CFT073
agcugaguauuaaccgguug

SEQ ID NO: 624359 - RNA, 20 nt, Escherichia coli CFT073
agcugagugcgaaaaucaau

SEQ ID NO: 624360 - RNA, 13 nt, Escherichia coli CFT073
agcugacuugcuc

SEQ ID NO: 624361 - RNA, 19 nt, Escherichia coli CFT073
agcugcgggaaauaacaaa

SEQ ID NO: 624362 - RNA, 23 nt, Escherichia coli CFT073
agcugcgggaaauaacaaauaau

SEQ ID NO: 624363 - RNA, 16 nt, Escherichia coli CFT073
agcugcucccagcgca

SEQ ID NO: 624364 - RNA, 20 nt, Escherichia coli CFT073
agcugcugacggugauaauc

SEQ ID NO: 624365 - RNA, 16 nt, Escherichia coli CFT073
agcugcucgauguugu

SEQ ID NO: 624366 - RNA, 21 nt, Escherichia coli CFT073
agcgaggcaaucagcaguauc

SEQ ID NO: 624367 - RNA, 13 nt, Escherichia coli CFT073
agcgagaguaauu

SEQ ID NO: 624368 - RNA, 17 nt, Escherichia coli CFT073
agcgagaguaauuaaac

SEQ ID NO: 624369 - RNA, 18 nt, Escherichia coli CFT073
agcgagaacaccgaacca

SEQ ID NO: 624370 - RNA, 18 nt, Escherichia coli CFT073
agcgacuuugccuggcgg

SEQ ID NO: 624371 - RNA, 12 nt, Escherichia coli CFT073
agcgaccauaac

SEQ ID NO: 624372 - RNA, 20 nt, Escherichia coli CFT073
agcgaccacaaauaccccac

SEQ ID NO: 624373 - RNA, 12 nt, Escherichia coli CFT073
agcgaccaccac

SEQ ID NO: 624374 - RNA, 15 nt, Escherichia coli CFT073
agcgacugugaagua

SEQ ID NO: 624375 - RNA, 20 nt, Escherichia coli CFT073
agcgaagguaacaccaguuu

SEQ ID NO: 624376 - RNA, 16 nt, Escherichia coli CFT073
agcgaagcgaacaucg

SEQ ID NO: 624377 - RNA, 18 nt, Escherichia coli CFT073
agcgaagcgcaugccuuc

SEQ ID NO: 624378 - RNA, 17 nt, Escherichia coli CFT073
agcgaagcggcacugcu

SEQ ID NO: 624379 - RNA, 20 nt, Escherichia coli CFT073
agcgaagguguugaaaugag

SEQ ID NO: 624380 - RNA, 22 nt, Escherichia coli CFT073
agcgaagguguugaaaugagaa

SEQ ID NO: 624381 - RNA, 18 nt, Escherichia coli CFT073
agcgaauaccccagcggc

SEQ ID NO: 624382 - RNA, 21 nt, Escherichia coli CFT073
agcgaaaucaacacgccugca

SEQ ID NO: 624383 - RNA, 13 nt, Escherichia coli CFT073
agcgaacaccagc

SEQ ID NO: 624384 - RNA, 21 nt, Escherichia coli CFT073
agcgaacaggaguagcucugg

SEQ ID NO: 624385 - RNA, 17 nt, Escherichia coli CFT073
agcgaacugguuucaau

SEQ ID NO: 624386 - RNA, 16 nt, Escherichia coli CFT073
agcgacagccagccca

SEQ ID NO: 624387 - RNA, 16 nt, Escherichia coli CFT073
agcgaauaucauugcc

SEQ ID NO: 624388 - RNA, 20 nt, Escherichia coli CFT073
agcgaauuaagaauuucuca

SEQ ID NO: 624389 - RNA, 14 nt, Escherichia coli CFT073
agcgaauuccaguu

SEQ ID NO: 624390 - RNA, 20 nt, Escherichia coli CFT073
agcgacaaacuccggcuuuu

SEQ ID NO: 624391 - RNA, 22 nt, Escherichia coli CFT073
agcgaaaacgacgagccaccaa

SEQ ID NO: 624392 - RNA, 15 nt, Escherichia coli CFT073
agccuuuuucagccg

SEQ ID NO: 624393 - RNA, 21 nt, Escherichia coli CFT073
agcgaaaaagucccuucccag

SEQ ID NO: 624394 - RNA, 21 nt, Escherichia coli CFT073
agccuuugacuauuucaucag

SEQ ID NO: 624395 - RNA, 18 nt, Escherichia coli CFT073
agccuuuuuuaauauuuc

SEQ ID NO: 624396 - RNA, 21 nt, Escherichia coli CFT073
agccuucggacguuugccaug

SEQ ID NO: 624397 - RNA, 17 nt, Escherichia coli CFT073
agccuucuauaucuccc

SEQ ID NO: 624398 - RNA, 18 nt, Escherichia coli CFT073
agccuguccacauccaga

SEQ ID NO: 624399 - RNA, 13 nt, Escherichia coli CFT073
agccuggaauuuc

SEQ ID NO: 624400 - RNA, 14 nt, Escherichia coli CFT073
agccuggaauuucu

SEQ ID NO: 624401 - RNA, 15 nt, Escherichia coli CFT073
agccugcuuaagacg

SEQ ID NO: 624402 - RNA, 14 nt, Escherichia coli CFT073
agccguuaaaacga

SEQ ID NO: 624403 - RNA, 13 nt, Escherichia coli CFT073
agccgugaaaaca

SEQ ID NO: 624404 - RNA, 18 nt, Escherichia coli CFT073
agccgugaaucacuccau

SEQ ID NO: 624405 - RNA, 12 nt, Escherichia coli CFT073
agccgguuuugg

SEQ ID NO: 624406 - RNA, 17 nt, Escherichia coli CFT073
agccggugcuugcaccg

SEQ ID NO: 624407 - RNA, 21 nt, Escherichia coli CFT073
agccgguuuugguuuucuguc

SEQ ID NO: 624408 - RNA, 19 nt, Escherichia coli CFT073
agccguagcuggcaaugau

SEQ ID NO: 624409 - RNA, 16 nt, Escherichia coli CFT073
agccgucgcccacagu

SEQ ID NO: 624410 - RNA, 23 nt, Escherichia coli CFT073
agccgggagcggcgucagccagu

SEQ ID NO: 624411 - RNA, 17 nt, Escherichia coli CFT073
agccggugccauuucgc

SEQ ID NO: 624412 - RNA, 21 nt, Escherichia coli CFT073
agccgguaaucaccagcaaca

SEQ ID NO: 624413 - RNA, 13 nt, Escherichia coli CFT073
agccggucauauu

SEQ ID NO: 624414 - RNA, 22 nt, Escherichia coli CFT073
agccuccucuuuuuccaucacc

SEQ ID NO: 624415 - RNA, 19 nt, Escherichia coli CFT073
agccuccaacccacaaaaa

SEQ ID NO: 624416 - RNA, 15 nt, Escherichia coli CFT073
agccucccgcaacau

SEQ ID NO: 624417 - RNA, 19 nt, Escherichia coli CFT073
agccucccugccuccauga

SEQ ID NO: 624418 - RNA, 19 nt, Escherichia coli CFT073
agccucacgguucauuagu

SEQ ID NO: 624419 - RNA, 18 nt, Escherichia coli CFT073
agccuaccagaccgcaca

SEQ ID NO: 624420 - RNA, 14 nt, Escherichia coli CFT073
agccuaccggcaua

SEQ ID NO: 624421 - RNA, 20 nt, Escherichia coli CFT073
agccuaacacagcaauaaua

SEQ ID NO: 624422 - RNA, 23 nt, Escherichia coli CFT073
agccuaagccauuuaacucaccg

SEQ ID NO: 624423 - RNA, 19 nt, Escherichia coli CFT073
agccguuggucaucaucag

SEQ ID NO: 624424 - RNA, 18 nt, Escherichia coli CFT073
agccugaugcgaugcugg

SEQ ID NO: 624425 - RNA, 21 nt, Escherichia coli CFT073
agccugauaacgaauugcugc

SEQ ID NO: 624426 - RNA, 15 nt, Escherichia coli CFT073
agccugcgcuaccag

SEQ ID NO: 624427 - RNA, 19 nt, Escherichia coli CFT073
agccugccaguggagccau

SEQ ID NO: 624428 - RNA, 16 nt, Escherichia coli CFT073
agccuccggccacgau

SEQ ID NO: 624429 - RNA, 20 nt, Escherichia coli CFT073
agccucugcguuauuuucag

SEQ ID NO: 624430 - RNA, 15 nt, Escherichia coli CFT073
agccucucucugagg

SEQ ID NO: 624431 - RNA, 12 nt, Escherichia coli CFT073
agccugaauaaa

SEQ ID NO: 624432 - RNA, 20 nt, Escherichia coli CFT073
agccugaaugccgcgcccca

SEQ ID NO: 624433 - RNA, 23 nt, Escherichia coli CFT073
agccgaagccguuggucaucauc

SEQ ID NO: 624434 - RNA, 14 nt, Escherichia coli CFT073
agccgaccagcacc

SEQ ID NO: 624435 - RNA, 22 nt, Escherichia coli CFT073
agccgagcgcuaccaucgacac

SEQ ID NO: 624436 - RNA, 12 nt, Escherichia coli CFT073
agcccugcaggg

SEQ ID NO: 624437 - RNA, 22 nt, Escherichia coli CFT073
agcccuuaguaucgauugauga

SEQ ID NO: 624438 - RNA, 18 nt, Escherichia coli CFT073
agcccuugcuucgccagu

SEQ ID NO: 624439 - RNA, 14 nt, Escherichia coli CFT073
agccgcauuuuuuc

SEQ ID NO: 624440 - RNA, 22 nt, Escherichia coli CFT073
agccgccaccagaaccgccgcu

SEQ ID NO: 624441 - RNA, 14 nt, Escherichia coli CFT073
agccgcauccgaca

SEQ ID NO: 624442 - RNA, 21 nt, Escherichia coli CFT073
agccgcauccgacacuggcag

SEQ ID NO: 624443 - RNA, 12 nt, Escherichia coli CFT073
agccgcaguaac

SEQ ID NO: 624444 - RNA, 14 nt, Escherichia coli CFT073
agccgauuuuaugu

SEQ ID NO: 624445 - RNA, 18 nt, Escherichia coli CFT073
agccgauguuauugcaga

SEQ ID NO: 624446 - RNA, 12 nt, Escherichia coli CFT073
agccgauuaaaa

SEQ ID NO: 624447 - RNA, 20 nt, Escherichia coli CFT073
agccgauuaaaaucagaauc

SEQ ID NO: 624448 - RNA, 21 nt, Escherichia coli CFT073
agccgauuaaucuuccagauc

SEQ ID NO: 624449 - RNA, 18 nt, Escherichia coli CFT073
agccgauaaagcgaccaa

SEQ ID NO: 624450 - RNA, 22 nt, Escherichia coli CFT073
agccgauaaagcgaccaaccau

SEQ ID NO: 624451 - RNA, 20 nt, Escherichia coli CFT073
agccggaggaaacuugccuc

SEQ ID NO: 624452 - RNA, 15 nt, Escherichia coli CFT073
agccggaggugaaaa

SEQ ID NO: 624453 - RNA, 17 nt, Escherichia coli CFT073
agccggaguugcagauu

SEQ ID NO: 624454 - RNA, 14 nt, Escherichia coli CFT073
agccggagcuucac

SEQ ID NO: 624455 - RNA, 17 nt, Escherichia coli CFT073
agccggauaagcaaugu

SEQ ID NO: 624456 - RNA, 17 nt, Escherichia coli CFT073
agccggauaaugcgcca

SEQ ID NO: 624457 - RNA, 14 nt, Escherichia coli CFT073
agccgcuucugcag

SEQ ID NO: 624458 - RNA, 23 nt, Escherichia coli CFT073
agccgcuuuuucugcacacacac

SEQ ID NO: 624459 - RNA, 15 nt, Escherichia coli CFT073
agccgcgugcgcugg

SEQ ID NO: 624460 - RNA, 17 nt, Escherichia coli CFT073
agccgcuaacagcagca

SEQ ID NO: 624461 - RNA, 17 nt, Escherichia coli CFT073
agccgcgcuuucuucuu

SEQ ID NO: 624462 - RNA, 19 nt, Escherichia coli CFT073
agccgcuggcgcagcaggc

SEQ ID NO: 624463 - RNA, 16 nt, Escherichia coli CFT073
agccgccagcaucuca

SEQ ID NO: 624464 - RNA, 14 nt, Escherichia coli CFT073
agccgccagacaau

SEQ ID NO: 624465 - RNA, 18 nt, Escherichia coli CFT073
agccgccauacggaaaau

SEQ ID NO: 624466 - RNA, 13 nt, Escherichia coli CFT073
agccgccauucca

SEQ ID NO: 624467 - RNA, 13 nt, Escherichia coli CFT073
agccgcccuguuu

SEQ ID NO: 624468 - RNA, 23 nt, Escherichia coli CFT073
agccgccgagcaaaccacaggcc

SEQ ID NO: 624469 - RNA, 20 nt, Escherichia coli CFT073
agccgccuuuacgcaaagca

SEQ ID NO: 624470 - RNA, 24 nt, Escherichia coli CFT073
agcccuaucaucgcggcacacagc

SEQ ID NO: 624471 - RNA, 17 nt, Escherichia coli CFT073
agcccuccucacuguug

SEQ ID NO: 624472 - RNA, 14 nt, Escherichia coli CFT073
agcccuacaaacca

SEQ ID NO: 624473 - RNA, 16 nt, Escherichia coli CFT073
agcccguguuucugau

SEQ ID NO: 624474 - RNA, 20 nt, Escherichia coli CFT073
agccccugaauucucaaacg

SEQ ID NO: 624475 - RNA, 14 nt, Escherichia coli CFT073
agcccgagcaacag

SEQ ID NO: 624476 - RNA, 15 nt, Escherichia coli CFT073
agcccgagcaacagu

SEQ ID NO: 624477 - RNA, 21 nt, Escherichia coli CFT073
agccccgcuuuuuucagcgcc

SEQ ID NO: 624478 - RNA, 16 nt, Escherichia coli CFT073
agccccucagcgguca

SEQ ID NO: 624479 - RNA, 16 nt, Escherichia coli CFT073
agcccgccagaccagc

SEQ ID NO: 624480 - RNA, 15 nt, Escherichia coli CFT073
agcccgccgagaauu

SEQ ID NO: 624481 - RNA, 15 nt, Escherichia coli CFT073
agcccgccaucgccc

SEQ ID NO: 624482 - RNA, 16 nt, Escherichia coli CFT073
agcccgccggaaagca

SEQ ID NO: 624483 - RNA, 23 nt, Escherichia coli CFT073
agcccaaagagcaagaaccccag

SEQ ID NO: 624484 - RNA, 15 nt, Escherichia coli CFT073
agccauuuuuugaac

SEQ ID NO: 624485 - RNA, 22 nt, Escherichia coli CFT073
agccauugaguagccucugcgu

SEQ ID NO: 624486 - RNA, 16 nt, Escherichia coli CFT073
agcccagaaauugcga

SEQ ID NO: 624487 - RNA, 16 nt, Escherichia coli CFT073
agcccacaugccugca

SEQ ID NO: 624488 - RNA, 16 nt, Escherichia coli CFT073
agccccagaacucacg

SEQ ID NO: 624489 - RNA, 21 nt, Escherichia coli CFT073
agcccauuuuuuugagaacau

SEQ ID NO: 624490 - RNA, 23 nt, Escherichia coli CFT073
agcccccacgccauacccgcaca

SEQ ID NO: 624491 - RNA, 14 nt, Escherichia coli CFT073
agcccccaguaauc

SEQ ID NO: 624492 - RNA, 12 nt, Escherichia coli CFT073
agccccaguucc

SEQ ID NO: 624493 - RNA, 23 nt, Escherichia coli CFT073
agccccauaugcagcacuugcag

SEQ ID NO: 624494 - RNA, 12 nt, Escherichia coli CFT073
agccccgcagcc

SEQ ID NO: 624495 - RNA, 19 nt, Escherichia coli CFT073
agcccaugcguuaucgcca

SEQ ID NO: 624496 - RNA, 18 nt, Escherichia coli CFT073
agcccaucgccagcgcuu

SEQ ID NO: 624497 - RNA, 18 nt, Escherichia coli CFT073
agcccaucguugaaaaaa

SEQ ID NO: 624498 - RNA, 20 nt, Escherichia coli CFT073
agcccaucguugaaaaaauu

SEQ ID NO: 624499 - RNA, 22 nt, Escherichia coli CFT073
agcccauacuuaaugccaguuc

SEQ ID NO: 624500 - RNA, 16 nt, Escherichia coli CFT073
agcccaucaccgccag

SEQ ID NO: 624501 - RNA, 18 nt, Escherichia coli CFT073
agcccaucaccgccaggc

SEQ ID NO: 624502 - RNA, 17 nt, Escherichia coli CFT073
agcccaguucagcggcu

SEQ ID NO: 624503 - RNA, 19 nt, Escherichia coli CFT073
agcccaguucagcggcuga

SEQ ID NO: 624504 - RNA, 22 nt, Escherichia coli CFT073
auaaacggucuacauugcucau

SEQ ID NO: 624505 - RNA, 22 nt, Escherichia coli CFT073
auaaacgccagguucaucaauu

SEQ ID NO: 624506 - RNA, 15 nt, Escherichia coli CFT073
auaaacgccugacga

SEQ ID NO: 624507 - RNA, 15 nt, Escherichia coli CFT073
auaaacgcuccugcu

SEQ ID NO: 624508 - RNA, 19 nt, Escherichia coli CFT073
auaaacggcacgaucaaga

SEQ ID NO: 624509 - RNA, 22 nt, Escherichia coli CFT073
auaaacggcacgaucaagagau

SEQ ID NO: 624510 - RNA, 17 nt, Escherichia coli CFT073
auaaacaccagcaauaa

SEQ ID NO: 624511 - RNA, 18 nt, Escherichia coli CFT073
auaaacaccagcaauaau

SEQ ID NO: 624512 - RNA, 17 nt, Escherichia coli CFT073
auaaacaccagcagcag

SEQ ID NO: 624513 - RNA, 15 nt, Escherichia coli CFT073
auaaacaccagcaau

SEQ ID NO: 624514 - RNA, 19 nt, Escherichia coli CFT073
auaaacagcguaaauaugc

SEQ ID NO: 624515 - RNA, 16 nt, Escherichia coli CFT073
auaaacauccuuuuca

SEQ ID NO: 624516 - RNA, 19 nt, Escherichia coli CFT073
auaaacauccuuuucaccu

SEQ ID NO: 624517 - RNA, 20 nt, Escherichia coli CFT073
auaaacauccuuuucaccuu

SEQ ID NO: 624518 - RNA, 21 nt, Escherichia coli CFT073
auaaacaucgccauaaacacc

SEQ ID NO: 624519 - RNA, 19 nt, Escherichia coli CFT073
auaaacaucgggacaugau

SEQ ID NO: 624520 - RNA, 20 nt, Escherichia coli CFT073
auaaacauugguccgauugu

SEQ ID NO: 624521 - RNA, 14 nt, Escherichia coli CFT073
auaaaaucccauaa

SEQ ID NO: 624522 - RNA, 20 nt, Escherichia coli CFT073
auaaaauccguaaucgcuuu

SEQ ID NO: 624523 - RNA, 15 nt, Escherichia coli CFT073
auaaaauaucuucua

SEQ ID NO: 624524 - RNA, 11 nt, Escherichia coli CFT073
auaaaaucaca

SEQ ID NO: 624525 - RNA, 23 nt, Escherichia coli CFT073
auaaaaucagcuuccuugcugau

SEQ ID NO: 624526 - RNA, 18 nt, Escherichia coli CFT073
auaaaagggcagcaggau

SEQ ID NO: 624527 - RNA, 13 nt, Escherichia coli CFT073
auaaaagccugau

SEQ ID NO: 624528 - RNA, 22 nt, Escherichia coli CFT073
auaaaagccugaucaaucauca

SEQ ID NO: 624529 - RNA, 21 nt, Escherichia coli CFT073
auaaaaguuuccuguuucuca

SEQ ID NO: 624530 - RNA, 15 nt, Escherichia coli CFT073
auaaaacgccugaua

SEQ ID NO: 624531 - RNA, 11 nt, Escherichia coli CFT073
auaaaacauua

SEQ ID NO: 624532 - RNA, 13 nt, Escherichia coli CFT073
auaaaacagggcg

SEQ ID NO: 624533 - RNA, 13 nt, Escherichia coli CFT073
auaaaacacauca

SEQ ID NO: 624534 - RNA, 18 nt, Escherichia coli CFT073
auaaaguuuuuauauuuu

SEQ ID NO: 624535 - RNA, 19 nt, Escherichia coli CFT073
auaaagaaugaaauucgag

SEQ ID NO: 624536 - RNA, 23 nt, Escherichia coli CFT073
auaaagaaugaaauucgagagaa

SEQ ID NO: 624537 - RNA, 14 nt, Escherichia coli CFT073
auaaaugccaaaga

SEQ ID NO: 624538 - RNA, 15 nt, Escherichia coli CFT073
auaaaugccgcaaug

SEQ ID NO: 624539 - RNA, 13 nt, Escherichia coli CFT073
auaaauggcgaac

SEQ ID NO: 624540 - RNA, 21 nt, Escherichia coli CFT073
auaaaugcacgcugccuggug

SEQ ID NO: 624541 - RNA, 11 nt, Escherichia coli CFT073
auaaaucagau

SEQ ID NO: 624542 - RNA, 15 nt, Escherichia coli CFT073
auaaaucaauacguu

SEQ ID NO: 624543 - RNA, 14 nt, Escherichia coli CFT073
auaacaaauaauug

SEQ ID NO: 624544 - RNA, 19 nt, Escherichia coli CFT073
auaacaaauaucuuucuac

SEQ ID NO: 624545 - RNA, 16 nt, Escherichia coli CFT073
auaacaaucaccaaac

SEQ ID NO: 624546 - RNA, 19 nt, Escherichia coli CFT073
auaacagcgggacaacaaa

SEQ ID NO: 624547 - RNA, 14 nt, Escherichia coli CFT073
auaacagcuggaua

SEQ ID NO: 624548 - RNA, 18 nt, Escherichia coli CFT073
auaacagcuggauaucaa

SEQ ID NO: 624549 - RNA, 17 nt, Escherichia coli CFT073
auaaauugcaauuuuua

SEQ ID NO: 624550 - RNA, 21 nt, Escherichia coli CFT073
auaaauugccugcgugcauau

SEQ ID NO: 624551 - RNA, 15 nt, Escherichia coli CFT073
auaaauuggcugggg

SEQ ID NO: 624552 - RNA, 18 nt, Escherichia coli CFT073
auaacaggcgauuucaaa

SEQ ID NO: 624553 - RNA, 21 nt, Escherichia coli CFT073
auaaccagcguuuccagcacc

SEQ ID NO: 624554 - RNA, 11 nt, Escherichia coli CFT073
auaaccaggca

SEQ ID NO: 624555 - RNA, 14 nt, Escherichia coli CFT073
auaaccaggcaguu

SEQ ID NO: 624556 - RNA, 18 nt, Escherichia coli CFT073
auaaccacgcucagcaau

SEQ ID NO: 624557 - RNA, 19 nt, Escherichia coli CFT073
auaaccacgcucagcaauc

SEQ ID NO: 624558 - RNA, 21 nt, Escherichia coli CFT073
auaaccaauguggguguuaag

SEQ ID NO: 624559 - RNA, 20 nt, Escherichia coli CFT073
auaaccauccgagcagcaau

SEQ ID NO: 624560 - RNA, 18 nt, Escherichia coli CFT073
auaaccauuccacgggca

SEQ ID NO: 624561 - RNA, 13 nt, Escherichia coli CFT073
aguuucaacauca

SEQ ID NO: 624562 - RNA, 23 nt, Escherichia coli CFT073
aguuucaccucuccgggcggcgu

SEQ ID NO: 624563 - RNA, 16 nt, Escherichia coli CFT073
aguuucagccccauca

SEQ ID NO: 624564 - RNA, 17 nt, Escherichia coli CFT073
aguuucagccccaucag

SEQ ID NO: 624565 - RNA, 22 nt, Escherichia coli CFT073
aguuucagccccaucagcgcca

SEQ ID NO: 624566 - RNA, 19 nt, Escherichia coli CFT073
aguuugccguuaaucucuc

SEQ ID NO: 624567 - RNA, 21 nt, Escherichia coli CFT073
aguuugccguuaaucucuccc

SEQ ID NO: 624568 - RNA, 22 nt, Escherichia coli CFT073
aguuuggucuggcaaaaauaag

SEQ ID NO: 624569 - RNA, 19 nt, Escherichia coli CFT073
aguuugcccgucugcugcu

SEQ ID NO: 624570 - RNA, 18 nt, Escherichia coli CFT073
aguuugcgggacaacuug

SEQ ID NO: 624571 - RNA, 15 nt, Escherichia coli CFT073
aguuugcucaaaucc

SEQ ID NO: 624572 - RNA, 16 nt, Escherichia coli CFT073
aguuugcugacaaagu

SEQ ID NO: 624573 - RNA, 15 nt, Escherichia coli CFT073
aguuuucaugaauaa

SEQ ID NO: 624574 - RNA, 17 nt, Escherichia coli CFT073
aguuuuccgccauucag

SEQ ID NO: 624575 - RNA, 18 nt, Escherichia coli CFT073
aguuuuugcccaucaugc

SEQ ID NO: 624576 - RNA, 15 nt, Escherichia coli CFT073
aguuuuugcccauca

SEQ ID NO: 624577 - RNA, 16 nt, Escherichia coli CFT073
aguuuuucuacuaacu

SEQ ID NO: 624578 - RNA, 16 nt, Escherichia coli CFT073
aguugcgguuucaacu

SEQ ID NO: 624579 - RNA, 17 nt, Escherichia coli CFT073
aguugccguucuucccg

SEQ ID NO: 624580 - RNA, 15 nt, Escherichia coli CFT073
aguugagcuuuuucc

SEQ ID NO: 624581 - RNA, 21 nt, Escherichia coli CFT073
aguugagcaguccccacauca

SEQ ID NO: 624582 - RNA, 20 nt, Escherichia coli CFT073
aguugaugauguucaacuuu

SEQ ID NO: 624583 - RNA, 15 nt, Escherichia coli CFT073
aguugcauaccauuc

SEQ ID NO: 624584 - RNA, 13 nt, Escherichia coli CFT073
aguugccagcagc

SEQ ID NO: 624585 - RNA, 18 nt, Escherichia coli CFT073
aguugauauacaccugau

SEQ ID NO: 624586 - RNA, 18 nt, Escherichia coli CFT073
aguuguccauuaauaccc

SEQ ID NO: 624587 - RNA, 16 nt, Escherichia coli CFT073
aguuguaauaagaggu

SEQ ID NO: 624588 - RNA, 19 nt, Escherichia coli CFT073
aguugguagagcacgaccu

SEQ ID NO: 624589 - RNA, 15 nt, Escherichia coli CFT073
aguugguauggcugu

SEQ ID NO: 624590 - RNA, 12 nt, Escherichia coli CFT073
aguuuaugcagu

SEQ ID NO: 624591 - RNA, 16 nt, Escherichia coli CFT073
aguuuagcucagaauu

SEQ ID NO: 624592 - RNA, 15 nt, Escherichia coli CFT073
aguuuauucuuuacu

SEQ ID NO: 624593 - RNA, 21 nt, Escherichia coli CFT073
aguuuauucuuuacugccaac

SEQ ID NO: 624594 - RNA, 16 nt, Escherichia coli CFT073
aguugugcaaugucuu

SEQ ID NO: 624595 - RNA, 21 nt, Escherichia coli CFT073
aguuuacucacaucugacaaa

SEQ ID NO: 624596 - RNA, 18 nt, Escherichia coli CFT073
aguucucaccaaaggcac

SEQ ID NO: 624597 - RNA, 19 nt, Escherichia coli CFT073
aguucgcgcgcugccagaa

SEQ ID NO: 624598 - RNA, 20 nt, Escherichia coli CFT073
aguucuucgguggucauuuu

SEQ ID NO: 624599 - RNA, 22 nt, Escherichia coli CFT073
aguucuucgguggucauuuuau

SEQ ID NO: 624600 - RNA, 15 nt, Escherichia coli CFT073
aguucgaugcucugu

SEQ ID NO: 624601 - RNA, 15 nt, Escherichia coli CFT073
aguucgccaucaaau

SEQ ID NO: 624602 - RNA, 17 nt, Escherichia coli CFT073
aguuccgggaucaccag

SEQ ID NO: 624603 - RNA, 22 nt, Escherichia coli CFT073
aguucccuacucucgcaugggg

SEQ ID NO: 624604 - RNA, 12 nt, Escherichia coli CFT073
aguucaucaacg

SEQ ID NO: 624605 - RNA, 17 nt, Escherichia coli CFT073
aguucaucaagcuguuc

SEQ ID NO: 624606 - RNA, 20 nt, Escherichia coli CFT073
aguucaucaagcuguuccuc

SEQ ID NO: 624607 - RNA, 20 nt, Escherichia coli CFT073
aguucagcagugacaaucuc

SEQ ID NO: 624608 - RNA, 21 nt, Escherichia coli CFT073
aguucagacgcucuuucacca

SEQ ID NO: 624609 - RNA, 12 nt, Escherichia coli CFT073
aguucacugccg

SEQ ID NO: 624610 - RNA, 23 nt, Escherichia coli CFT073
aguucacuugugcgguguggccu

SEQ ID NO: 624611 - RNA, 17 nt, Escherichia coli CFT073
aguuacccagcggauaa

SEQ ID NO: 624612 - RNA, 22 nt, Escherichia coli CFT073
aguuaccgccggcuucaucuuu

SEQ ID NO: 624613 - RNA, 13 nt, Escherichia coli CFT073
aguuacagcucuc

SEQ ID NO: 624614 - RNA, 17 nt, Escherichia coli CFT073
aguuacagcucucacuu

SEQ ID NO: 624615 - RNA, 21 nt, Escherichia coli CFT073
aguuacaucagaguacagauu

SEQ ID NO: 624616 - RNA, 14 nt, Escherichia coli CFT073
aguuaagauucagc

SEQ ID NO: 624617 - RNA, 17 nt, Escherichia coli CFT073
aguuaagcccuuaguau

SEQ ID NO: 624618 - RNA, 20 nt, Escherichia coli CFT073
aguuaaucaguuuaucaauc

SEQ ID NO: 624619 - RNA, 21 nt, Escherichia coli CFT073
aguuaaucgccgcauaauauc

SEQ ID NO: 624620 - RNA, 17 nt, Escherichia coli CFT073
agugcuuucauuucagc

SEQ ID NO: 624621 - RNA, 11 nt, Escherichia coli CFT073
agugcuuucag

SEQ ID NO: 624622 - RNA, 16 nt, Escherichia coli CFT073
agugcuuucagcgaaa

SEQ ID NO: 624623 - RNA, 21 nt, Escherichia coli CFT073
aguggaaauccccaucagguu

SEQ ID NO: 624624 - RNA, 17 nt, Escherichia coli CFT073
agugcugcuggaaaagg

SEQ ID NO: 624625 - RNA, 14 nt, Escherichia coli CFT073
agugcugggcuggg

SEQ ID NO: 624626 - RNA, 20 nt, Escherichia coli CFT073
agugccggacggugcgggga

SEQ ID NO: 624627 - RNA, 20 nt, Escherichia coli CFT073
agugccggaugcgaugcuga

SEQ ID NO: 624628 - RNA, 19 nt, Escherichia coli CFT073
agugcccguccccugagca

SEQ ID NO: 624629 - RNA, 17 nt, Escherichia coli CFT073
agugcgcucuucaacuu

SEQ ID NO: 624630 - RNA, 21 nt, Escherichia coli CFT073
agugcgggcgagaggaauuua

SEQ ID NO: 624631 - RNA, 17 nt, Escherichia coli CFT073
agugcgguaaauuuuuu

SEQ ID NO: 624632 - RNA, 22 nt, Escherichia coli CFT073
agugcgguaaauuuuuugauca

SEQ ID NO: 624633 - RNA, 18 nt, Escherichia coli CFT073
agugcaacagagagcaaa

SEQ ID NO: 624634 - RNA, 17 nt, Escherichia coli CFT073
agugcaacuuuacuaaa

SEQ ID NO: 624635 - RNA, 18 nt, Escherichia coli CFT073
agugcaacuuuacuaaaa

SEQ ID NO: 624636 - RNA, 17 nt, Escherichia coli CFT073
agugauuccguucagua

SEQ ID NO: 624637 - RNA, 18 nt, Escherichia coli CFT073
agugcccgaccacuucau

SEQ ID NO: 624638 - RNA, 16 nt, Escherichia coli CFT073
agugccagaacagaaa

SEQ ID NO: 624639 - RNA, 20 nt, Escherichia coli CFT073
agugcacuucuucacaucaa

SEQ ID NO: 624640 - RNA, 16 nt, Escherichia coli CFT073
agucucaaaccggcuc

SEQ ID NO: 624641 - RNA, 14 nt, Escherichia coli CFT073
agucuccauuuuuu

SEQ ID NO: 624642 - RNA, 16 nt, Escherichia coli CFT073
agucuccauuuuuuug

SEQ ID NO: 624643 - RNA, 20 nt, Escherichia coli CFT073
agucguauuaucgcgcugaa

SEQ ID NO: 624644 - RNA, 20 nt, Escherichia coli CFT073
agugaaaucgccgggauaua

SEQ ID NO: 624645 - RNA, 13 nt, Escherichia coli CFT073
agugaaaugcuuu

SEQ ID NO: 624646 - RNA, 22 nt, Escherichia coli CFT073
agugaaauguugccggauggca

SEQ ID NO: 624647 - RNA, 23 nt, Escherichia coli CFT073
agugaaaaaagcaagauuaaaau

SEQ ID NO: 624648 - RNA, 20 nt, Escherichia coli CFT073
agugaauccccaggagcuua

SEQ ID NO: 624649 - RNA, 19 nt, Escherichia coli CFT073
agugaggcguggcgcccca

SEQ ID NO: 624650 - RNA, 20 nt, Escherichia coli CFT073
agugauaccccgcaucgugg

SEQ ID NO: 624651 - RNA, 13 nt, Escherichia coli CFT073
agugauggcggca

SEQ ID NO: 624652 - RNA, 23 nt, Escherichia coli CFT073
aguccgccagaauacccgaagcg

SEQ ID NO: 624653 - RNA, 14 nt, Escherichia coli CFT073
aguccucaucaucc

SEQ ID NO: 624654 - RNA, 16 nt, Escherichia coli CFT073
aguccugaauuaaaca

SEQ ID NO: 624655 - RNA, 11 nt, Escherichia coli CFT073
aguccgaugcc

SEQ ID NO: 624656 - RNA, 18 nt, Escherichia coli CFT073
agucccuuucaggucagu

SEQ ID NO: 624657 - RNA, 19 nt, Escherichia coli CFT073
agucccugcucuuucagca

SEQ ID NO: 624658 - RNA, 21 nt, Escherichia coli CFT073
agucccugcucuuucagcacc

SEQ ID NO: 624659 - RNA, 16 nt, Escherichia coli CFT073
agucccuacugcuccu

SEQ ID NO: 624660 - RNA, 14 nt, Escherichia coli CFT073
agucccuccgcaca

SEQ ID NO: 624661 - RNA, 13 nt, Escherichia coli CFT073
agucccguaccca

SEQ ID NO: 624662 - RNA, 18 nt, Escherichia coli CFT073
agucgcuuucauucagaa

SEQ ID NO: 624663 - RNA, 19 nt, Escherichia coli CFT073
agucgcuuucauucagaac

SEQ ID NO: 624664 - RNA, 18 nt, Escherichia coli CFT073
agucgcugugacauccag

SEQ ID NO: 624665 - RNA, 16 nt, Escherichia coli CFT073
agucgcuugcaggauc

SEQ ID NO: 624666 - RNA, 16 nt, Escherichia coli CFT073
agucgcguuaaagcgu

SEQ ID NO: 624667 - RNA, 23 nt, Escherichia coli CFT073
agucggaaccgguuuagaaaaga

SEQ ID NO: 624668 - RNA, 14 nt, Escherichia coli CFT073
agucgggugcugcc

SEQ ID NO: 624669 - RNA, 15 nt, Escherichia coli CFT073
agucggcgcaaccuu

SEQ ID NO: 624670 - RNA, 20 nt, Escherichia coli CFT073
agucgcaaaucagcggcaga

SEQ ID NO: 624671 - RNA, 18 nt, Escherichia coli CFT073
agucgcaaaacucaccuu

SEQ ID NO: 624672 - RNA, 18 nt, Escherichia coli CFT073
agucauuaacucaguugc

SEQ ID NO: 624673 - RNA, 15 nt, Escherichia coli CFT073
agucauuacucaucc

SEQ ID NO: 624674 - RNA, 13 nt, Escherichia coli CFT073
agucauuccuuca

SEQ ID NO: 624675 - RNA, 12 nt, Escherichia coli CFT073
agucauuguaaa

SEQ ID NO: 624676 - RNA, 20 nt, Escherichia coli CFT073
agucauuguaaauugcagua

SEQ ID NO: 624677 - RNA, 21 nt, Escherichia coli CFT073
agucauuguaaauugcaguac

SEQ ID NO: 624678 - RNA, 21 nt, Escherichia coli CFT073
agucauacuuauugaaagcaa

SEQ ID NO: 624679 - RNA, 17 nt, Escherichia coli CFT073
agucaucacuuucagac

SEQ ID NO: 624680 - RNA, 20 nt, Escherichia coli CFT073
agucaucaguugcaccugau

SEQ ID NO: 624681 - RNA, 19 nt, Escherichia coli CFT073
agucauccggcgucaucuu

SEQ ID NO: 624682 - RNA, 14 nt, Escherichia coli CFT073
agucaucaguugca

SEQ ID NO: 624683 - RNA, 13 nt, Escherichia coli CFT073
agucaucgggcgu

SEQ ID NO: 624684 - RNA, 20 nt, Escherichia coli CFT073
agucaucgggcguuuucuug

SEQ ID NO: 624685 - RNA, 18 nt, Escherichia coli CFT073
aguccaccuggccugcga

SEQ ID NO: 624686 - RNA, 22 nt, Escherichia coli CFT073
aguccagccccgcgcggcgcag

SEQ ID NO: 624687 - RNA, 24 nt, Escherichia coli CFT073
aguccagccccgcgcggcgcaggc

SEQ ID NO: 624688 - RNA, 17 nt, Escherichia coli CFT073
aguccacccccauaauc

SEQ ID NO: 624689 - RNA, 17 nt, Escherichia coli CFT073
aguccauggcagaugau

SEQ ID NO: 624690 - RNA, 16 nt, Escherichia coli CFT073
aguccaggccugauua

SEQ ID NO: 624691 - RNA, 12 nt, Escherichia coli CFT073
agucccaguuca

SEQ ID NO: 624692 - RNA, 16 nt, Escherichia coli CFT073
agucccaucuucugaa

SEQ ID NO: 624693 - RNA, 21 nt, Escherichia coli CFT073
agucccaucuucugaaucaga

SEQ ID NO: 624694 - RNA, 15 nt, Escherichia coli CFT073
agucccaaacagcag

SEQ ID NO: 624695 - RNA, 18 nt, Escherichia coli CFT073
agucaaggaaugaaauau

SEQ ID NO: 624696 - RNA, 23 nt, Escherichia coli CFT073
agucaaggaaugaaauauuaucu

SEQ ID NO: 624697 - RNA, 19 nt, Escherichia coli CFT073
agucaaaagccuccgaccg

SEQ ID NO: 624698 - RNA, 14 nt, Escherichia coli CFT073
agucaaaauucaac

SEQ ID NO: 624699 - RNA, 23 nt, Escherichia coli CFT073
agucaaugaaauuacuuuccauc

SEQ ID NO: 624700 - RNA, 19 nt, Escherichia coli CFT073
agucacccgauaaauaaua

SEQ ID NO: 624701 - RNA, 14 nt, Escherichia coli CFT073
agucacccugcccg

SEQ ID NO: 624702 - RNA, 14 nt, Escherichia coli CFT073
agucaccagcauca

SEQ ID NO: 624703 - RNA, 19 nt, Escherichia coli CFT073
agucaccugcggugcagcc

SEQ ID NO: 624704 - RNA, 21 nt, Escherichia coli CFT073
agucaccuuucagccacuuca

SEQ ID NO: 624705 - RNA, 16 nt, Escherichia coli CFT073
agucacgacaaagacg

SEQ ID NO: 624706 - RNA, 16 nt, Escherichia coli CFT073
agucagauuagaacug

SEQ ID NO: 624707 - RNA, 22 nt, Escherichia coli CFT073
agucagauuagaacugauaaac

SEQ ID NO: 624708 - RNA, 16 nt, Escherichia coli CFT073
agucagauaccaguug

SEQ ID NO: 624709 - RNA, 16 nt, Escherichia coli CFT073
agucagcgaacaccag

SEQ ID NO: 624710 - RNA, 17 nt, Escherichia coli CFT073
agucagcaaugccagag

SEQ ID NO: 624711 - RNA, 22 nt, Escherichia coli CFT073
agucacgguuaaucagauaauc

SEQ ID NO: 624712 - RNA, 21 nt, Escherichia coli CFT073
agucaggggcuuccagcaaau

SEQ ID NO: 624713 - RNA, 18 nt, Escherichia coli CFT073
agucagcgaacaccagca

SEQ ID NO: 624714 - RNA, 13 nt, Escherichia coli CFT073
agucaggaagccc

SEQ ID NO: 624715 - RNA, 17 nt, Escherichia coli CFT073
agucaggggagugaggu

SEQ ID NO: 624716 - RNA, 20 nt, Escherichia coli CFT073
aguauggacgugcucugguu

SEQ ID NO: 624717 - RNA, 15 nt, Escherichia coli CFT073
aguaugcgcgucaga

SEQ ID NO: 624718 - RNA, 18 nt, Escherichia coli CFT073
aguaucgaaaacaucaaa

SEQ ID NO: 624719 - RNA, 21 nt, Escherichia coli CFT073
aguaucguguccggcaauaaa

SEQ ID NO: 624720 - RNA, 22 nt, Escherichia coli CFT073
aguaucguguccggcaauaaac

SEQ ID NO: 624721 - RNA, 16 nt, Escherichia coli CFT073
aguauauugcagaaau

SEQ ID NO: 624722 - RNA, 13 nt, Escherichia coli CFT073
aguauauugcuga

SEQ ID NO: 624723 - RNA, 13 nt, Escherichia coli CFT073
aguaucaccaacu

SEQ ID NO: 624724 - RNA, 21 nt, Escherichia coli CFT073
aguaugugacuggaaaucaaa

SEQ ID NO: 624725 - RNA, 16 nt, Escherichia coli CFT073
aguauguauacaaaau

SEQ ID NO: 624726 - RNA, 11 nt, Escherichia coli CFT073
aguauuaaaug

SEQ ID NO: 624727 - RNA, 14 nt, Escherichia coli CFT073
aguauuaaccgguu

SEQ ID NO: 624728 - RNA, 22 nt, Escherichia coli CFT073
aguauuauucuugacuaucacu

SEQ ID NO: 624729 - RNA, 13 nt, Escherichia coli CFT073
aguauuuccagcu

SEQ ID NO: 624730 - RNA, 16 nt, Escherichia coli CFT073
aguauuuccagcucaa

SEQ ID NO: 624731 - RNA, 19 nt, Escherichia coli CFT073
aguagcgucgccagcaguu

SEQ ID NO: 624732 - RNA, 16 nt, Escherichia coli CFT073
aguagccccgcgggga

SEQ ID NO: 624733 - RNA, 20 nt, Escherichia coli CFT073
aguagccaauaccaaaauca

SEQ ID NO: 624734 - RNA, 20 nt, Escherichia coli CFT073
aguagcaaccggauuuuuau

SEQ ID NO: 624735 - RNA, 13 nt, Escherichia coli CFT073
aguagcaccucuc

SEQ ID NO: 624736 - RNA, 14 nt, Escherichia coli CFT073
aguagcuugaaauc

SEQ ID NO: 624737 - RNA, 17 nt, Escherichia coli CFT073
aguagcucaccagcagg

SEQ ID NO: 624738 - RNA, 22 nt, Escherichia coli CFT073
aguaguaaugaucacuggaaga

SEQ ID NO: 624739 - RNA, 20 nt, Escherichia coli CFT073
aguaguacgcgggaauagcu

SEQ ID NO: 624740 - RNA, 21 nt, Escherichia coli CFT073
aguaguacgcgggaauagcuc

SEQ ID NO: 624741 - RNA, 17 nt, Escherichia coli CFT073
aguaguggaugaaucuc

SEQ ID NO: 624742 - RNA, 15 nt, Escherichia coli CFT073
aguaguucauccccu

SEQ ID NO: 624743 - RNA, 16 nt, Escherichia coli CFT073
aguaguucauccccuc

SEQ ID NO: 624744 - RNA, 14 nt, Escherichia coli CFT073
aguaguuugguuaa

SEQ ID NO: 624745 - RNA, 19 nt, Escherichia coli CFT073
aguaguuuuugcagaugga

SEQ ID NO: 624746 - RNA, 16 nt, Escherichia coli CFT073
aguauagaaggugacg

SEQ ID NO: 624747 - RNA, 13 nt, Escherichia coli CFT073
aguacuuuaacuc

SEQ ID NO: 624748 - RNA, 18 nt, Escherichia coli CFT073
aguacuuuaccuggaacu

SEQ ID NO: 624749 - RNA, 16 nt, Escherichia coli CFT073
aguacuaaauaauuug

SEQ ID NO: 624750 - RNA, 20 nt, Escherichia coli CFT073
aguacucgcacuuuucccac

SEQ ID NO: 624751 - RNA, 22 nt, Escherichia coli CFT073
aguacugacuauccacuggaau

SEQ ID NO: 624752 - RNA, 19 nt, Escherichia coli CFT073
aguacugccgggaagaagu

SEQ ID NO: 624753 - RNA, 17 nt, Escherichia coli CFT073
aguacuggaagaaaaca

SEQ ID NO: 624754 - RNA, 17 nt, Escherichia coli CFT073
aguacuggaagccauuu

SEQ ID NO: 624755 - RNA, 15 nt, Escherichia coli CFT073
aguagaacgggaagu

SEQ ID NO: 624756 - RNA, 22 nt, Escherichia coli CFT073
aguagaauaaucuguuucucau

SEQ ID NO: 624757 - RNA, 20 nt, Escherichia coli CFT073
aguagcaaaguggcgcagag

SEQ ID NO: 624758 - RNA, 17 nt, Escherichia coli CFT073
agcuggcagccccguuc

SEQ ID NO: 624759 - RNA, 15 nt, Escherichia coli CFT073
agcuggcggcaaaaa

SEQ ID NO: 624760 - RNA, 14 nt, Escherichia coli CFT073
aguacgaaauaacu

SEQ ID NO: 624761 - RNA, 18 nt, Escherichia coli CFT073
aguacgcaguaaauaaaa

SEQ ID NO: 624762 - RNA, 19 nt, Escherichia coli CFT073
aguacgcggacacuuuccu

SEQ ID NO: 624763 - RNA, 22 nt, Escherichia coli CFT073
aguacgcgggcaacgccuucca

SEQ ID NO: 624764 - RNA, 14 nt, Escherichia coli CFT073
aucaacaauuccca

SEQ ID NO: 624765 - RNA, 23 nt, Escherichia coli CFT073
aucaacaauugcgggccaaagac

SEQ ID NO: 624766 - RNA, 14 nt, Escherichia coli CFT073
aucaacacauugaa

SEQ ID NO: 624767 - RNA, 13 nt, Escherichia coli CFT073
aucaacagaauga

SEQ ID NO: 624768 - RNA, 21 nt, Escherichia coli CFT073
aucaacagauaaauggcacag

SEQ ID NO: 624769 - RNA, 22 nt, Escherichia coli CFT073
aucaacaccgacuucaauaacg

SEQ ID NO: 624770 - RNA, 13 nt, Escherichia coli CFT073
aucaacagcauau

SEQ ID NO: 624771 - RNA, 14 nt, Escherichia coli CFT073
aucaacaggaacau

SEQ ID NO: 624772 - RNA, 16 nt, Escherichia coli CFT073
aucaacucaggaacau

SEQ ID NO: 624773 - RNA, 21 nt, Escherichia coli CFT073
aucaacucaggaacaucagca

SEQ ID NO: 624774 - RNA, 15 nt, Escherichia coli CFT073
aucaacaucauuaac

SEQ ID NO: 624775 - RNA, 14 nt, Escherichia coli CFT073
aucaacggugccau

SEQ ID NO: 624776 - RNA, 21 nt, Escherichia coli CFT073
aucaacgguuuuacaaugucc

SEQ ID NO: 624777 - RNA, 14 nt, Escherichia coli CFT073
aucaacguagaaua

SEQ ID NO: 624778 - RNA, 22 nt, Escherichia coli CFT073
aucaacguaguaucguaaucag

SEQ ID NO: 624779 - RNA, 19 nt, Escherichia coli CFT073
aucaacuucaacaguggcg

SEQ ID NO: 624780 - RNA, 14 nt, Escherichia coli CFT073
aucaaucagccccu

SEQ ID NO: 624781 - RNA, 15 nt, Escherichia coli CFT073
aucaaucagccccuu

SEQ ID NO: 624782 - RNA, 13 nt, Escherichia coli CFT073
aucaaucaucagg

SEQ ID NO: 624783 - RNA, 21 nt, Escherichia coli CFT073
aucaauacuuuccagcauaug

SEQ ID NO: 624784 - RNA, 14 nt, Escherichia coli CFT073
aucaaucaccucuu

SEQ ID NO: 624785 - RNA, 19 nt, Escherichia coli CFT073
aucaauaccagcuguuuug

SEQ ID NO: 624786 - RNA, 15 nt, Escherichia coli CFT073
aucaagaaugcucgc

SEQ ID NO: 624787 - RNA, 12 nt, Escherichia coli CFT073
auauuuccccaa

SEQ ID NO: 624788 - RNA, 18 nt, Escherichia coli CFT073
auauuucgucgcaucaca

SEQ ID NO: 624789 - RNA, 11 nt, Escherichia coli CFT073
auauuucacau

SEQ ID NO: 624790 - RNA, 21 nt, Escherichia coli CFT073
auauuucagagcuuuguugcg

SEQ ID NO: 624791 - RNA, 15 nt, Escherichia coli CFT073
auauuucaggccaac

SEQ ID NO: 624792 - RNA, 18 nt, Escherichia coli CFT073
auauuucauucuccauuu

SEQ ID NO: 624793 - RNA, 15 nt, Escherichia coli CFT073
aucaaaaucaccgau

SEQ ID NO: 624794 - RNA, 20 nt, Escherichia coli CFT073
aucaaaaucaccgaugacag

SEQ ID NO: 624795 - RNA, 18 nt, Escherichia coli CFT073
aucaaaaugaacauuggc

SEQ ID NO: 624796 - RNA, 18 nt, Escherichia coli CFT073
aucaaauaaauaaucucu

SEQ ID NO: 624797 - RNA, 22 nt, Escherichia coli CFT073
aucaaauaaauaaucucuuccg

SEQ ID NO: 624798 - RNA, 11 nt, Escherichia coli CFT073
aucaaaucaca

SEQ ID NO: 624799 - RNA, 13 nt, Escherichia coli CFT073
aucaaaucaccau

SEQ ID NO: 624800 - RNA, 18 nt, Escherichia coli CFT073
aucaaaucaaccaggccu

SEQ ID NO: 624801 - RNA, 23 nt, Escherichia coli CFT073
aucaaaucaccauauucagcagc

SEQ ID NO: 624802 - RNA, 16 nt, Escherichia coli CFT073
aucaaauccaauaacg

SEQ ID NO: 624803 - RNA, 23 nt, Escherichia coli CFT073
aucaaauucaaugacaguaucac

SEQ ID NO: 624804 - RNA, 12 nt, Escherichia coli CFT073
aucaaaucugcc

SEQ ID NO: 624805 - RNA, 13 nt, Escherichia coli CFT073
aucaaaaugaucg

SEQ ID NO: 624806 - RNA, 16 nt, Escherichia coli CFT073
aucaaaguuaguaaaa

SEQ ID NO: 624807 - RNA, 23 nt, Escherichia coli CFT073
auauuuaacaucauugccgccug

SEQ ID NO: 624808 - RNA, 15 nt, Escherichia coli CFT073
auauuuaaugacgaa

SEQ ID NO: 624809 - RNA, 17 nt, Escherichia coli CFT073
auauuuauucaucagcg

SEQ ID NO: 624810 - RNA, 14 nt, Escherichia coli CFT073
auauugcguaccug

SEQ ID NO: 624811 - RNA, 21 nt, Escherichia coli CFT073
auauugcuguaaaguaacgaa

SEQ ID NO: 624812 - RNA, 21 nt, Escherichia coli CFT073
auauuggagaguugcaccagc

SEQ ID NO: 624813 - RNA, 20 nt, Escherichia coli CFT073
auauuguaauacaaacucac

SEQ ID NO: 624814 - RNA, 22 nt, Escherichia coli CFT073
auauuguaauacaaacucacug

SEQ ID NO: 624815 - RNA, 15 nt, Escherichia coli CFT073
auauuccuauauauu

SEQ ID NO: 624816 - RNA, 16 nt, Escherichia coli CFT073
auauuccugacccagc

SEQ ID NO: 624817 - RNA, 22 nt, Escherichia coli CFT073
auauucccuugcucugguuccc

SEQ ID NO: 624818 - RNA, 21 nt, Escherichia coli CFT073
auauucccuagucgauacugc

SEQ ID NO: 624819 - RNA, 18 nt, Escherichia coli CFT073
auauuccccggucagcag

SEQ ID NO: 624820 - RNA, 21 nt, Escherichia coli CFT073
auauuccccggucagcagcac

SEQ ID NO: 624821 - RNA, 16 nt, Escherichia coli CFT073
auauuccagucagcac

SEQ ID NO: 624822 - RNA, 18 nt, Escherichia coli CFT073
auauuccagucagcacca

SEQ ID NO: 624823 - RNA, 19 nt, Escherichia coli CFT073
auauucaguccacaucuca

SEQ ID NO: 624824 - RNA, 18 nt, Escherichia coli CFT073
auauucauagcacauccu

SEQ ID NO: 624825 - RNA, 22 nt, Escherichia coli CFT073
auauucauauuuuuucccgccc

SEQ ID NO: 624826 - RNA, 20 nt, Escherichia coli CFT073
auauucaucaaaaugaacau

SEQ ID NO: 624827 - RNA, 12 nt, Escherichia coli CFT073
auauucaugaau

SEQ ID NO: 624828 - RNA, 19 nt, Escherichia coli CFT073
auauuaauguuuucaguua

SEQ ID NO: 624829 - RNA, 13 nt, Escherichia coli CFT073
auauuaacaacau

SEQ ID NO: 624830 - RNA, 14 nt, Escherichia coli CFT073
auauuaacaacauu

SEQ ID NO: 624831 - RNA, 18 nt, Escherichia coli CFT073
auauuaaccucucagaau

SEQ ID NO: 624832 - RNA, 17 nt, Escherichia coli CFT073
auauuacauaccagcag

SEQ ID NO: 624833 - RNA, 13 nt, Escherichia coli CFT073
auauuaauuacuu

SEQ ID NO: 624834 - RNA, 23 nt, Escherichia coli CFT073
auauuacgggucacaaacaucau

SEQ ID NO: 624835 - RNA, 22 nt, Escherichia coli CFT073
auauguuuacgcguuuuucaga

SEQ ID NO: 624836 - RNA, 20 nt, Escherichia coli CFT073
auauguugauaaucaacagg

SEQ ID NO: 624837 - RNA, 14 nt, Escherichia coli CFT073
auauguuuuuaaac

SEQ ID NO: 624838 - RNA, 18 nt, Escherichia coli CFT073
auauguuuuuaaaccaac

SEQ ID NO: 624839 - RNA, 20 nt, Escherichia coli CFT073
auaugucgcgccaggcgcug

SEQ ID NO: 624840 - RNA, 18 nt, Escherichia coli CFT073
auauggggcagaugggcu

SEQ ID NO: 624841 - RNA, 15 nt, Escherichia coli CFT073
auaugggcaaacaaa

SEQ ID NO: 624842 - RNA, 15 nt, Escherichia coli CFT073
auauggcggcggcuu

SEQ ID NO: 624843 - RNA, 14 nt, Escherichia coli CFT073
auauguauuauaag

SEQ ID NO: 624844 - RNA, 21 nt, Escherichia coli CFT073
auauguauuauaaguacuuuc

SEQ ID NO: 624845 - RNA, 14 nt, Escherichia coli CFT073
auaugucaccagca

SEQ ID NO: 624846 - RNA, 22 nt, Escherichia coli CFT073
auaugucaccagcauuagcauu

SEQ ID NO: 624847 - RNA, 21 nt, Escherichia coli CFT073
auaucugccagauaauggcug

SEQ ID NO: 624848 - RNA, 23 nt, Escherichia coli CFT073
auaugcacacgcagcugaugcga

SEQ ID NO: 624849 - RNA, 21 nt, Escherichia coli CFT073
auaugacccacgccuuuuucu

SEQ ID NO: 624850 - RNA, 18 nt, Escherichia coli CFT073
auaugaacaaagcaaaua

SEQ ID NO: 624851 - RNA, 13 nt, Escherichia coli CFT073
auaugaauuaacg

SEQ ID NO: 624852 - RNA, 20 nt, Escherichia coli CFT073
auaugcuuguuugcccagaa

SEQ ID NO: 624853 - RNA, 23 nt, Escherichia coli CFT073
auaugcuuuuauucauguugauu

SEQ ID NO: 624854 - RNA, 18 nt, Escherichia coli CFT073
auauggaagaaacgcuua

SEQ ID NO: 624855 - RNA, 17 nt, Escherichia coli CFT073
auaugcuuuuuuaaaaa

SEQ ID NO: 624856 - RNA, 22 nt, Escherichia coli CFT073
auaugcggugccauuaaaccaa

SEQ ID NO: 624857 - RNA, 22 nt, Escherichia coli CFT073
auaugcacaugaugauggcuau

SEQ ID NO: 624858 - RNA, 16 nt, Escherichia coli CFT073
auaugcagcagccagu

SEQ ID NO: 624859 - RNA, 20 nt, Escherichia coli CFT073
auaugccaucgccagcagcc

SEQ ID NO: 624860 - RNA, 15 nt, Escherichia coli CFT073
auaugccggcaucaa

SEQ ID NO: 624861 - RNA, 16 nt, Escherichia coli CFT073
auaugccggcaucaaa

SEQ ID NO: 624862 - RNA, 17 nt, Escherichia coli CFT073
auaugcgccuuuugcuu

SEQ ID NO: 624863 - RNA, 18 nt, Escherichia coli CFT073
auaugcgcugucauucau

SEQ ID NO: 624864 - RNA, 20 nt, Escherichia coli CFT073
auaucccaacgcaaaaccaa

SEQ ID NO: 624865 - RNA, 20 nt, Escherichia coli CFT073
auauccccagggaagauguu

SEQ ID NO: 624866 - RNA, 20 nt, Escherichia coli CFT073
auauccauguaccagacuga

SEQ ID NO: 624867 - RNA, 11 nt, Escherichia coli CFT073
auaucaucaag

SEQ ID NO: 624868 - RNA, 15 nt, Escherichia coli CFT073
auaucauaggucagg

SEQ ID NO: 624869 - RNA, 10 nt, Escherichia coli CFT073
auaucaucau

SEQ ID NO: 624870 - RNA, 14 nt, Escherichia coli CFT073
auaucaucauccgc

SEQ ID NO: 624871 - RNA, 14 nt, Escherichia coli CFT073
auaucaucaucggu

SEQ ID NO: 624872 - RNA, 21 nt, Escherichia coli CFT073
auauaugccaucgccagcagc

SEQ ID NO: 624873 - RNA, 24 nt, Escherichia coli CFT073
auauaugccaucgccagcagccau

SEQ ID NO: 624874 - RNA, 15 nt, Escherichia coli CFT073
auaucgcgcagaaau

SEQ ID NO: 624875 - RNA, 20 nt, Escherichia coli CFT073
auaucguauccgguuuucca

SEQ ID NO: 624876 - RNA, 21 nt, Escherichia coli CFT073
auaucgugcgggaccagcacg

SEQ ID NO: 624877 - RNA, 19 nt, Escherichia coli CFT073
auaucggcccggcuuucuu

SEQ ID NO: 624878 - RNA, 14 nt, Escherichia coli CFT073
auaucggcauugcu

SEQ ID NO: 624879 - RNA, 16 nt, Escherichia coli CFT073
auaucgcuggcagaaa

SEQ ID NO: 624880 - RNA, 19 nt, Escherichia coli CFT073
auaucggaggcuuguucaa

SEQ ID NO: 624881 - RNA, 13 nt, Escherichia coli CFT073
auaucccaccagc

SEQ ID NO: 624882 - RNA, 23 nt, Escherichia coli CFT073
auauccgccguauggacguuaau

SEQ ID NO: 624883 - RNA, 18 nt, Escherichia coli CFT073
auauccgugcauuccagc

SEQ ID NO: 624884 - RNA, 12 nt, Escherichia coli CFT073
auauccugaccu

SEQ ID NO: 624885 - RNA, 19 nt, Escherichia coli CFT073
auaucccgccagcaccagc

SEQ ID NO: 624886 - RNA, 22 nt, Escherichia coli CFT073
auauccggccuggguauaaauc

SEQ ID NO: 624887 - RNA, 16 nt, Escherichia coli CFT073
auaguccggcaccagc

SEQ ID NO: 624888 - RNA, 20 nt, Escherichia coli CFT073
auauaaagcccaucguugaa

SEQ ID NO: 624889 - RNA, 14 nt, Escherichia coli CFT073
auauaaagaaugaa

SEQ ID NO: 624890 - RNA, 22 nt, Escherichia coli CFT073
auauaaaccguccccaaaaaag

SEQ ID NO: 624891 - RNA, 23 nt, Escherichia coli CFT073
auagccugccaguggagccauca

SEQ ID NO: 624892 - RNA, 19 nt, Escherichia coli CFT073
auagccucaaauuccuuau

SEQ ID NO: 624893 - RNA, 19 nt, Escherichia coli CFT073
auagcgaaccgguaugacg

SEQ ID NO: 624894 - RNA, 19 nt, Escherichia coli CFT073
auagcgaagguguugaaau

SEQ ID NO: 624895 - RNA, 18 nt, Escherichia coli CFT073
auagcgcauggcagccag

SEQ ID NO: 624896 - RNA, 18 nt, Escherichia coli CFT073
auagcgccucuuuauaaa

SEQ ID NO: 624897 - RNA, 15 nt, Escherichia coli CFT073
auagcgccugcugcu

SEQ ID NO: 624898 - RNA, 13 nt, Escherichia coli CFT073
auaguauccaacu

SEQ ID NO: 624899 - RNA, 19 nt, Escherichia coli CFT073
auaguccgccagaauaccc

SEQ ID NO: 624900 - RNA, 21 nt, Escherichia coli CFT073
auagucagugaagccauuacc

SEQ ID NO: 624901 - RNA, 16 nt, Escherichia coli CFT073
auauauaauagugcuu

SEQ ID NO: 624902 - RNA, 22 nt, Escherichia coli CFT073
auauaguaagaagcaagguagu

SEQ ID NO: 624903 - RNA, 23 nt, Escherichia coli CFT073
auauaggugauaaaguacauuca

SEQ ID NO: 624904 - RNA, 16 nt, Escherichia coli CFT073
auauagcguaaagcca

SEQ ID NO: 624905 - RNA, 20 nt, Escherichia coli CFT073
auauaggcaccguguuccug

SEQ ID NO: 624906 - RNA, 21 nt, Escherichia coli CFT073
auauagccgccuuuacgcaaa

SEQ ID NO: 624907 - RNA, 18 nt, Escherichia coli CFT073
auauagccuaacacagca

SEQ ID NO: 624908 - RNA, 16 nt, Escherichia coli CFT073
auauacucuaaauaau

SEQ ID NO: 624909 - RNA, 13 nt, Escherichia coli CFT073
auauagauaucau

SEQ ID NO: 624910 - RNA, 21 nt, Escherichia coli CFT073
auauaccuuccgguuucaaau

SEQ ID NO: 624911 - RNA, 15 nt, Escherichia coli CFT073
auauacacgaaauga

SEQ ID NO: 624912 - RNA, 17 nt, Escherichia coli CFT073
auacccaguuucaugau

SEQ ID NO: 624913 - RNA, 24 nt, Escherichia coli CFT073
auaccccagcggcaaccagcagca

SEQ ID NO: 624914 - RNA, 19 nt, Escherichia coli CFT073
auaccccugccguuuuuua

SEQ ID NO: 624915 - RNA, 14 nt, Escherichia coli CFT073
auaccccgcauccu

SEQ ID NO: 624916 - RNA, 15 nt, Escherichia coli CFT073
auacccgguccuuca

SEQ ID NO: 624917 - RNA, 16 nt, Escherichia coli CFT073
auacccgguccuucau

SEQ ID NO: 624918 - RNA, 19 nt, Escherichia coli CFT073
auacccaaaaaauagcaaa

SEQ ID NO: 624919 - RNA, 23 nt, Escherichia coli CFT073
auaccaucggcagcgccaaucgc

SEQ ID NO: 624920 - RNA, 22 nt, Escherichia coli CFT073
auaccagcguagugauaccccg

SEQ ID NO: 624921 - RNA, 19 nt, Escherichia coli CFT073
auaccaguugaucaaauaa

SEQ ID NO: 624922 - RNA, 11 nt, Escherichia coli CFT073
auaccaacaaa

SEQ ID NO: 624923 - RNA, 20 nt, Escherichia coli CFT073
auaccaacccuggugcaauu

SEQ ID NO: 624924 - RNA, 17 nt, Escherichia coli CFT073
auaccaagccaagccag

SEQ ID NO: 624925 - RNA, 22 nt, Escherichia coli CFT073
auaccaagccaagccagagcag

SEQ ID NO: 624926 - RNA, 15 nt, Escherichia coli CFT073
auaccaauuuauuuu

SEQ ID NO: 624927 - RNA, 12 nt, Escherichia coli CFT073
auaccacacccg

SEQ ID NO: 624928 - RNA, 23 nt, Escherichia coli CFT073
auaccaagucucaagagugaaca

SEQ ID NO: 624929 - RNA, 16 nt, Escherichia coli CFT073
auaccaccagcgccau

SEQ ID NO: 624930 - RNA, 21 nt, Escherichia coli CFT073
auaccacccgcagugauugcc

SEQ ID NO: 624931 - RNA, 15 nt, Escherichia coli CFT073
auaccacgucugaag

SEQ ID NO: 624932 - RNA, 15 nt, Escherichia coli CFT073
auaccacugcgccau

SEQ ID NO: 624933 - RNA, 16 nt, Escherichia coli CFT073
auaccacuuccagcag

SEQ ID NO: 624934 - RNA, 17 nt, Escherichia coli CFT073
auaccacuuccagcaga

SEQ ID NO: 624935 - RNA, 15 nt, Escherichia coli CFT073
auaccagaacugaag

SEQ ID NO: 624936 - RNA, 17 nt, Escherichia coli CFT073
auaccagauuaauuauu

SEQ ID NO: 624937 - RNA, 12 nt, Escherichia coli CFT073
auaccagcagca

SEQ ID NO: 624938 - RNA, 19 nt, Escherichia coli CFT073
auaccagcaggaaucccau

SEQ ID NO: 624939 - RNA, 14 nt, Escherichia coli CFT073
auaccuaaaagcac

SEQ ID NO: 624940 - RNA, 17 nt, Escherichia coli CFT073
auaccuaacgccagcgc

SEQ ID NO: 624941 - RNA, 17 nt, Escherichia coli CFT073
auaccguugaccauauc

SEQ ID NO: 624942 - RNA, 18 nt, Escherichia coli CFT073
auaccgccgcacaauaca

SEQ ID NO: 624943 - RNA, 18 nt, Escherichia coli CFT073
auaccgccugcaaauaaa

SEQ ID NO: 624944 - RNA, 22 nt, Escherichia coli CFT073
auaccgagcagccacugcggca

SEQ ID NO: 624945 - RNA, 18 nt, Escherichia coli CFT073
auaccgaagaguaaccaa

SEQ ID NO: 624946 - RNA, 14 nt, Escherichia coli CFT073
auaccgcaucagca

SEQ ID NO: 624947 - RNA, 18 nt, Escherichia coli CFT073
auaccgcaucagcaucgg

SEQ ID NO: 624948 - RNA, 16 nt, Escherichia coli CFT073
auacgcuuuauccagc

SEQ ID NO: 624949 - RNA, 20 nt, Escherichia coli CFT073
auacgcuuuauccagcauaa

SEQ ID NO: 624950 - RNA, 14 nt, Escherichia coli CFT073
auacgcuuucagca

SEQ ID NO: 624951 - RNA, 17 nt, Escherichia coli CFT073
auacgacagucaauauu

SEQ ID NO: 624952 - RNA, 14 nt, Escherichia coli CFT073
auacgccucacaga

SEQ ID NO: 624953 - RNA, 17 nt, Escherichia coli CFT073
auacgcggaucuccggc

SEQ ID NO: 624954 - RNA, 15 nt, Escherichia coli CFT073
auacgcgguacaccg

SEQ ID NO: 624955 - RNA, 23 nt, Escherichia coli CFT073
auacgcgucccggaauccuucau

SEQ ID NO: 624956 - RNA, 14 nt, Escherichia coli CFT073
auagaaucaccgcc

SEQ ID NO: 624957 - RNA, 16 nt, Escherichia coli CFT073
auagaaugcagcagca

SEQ ID NO: 624958 - RNA, 17 nt, Escherichia coli CFT073
auagaaugcagcagcaa

SEQ ID NO: 624959 - RNA, 19 nt, Escherichia coli CFT073
auagaauggcauugggugc

SEQ ID NO: 624960 - RNA, 19 nt, Escherichia coli CFT073
auagaagcucauaugcagc

SEQ ID NO: 624961 - RNA, 17 nt, Escherichia coli CFT073
auagaaagugacagccc

SEQ ID NO: 624962 - RNA, 20 nt, Escherichia coli CFT073
auagaaccuaagaaccagaa

SEQ ID NO: 624963 - RNA, 18 nt, Escherichia coli CFT073
auagaacauaauguaaac

SEQ ID NO: 624964 - RNA, 13 nt, Escherichia coli CFT073
auagaacauguca

SEQ ID NO: 624965 - RNA, 21 nt, Escherichia coli CFT073
auagaacugcggcagguugaa

SEQ ID NO: 624966 - RNA, 16 nt, Escherichia coli CFT073
auacuuauugaaagca

SEQ ID NO: 624967 - RNA, 16 nt, Escherichia coli CFT073
auacuuaaauaaugcu

SEQ ID NO: 624968 - RNA, 19 nt, Escherichia coli CFT073
auacuuaaugccaguucag

SEQ ID NO: 624969 - RNA, 21 nt, Escherichia coli CFT073
auacuuaaugccaguucagua

SEQ ID NO: 624970 - RNA, 22 nt, Escherichia coli CFT073
auagcaauaaaugccuggauga

SEQ ID NO: 624971 - RNA, 19 nt, Escherichia coli CFT073
auagcaaaguaguaaugau

SEQ ID NO: 624972 - RNA, 15 nt, Escherichia coli CFT073
auagauuuucagaau

SEQ ID NO: 624973 - RNA, 17 nt, Escherichia coli CFT073
auagccuccucuuuuuc

SEQ ID NO: 624974 - RNA, 20 nt, Escherichia coli CFT073
auagccuaacacagcaauaa

SEQ ID NO: 624975 - RNA, 15 nt, Escherichia coli CFT073
auagccgccauucca

SEQ ID NO: 624976 - RNA, 15 nt, Escherichia coli CFT073
auagccaaagcacca

SEQ ID NO: 624977 - RNA, 20 nt, Escherichia coli CFT073
auagccaaaacucgaacauu

SEQ ID NO: 624978 - RNA, 14 nt, Escherichia coli CFT073
auagaccggagaaa

SEQ ID NO: 624979 - RNA, 15 nt, Escherichia coli CFT073
auagaccggagaaaa

SEQ ID NO: 624980 - RNA, 20 nt, Escherichia coli CFT073
auagacggugacacuuugug

SEQ ID NO: 624981 - RNA, 18 nt, Escherichia coli CFT073
auagauauucaucaaaau

SEQ ID NO: 624982 - RNA, 19 nt, Escherichia coli CFT073
auagauauucaucaaaaug

SEQ ID NO: 624983 - RNA, 19 nt, Escherichia coli CFT073
auagauauagccuaacaca

SEQ ID NO: 624984 - RNA, 17 nt, Escherichia coli CFT073
auagauaucaugcucug

SEQ ID NO: 624985 - RNA, 15 nt, Escherichia coli CFT073
auacauauagccaaa

SEQ ID NO: 624986 - RNA, 22 nt, Escherichia coli CFT073
auacauagcgccucuuuauaaa

SEQ ID NO: 624987 - RNA, 21 nt, Escherichia coli CFT073
auacaggaaauaagaagccau

SEQ ID NO: 624988 - RNA, 22 nt, Escherichia coli CFT073
auacaggaaauaagaagccaua

SEQ ID NO: 624989 - RNA, 22 nt, Escherichia coli CFT073
auacaggcgcuguaagccucuu

SEQ ID NO: 624990 - RNA, 20 nt, Escherichia coli CFT073
auacagcgucgguuccugau

SEQ ID NO: 624991 - RNA, 12 nt, Escherichia coli CFT073
auacagccgaag

SEQ ID NO: 624992 - RNA, 17 nt, Escherichia coli CFT073
auacagcaauggaaaaa

SEQ ID NO: 624993 - RNA, 19 nt, Escherichia coli CFT073
auacagcaauggaaaaagu

SEQ ID NO: 624994 - RNA, 11 nt, Escherichia coli CFT073
auacagcagcc

SEQ ID NO: 624995 - RNA, 22 nt, Escherichia coli CFT073
auacagaugcugcucuucacgc

SEQ ID NO: 624996 - RNA, 18 nt, Escherichia coli CFT073
auacagaugcugcucuuc

SEQ ID NO: 624997 - RNA, 17 nt, Escherichia coli CFT073
auacagugauuccagau

SEQ ID NO: 624998 - RNA, 20 nt, Escherichia coli CFT073
auacaguuaucccguacucg

SEQ ID NO: 624999 - RNA, 14 nt, Escherichia coli CFT073
auacauaacagaau

SEQ ID NO: 625000 - RNA, 19 nt, Escherichia coli CFT073
auacauaccagcaggaauc

SEQ ID NO: 625001 - RNA, 18 nt, Escherichia coli CFT073
auacacagauaaacuaca

SEQ ID NO: 625002 - RNA, 18 nt, Escherichia coli CFT073
auacaccagaugguuagu

SEQ ID NO: 625003 - RNA, 21 nt, Escherichia coli CFT073
auacacugcugauaauccagu

SEQ ID NO: 625004 - RNA, 21 nt, Escherichia coli CFT073
auacaccgcgaagcagcucca

SEQ ID NO: 625005 - RNA, 22 nt, Escherichia coli CFT073
auacaccguuagagaauguaaa

SEQ ID NO: 625006 - RNA, 13 nt, Escherichia coli CFT073
auacacgaaacga

SEQ ID NO: 625007 - RNA, 19 nt, Escherichia coli CFT073
auaauuuugcagucccauc

SEQ ID NO: 625008 - RNA, 14 nt, Escherichia coli CFT073
auacaaccaaucgc

SEQ ID NO: 625009 - RNA, 18 nt, Escherichia coli CFT073
auacaaccagauaaccau

SEQ ID NO: 625010 - RNA, 21 nt, Escherichia coli CFT073
auacaaacucacugccagcau

SEQ ID NO: 625011 - RNA, 19 nt, Escherichia coli CFT073
auacaagccacaucgccau

SEQ ID NO: 625012 - RNA, 22 nt, Escherichia coli CFT073
auaauugaccagaucuucauca

SEQ ID NO: 625013 - RNA, 15 nt, Escherichia coli CFT073
auaauugagcagcaa

SEQ ID NO: 625014 - RNA, 18 nt, Escherichia coli CFT073
auaauuccccaccugaac

SEQ ID NO: 625015 - RNA, 23 nt, Escherichia coli CFT073
auaauuccucccguuaugaucag

SEQ ID NO: 625016 - RNA, 19 nt, Escherichia coli CFT073
auaauucuggaucaaguau

SEQ ID NO: 625017 - RNA, 16 nt, Escherichia coli CFT073
auaauguaucugaagu

SEQ ID NO: 625018 - RNA, 18 nt, Escherichia coli CFT073
auaauguaucugaaguaa

SEQ ID NO: 625019 - RNA, 19 nt, Escherichia coli CFT073
auaaugucggcauaaagcu

SEQ ID NO: 625020 - RNA, 18 nt, Escherichia coli CFT073
auaauuauaaaucccugc

SEQ ID NO: 625021 - RNA, 24 nt, Escherichia coli CFT073
auaauguaaacaagacaucacuca

SEQ ID NO: 625022 - RNA, 12 nt, Escherichia coli CFT073
auaaugucagac

SEQ ID NO: 625023 - RNA, 19 nt, Escherichia coli CFT073
auaacgggcuucccaacug

SEQ ID NO: 625024 - RNA, 19 nt, Escherichia coli CFT073
auaacgguaguggcaacca

SEQ ID NO: 625025 - RNA, 18 nt, Escherichia coli CFT073
auaacggugcugcacauu

SEQ ID NO: 625026 - RNA, 14 nt, Escherichia coli CFT073
auaacguaaaccaa

SEQ ID NO: 625027 - RNA, 20 nt, Escherichia coli CFT073
auaacgucgccagaaaucag

SEQ ID NO: 625028 - RNA, 14 nt, Escherichia coli CFT073
auaaucaucuguau

SEQ ID NO: 625029 - RNA, 14 nt, Escherichia coli CFT073
auaaucaucuucau

SEQ ID NO: 625030 - RNA, 19 nt, Escherichia coli CFT073
auaaucauuucgccugaaa

SEQ ID NO: 625031 - RNA, 21 nt, Escherichia coli CFT073
auaauccagauauguaucuac

SEQ ID NO: 625032 - RNA, 13 nt, Escherichia coli CFT073
auaauccaggcau

SEQ ID NO: 625033 - RNA, 21 nt, Escherichia coli CFT073
auaauccaggcaucagauugu

SEQ ID NO: 625034 - RNA, 14 nt, Escherichia coli CFT073
auaauccaugccaa

SEQ ID NO: 625035 - RNA, 16 nt, Escherichia coli CFT073
auaauccaugccaacg

SEQ ID NO: 625036 - RNA, 14 nt, Escherichia coli CFT073
auaauccggcauuu

SEQ ID NO: 625037 - RNA, 16 nt, Escherichia coli CFT073
auaaucccggcaccaa

SEQ ID NO: 625038 - RNA, 15 nt, Escherichia coli CFT073
auaauccccacauca

SEQ ID NO: 625039 - RNA, 16 nt, Escherichia coli CFT073
auaaucccgaacacuu

SEQ ID NO: 625040 - RNA, 23 nt, Escherichia coli CFT073
auaaugauggugaaagcaaaaaa

SEQ ID NO: 625041 - RNA, 15 nt, Escherichia coli CFT073
auaaugaucccuuca

SEQ ID NO: 625042 - RNA, 18 nt, Escherichia coli CFT073
auaaucuguuucucaugc

SEQ ID NO: 625043 - RNA, 18 nt, Escherichia coli CFT073
auaaugacggacaguacu

SEQ ID NO: 625044 - RNA, 22 nt, Escherichia coli CFT073
auaaucgaaccaaacagcgcca

SEQ ID NO: 625045 - RNA, 20 nt, Escherichia coli CFT073
auaauccugccgagauacag

SEQ ID NO: 625046 - RNA, 21 nt, Escherichia coli CFT073
auaauccuggcagcaucagac

SEQ ID NO: 625047 - RNA, 20 nt, Escherichia coli CFT073
auaaucgaaaacaucauggu

SEQ ID NO: 625048 - RNA, 18 nt, Escherichia coli CFT073
auaaucucuuuacccagc

SEQ ID NO: 625049 - RNA, 13 nt, Escherichia coli CFT073
auaaucugacuuc

SEQ ID NO: 625050 - RNA, 18 nt, Escherichia coli CFT073
auaaucugacuuccugcc

SEQ ID NO: 625051 - RNA, 18 nt, Escherichia coli CFT073
auaaucugcggguaauau

SEQ ID NO: 625052 - RNA, 13 nt, Escherichia coli CFT073
aucgacaucaacg

SEQ ID NO: 625053 - RNA, 15 nt, Escherichia coli CFT073
aucgacaccagccag

SEQ ID NO: 625054 - RNA, 15 nt, Escherichia coli CFT073
aucgacagacgccag

SEQ ID NO: 625055 - RNA, 15 nt, Escherichia coli CFT073
aucgaaucaaacaug

SEQ ID NO: 625056 - RNA, 18 nt, Escherichia coli CFT073
aucgacaaaaacccugcc

SEQ ID NO: 625057 - RNA, 13 nt, Escherichia coli CFT073
aucgaagcaaaga

SEQ ID NO: 625058 - RNA, 12 nt, Escherichia coli CFT073
auccuuuccuua

SEQ ID NO: 625059 - RNA, 15 nt, Escherichia coli CFT073
aucgaacgcagaggu

SEQ ID NO: 625060 - RNA, 14 nt, Escherichia coli CFT073
aucgaacgcagcaa

SEQ ID NO: 625061 - RNA, 19 nt, Escherichia coli CFT073
auccugugcuccaguaccu

SEQ ID NO: 625062 - RNA, 14 nt, Escherichia coli CFT073
auccuuccagcucc

SEQ ID NO: 625063 - RNA, 18 nt, Escherichia coli CFT073
auccuuccagcuccagcc

SEQ ID NO: 625064 - RNA, 19 nt, Escherichia coli CFT073
auccuuccagcuccagccg

SEQ ID NO: 625065 - RNA, 12 nt, Escherichia coli CFT073
auccuucaucuu

SEQ ID NO: 625066 - RNA, 15 nt, Escherichia coli CFT073
auccuuuaucugccc

SEQ ID NO: 625067 - RNA, 22 nt, Escherichia coli CFT073
auccuugcuaaccaacaauaca

SEQ ID NO: 625068 - RNA, 23 nt, Escherichia coli CFT073
auccuugcagauauugcacccca

SEQ ID NO: 625069 - RNA, 20 nt, Escherichia coli CFT073
aucgccgcauaauaucuuuc

SEQ ID NO: 625070 - RNA, 19 nt, Escherichia coli CFT073
aucgccgcacccgccagaa

SEQ ID NO: 625071 - RNA, 20 nt, Escherichia coli CFT073
aucgccgccagugccaccag

SEQ ID NO: 625072 - RNA, 17 nt, Escherichia coli CFT073
aucgccgaaccagugcu

SEQ ID NO: 625073 - RNA, 16 nt, Escherichia coli CFT073
aucgccauugcuggug

SEQ ID NO: 625074 - RNA, 23 nt, Escherichia coli CFT073
aucgccauuuucugccgcaugga

SEQ ID NO: 625075 - RNA, 15 nt, Escherichia coli CFT073
aucgccaugaugagc

SEQ ID NO: 625076 - RNA, 17 nt, Escherichia coli CFT073
aucgccauauccgcaau

SEQ ID NO: 625077 - RNA, 20 nt, Escherichia coli CFT073
aucgccagcaaaaucaccau

SEQ ID NO: 625078 - RNA, 15 nt, Escherichia coli CFT073
aucgccagcagccau

SEQ ID NO: 625079 - RNA, 12 nt, Escherichia coli CFT073
aucgccagcauc

SEQ ID NO: 625080 - RNA, 20 nt, Escherichia coli CFT073
aucgacuaacuucugaucua

SEQ ID NO: 625081 - RNA, 16 nt, Escherichia coli CFT073
aucgccaaagcggcag

SEQ ID NO: 625082 - RNA, 19 nt, Escherichia coli CFT073
aucgauggcuucuggcugc

SEQ ID NO: 625083 - RNA, 15 nt, Escherichia coli CFT073
aucgauggugaagug

SEQ ID NO: 625084 - RNA, 23 nt, Escherichia coli CFT073
aucgauucagaugccauuuugca

SEQ ID NO: 625085 - RNA, 15 nt, Escherichia coli CFT073
aucgccaacgccugc

SEQ ID NO: 625086 - RNA, 21 nt, Escherichia coli CFT073
aucgccaacgccugcggcuga

SEQ ID NO: 625087 - RNA, 21 nt, Escherichia coli CFT073
aucgccacggcaugaaagcga

SEQ ID NO: 625088 - RNA, 23 nt, Escherichia coli CFT073
aucgccaccggauauagcguaaa

SEQ ID NO: 625089 - RNA, 19 nt, Escherichia coli CFT073
aucgccuuucagaucaaaa

SEQ ID NO: 625090 - RNA, 23 nt, Escherichia coli CFT073
aucgccuuuugcccggcaacaac

SEQ ID NO: 625091 - RNA, 21 nt, Escherichia coli CFT073
aucgcgaaaaaaaagauggcu

SEQ ID NO: 625092 - RNA, 14 nt, Escherichia coli CFT073
aucgccugcgaauc

SEQ ID NO: 625093 - RNA, 18 nt, Escherichia coli CFT073
aucgccugcgccaccaca

SEQ ID NO: 625094 - RNA, 13 nt, Escherichia coli CFT073
aucgccugcugga

SEQ ID NO: 625095 - RNA, 16 nt, Escherichia coli CFT073
aucgcgacaaaauaca

SEQ ID NO: 625096 - RNA, 15 nt, Escherichia coli CFT073
aucgcgaccaaucac

SEQ ID NO: 625097 - RNA, 18 nt, Escherichia coli CFT073
aucgcuagauauauauua

SEQ ID NO: 625098 - RNA, 18 nt, Escherichia coli CFT073
aucgcucacaacaauauc

SEQ ID NO: 625099 - RNA, 19 nt, Escherichia coli CFT073
aucgcucugguugacgcgu

SEQ ID NO: 625100 - RNA, 23 nt, Escherichia coli CFT073
aucgcucugguugacgcguaaau

SEQ ID NO: 625101 - RNA, 18 nt, Escherichia coli CFT073
aucgcugaacgcaccuuc

SEQ ID NO: 625102 - RNA, 17 nt, Escherichia coli CFT073
aucgcugacacgggaaa

SEQ ID NO: 625103 - RNA, 17 nt, Escherichia coli CFT073
aucgcugacgaucauuc

SEQ ID NO: 625104 - RNA, 13 nt, Escherichia coli CFT073
aucgcugauauac

SEQ ID NO: 625105 - RNA, 15 nt, Escherichia coli CFT073
aucgcuguacucacc

SEQ ID NO: 625106 - RNA, 21 nt, Escherichia coli CFT073
aucgcuguacucaccaacgca

SEQ ID NO: 625107 - RNA, 12 nt, Escherichia coli CFT073
aucgcuggcugc

SEQ ID NO: 625108 - RNA, 16 nt, Escherichia coli CFT073
aucgcuucaauaccac

SEQ ID NO: 625109 - RNA, 20 nt, Escherichia coli CFT073
aucgcuuuugcgguuuuucu

SEQ ID NO: 625110 - RNA, 21 nt, Escherichia coli CFT073
aucgcuuuugcgguuuuucuc

SEQ ID NO: 625111 - RNA, 17 nt, Escherichia coli CFT073
aucggaaagccccgccu

SEQ ID NO: 625112 - RNA, 15 nt, Escherichia coli CFT073
aucggaaugcacagc

SEQ ID NO: 625113 - RNA, 12 nt, Escherichia coli CFT073
aucggcaccgcc

SEQ ID NO: 625114 - RNA, 18 nt, Escherichia coli CFT073
aucggcaccgccagcagg

SEQ ID NO: 625115 - RNA, 23 nt, Escherichia coli CFT073
aucggcacccaucgccagcacuu

SEQ ID NO: 625116 - RNA, 19 nt, Escherichia coli CFT073
aucggcauacagcgacaga

SEQ ID NO: 625117 - RNA, 18 nt, Escherichia coli CFT073
aucggcauugcucccugc

SEQ ID NO: 625118 - RNA, 16 nt, Escherichia coli CFT073
aucggcgcagcuaauu

SEQ ID NO: 625119 - RNA, 20 nt, Escherichia coli CFT073
aucguuguuggcuuccugcc

SEQ ID NO: 625120 - RNA, 15 nt, Escherichia coli CFT073
aucuaacagugccug

SEQ ID NO: 625121 - RNA, 22 nt, Escherichia coli CFT073
aucuaaccggauaucuaaugcc

SEQ ID NO: 625122 - RNA, 16 nt, Escherichia coli CFT073
aucuaacgcccgagcc

SEQ ID NO: 625123 - RNA, 21 nt, Escherichia coli CFT073
aucgugacagcauaccuucac

SEQ ID NO: 625124 - RNA, 18 nt, Escherichia coli CFT073
aucgucaggaucagccau

SEQ ID NO: 625125 - RNA, 21 nt, Escherichia coli CFT073
aucgucaggggcauuuuccag

SEQ ID NO: 625126 - RNA, 20 nt, Escherichia coli CFT073
aucguaccaggagucacgca

SEQ ID NO: 625127 - RNA, 14 nt, Escherichia coli CFT073
aucguaaucagcau

SEQ ID NO: 625128 - RNA, 23 nt, Escherichia coli CFT073
aucgucaauaaucaugcagcgca

SEQ ID NO: 625129 - RNA, 18 nt, Escherichia coli CFT073
aucgucagcaucucugca

SEQ ID NO: 625130 - RNA, 19 nt, Escherichia coli CFT073
aucgucagcucgcugccau

SEQ ID NO: 625131 - RNA, 21 nt, Escherichia coli CFT073
aucgucacgcgcgccaagccc

SEQ ID NO: 625132 - RNA, 20 nt, Escherichia coli CFT073
aucggugugagaauauugcc

SEQ ID NO: 625133 - RNA, 20 nt, Escherichia coli CFT073
aucggugguguaaccuucac

SEQ ID NO: 625134 - RNA, 22 nt, Escherichia coli CFT073
aucggcgcuacggcguuucacu

SEQ ID NO: 625135 - RNA, 16 nt, Escherichia coli CFT073
auccuggacuuuaaac

SEQ ID NO: 625136 - RNA, 13 nt, Escherichia coli CFT073
auccuggcacagc

SEQ ID NO: 625137 - RNA, 16 nt, Escherichia coli CFT073
auccuggcagcaucag

SEQ ID NO: 625138 - RNA, 18 nt, Escherichia coli CFT073
auccuggggauucaucac

SEQ ID NO: 625139 - RNA, 21 nt, Escherichia coli CFT073
auccuggggauucaucaccac

SEQ ID NO: 625140 - RNA, 15 nt, Escherichia coli CFT073
auccuggugaaaguu

SEQ ID NO: 625141 - RNA, 23 nt, Escherichia coli CFT073
auccuguauuuuuuaauucaaau

SEQ ID NO: 625142 - RNA, 20 nt, Escherichia coli CFT073
auccugcugcacgcccugau

SEQ ID NO: 625143 - RNA, 22 nt, Escherichia coli CFT073
auccugcguuuguccgccagaa

SEQ ID NO: 625144 - RNA, 18 nt, Escherichia coli CFT073
auccugccauuggcaggc

SEQ ID NO: 625145 - RNA, 16 nt, Escherichia coli CFT073
auccugcaacaacacc

SEQ ID NO: 625146 - RNA, 15 nt, Escherichia coli CFT073
auccugcacuguccc

SEQ ID NO: 625147 - RNA, 21 nt, Escherichia coli CFT073
auccugcacuucaaauuucau

SEQ ID NO: 625148 - RNA, 13 nt, Escherichia coli CFT073
auccugcagugcg

SEQ ID NO: 625149 - RNA, 21 nt, Escherichia coli CFT073
auccugccaggcugcaugccu

SEQ ID NO: 625150 - RNA, 22 nt, Escherichia coli CFT073
auccugccagggucaguuucac

SEQ ID NO: 625151 - RNA, 15 nt, Escherichia coli CFT073
auccugccagugcaa

SEQ ID NO: 625152 - RNA, 21 nt, Escherichia coli CFT073
auccucuaaaccccaaccacu

SEQ ID NO: 625153 - RNA, 20 nt, Escherichia coli CFT073
auccucuauaaaagaggcga

SEQ ID NO: 625154 - RNA, 15 nt, Escherichia coli CFT073
auccucuucaagcug

SEQ ID NO: 625155 - RNA, 12 nt, Escherichia coli CFT073
auccucuucagg

SEQ ID NO: 625156 - RNA, 20 nt, Escherichia coli CFT073
auccuccgcagccaugagua

SEQ ID NO: 625157 - RNA, 20 nt, Escherichia coli CFT073
auccugaaagcugagaaaau

SEQ ID NO: 625158 - RNA, 22 nt, Escherichia coli CFT073
auccugaaauuccugagaggau

SEQ ID NO: 625159 - RNA, 15 nt, Escherichia coli CFT073
auccugaauuaacuu

SEQ ID NO: 625160 - RNA, 22 nt, Escherichia coli CFT073
auccugcaaauaacgcuucagc

SEQ ID NO: 625161 - RNA, 23 nt, Escherichia coli CFT073
auccugaguaucgaaaacaucaa

SEQ ID NO: 625162 - RNA, 15 nt, Escherichia coli CFT073
auccugauacagacc

SEQ ID NO: 625163 - RNA, 21 nt, Escherichia coli CFT073
auccugauccugcaacaacac

SEQ ID NO: 625164 - RNA, 16 nt, Escherichia coli CFT073
auccggcauaauacau

SEQ ID NO: 625165 - RNA, 16 nt, Escherichia coli CFT073
auccggcagcgcauaa

SEQ ID NO: 625166 - RNA, 21 nt, Escherichia coli CFT073
auccggccauuuucauuuaag

SEQ ID NO: 625167 - RNA, 16 nt, Escherichia coli CFT073
auccggcauuguucau

SEQ ID NO: 625168 - RNA, 18 nt, Escherichia coli CFT073
auccggcaauauccauua

SEQ ID NO: 625169 - RNA, 13 nt, Escherichia coli CFT073
auccggcaccaau

SEQ ID NO: 625170 - RNA, 12 nt, Escherichia coli CFT073
auccggcaccaa

SEQ ID NO: 625171 - RNA, 16 nt, Escherichia coli CFT073
auccggcacuuucgga

SEQ ID NO: 625172 - RNA, 17 nt, Escherichia coli CFT073
auccgggcaaaaauuau

SEQ ID NO: 625173 - RNA, 18 nt, Escherichia coli CFT073
auccggcgucaucuuacu

SEQ ID NO: 625174 - RNA, 20 nt, Escherichia coli CFT073
auccggcgucaucuuacugc

SEQ ID NO: 625175 - RNA, 17 nt, Escherichia coli CFT073
auccggcgacaggaacc

SEQ ID NO: 625176 - RNA, 18 nt, Escherichia coli CFT073
auccggcgacaggaacca

SEQ ID NO: 625177 - RNA, 19 nt, Escherichia coli CFT073
auccggcgacaggaaccaa

SEQ ID NO: 625178 - RNA, 19 nt, Escherichia coli CFT073
auccggcgcaaaaaacuau

SEQ ID NO: 625179 - RNA, 23 nt, Escherichia coli CFT073
auccggugccaaagucaucaauu

SEQ ID NO: 625180 - RNA, 20 nt, Escherichia coli CFT073
auccggugccuuaccgcuug

SEQ ID NO: 625181 - RNA, 19 nt, Escherichia coli CFT073
auccggggcaauuucaguu

SEQ ID NO: 625182 - RNA, 13 nt, Escherichia coli CFT073
auccgguaacccu

SEQ ID NO: 625183 - RNA, 23 nt, Escherichia coli CFT073
auccgguaacccuucauauuccu

SEQ ID NO: 625184 - RNA, 18 nt, Escherichia coli CFT073
auccguaaagcccauacc

SEQ ID NO: 625185 - RNA, 15 nt, Escherichia coli CFT073
auccgguuucaucag

SEQ ID NO: 625186 - RNA, 17 nt, Escherichia coli CFT073
auccguaugacaaacug

SEQ ID NO: 625187 - RNA, 22 nt, Escherichia coli CFT073
auccguaaucgcuuuuucugca

SEQ ID NO: 625188 - RNA, 13 nt, Escherichia coli CFT073
auccguccgcaaa

SEQ ID NO: 625189 - RNA, 23 nt, Escherichia coli CFT073
auccgucgccguaauuaacaccu

SEQ ID NO: 625190 - RNA, 14 nt, Escherichia coli CFT073
auccuaauccuggc

SEQ ID NO: 625191 - RNA, 15 nt, Escherichia coli CFT073
auccguuauguuuca

SEQ ID NO: 625192 - RNA, 21 nt, Escherichia coli CFT073
auccguggcaaauugcccaag

SEQ ID NO: 625193 - RNA, 22 nt, Escherichia coli CFT073
auccgugguggcagccagccau

SEQ ID NO: 625194 - RNA, 18 nt, Escherichia coli CFT073
auccguucagaucggcaa

SEQ ID NO: 625195 - RNA, 16 nt, Escherichia coli CFT073
auccucacugaccaca

SEQ ID NO: 625196 - RNA, 15 nt, Escherichia coli CFT073
auccucagaaaucag

SEQ ID NO: 625197 - RNA, 17 nt, Escherichia coli CFT073
auccucagaaaucagau

SEQ ID NO: 625198 - RNA, 15 nt, Escherichia coli CFT073
auccucaauaauaac

SEQ ID NO: 625199 - RNA, 18 nt, Escherichia coli CFT073
auccucaaucggaaaaca

SEQ ID NO: 625200 - RNA, 12 nt, Escherichia coli CFT073
aucccguucagc

SEQ ID NO: 625201 - RNA, 19 nt, Escherichia coli CFT073
aucccguaggauuucuucg

SEQ ID NO: 625202 - RNA, 14 nt, Escherichia coli CFT073
aucccuaacuggcg

SEQ ID NO: 625203 - RNA, 22 nt, Escherichia coli CFT073
aucccuaaugucgacauaauca

SEQ ID NO: 625204 - RNA, 23 nt, Escherichia coli CFT073
aucccgguauaacuugccaggcc

SEQ ID NO: 625205 - RNA, 20 nt, Escherichia coli CFT073
aucccggugucaugcgggcg

SEQ ID NO: 625206 - RNA, 13 nt, Escherichia coli CFT073
aucccgccgcuuc

SEQ ID NO: 625207 - RNA, 20 nt, Escherichia coli CFT073
aucccgcucuguaagacauu

SEQ ID NO: 625208 - RNA, 19 nt, Escherichia coli CFT073
aucccgcgacggaagcuua

SEQ ID NO: 625209 - RNA, 15 nt, Escherichia coli CFT073
aucccgcgauaugcc

SEQ ID NO: 625210 - RNA, 14 nt, Escherichia coli CFT073
aucccggaagccac

SEQ ID NO: 625211 - RNA, 18 nt, Escherichia coli CFT073
aucccggcaaccgcaacg

SEQ ID NO: 625212 - RNA, 16 nt, Escherichia coli CFT073
aucccggcaggaauau

SEQ ID NO: 625213 - RNA, 15 nt, Escherichia coli CFT073
auccccgcagcaaac

SEQ ID NO: 625214 - RNA, 15 nt, Escherichia coli CFT073
auccccgccagcacg

SEQ ID NO: 625215 - RNA, 14 nt, Escherichia coli CFT073
auccccgccagcgu

SEQ ID NO: 625216 - RNA, 19 nt, Escherichia coli CFT073
auccccgcgcggaacauga

SEQ ID NO: 625217 - RNA, 20 nt, Escherichia coli CFT073
auccccgcgcggaacaugaa

SEQ ID NO: 625218 - RNA, 18 nt, Escherichia coli CFT073
auccccuacucucugugc

SEQ ID NO: 625219 - RNA, 13 nt, Escherichia coli CFT073
auccccucaauaa

SEQ ID NO: 625220 - RNA, 14 nt, Escherichia coli CFT073
auccccugaaauau

SEQ ID NO: 625221 - RNA, 23 nt, Escherichia coli CFT073
auccccgucaacggugcuuuaau

SEQ ID NO: 625222 - RNA, 14 nt, Escherichia coli CFT073
auccccugccccau

SEQ ID NO: 625223 - RNA, 14 nt, Escherichia coli CFT073
aucccgacaaucau

SEQ ID NO: 625224 - RNA, 21 nt, Escherichia coli CFT073
auccccuucucaaucccuuuc

SEQ ID NO: 625225 - RNA, 20 nt, Escherichia coli CFT073
auccccaccaaaacagcgac

SEQ ID NO: 625226 - RNA, 17 nt, Escherichia coli CFT073
aucccauuucuccacug

SEQ ID NO: 625227 - RNA, 15 nt, Escherichia coli CFT073
aucccauuuacuggc

SEQ ID NO: 625228 - RNA, 17 nt, Escherichia coli CFT073
aucccccgcacacucca

SEQ ID NO: 625229 - RNA, 17 nt, Escherichia coli CFT073
aucccccacuuuuaaau

SEQ ID NO: 625230 - RNA, 19 nt, Escherichia coli CFT073
auccccagcgucagcagca

SEQ ID NO: 625231 - RNA, 18 nt, Escherichia coli CFT073
auccccagacaaaagcga

SEQ ID NO: 625232 - RNA, 13 nt, Escherichia coli CFT073
auccccagccuaa

SEQ ID NO: 625233 - RNA, 18 nt, Escherichia coli CFT073
auccccagccuaagccau

SEQ ID NO: 625234 - RNA, 17 nt, Escherichia coli CFT073
auccgauaaucccuucc

SEQ ID NO: 625235 - RNA, 20 nt, Escherichia coli CFT073
auccgacguuacgcgccaau

SEQ ID NO: 625236 - RNA, 20 nt, Escherichia coli CFT073
auccgagcagcaaugcuuac

SEQ ID NO: 625237 - RNA, 20 nt, Escherichia coli CFT073
auccgaccuacguucggcac

SEQ ID NO: 625238 - RNA, 19 nt, Escherichia coli CFT073
auccgcacccgcacgcuua

SEQ ID NO: 625239 - RNA, 23 nt, Escherichia coli CFT073
auccgcacccgcacgcuuaaucg

SEQ ID NO: 625240 - RNA, 19 nt, Escherichia coli CFT073
aucccugccgccaucacca

SEQ ID NO: 625241 - RNA, 19 nt, Escherichia coli CFT073
aucccuucgcuggcaaagc

SEQ ID NO: 625242 - RNA, 13 nt, Escherichia coli CFT073
aucccuucuccac

SEQ ID NO: 625243 - RNA, 22 nt, Escherichia coli CFT073
aucccuucaagcguccauuuac

SEQ ID NO: 625244 - RNA, 17 nt, Escherichia coli CFT073
aucccuucacuucugga

SEQ ID NO: 625245 - RNA, 22 nt, Escherichia coli CFT073
aucccuguucauaugcuuguuu

SEQ ID NO: 625246 - RNA, 14 nt, Escherichia coli CFT073
auccgacaucaacg

SEQ ID NO: 625247 - RNA, 20 nt, Escherichia coli CFT073
auccgacauuucugcugccu

SEQ ID NO: 625248 - RNA, 14 nt, Escherichia coli CFT073
aucccuuuauucag

SEQ ID NO: 625249 - RNA, 14 nt, Escherichia coli CFT073
aucccuuuucacua

SEQ ID NO: 625250 - RNA, 18 nt, Escherichia coli CFT073
auccgcuuuugguuuuuc

SEQ ID NO: 625251 - RNA, 17 nt, Escherichia coli CFT073
auccggaaacuggaugg

SEQ ID NO: 625252 - RNA, 18 nt, Escherichia coli CFT073
auccggauucaaaccuaa

SEQ ID NO: 625253 - RNA, 14 nt, Escherichia coli CFT073
auccggcaaauaac

SEQ ID NO: 625254 - RNA, 22 nt, Escherichia coli CFT073
auccggcaacaaaauauccugu

SEQ ID NO: 625255 - RNA, 15 nt, Escherichia coli CFT073
auccgcuucacugau

SEQ ID NO: 625256 - RNA, 18 nt, Escherichia coli CFT073
auccgcucgucaaaaaca

SEQ ID NO: 625257 - RNA, 22 nt, Escherichia coli CFT073
auccgcucgucaaaaacaaaau

SEQ ID NO: 625258 - RNA, 23 nt, Escherichia coli CFT073
auccgcucugcccugccaucacu

SEQ ID NO: 625259 - RNA, 17 nt, Escherichia coli CFT073
auccgcugaaaaacgaa

SEQ ID NO: 625260 - RNA, 13 nt, Escherichia coli CFT073
auccgcaggugac

SEQ ID NO: 625261 - RNA, 14 nt, Escherichia coli CFT073
auccgccauaucac

SEQ ID NO: 625262 - RNA, 13 nt, Escherichia coli CFT073
auccgcccacacc

SEQ ID NO: 625263 - RNA, 17 nt, Escherichia coli CFT073
auccgcgauuaucccau

SEQ ID NO: 625264 - RNA, 22 nt, Escherichia coli CFT073
auccaggcccgcgugccggaag

SEQ ID NO: 625265 - RNA, 13 nt, Escherichia coli CFT073
auccaggcacugg

SEQ ID NO: 625266 - RNA, 16 nt, Escherichia coli CFT073
auccaggccagauauc

SEQ ID NO: 625267 - RNA, 15 nt, Escherichia coli CFT073
auccaggguuuuauu

SEQ ID NO: 625268 - RNA, 19 nt, Escherichia coli CFT073
auccagggguuguuauuuc

SEQ ID NO: 625269 - RNA, 21 nt, Escherichia coli CFT073
auccagggguuguuauuuccg

SEQ ID NO: 625270 - RNA, 17 nt, Escherichia coli CFT073
auccagguuacgcaugg

SEQ ID NO: 625271 - RNA, 17 nt, Escherichia coli CFT073
auccauaaucacgcugu

SEQ ID NO: 625272 - RNA, 14 nt, Escherichia coli CFT073
auccaguacaugaa

SEQ ID NO: 625273 - RNA, 22 nt, Escherichia coli CFT073
auccaguacaugaagcacggca

SEQ ID NO: 625274 - RNA, 17 nt, Escherichia coli CFT073
auccaguacgccuucac

SEQ ID NO: 625275 - RNA, 13 nt, Escherichia coli CFT073
auccaguagaaua

SEQ ID NO: 625276 - RNA, 16 nt, Escherichia coli CFT073
auccagugauuccagu

SEQ ID NO: 625277 - RNA, 11 nt, Escherichia coli CFT073
auccagugccg

SEQ ID NO: 625278 - RNA, 19 nt, Escherichia coli CFT073
auccagugccgcagcggcg

SEQ ID NO: 625279 - RNA, 20 nt, Escherichia coli CFT073
auccagcucgcguucuguca

SEQ ID NO: 625280 - RNA, 14 nt, Escherichia coli CFT073
auccagcucuuccu

SEQ ID NO: 625281 - RNA, 15 nt, Escherichia coli CFT073
auccagcguguucgu

SEQ ID NO: 625282 - RNA, 17 nt, Escherichia coli CFT073
auccagcugccaggcac

SEQ ID NO: 625283 - RNA, 21 nt, Escherichia coli CFT073
auccagcggugcgcgauuaug

SEQ ID NO: 625284 - RNA, 12 nt, Escherichia coli CFT073
auccagcggcaa

SEQ ID NO: 625285 - RNA, 23 nt, Escherichia coli CFT073
auccagcggcgagcuuuucugga

SEQ ID NO: 625286 - RNA, 16 nt, Escherichia coli CFT073
auccagcgcccgcuuc

SEQ ID NO: 625287 - RNA, 14 nt, Escherichia coli CFT073
auccagcaacaaca

SEQ ID NO: 625288 - RNA, 15 nt, Escherichia coli CFT073
auccagcaacaacag

SEQ ID NO: 625289 - RNA, 16 nt, Escherichia coli CFT073
auccagcaacaacagc

SEQ ID NO: 625290 - RNA, 12 nt, Escherichia coli CFT073
auccagcaacgu

SEQ ID NO: 625291 - RNA, 13 nt, Escherichia coli CFT073
auccagcaccgcu

SEQ ID NO: 625292 - RNA, 16 nt, Escherichia coli CFT073
auccagccgcccagcg

SEQ ID NO: 625293 - RNA, 17 nt, Escherichia coli CFT073
auccagccacggcucca

SEQ ID NO: 625294 - RNA, 18 nt, Escherichia coli CFT073
auccagccacggcuccag

SEQ ID NO: 625295 - RNA, 13 nt, Escherichia coli CFT073
auccagcagugga

SEQ ID NO: 625296 - RNA, 22 nt, Escherichia coli CFT073
auccagcaguggaucgaacucc

SEQ ID NO: 625297 - RNA, 11 nt, Escherichia coli CFT073
auccagcaugc

SEQ ID NO: 625298 - RNA, 19 nt, Escherichia coli CFT073
auccagcauucccgccacc

SEQ ID NO: 625299 - RNA, 14 nt, Escherichia coli CFT073
auccagccaaacau

SEQ ID NO: 625300 - RNA, 23 nt, Escherichia coli CFT073
aucccaacugaucugccagcaga

SEQ ID NO: 625301 - RNA, 23 nt, Escherichia coli CFT073
aucccacauauguuuaaccggca

SEQ ID NO: 625302 - RNA, 16 nt, Escherichia coli CFT073
aucccaaaauacggca

SEQ ID NO: 625303 - RNA, 18 nt, Escherichia coli CFT073
aucccagccaaugcaggc

SEQ ID NO: 625304 - RNA, 22 nt, Escherichia coli CFT073
aucccaucgcagaaacgacacc

SEQ ID NO: 625305 - RNA, 14 nt, Escherichia coli CFT073
aucccagcccagcg

SEQ ID NO: 625306 - RNA, 15 nt, Escherichia coli CFT073
aucccaggcauccag

SEQ ID NO: 625307 - RNA, 20 nt, Escherichia coli CFT073
aucccagugaauuaaaaaca

SEQ ID NO: 625308 - RNA, 12 nt, Escherichia coli CFT073
aucccagugcag

SEQ ID NO: 625309 - RNA, 13 nt, Escherichia coli CFT073
auccaugccacag

SEQ ID NO: 625310 - RNA, 14 nt, Escherichia coli CFT073
auccaugcuuguuu

SEQ ID NO: 625311 - RNA, 15 nt, Escherichia coli CFT073
auccauucaucacgc

SEQ ID NO: 625312 - RNA, 16 nt, Escherichia coli CFT073
auccauugaaaucaaa

SEQ ID NO: 625313 - RNA, 19 nt, Escherichia coli CFT073
auccaucagacuuugcgcc

SEQ ID NO: 625314 - RNA, 12 nt, Escherichia coli CFT073
auccaucaccag

SEQ ID NO: 625315 - RNA, 21 nt, Escherichia coli CFT073
auccaucagacuuugcgccau

SEQ ID NO: 625316 - RNA, 22 nt, Escherichia coli CFT073
auccaucguugaauacauucau

SEQ ID NO: 625317 - RNA, 18 nt, Escherichia coli CFT073
auccauaccagcacauaa

SEQ ID NO: 625318 - RNA, 17 nt, Escherichia coli CFT073
auccauauucagcgcca

SEQ ID NO: 625319 - RNA, 14 nt, Escherichia coli CFT073
auccaucaaagguu

SEQ ID NO: 625320 - RNA, 22 nt, Escherichia coli CFT073
auccauauuuuuugaaaaaugc

SEQ ID NO: 625321 - RNA, 21 nt, Escherichia coli CFT073
auccacaacaaugucuucaca

SEQ ID NO: 625322 - RNA, 16 nt, Escherichia coli CFT073
auccacagcaaugcau

SEQ ID NO: 625323 - RNA, 15 nt, Escherichia coli CFT073
auccacauuaacgaa

SEQ ID NO: 625324 - RNA, 18 nt, Escherichia coli CFT073
auccacauuuucagccag

SEQ ID NO: 625325 - RNA, 14 nt, Escherichia coli CFT073
auccacccgcagcc

SEQ ID NO: 625326 - RNA, 21 nt, Escherichia coli CFT073
auccaccgacacuacaaauuu

SEQ ID NO: 625327 - RNA, 22 nt, Escherichia coli CFT073
auccaccgacacuacaaauuua

SEQ ID NO: 625328 - RNA, 13 nt, Escherichia coli CFT073
auccagaaaaaaa

SEQ ID NO: 625329 - RNA, 18 nt, Escherichia coli CFT073
auccagacccagcuucag

SEQ ID NO: 625330 - RNA, 14 nt, Escherichia coli CFT073
auccagaugucuuu

SEQ ID NO: 625331 - RNA, 21 nt, Escherichia coli CFT073
auccagacugcgcauuaaaua

SEQ ID NO: 625332 - RNA, 20 nt, Escherichia coli CFT073
auccacuacuuaauaagcag

SEQ ID NO: 625333 - RNA, 23 nt, Escherichia coli CFT073
auccacuacgcuguagccgccau

SEQ ID NO: 625334 - RNA, 20 nt, Escherichia coli CFT073
auccacugaaacaugaacau

SEQ ID NO: 625335 - RNA, 22 nt, Escherichia coli CFT073
auccaccuucuguaacuggaag

SEQ ID NO: 625336 - RNA, 18 nt, Escherichia coli CFT073
aucauucugcaaggcaaa

SEQ ID NO: 625337 - RNA, 23 nt, Escherichia coli CFT073
aucauucccuacgcgauaaaaaa

SEQ ID NO: 625338 - RNA, 22 nt, Escherichia coli CFT073
aucauuccguagcguuuuuuca

SEQ ID NO: 625339 - RNA, 16 nt, Escherichia coli CFT073
aucauucgcagcugca

SEQ ID NO: 625340 - RNA, 17 nt, Escherichia coli CFT073
aucauucgcagcugcag

SEQ ID NO: 625341 - RNA, 18 nt, Escherichia coli CFT073
aucauucgcccgccgaga

SEQ ID NO: 625342 - RNA, 15 nt, Escherichia coli CFT073
auccaacaucgguac

SEQ ID NO: 625343 - RNA, 17 nt, Escherichia coli CFT073
auccaacuuuucccagc

SEQ ID NO: 625344 - RNA, 20 nt, Escherichia coli CFT073
auccaacuuuucccagcgcg

SEQ ID NO: 625345 - RNA, 17 nt, Escherichia coli CFT073
auccaacugauuuucau

SEQ ID NO: 625346 - RNA, 14 nt, Escherichia coli CFT073
aucauuuuuucccc

SEQ ID NO: 625347 - RNA, 22 nt, Escherichia coli CFT073
aucauuaugccggguuauccaa

SEQ ID NO: 625348 - RNA, 15 nt, Escherichia coli CFT073
aucauucaccagccc

SEQ ID NO: 625349 - RNA, 23 nt, Escherichia coli CFT073
aucauuagucacaaaucucccuu

SEQ ID NO: 625350 - RNA, 20 nt, Escherichia coli CFT073
aucauuaacgcagaaucuuc

SEQ ID NO: 625351 - RNA, 14 nt, Escherichia coli CFT073
aucauuaacugcug

SEQ ID NO: 625352 - RNA, 19 nt, Escherichia coli CFT073
aucaugcccuuuuuucuua

SEQ ID NO: 625353 - RNA, 20 nt, Escherichia coli CFT073
aucaugcugccgagcgcaag

SEQ ID NO: 625354 - RNA, 17 nt, Escherichia coli CFT073
aucauggcauccuguuu

SEQ ID NO: 625355 - RNA, 21 nt, Escherichia coli CFT073
aucauggcauccuguuuucug

SEQ ID NO: 625356 - RNA, 18 nt, Escherichia coli CFT073
aucauccgcaauaacuaa

SEQ ID NO: 625357 - RNA, 15 nt, Escherichia coli CFT073
aucauccgcacaauc

SEQ ID NO: 625358 - RNA, 18 nt, Escherichia coli CFT073
aucaucgacauugaccag

SEQ ID NO: 625359 - RNA, 15 nt, Escherichia coli CFT073
aucauccggcacuuu

SEQ ID NO: 625360 - RNA, 22 nt, Escherichia coli CFT073
aucauccugcggcagcuccagc

SEQ ID NO: 625361 - RNA, 19 nt, Escherichia coli CFT073
aucauccugcugcacgccc

SEQ ID NO: 625362 - RNA, 22 nt, Escherichia coli CFT073
aucauccugcugcacgcccuga

SEQ ID NO: 625363 - RNA, 17 nt, Escherichia coli CFT073
aucaucgcggcacacag

SEQ ID NO: 625364 - RNA, 19 nt, Escherichia coli CFT073
aucaucgcguacucaccgc

SEQ ID NO: 625365 - RNA, 17 nt, Escherichia coli CFT073
aucaucggcaccgccag

SEQ ID NO: 625366 - RNA, 15 nt, Escherichia coli CFT073
aucaucggcugcgcu

SEQ ID NO: 625367 - RNA, 13 nt, Escherichia coli CFT073
aucaucgggaaga

SEQ ID NO: 625368 - RNA, 12 nt, Escherichia coli CFT073
aucaucaucgcg

SEQ ID NO: 625369 - RNA, 14 nt, Escherichia coli CFT073
aucaucauuauuaa

SEQ ID NO: 625370 - RNA, 17 nt, Escherichia coli CFT073
aucaucagcgcuuuauc

SEQ ID NO: 625371 - RNA, 17 nt, Escherichia coli CFT073
aucaucaggcaugaggg

SEQ ID NO: 625372 - RNA, 19 nt, Escherichia coli CFT073
aucaucaugcuuaaauauu

SEQ ID NO: 625373 - RNA, 18 nt, Escherichia coli CFT073
aucauccaggcuuuaaac

SEQ ID NO: 625374 - RNA, 15 nt, Escherichia coli CFT073
aucaucaaugccagc

SEQ ID NO: 625375 - RNA, 12 nt, Escherichia coli CFT073
aucaucaauaug

SEQ ID NO: 625376 - RNA, 16 nt, Escherichia coli CFT073
aucaucacccugcgau

SEQ ID NO: 625377 - RNA, 23 nt, Escherichia coli CFT073
aucaucaccugcgcuggcaggcc

SEQ ID NO: 625378 - RNA, 20 nt, Escherichia coli CFT073
aucaucacgcagagcaucau

SEQ ID NO: 625379 - RNA, 15 nt, Escherichia coli CFT073
aucaucacuuuuucc

SEQ ID NO: 625380 - RNA, 12 nt, Escherichia coli CFT073
aucaucaagcac

SEQ ID NO: 625381 - RNA, 16 nt, Escherichia coli CFT073
aucaggcaucgugcac

SEQ ID NO: 625382 - RNA, 23 nt, Escherichia coli CFT073
aucaggcaugagggugacaucaa

SEQ ID NO: 625383 - RNA, 13 nt, Escherichia coli CFT073
aucaggcccgcgu

SEQ ID NO: 625384 - RNA, 17 nt, Escherichia coli CFT073
aucaggccaaacagacc

SEQ ID NO: 625385 - RNA, 23 nt, Escherichia coli CFT073
aucaggccaccucgcaacaaugu

SEQ ID NO: 625386 - RNA, 13 nt, Escherichia coli CFT073
aucaggccaggcg

SEQ ID NO: 625387 - RNA, 13 nt, Escherichia coli CFT073
aucaggcagaaca

SEQ ID NO: 625388 - RNA, 20 nt, Escherichia coli CFT073
aucaggcagaacgccaugcc

SEQ ID NO: 625389 - RNA, 16 nt, Escherichia coli CFT073
aucaaucgcucccagc

SEQ ID NO: 625390 - RNA, 20 nt, Escherichia coli CFT073
aucaaucgcagccacguuaa

SEQ ID NO: 625391 - RNA, 17 nt, Escherichia coli CFT073
aucaaucgcaaucuggc

SEQ ID NO: 625392 - RNA, 19 nt, Escherichia coli CFT073
aucaauccggcaaucaaca

SEQ ID NO: 625393 - RNA, 20 nt, Escherichia coli CFT073
aucaauccggcaaucaacau

SEQ ID NO: 625394 - RNA, 16 nt, Escherichia coli CFT073
aucaauccccagaugc

SEQ ID NO: 625395 - RNA, 23 nt, Escherichia coli CFT073
aucaggacgaauacaagaaauau

SEQ ID NO: 625396 - RNA, 23 nt, Escherichia coli CFT073
aucaggaaaacgugccacugaca

SEQ ID NO: 625397 - RNA, 18 nt, Escherichia coli CFT073
aucaggcuuguguaccug

SEQ ID NO: 625398 - RNA, 15 nt, Escherichia coli CFT073
aucaggcguugauug

SEQ ID NO: 625399 - RNA, 17 nt, Escherichia coli CFT073
aucaggcuacgcagcau

SEQ ID NO: 625400 - RNA, 20 nt, Escherichia coli CFT073
aucaggcgacacuucguuaa

SEQ ID NO: 625401 - RNA, 19 nt, Escherichia coli CFT073
aucaggccuacaggugcac

SEQ ID NO: 625402 - RNA, 18 nt, Escherichia coli CFT073
aucaggccuacaugccau

SEQ ID NO: 625403 - RNA, 11 nt, Escherichia coli CFT073
aucagguugag

SEQ ID NO: 625404 - RNA, 15 nt, Escherichia coli CFT073
aucagguguaauaaa

SEQ ID NO: 625405 - RNA, 22 nt, Escherichia coli CFT073
aucaguaccagcccgccgagaa

SEQ ID NO: 625406 - RNA, 22 nt, Escherichia coli CFT073
aucagggcgaugcgggauguau

SEQ ID NO: 625407 - RNA, 17 nt, Escherichia coli CFT073
aucagguaauuuugcuu

SEQ ID NO: 625408 - RNA, 22 nt, Escherichia coli CFT073
aucaggucaucaaucaguucau

SEQ ID NO: 625409 - RNA, 18 nt, Escherichia coli CFT073
aucaggucuuucagggug

SEQ ID NO: 625410 - RNA, 14 nt, Escherichia coli CFT073
aucaguuuauccau

SEQ ID NO: 625411 - RNA, 12 nt, Escherichia coli CFT073
aucaguuucaga

SEQ ID NO: 625412 - RNA, 20 nt, Escherichia coli CFT073
aucaguuuguuauauucacu

SEQ ID NO: 625413 - RNA, 16 nt, Escherichia coli CFT073
aucaguuccaguucau

SEQ ID NO: 625414 - RNA, 19 nt, Escherichia coli CFT073
aucaguccguugucuguaa

SEQ ID NO: 625415 - RNA, 21 nt, Escherichia coli CFT073
aucaguauuaucaaaucacca

SEQ ID NO: 625416 - RNA, 16 nt, Escherichia coli CFT073
aucagucagguuggca

SEQ ID NO: 625417 - RNA, 15 nt, Escherichia coli CFT073
aucauacugaacuua

SEQ ID NO: 625418 - RNA, 13 nt, Escherichia coli CFT073
aucauaugcacaa

SEQ ID NO: 625419 - RNA, 17 nt, Escherichia coli CFT073
aucauaugcacaaucag

SEQ ID NO: 625420 - RNA, 19 nt, Escherichia coli CFT073
aucauaucccggcugaaua

SEQ ID NO: 625421 - RNA, 18 nt, Escherichia coli CFT073
aucauaucgucauuaucg

SEQ ID NO: 625422 - RNA, 23 nt, Escherichia coli CFT073
aucauaguaaguguuguauuaua

SEQ ID NO: 625423 - RNA, 13 nt, Escherichia coli CFT073
augcgaagaccgc

SEQ ID NO: 625424 - RNA, 14 nt, Escherichia coli CFT073
augcgaaugccaau

SEQ ID NO: 625425 - RNA, 15 nt, Escherichia coli CFT073
augcgaaugccgggc

SEQ ID NO: 625426 - RNA, 13 nt, Escherichia coli CFT073
augcgacgcuugc

SEQ ID NO: 625427 - RNA, 12 nt, Escherichia coli CFT073
augcgacggcac

SEQ ID NO: 625428 - RNA, 18 nt, Escherichia coli CFT073
augcgacguuacaaccac

SEQ ID NO: 625429 - RNA, 20 nt, Escherichia coli CFT073
augcgacguuacaaccacau

SEQ ID NO: 625430 - RNA, 20 nt, Escherichia coli CFT073
augcgaguaaacaggggcug

SEQ ID NO: 625431 - RNA, 18 nt, Escherichia coli CFT073
augcgagucaggccagga

SEQ ID NO: 625432 - RNA, 18 nt, Escherichia coli CFT073
augcgagugucauucaga

SEQ ID NO: 625433 - RNA, 21 nt, Escherichia coli CFT073
augcgccaacaucaauggaug

SEQ ID NO: 625434 - RNA, 14 nt, Escherichia coli CFT073
augcgccacuccac

SEQ ID NO: 625435 - RNA, 20 nt, Escherichia coli CFT073
augcgccagacgugcacgca

SEQ ID NO: 625436 - RNA, 24 nt, Escherichia coli CFT073
augccaaauauuucuuuaucacca

SEQ ID NO: 625437 - RNA, 14 nt, Escherichia coli CFT073
augccaaacagaau

SEQ ID NO: 625438 - RNA, 19 nt, Escherichia coli CFT073
augccaaagaaugcaguca

SEQ ID NO: 625439 - RNA, 21 nt, Escherichia coli CFT073
augcgcuucgcuuaccaugcc

SEQ ID NO: 625440 - RNA, 12 nt, Escherichia coli CFT073
augcggcgagga

SEQ ID NO: 625441 - RNA, 21 nt, Escherichia coli CFT073
augcggaugagauacauuggu

SEQ ID NO: 625442 - RNA, 20 nt, Escherichia coli CFT073
augcggcaucuucuccacgc

SEQ ID NO: 625443 - RNA, 22 nt, Escherichia coli CFT073
augcggcaucuucuccacgcca

SEQ ID NO: 625444 - RNA, 14 nt, Escherichia coli CFT073
augcgcucaauaua

SEQ ID NO: 625445 - RNA, 14 nt, Escherichia coli CFT073
augcgcugucauuc

SEQ ID NO: 625446 - RNA, 22 nt, Escherichia coli CFT073
augcgcugggcgguaauguuuu

SEQ ID NO: 625447 - RNA, 22 nt, Escherichia coli CFT073
augcgcucgcauccugccagga

SEQ ID NO: 625448 - RNA, 16 nt, Escherichia coli CFT073
augcgcgagguaacaa

SEQ ID NO: 625449 - RNA, 19 nt, Escherichia coli CFT073
augcgccgucagaguggcg

SEQ ID NO: 625450 - RNA, 12 nt, Escherichia coli CFT073
augcuccccaga

SEQ ID NO: 625451 - RNA, 23 nt, Escherichia coli CFT073
augcucgcugcgaaguuuuuccg

SEQ ID NO: 625452 - RNA, 15 nt, Escherichia coli CFT073
augcucucccaaaua

SEQ ID NO: 625453 - RNA, 19 nt, Escherichia coli CFT073
augcucuuaauacgaguuu

SEQ ID NO: 625454 - RNA, 15 nt, Escherichia coli CFT073
augcucauaccauuc

SEQ ID NO: 625455 - RNA, 12 nt, Escherichia coli CFT073
augcucaagcau

SEQ ID NO: 625456 - RNA, 13 nt, Escherichia coli CFT073
augcguuaagcgu

SEQ ID NO: 625457 - RNA, 22 nt, Escherichia coli CFT073
augcguuggccaaaguuccggg

SEQ ID NO: 625458 - RNA, 18 nt, Escherichia coli CFT073
augcgucuuccgugccug

SEQ ID NO: 625459 - RNA, 16 nt, Escherichia coli CFT073
augcguaccauuucuu

SEQ ID NO: 625460 - RNA, 22 nt, Escherichia coli CFT073
augcgguacugaccaucagcag

SEQ ID NO: 625461 - RNA, 16 nt, Escherichia coli CFT073
augcgggugaacgcgu

SEQ ID NO: 625462 - RNA, 23 nt, Escherichia coli CFT073
augcuuguuuauuaucaauuuua

SEQ ID NO: 625463 - RNA, 16 nt, Escherichia coli CFT073
augcuugacucuguag

SEQ ID NO: 625464 - RNA, 21 nt, Escherichia coli CFT073
augcuguugcugauugguguc

SEQ ID NO: 625465 - RNA, 13 nt, Escherichia coli CFT073
augcugugcuccu

SEQ ID NO: 625466 - RNA, 23 nt, Escherichia coli CFT073
augcuucacugaaacagauaaaa

SEQ ID NO: 625467 - RNA, 22 nt, Escherichia coli CFT073
augcuucagccagaggcggcaa

SEQ ID NO: 625468 - RNA, 14 nt, Escherichia coli CFT073
augcugguuuugug

SEQ ID NO: 625469 - RNA, 15 nt, Escherichia coli CFT073
augcugguuacugga

SEQ ID NO: 625470 - RNA, 14 nt, Escherichia coli CFT073
augcuguaaacaac

SEQ ID NO: 625471 - RNA, 21 nt, Escherichia coli CFT073
augcugcaauaaaauaucuuc

SEQ ID NO: 625472 - RNA, 14 nt, Escherichia coli CFT073
augcugcaaucauu

SEQ ID NO: 625473 - RNA, 14 nt, Escherichia coli CFT073
augcugcaauaaaa

SEQ ID NO: 625474 - RNA, 19 nt, Escherichia coli CFT073
augcugcaccccacaaaca

SEQ ID NO: 625475 - RNA, 23 nt, Escherichia coli CFT073
augcugcaccccacaaacagaau

SEQ ID NO: 625476 - RNA, 14 nt, Escherichia coli CFT073
augcugaauuagcc

SEQ ID NO: 625477 - RNA, 15 nt, Escherichia coli CFT073
augcugccacacugc

SEQ ID NO: 625478 - RNA, 17 nt, Escherichia coli CFT073
augcugccacacugccu

SEQ ID NO: 625479 - RNA, 17 nt, Escherichia coli CFT073
augcugcgggcgaucau

SEQ ID NO: 625480 - RNA, 19 nt, Escherichia coli CFT073
augcugcucgcaaaauaaa

SEQ ID NO: 625481 - RNA, 22 nt, Escherichia coli CFT073
augcugcucgcaaaauaaaaac

SEQ ID NO: 625482 - RNA, 14 nt, Escherichia coli CFT073
augcugcuuacaua

SEQ ID NO: 625483 - RNA, 22 nt, Escherichia coli CFT073
augcugcuuuaucagaucacgc

SEQ ID NO: 625484 - RNA, 15 nt, Escherichia coli CFT073
augcugccuucggug

SEQ ID NO: 625485 - RNA, 19 nt, Escherichia coli CFT073
augcuuuuuccugagucag

SEQ ID NO: 625486 - RNA, 15 nt, Escherichia coli CFT073
augcuuucaguacug

SEQ ID NO: 625487 - RNA, 13 nt, Escherichia coli CFT073
auggaaacagcac

SEQ ID NO: 625488 - RNA, 15 nt, Escherichia coli CFT073
auggaauagaaucac

SEQ ID NO: 625489 - RNA, 21 nt, Escherichia coli CFT073
auggaauucgcagcgaucugc

SEQ ID NO: 625490 - RNA, 19 nt, Escherichia coli CFT073
auggaauggucaauggugg

SEQ ID NO: 625491 - RNA, 22 nt, Escherichia coli CFT073
auggaaauagaacguuuaucug

SEQ ID NO: 625492 - RNA, 17 nt, Escherichia coli CFT073
auggauccccgcagcaa

SEQ ID NO: 625493 - RNA, 15 nt, Escherichia coli CFT073
auggaugagcaaacg

SEQ ID NO: 625494 - RNA, 18 nt, Escherichia coli CFT073
auggaugcaucuucauua

SEQ ID NO: 625495 - RNA, 19 nt, Escherichia coli CFT073
auggaucagcguuucuucc

SEQ ID NO: 625496 - RNA, 20 nt, Escherichia coli CFT073
auggaucuuugacugaaauu

SEQ ID NO: 625497 - RNA, 15 nt, Escherichia coli CFT073
auggagcuaaacaga

SEQ ID NO: 625498 - RNA, 16 nt, Escherichia coli CFT073
auggagcuaaacagag

SEQ ID NO: 625499 - RNA, 17 nt, Escherichia coli CFT073
auggauauaauucauca

SEQ ID NO: 625500 - RNA, 17 nt, Escherichia coli CFT073
auggacuuuuacugucu

SEQ ID NO: 625501 - RNA, 12 nt, Escherichia coli CFT073
auggagaaaaca

SEQ ID NO: 625502 - RNA, 17 nt, Escherichia coli CFT073
auggacguuaauccgcu

SEQ ID NO: 625503 - RNA, 18 nt, Escherichia coli CFT073
auggacgucaaaaggcuc

SEQ ID NO: 625504 - RNA, 18 nt, Escherichia coli CFT073
auggagagaaccagcgca

SEQ ID NO: 625505 - RNA, 15 nt, Escherichia coli CFT073
auggacgcagaccaa

SEQ ID NO: 625506 - RNA, 17 nt, Escherichia coli CFT073
auggacgcagaccaaag

SEQ ID NO: 625507 - RNA, 16 nt, Escherichia coli CFT073
auggcgcgaaaacaac

SEQ ID NO: 625508 - RNA, 17 nt, Escherichia coli CFT073
auggcgcccaucggcgc

SEQ ID NO: 625509 - RNA, 23 nt, Escherichia coli CFT073
auggcgcaguugccggaugcggc

SEQ ID NO: 625510 - RNA, 20 nt, Escherichia coli CFT073
auggcgauuucacaagacug

SEQ ID NO: 625511 - RNA, 15 nt, Escherichia coli CFT073
auggcgauuuugugc

SEQ ID NO: 625512 - RNA, 14 nt, Escherichia coli CFT073
auggcgaauggcac

SEQ ID NO: 625513 - RNA, 12 nt, Escherichia coli CFT073
auggcugauuac

SEQ ID NO: 625514 - RNA, 16 nt, Escherichia coli CFT073
auggcguauaccugau

SEQ ID NO: 625515 - RNA, 19 nt, Escherichia coli CFT073
auggcggugagggggggau

SEQ ID NO: 625516 - RNA, 13 nt, Escherichia coli CFT073
auggcguacucaa

SEQ ID NO: 625517 - RNA, 23 nt, Escherichia coli CFT073
auggcgaaaaaccuaauacucug

SEQ ID NO: 625518 - RNA, 13 nt, Escherichia coli CFT073
auggccuuucugg

SEQ ID NO: 625519 - RNA, 20 nt, Escherichia coli CFT073
auggccugaugugacgcugu

SEQ ID NO: 625520 - RNA, 19 nt, Escherichia coli CFT073
auggcccgccgcauuggua

SEQ ID NO: 625521 - RNA, 22 nt, Escherichia coli CFT073
auggcccgcuugccagauggca

SEQ ID NO: 625522 - RNA, 16 nt, Escherichia coli CFT073
auggauucaugauacu

SEQ ID NO: 625523 - RNA, 18 nt, Escherichia coli CFT073
auggcaacagcagccaac

SEQ ID NO: 625524 - RNA, 15 nt, Escherichia coli CFT073
auggcaaacaaacug

SEQ ID NO: 625525 - RNA, 13 nt, Escherichia coli CFT073
augguucaagacg

SEQ ID NO: 625526 - RNA, 17 nt, Escherichia coli CFT073
augguuauuaccaaaaa

SEQ ID NO: 625527 - RNA, 18 nt, Escherichia coli CFT073
augguuggaauugaagcu

SEQ ID NO: 625528 - RNA, 13 nt, Escherichia coli CFT073
auggugcagcaga

SEQ ID NO: 625529 - RNA, 20 nt, Escherichia coli CFT073
auggugccguguaaaaucac

SEQ ID NO: 625530 - RNA, 22 nt, Escherichia coli CFT073
auggugaaguuauuaaugacaa

SEQ ID NO: 625531 - RNA, 14 nt, Escherichia coli CFT073
auggugacaaacac

SEQ ID NO: 625532 - RNA, 13 nt, Escherichia coli CFT073
auggugaccugca

SEQ ID NO: 625533 - RNA, 18 nt, Escherichia coli CFT073
augguggucgcaucaucc

SEQ ID NO: 625534 - RNA, 21 nt, Escherichia coli CFT073
auggguuacgcgaaccaauca

SEQ ID NO: 625535 - RNA, 17 nt, Escherichia coli CFT073
auggucaacauucccug

SEQ ID NO: 625536 - RNA, 14 nt, Escherichia coli CFT073
augggugugcugac

SEQ ID NO: 625537 - RNA, 14 nt, Escherichia coli CFT073
auggucagccagcg

SEQ ID NO: 625538 - RNA, 12 nt, Escherichia coli CFT073
auggucaucauc

SEQ ID NO: 625539 - RNA, 15 nt, Escherichia coli CFT073
auggucaccacaccg

SEQ ID NO: 625540 - RNA, 15 nt, Escherichia coli CFT073
auggcuugcgccaug

SEQ ID NO: 625541 - RNA, 15 nt, Escherichia coli CFT073
auggcuucuuccccg

SEQ ID NO: 625542 - RNA, 15 nt, Escherichia coli CFT073
auggcuuuccaccug

SEQ ID NO: 625543 - RNA, 22 nt, Escherichia coli CFT073
augucacaaucccuuccaccga

SEQ ID NO: 625544 - RNA, 18 nt, Escherichia coli CFT073
augucacccacuguggua

SEQ ID NO: 625545 - RNA, 20 nt, Escherichia coli CFT073
augucaccuaauuuaaaauu

SEQ ID NO: 625546 - RNA, 17 nt, Escherichia coli CFT073
auguauuucaucaucag

SEQ ID NO: 625547 - RNA, 12 nt, Escherichia coli CFT073
augucaggcguc

SEQ ID NO: 625548 - RNA, 15 nt, Escherichia coli CFT073
augucagguauugcc

SEQ ID NO: 625549 - RNA, 21 nt, Escherichia coli CFT073
augucaguaguuuuugcagau

SEQ ID NO: 625550 - RNA, 21 nt, Escherichia coli CFT073
augucagagcuguagauauau

SEQ ID NO: 625551 - RNA, 14 nt, Escherichia coli CFT073
augucaguugcaua

SEQ ID NO: 625552 - RNA, 18 nt, Escherichia coli CFT073
augucaucccuuccugcc

SEQ ID NO: 625553 - RNA, 20 nt, Escherichia coli CFT073
augucaucccuuccugcccu

SEQ ID NO: 625554 - RNA, 16 nt, Escherichia coli CFT073
augucgcgcacugggu

SEQ ID NO: 625555 - RNA, 20 nt, Escherichia coli CFT073
augucggcagugauuuuccc

SEQ ID NO: 625556 - RNA, 14 nt, Escherichia coli CFT073
auguaccagacuga

SEQ ID NO: 625557 - RNA, 21 nt, Escherichia coli CFT073
auguaccagacugacauguua

SEQ ID NO: 625558 - RNA, 12 nt, Escherichia coli CFT073
auguaauucggc

SEQ ID NO: 625559 - RNA, 13 nt, Escherichia coli CFT073
auguaacugccuu

SEQ ID NO: 625560 - RNA, 20 nt, Escherichia coli CFT073
auguagcggaucgccgccgg

SEQ ID NO: 625561 - RNA, 13 nt, Escherichia coli CFT073
auguauucuuuga

SEQ ID NO: 625562 - RNA, 16 nt, Escherichia coli CFT073
auguacucaauugcuu

SEQ ID NO: 625563 - RNA, 16 nt, Escherichia coli CFT073
auguacucgcuguuga

SEQ ID NO: 625564 - RNA, 21 nt, Escherichia coli CFT073
auguuccggcgacacaucuaa

SEQ ID NO: 625565 - RNA, 22 nt, Escherichia coli CFT073
auguuccucaucgucaaaugaa

SEQ ID NO: 625566 - RNA, 17 nt, Escherichia coli CFT073
auguucccccagccaga

SEQ ID NO: 625567 - RNA, 19 nt, Escherichia coli CFT073
auguuaucgagauauuuca

SEQ ID NO: 625568 - RNA, 15 nt, Escherichia coli CFT073
auguuaccaacacug

SEQ ID NO: 625569 - RNA, 17 nt, Escherichia coli CFT073
auguuacaaccuccucc

SEQ ID NO: 625570 - RNA, 13 nt, Escherichia coli CFT073
auguguuagcccu

SEQ ID NO: 625571 - RNA, 15 nt, Escherichia coli CFT073
augugguuagcugga

SEQ ID NO: 625572 - RNA, 19 nt, Escherichia coli CFT073
auguguacuucucugugac

SEQ ID NO: 625573 - RNA, 17 nt, Escherichia coli CFT073
augugcucuaacccuuc

SEQ ID NO: 625574 - RNA, 19 nt, Escherichia coli CFT073
augugcucuaacccuucca

SEQ ID NO: 625575 - RNA, 16 nt, Escherichia coli CFT073
augugcccggccaguc

SEQ ID NO: 625576 - RNA, 20 nt, Escherichia coli CFT073
augugccugaugugcuccgc

SEQ ID NO: 625577 - RNA, 19 nt, Escherichia coli CFT073
augucucgguagagaaaac

SEQ ID NO: 625578 - RNA, 13 nt, Escherichia coli CFT073
augucugcauaug

SEQ ID NO: 625579 - RNA, 22 nt, Escherichia coli CFT073
augugccagcgauuuugccagc

SEQ ID NO: 625580 - RNA, 11 nt, Escherichia coli CFT073
augugccauua

SEQ ID NO: 625581 - RNA, 18 nt, Escherichia coli CFT073
augaugccgucuuuaucg

SEQ ID NO: 625582 - RNA, 16 nt, Escherichia coli CFT073
augauuaucaugcccu

SEQ ID NO: 625583 - RNA, 21 nt, Escherichia coli CFT073
augaugauugaccauauuaac

SEQ ID NO: 625584 - RNA, 20 nt, Escherichia coli CFT073
augaugcgacuugucaucau

SEQ ID NO: 625585 - RNA, 20 nt, Escherichia coli CFT073
augaugcccgguugcuuuuc

SEQ ID NO: 625586 - RNA, 18 nt, Escherichia coli CFT073
augaugcacuucagggcg

SEQ ID NO: 625587 - RNA, 15 nt, Escherichia coli CFT073
augaucuccauugcc

SEQ ID NO: 625588 - RNA, 15 nt, Escherichia coli CFT073
augaucuaaaagcaa

SEQ ID NO: 625589 - RNA, 17 nt, Escherichia coli CFT073
augaucuaaaagcaaac

SEQ ID NO: 625590 - RNA, 19 nt, Escherichia coli CFT073
augaucauuaacgcagaau

SEQ ID NO: 625591 - RNA, 21 nt, Escherichia coli CFT073
augaucaucgcgucaucguca

SEQ ID NO: 625592 - RNA, 14 nt, Escherichia coli CFT073
augauccagcuugu

SEQ ID NO: 625593 - RNA, 13 nt, Escherichia coli CFT073
augauauuuuucc

SEQ ID NO: 625594 - RNA, 14 nt, Escherichia coli CFT073
augaucaaaaaaau

SEQ ID NO: 625595 - RNA, 19 nt, Escherichia coli CFT073
augaucagcgguuuugcca

SEQ ID NO: 625596 - RNA, 18 nt, Escherichia coli CFT073
augaucagaacaucgcca

SEQ ID NO: 625597 - RNA, 21 nt, Escherichia coli CFT073
augauaucgcuggcaggcaaa

SEQ ID NO: 625598 - RNA, 13 nt, Escherichia coli CFT073
augcagacucauu

SEQ ID NO: 625599 - RNA, 15 nt, Escherichia coli CFT073
augcagauaacuuag

SEQ ID NO: 625600 - RNA, 18 nt, Escherichia coli CFT073
augcacggcagauaaaca

SEQ ID NO: 625601 - RNA, 22 nt, Escherichia coli CFT073
augcacggcagauaaacaaccc

SEQ ID NO: 625602 - RNA, 17 nt, Escherichia coli CFT073
augcacgcccgcagcgg

SEQ ID NO: 625603 - RNA, 18 nt, Escherichia coli CFT073
augcauagcguucuucca

SEQ ID NO: 625604 - RNA, 16 nt, Escherichia coli CFT073
augcauauccaggcua

SEQ ID NO: 625605 - RNA, 18 nt, Escherichia coli CFT073
augcauaugaaugccagc

SEQ ID NO: 625606 - RNA, 20 nt, Escherichia coli CFT073
augcagcauagaagaaauaa

SEQ ID NO: 625607 - RNA, 22 nt, Escherichia coli CFT073
augcauacacagauaaacuaca

SEQ ID NO: 625608 - RNA, 12 nt, Escherichia coli CFT073
augauugaccau

SEQ ID NO: 625609 - RNA, 15 nt, Escherichia coli CFT073
augauuuuccugagg

SEQ ID NO: 625610 - RNA, 16 nt, Escherichia coli CFT073
augcaaaaaaugagua

SEQ ID NO: 625611 - RNA, 17 nt, Escherichia coli CFT073
augcaaaaaggcgugca

SEQ ID NO: 625612 - RNA, 17 nt, Escherichia coli CFT073
augcaaacgauuaucaa

SEQ ID NO: 625613 - RNA, 14 nt, Escherichia coli CFT073
augcacauccacgc

SEQ ID NO: 625614 - RNA, 15 nt, Escherichia coli CFT073
augcaccaucucuua

SEQ ID NO: 625615 - RNA, 17 nt, Escherichia coli CFT073
augcaccgacaauccag

SEQ ID NO: 625616 - RNA, 18 nt, Escherichia coli CFT073
augcaccgacaauccagu

SEQ ID NO: 625617 - RNA, 21 nt, Escherichia coli CFT073
augcaccggaucgaugccaaa

SEQ ID NO: 625618 - RNA, 19 nt, Escherichia coli CFT073
augaccgguucuacaucag

SEQ ID NO: 625619 - RNA, 13 nt, Escherichia coli CFT073
augacggggauuc

SEQ ID NO: 625620 - RNA, 16 nt, Escherichia coli CFT073
augaccgacagaggau

SEQ ID NO: 625621 - RNA, 19 nt, Escherichia coli CFT073
augaccgacguuaugcucg

SEQ ID NO: 625622 - RNA, 18 nt, Escherichia coli CFT073
augaccgaggcgcggcga

SEQ ID NO: 625623 - RNA, 13 nt, Escherichia coli CFT073
augacccacgccu

SEQ ID NO: 625624 - RNA, 14 nt, Escherichia coli CFT073
augacagaaucagc

SEQ ID NO: 625625 - RNA, 19 nt, Escherichia coli CFT073
augacagccccaccagcaa

SEQ ID NO: 625626 - RNA, 20 nt, Escherichia coli CFT073
augacagccccaccagcaaa

SEQ ID NO: 625627 - RNA, 18 nt, Escherichia coli CFT073
augacauacagcaccgcc

SEQ ID NO: 625628 - RNA, 15 nt, Escherichia coli CFT073
augacaggcagacga

SEQ ID NO: 625629 - RNA, 12 nt, Escherichia coli CFT073
augacauaaccu

SEQ ID NO: 625630 - RNA, 14 nt, Escherichia coli CFT073
augaauuuucgaca

SEQ ID NO: 625631 - RNA, 18 nt, Escherichia coli CFT073
augaauuuucgacagcac

SEQ ID NO: 625632 - RNA, 14 nt, Escherichia coli CFT073
augacaauguggcc

SEQ ID NO: 625633 - RNA, 15 nt, Escherichia coli CFT073
augacaauuacaaaa

SEQ ID NO: 625634 - RNA, 19 nt, Escherichia coli CFT073
augacaauuacaaaaugac

SEQ ID NO: 625635 - RNA, 21 nt, Escherichia coli CFT073
augacaauuacaaaaugacau

SEQ ID NO: 625636 - RNA, 15 nt, Escherichia coli CFT073
augacaccaagcacc

SEQ ID NO: 625637 - RNA, 16 nt, Escherichia coli CFT073
augacaccaagcacca

SEQ ID NO: 625638 - RNA, 18 nt, Escherichia coli CFT073
augacaccaagcaccaua

SEQ ID NO: 625639 - RNA, 20 nt, Escherichia coli CFT073
augaggcuuuaauaccugcc

SEQ ID NO: 625640 - RNA, 18 nt, Escherichia coli CFT073
augaggcuuuaauaccug

SEQ ID NO: 625641 - RNA, 19 nt, Escherichia coli CFT073
augaggcguuaacagcgca

SEQ ID NO: 625642 - RNA, 16 nt, Escherichia coli CFT073
augauaccgauuacuc

SEQ ID NO: 625643 - RNA, 18 nt, Escherichia coli CFT073
augauacaaaacagauac

SEQ ID NO: 625644 - RNA, 21 nt, Escherichia coli CFT073
augauaucccugcuguccuga

SEQ ID NO: 625645 - RNA, 22 nt, Escherichia coli CFT073
augauaucagccugcaaacgcu

SEQ ID NO: 625646 - RNA, 16 nt, Escherichia coli CFT073
augauaggcuucaacc

SEQ ID NO: 625647 - RNA, 15 nt, Escherichia coli CFT073
augauacggaaaucc

SEQ ID NO: 625648 - RNA, 12 nt, Escherichia coli CFT073
augauacucagc

SEQ ID NO: 625649 - RNA, 17 nt, Escherichia coli CFT073
augacguguaugcauaa

SEQ ID NO: 625650 - RNA, 23 nt, Escherichia coli CFT073
augacguguaugcauaaccaaca

SEQ ID NO: 625651 - RNA, 18 nt, Escherichia coli CFT073
augacuaucacagaaaaa

SEQ ID NO: 625652 - RNA, 20 nt, Escherichia coli CFT073
augacucauaaaaauauauu

SEQ ID NO: 625653 - RNA, 14 nt, Escherichia coli CFT073
aucuuugacugucc

SEQ ID NO: 625654 - RNA, 15 nt, Escherichia coli CFT073
aucuuuuaaaucauc

SEQ ID NO: 625655 - RNA, 17 nt, Escherichia coli CFT073
aucuuugacugaaauuu

SEQ ID NO: 625656 - RNA, 21 nt, Escherichia coli CFT073
aucuuugauugaagaaaucag

SEQ ID NO: 625657 - RNA, 21 nt, Escherichia coli CFT073
aucuuugaaauaauauugcuu

SEQ ID NO: 625658 - RNA, 11 nt, Escherichia coli CFT073
aucuuuauuca

SEQ ID NO: 625659 - RNA, 12 nt, Escherichia coli CFT073
aucuuuauucau

SEQ ID NO: 625660 - RNA, 16 nt, Escherichia coli CFT073
aucuuuaucaaucacc

SEQ ID NO: 625661 - RNA, 15 nt, Escherichia coli CFT073
augaacaaagcaaau

SEQ ID NO: 625662 - RNA, 17 nt, Escherichia coli CFT073
augaacaaagcaaauaa

SEQ ID NO: 625663 - RNA, 13 nt, Escherichia coli CFT073
augaaaugcaggc

SEQ ID NO: 625664 - RNA, 14 nt, Escherichia coli CFT073
augaaaaacguugc

SEQ ID NO: 625665 - RNA, 22 nt, Escherichia coli CFT073
augaaaacgaauugucccauuu

SEQ ID NO: 625666 - RNA, 13 nt, Escherichia coli CFT073
augaaaaaaccag

SEQ ID NO: 625667 - RNA, 18 nt, Escherichia coli CFT073
augaaaaaaccagaaagg

SEQ ID NO: 625668 - RNA, 18 nt, Escherichia coli CFT073
aucuugcucuaccagcac

SEQ ID NO: 625669 - RNA, 19 nt, Escherichia coli CFT073
aucuugauuugcuuguuuc

SEQ ID NO: 625670 - RNA, 18 nt, Escherichia coli CFT073
aucuucgucaaagauauu

SEQ ID NO: 625671 - RNA, 15 nt, Escherichia coli CFT073
aucuucguuauccca

SEQ ID NO: 625672 - RNA, 20 nt, Escherichia coli CFT073
aucuucguuaucccaggcgu

SEQ ID NO: 625673 - RNA, 19 nt, Escherichia coli CFT073
aucuucaugcuccagcaga

SEQ ID NO: 625674 - RNA, 14 nt, Escherichia coli CFT073
aucuuccaguggca

SEQ ID NO: 625675 - RNA, 15 nt, Escherichia coli CFT073
aucuuccagcggcca

SEQ ID NO: 625676 - RNA, 18 nt, Escherichia coli CFT073
aucuuccagcggccagac

SEQ ID NO: 625677 - RNA, 15 nt, Escherichia coli CFT073
aucuuccagcugcac

SEQ ID NO: 625678 - RNA, 19 nt, Escherichia coli CFT073
aucuucccagcccagcgcu

SEQ ID NO: 625679 - RNA, 18 nt, Escherichia coli CFT073
aucuucccgcgccagcgc

SEQ ID NO: 625680 - RNA, 20 nt, Escherichia coli CFT073
aucuuccggcgggcaaacgg

SEQ ID NO: 625681 - RNA, 17 nt, Escherichia coli CFT073
aucuuccccuuuugccu

SEQ ID NO: 625682 - RNA, 13 nt, Escherichia coli CFT073
aucuucccagccc

SEQ ID NO: 625683 - RNA, 15 nt, Escherichia coli CFT073
aucuuccugauaacc

SEQ ID NO: 625684 - RNA, 19 nt, Escherichia coli CFT073
aucuucgaccgucaccagu

SEQ ID NO: 625685 - RNA, 20 nt, Escherichia coli CFT073
aucuucgccugaaacagaag

SEQ ID NO: 625686 - RNA, 21 nt, Escherichia coli CFT073
aucuucgccguguucuuaccc

SEQ ID NO: 625687 - RNA, 17 nt, Escherichia coli CFT073
aucuguuucucaugcag

SEQ ID NO: 625688 - RNA, 16 nt, Escherichia coli CFT073
aucuguugugccacau

SEQ ID NO: 625689 - RNA, 22 nt, Escherichia coli CFT073
aucuguugauuuaacagcaaaa

SEQ ID NO: 625690 - RNA, 14 nt, Escherichia coli CFT073
aucuguugaaauua

SEQ ID NO: 625691 - RNA, 16 nt, Escherichia coli CFT073
aucuuacgcuuaagau

SEQ ID NO: 625692 - RNA, 14 nt, Escherichia coli CFT073
aucuuacugcaacu

SEQ ID NO: 625693 - RNA, 17 nt, Escherichia coli CFT073
aucuuagacaucaaaau

SEQ ID NO: 625694 - RNA, 23 nt, Escherichia coli CFT073
aucuucaacuacggcuuuuuuca

SEQ ID NO: 625695 - RNA, 22 nt, Escherichia coli CFT073
aucuuauugaaagaucacaaug

SEQ ID NO: 625696 - RNA, 18 nt, Escherichia coli CFT073
aucuucaaucagaugugc

SEQ ID NO: 625697 - RNA, 13 nt, Escherichia coli CFT073
aucuucacacaca

SEQ ID NO: 625698 - RNA, 15 nt, Escherichia coli CFT073
aucuucacacacauc

SEQ ID NO: 625699 - RNA, 21 nt, Escherichia coli CFT073
aucuucaccaauguucaguuu

SEQ ID NO: 625700 - RNA, 16 nt, Escherichia coli CFT073
aucuucacuaccaccu

SEQ ID NO: 625701 - RNA, 13 nt, Escherichia coli CFT073
aucuucacugcgg

SEQ ID NO: 625702 - RNA, 19 nt, Escherichia coli CFT073
aucuucaggaguagaaaua

SEQ ID NO: 625703 - RNA, 13 nt, Escherichia coli CFT073
aucuucaucaucu

SEQ ID NO: 625704 - RNA, 21 nt, Escherichia coli CFT073
aucuggucgaggaucucugca

SEQ ID NO: 625705 - RNA, 23 nt, Escherichia coli CFT073
aucuggucgaggaucucugcaag

SEQ ID NO: 625706 - RNA, 21 nt, Escherichia coli CFT073
aucugcuuuucauacaaucgg

SEQ ID NO: 625707 - RNA, 18 nt, Escherichia coli CFT073
aucuaaugccauuaacau

SEQ ID NO: 625708 - RNA, 16 nt, Escherichia coli CFT073
aucuaagaucccugcc

SEQ ID NO: 625709 - RNA, 22 nt, Escherichia coli CFT073
aucugugugggcacucgaagau

SEQ ID NO: 625710 - RNA, 17 nt, Escherichia coli CFT073
aucugugcuugcagaua

SEQ ID NO: 625711 - RNA, 18 nt, Escherichia coli CFT073
aucugucugauaaaaaac

SEQ ID NO: 625712 - RNA, 19 nt, Escherichia coli CFT073
aucugucugauaaaaaacc

SEQ ID NO: 625713 - RNA, 20 nt, Escherichia coli CFT073
aucuguaagcaauuauucau

SEQ ID NO: 625714 - RNA, 17 nt, Escherichia coli CFT073
aucuguaccuucugcac

SEQ ID NO: 625715 - RNA, 24 nt, Escherichia coli CFT073
auucccugcagucaccugcccucc

SEQ ID NO: 625716 - RNA, 22 nt, Escherichia coli CFT073
auucccuacgcgauaaaaaacc

SEQ ID NO: 625717 - RNA, 19 nt, Escherichia coli CFT073
auucccgcgaacuaaacaa

SEQ ID NO: 625718 - RNA, 15 nt, Escherichia coli CFT073
auuccccugccagaa

SEQ ID NO: 625719 - RNA, 19 nt, Escherichia coli CFT073
auuccccggucagcagcac

SEQ ID NO: 625720 - RNA, 13 nt, Escherichia coli CFT073
auuccccaccuga

SEQ ID NO: 625721 - RNA, 15 nt, Escherichia coli CFT073
auucccagcaacagc

SEQ ID NO: 625722 - RNA, 22 nt, Escherichia coli CFT073
auucccagcaacagcaaagaga

SEQ ID NO: 625723 - RNA, 18 nt, Escherichia coli CFT073
auuccgcgugaaaugcca

SEQ ID NO: 625724 - RNA, 14 nt, Escherichia coli CFT073
auuccuauauauuu

SEQ ID NO: 625725 - RNA, 20 nt, Escherichia coli CFT073
auuccuauauauuuaguuca

SEQ ID NO: 625726 - RNA, 14 nt, Escherichia coli CFT073
auuccuaaaccauc

SEQ ID NO: 625727 - RNA, 18 nt, Escherichia coli CFT073
auuccuaaaccaucagca

SEQ ID NO: 625728 - RNA, 18 nt, Escherichia coli CFT073
auuccgugccagcaccaa

SEQ ID NO: 625729 - RNA, 12 nt, Escherichia coli CFT073
auuccguucagu

SEQ ID NO: 625730 - RNA, 14 nt, Escherichia coli CFT073
auuccguucaguaa

SEQ ID NO: 625731 - RNA, 17 nt, Escherichia coli CFT073
auuccguugccagaugc

SEQ ID NO: 625732 - RNA, 19 nt, Escherichia coli CFT073
auuccuuugcugcucuauu

SEQ ID NO: 625733 - RNA, 15 nt, Escherichia coli CFT073
auucgacgcaaacaa

SEQ ID NO: 625734 - RNA, 20 nt, Escherichia coli CFT073
auucgacuuucucuggcugu

SEQ ID NO: 625735 - RNA, 19 nt, Escherichia coli CFT073
auucgaguagcguucuguu

SEQ ID NO: 625736 - RNA, 21 nt, Escherichia coli CFT073
auuccugcgcuuccaguucca

SEQ ID NO: 625737 - RNA, 20 nt, Escherichia coli CFT073
auuccuggggucaucagcau

SEQ ID NO: 625738 - RNA, 19 nt, Escherichia coli CFT073
auucgcgcacgaggaacag

SEQ ID NO: 625739 - RNA, 21 nt, Escherichia coli CFT073
auucgcgcacggugcaucuuc

SEQ ID NO: 625740 - RNA, 21 nt, Escherichia coli CFT073
auucgcgcagaauuuggugaa

SEQ ID NO: 625741 - RNA, 20 nt, Escherichia coli CFT073
auucgccacugcgacaccag

SEQ ID NO: 625742 - RNA, 16 nt, Escherichia coli CFT073
auucgcagcgaucugc

SEQ ID NO: 625743 - RNA, 19 nt, Escherichia coli CFT073
auucgcagaccgggaaucg

SEQ ID NO: 625744 - RNA, 12 nt, Escherichia coli CFT073
auucgccagcac

SEQ ID NO: 625745 - RNA, 19 nt, Escherichia coli CFT073
auucgccccuucagaagau

SEQ ID NO: 625746 - RNA, 21 nt, Escherichia coli CFT073
auucgccgaauuaaacaacgc

SEQ ID NO: 625747 - RNA, 14 nt, Escherichia coli CFT073
auucgcuucaauac

SEQ ID NO: 625748 - RNA, 17 nt, Escherichia coli CFT073
auucgcuuccuccacca

SEQ ID NO: 625749 - RNA, 21 nt, Escherichia coli CFT073
auucgcuuccuccaccacuuu

SEQ ID NO: 625750 - RNA, 17 nt, Escherichia coli CFT073
auucgcuugcaaaagca

SEQ ID NO: 625751 - RNA, 15 nt, Escherichia coli CFT073
auucgcuuucacuca

SEQ ID NO: 625752 - RNA, 16 nt, Escherichia coli CFT073
auucggcaagauaaau

SEQ ID NO: 625753 - RNA, 14 nt, Escherichia coli CFT073
auucggcaaucaca

SEQ ID NO: 625754 - RNA, 18 nt, Escherichia coli CFT073
auucgggcuuacuugcug

SEQ ID NO: 625755 - RNA, 17 nt, Escherichia coli CFT073
auucggcuucuuccucc

SEQ ID NO: 625756 - RNA, 21 nt, Escherichia coli CFT073
auucggcaaugguuucccugc

SEQ ID NO: 625757 - RNA, 22 nt, Escherichia coli CFT073
auucggcgaccagcgcagcuuc

SEQ ID NO: 625758 - RNA, 20 nt, Escherichia coli CFT073
auucggcgcuccugcgggag

SEQ ID NO: 625759 - RNA, 22 nt, Escherichia coli CFT073
auucauuuggcguaguugcugc

SEQ ID NO: 625760 - RNA, 13 nt, Escherichia coli CFT073
auucauucagauu

SEQ ID NO: 625761 - RNA, 18 nt, Escherichia coli CFT073
auucauugcuauuucccc

SEQ ID NO: 625762 - RNA, 14 nt, Escherichia coli CFT073
auuccaauauuaaa

SEQ ID NO: 625763 - RNA, 15 nt, Escherichia coli CFT073
auuccaacgaaaaug

SEQ ID NO: 625764 - RNA, 18 nt, Escherichia coli CFT073
auuccaacgaaaaugauu

SEQ ID NO: 625765 - RNA, 22 nt, Escherichia coli CFT073
auuccaucaauagcccggcaau

SEQ ID NO: 625766 - RNA, 19 nt, Escherichia coli CFT073
auuccaggucaaucccagg

SEQ ID NO: 625767 - RNA, 16 nt, Escherichia coli CFT073
auuccagucagcacca

SEQ ID NO: 625768 - RNA, 17 nt, Escherichia coli CFT073
auuccagucagcaccag

SEQ ID NO: 625769 - RNA, 19 nt, Escherichia coli CFT073
auuccagcgguuguagcca

SEQ ID NO: 625770 - RNA, 15 nt, Escherichia coli CFT073
auuccagcgccgcca

SEQ ID NO: 625771 - RNA, 12 nt, Escherichia coli CFT073
auuccagaugaa

SEQ ID NO: 625772 - RNA, 20 nt, Escherichia coli CFT073
auuccaccguacgccagcgu

SEQ ID NO: 625773 - RNA, 14 nt, Escherichia coli CFT073
auucauaaugccca

SEQ ID NO: 625774 - RNA, 16 nt, Escherichia coli CFT073
auucaguucaucuacu

SEQ ID NO: 625775 - RNA, 13 nt, Escherichia coli CFT073
auucauaaagaua

SEQ ID NO: 625776 - RNA, 21 nt, Escherichia coli CFT073
auucauaaagcuauuaaucca

SEQ ID NO: 625777 - RNA, 23 nt, Escherichia coli CFT073
auguucuucaauggucagccaca

SEQ ID NO: 625778 - RNA, 16 nt, Escherichia coli CFT073
auguucuuucggugca

SEQ ID NO: 625779 - RNA, 14 nt, Escherichia coli CFT073
auguugcagaugcu

SEQ ID NO: 625780 - RNA, 22 nt, Escherichia coli CFT073
auguugauaaagaagugcucuu

SEQ ID NO: 625781 - RNA, 16 nt, Escherichia coli CFT073
auguugacuucaaucu

SEQ ID NO: 625782 - RNA, 20 nt, Escherichia coli CFT073
auucauaugcgccagcugca

SEQ ID NO: 625783 - RNA, 16 nt, Escherichia coli CFT073
auucauaucuucaggc

SEQ ID NO: 625784 - RNA, 14 nt, Escherichia coli CFT073
auucauauuuuuuc

SEQ ID NO: 625785 - RNA, 15 nt, Escherichia coli CFT073
auucaucaaaaugaa

SEQ ID NO: 625786 - RNA, 13 nt, Escherichia coli CFT073
auucaucaaaugg

SEQ ID NO: 625787 - RNA, 17 nt, Escherichia coli CFT073
auucauccaguagaaua

SEQ ID NO: 625788 - RNA, 13 nt, Escherichia coli CFT073
auucauccggcaa

SEQ ID NO: 625789 - RNA, 16 nt, Escherichia coli CFT073
auucaucgccuucuug

SEQ ID NO: 625790 - RNA, 12 nt, Escherichia coli CFT073
auucaucacaaa

SEQ ID NO: 625791 - RNA, 15 nt, Escherichia coli CFT073
auucaucacaaaaua

SEQ ID NO: 625792 - RNA, 17 nt, Escherichia coli CFT073
auucaucacaaaauaga

SEQ ID NO: 625793 - RNA, 12 nt, Escherichia coli CFT073
auucaucaauuc

SEQ ID NO: 625794 - RNA, 23 nt, Escherichia coli CFT073
auucaucuuucaucuguuuucaa

SEQ ID NO: 625795 - RNA, 21 nt, Escherichia coli CFT073
auucaucguaaucucuuucca

SEQ ID NO: 625796 - RNA, 18 nt, Escherichia coli CFT073
auucauggcauuuucucg

SEQ ID NO: 625797 - RNA, 22 nt, Escherichia coli CFT073
auucaugcccugcccgcugcca

SEQ ID NO: 625798 - RNA, 12 nt, Escherichia coli CFT073
auucauguucgg

SEQ ID NO: 625799 - RNA, 22 nt, Escherichia coli CFT073
auucaugucgguuacuauccug

SEQ ID NO: 625800 - RNA, 24 nt, Escherichia coli CFT073
auuggcauccgugguggcagccag

SEQ ID NO: 625801 - RNA, 11 nt, Escherichia coli CFT073
auugcugccag

SEQ ID NO: 625802 - RNA, 14 nt, Escherichia coli CFT073
auugcugcaccagc

SEQ ID NO: 625803 - RNA, 17 nt, Escherichia coli CFT073
auugcugaugcaccuuc

SEQ ID NO: 625804 - RNA, 21 nt, Escherichia coli CFT073
auugcugaugcaccuucaacu

SEQ ID NO: 625805 - RNA, 15 nt, Escherichia coli CFT073
auugcuuuuuugauu

SEQ ID NO: 625806 - RNA, 22 nt, Escherichia coli CFT073
auugcgggcgagauuuuacuuu

SEQ ID NO: 625807 - RNA, 18 nt, Escherichia coli CFT073
auugcguaaagccugcug

SEQ ID NO: 625808 - RNA, 15 nt, Escherichia coli CFT073
auugcguaaaucuuc

SEQ ID NO: 625809 - RNA, 15 nt, Escherichia coli CFT073
auugcguaacgugac

SEQ ID NO: 625810 - RNA, 16 nt, Escherichia coli CFT073
auugcguaaucuuuuc

SEQ ID NO: 625811 - RNA, 16 nt, Escherichia coli CFT073
auugcggcaucauaaa

SEQ ID NO: 625812 - RNA, 14 nt, Escherichia coli CFT073
auugccagaaacca

SEQ ID NO: 625813 - RNA, 18 nt, Escherichia coli CFT073
auugccauaaaaacgaua

SEQ ID NO: 625814 - RNA, 22 nt, Escherichia coli CFT073
auugccauacgccggaugggua

SEQ ID NO: 625815 - RNA, 22 nt, Escherichia coli CFT073
auugcauuugaacuggaaaaac

SEQ ID NO: 625816 - RNA, 15 nt, Escherichia coli CFT073
auugaucucacaauc

SEQ ID NO: 625817 - RNA, 17 nt, Escherichia coli CFT073
auugaucucacaaucau

SEQ ID NO: 625818 - RNA, 22 nt, Escherichia coli CFT073
auugaucccggcuuccugcagc

SEQ ID NO: 625819 - RNA, 20 nt, Escherichia coli CFT073
auugauagauuucucuaaaa

SEQ ID NO: 625820 - RNA, 23 nt, Escherichia coli CFT073
auugauagauuucucuaaaaacu

SEQ ID NO: 625821 - RNA, 17 nt, Escherichia coli CFT073
auugauaaacaaaaguc

SEQ ID NO: 625822 - RNA, 14 nt, Escherichia coli CFT073
auugaauuuucaau

SEQ ID NO: 625823 - RNA, 21 nt, Escherichia coli CFT073
auugaauguugacgcuaugug

SEQ ID NO: 625824 - RNA, 17 nt, Escherichia coli CFT073
auugaugugcuucagcu

SEQ ID NO: 625825 - RNA, 21 nt, Escherichia coli CFT073
auugaugcugccaucaucuuc

SEQ ID NO: 625826 - RNA, 16 nt, Escherichia coli CFT073
auugaugagaacauca

SEQ ID NO: 625827 - RNA, 18 nt, Escherichia coli CFT073
auugcagggugcaagagu

SEQ ID NO: 625828 - RNA, 17 nt, Escherichia coli CFT073
auugcagauaccacauc

SEQ ID NO: 625829 - RNA, 13 nt, Escherichia coli CFT073
auugcagcucugu

SEQ ID NO: 625830 - RNA, 17 nt, Escherichia coli CFT073
auugauuguuuuaaaua

SEQ ID NO: 625831 - RNA, 19 nt, Escherichia coli CFT073
auugauuguuuuaaauauu

SEQ ID NO: 625832 - RNA, 22 nt, Escherichia coli CFT073
auugauuguuuuaaauauuguu

SEQ ID NO: 625833 - RNA, 19 nt, Escherichia coli CFT073
auucguccauugaagacaa

SEQ ID NO: 625834 - RNA, 12 nt, Escherichia coli CFT073
auucuccagcau

SEQ ID NO: 625835 - RNA, 24 nt, Escherichia coli CFT073
auucuacuuugcgagucugcucca

SEQ ID NO: 625836 - RNA, 22 nt, Escherichia coli CFT073
auucuacgaacugagacugucu

SEQ ID NO: 625837 - RNA, 19 nt, Escherichia coli CFT073
auucucaccuacagccaca

SEQ ID NO: 625838 - RNA, 15 nt, Escherichia coli CFT073
auugaaauuugcaua

SEQ ID NO: 625839 - RNA, 17 nt, Escherichia coli CFT073
auucugcgcugacucua

SEQ ID NO: 625840 - RNA, 16 nt, Escherichia coli CFT073
auucugcggccauuuu

SEQ ID NO: 625841 - RNA, 15 nt, Escherichia coli CFT073
auucugcggcuucag

SEQ ID NO: 625842 - RNA, 14 nt, Escherichia coli CFT073
auucuucgcuggau

SEQ ID NO: 625843 - RNA, 15 nt, Escherichia coli CFT073
auucuucugaauauc

SEQ ID NO: 625844 - RNA, 17 nt, Escherichia coli CFT073
auuuguaggccugauaa

SEQ ID NO: 625845 - RNA, 20 nt, Escherichia coli CFT073
auuugcuuguuucauuacuc

SEQ ID NO: 625846 - RNA, 15 nt, Escherichia coli CFT073
auuugagcauagugc

SEQ ID NO: 625847 - RNA, 18 nt, Escherichia coli CFT073
auuugaggaagcugcccu

SEQ ID NO: 625848 - RNA, 12 nt, Escherichia coli CFT073
auuugcaccacu

SEQ ID NO: 625849 - RNA, 20 nt, Escherichia coli CFT073
auuugcaucacuccagucca

SEQ ID NO: 625850 - RNA, 20 nt, Escherichia coli CFT073
auuugcccaucaggccaggc

SEQ ID NO: 625851 - RNA, 20 nt, Escherichia coli CFT073
auuugcugguggcauuuuua

SEQ ID NO: 625852 - RNA, 19 nt, Escherichia coli CFT073
auuucguauacugcagcgg

SEQ ID NO: 625853 - RNA, 14 nt, Escherichia coli CFT073
auuucguccagcga

SEQ ID NO: 625854 - RNA, 20 nt, Escherichia coli CFT073
auuucguccauguuggagau

SEQ ID NO: 625855 - RNA, 19 nt, Escherichia coli CFT073
auuucucuggagaaauaua

SEQ ID NO: 625856 - RNA, 21 nt, Escherichia coli CFT073
auuucugacgaugguguuuau

SEQ ID NO: 625857 - RNA, 12 nt, Escherichia coli CFT073
auuucuaucauc

SEQ ID NO: 625858 - RNA, 13 nt, Escherichia coli CFT073
auuucuaucauca

SEQ ID NO: 625859 - RNA, 14 nt, Escherichia coli CFT073
auuucuaucaucau

SEQ ID NO: 625860 - RNA, 17 nt, Escherichia coli CFT073
auuucuaucaucauauc

SEQ ID NO: 625861 - RNA, 16 nt, Escherichia coli CFT073
auuucugcuucguuaa

SEQ ID NO: 625862 - RNA, 14 nt, Escherichia coli CFT073
auuucugcugccua

SEQ ID NO: 625863 - RNA, 20 nt, Escherichia coli CFT073
auuucugugcagccaaaaau

SEQ ID NO: 625864 - RNA, 16 nt, Escherichia coli CFT073
auuucuuuaucaccaa

SEQ ID NO: 625865 - RNA, 18 nt, Escherichia coli CFT073
auuucuuuauugauaaac

SEQ ID NO: 625866 - RNA, 22 nt, Escherichia coli CFT073
auuucuuucgcacugguuugca

SEQ ID NO: 625867 - RNA, 23 nt, Escherichia coli CFT073
auuucuuucgcacugguuugcag

SEQ ID NO: 625868 - RNA, 16 nt, Escherichia coli CFT073
auuucuuuucauaauc

SEQ ID NO: 625869 - RNA, 15 nt, Escherichia coli CFT073
auuucuuugcgcucu

SEQ ID NO: 625870 - RNA, 22 nt, Escherichia coli CFT073
auuuugggacagugcaggaugc

SEQ ID NO: 625871 - RNA, 16 nt, Escherichia coli CFT073
auuuugcuggaaaagu

SEQ ID NO: 625872 - RNA, 20 nt, Escherichia coli CFT073
auuuugcagucccaucuucu

SEQ ID NO: 625873 - RNA, 14 nt, Escherichia coli CFT073
auuuugccagccgc

SEQ ID NO: 625874 - RNA, 14 nt, Escherichia coli CFT073
auuuugcagcauuc

SEQ ID NO: 625875 - RNA, 14 nt, Escherichia coli CFT073
auuuugaaggaaaa

SEQ ID NO: 625876 - RNA, 19 nt, Escherichia coli CFT073
auuuucuaugcugccacac

SEQ ID NO: 625877 - RNA, 14 nt, Escherichia coli CFT073
auuuuccagcucuu

SEQ ID NO: 625878 - RNA, 15 nt, Escherichia coli CFT073
auuuuccccacaauc

SEQ ID NO: 625879 - RNA, 23 nt, Escherichia coli CFT073
auuuuccagauucuccaccugcg

SEQ ID NO: 625880 - RNA, 21 nt, Escherichia coli CFT073
auuuuauccauauuuuuugaa

SEQ ID NO: 625881 - RNA, 23 nt, Escherichia coli CFT073
auuuuauccauauuuuuugaaaa

SEQ ID NO: 625882 - RNA, 14 nt, Escherichia coli CFT073
auuuuaguuuacau

SEQ ID NO: 625883 - RNA, 17 nt, Escherichia coli CFT073
auuuuaccauauaaaca

SEQ ID NO: 625884 - RNA, 19 nt, Escherichia coli CFT073
auuuuaccauauaaacaua

SEQ ID NO: 625885 - RNA, 21 nt, Escherichia coli CFT073
auuuuacccgugcaucccaga

SEQ ID NO: 625886 - RNA, 15 nt, Escherichia coli CFT073
auuucgccaucaaga

SEQ ID NO: 625887 - RNA, 12 nt, Escherichia coli CFT073
auuucgauauag

SEQ ID NO: 625888 - RNA, 13 nt, Escherichia coli CFT073
auuuccguuugcg

SEQ ID NO: 625889 - RNA, 22 nt, Escherichia coli CFT073
auuuccugccagaccuuaucac

SEQ ID NO: 625890 - RNA, 13 nt, Escherichia coli CFT073
auuuccucuuccc

SEQ ID NO: 625891 - RNA, 18 nt, Escherichia coli CFT073
auuuccucuucccgcuca

SEQ ID NO: 625892 - RNA, 15 nt, Escherichia coli CFT073
auuuccuucagcagc

SEQ ID NO: 625893 - RNA, 17 nt, Escherichia coli CFT073
auuuccuucgcuuuaau

SEQ ID NO: 625894 - RNA, 22 nt, Escherichia coli CFT073
auuucccaccacuauuguugaa

SEQ ID NO: 625895 - RNA, 19 nt, Escherichia coli CFT073
auuucccagcaagaaccau

SEQ ID NO: 625896 - RNA, 22 nt, Escherichia coli CFT073
auuucccagcaagaaccaugca

SEQ ID NO: 625897 - RNA, 21 nt, Escherichia coli CFT073
auuuccaucuccagcugcucg

SEQ ID NO: 625898 - RNA, 13 nt, Escherichia coli CFT073
auuuccaguuugc

SEQ ID NO: 625899 - RNA, 17 nt, Escherichia coli CFT073
auuuccaguuugcguuc

SEQ ID NO: 625900 - RNA, 10 nt, Escherichia coli CFT073
auuuccagcg

SEQ ID NO: 625901 - RNA, 18 nt, Escherichia coli CFT073
auuuccagcucaaagaua

SEQ ID NO: 625902 - RNA, 15 nt, Escherichia coli CFT073
auuuccagacgccau

SEQ ID NO: 625903 - RNA, 14 nt, Escherichia coli CFT073
auuuccagaaagug

SEQ ID NO: 625904 - RNA, 15 nt, Escherichia coli CFT073
auuuccccccggcag

SEQ ID NO: 625905 - RNA, 20 nt, Escherichia coli CFT073
auuuccccccggcagcugcc

SEQ ID NO: 625906 - RNA, 14 nt, Escherichia coli CFT073
auuuccccaauuca

SEQ ID NO: 625907 - RNA, 17 nt, Escherichia coli CFT073
auuucccgugaagacuu

SEQ ID NO: 625908 - RNA, 22 nt, Escherichia coli CFT073
auuucccgugaagacuuugccc

SEQ ID NO: 625909 - RNA, 13 nt, Escherichia coli CFT073
auuuccgcuuuca

SEQ ID NO: 625910 - RNA, 15 nt, Escherichia coli CFT073
auuuccgcagcucca

SEQ ID NO: 625911 - RNA, 15 nt, Escherichia coli CFT073
auuuccgccaaucaa

SEQ ID NO: 625912 - RNA, 15 nt, Escherichia coli CFT073
auuucaccagcgcac

SEQ ID NO: 625913 - RNA, 22 nt, Escherichia coli CFT073
auuucauaauccuguagauauu

SEQ ID NO: 625914 - RNA, 22 nt, Escherichia coli CFT073
auuucagguucugaccagccag

SEQ ID NO: 625915 - RNA, 15 nt, Escherichia coli CFT073
auuucagugcugacu

SEQ ID NO: 625916 - RNA, 13 nt, Escherichia coli CFT073
auuuccaccgcua

SEQ ID NO: 625917 - RNA, 17 nt, Escherichia coli CFT073
auuuccaccgcuauuga

SEQ ID NO: 625918 - RNA, 13 nt, Escherichia coli CFT073
auuucauuauuca

SEQ ID NO: 625919 - RNA, 21 nt, Escherichia coli CFT073
auuucauuguccgucugaaaa

SEQ ID NO: 625920 - RNA, 22 nt, Escherichia coli CFT073
auuucauauccggcauuuuuua

SEQ ID NO: 625921 - RNA, 18 nt, Escherichia coli CFT073
auuucauaugcgccagac

SEQ ID NO: 625922 - RNA, 20 nt, Escherichia coli CFT073
auuggugcuaauuugaaaug

SEQ ID NO: 625923 - RNA, 18 nt, Escherichia coli CFT073
auuggucuggauggcuug

SEQ ID NO: 625924 - RNA, 18 nt, Escherichia coli CFT073
auuggugguguguuugau

SEQ ID NO: 625925 - RNA, 16 nt, Escherichia coli CFT073
auugguacagagaaca

SEQ ID NO: 625926 - RNA, 13 nt, Escherichia coli CFT073
auuggucagagca

SEQ ID NO: 625927 - RNA, 16 nt, Escherichia coli CFT073
auuuaauguaaauauu

SEQ ID NO: 625928 - RNA, 16 nt, Escherichia coli CFT073
auuuaaguugaucgcc

SEQ ID NO: 625929 - RNA, 20 nt, Escherichia coli CFT073
auuuaccagagucuuugcuu

SEQ ID NO: 625930 - RNA, 18 nt, Escherichia coli CFT073
auuuaccagcacaucuua

SEQ ID NO: 625931 - RNA, 23 nt, Escherichia coli CFT073
auuuaccgcuacuggcaauccug

SEQ ID NO: 625932 - RNA, 13 nt, Escherichia coli CFT073
auuuacugcaugg

SEQ ID NO: 625933 - RNA, 23 nt, Escherichia coli CFT073
auuuacugcauggccagacauua

SEQ ID NO: 625934 - RNA, 17 nt, Escherichia coli CFT073
auuuagcgaauaacaaa

SEQ ID NO: 625935 - RNA, 15 nt, Escherichia coli CFT073
auuuagcaaauuuuu

SEQ ID NO: 625936 - RNA, 15 nt, Escherichia coli CFT073
auuuacuuacuucug

SEQ ID NO: 625937 - RNA, 12 nt, Escherichia coli CFT073
auuuacuuucuu

SEQ ID NO: 625938 - RNA, 15 nt, Escherichia coli CFT073
caaaggcggaaacgc

SEQ ID NO: 625939 - RNA, 14 nt, Escherichia coli CFT073
caaaggccagcaau

SEQ ID NO: 625940 - RNA, 19 nt, Escherichia coli CFT073
caaaggccagcaaucccca

SEQ ID NO: 625941 - RNA, 14 nt, Escherichia coli CFT073
caaagggagcagac

SEQ ID NO: 625942 - RNA, 16 nt, Escherichia coli CFT073
caaagggagcagacug

SEQ ID NO: 625943 - RNA, 14 nt, Escherichia coli CFT073
caaaggcacaacug

SEQ ID NO: 625944 - RNA, 20 nt, Escherichia coli CFT073
caaauaaggaaaacugggug

SEQ ID NO: 625945 - RNA, 20 nt, Escherichia coli CFT073
caaauacccaaaaaauagca

SEQ ID NO: 625946 - RNA, 19 nt, Escherichia coli CFT073
caaagggggcgacauuuag

SEQ ID NO: 625947 - RNA, 12 nt, Escherichia coli CFT073
caaauaaauacc

SEQ ID NO: 625948 - RNA, 12 nt, Escherichia coli CFT073
caaauaucugga

SEQ ID NO: 625949 - RNA, 14 nt, Escherichia coli CFT073
caaauauuucuuua

SEQ ID NO: 625950 - RNA, 17 nt, Escherichia coli CFT073
caaaucaaccaggccuu

SEQ ID NO: 625951 - RNA, 16 nt, Escherichia coli CFT073
caaaucaacuaaaauc

SEQ ID NO: 625952 - RNA, 14 nt, Escherichia coli CFT073
caaauccauuuucg

SEQ ID NO: 625953 - RNA, 19 nt, Escherichia coli CFT073
caaauccccaguugugcug

SEQ ID NO: 625954 - RNA, 12 nt, Escherichia coli CFT073
caaauccagcgc

SEQ ID NO: 625955 - RNA, 19 nt, Escherichia coli CFT073
caaacuggggcauuuuuuc

SEQ ID NO: 625956 - RNA, 19 nt, Escherichia coli CFT073
caaacugugcaaugaaaaa

SEQ ID NO: 625957 - RNA, 17 nt, Escherichia coli CFT073
caaacugugcaccgccc

SEQ ID NO: 625958 - RNA, 21 nt, Escherichia coli CFT073
caaacuugaacuuaucaucag

SEQ ID NO: 625959 - RNA, 13 nt, Escherichia coli CFT073
caaacuuccagaa

SEQ ID NO: 625960 - RNA, 15 nt, Escherichia coli CFT073
caaacuuccggcaag

SEQ ID NO: 625961 - RNA, 22 nt, Escherichia coli CFT073
caaacuuccggcaagauuugca

SEQ ID NO: 625962 - RNA, 19 nt, Escherichia coli CFT073
caaacuucucaccaucaaa

SEQ ID NO: 625963 - RNA, 19 nt, Escherichia coli CFT073
caaacugcguagaguccag

SEQ ID NO: 625964 - RNA, 18 nt, Escherichia coli CFT073
caaacugcgugugacaaa

SEQ ID NO: 625965 - RNA, 15 nt, Escherichia coli CFT073
caaacuggaauagcg

SEQ ID NO: 625966 - RNA, 20 nt, Escherichia coli CFT073
caaacuggcugaugcuggca

SEQ ID NO: 625967 - RNA, 15 nt, Escherichia coli CFT073
caaacugguugaaau

SEQ ID NO: 625968 - RNA, 18 nt, Escherichia coli CFT073
caaacugguugaaauaaa

SEQ ID NO: 625969 - RNA, 20 nt, Escherichia coli CFT073
caaacugguugaaauaaacc

SEQ ID NO: 625970 - RNA, 20 nt, Escherichia coli CFT073
caaagacgcgguaaaagccc

SEQ ID NO: 625971 - RNA, 16 nt, Escherichia coli CFT073
caaagagcaagaaccc

SEQ ID NO: 625972 - RNA, 21 nt, Escherichia coli CFT073
caaagauauucaguaccguag

SEQ ID NO: 625973 - RNA, 23 nt, Escherichia coli CFT073
caaagcgcacuuugcuggucugu

SEQ ID NO: 625974 - RNA, 21 nt, Escherichia coli CFT073
caaagcucauagcggcaacaa

SEQ ID NO: 625975 - RNA, 19 nt, Escherichia coli CFT073
caacaaaaaucucgacuuc

SEQ ID NO: 625976 - RNA, 19 nt, Escherichia coli CFT073
caacaaaaaacggaaagca

SEQ ID NO: 625977 - RNA, 21 nt, Escherichia coli CFT073
caacaaacgcaaacaccagcu

SEQ ID NO: 625978 - RNA, 19 nt, Escherichia coli CFT073
caacaaacgcugacauauu

SEQ ID NO: 625979 - RNA, 12 nt, Escherichia coli CFT073
caacaaacucau

SEQ ID NO: 625980 - RNA, 20 nt, Escherichia coli CFT073
caaauuugugcucuggcaua

SEQ ID NO: 625981 - RNA, 18 nt, Escherichia coli CFT073
caaauuuuccccagaugc

SEQ ID NO: 625982 - RNA, 15 nt, Escherichia coli CFT073
caaauucaccgccug

SEQ ID NO: 625983 - RNA, 17 nt, Escherichia coli CFT073
caaaugucaccagccgg

SEQ ID NO: 625984 - RNA, 19 nt, Escherichia coli CFT073
caaaugucagaaagaaauu

SEQ ID NO: 625985 - RNA, 16 nt, Escherichia coli CFT073
caaauguauccaucac

SEQ ID NO: 625986 - RNA, 16 nt, Escherichia coli CFT073
caaauuaaacgggcga

SEQ ID NO: 625987 - RNA, 17 nt, Escherichia coli CFT073
caaauuaaacgggcgau

SEQ ID NO: 625988 - RNA, 12 nt, Escherichia coli CFT073
caaaucuuucac

SEQ ID NO: 625989 - RNA, 22 nt, Escherichia coli CFT073
caaauccggcauacauuuauuu

SEQ ID NO: 625990 - RNA, 22 nt, Escherichia coli CFT073
caacaccgcucccggauacccc

SEQ ID NO: 625991 - RNA, 23 nt, Escherichia coli CFT073
caacaccgguacuaacagguugc

SEQ ID NO: 625992 - RNA, 19 nt, Escherichia coli CFT073
caacaccgauagaaccaaa

SEQ ID NO: 625993 - RNA, 20 nt, Escherichia coli CFT073
caacaaguucgaaccaacaa

SEQ ID NO: 625994 - RNA, 15 nt, Escherichia coli CFT073
caacaauaaaaggug

SEQ ID NO: 625995 - RNA, 14 nt, Escherichia coli CFT073
caacaauaaacugc

SEQ ID NO: 625996 - RNA, 22 nt, Escherichia coli CFT073
caacaauaaacugcgaccaggg

SEQ ID NO: 625997 - RNA, 12 nt, Escherichia coli CFT073
caacaagcaccg

SEQ ID NO: 625998 - RNA, 18 nt, Escherichia coli CFT073
caacaagcagcuugagaa

SEQ ID NO: 625999 - RNA, 21 nt, Escherichia coli CFT073
caacaagcagcuugagaaaau

SEQ ID NO: 626000 - RNA, 15 nt, Escherichia coli CFT073
caacaacuucagguu

SEQ ID NO: 626001 - RNA, 14 nt, Escherichia coli CFT073
caacaacaccagca

SEQ ID NO: 626002 - RNA, 13 nt, Escherichia coli CFT073
caacaacccugca

SEQ ID NO: 626003 - RNA, 15 nt, Escherichia coli CFT073
caacagauaaauggc

SEQ ID NO: 626004 - RNA, 21 nt, Escherichia coli CFT073
caacagauuuugcaggccuga

SEQ ID NO: 626005 - RNA, 16 nt, Escherichia coli CFT073
caacagccacucuuaa

SEQ ID NO: 626006 - RNA, 12 nt, Escherichia coli CFT073
caacagguauca

SEQ ID NO: 626007 - RNA, 19 nt, Escherichia coli CFT073
caacaguaauaaugcccau

SEQ ID NO: 626008 - RNA, 12 nt, Escherichia coli CFT073
caacagugaaau

SEQ ID NO: 626009 - RNA, 13 nt, Escherichia coli CFT073
caacaguuccagc

SEQ ID NO: 626010 - RNA, 20 nt, Escherichia coli CFT073
caacagugccgaugccgcua

SEQ ID NO: 626011 - RNA, 20 nt, Escherichia coli CFT073
caacagugcgcgguucauuc

SEQ ID NO: 626012 - RNA, 17 nt, Escherichia coli CFT073
caaacgauuaucaacac

SEQ ID NO: 626013 - RNA, 16 nt, Escherichia coli CFT073
caaacgcaaacaccag

SEQ ID NO: 626014 - RNA, 19 nt, Escherichia coli CFT073
caaacgccaacucaacgcc

SEQ ID NO: 626015 - RNA, 22 nt, Escherichia coli CFT073
caaacgccgcaugugccgggua

SEQ ID NO: 626016 - RNA, 16 nt, Escherichia coli CFT073
caaacgccggauggca

SEQ ID NO: 626017 - RNA, 18 nt, Escherichia coli CFT073
caaacgccggauggcaca

SEQ ID NO: 626018 - RNA, 22 nt, Escherichia coli CFT073
caaacgccggauggcacaugac

SEQ ID NO: 626019 - RNA, 19 nt, Escherichia coli CFT073
caaacgcugacauauuuuu

SEQ ID NO: 626020 - RNA, 18 nt, Escherichia coli CFT073
caaacgcguuaagcccag

SEQ ID NO: 626021 - RNA, 13 nt, Escherichia coli CFT073
caaacgcucccuu

SEQ ID NO: 626022 - RNA, 16 nt, Escherichia coli CFT073
caaaccgacgcugucc

SEQ ID NO: 626023 - RNA, 19 nt, Escherichia coli CFT073
caaaccugcaaugauguca

SEQ ID NO: 626024 - RNA, 19 nt, Escherichia coli CFT073
caaaccuucguuagcuaau

SEQ ID NO: 626025 - RNA, 19 nt, Escherichia coli CFT073
caaacugauuuagcaucag

SEQ ID NO: 626026 - RNA, 21 nt, Escherichia coli CFT073
caaacugccguuaacgacaaa

SEQ ID NO: 626027 - RNA, 15 nt, Escherichia coli CFT073
caaacugauauugug

SEQ ID NO: 626028 - RNA, 19 nt, Escherichia coli CFT073
caaacuccgugaagcucac

SEQ ID NO: 626029 - RNA, 22 nt, Escherichia coli CFT073
caaacucauaaaccagcggcac

SEQ ID NO: 626030 - RNA, 22 nt, Escherichia coli CFT073
caaacuccgcgaccacacucaa

SEQ ID NO: 626031 - RNA, 17 nt, Escherichia coli CFT073
caaacuaucuguguaau

SEQ ID NO: 626032 - RNA, 23 nt, Escherichia coli CFT073
caaacgucucuauuucacccacc

SEQ ID NO: 626033 - RNA, 20 nt, Escherichia coli CFT073
caaacgugacauucugacug

SEQ ID NO: 626034 - RNA, 19 nt, Escherichia coli CFT073
caaacggcagcaugauaca

SEQ ID NO: 626035 - RNA, 23 nt, Escherichia coli CFT073
caaacggcguuuuuucaucacug

SEQ ID NO: 626036 - RNA, 21 nt, Escherichia coli CFT073
caaacagggugcagcgagugc

SEQ ID NO: 626037 - RNA, 16 nt, Escherichia coli CFT073
caaacaguaacccagc

SEQ ID NO: 626038 - RNA, 23 nt, Escherichia coli CFT073
caaacagucacuuucgagcaauu

SEQ ID NO: 626039 - RNA, 17 nt, Escherichia coli CFT073
caaacagucgcccgacc

SEQ ID NO: 626040 - RNA, 23 nt, Escherichia coli CFT073
caaacaguguuuugacauuggca

SEQ ID NO: 626041 - RNA, 16 nt, Escherichia coli CFT073
caaacaguugcugaua

SEQ ID NO: 626042 - RNA, 16 nt, Escherichia coli CFT073
caaacagaaaaacgaa

SEQ ID NO: 626043 - RNA, 13 nt, Escherichia coli CFT073
caaacagcagaac

SEQ ID NO: 626044 - RNA, 22 nt, Escherichia coli CFT073
caaacacugcuuuuaaaugccc

SEQ ID NO: 626045 - RNA, 16 nt, Escherichia coli CFT073
caaacagaauauugug

SEQ ID NO: 626046 - RNA, 13 nt, Escherichia coli CFT073
caaacagaauuau

SEQ ID NO: 626047 - RNA, 21 nt, Escherichia coli CFT073
caaacagaauuaucauuuuua

SEQ ID NO: 626048 - RNA, 16 nt, Escherichia coli CFT073
caaacaccagcugaau

SEQ ID NO: 626049 - RNA, 22 nt, Escherichia coli CFT073
caaacacccgacgugcagcauc

SEQ ID NO: 626050 - RNA, 18 nt, Escherichia coli CFT073
caaacaccgaaccagaga

SEQ ID NO: 626051 - RNA, 20 nt, Escherichia coli CFT073
caaaccagccgccaacucca

SEQ ID NO: 626052 - RNA, 23 nt, Escherichia coli CFT073
caaaccagccgccaacuccacca

SEQ ID NO: 626053 - RNA, 14 nt, Escherichia coli CFT073
caaaccagacaaca

SEQ ID NO: 626054 - RNA, 23 nt, Escherichia coli CFT073
caaaccagauaauaaaaaaggca

SEQ ID NO: 626055 - RNA, 13 nt, Escherichia coli CFT073
caaaccaucacaa

SEQ ID NO: 626056 - RNA, 16 nt, Escherichia coli CFT073
caaaccagcuaauaaa

SEQ ID NO: 626057 - RNA, 16 nt, Escherichia coli CFT073
caaacccuucuucaau

SEQ ID NO: 626058 - RNA, 15 nt, Escherichia coli CFT073
caaacauccaucugc

SEQ ID NO: 626059 - RNA, 17 nt, Escherichia coli CFT073
caaacaucggcuuauuc

SEQ ID NO: 626060 - RNA, 19 nt, Escherichia coli CFT073
caaacauugcugccagaaa

SEQ ID NO: 626061 - RNA, 19 nt, Escherichia coli CFT073
caaaauggguauauuugcc

SEQ ID NO: 626062 - RNA, 11 nt, Escherichia coli CFT073
caaaauggccg

SEQ ID NO: 626063 - RNA, 19 nt, Escherichia coli CFT073
caaaaugcccgaucgagga

SEQ ID NO: 626064 - RNA, 18 nt, Escherichia coli CFT073
caaaaugccguacagcag

SEQ ID NO: 626065 - RNA, 17 nt, Escherichia coli CFT073
caaaaucuaccagcgga

SEQ ID NO: 626066 - RNA, 16 nt, Escherichia coli CFT073
caaaaucguaagcagg

SEQ ID NO: 626067 - RNA, 14 nt, Escherichia coli CFT073
caaaaucuucguua

SEQ ID NO: 626068 - RNA, 16 nt, Escherichia coli CFT073
caaaaucucacacuga

SEQ ID NO: 626069 - RNA, 16 nt, Escherichia coli CFT073
caaaauccagaaaaaa

SEQ ID NO: 626070 - RNA, 21 nt, Escherichia coli CFT073
caaaaucaugcaaauucaaua

SEQ ID NO: 626071 - RNA, 13 nt, Escherichia coli CFT073
caaaaucaucaca

SEQ ID NO: 626072 - RNA, 17 nt, Escherichia coli CFT073
caaaauccuuccagcuc

SEQ ID NO: 626073 - RNA, 19 nt, Escherichia coli CFT073
caaaauccuuccagcucca

SEQ ID NO: 626074 - RNA, 15 nt, Escherichia coli CFT073
caaaauccugccagc

SEQ ID NO: 626075 - RNA, 15 nt, Escherichia coli CFT073
caaacaaaaaaccua

SEQ ID NO: 626076 - RNA, 19 nt, Escherichia coli CFT073
caaacaacggcacuucaau

SEQ ID NO: 626077 - RNA, 15 nt, Escherichia coli CFT073
caaacaaugccagaa

SEQ ID NO: 626078 - RNA, 19 nt, Escherichia coli CFT073
caaaauuuaacauuacuaa

SEQ ID NO: 626079 - RNA, 22 nt, Escherichia coli CFT073
caaaauucuccgcggucagcgc

SEQ ID NO: 626080 - RNA, 23 nt, Escherichia coli CFT073
caaaauugccgcuaucaggccac

SEQ ID NO: 626081 - RNA, 13 nt, Escherichia coli CFT073
caaaauuccauuu

SEQ ID NO: 626082 - RNA, 16 nt, Escherichia coli CFT073
caaaauaaggcugcca

SEQ ID NO: 626083 - RNA, 18 nt, Escherichia coli CFT073
caaaauaaguaucugcua

SEQ ID NO: 626084 - RNA, 14 nt, Escherichia coli CFT073
caaaauacaggaaa

SEQ ID NO: 626085 - RNA, 20 nt, Escherichia coli CFT073
caaaauacguuuucaccucu

SEQ ID NO: 626086 - RNA, 20 nt, Escherichia coli CFT073
caaaaucaaaguuaguaaaa

SEQ ID NO: 626087 - RNA, 21 nt, Escherichia coli CFT073
caaaaucaccgaugacagaau

SEQ ID NO: 626088 - RNA, 21 nt, Escherichia coli CFT073
caaaauaucgacauucaauga

SEQ ID NO: 626089 - RNA, 19 nt, Escherichia coli CFT073
caaaauaucgauauacacc

SEQ ID NO: 626090 - RNA, 14 nt, Escherichia coli CFT073
auuuuuauuaaaua

SEQ ID NO: 626091 - RNA, 23 nt, Escherichia coli CFT073
auuuuuaugaugcacuucagggc

SEQ ID NO: 626092 - RNA, 22 nt, Escherichia coli CFT073
auuuuuaucucaaaaauuacuc

SEQ ID NO: 626093 - RNA, 13 nt, Escherichia coli CFT073
auuuuuauaacua

SEQ ID NO: 626094 - RNA, 13 nt, Escherichia coli CFT073
caaaauaaaaacg

SEQ ID NO: 626095 - RNA, 21 nt, Escherichia coli CFT073
caaguuaagcauuggcaugca

SEQ ID NO: 626096 - RNA, 12 nt, Escherichia coli CFT073
caaguguauacc

SEQ ID NO: 626097 - RNA, 19 nt, Escherichia coli CFT073
caagugccuguguuuaugc

SEQ ID NO: 626098 - RNA, 22 nt, Escherichia coli CFT073
caaguggaaauccccaucaggu

SEQ ID NO: 626099 - RNA, 18 nt, Escherichia coli CFT073
caagucuggcaggaaaua

SEQ ID NO: 626100 - RNA, 23 nt, Escherichia coli CFT073
caaggcuauccucuaaaccccaa

SEQ ID NO: 626101 - RNA, 13 nt, Escherichia coli CFT073
caaggccaauacc

SEQ ID NO: 626102 - RNA, 15 nt, Escherichia coli CFT073
caaggcugucgcaaa

SEQ ID NO: 626103 - RNA, 18 nt, Escherichia coli CFT073
caaggcuucuauggaagu

SEQ ID NO: 626104 - RNA, 16 nt, Escherichia coli CFT073
caaguaauuguuucau

SEQ ID NO: 626105 - RNA, 17 nt, Escherichia coli CFT073
caaguaaucaaucaccu

SEQ ID NO: 626106 - RNA, 19 nt, Escherichia coli CFT073
caaguaaucaaucaccucu

SEQ ID NO: 626107 - RNA, 13 nt, Escherichia coli CFT073
caaguaauaaagc

SEQ ID NO: 626108 - RNA, 22 nt, Escherichia coli CFT073
caaguaaaacagccuuguauua

SEQ ID NO: 626109 - RNA, 14 nt, Escherichia coli CFT073
caagcugguggcaa

SEQ ID NO: 626110 - RNA, 15 nt, Escherichia coli CFT073
caagcucucuucauc

SEQ ID NO: 626111 - RNA, 20 nt, Escherichia coli CFT073
caagcugaacgcaggccgcc

SEQ ID NO: 626112 - RNA, 15 nt, Escherichia coli CFT073
caaggcacaaagucg

SEQ ID NO: 626113 - RNA, 18 nt, Escherichia coli CFT073
caagauggggaauaagcu

SEQ ID NO: 626114 - RNA, 13 nt, Escherichia coli CFT073
caagauuaaaaua

SEQ ID NO: 626115 - RNA, 14 nt, Escherichia coli CFT073
caagauuaaaauau

SEQ ID NO: 626116 - RNA, 16 nt, Escherichia coli CFT073
caauaugaauuacccc

SEQ ID NO: 626117 - RNA, 17 nt, Escherichia coli CFT073
caauaugaauuaccccu

SEQ ID NO: 626118 - RNA, 20 nt, Escherichia coli CFT073
caaucacaacacgaauacca

SEQ ID NO: 626119 - RNA, 21 nt, Escherichia coli CFT073
caaucaauccggcaaucaaca

SEQ ID NO: 626120 - RNA, 14 nt, Escherichia coli CFT073
caaucacauccacc

SEQ ID NO: 626121 - RNA, 15 nt, Escherichia coli CFT073
caaucaccaaaccaa

SEQ ID NO: 626122 - RNA, 15 nt, Escherichia coli CFT073
caaucaccgccagcg

SEQ ID NO: 626123 - RNA, 19 nt, Escherichia coli CFT073
caaucaccgccagcggcgu

SEQ ID NO: 626124 - RNA, 12 nt, Escherichia coli CFT073
caauaccgucug

SEQ ID NO: 626125 - RNA, 20 nt, Escherichia coli CFT073
caauagcaaagccuuuuuag

SEQ ID NO: 626126 - RNA, 22 nt, Escherichia coli CFT073
caauauauugcauggcuugugu

SEQ ID NO: 626127 - RNA, 20 nt, Escherichia coli CFT073
caauauacaaauagaucgcc

SEQ ID NO: 626128 - RNA, 19 nt, Escherichia coli CFT073
caaguucuucgaagcacuc

SEQ ID NO: 626129 - RNA, 22 nt, Escherichia coli CFT073
caaguuagaguagccaauacca

SEQ ID NO: 626130 - RNA, 18 nt, Escherichia coli CFT073
caaguucagcgucaucaa

SEQ ID NO: 626131 - RNA, 19 nt, Escherichia coli CFT073
caaguuccguuuccagcca

SEQ ID NO: 626132 - RNA, 23 nt, Escherichia coli CFT073
caaguucgaacgccgccaguacg

SEQ ID NO: 626133 - RNA, 15 nt, Escherichia coli CFT073
caaguugauuuuucg

SEQ ID NO: 626134 - RNA, 23 nt, Escherichia coli CFT073
caaguuguaauuccugaagagaa

SEQ ID NO: 626135 - RNA, 15 nt, Escherichia coli CFT073
caauaacccccugcc

SEQ ID NO: 626136 - RNA, 16 nt, Escherichia coli CFT073
caauaacccccugccc

SEQ ID NO: 626137 - RNA, 17 nt, Escherichia coli CFT073
caauaaccggcacuuca

SEQ ID NO: 626138 - RNA, 21 nt, Escherichia coli CFT073
caauaacccguuguaaaugcu

SEQ ID NO: 626139 - RNA, 16 nt, Escherichia coli CFT073
caauaaccgucagcgc

SEQ ID NO: 626140 - RNA, 18 nt, Escherichia coli CFT073
caauaagauaacccugca

SEQ ID NO: 626141 - RNA, 18 nt, Escherichia coli CFT073
caauaaucaugcagcgca

SEQ ID NO: 626142 - RNA, 17 nt, Escherichia coli CFT073
caauacaucaauuuucc

SEQ ID NO: 626143 - RNA, 15 nt, Escherichia coli CFT073
caauaccagcaucag

SEQ ID NO: 626144 - RNA, 22 nt, Escherichia coli CFT073
caauaccagcuguuuugguaaa

SEQ ID NO: 626145 - RNA, 20 nt, Escherichia coli CFT073
caauacccguccacacggca

SEQ ID NO: 626146 - RNA, 15 nt, Escherichia coli CFT073
caauacccugaccca

SEQ ID NO: 626147 - RNA, 19 nt, Escherichia coli CFT073
caauaccgccugcaaauaa

SEQ ID NO: 626148 - RNA, 20 nt, Escherichia coli CFT073
caauaccgccugcaaauaaa

SEQ ID NO: 626149 - RNA, 16 nt, Escherichia coli CFT073
caauaccgaucaguac

SEQ ID NO: 626150 - RNA, 17 nt, Escherichia coli CFT073
caauaaucuuuacacca

SEQ ID NO: 626151 - RNA, 20 nt, Escherichia coli CFT073
caauaaucuuuacaccaacg

SEQ ID NO: 626152 - RNA, 21 nt, Escherichia coli CFT073
caauaaucuuuacaccaacgc

SEQ ID NO: 626153 - RNA, 21 nt, Escherichia coli CFT073
caagaaugauacggaaauccu

SEQ ID NO: 626154 - RNA, 16 nt, Escherichia coli CFT073
caagaauuaaaauauc

SEQ ID NO: 626155 - RNA, 20 nt, Escherichia coli CFT073
caagaccaacacccacagcc

SEQ ID NO: 626156 - RNA, 16 nt, Escherichia coli CFT073
caagacgaaaaaugaa

SEQ ID NO: 626157 - RNA, 15 nt, Escherichia coli CFT073
caagagcaaauaaaa

SEQ ID NO: 626158 - RNA, 20 nt, Escherichia coli CFT073
caagacgaauaccuucuucc

SEQ ID NO: 626159 - RNA, 23 nt, Escherichia coli CFT073
caagaggguuauuuguucagcaa

SEQ ID NO: 626160 - RNA, 19 nt, Escherichia coli CFT073
caagaguaaacaucuucuu

SEQ ID NO: 626161 - RNA, 15 nt, Escherichia coli CFT073
caagagugaacacgu

SEQ ID NO: 626162 - RNA, 20 nt, Escherichia coli CFT073
caagauaacgccuggcagug

SEQ ID NO: 626163 - RNA, 16 nt, Escherichia coli CFT073
caagauacugcauaau

SEQ ID NO: 626164 - RNA, 13 nt, Escherichia coli CFT073
caagauagaacca

SEQ ID NO: 626165 - RNA, 20 nt, Escherichia coli CFT073
caagauauuccgucuccgga

SEQ ID NO: 626166 - RNA, 18 nt, Escherichia coli CFT073
caagaucagcauccauau

SEQ ID NO: 626167 - RNA, 19 nt, Escherichia coli CFT073
caagaucagcauccauauc

SEQ ID NO: 626168 - RNA, 18 nt, Escherichia coli CFT073
caagaugcgcguaguacu

SEQ ID NO: 626169 - RNA, 14 nt, Escherichia coli CFT073
caagaaaaauacug

SEQ ID NO: 626170 - RNA, 12 nt, Escherichia coli CFT073
caacuuuuucuu

SEQ ID NO: 626171 - RNA, 16 nt, Escherichia coli CFT073
caacuuuguauucagu

SEQ ID NO: 626172 - RNA, 18 nt, Escherichia coli CFT073
caacuuuguauucaguuc

SEQ ID NO: 626173 - RNA, 21 nt, Escherichia coli CFT073
caacuuuccgcacuuucuccg

SEQ ID NO: 626174 - RNA, 13 nt, Escherichia coli CFT073
caacuuuaaaauc

SEQ ID NO: 626175 - RNA, 14 nt, Escherichia coli CFT073
caacuuuacuaaaa

SEQ ID NO: 626176 - RNA, 23 nt, Escherichia coli CFT073
caacuuuacuaaaaagugauaaa

SEQ ID NO: 626177 - RNA, 22 nt, Escherichia coli CFT073
caagaaucacuucaucgccgcu

SEQ ID NO: 626178 - RNA, 16 nt, Escherichia coli CFT073
caagaaucaugccaaa

SEQ ID NO: 626179 - RNA, 20 nt, Escherichia coli CFT073
caagaaggauauaaaaauaa

SEQ ID NO: 626180 - RNA, 21 nt, Escherichia coli CFT073
caagaaaugcauguucaguca

SEQ ID NO: 626181 - RNA, 19 nt, Escherichia coli CFT073
caagaaacgcuccaccacc

SEQ ID NO: 626182 - RNA, 14 nt, Escherichia coli CFT073
caacuccuguugca

SEQ ID NO: 626183 - RNA, 14 nt, Escherichia coli CFT073
caacucaggaacau

SEQ ID NO: 626184 - RNA, 16 nt, Escherichia coli CFT073
caacuccaccaauaau

SEQ ID NO: 626185 - RNA, 16 nt, Escherichia coli CFT073
caacuccagaauaccg

SEQ ID NO: 626186 - RNA, 23 nt, Escherichia coli CFT073
caacuccagcuuaacauccccau

SEQ ID NO: 626187 - RNA, 13 nt, Escherichia coli CFT073
caacuccgccagc

SEQ ID NO: 626188 - RNA, 19 nt, Escherichia coli CFT073
caacuccgccagcaacuga

SEQ ID NO: 626189 - RNA, 20 nt, Escherichia coli CFT073
caacguuuuaagcaaauaau

SEQ ID NO: 626190 - RNA, 23 nt, Escherichia coli CFT073
caacgugcgauuuguucaugccc

SEQ ID NO: 626191 - RNA, 23 nt, Escherichia coli CFT073
caacguguauaucaccaguaacu

SEQ ID NO: 626192 - RNA, 16 nt, Escherichia coli CFT073
caacguuaccaagaaa

SEQ ID NO: 626193 - RNA, 18 nt, Escherichia coli CFT073
caacguugccaguaccau

SEQ ID NO: 626194 - RNA, 15 nt, Escherichia coli CFT073
caacgggcugaagaa

SEQ ID NO: 626195 - RNA, 15 nt, Escherichia coli CFT073
caacggugcuuuaau

SEQ ID NO: 626196 - RNA, 17 nt, Escherichia coli CFT073
caacggucagcgcacca

SEQ ID NO: 626197 - RNA, 19 nt, Escherichia coli CFT073
caacgguuuucaagacgcc

SEQ ID NO: 626198 - RNA, 16 nt, Escherichia coli CFT073
caacggcuucgccaaa

SEQ ID NO: 626199 - RNA, 23 nt, Escherichia coli CFT073
caacgccuaaacugaucgacagu

SEQ ID NO: 626200 - RNA, 18 nt, Escherichia coli CFT073
caacgcaucgcugcgcuu

SEQ ID NO: 626201 - RNA, 15 nt, Escherichia coli CFT073
caacgcacccgcgcc

SEQ ID NO: 626202 - RNA, 15 nt, Escherichia coli CFT073
caacgcaucuuuuuc

SEQ ID NO: 626203 - RNA, 22 nt, Escherichia coli CFT073
caacgccugaugcgacgcuugc

SEQ ID NO: 626204 - RNA, 18 nt, Escherichia coli CFT073
caacgccuuuaccaccag

SEQ ID NO: 626205 - RNA, 13 nt, Escherichia coli CFT073
caacgcaaagaga

SEQ ID NO: 626206 - RNA, 18 nt, Escherichia coli CFT073
caacgcaaagagagaagc

SEQ ID NO: 626207 - RNA, 20 nt, Escherichia coli CFT073
caacgcaaagagagaagcca

SEQ ID NO: 626208 - RNA, 15 nt, Escherichia coli CFT073
caacgcaacgcgcuu

SEQ ID NO: 626209 - RNA, 20 nt, Escherichia coli CFT073
caacgcaauauccgccacuu

SEQ ID NO: 626210 - RNA, 15 nt, Escherichia coli CFT073
caacgauauccauau

SEQ ID NO: 626211 - RNA, 16 nt, Escherichia coli CFT073
caacgaugggugauca

SEQ ID NO: 626212 - RNA, 21 nt, Escherichia coli CFT073
caacgagacucaauggcaucc

SEQ ID NO: 626213 - RNA, 19 nt, Escherichia coli CFT073
caacgauaacaaucaccaa

SEQ ID NO: 626214 - RNA, 14 nt, Escherichia coli CFT073
caacgauaauccag

SEQ ID NO: 626215 - RNA, 16 nt, Escherichia coli CFT073
caacgauaauccagca

SEQ ID NO: 626216 - RNA, 14 nt, Escherichia coli CFT073
caacgaacguuccc

SEQ ID NO: 626217 - RNA, 14 nt, Escherichia coli CFT073
caacgaaucacugg

SEQ ID NO: 626218 - RNA, 15 nt, Escherichia coli CFT073
caacgaaucacuggu

SEQ ID NO: 626219 - RNA, 18 nt, Escherichia coli CFT073
caacgacguaccaacuga

SEQ ID NO: 626220 - RNA, 15 nt, Escherichia coli CFT073
caacgacuacgccag

SEQ ID NO: 626221 - RNA, 16 nt, Escherichia coli CFT073
caacgacuacgccaga

SEQ ID NO: 626222 - RNA, 18 nt, Escherichia coli CFT073
caacgacuggggcuggaa

SEQ ID NO: 626223 - RNA, 15 nt, Escherichia coli CFT073
caacaucucaauauc

SEQ ID NO: 626224 - RNA, 17 nt, Escherichia coli CFT073
caaccugcacugacagg

SEQ ID NO: 626225 - RNA, 11 nt, Escherichia coli CFT073
caacaucaccg

SEQ ID NO: 626226 - RNA, 17 nt, Escherichia coli CFT073
caacaucacgcugacgc

SEQ ID NO: 626227 - RNA, 17 nt, Escherichia coli CFT073
caacaucacaccauauc

SEQ ID NO: 626228 - RNA, 21 nt, Escherichia coli CFT073
caacaucaaaucacagcaccu

SEQ ID NO: 626229 - RNA, 22 nt, Escherichia coli CFT073
caacauaguuauuauucauaaa

SEQ ID NO: 626230 - RNA, 19 nt, Escherichia coli CFT073
caacauauaucgaaaaauc

SEQ ID NO: 626231 - RNA, 21 nt, Escherichia coli CFT073
cacucaacuuauugaucaucc

SEQ ID NO: 626232 - RNA, 15 nt, Escherichia coli CFT073
cacucacgccaggca

SEQ ID NO: 626233 - RNA, 18 nt, Escherichia coli CFT073
cacucacgacacauaaau

SEQ ID NO: 626234 - RNA, 19 nt, Escherichia coli CFT073
cacucacgacacauaaaua

SEQ ID NO: 626235 - RNA, 18 nt, Escherichia coli CFT073
cacuccacugcgcauaau

SEQ ID NO: 626236 - RNA, 19 nt, Escherichia coli CFT073
cacuccaguccacccccau

SEQ ID NO: 626237 - RNA, 14 nt, Escherichia coli CFT073
cacucaugccuuuc

SEQ ID NO: 626238 - RNA, 23 nt, Escherichia coli CFT073
cacucagguaacagggaacuuau

SEQ ID NO: 626239 - RNA, 14 nt, Escherichia coli CFT073
cacucaucaagcau

SEQ ID NO: 626240 - RNA, 17 nt, Escherichia coli CFT073
cacucaucaagcauuuu

SEQ ID NO: 626241 - RNA, 16 nt, Escherichia coli CFT073
cacucaucacuccccg

SEQ ID NO: 626242 - RNA, 19 nt, Escherichia coli CFT073
cacuaccgugucugccaua

SEQ ID NO: 626243 - RNA, 22 nt, Escherichia coli CFT073
cacuaccguuuuacucaaaaug

SEQ ID NO: 626244 - RNA, 19 nt, Escherichia coli CFT073
cacuaccgccgagcacaaa

SEQ ID NO: 626245 - RNA, 21 nt, Escherichia coli CFT073
cacuaccugauucgcaccacg

SEQ ID NO: 626246 - RNA, 19 nt, Escherichia coli CFT073
cacuacgcuguagccgcca

SEQ ID NO: 626247 - RNA, 18 nt, Escherichia coli CFT073
cacuaucgccaucaggca

SEQ ID NO: 626248 - RNA, 15 nt, Escherichia coli CFT073
cacuauaucucaauc

SEQ ID NO: 626249 - RNA, 23 nt, Escherichia coli CFT073
cacuauaucucaaucaaaagaac

SEQ ID NO: 626250 - RNA, 20 nt, Escherichia coli CFT073
cacuagucccuccgcacaaa

SEQ ID NO: 626251 - RNA, 14 nt, Escherichia coli CFT073
cacucuuggcaccg

SEQ ID NO: 626252 - RNA, 16 nt, Escherichia coli CFT073
cacucuuggcaccgcc

SEQ ID NO: 626253 - RNA, 14 nt, Escherichia coli CFT073
cacucuuaaagcua

SEQ ID NO: 626254 - RNA, 14 nt, Escherichia coli CFT073
cacugaaaaucacc

SEQ ID NO: 626255 - RNA, 17 nt, Escherichia coli CFT073
cacugaaaaucaccuca

SEQ ID NO: 626256 - RNA, 19 nt, Escherichia coli CFT073
cacucucugucguuaucag

SEQ ID NO: 626257 - RNA, 16 nt, Escherichia coli CFT073
cacucugccaggcagc

SEQ ID NO: 626258 - RNA, 17 nt, Escherichia coli CFT073
cacucugaaaacgcugu

SEQ ID NO: 626259 - RNA, 21 nt, Escherichia coli CFT073
cacugaauaccguaaaacuca

SEQ ID NO: 626260 - RNA, 19 nt, Escherichia coli CFT073
cacugacaggccgugcagu

SEQ ID NO: 626261 - RNA, 14 nt, Escherichia coli CFT073
cacugacauacagc

SEQ ID NO: 626262 - RNA, 18 nt, Escherichia coli CFT073
cacugacaucacgccacu

SEQ ID NO: 626263 - RNA, 17 nt, Escherichia coli CFT073
cacugaccgcccggccc

SEQ ID NO: 626264 - RNA, 21 nt, Escherichia coli CFT073
cacugaccaccaccaccugca

SEQ ID NO: 626265 - RNA, 15 nt, Escherichia coli CFT073
cacugagcccgcuuc

SEQ ID NO: 626266 - RNA, 21 nt, Escherichia coli CFT073
cacugacgcgcuuuucaccga

SEQ ID NO: 626267 - RNA, 18 nt, Escherichia coli CFT073
cacugacgcgucuuaucu

SEQ ID NO: 626268 - RNA, 20 nt, Escherichia coli CFT073
cacugacgcgucuuaucugg

SEQ ID NO: 626269 - RNA, 16 nt, Escherichia coli CFT073
cacugacgggaaacuc

SEQ ID NO: 626270 - RNA, 15 nt, Escherichia coli CFT073
cacucuauccagccu

SEQ ID NO: 626271 - RNA, 20 nt, Escherichia coli CFT073
cacucgcaugguagaacagu

SEQ ID NO: 626272 - RNA, 19 nt, Escherichia coli CFT073
cacucggggcuuuucucua

SEQ ID NO: 626273 - RNA, 16 nt, Escherichia coli CFT073
cacucccugccccguc

SEQ ID NO: 626274 - RNA, 16 nt, Escherichia coli CFT073
cacuccccgcaacagu

SEQ ID NO: 626275 - RNA, 17 nt, Escherichia coli CFT073
cacuccccgcaacagug

SEQ ID NO: 626276 - RNA, 20 nt, Escherichia coli CFT073
cacucccuuucugccacgcc

SEQ ID NO: 626277 - RNA, 17 nt, Escherichia coli CFT073
cacuccgucaugucucu

SEQ ID NO: 626278 - RNA, 14 nt, Escherichia coli CFT073
cacuccucgcgcgu

SEQ ID NO: 626279 - RNA, 21 nt, Escherichia coli CFT073
cacucgaagauacggauucuu

SEQ ID NO: 626280 - RNA, 21 nt, Escherichia coli CFT073
cacguaucaacaucacaccau

SEQ ID NO: 626281 - RNA, 15 nt, Escherichia coli CFT073
cacgucaucagcaau

SEQ ID NO: 626282 - RNA, 13 nt, Escherichia coli CFT073
cacguaagcugga

SEQ ID NO: 626283 - RNA, 15 nt, Escherichia coli CFT073
cacguaccagaugca

SEQ ID NO: 626284 - RNA, 19 nt, Escherichia coli CFT073
cacguaaguacugauugac

SEQ ID NO: 626285 - RNA, 19 nt, Escherichia coli CFT073
cacguaauaaaaucuauua

SEQ ID NO: 626286 - RNA, 18 nt, Escherichia coli CFT073
cacguaacgaguuaccgu

SEQ ID NO: 626287 - RNA, 18 nt, Escherichia coli CFT073
cacgguuucaaagaaacg

SEQ ID NO: 626288 - RNA, 21 nt, Escherichia coli CFT073
cacgguuucuacaagcagaga

SEQ ID NO: 626289 - RNA, 22 nt, Escherichia coli CFT073
cacgguuugagagucauccaug

SEQ ID NO: 626290 - RNA, 18 nt, Escherichia coli CFT073
cacggguggucuucauag

SEQ ID NO: 626291 - RNA, 14 nt, Escherichia coli CFT073
cacgggacgcugca

SEQ ID NO: 626292 - RNA, 21 nt, Escherichia coli CFT073
cacgguggcuggcgcggcgca

SEQ ID NO: 626293 - RNA, 18 nt, Escherichia coli CFT073
cacuaaggguaaaacgac

SEQ ID NO: 626294 - RNA, 17 nt, Escherichia coli CFT073
cacuacaaauuuagccc

SEQ ID NO: 626295 - RNA, 12 nt, Escherichia coli CFT073
cacuacaacaac

SEQ ID NO: 626296 - RNA, 15 nt, Escherichia coli CFT073
cacuaauugcagcga

SEQ ID NO: 626297 - RNA, 18 nt, Escherichia coli CFT073
cacuaccccaauaauucu

SEQ ID NO: 626298 - RNA, 21 nt, Escherichia coli CFT073
cacuaccggaaccaaccgcaa

SEQ ID NO: 626299 - RNA, 20 nt, Escherichia coli CFT073
cacuaccagugccagaacag

SEQ ID NO: 626300 - RNA, 12 nt, Escherichia coli CFT073
cacuacacccca

SEQ ID NO: 626301 - RNA, 23 nt, Escherichia coli CFT073
cacuacagcgaaauacaaguccc

SEQ ID NO: 626302 - RNA, 20 nt, Escherichia coli CFT073
cacuaacaugacaccaagca

SEQ ID NO: 626303 - RNA, 16 nt, Escherichia coli CFT073
cacguuuaacacgcuc

SEQ ID NO: 626304 - RNA, 15 nt, Escherichia coli CFT073
cacguuuuucaucca

SEQ ID NO: 626305 - RNA, 21 nt, Escherichia coli CFT073
cacguucaaagcggugaucaa

SEQ ID NO: 626306 - RNA, 23 nt, Escherichia coli CFT073
cacguuccuggaaccagugaaua

SEQ ID NO: 626307 - RNA, 11 nt, Escherichia coli CFT073
cacgucugaag

SEQ ID NO: 626308 - RNA, 12 nt, Escherichia coli CFT073
cacgucugccac

SEQ ID NO: 626309 - RNA, 19 nt, Escherichia coli CFT073
cacgcucacucaucacucc

SEQ ID NO: 626310 - RNA, 13 nt, Escherichia coli CFT073
cacgcucagcaau

SEQ ID NO: 626311 - RNA, 14 nt, Escherichia coli CFT073
cacgcucagcaauc

SEQ ID NO: 626312 - RNA, 22 nt, Escherichia coli CFT073
cacgcugcaaggcaacgcagcc

SEQ ID NO: 626313 - RNA, 17 nt, Escherichia coli CFT073
cacgcucuguucugcgc

SEQ ID NO: 626314 - RNA, 17 nt, Escherichia coli CFT073
cacgcucuggaugaaau

SEQ ID NO: 626315 - RNA, 14 nt, Escherichia coli CFT073
cacgcucuguucug

SEQ ID NO: 626316 - RNA, 21 nt, Escherichia coli CFT073
cacgcuggacgccgaugcgcu

SEQ ID NO: 626317 - RNA, 16 nt, Escherichia coli CFT073
cacgcgacauuuuuau

SEQ ID NO: 626318 - RNA, 18 nt, Escherichia coli CFT073
cacgccuucuuccagcgc

SEQ ID NO: 626319 - RNA, 13 nt, Escherichia coli CFT073
cacgccuuguucu

SEQ ID NO: 626320 - RNA, 19 nt, Escherichia coli CFT073
cacgcgccugcagcggcca

SEQ ID NO: 626321 - RNA, 19 nt, Escherichia coli CFT073
cacgcgguauggucacuga

SEQ ID NO: 626322 - RNA, 14 nt, Escherichia coli CFT073
cacgcggaucgcca

SEQ ID NO: 626323 - RNA, 23 nt, Escherichia coli CFT073
cacgcgcuguaauuucacaccau

SEQ ID NO: 626324 - RNA, 18 nt, Escherichia coli CFT073
cacggaauaaaccguggc

SEQ ID NO: 626325 - RNA, 15 nt, Escherichia coli CFT073
cacgcuucacugccg

SEQ ID NO: 626326 - RNA, 14 nt, Escherichia coli CFT073
cacggcaacgccgu

SEQ ID NO: 626327 - RNA, 21 nt, Escherichia coli CFT073
cacggauauauccguggcuuu

SEQ ID NO: 626328 - RNA, 21 nt, Escherichia coli CFT073
cacggcaggaucugcgcggca

SEQ ID NO: 626329 - RNA, 23 nt, Escherichia coli CFT073
cacggcuucugacauagccacuc

SEQ ID NO: 626330 - RNA, 17 nt, Escherichia coli CFT073
cacggcuuugaucagcg

SEQ ID NO: 626331 - RNA, 18 nt, Escherichia coli CFT073
cacggcuaccguugcggc

SEQ ID NO: 626332 - RNA, 15 nt, Escherichia coli CFT073
cacggcuccagcaau

SEQ ID NO: 626333 - RNA, 21 nt, Escherichia coli CFT073
cacggcgcauuugcggcagag

SEQ ID NO: 626334 - RNA, 17 nt, Escherichia coli CFT073
cacggccauauccagcc

SEQ ID NO: 626335 - RNA, 20 nt, Escherichia coli CFT073
cacggccauauccagccaac

SEQ ID NO: 626336 - RNA, 15 nt, Escherichia coli CFT073
cacgcauugccgcca

SEQ ID NO: 626337 - RNA, 14 nt, Escherichia coli CFT073
cacgcauuugcagc

SEQ ID NO: 626338 - RNA, 21 nt, Escherichia coli CFT073
cacgcagugucagcaccagag

SEQ ID NO: 626339 - RNA, 14 nt, Escherichia coli CFT073
cacgcaucugcugu

SEQ ID NO: 626340 - RNA, 13 nt, Escherichia coli CFT073
cacgccaacaaau

SEQ ID NO: 626341 - RNA, 14 nt, Escherichia coli CFT073
cacgccaaccaccg

SEQ ID NO: 626342 - RNA, 18 nt, Escherichia coli CFT073
cacgccaaccaccggaau

SEQ ID NO: 626343 - RNA, 21 nt, Escherichia coli CFT073
cacgccaauguguuuauaagc

SEQ ID NO: 626344 - RNA, 23 nt, Escherichia coli CFT073
cacgccacucacuaccagugcca

SEQ ID NO: 626345 - RNA, 20 nt, Escherichia coli CFT073
cacgccagugcgccccaggu

SEQ ID NO: 626346 - RNA, 14 nt, Escherichia coli CFT073
cacgcccagcgacc

SEQ ID NO: 626347 - RNA, 16 nt, Escherichia coli CFT073
cacgccgcaucaggca

SEQ ID NO: 626348 - RNA, 15 nt, Escherichia coli CFT073
cacgccgaagugcgc

SEQ ID NO: 626349 - RNA, 14 nt, Escherichia coli CFT073
cacgccgaccagac

SEQ ID NO: 626350 - RNA, 17 nt, Escherichia coli CFT073
cacgccgcauccggcca

SEQ ID NO: 626351 - RNA, 17 nt, Escherichia coli CFT073
cacgccgucacgaccca

SEQ ID NO: 626352 - RNA, 18 nt, Escherichia coli CFT073
cacgccgguucccagacc

SEQ ID NO: 626353 - RNA, 18 nt, Escherichia coli CFT073
cacgauauucuguaccaa

SEQ ID NO: 626354 - RNA, 20 nt, Escherichia coli CFT073
  misc_feature (9)..(9): n is a, c, g or u
cacgauaangcuugcgcauc

SEQ ID NO: 626355 - RNA, 23 nt, Escherichia coli CFT073
cacgauacgguuauccugcaaau

SEQ ID NO: 626356 - RNA, 19 nt, Escherichia coli CFT073
cacgaucgaugugauaaau

SEQ ID NO: 626357 - RNA, 12 nt, Escherichia coli CFT073
cacgaugcacag

SEQ ID NO: 626358 - RNA, 18 nt, Escherichia coli CFT073
cacgaugccauucaguuu

SEQ ID NO: 626359 - RNA, 18 nt, Escherichia coli CFT073
cacgaucugacauuugca

SEQ ID NO: 626360 - RNA, 13 nt, Escherichia coli CFT073
cacgaucuucacg

SEQ ID NO: 626361 - RNA, 20 nt, Escherichia coli CFT073
cacgauuugcguaaaaccug

SEQ ID NO: 626362 - RNA, 21 nt, Escherichia coli CFT073
cacgauuugcguaaaaccugc

SEQ ID NO: 626363 - RNA, 17 nt, Escherichia coli CFT073
cacgcaaaccaccuggc

SEQ ID NO: 626364 - RNA, 15 nt, Escherichia coli CFT073
cacgcacagcccgcc

SEQ ID NO: 626365 - RNA, 20 nt, Escherichia coli CFT073
cacgcaacccgcucaacagc

SEQ ID NO: 626366 - RNA, 21 nt, Escherichia coli CFT073
cacgcaggcaucuuuuucaau

SEQ ID NO: 626367 - RNA, 14 nt, Escherichia coli CFT073
cacgcagucagcac

SEQ ID NO: 626368 - RNA, 12 nt, Escherichia coli CFT073
cacgcagcucac

SEQ ID NO: 626369 - RNA, 24 nt, Escherichia coli CFT073
cacgcagcuucucgugaaauucac

SEQ ID NO: 626370 - RNA, 13 nt, Escherichia coli CFT073
cacgcaccauccc

SEQ ID NO: 626371 - RNA, 14 nt, Escherichia coli CFT073
cacgcagacaauaa

SEQ ID NO: 626372 - RNA, 18 nt, Escherichia coli CFT073
cacgcacugacugacaga

SEQ ID NO: 626373 - RNA, 21 nt, Escherichia coli CFT073
cacgcacugacugacagacug

SEQ ID NO: 626374 - RNA, 15 nt, Escherichia coli CFT073
cacgcacugcaauau

SEQ ID NO: 626375 - RNA, 12 nt, Escherichia coli CFT073
cacgcagaccaa

SEQ ID NO: 626376 - RNA, 16 nt, Escherichia coli CFT073
cacgcagaccaaccgu

SEQ ID NO: 626377 - RNA, 16 nt, Escherichia coli CFT073
caccggcaucaacggg

SEQ ID NO: 626378 - RNA, 23 nt, Escherichia coli CFT073
caccggaacaacccagcggauga

SEQ ID NO: 626379 - RNA, 21 nt, Escherichia coli CFT073
caccggaauaauaaugucucu

SEQ ID NO: 626380 - RNA, 22 nt, Escherichia coli CFT073
caccggaauaauaaugucucug

SEQ ID NO: 626381 - RNA, 18 nt, Escherichia coli CFT073
caccggaauggucaccac

SEQ ID NO: 626382 - RNA, 22 nt, Escherichia coli CFT073
caccggaauggucaccacaaau

SEQ ID NO: 626383 - RNA, 20 nt, Escherichia coli CFT073
caccgcguuuagcaguucau

SEQ ID NO: 626384 - RNA, 23 nt, Escherichia coli CFT073
caccgcguuuagcaguucaucaa

SEQ ID NO: 626385 - RNA, 23 nt, Escherichia coli CFT073
caccgcuacguucgcgaggagcg

SEQ ID NO: 626386 - RNA, 20 nt, Escherichia coli CFT073
caccgccuccaccugagggg

SEQ ID NO: 626387 - RNA, 20 nt, Escherichia coli CFT073
caccgcgaagcagcuccaga

SEQ ID NO: 626388 - RNA, 16 nt, Escherichia coli CFT073
caccgccuucguaacc

SEQ ID NO: 626389 - RNA, 18 nt, Escherichia coli CFT073
caccgcguaugcccagcg

SEQ ID NO: 626390 - RNA, 16 nt, Escherichia coli CFT073
caccgcggaacgcacu

SEQ ID NO: 626391 - RNA, 16 nt, Escherichia coli CFT073
caccgccgccgggcuu

SEQ ID NO: 626392 - RNA, 14 nt, Escherichia coli CFT073
caccgccgccgcca

SEQ ID NO: 626393 - RNA, 11 nt, Escherichia coli CFT073
caccgccgcca

SEQ ID NO: 626394 - RNA, 12 nt, Escherichia coli CFT073
caccgccgccac

SEQ ID NO: 626395 - RNA, 19 nt, Escherichia coli CFT073
caccgccgccacuucuggc

SEQ ID NO: 626396 - RNA, 14 nt, Escherichia coli CFT073
caccgcccugcauc

SEQ ID NO: 626397 - RNA, 18 nt, Escherichia coli CFT073
caccgcccaccauaauca

SEQ ID NO: 626398 - RNA, 18 nt, Escherichia coli CFT073
caccgccaggcacuuccc

SEQ ID NO: 626399 - RNA, 18 nt, Escherichia coli CFT073
caccgccaggccuaacac

SEQ ID NO: 626400 - RNA, 15 nt, Escherichia coli CFT073
caccgaccaucggca

SEQ ID NO: 626401 - RNA, 18 nt, Escherichia coli CFT073
caccgacgggccugcagg

SEQ ID NO: 626402 - RNA, 23 nt, Escherichia coli CFT073
caccgagauaaugguuuccagca

SEQ ID NO: 626403 - RNA, 16 nt, Escherichia coli CFT073
caccgagauccugguc

SEQ ID NO: 626404 - RNA, 17 nt, Escherichia coli CFT073
caccgauaaaauaauca

SEQ ID NO: 626405 - RNA, 16 nt, Escherichia coli CFT073
caccgaugacagaauc

SEQ ID NO: 626406 - RNA, 12 nt, Escherichia coli CFT073
caccgcacuggu

SEQ ID NO: 626407 - RNA, 18 nt, Escherichia coli CFT073
caccgcagaacagauccc

SEQ ID NO: 626408 - RNA, 19 nt, Escherichia coli CFT073
caccgcagagaucgccccg

SEQ ID NO: 626409 - RNA, 15 nt, Escherichia coli CFT073
caccgcagccgccac

SEQ ID NO: 626410 - RNA, 19 nt, Escherichia coli CFT073
caccgcagccgccacaaua

SEQ ID NO: 626411 - RNA, 16 nt, Escherichia coli CFT073
caccgcaggcagugga

SEQ ID NO: 626412 - RNA, 23 nt, Escherichia coli CFT073
caccgcauuccacggggacucca

SEQ ID NO: 626413 - RNA, 13 nt, Escherichia coli CFT073
caccgccaacaag

SEQ ID NO: 626414 - RNA, 14 nt, Escherichia coli CFT073
caccgccaaagaua

SEQ ID NO: 626415 - RNA, 17 nt, Escherichia coli CFT073
caccgccagcagcagcg

SEQ ID NO: 626416 - RNA, 22 nt, Escherichia coli CFT073
caccgccagaagaaccgccacc

SEQ ID NO: 626417 - RNA, 23 nt, Escherichia coli CFT073
cacccugacuguuuuuccagcuu

SEQ ID NO: 626418 - RNA, 22 nt, Escherichia coli CFT073
cacccgugcagggugagggcaa

SEQ ID NO: 626419 - RNA, 12 nt, Escherichia coli CFT073
cacccugugucg

SEQ ID NO: 626420 - RNA, 12 nt, Escherichia coli CFT073
cacccgcggcga

SEQ ID NO: 626421 - RNA, 23 nt, Escherichia coli CFT073
cacccgcgccuaaauuuuuccac

SEQ ID NO: 626422 - RNA, 22 nt, Escherichia coli CFT073
cacgaacguuccccggaaaauu

SEQ ID NO: 626423 - RNA, 14 nt, Escherichia coli CFT073
cacgaaacugcugg

SEQ ID NO: 626424 - RNA, 16 nt, Escherichia coli CFT073
cacgaaaugaauaauc

SEQ ID NO: 626425 - RNA, 17 nt, Escherichia coli CFT073
caccuuuuuaaucucac

SEQ ID NO: 626426 - RNA, 15 nt, Escherichia coli CFT073
cacgaauugcuucca

SEQ ID NO: 626427 - RNA, 19 nt, Escherichia coli CFT073
cacgacaaaugcgccgcca

SEQ ID NO: 626428 - RNA, 12 nt, Escherichia coli CFT073
cacgacacagcu

SEQ ID NO: 626429 - RNA, 16 nt, Escherichia coli CFT073
cacgacacauaaauaa

SEQ ID NO: 626430 - RNA, 17 nt, Escherichia coli CFT073
cacgacacauaaauaac

SEQ ID NO: 626431 - RNA, 18 nt, Escherichia coli CFT073
cacgaauagucaguucac

SEQ ID NO: 626432 - RNA, 21 nt, Escherichia coli CFT073
cacgacguuugguggaauguc

SEQ ID NO: 626433 - RNA, 22 nt, Escherichia coli CFT073
cacgagugaguuaauuuuccug

SEQ ID NO: 626434 - RNA, 14 nt, Escherichia coli CFT073
cacgaccaggaacg

SEQ ID NO: 626435 - RNA, 17 nt, Escherichia coli CFT073
cacgaccggguuuucaa

SEQ ID NO: 626436 - RNA, 13 nt, Escherichia coli CFT073
cacgaccuugcca

SEQ ID NO: 626437 - RNA, 14 nt, Escherichia coli CFT073
caccuguuccauga

SEQ ID NO: 626438 - RNA, 17 nt, Escherichia coli CFT073
caccuguuccaugacgu

SEQ ID NO: 626439 - RNA, 20 nt, Escherichia coli CFT073
caccuguaaaaaaggcagcc

SEQ ID NO: 626440 - RNA, 21 nt, Escherichia coli CFT073
caccuguaaagucacauuccc

SEQ ID NO: 626441 - RNA, 21 nt, Escherichia coli CFT073
caccugcggaaucaccggcaa

SEQ ID NO: 626442 - RNA, 20 nt, Escherichia coli CFT073
caccugcggugcagccggag

SEQ ID NO: 626443 - RNA, 13 nt, Escherichia coli CFT073
caccugcgguucg

SEQ ID NO: 626444 - RNA, 21 nt, Escherichia coli CFT073
caccugggcaauggugaacug

SEQ ID NO: 626445 - RNA, 21 nt, Escherichia coli CFT073
caccuggcgcauuaacggcaa

SEQ ID NO: 626446 - RNA, 15 nt, Escherichia coli CFT073
caccuuauccggccu

SEQ ID NO: 626447 - RNA, 21 nt, Escherichia coli CFT073
caccuucagcgaagcccacac

SEQ ID NO: 626448 - RNA, 13 nt, Escherichia coli CFT073
caccuuccucuuc

SEQ ID NO: 626449 - RNA, 16 nt, Escherichia coli CFT073
caccuucuguaacugg

SEQ ID NO: 626450 - RNA, 20 nt, Escherichia coli CFT073
caccuugcaguuguaaucac

SEQ ID NO: 626451 - RNA, 18 nt, Escherichia coli CFT073
caccuuucagccacuuca

SEQ ID NO: 626452 - RNA, 22 nt, Escherichia coli CFT073
caccuuguggaaauuccagcgg

SEQ ID NO: 626453 - RNA, 23 nt, Escherichia coli CFT073
caccguuuaccucgucaccaccu

SEQ ID NO: 626454 - RNA, 17 nt, Escherichia coli CFT073
caccuacgcccgccagu

SEQ ID NO: 626455 - RNA, 16 nt, Escherichia coli CFT073
caccgugcacuucugc

SEQ ID NO: 626456 - RNA, 12 nt, Escherichia coli CFT073
caccgugaaaga

SEQ ID NO: 626457 - RNA, 16 nt, Escherichia coli CFT073
caccgugaaagagauc

SEQ ID NO: 626458 - RNA, 21 nt, Escherichia coli CFT073
caccguugagguugaucuucu

SEQ ID NO: 626459 - RNA, 17 nt, Escherichia coli CFT073
caccguuaauccacgcu

SEQ ID NO: 626460 - RNA, 20 nt, Escherichia coli CFT073
caccguuaauccacgcugua

SEQ ID NO: 626461 - RNA, 13 nt, Escherichia coli CFT073
caccguauccagu

SEQ ID NO: 626462 - RNA, 21 nt, Escherichia coli CFT073
caccgucaaauccagaccaau

SEQ ID NO: 626463 - RNA, 15 nt, Escherichia coli CFT073
caccgucacuucuuc

SEQ ID NO: 626464 - RNA, 13 nt, Escherichia coli CFT073
caccguccagcgg

SEQ ID NO: 626465 - RNA, 16 nt, Escherichia coli CFT073
caccggugauuauugu

SEQ ID NO: 626466 - RNA, 18 nt, Escherichia coli CFT073
caccgggggguugccgcc

SEQ ID NO: 626467 - RNA, 21 nt, Escherichia coli CFT073
caccgggggguugccgccacu

SEQ ID NO: 626468 - RNA, 14 nt, Escherichia coli CFT073
caccgguacaaaca

SEQ ID NO: 626469 - RNA, 16 nt, Escherichia coli CFT073
caccgguacaggcauc

SEQ ID NO: 626470 - RNA, 15 nt, Escherichia coli CFT073
caccgguaucugcca

SEQ ID NO: 626471 - RNA, 19 nt, Escherichia coli CFT073
caccgguaucugccagcac

SEQ ID NO: 626472 - RNA, 15 nt, Escherichia coli CFT073
caccugcaucacgcu

SEQ ID NO: 626473 - RNA, 14 nt, Escherichia coli CFT073
caccugccagcgcc

SEQ ID NO: 626474 - RNA, 19 nt, Escherichia coli CFT073
caccugauugaccgccagc

SEQ ID NO: 626475 - RNA, 20 nt, Escherichia coli CFT073
caccugcaacggcaucgcca

SEQ ID NO: 626476 - RNA, 21 nt, Escherichia coli CFT073
caccugcaacggcaucgccaa

SEQ ID NO: 626477 - RNA, 19 nt, Escherichia coli CFT073
caccugaguaccuugcuga

SEQ ID NO: 626478 - RNA, 20 nt, Escherichia coli CFT073
caccugauccagcucuuccu

SEQ ID NO: 626479 - RNA, 18 nt, Escherichia coli CFT073
caccugauacgcgccaau

SEQ ID NO: 626480 - RNA, 20 nt, Escherichia coli CFT073
caccugauuaguggcacacu

SEQ ID NO: 626481 - RNA, 22 nt, Escherichia coli CFT073
caccugaacuucuucgccaggu

SEQ ID NO: 626482 - RNA, 20 nt, Escherichia coli CFT073
caccugaccgagccagugcc

SEQ ID NO: 626483 - RNA, 15 nt, Escherichia coli CFT073
caccucuuucaccaa

SEQ ID NO: 626484 - RNA, 19 nt, Escherichia coli CFT073
caccucucacgacgcuggu

SEQ ID NO: 626485 - RNA, 20 nt, Escherichia coli CFT073
caccucuccacgcaucugca

SEQ ID NO: 626486 - RNA, 18 nt, Escherichia coli CFT073
caccucuccgggcggcgu

SEQ ID NO: 626487 - RNA, 12 nt, Escherichia coli CFT073
caccucugcaac

SEQ ID NO: 626488 - RNA, 20 nt, Escherichia coli CFT073
caccucugcaacgucuuccc

SEQ ID NO: 626489 - RNA, 15 nt, Escherichia coli CFT073
caccucaccgguccc

SEQ ID NO: 626490 - RNA, 15 nt, Escherichia coli CFT073
caccucaucaccaca

SEQ ID NO: 626491 - RNA, 18 nt, Escherichia coli CFT073
caccucaguacccgcguu

SEQ ID NO: 626492 - RNA, 14 nt, Escherichia coli CFT073
caccuccacgccca

SEQ ID NO: 626493 - RNA, 18 nt, Escherichia coli CFT073
caccuccacgcccagcgc

SEQ ID NO: 626494 - RNA, 21 nt, Escherichia coli CFT073
caccuccgcuaaauccgccgc

SEQ ID NO: 626495 - RNA, 22 nt, Escherichia coli CFT073
caccuccgcuaaauccgccgcc

SEQ ID NO: 626496 - RNA, 14 nt, Escherichia coli CFT073
caccucggcacuga

SEQ ID NO: 626497 - RNA, 18 nt, Escherichia coli CFT073
cacccauagauaccuucu

SEQ ID NO: 626498 - RNA, 15 nt, Escherichia coli CFT073
cacccauagcccaug

SEQ ID NO: 626499 - RNA, 15 nt, Escherichia coli CFT073
cacccagcgaagcaa

SEQ ID NO: 626500 - RNA, 18 nt, Escherichia coli CFT073
caccccacaaacagaaug

SEQ ID NO: 626501 - RNA, 16 nt, Escherichia coli CFT073
cacccauuuauccagc

SEQ ID NO: 626502 - RNA, 15 nt, Escherichia coli CFT073
cacccaugcgcgccg

SEQ ID NO: 626503 - RNA, 20 nt, Escherichia coli CFT073
cacccauuacacugaaaaaa

SEQ ID NO: 626504 - RNA, 16 nt, Escherichia coli CFT073
caccccagacuucccc

SEQ ID NO: 626505 - RNA, 22 nt, Escherichia coli CFT073
cacccgcagcaagcguuugagc

SEQ ID NO: 626506 - RNA, 21 nt, Escherichia coli CFT073
cacccgcagugauugccgcga

SEQ ID NO: 626507 - RNA, 15 nt, Escherichia coli CFT073
cacccgcaacgcccu

SEQ ID NO: 626508 - RNA, 21 nt, Escherichia coli CFT073
cacccgcaacgcccugcaacu

SEQ ID NO: 626509 - RNA, 21 nt, Escherichia coli CFT073
cacccgcaagacgaaccggca

SEQ ID NO: 626510 - RNA, 16 nt, Escherichia coli CFT073
cacccgacgugcagca

SEQ ID NO: 626511 - RNA, 13 nt, Escherichia coli CFT073
cacccacagccau

SEQ ID NO: 626512 - RNA, 16 nt, Escherichia coli CFT073
cacccaaucccugacc

SEQ ID NO: 626513 - RNA, 17 nt, Escherichia coli CFT073
cacccagaacgccgaau

SEQ ID NO: 626514 - RNA, 13 nt, Escherichia coli CFT073
cacccaaaucugc

SEQ ID NO: 626515 - RNA, 14 nt, Escherichia coli CFT073
caccauuuaaugac

SEQ ID NO: 626516 - RNA, 18 nt, Escherichia coli CFT073
caccauuuaaugacaaaa

SEQ ID NO: 626517 - RNA, 23 nt, Escherichia coli CFT073
caccauuuaaugacaaaaagagu

SEQ ID NO: 626518 - RNA, 21 nt, Escherichia coli CFT073
caccauuuccggagacagcuu

SEQ ID NO: 626519 - RNA, 16 nt, Escherichia coli CFT073
caccauugccggaugc

SEQ ID NO: 626520 - RNA, 21 nt, Escherichia coli CFT073
caccauugccggaugcggcgu

SEQ ID NO: 626521 - RNA, 18 nt, Escherichia coli CFT073
caccauccagcaacaaca

SEQ ID NO: 626522 - RNA, 19 nt, Escherichia coli CFT073
caccauccccaccaaaaca

SEQ ID NO: 626523 - RNA, 20 nt, Escherichia coli CFT073
caccaucagcagcaacaaaa

SEQ ID NO: 626524 - RNA, 14 nt, Escherichia coli CFT073
caccaucagcagca

SEQ ID NO: 626525 - RNA, 15 nt, Escherichia coli CFT073
caccaucagcagcaa

SEQ ID NO: 626526 - RNA, 13 nt, Escherichia coli CFT073
caccaucaguggc

SEQ ID NO: 626527 - RNA, 14 nt, Escherichia coli CFT073
caccaucaucggca

SEQ ID NO: 626528 - RNA, 22 nt, Escherichia coli CFT073
caccaucgauaaaaucguuaaa

SEQ ID NO: 626529 - RNA, 18 nt, Escherichia coli CFT073
caccaucgcgauccacgc

SEQ ID NO: 626530 - RNA, 17 nt, Escherichia coli CFT073
caccaucgcaaacagca

SEQ ID NO: 626531 - RNA, 17 nt, Escherichia coli CFT073
caccauccugaucgcca

SEQ ID NO: 626532 - RNA, 18 nt, Escherichia coli CFT073
caccaucucaagcauuac

SEQ ID NO: 626533 - RNA, 16 nt, Escherichia coli CFT073
caccaugccagaaaag

SEQ ID NO: 626534 - RNA, 17 nt, Escherichia coli CFT073
caccaugccagaaaagg

SEQ ID NO: 626535 - RNA, 20 nt, Escherichia coli CFT073
caccaggaacgcgccaagau

SEQ ID NO: 626536 - RNA, 17 nt, Escherichia coli CFT073
caccaggaacucagcgu

SEQ ID NO: 626537 - RNA, 21 nt, Escherichia coli CFT073
caccaggaacucagcgugcca

SEQ ID NO: 626538 - RNA, 14 nt, Escherichia coli CFT073
caccaggccgcgca

SEQ ID NO: 626539 - RNA, 23 nt, Escherichia coli CFT073
caccaggccgcgcaggugguuau

SEQ ID NO: 626540 - RNA, 20 nt, Escherichia coli CFT073
caccaggcaguuuauccagc

SEQ ID NO: 626541 - RNA, 22 nt, Escherichia coli CFT073
caccaggguggcaaaugcauag

SEQ ID NO: 626542 - RNA, 20 nt, Escherichia coli CFT073
caccaggcucuuugaacagu

SEQ ID NO: 626543 - RNA, 22 nt, Escherichia coli CFT073
caccaggcucuuugaacaguuu

SEQ ID NO: 626544 - RNA, 14 nt, Escherichia coli CFT073
caccaucaccucuc

SEQ ID NO: 626545 - RNA, 19 nt, Escherichia coli CFT073
caccaucaacaaacgccag

SEQ ID NO: 626546 - RNA, 12 nt, Escherichia coli CFT073
caccauaacuag

SEQ ID NO: 626547 - RNA, 19 nt, Escherichia coli CFT073
caccaguucgccuucauuc

SEQ ID NO: 626548 - RNA, 15 nt, Escherichia coli CFT073
caccaguucgcgcag

SEQ ID NO: 626549 - RNA, 22 nt, Escherichia coli CFT073
caccaguugugaugccacuuca

SEQ ID NO: 626550 - RNA, 14 nt, Escherichia coli CFT073
caccaguuuccagu

SEQ ID NO: 626551 - RNA, 20 nt, Escherichia coli CFT073
caccaguuuccagucacccu

SEQ ID NO: 626552 - RNA, 22 nt, Escherichia coli CFT073
caccagucagcgaacaccagca

SEQ ID NO: 626553 - RNA, 15 nt, Escherichia coli CFT073
caccagugcaggcac

SEQ ID NO: 626554 - RNA, 16 nt, Escherichia coli CFT073
caccaguucaccaccu

SEQ ID NO: 626555 - RNA, 13 nt, Escherichia coli CFT073
caccaguucacgc

SEQ ID NO: 626556 - RNA, 16 nt, Escherichia coli CFT073
caccaguucagugacc

SEQ ID NO: 626557 - RNA, 23 nt, Escherichia coli CFT073
caccagguuuucgucguacugac

SEQ ID NO: 626558 - RNA, 15 nt, Escherichia coli CFT073
caccaguaacuuccc

SEQ ID NO: 626559 - RNA, 17 nt, Escherichia coli CFT073
caccaguaacuuccccu

SEQ ID NO: 626560 - RNA, 20 nt, Escherichia coli CFT073
caccaguaaggcaucuucuu

SEQ ID NO: 626561 - RNA, 18 nt, Escherichia coli CFT073
caccagguucgccaacaa

SEQ ID NO: 626562 - RNA, 21 nt, Escherichia coli CFT073
caccaguaaggcaucuucuuc

SEQ ID NO: 626563 - RNA, 22 nt, Escherichia coli CFT073
caccaguaaggcaucuucuuca

SEQ ID NO: 626564 - RNA, 17 nt, Escherichia coli CFT073
caccagcgucagaaaca

SEQ ID NO: 626565 - RNA, 19 nt, Escherichia coli CFT073
caccagcuuguuguccggu

SEQ ID NO: 626566 - RNA, 21 nt, Escherichia coli CFT073
caccagcugaauggguaaacc

SEQ ID NO: 626567 - RNA, 16 nt, Escherichia coli CFT073
caccagcgacagccag

SEQ ID NO: 626568 - RNA, 14 nt, Escherichia coli CFT073
caccagcgcgagga

SEQ ID NO: 626569 - RNA, 20 nt, Escherichia coli CFT073
caccagcgccgcccacaaca

SEQ ID NO: 626570 - RNA, 22 nt, Escherichia coli CFT073
caccagcgccaccacccagaac

SEQ ID NO: 626571 - RNA, 15 nt, Escherichia coli CFT073
caccagcgccucuuc

SEQ ID NO: 626572 - RNA, 17 nt, Escherichia coli CFT073
caccagcgccucuucca

SEQ ID NO: 626573 - RNA, 19 nt, Escherichia coli CFT073
caccagcgccugcgcggca

SEQ ID NO: 626574 - RNA, 16 nt, Escherichia coli CFT073
caccagcaaauccagc

SEQ ID NO: 626575 - RNA, 13 nt, Escherichia coli CFT073
caccagcaauaag

SEQ ID NO: 626576 - RNA, 16 nt, Escherichia coli CFT073
caccagcaauaagcca

SEQ ID NO: 626577 - RNA, 20 nt, Escherichia coli CFT073
caccagcaauaagccagucc

SEQ ID NO: 626578 - RNA, 14 nt, Escherichia coli CFT073
caccagcaccagca

SEQ ID NO: 626579 - RNA, 16 nt, Escherichia coli CFT073
caccagcaccagcaac

SEQ ID NO: 626580 - RNA, 22 nt, Escherichia coli CFT073
caccagcacaucaucaaagcca

SEQ ID NO: 626581 - RNA, 14 nt, Escherichia coli CFT073
caccagcagcugcu

SEQ ID NO: 626582 - RNA, 10 nt, Escherichia coli CFT073
caccagcagc

SEQ ID NO: 626583 - RNA, 14 nt, Escherichia coli CFT073
caccagcagcagcg

SEQ ID NO: 626584 - RNA, 22 nt, Escherichia coli CFT073
caccagcaguaaaccacccacc

SEQ ID NO: 626585 - RNA, 15 nt, Escherichia coli CFT073
caccagcaucaacaa

SEQ ID NO: 626586 - RNA, 17 nt, Escherichia coli CFT073
caccagcaucaacaaca

SEQ ID NO: 626587 - RNA, 22 nt, Escherichia coli CFT073
caccagccagacucagcaacag

SEQ ID NO: 626588 - RNA, 14 nt, Escherichia coli CFT073
caccagccaguagc

SEQ ID NO: 626589 - RNA, 15 nt, Escherichia coli CFT073
caccacuccucaaca

SEQ ID NO: 626590 - RNA, 19 nt, Escherichia coli CFT073
caccacgguuuuuugcagc

SEQ ID NO: 626591 - RNA, 17 nt, Escherichia coli CFT073
caccacgaccacgaacg

SEQ ID NO: 626592 - RNA, 13 nt, Escherichia coli CFT073
caccaccucuucc

SEQ ID NO: 626593 - RNA, 16 nt, Escherichia coli CFT073
caccaccugcaucucc

SEQ ID NO: 626594 - RNA, 13 nt, Escherichia coli CFT073
caccaccugggug

SEQ ID NO: 626595 - RNA, 20 nt, Escherichia coli CFT073
caccacgcgccugcagcggc

SEQ ID NO: 626596 - RNA, 14 nt, Escherichia coli CFT073
caccacgccaagaa

SEQ ID NO: 626597 - RNA, 20 nt, Escherichia coli CFT073
caccacgcccagcgaccaca

SEQ ID NO: 626598 - RNA, 19 nt, Escherichia coli CFT073
caccagacaucaaguaacc

SEQ ID NO: 626599 - RNA, 13 nt, Escherichia coli CFT073
caccagaccagac

SEQ ID NO: 626600 - RNA, 14 nt, Escherichia coli CFT073
caccagagaacuga

SEQ ID NO: 626601 - RNA, 17 nt, Escherichia coli CFT073
caccagaaucgccagca

SEQ ID NO: 626602 - RNA, 20 nt, Escherichia coli CFT073
caccagaaucgccagcaucg

SEQ ID NO: 626603 - RNA, 21 nt, Escherichia coli CFT073
caccagauccugccauuggca

SEQ ID NO: 626604 - RNA, 13 nt, Escherichia coli CFT073
caccagaggaugc

SEQ ID NO: 626605 - RNA, 11 nt, Escherichia coli CFT073
caccagaauac

SEQ ID NO: 626606 - RNA, 14 nt, Escherichia coli CFT073
caccacuuuauagc

SEQ ID NO: 626607 - RNA, 17 nt, Escherichia coli CFT073
caccagaaccagcaacc

SEQ ID NO: 626608 - RNA, 17 nt, Escherichia coli CFT073
caccagaaccgccgcug

SEQ ID NO: 626609 - RNA, 22 nt, Escherichia coli CFT073
caccacugacaaucgccaguga

SEQ ID NO: 626610 - RNA, 15 nt, Escherichia coli CFT073
caccacuucauacuc

SEQ ID NO: 626611 - RNA, 21 nt, Escherichia coli CFT073
caccacuuccggcaacaaggc

SEQ ID NO: 626612 - RNA, 14 nt, Escherichia coli CFT073
caccacuuccugcu

SEQ ID NO: 626613 - RNA, 13 nt, Escherichia coli CFT073
caccacuucuuuc

SEQ ID NO: 626614 - RNA, 14 nt, Escherichia coli CFT073
caccacuucuuuca

SEQ ID NO: 626615 - RNA, 19 nt, Escherichia coli CFT073
caccacuuguagaccagga

SEQ ID NO: 626616 - RNA, 22 nt, Escherichia coli CFT073
caccacuuguagaccaggaugc

SEQ ID NO: 626617 - RNA, 22 nt, Escherichia coli CFT073
caccacuuuacgggcaaucucc

SEQ ID NO: 626618 - RNA, 18 nt, Escherichia coli CFT073
caccaauugugguacgcu

SEQ ID NO: 626619 - RNA, 16 nt, Escherichia coli CFT073
caccacaaaccagccc

SEQ ID NO: 626620 - RNA, 20 nt, Escherichia coli CFT073
caccacagcaccccauagcc

SEQ ID NO: 626621 - RNA, 18 nt, Escherichia coli CFT073
caccacauaagaucaucg

SEQ ID NO: 626622 - RNA, 19 nt, Escherichia coli CFT073
caccacaagccaccauccc

SEQ ID NO: 626623 - RNA, 13 nt, Escherichia coli CFT073
caccacaccagac

SEQ ID NO: 626624 - RNA, 16 nt, Escherichia coli CFT073
caccacaccagaccag

SEQ ID NO: 626625 - RNA, 19 nt, Escherichia coli CFT073
caccacaccagaccagaca

SEQ ID NO: 626626 - RNA, 18 nt, Escherichia coli CFT073
caccacauucagcagccc

SEQ ID NO: 626627 - RNA, 19 nt, Escherichia coli CFT073
caccacauucagcagcccg

SEQ ID NO: 626628 - RNA, 11 nt, Escherichia coli CFT073
caccacauucu

SEQ ID NO: 626629 - RNA, 15 nt, Escherichia coli CFT073
caccaccaaagguua

SEQ ID NO: 626630 - RNA, 14 nt, Escherichia coli CFT073
caccaccagcgcca

SEQ ID NO: 626631 - RNA, 17 nt, Escherichia coli CFT073
caccaccagcgccacca

SEQ ID NO: 626632 - RNA, 15 nt, Escherichia coli CFT073
caccaccagcagcug

SEQ ID NO: 626633 - RNA, 14 nt, Escherichia coli CFT073
caccaccagcaccg

SEQ ID NO: 626634 - RNA, 14 nt, Escherichia coli CFT073
caccaccucacccg

SEQ ID NO: 626635 - RNA, 21 nt, Escherichia coli CFT073
caccaccgcaucggcaucaaa

SEQ ID NO: 626636 - RNA, 18 nt, Escherichia coli CFT073
caccaccgcccgguuuuu

SEQ ID NO: 626637 - RNA, 13 nt, Escherichia coli CFT073
caccaccaucaaa

SEQ ID NO: 626638 - RNA, 22 nt, Escherichia coli CFT073
caccaccaucaaaugcgccugc

SEQ ID NO: 626639 - RNA, 13 nt, Escherichia coli CFT073
caccacccaacag

SEQ ID NO: 626640 - RNA, 12 nt, Escherichia coli CFT073
caccacccagcg

SEQ ID NO: 626641 - RNA, 21 nt, Escherichia coli CFT073
caccaccgauaaaauaaucac

SEQ ID NO: 626642 - RNA, 15 nt, Escherichia coli CFT073
caccaccgcaaaaua

SEQ ID NO: 626643 - RNA, 15 nt, Escherichia coli CFT073
caccaccgcaaagaa

SEQ ID NO: 626644 - RNA, 22 nt, Escherichia coli CFT073
caccaagcacggcgcgacucag

SEQ ID NO: 626645 - RNA, 19 nt, Escherichia coli CFT073
caccaaggaacugugcauu

SEQ ID NO: 626646 - RNA, 13 nt, Escherichia coli CFT073
caccaaggaagcu

SEQ ID NO: 626647 - RNA, 15 nt, Escherichia coli CFT073
caccaaggaacugug

SEQ ID NO: 626648 - RNA, 16 nt, Escherichia coli CFT073
caccaaucagcccugc

SEQ ID NO: 626649 - RNA, 13 nt, Escherichia coli CFT073
caccaaucagcgg

SEQ ID NO: 626650 - RNA, 12 nt, Escherichia coli CFT073
caccaaguucuu

SEQ ID NO: 626651 - RNA, 14 nt, Escherichia coli CFT073
caccaaguucuuca

SEQ ID NO: 626652 - RNA, 16 nt, Escherichia coli CFT073
caccaaguucuucacu

SEQ ID NO: 626653 - RNA, 23 nt, Escherichia coli CFT073
caccaaucaacaauugcgggcca

SEQ ID NO: 626654 - RNA, 13 nt, Escherichia coli CFT073
caccaauccaggc

SEQ ID NO: 626655 - RNA, 12 nt, Escherichia coli CFT073
caccaaucggca

SEQ ID NO: 626656 - RNA, 21 nt, Escherichia coli CFT073
caccaaucgucaaugccguca

SEQ ID NO: 626657 - RNA, 23 nt, Escherichia coli CFT073
caccaaugacagccccaccagca

SEQ ID NO: 626658 - RNA, 17 nt, Escherichia coli CFT073
caccaaaugccugcugu

SEQ ID NO: 626659 - RNA, 22 nt, Escherichia coli CFT073
caccaaauaaaaaaacgccaga

SEQ ID NO: 626660 - RNA, 17 nt, Escherichia coli CFT073
caccaaauuguuuugcu

SEQ ID NO: 626661 - RNA, 18 nt, Escherichia coli CFT073
caccaaauuguuuugcua

SEQ ID NO: 626662 - RNA, 18 nt, Escherichia coli CFT073
caccaacaucgacauaau

SEQ ID NO: 626663 - RNA, 19 nt, Escherichia coli CFT073
caccaacgcaccaaaguua

SEQ ID NO: 626664 - RNA, 16 nt, Escherichia coli CFT073
caccaacgcagacgca

SEQ ID NO: 626665 - RNA, 17 nt, Escherichia coli CFT073
caccaacuccacuucac

SEQ ID NO: 626666 - RNA, 23 nt, Escherichia coli CFT073
cacauugauggcgcuuucguuuu

SEQ ID NO: 626667 - RNA, 17 nt, Escherichia coli CFT073
cacauugccauuguugu

SEQ ID NO: 626668 - RNA, 18 nt, Escherichia coli CFT073
cacauugccauuguugua

SEQ ID NO: 626669 - RNA, 21 nt, Escherichia coli CFT073
cacauucccugcagucaccug

SEQ ID NO: 626670 - RNA, 22 nt, Escherichia coli CFT073
cacauucugcauugcgcugaac

SEQ ID NO: 626671 - RNA, 13 nt, Escherichia coli CFT073
cacauucagcagc

SEQ ID NO: 626672 - RNA, 14 nt, Escherichia coli CFT073
cacauucagcagcc

SEQ ID NO: 626673 - RNA, 19 nt, Escherichia coli CFT073
cacaugcaagucgaacggu

SEQ ID NO: 626674 - RNA, 14 nt, Escherichia coli CFT073
cacaugcuucagca

SEQ ID NO: 626675 - RNA, 22 nt, Escherichia coli CFT073
cacauuaaaaugaauaacuucc

SEQ ID NO: 626676 - RNA, 23 nt, Escherichia coli CFT073
cacauuaaaaugaauaacuuccu

SEQ ID NO: 626677 - RNA, 22 nt, Escherichia coli CFT073
cacaugaauucgacuuucucug

SEQ ID NO: 626678 - RNA, 15 nt, Escherichia coli CFT073
cacaucucaauccgc

SEQ ID NO: 626679 - RNA, 18 nt, Escherichia coli CFT073
cacaucucccacuuugau

SEQ ID NO: 626680 - RNA, 23 nt, Escherichia coli CFT073
cacaucgccgaccgcaaccggcc

SEQ ID NO: 626681 - RNA, 15 nt, Escherichia coli CFT073
cacaucgcugugcug

SEQ ID NO: 626682 - RNA, 20 nt, Escherichia coli CFT073
cacaucggcaggaacagaua

SEQ ID NO: 626683 - RNA, 18 nt, Escherichia coli CFT073
cacauccagaugucuuua

SEQ ID NO: 626684 - RNA, 16 nt, Escherichia coli CFT073
cacauccagcggcaga

SEQ ID NO: 626685 - RNA, 18 nt, Escherichia coli CFT073
cacaucccagcagagauc

SEQ ID NO: 626686 - RNA, 14 nt, Escherichia coli CFT073
cacaucacauccag

SEQ ID NO: 626687 - RNA, 22 nt, Escherichia coli CFT073
cacaucaggcugagaagggauu

SEQ ID NO: 626688 - RNA, 15 nt, Escherichia coli CFT073
cacaucaucaaagcc

SEQ ID NO: 626689 - RNA, 14 nt, Escherichia coli CFT073
cacaucaucaucgc

SEQ ID NO: 626690 - RNA, 23 nt, Escherichia coli CFT073
cacaucauccggcacuuuuucau

SEQ ID NO: 626691 - RNA, 17 nt, Escherichia coli CFT073
cacaucagaacagcccc

SEQ ID NO: 626692 - RNA, 17 nt, Escherichia coli CFT073
cacaucaggacgaauac

SEQ ID NO: 626693 - RNA, 19 nt, Escherichia coli CFT073
cacaucaggcccacuacac

SEQ ID NO: 626694 - RNA, 20 nt, Escherichia coli CFT073
cacaucaggcccacuacacc

SEQ ID NO: 626695 - RNA, 22 nt, Escherichia coli CFT073
cacaguuuuacugcagccagcg

SEQ ID NO: 626696 - RNA, 17 nt, Escherichia coli CFT073
cacaguuuuacugcagc

SEQ ID NO: 626697 - RNA, 18 nt, Escherichia coli CFT073
cacaguuuuacugcagcc

SEQ ID NO: 626698 - RNA, 16 nt, Escherichia coli CFT073
cacagugaaucucuua

SEQ ID NO: 626699 - RNA, 12 nt, Escherichia coli CFT073
cacagugacccg

SEQ ID NO: 626700 - RNA, 20 nt, Escherichia coli CFT073
cacauaaaguagccaauccc

SEQ ID NO: 626701 - RNA, 15 nt, Escherichia coli CFT073
cacauaaccagugac

SEQ ID NO: 626702 - RNA, 17 nt, Escherichia coli CFT073
cacauaagaucaucggc

SEQ ID NO: 626703 - RNA, 16 nt, Escherichia coli CFT073
cacauagauaaagccg

SEQ ID NO: 626704 - RNA, 22 nt, Escherichia coli CFT073
cacauacgcgguauuaaauccg

SEQ ID NO: 626705 - RNA, 19 nt, Escherichia coli CFT073
cacauaccacggcauuucc

SEQ ID NO: 626706 - RNA, 21 nt, Escherichia coli CFT073
cacaguaagccgguaaucacc

SEQ ID NO: 626707 - RNA, 17 nt, Escherichia coli CFT073
cacaguaauuuccugcc

SEQ ID NO: 626708 - RNA, 15 nt, Escherichia coli CFT073
cacaggagacaccag

SEQ ID NO: 626709 - RNA, 14 nt, Escherichia coli CFT073
cacaggccaucaca

SEQ ID NO: 626710 - RNA, 20 nt, Escherichia coli CFT073
cacaggauggcccaaauggc

SEQ ID NO: 626711 - RNA, 21 nt, Escherichia coli CFT073
cacaggcagcaaucacugcca

SEQ ID NO: 626712 - RNA, 12 nt, Escherichia coli CFT073
cacaggccgcca

SEQ ID NO: 626713 - RNA, 15 nt, Escherichia coli CFT073
cacaggccauuuccc

SEQ ID NO: 626714 - RNA, 15 nt, Escherichia coli CFT073
cacagcaguugugug

SEQ ID NO: 626715 - RNA, 18 nt, Escherichia coli CFT073
cacagcauucagcuucca

SEQ ID NO: 626716 - RNA, 22 nt, Escherichia coli CFT073
cacagccagccuccaacccaca

SEQ ID NO: 626717 - RNA, 23 nt, Escherichia coli CFT073
cacagccagccuccaacccacaa

SEQ ID NO: 626718 - RNA, 19 nt, Escherichia coli CFT073
cacagccagcgcaggcagu

SEQ ID NO: 626719 - RNA, 19 nt, Escherichia coli CFT073
cacagcgacaagcucucuu

SEQ ID NO: 626720 - RNA, 16 nt, Escherichia coli CFT073
cacagcgccagacacu

SEQ ID NO: 626721 - RNA, 18 nt, Escherichia coli CFT073
cacagagcgcuuauacac

SEQ ID NO: 626722 - RNA, 19 nt, Escherichia coli CFT073
cacagagcgcuuauacacc

SEQ ID NO: 626723 - RNA, 13 nt, Escherichia coli CFT073
cacagacgaaggu

SEQ ID NO: 626724 - RNA, 22 nt, Escherichia coli CFT073
cacagagggcgaacgagauaau

SEQ ID NO: 626725 - RNA, 14 nt, Escherichia coli CFT073
cacagaguauuucc

SEQ ID NO: 626726 - RNA, 17 nt, Escherichia coli CFT073
cacagaguguauucaug

SEQ ID NO: 626727 - RNA, 19 nt, Escherichia coli CFT073
cacagaguguauucaugcc

SEQ ID NO: 626728 - RNA, 22 nt, Escherichia coli CFT073
cacagaauggcauuauuuacgc

SEQ ID NO: 626729 - RNA, 11 nt, Escherichia coli CFT073
cacagaaguga

SEQ ID NO: 626730 - RNA, 13 nt, Escherichia coli CFT073
cacagacaaacag

SEQ ID NO: 626731 - RNA, 14 nt, Escherichia coli CFT073
cacagaccaaaacu

SEQ ID NO: 626732 - RNA, 18 nt, Escherichia coli CFT073
cacagcaccuuaugcggg

SEQ ID NO: 626733 - RNA, 22 nt, Escherichia coli CFT073
cacaaugccuuuugacuccuga

SEQ ID NO: 626734 - RNA, 23 nt, Escherichia coli CFT073
cacaauggccagcacauuaaaau

SEQ ID NO: 626735 - RNA, 16 nt, Escherichia coli CFT073
cacaauguaaaucaug

SEQ ID NO: 626736 - RNA, 16 nt, Escherichia coli CFT073
cacaauguucaaaugu

SEQ ID NO: 626737 - RNA, 12 nt, Escherichia coli CFT073
cacaauuaccuu

SEQ ID NO: 626738 - RNA, 23 nt, Escherichia coli CFT073
cacaauuaccuuccacaauggca

SEQ ID NO: 626739 - RNA, 14 nt, Escherichia coli CFT073
cacaauuuaaauca

SEQ ID NO: 626740 - RNA, 22 nt, Escherichia coli CFT073
cacacaagccgugaaucacucc

SEQ ID NO: 626741 - RNA, 19 nt, Escherichia coli CFT073
cacacacuaccgccgagca

SEQ ID NO: 626742 - RNA, 14 nt, Escherichia coli CFT073
cacaccacaacagc

SEQ ID NO: 626743 - RNA, 15 nt, Escherichia coli CFT073
cacaccacagcaccc

SEQ ID NO: 626744 - RNA, 15 nt, Escherichia coli CFT073
cacacagcuuucuca

SEQ ID NO: 626745 - RNA, 22 nt, Escherichia coli CFT073
cacaagccaaucugcuggaaag

SEQ ID NO: 626746 - RNA, 15 nt, Escherichia coli CFT073
cacaagccaccaucc

SEQ ID NO: 626747 - RNA, 17 nt, Escherichia coli CFT073
cacaauacauagaagcu

SEQ ID NO: 626748 - RNA, 20 nt, Escherichia coli CFT073
cacaaucaacgccaccauca

SEQ ID NO: 626749 - RNA, 17 nt, Escherichia coli CFT073
cacaaucccuuccaccg

SEQ ID NO: 626750 - RNA, 22 nt, Escherichia coli CFT073
cacaaucgcagcgcaagcugaa

SEQ ID NO: 626751 - RNA, 23 nt, Escherichia coli CFT073
cacacuguucauuaaagccgccc

SEQ ID NO: 626752 - RNA, 16 nt, Escherichia coli CFT073
cacacuuuccaguucc

SEQ ID NO: 626753 - RNA, 14 nt, Escherichia coli CFT073
cacacuugguuugu

SEQ ID NO: 626754 - RNA, 17 nt, Escherichia coli CFT073
cacagaaccggagucag

SEQ ID NO: 626755 - RNA, 12 nt, Escherichia coli CFT073
cacagaaaagca

SEQ ID NO: 626756 - RNA, 18 nt, Escherichia coli CFT073
cacagaaaagcagagugu

SEQ ID NO: 626757 - RNA, 12 nt, Escherichia coli CFT073
cacacgcgccca

SEQ ID NO: 626758 - RNA, 14 nt, Escherichia coli CFT073
cacacgcgcccagc

SEQ ID NO: 626759 - RNA, 14 nt, Escherichia coli CFT073
cacacgcucuucca

SEQ ID NO: 626760 - RNA, 13 nt, Escherichia coli CFT073
cacacgacgccag

SEQ ID NO: 626761 - RNA, 23 nt, Escherichia coli CFT073
cacaccuuguggaaauuccagcg

SEQ ID NO: 626762 - RNA, 21 nt, Escherichia coli CFT073
cacacgcccaguucaaacggc

SEQ ID NO: 626763 - RNA, 16 nt, Escherichia coli CFT073
cacacgcagcugaugc

SEQ ID NO: 626764 - RNA, 17 nt, Escherichia coli CFT073
cacaccguaauugccag

SEQ ID NO: 626765 - RNA, 17 nt, Escherichia coli CFT073
cacaccguugccgcauu

SEQ ID NO: 626766 - RNA, 16 nt, Escherichia coli CFT073
cacaccucacaccccg

SEQ ID NO: 626767 - RNA, 23 nt, Escherichia coli CFT073
cacaccuucuugcgucacaaaua

SEQ ID NO: 626768 - RNA, 16 nt, Escherichia coli CFT073
cacaccgcugacuuuc

SEQ ID NO: 626769 - RNA, 13 nt, Escherichia coli CFT073
cacaccggcacca

SEQ ID NO: 626770 - RNA, 14 nt, Escherichia coli CFT073
cacaccagucagcg

SEQ ID NO: 626771 - RNA, 14 nt, Escherichia coli CFT073
cacaccacuucauu

SEQ ID NO: 626772 - RNA, 11 nt, Escherichia coli CFT073
cacaccagauc

SEQ ID NO: 626773 - RNA, 16 nt, Escherichia coli CFT073
cacaccgcccugcugu

SEQ ID NO: 626774 - RNA, 14 nt, Escherichia coli CFT073
cacaaccacuuugu

SEQ ID NO: 626775 - RNA, 15 nt, Escherichia coli CFT073
cacaaccacuuugua

SEQ ID NO: 626776 - RNA, 20 nt, Escherichia coli CFT073
cacaacagccagguuuugcu

SEQ ID NO: 626777 - RNA, 16 nt, Escherichia coli CFT073
cacaaccgccggaugc

SEQ ID NO: 626778 - RNA, 18 nt, Escherichia coli CFT073
cacaaccgccggaugcgg

SEQ ID NO: 626779 - RNA, 21 nt, Escherichia coli CFT073
cacaaccgccggaugcggcgu

SEQ ID NO: 626780 - RNA, 13 nt, Escherichia coli CFT073
cacaagacugaca

SEQ ID NO: 626781 - RNA, 11 nt, Escherichia coli CFT073
cacaagacugu

SEQ ID NO: 626782 - RNA, 18 nt, Escherichia coli CFT073
cacaagacuguaaauacu

SEQ ID NO: 626783 - RNA, 20 nt, Escherichia coli CFT073
cacaacgcuuucaacaaccu

SEQ ID NO: 626784 - RNA, 18 nt, Escherichia coli CFT073
cacaaaaugccagcaacu

SEQ ID NO: 626785 - RNA, 13 nt, Escherichia coli CFT073
cacaaaaccugcc

SEQ ID NO: 626786 - RNA, 13 nt, Escherichia coli CFT073
cacaaacaauuug

SEQ ID NO: 626787 - RNA, 14 nt, Escherichia coli CFT073
cacaaacagcgccu

SEQ ID NO: 626788 - RNA, 17 nt, Escherichia coli CFT073
cacaaacgccgugcaca

SEQ ID NO: 626789 - RNA, 17 nt, Escherichia coli CFT073
cacaaagcaauauuaug

SEQ ID NO: 626790 - RNA, 19 nt, Escherichia coli CFT073
cacaaaggcgcgaagcugg

SEQ ID NO: 626791 - RNA, 19 nt, Escherichia coli CFT073
cacaaaggcuugcugcauu

SEQ ID NO: 626792 - RNA, 14 nt, Escherichia coli CFT073
cacaaaucuuauag

SEQ ID NO: 626793 - RNA, 12 nt, Escherichia coli CFT073
caauuuccaguu

SEQ ID NO: 626794 - RNA, 16 nt, Escherichia coli CFT073
caauuuccgcuacugu

SEQ ID NO: 626795 - RNA, 14 nt, Escherichia coli CFT073
caauuugccaggcu

SEQ ID NO: 626796 - RNA, 22 nt, Escherichia coli CFT073
caauuucugugcagccaaaaau

SEQ ID NO: 626797 - RNA, 23 nt, Escherichia coli CFT073
caauuugcggugaagccaccagc

SEQ ID NO: 626798 - RNA, 20 nt, Escherichia coli CFT073
caauuuguagucauuuuuug

SEQ ID NO: 626799 - RNA, 13 nt, Escherichia coli CFT073
caauuuugcugug

SEQ ID NO: 626800 - RNA, 20 nt, Escherichia coli CFT073
caauuuugcguuuggcauca

SEQ ID NO: 626801 - RNA, 18 nt, Escherichia coli CFT073
cacaaaaacaguaagcaa

SEQ ID NO: 626802 - RNA, 14 nt, Escherichia coli CFT073
cacaaaacuguauc

SEQ ID NO: 626803 - RNA, 19 nt, Escherichia coli CFT073
cacaaaacuguaucccagc

SEQ ID NO: 626804 - RNA, 15 nt, Escherichia coli CFT073
caauuuuucccucuu

SEQ ID NO: 626805 - RNA, 12 nt, Escherichia coli CFT073
caauuaaaaauu

SEQ ID NO: 626806 - RNA, 16 nt, Escherichia coli CFT073
caauuaacgaaaucuc

SEQ ID NO: 626807 - RNA, 12 nt, Escherichia coli CFT073
caaucagccccu

SEQ ID NO: 626808 - RNA, 22 nt, Escherichia coli CFT073
caaucagccccuucgccagugc

SEQ ID NO: 626809 - RNA, 18 nt, Escherichia coli CFT073
caaucagcccugcccaga

SEQ ID NO: 626810 - RNA, 23 nt, Escherichia coli CFT073
caaucagcggaaaugcagaggca

SEQ ID NO: 626811 - RNA, 21 nt, Escherichia coli CFT073
caaucagguaagcgaaggugc

SEQ ID NO: 626812 - RNA, 14 nt, Escherichia coli CFT073
caaucaggcuaucg

SEQ ID NO: 626813 - RNA, 20 nt, Escherichia coli CFT073
caaucagcacacauaacagc

SEQ ID NO: 626814 - RNA, 12 nt, Escherichia coli CFT073
caaucagccaga

SEQ ID NO: 626815 - RNA, 14 nt, Escherichia coli CFT073
caaucacugccaga

SEQ ID NO: 626816 - RNA, 17 nt, Escherichia coli CFT073
caaucacuuucugcgcc

SEQ ID NO: 626817 - RNA, 23 nt, Escherichia coli CFT073
caauucacacagugaaucucuua

SEQ ID NO: 626818 - RNA, 17 nt, Escherichia coli CFT073
caauucacacucugcca

SEQ ID NO: 626819 - RNA, 13 nt, Escherichia coli CFT073
caauuaugcccuc

SEQ ID NO: 626820 - RNA, 14 nt, Escherichia coli CFT073
caauuaucuggcua

SEQ ID NO: 626821 - RNA, 21 nt, Escherichia coli CFT073
caauuaucuguucuuuuauau

SEQ ID NO: 626822 - RNA, 19 nt, Escherichia coli CFT073
caauuacgccgagcgccag

SEQ ID NO: 626823 - RNA, 13 nt, Escherichia coli CFT073
caauuacaaaaag

SEQ ID NO: 626824 - RNA, 14 nt, Escherichia coli CFT073
caauuacaaaaagu

SEQ ID NO: 626825 - RNA, 15 nt, Escherichia coli CFT073
caauuacaaaaugac

SEQ ID NO: 626826 - RNA, 13 nt, Escherichia coli CFT073
caauuaccuuuuu

SEQ ID NO: 626827 - RNA, 18 nt, Escherichia coli CFT073
caauuaccuuuuuaccaa

SEQ ID NO: 626828 - RNA, 15 nt, Escherichia coli CFT073
caauuacgccugccc

SEQ ID NO: 626829 - RNA, 22 nt, Escherichia coli CFT073
caauuacgccugcccaauauac

SEQ ID NO: 626830 - RNA, 19 nt, Escherichia coli CFT073
caauuacgcggcuucaacu

SEQ ID NO: 626831 - RNA, 13 nt, Escherichia coli CFT073
caauuacuucugg

SEQ ID NO: 626832 - RNA, 15 nt, Escherichia coli CFT073
caauuagaauuauua

SEQ ID NO: 626833 - RNA, 18 nt, Escherichia coli CFT073
caauuagcuggaauaaua

SEQ ID NO: 626834 - RNA, 15 nt, Escherichia coli CFT073
caauugguaaauaag

SEQ ID NO: 626835 - RNA, 16 nt, Escherichia coli CFT073
caauugcgggccaaag

SEQ ID NO: 626836 - RNA, 18 nt, Escherichia coli CFT073
caauugcgggccaaagac

SEQ ID NO: 626837 - RNA, 20 nt, Escherichia coli CFT073
caauugcgggccaaagacca

SEQ ID NO: 626838 - RNA, 15 nt, Escherichia coli CFT073
caauugcugaaacgc

SEQ ID NO: 626839 - RNA, 14 nt, Escherichia coli CFT073
caauugcuguaaau

SEQ ID NO: 626840 - RNA, 21 nt, Escherichia coli CFT073
caauucuuuccguuuucaccc

SEQ ID NO: 626841 - RNA, 18 nt, Escherichia coli CFT073
caauugcauuugaacugg

SEQ ID NO: 626842 - RNA, 17 nt, Escherichia coli CFT073
caauugccauaaaaacg

SEQ ID NO: 626843 - RNA, 22 nt, Escherichia coli CFT073
caauugccauaaaaacgauaaa

SEQ ID NO: 626844 - RNA, 20 nt, Escherichia coli CFT073
caauugaugcuuuuugcccu

SEQ ID NO: 626845 - RNA, 22 nt, Escherichia coli CFT073
caauugcaggaagguuuuaauc

SEQ ID NO: 626846 - RNA, 14 nt, Escherichia coli CFT073
caauucuagaaacu

SEQ ID NO: 626847 - RNA, 15 nt, Escherichia coli CFT073
caauucggcuuuuuu

SEQ ID NO: 626848 - RNA, 22 nt, Escherichia coli CFT073
caauucgagcaucaucucacgc

SEQ ID NO: 626849 - RNA, 16 nt, Escherichia coli CFT073
caauuccuucugggcg

SEQ ID NO: 626850 - RNA, 14 nt, Escherichia coli CFT073
caauuccuggaacu

SEQ ID NO: 626851 - RNA, 14 nt, Escherichia coli CFT073
caauuccagcgcca

SEQ ID NO: 626852 - RNA, 16 nt, Escherichia coli CFT073
caauucccaguaccug

SEQ ID NO: 626853 - RNA, 13 nt, Escherichia coli CFT073
caauucauggugu

SEQ ID NO: 626854 - RNA, 15 nt, Escherichia coli CFT073
caauucauuccuuga

SEQ ID NO: 626855 - RNA, 14 nt, Escherichia coli CFT073
cauagacagccaca

SEQ ID NO: 626856 - RNA, 23 nt, Escherichia coli CFT073
cauagaauaaagacacugcuguu

SEQ ID NO: 626857 - RNA, 15 nt, Escherichia coli CFT073
cauagaagaaauaaa

SEQ ID NO: 626858 - RNA, 20 nt, Escherichia coli CFT073
cauagacggugacacuuugu

SEQ ID NO: 626859 - RNA, 15 nt, Escherichia coli CFT073
cauagaccauugcau

SEQ ID NO: 626860 - RNA, 18 nt, Escherichia coli CFT073
cauacacagauaaacuac

SEQ ID NO: 626861 - RNA, 13 nt, Escherichia coli CFT073
cauacacaucacg

SEQ ID NO: 626862 - RNA, 14 nt, Escherichia coli CFT073
cauacaccaccaca

SEQ ID NO: 626863 - RNA, 17 nt, Escherichia coli CFT073
cauacaccaccacauug

SEQ ID NO: 626864 - RNA, 13 nt, Escherichia coli CFT073
cauaauguuaugu

SEQ ID NO: 626865 - RNA, 23 nt, Escherichia coli CFT073
cauaauguuaugucauugccuga

SEQ ID NO: 626866 - RNA, 22 nt, Escherichia coli CFT073
cauagccggagguuuuucaaau

SEQ ID NO: 626867 - RNA, 14 nt, Escherichia coli CFT073
cauagccaccuggc

SEQ ID NO: 626868 - RNA, 16 nt, Escherichia coli CFT073
cauagcagcacaccac

SEQ ID NO: 626869 - RNA, 12 nt, Escherichia coli CFT073
cauagagauaac

SEQ ID NO: 626870 - RNA, 21 nt, Escherichia coli CFT073
cauagagauaacuggcaaaaa

SEQ ID NO: 626871 - RNA, 21 nt, Escherichia coli CFT073
cauagacuuuacuaauagcaa

SEQ ID NO: 626872 - RNA, 22 nt, Escherichia coli CFT073
cauagacuuuacuaauagcaaa

SEQ ID NO: 626873 - RNA, 23 nt, Escherichia coli CFT073
cauagcaauaaaugccuggauga

SEQ ID NO: 626874 - RNA, 23 nt, Escherichia coli CFT073
cauagauuaauuucccaccacua

SEQ ID NO: 626875 - RNA, 17 nt, Escherichia coli CFT073
cauagauaccuucuuga

SEQ ID NO: 626876 - RNA, 17 nt, Escherichia coli CFT073
cauaguacuggaagaaa

SEQ ID NO: 626877 - RNA, 18 nt, Escherichia coli CFT073
cauaguacuggaagaaaa

SEQ ID NO: 626878 - RNA, 19 nt, Escherichia coli CFT073
cauaguaggucauaucgac

SEQ ID NO: 626879 - RNA, 14 nt, Escherichia coli CFT073
cauaguauuuaucc

SEQ ID NO: 626880 - RNA, 14 nt, Escherichia coli CFT073
cauagcguaacuua

SEQ ID NO: 626881 - RNA, 16 nt, Escherichia coli CFT073
cauagcgugacaccag

SEQ ID NO: 626882 - RNA, 20 nt, Escherichia coli CFT073
cauagcuaauccccuccagc

SEQ ID NO: 626883 - RNA, 14 nt, Escherichia coli CFT073
cauauagccgccau

SEQ ID NO: 626884 - RNA, 23 nt, Escherichia coli CFT073
cauauagccgccuuuuuguugua

SEQ ID NO: 626885 - RNA, 22 nt, Escherichia coli CFT073
cauauaccgcgguucccagcgu

SEQ ID NO: 626886 - RNA, 18 nt, Escherichia coli CFT073
cauauaccgucagcgucu

SEQ ID NO: 626887 - RNA, 16 nt, Escherichia coli CFT073
cauaguccggcaccag

SEQ ID NO: 626888 - RNA, 19 nt, Escherichia coli CFT073
cauaguguguuccucugcu

SEQ ID NO: 626889 - RNA, 17 nt, Escherichia coli CFT073
caucagauuguugaucg

SEQ ID NO: 626890 - RNA, 14 nt, Escherichia coli CFT073
caucagcaacgcug

SEQ ID NO: 626891 - RNA, 18 nt, Escherichia coli CFT073
caucagcauaaucaccag

SEQ ID NO: 626892 - RNA, 19 nt, Escherichia coli CFT073
caucagcauaaucaccagu

SEQ ID NO: 626893 - RNA, 14 nt, Escherichia coli CFT073
caucagcgccuuac

SEQ ID NO: 626894 - RNA, 22 nt, Escherichia coli CFT073
caucagcgcuaccagagccgcg

SEQ ID NO: 626895 - RNA, 23 nt, Escherichia coli CFT073
caucagcaucggugaggaucacc

SEQ ID NO: 626896 - RNA, 23 nt, Escherichia coli CFT073
caucagacaccggcgcacaaccg

SEQ ID NO: 626897 - RNA, 16 nt, Escherichia coli CFT073
caucacugcaaauacc

SEQ ID NO: 626898 - RNA, 20 nt, Escherichia coli CFT073
caucacuugcucccgggcau

SEQ ID NO: 626899 - RNA, 22 nt, Escherichia coli CFT073
caucacuauucagaucuugcuc

SEQ ID NO: 626900 - RNA, 20 nt, Escherichia coli CFT073
caucacucacgacacauaaa

SEQ ID NO: 626901 - RNA, 21 nt, Escherichia coli CFT073
caucacuccaguccaccccca

SEQ ID NO: 626902 - RNA, 15 nt, Escherichia coli CFT073
caucacuccccuccu

SEQ ID NO: 626903 - RNA, 17 nt, Escherichia coli CFT073
caucacucccuuucugc

SEQ ID NO: 626904 - RNA, 19 nt, Escherichia coli CFT073
caucaccaaugacagcccc

SEQ ID NO: 626905 - RNA, 13 nt, Escherichia coli CFT073
caucaccacgccg

SEQ ID NO: 626906 - RNA, 20 nt, Escherichia coli CFT073
caucacaaaauagaaauuua

SEQ ID NO: 626907 - RNA, 17 nt, Escherichia coli CFT073
caucaauugcucacucc

SEQ ID NO: 626908 - RNA, 20 nt, Escherichia coli CFT073
caucaauugcucacucccgg

SEQ ID NO: 626909 - RNA, 19 nt, Escherichia coli CFT073
caucaauuaaugccuucaa

SEQ ID NO: 626910 - RNA, 15 nt, Escherichia coli CFT073
caucacaucccagca

SEQ ID NO: 626911 - RNA, 14 nt, Escherichia coli CFT073
caucacauccagcg

SEQ ID NO: 626912 - RNA, 14 nt, Escherichia coli CFT073
caucacaucccagc

SEQ ID NO: 626913 - RNA, 18 nt, Escherichia coli CFT073
cauauucugaucgugcuc

SEQ ID NO: 626914 - RNA, 14 nt, Escherichia coli CFT073
cauauucgccauca

SEQ ID NO: 626915 - RNA, 17 nt, Escherichia coli CFT073
cauauucgccaucagcc

SEQ ID NO: 626916 - RNA, 18 nt, Escherichia coli CFT073
cauauucgccgcccugca

SEQ ID NO: 626917 - RNA, 19 nt, Escherichia coli CFT073
cauauugaacggcaccggu

SEQ ID NO: 626918 - RNA, 16 nt, Escherichia coli CFT073
cauauugccgugcccc

SEQ ID NO: 626919 - RNA, 13 nt, Escherichia coli CFT073
cauauuuaagccu

SEQ ID NO: 626920 - RNA, 18 nt, Escherichia coli CFT073
cauauuggcaacagccau

SEQ ID NO: 626921 - RNA, 15 nt, Escherichia coli CFT073
cauauuguccuguac

SEQ ID NO: 626922 - RNA, 19 nt, Escherichia coli CFT073
cauauugucugcgccgauc

SEQ ID NO: 626923 - RNA, 18 nt, Escherichia coli CFT073
cauauuguucugaccaaa

SEQ ID NO: 626924 - RNA, 18 nt, Escherichia coli CFT073
cauaucaucaucggucag

SEQ ID NO: 626925 - RNA, 15 nt, Escherichia coli CFT073
cauauccagcgccug

SEQ ID NO: 626926 - RNA, 23 nt, Escherichia coli CFT073
cauauccagcgccugagcagcga

SEQ ID NO: 626927 - RNA, 17 nt, Escherichia coli CFT073
cauaucccaccagcgcc

SEQ ID NO: 626928 - RNA, 14 nt, Escherichia coli CFT073
cauauccgacacua

SEQ ID NO: 626929 - RNA, 17 nt, Escherichia coli CFT073
cauauucccgcaacuua

SEQ ID NO: 626930 - RNA, 15 nt, Escherichia coli CFT073
cauauuccugaccca

SEQ ID NO: 626931 - RNA, 23 nt, Escherichia coli CFT073
cauauuccugacccagcaccagu

SEQ ID NO: 626932 - RNA, 18 nt, Escherichia coli CFT073
cauaucgccauugcuggu

SEQ ID NO: 626933 - RNA, 15 nt, Escherichia coli CFT073
cauauucauagcaca

SEQ ID NO: 626934 - RNA, 23 nt, Escherichia coli CFT073
cauauucauccccgcaggucgga

SEQ ID NO: 626935 - RNA, 15 nt, Escherichia coli CFT073
caucaaaucacagca

SEQ ID NO: 626936 - RNA, 14 nt, Escherichia coli CFT073
caucaaaucacuaa

SEQ ID NO: 626937 - RNA, 15 nt, Escherichia coli CFT073
caucaaagaacagcc

SEQ ID NO: 626938 - RNA, 19 nt, Escherichia coli CFT073
caucaaauuugucgccaac

SEQ ID NO: 626939 - RNA, 17 nt, Escherichia coli CFT073
caucaaagaaaagcagu

SEQ ID NO: 626940 - RNA, 19 nt, Escherichia coli CFT073
caucaauaugaauccaggc

SEQ ID NO: 626941 - RNA, 15 nt, Escherichia coli CFT073
caucaacaauuccca

SEQ ID NO: 626942 - RNA, 14 nt, Escherichia coli CFT073
caucaacacuuugg

SEQ ID NO: 626943 - RNA, 16 nt, Escherichia coli CFT073
caucaauccugcagca

SEQ ID NO: 626944 - RNA, 17 nt, Escherichia coli CFT073
caucaaucgcucccagc

SEQ ID NO: 626945 - RNA, 15 nt, Escherichia coli CFT073
caucaauccaaacau

SEQ ID NO: 626946 - RNA, 12 nt, Escherichia coli CFT073
caucguuugggc

SEQ ID NO: 626947 - RNA, 18 nt, Escherichia coli CFT073
caucucaucaauggauuc

SEQ ID NO: 626948 - RNA, 14 nt, Escherichia coli CFT073
caucuccagcugcu

SEQ ID NO: 626949 - RNA, 19 nt, Escherichia coli CFT073
caucguuaaaaaacagugc

SEQ ID NO: 626950 - RNA, 20 nt, Escherichia coli CFT073
caucgugcuucacuucagcg

SEQ ID NO: 626951 - RNA, 14 nt, Escherichia coli CFT073
caucguggaugaaa

SEQ ID NO: 626952 - RNA, 14 nt, Escherichia coli CFT073
caucgucuccagcg

SEQ ID NO: 626953 - RNA, 17 nt, Escherichia coli CFT073
caucgucuccagcgaau

SEQ ID NO: 626954 - RNA, 13 nt, Escherichia coli CFT073
caucgugcaccaa

SEQ ID NO: 626955 - RNA, 14 nt, Escherichia coli CFT073
caucgugcaccaau

SEQ ID NO: 626956 - RNA, 19 nt, Escherichia coli CFT073
caucguagacauaaccggu

SEQ ID NO: 626957 - RNA, 21 nt, Escherichia coli CFT073
caucguaguuuuugcccauca

SEQ ID NO: 626958 - RNA, 16 nt, Escherichia coli CFT073
caucguauuucagacc

SEQ ID NO: 626959 - RNA, 13 nt, Escherichia coli CFT073
caucggccugcaa

SEQ ID NO: 626960 - RNA, 13 nt, Escherichia coli CFT073
caucggcaucaaa

SEQ ID NO: 626961 - RNA, 15 nt, Escherichia coli CFT073
caucggcauuaaucu

SEQ ID NO: 626962 - RNA, 16 nt, Escherichia coli CFT073
caucggcagcgccaau

SEQ ID NO: 626963 - RNA, 15 nt, Escherichia coli CFT073
caucggcaccgccag

SEQ ID NO: 626964 - RNA, 19 nt, Escherichia coli CFT073
caucggcaauuuaccgccg

SEQ ID NO: 626965 - RNA, 18 nt, Escherichia coli CFT073
caucgauuuacugccaau

SEQ ID NO: 626966 - RNA, 12 nt, Escherichia coli CFT073
caucgaugcugc

SEQ ID NO: 626967 - RNA, 14 nt, Escherichia coli CFT073
cauccuguggcuuu

SEQ ID NO: 626968 - RNA, 21 nt, Escherichia coli CFT073
cauccuguggcuuuuuuguag

SEQ ID NO: 626969 - RNA, 14 nt, Escherichia coli CFT073
caucgauccccugc

SEQ ID NO: 626970 - RNA, 12 nt, Escherichia coli CFT073
cauccugcugca

SEQ ID NO: 626971 - RNA, 21 nt, Escherichia coli CFT073
cauccuggggauucaucacca

SEQ ID NO: 626972 - RNA, 18 nt, Escherichia coli CFT073
cauccugcggcagcucca

SEQ ID NO: 626973 - RNA, 21 nt, Escherichia coli CFT073
cauccugcggcagcuccagca

SEQ ID NO: 626974 - RNA, 14 nt, Escherichia coli CFT073
cauccugcucaagu

SEQ ID NO: 626975 - RNA, 15 nt, Escherichia coli CFT073
caucgcaucaaaguu

SEQ ID NO: 626976 - RNA, 15 nt, Escherichia coli CFT073
caucgcaucuucgcc

SEQ ID NO: 626977 - RNA, 22 nt, Escherichia coli CFT073
caucgcauguugauuaccuguc

SEQ ID NO: 626978 - RNA, 19 nt, Escherichia coli CFT073
caucgcaaaccagacgcgc

SEQ ID NO: 626979 - RNA, 16 nt, Escherichia coli CFT073
caucgauuuugcaaua

SEQ ID NO: 626980 - RNA, 17 nt, Escherichia coli CFT073
caucgcaacgcaucuuu

SEQ ID NO: 626981 - RNA, 21 nt, Escherichia coli CFT073
caucgcaacgcaucuuuuuca

SEQ ID NO: 626982 - RNA, 13 nt, Escherichia coli CFT073
caucgccaccgcg

SEQ ID NO: 626983 - RNA, 22 nt, Escherichia coli CFT073
caucgccacugcaaauuuuaac

SEQ ID NO: 626984 - RNA, 17 nt, Escherichia coli CFT073
caucgccagagaagaaa

SEQ ID NO: 626985 - RNA, 19 nt, Escherichia coli CFT073
caucgcccucuuucaccag

SEQ ID NO: 626986 - RNA, 17 nt, Escherichia coli CFT073
caucgccgguuuugcca

SEQ ID NO: 626987 - RNA, 20 nt, Escherichia coli CFT073
caucgcuuuccagguggugc

SEQ ID NO: 626988 - RNA, 20 nt, Escherichia coli CFT073
caucgcuuugugcucuuccu

SEQ ID NO: 626989 - RNA, 17 nt, Escherichia coli CFT073
caucgcucccaaaccgc

SEQ ID NO: 626990 - RNA, 15 nt, Escherichia coli CFT073
caucgcugugcugcu

SEQ ID NO: 626991 - RNA, 16 nt, Escherichia coli CFT073
caucgcuuaacccaaa

SEQ ID NO: 626992 - RNA, 21 nt, Escherichia coli CFT073
cauccgcaucacgaccgcuuc

SEQ ID NO: 626993 - RNA, 19 nt, Escherichia coli CFT073
cauccggcaacaucaaauc

SEQ ID NO: 626994 - RNA, 21 nt, Escherichia coli CFT073
cauccggcaaucggugcuggc

SEQ ID NO: 626995 - RNA, 15 nt, Escherichia coli CFT073
cauccggcagcaaau

SEQ ID NO: 626996 - RNA, 22 nt, Escherichia coli CFT073
cauccugccaggaccgcugaaa

SEQ ID NO: 626997 - RNA, 18 nt, Escherichia coli CFT073
cauccugccaugcgcaau

SEQ ID NO: 626998 - RNA, 17 nt, Escherichia coli CFT073
cauccggcgacaggaac

SEQ ID NO: 626999 - RNA, 15 nt, Escherichia coli CFT073
caucccuucaauuau

SEQ ID NO: 627000 - RNA, 21 nt, Escherichia coli CFT073
caucccuucguaaacgcgaag

SEQ ID NO: 627001 - RNA, 16 nt, Escherichia coli CFT073
cauccgaacgcugaca

SEQ ID NO: 627002 - RNA, 23 nt, Escherichia coli CFT073
cauccgaacgcugacaaacugcg

SEQ ID NO: 627003 - RNA, 18 nt, Escherichia coli CFT073
caucccuuucgccugcaa

SEQ ID NO: 627004 - RNA, 15 nt, Escherichia coli CFT073
cauccgacaaaauga

SEQ ID NO: 627005 - RNA, 13 nt, Escherichia coli CFT073
cauccgacaaaug

SEQ ID NO: 627006 - RNA, 15 nt, Escherichia coli CFT073
cauccgacacuggca

SEQ ID NO: 627007 - RNA, 13 nt, Escherichia coli CFT073
cauccccucuucc

SEQ ID NO: 627008 - RNA, 14 nt, Escherichia coli CFT073
cauccccucuucca

SEQ ID NO: 627009 - RNA, 14 nt, Escherichia coli CFT073
cauccccaucgccg

SEQ ID NO: 627010 - RNA, 16 nt, Escherichia coli CFT073
caucccggcaaacucu

SEQ ID NO: 627011 - RNA, 15 nt, Escherichia coli CFT073
caucccggcaaccgc

SEQ ID NO: 627012 - RNA, 15 nt, Escherichia coli CFT073
caucccaggcaucca

SEQ ID NO: 627013 - RNA, 20 nt, Escherichia coli CFT073
cauccccaaaaaaucaacga

SEQ ID NO: 627014 - RNA, 19 nt, Escherichia coli CFT073
caucccauugcgugcagaa

SEQ ID NO: 627015 - RNA, 22 nt, Escherichia coli CFT073
cauccauucuugcgcggauggc

SEQ ID NO: 627016 - RNA, 16 nt, Escherichia coli CFT073
cauccauuacaucacg

SEQ ID NO: 627017 - RNA, 14 nt, Escherichia coli CFT073
cauccaugcggcag

SEQ ID NO: 627018 - RNA, 16 nt, Escherichia coli CFT073
cauccaugcuuguuua

SEQ ID NO: 627019 - RNA, 14 nt, Escherichia coli CFT073
cauccaucugcuuu

SEQ ID NO: 627020 - RNA, 19 nt, Escherichia coli CFT073
cauccaucggcgcuucaau

SEQ ID NO: 627021 - RNA, 14 nt, Escherichia coli CFT073
cauccagugaaaug

SEQ ID NO: 627022 - RNA, 17 nt, Escherichia coli CFT073
cauccaguuccacaccu

SEQ ID NO: 627023 - RNA, 14 nt, Escherichia coli CFT073
cauccaggguuuua

SEQ ID NO: 627024 - RNA, 20 nt, Escherichia coli CFT073
cauccaggugaaaaauaaaa

SEQ ID NO: 627025 - RNA, 18 nt, Escherichia coli CFT073
cauccaguauauugcuga

SEQ ID NO: 627026 - RNA, 14 nt, Escherichia coli CFT073
cauccaggcaaagu

SEQ ID NO: 627027 - RNA, 20 nt, Escherichia coli CFT073
cauccagcuuuuagaucacu

SEQ ID NO: 627028 - RNA, 20 nt, Escherichia coli CFT073
cauccagcagcccuugcuuc

SEQ ID NO: 627029 - RNA, 22 nt, Escherichia coli CFT073
cauccagcaguggaucgaacuc

SEQ ID NO: 627030 - RNA, 19 nt, Escherichia coli CFT073
cauccagccuggaauuucu

SEQ ID NO: 627031 - RNA, 18 nt, Escherichia coli CFT073
cauccagcgcacgggcag

SEQ ID NO: 627032 - RNA, 16 nt, Escherichia coli CFT073
cauccagcguucuauc

SEQ ID NO: 627033 - RNA, 22 nt, Escherichia coli CFT073
cauccagcguucuaucagggcu

SEQ ID NO: 627034 - RNA, 20 nt, Escherichia coli CFT073
cauccagcaacaacagcgcg

SEQ ID NO: 627035 - RNA, 13 nt, Escherichia coli CFT073
cauccagcagccc

SEQ ID NO: 627036 - RNA, 14 nt, Escherichia coli CFT073
cauccagcagcccu

SEQ ID NO: 627037 - RNA, 23 nt, Escherichia coli CFT073
cauccaagcugguggcaaucgcg

SEQ ID NO: 627038 - RNA, 16 nt, Escherichia coli CFT073
caucauucaaugcuca

SEQ ID NO: 627039 - RNA, 11 nt, Escherichia coli CFT073
caucaggcaac

SEQ ID NO: 627040 - RNA, 21 nt, Escherichia coli CFT073
caucaggcaaugggcaaacgc

SEQ ID NO: 627041 - RNA, 19 nt, Escherichia coli CFT073
caucaugcggauuaauaag

SEQ ID NO: 627042 - RNA, 18 nt, Escherichia coli CFT073
caucaugcgucaccagca

SEQ ID NO: 627043 - RNA, 12 nt, Escherichia coli CFT073
caucauuaacug

SEQ ID NO: 627044 - RNA, 19 nt, Escherichia coli CFT073
caucagcggcgaagccuaa

SEQ ID NO: 627045 - RNA, 21 nt, Escherichia coli CFT073
caucagcggguuuucuacuuu

SEQ ID NO: 627046 - RNA, 23 nt, Escherichia coli CFT073
cauuuaugaugagaacuccuggc

SEQ ID NO: 627047 - RNA, 14 nt, Escherichia coli CFT073
cauuuauuucucac

SEQ ID NO: 627048 - RNA, 19 nt, Escherichia coli CFT073
cauuuauuugacauuuuuu

SEQ ID NO: 627049 - RNA, 21 nt, Escherichia coli CFT073
cauuucggguguacauaaccg

SEQ ID NO: 627050 - RNA, 19 nt, Escherichia coli CFT073
cauuucgauauagccgccu

SEQ ID NO: 627051 - RNA, 14 nt, Escherichia coli CFT073
cauuuccucaacau

SEQ ID NO: 627052 - RNA, 19 nt, Escherichia coli CFT073
cauuuccucaacaucuuca

SEQ ID NO: 627053 - RNA, 19 nt, Escherichia coli CFT073
cauuucccagcaagaacca

SEQ ID NO: 627054 - RNA, 18 nt, Escherichia coli CFT073
cauuuccccaaucuucuc

SEQ ID NO: 627055 - RNA, 14 nt, Escherichia coli CFT073
cauuucccaacagu

SEQ ID NO: 627056 - RNA, 21 nt, Escherichia coli CFT073
cauuuccgcugauucaagauu

SEQ ID NO: 627057 - RNA, 17 nt, Escherichia coli CFT073
cauuuccgcugauucaa

SEQ ID NO: 627058 - RNA, 12 nt, Escherichia coli CFT073
cauuucaucccc

SEQ ID NO: 627059 - RNA, 16 nt, Escherichia coli CFT073
cauuucauucacgccg

SEQ ID NO: 627060 - RNA, 18 nt, Escherichia coli CFT073
cauucggcauugaauaua

SEQ ID NO: 627061 - RNA, 20 nt, Escherichia coli CFT073
cauucggcguuaacaauaac

SEQ ID NO: 627062 - RNA, 23 nt, Escherichia coli CFT073
cauucguaaugaauguuuuccug

SEQ ID NO: 627063 - RNA, 13 nt, Escherichia coli CFT073
cauucuuucccag

SEQ ID NO: 627064 - RNA, 22 nt, Escherichia coli CFT073
cauucuuucuucccguuuucag

SEQ ID NO: 627065 - RNA, 13 nt, Escherichia coli CFT073
cauugaaaucaaa

SEQ ID NO: 627066 - RNA, 13 nt, Escherichia coli CFT073
cauugccagaaac

SEQ ID NO: 627067 - RNA, 22 nt, Escherichia coli CFT073
cauugccagugguacaaaagca

SEQ ID NO: 627068 - RNA, 15 nt, Escherichia coli CFT073
cauugcccaauacug

SEQ ID NO: 627069 - RNA, 22 nt, Escherichia coli CFT073
cauugguccgauuguacuuuaa

SEQ ID NO: 627070 - RNA, 21 nt, Escherichia coli CFT073
cauuggucuggauggcuugcu

SEQ ID NO: 627071 - RNA, 18 nt, Escherichia coli CFT073
cauugguuucacccaguc

SEQ ID NO: 627072 - RNA, 19 nt, Escherichia coli CFT073
cauugggccacucaacauc

SEQ ID NO: 627073 - RNA, 22 nt, Escherichia coli CFT073
cauuggccggaauaccacuuuc

SEQ ID NO: 627074 - RNA, 15 nt, Escherichia coli CFT073
cauugcuaucaacaa

SEQ ID NO: 627075 - RNA, 20 nt, Escherichia coli CFT073
cauugcuauuucccccuccc

SEQ ID NO: 627076 - RNA, 16 nt, Escherichia coli CFT073
cauugcucucuucucc

SEQ ID NO: 627077 - RNA, 14 nt, Escherichia coli CFT073
cauugcucuuucac

SEQ ID NO: 627078 - RNA, 18 nt, Escherichia coli CFT073
cauugcucuuucacuuua

SEQ ID NO: 627079 - RNA, 19 nt, Escherichia coli CFT073
cauugcugaugcaccuuca

SEQ ID NO: 627080 - RNA, 18 nt, Escherichia coli CFT073
cauugcugccagaaaucg

SEQ ID NO: 627081 - RNA, 18 nt, Escherichia coli CFT073
cauugcggaugcgcugcu

SEQ ID NO: 627082 - RNA, 18 nt, Escherichia coli CFT073
cauugcuaaugcagguac

SEQ ID NO: 627083 - RNA, 14 nt, Escherichia coli CFT073
cauuccuuuacuua

SEQ ID NO: 627084 - RNA, 14 nt, Escherichia coli CFT073
cauuccuaaaccau

SEQ ID NO: 627085 - RNA, 14 nt, Escherichia coli CFT073
cauucgcagcugca

SEQ ID NO: 627086 - RNA, 21 nt, Escherichia coli CFT073
cauucgcagcugcaguaccag

SEQ ID NO: 627087 - RNA, 18 nt, Escherichia coli CFT073
cauucgccguuaccagca

SEQ ID NO: 627088 - RNA, 21 nt, Escherichia coli CFT073
cauucgccguuaccagcaccg

SEQ ID NO: 627089 - RNA, 20 nt, Escherichia coli CFT073
cauucgcgcacgaggaacag

SEQ ID NO: 627090 - RNA, 22 nt, Escherichia coli CFT073
cauuccgcccagaccgugcgca

SEQ ID NO: 627091 - RNA, 19 nt, Escherichia coli CFT073
cauuccguagcguuuuuuc

SEQ ID NO: 627092 - RNA, 18 nt, Escherichia coli CFT073
cauucccuacgcgauaaa

SEQ ID NO: 627093 - RNA, 20 nt, Escherichia coli CFT073
cauucccgguuucaggauga

SEQ ID NO: 627094 - RNA, 16 nt, Escherichia coli CFT073
cauucccauaccuuuc

SEQ ID NO: 627095 - RNA, 18 nt, Escherichia coli CFT073
cauucaucacgcacugca

SEQ ID NO: 627096 - RNA, 18 nt, Escherichia coli CFT073
cauucaugcgaauacagc

SEQ ID NO: 627097 - RNA, 20 nt, Escherichia coli CFT073
cauucaugcgaauacagccc

SEQ ID NO: 627098 - RNA, 21 nt, Escherichia coli CFT073
cauuccaguccacaucaacca

SEQ ID NO: 627099 - RNA, 17 nt, Escherichia coli CFT073
cauuccacaaaaaccac

SEQ ID NO: 627100 - RNA, 18 nt, Escherichia coli CFT073
cauuccaccauacagacc

SEQ ID NO: 627101 - RNA, 15 nt, Escherichia coli CFT073
cauucagauucaaau

SEQ ID NO: 627102 - RNA, 16 nt, Escherichia coli CFT073
cauucagauucaaauc

SEQ ID NO: 627103 - RNA, 22 nt, Escherichia coli CFT073
cauucagcaauaacuccccuuc

SEQ ID NO: 627104 - RNA, 17 nt, Escherichia coli CFT073
cauucagcauggaauag

SEQ ID NO: 627105 - RNA, 21 nt, Escherichia coli CFT073
cauucaggccgccgucaucac

SEQ ID NO: 627106 - RNA, 20 nt, Escherichia coli CFT073
cauucauauacucgcauaau

SEQ ID NO: 627107 - RNA, 13 nt, Escherichia coli CFT073
cauucaucacaaa

SEQ ID NO: 627108 - RNA, 19 nt, Escherichia coli CFT073
cauucaucacaaaauagaa

SEQ ID NO: 627109 - RNA, 16 nt, Escherichia coli CFT073
cauucaucgccuucuu

SEQ ID NO: 627110 - RNA, 16 nt, Escherichia coli CFT073
cauucacaaaaacagu

SEQ ID NO: 627111 - RNA, 17 nt, Escherichia coli CFT073
cauucaacauauccagc

SEQ ID NO: 627112 - RNA, 19 nt, Escherichia coli CFT073
cauucaacuuaagucucca

SEQ ID NO: 627113 - RNA, 21 nt, Escherichia coli CFT073
cauucaacuuaagucuccauu

SEQ ID NO: 627114 - RNA, 14 nt, Escherichia coli CFT073
cauuaucaaagaug

SEQ ID NO: 627115 - RNA, 18 nt, Escherichia coli CFT073
cauuauggcgcaguugcc

SEQ ID NO: 627116 - RNA, 15 nt, Escherichia coli CFT073
cauuauucaggcacu

SEQ ID NO: 627117 - RNA, 17 nt, Escherichia coli CFT073
cauuauuaaacaggcag

SEQ ID NO: 627118 - RNA, 14 nt, Escherichia coli CFT073
cauguuauucaugc

SEQ ID NO: 627119 - RNA, 13 nt, Escherichia coli CFT073
cauuaccucaaua

SEQ ID NO: 627120 - RNA, 17 nt, Escherichia coli CFT073
cauguucagucacuuca

SEQ ID NO: 627121 - RNA, 17 nt, Escherichia coli CFT073
cauguucauaucaaaac

SEQ ID NO: 627122 - RNA, 18 nt, Escherichia coli CFT073
cauuacgcgccucuucca

SEQ ID NO: 627123 - RNA, 23 nt, Escherichia coli CFT073
cauuacgcgcuggguuaaacagc

SEQ ID NO: 627124 - RNA, 23 nt, Escherichia coli CFT073
cauuacgcucgcugcaaaacagg

SEQ ID NO: 627125 - RNA, 15 nt, Escherichia coli CFT073
cauuacgaucaagaa

SEQ ID NO: 627126 - RNA, 20 nt, Escherichia coli CFT073
cauuaccuucaauacuggca

SEQ ID NO: 627127 - RNA, 14 nt, Escherichia coli CFT073
cauuacgaaaccac

SEQ ID NO: 627128 - RNA, 17 nt, Escherichia coli CFT073
cauuacugguucguuua

SEQ ID NO: 627129 - RNA, 16 nt, Escherichia coli CFT073
cauuacuaauuaauaa

SEQ ID NO: 627130 - RNA, 23 nt, Escherichia coli CFT073
cauuacuaauuaauaauauaaau

SEQ ID NO: 627131 - RNA, 18 nt, Escherichia coli CFT073
cauuagugcgcaguugcc

SEQ ID NO: 627132 - RNA, 19 nt, Escherichia coli CFT073
caugcugcggcuguccggc

SEQ ID NO: 627133 - RNA, 16 nt, Escherichia coli CFT073
caugcuuaaauauuuu

SEQ ID NO: 627134 - RNA, 12 nt, Escherichia coli CFT073
caugcuuaacac

SEQ ID NO: 627135 - RNA, 20 nt, Escherichia coli CFT073
caugcugagcuucuucaaaa

SEQ ID NO: 627136 - RNA, 22 nt, Escherichia coli CFT073
cauggcgaaaauuggcagacca

SEQ ID NO: 627137 - RNA, 17 nt, Escherichia coli CFT073
caugccagaaaaggagu

SEQ ID NO: 627138 - RNA, 17 nt, Escherichia coli CFT073
caugccaguuucuuuua

SEQ ID NO: 627139 - RNA, 16 nt, Escherichia coli CFT073
caugccaucacaccuc

SEQ ID NO: 627140 - RNA, 16 nt, Escherichia coli CFT073
caugccaucugccagc

SEQ ID NO: 627141 - RNA, 13 nt, Escherichia coli CFT073
caugcuauuccuu

SEQ ID NO: 627142 - RNA, 13 nt, Escherichia coli CFT073
caugcucaccaau

SEQ ID NO: 627143 - RNA, 14 nt, Escherichia coli CFT073
caugcucaccaauc

SEQ ID NO: 627144 - RNA, 17 nt, Escherichia coli CFT073
caugccggccagcgcca

SEQ ID NO: 627145 - RNA, 17 nt, Escherichia coli CFT073
caugccgccaccaccag

SEQ ID NO: 627146 - RNA, 13 nt, Escherichia coli CFT073
caugucaguugca

SEQ ID NO: 627147 - RNA, 11 nt, Escherichia coli CFT073
caugucaucaa

SEQ ID NO: 627148 - RNA, 21 nt, Escherichia coli CFT073
caugucagagcuguagauaua

SEQ ID NO: 627149 - RNA, 20 nt, Escherichia coli CFT073
cauguacgcguucaaucaaa

SEQ ID NO: 627150 - RNA, 17 nt, Escherichia coli CFT073
cauggcgugacauggcg

SEQ ID NO: 627151 - RNA, 12 nt, Escherichia coli CFT073
cauggcgcggca

SEQ ID NO: 627152 - RNA, 18 nt, Escherichia coli CFT073
caugguuugcauccacaa

SEQ ID NO: 627153 - RNA, 17 nt, Escherichia coli CFT073
cauggcguuuuucccaa

SEQ ID NO: 627154 - RNA, 15 nt, Escherichia coli CFT073
caugaucguuaaauc

SEQ ID NO: 627155 - RNA, 18 nt, Escherichia coli CFT073
caugaucauucaccagcc

SEQ ID NO: 627156 - RNA, 21 nt, Escherichia coli CFT073
caugaucauucaccagcccac

SEQ ID NO: 627157 - RNA, 14 nt, Escherichia coli CFT073
caugauacucagca

SEQ ID NO: 627158 - RNA, 18 nt, Escherichia coli CFT073
caugauaccgauuacuca

SEQ ID NO: 627159 - RNA, 23 nt, Escherichia coli CFT073
caugagccgcuugugccaccagc

SEQ ID NO: 627160 - RNA, 22 nt, Escherichia coli CFT073
caugcaggucguuuuccugcau

SEQ ID NO: 627161 - RNA, 18 nt, Escherichia coli CFT073
caugccaaagaaggaagg

SEQ ID NO: 627162 - RNA, 16 nt, Escherichia coli CFT073
caugcaucgguuuugc

SEQ ID NO: 627163 - RNA, 23 nt, Escherichia coli CFT073
caugcagggcaaacuccgagaga

SEQ ID NO: 627164 - RNA, 17 nt, Escherichia coli CFT073
caugcaggcaugcaaua

SEQ ID NO: 627165 - RNA, 14 nt, Escherichia coli CFT073
caugcagcaugggu

SEQ ID NO: 627166 - RNA, 23 nt, Escherichia coli CFT073
caugaugcgcggcuccagaauau

SEQ ID NO: 627167 - RNA, 22 nt, Escherichia coli CFT073
caugaugagcgccauaucggca

SEQ ID NO: 627168 - RNA, 18 nt, Escherichia coli CFT073
caugaugauaucacuggu

SEQ ID NO: 627169 - RNA, 13 nt, Escherichia coli CFT073
caugauuccccag

SEQ ID NO: 627170 - RNA, 14 nt, Escherichia coli CFT073
caugauuaccagca

SEQ ID NO: 627171 - RNA, 20 nt, Escherichia coli CFT073
caucucggauaaggcuuccu

SEQ ID NO: 627172 - RNA, 20 nt, Escherichia coli CFT073
caucucugcaacgucuuccc

SEQ ID NO: 627173 - RNA, 20 nt, Escherichia coli CFT073
caucucuggcggcaaaccuu

SEQ ID NO: 627174 - RNA, 14 nt, Escherichia coli CFT073
caucucuucaauau

SEQ ID NO: 627175 - RNA, 13 nt, Escherichia coli CFT073
caucucuucccac

SEQ ID NO: 627176 - RNA, 14 nt, Escherichia coli CFT073
caucucuucuucaa

SEQ ID NO: 627177 - RNA, 15 nt, Escherichia coli CFT073
caugaacauugcugc

SEQ ID NO: 627178 - RNA, 19 nt, Escherichia coli CFT073
caugaagcugacaggcgcu

SEQ ID NO: 627179 - RNA, 19 nt, Escherichia coli CFT073
caugaagcaaugauaaguc

SEQ ID NO: 627180 - RNA, 22 nt, Escherichia coli CFT073
caugaagcacggcaucaaugcc

SEQ ID NO: 627181 - RNA, 24 nt, Escherichia coli CFT073
caugaagauggucuguaccaccag

SEQ ID NO: 627182 - RNA, 17 nt, Escherichia coli CFT073
caugaauaaaaaaacuu

SEQ ID NO: 627183 - RNA, 13 nt, Escherichia coli CFT073
caugaauaucaag

SEQ ID NO: 627184 - RNA, 15 nt, Escherichia coli CFT073
caugaccgugaucgu

SEQ ID NO: 627185 - RNA, 18 nt, Escherichia coli CFT073
caugaccgcuccgccauc

SEQ ID NO: 627186 - RNA, 24 nt, Escherichia coli CFT073
caugaccgaucaaggcauauacca

SEQ ID NO: 627187 - RNA, 16 nt, Escherichia coli CFT073
caugacaggcaaccgg

SEQ ID NO: 627188 - RNA, 14 nt, Escherichia coli CFT073
caugacauccccau

SEQ ID NO: 627189 - RNA, 14 nt, Escherichia coli CFT073
caugaccaccgcag

SEQ ID NO: 627190 - RNA, 15 nt, Escherichia coli CFT073
caugaauucgacuuu

SEQ ID NO: 627191 - RNA, 18 nt, Escherichia coli CFT073
caugaauucgacuuucuc

SEQ ID NO: 627192 - RNA, 19 nt, Escherichia coli CFT073
caugacacacucugaccug

SEQ ID NO: 627193 - RNA, 23 nt, Escherichia coli CFT073
caguuucccaagaugcggggauu

SEQ ID NO: 627194 - RNA, 22 nt, Escherichia coli CFT073
caguuucaugauauguuuuaaa

SEQ ID NO: 627195 - RNA, 21 nt, Escherichia coli CFT073
caguuucagagcgaauuaaga

SEQ ID NO: 627196 - RNA, 14 nt, Escherichia coli CFT073
caguucgucacagu

SEQ ID NO: 627197 - RNA, 16 nt, Escherichia coli CFT073
caguucgucacaguua

SEQ ID NO: 627198 - RNA, 17 nt, Escherichia coli CFT073
caguucguucaguugcg

SEQ ID NO: 627199 - RNA, 18 nt, Escherichia coli CFT073
caguucguucaguugcgu

SEQ ID NO: 627200 - RNA, 14 nt, Escherichia coli CFT073
caguuugcugacaa

SEQ ID NO: 627201 - RNA, 16 nt, Escherichia coli CFT073
caguuugcugcuguua

SEQ ID NO: 627202 - RNA, 21 nt, Escherichia coli CFT073
caguuuguuaugcgaaauagc

SEQ ID NO: 627203 - RNA, 19 nt, Escherichia coli CFT073
caguuugagauugaagaua

SEQ ID NO: 627204 - RNA, 17 nt, Escherichia coli CFT073
caguuucgucaacuucu

SEQ ID NO: 627205 - RNA, 17 nt, Escherichia coli CFT073
caguuucgacaccuuca

SEQ ID NO: 627206 - RNA, 21 nt, Escherichia coli CFT073
caguuucgaucagcaauuucu

SEQ ID NO: 627207 - RNA, 20 nt, Escherichia coli CFT073
caguuucgcauccagagauu

SEQ ID NO: 627208 - RNA, 12 nt, Escherichia coli CFT073
cauaaaaucaau

SEQ ID NO: 627209 - RNA, 15 nt, Escherichia coli CFT073
cauaaagcccgcuuc

SEQ ID NO: 627210 - RNA, 22 nt, Escherichia coli CFT073
cauaaagcccgcuucaaacgcu

SEQ ID NO: 627211 - RNA, 17 nt, Escherichia coli CFT073
cauaaagcgguuuucaa

SEQ ID NO: 627212 - RNA, 18 nt, Escherichia coli CFT073
cauaaagcgguuuucaaa

SEQ ID NO: 627213 - RNA, 16 nt, Escherichia coli CFT073
cauaaaagggcagcag

SEQ ID NO: 627214 - RNA, 19 nt, Escherichia coli CFT073
cauaaaagggcagcaggau

SEQ ID NO: 627215 - RNA, 21 nt, Escherichia coli CFT073
caguuuucauauaccgcauca

SEQ ID NO: 627216 - RNA, 11 nt, Escherichia coli CFT073
caguuuuccau

SEQ ID NO: 627217 - RNA, 17 nt, Escherichia coli CFT073
caguuuuuccccugcca

SEQ ID NO: 627218 - RNA, 17 nt, Escherichia coli CFT073
caguuuuugcuucugaa

SEQ ID NO: 627219 - RNA, 23 nt, Escherichia coli CFT073
cauaauaaccucaugguuuuuau

SEQ ID NO: 627220 - RNA, 16 nt, Escherichia coli CFT073
cauaauaaucuacuaa

SEQ ID NO: 627221 - RNA, 21 nt, Escherichia coli CFT073
cauaauaaucuacuaauaaau

SEQ ID NO: 627222 - RNA, 14 nt, Escherichia coli CFT073
cauaaggugggagg

SEQ ID NO: 627223 - RNA, 18 nt, Escherichia coli CFT073
cauaaguaguuguucaga

SEQ ID NO: 627224 - RNA, 12 nt, Escherichia coli CFT073
cauaauccacuu

SEQ ID NO: 627225 - RNA, 13 nt, Escherichia coli CFT073
cauaauccagguu

SEQ ID NO: 627226 - RNA, 18 nt, Escherichia coli CFT073
cauaaucacucuuccccg

SEQ ID NO: 627227 - RNA, 14 nt, Escherichia coli CFT073
cauaaugcaaaaug

SEQ ID NO: 627228 - RNA, 16 nt, Escherichia coli CFT073
cauaaugccccagcgc

SEQ ID NO: 627229 - RNA, 13 nt, Escherichia coli CFT073
cauaaugccugca

SEQ ID NO: 627230 - RNA, 14 nt, Escherichia coli CFT073
cauaauauaaggag

SEQ ID NO: 627231 - RNA, 23 nt, Escherichia coli CFT073
cauaauaucuuuccuuaacaaaa

SEQ ID NO: 627232 - RNA, 20 nt, Escherichia coli CFT073
cauaaucaccaucagcagca

SEQ ID NO: 627233 - RNA, 15 nt, Escherichia coli CFT073
cauaaauacagagca

SEQ ID NO: 627234 - RNA, 23 nt, Escherichia coli CFT073
cauaagcaccgaacaagaaacag

SEQ ID NO: 627235 - RNA, 18 nt, Escherichia coli CFT073
cagugcccgaccacuuca

SEQ ID NO: 627236 - RNA, 13 nt, Escherichia coli CFT073
cagugccgauggu

SEQ ID NO: 627237 - RNA, 12 nt, Escherichia coli CFT073
cagugccgcgcc

SEQ ID NO: 627238 - RNA, 15 nt, Escherichia coli CFT073
cagugccgcgccgcg

SEQ ID NO: 627239 - RNA, 23 nt, Escherichia coli CFT073
cagugccucguucacauauugca

SEQ ID NO: 627240 - RNA, 12 nt, Escherichia coli CFT073
cagugccuggcg

SEQ ID NO: 627241 - RNA, 18 nt, Escherichia coli CFT073
cagugccuggcgaaagga

SEQ ID NO: 627242 - RNA, 20 nt, Escherichia coli CFT073
caguggcuuaucuuccuguu

SEQ ID NO: 627243 - RNA, 23 nt, Escherichia coli CFT073
caguggucaaauuucuucagcca

SEQ ID NO: 627244 - RNA, 20 nt, Escherichia coli CFT073
cagugcuccaccuugcggaa

SEQ ID NO: 627245 - RNA, 22 nt, Escherichia coli CFT073
cagugcggcuguuggugccaga

SEQ ID NO: 627246 - RNA, 16 nt, Escherichia coli CFT073
caguggcggcauugac

SEQ ID NO: 627247 - RNA, 21 nt, Escherichia coli CFT073
caguccguggcacgguaaacu

SEQ ID NO: 627248 - RNA, 20 nt, Escherichia coli CFT073
cagugaucgugugccaccag

SEQ ID NO: 627249 - RNA, 23 nt, Escherichia coli CFT073
cagugauuguccuauuggagaau

SEQ ID NO: 627250 - RNA, 14 nt, Escherichia coli CFT073
cagugauuuauuuu

SEQ ID NO: 627251 - RNA, 16 nt, Escherichia coli CFT073
cagugcaacagagagc

SEQ ID NO: 627252 - RNA, 18 nt, Escherichia coli CFT073
cagugcaaucagcggcgu

SEQ ID NO: 627253 - RNA, 13 nt, Escherichia coli CFT073
cagugccauccca

SEQ ID NO: 627254 - RNA, 16 nt, Escherichia coli CFT073
cagugccccaaauguc

SEQ ID NO: 627255 - RNA, 21 nt, Escherichia coli CFT073
caguccgcucgccgcagagau

SEQ ID NO: 627256 - RNA, 19 nt, Escherichia coli CFT073
cagucccugaaugucucca

SEQ ID NO: 627257 - RNA, 23 nt, Escherichia coli CFT073
cagucccugcucuuucagcaccg

SEQ ID NO: 627258 - RNA, 19 nt, Escherichia coli CFT073
caguuaucaaauucauugc

SEQ ID NO: 627259 - RNA, 22 nt, Escherichia coli CFT073
caguuaucgcauuaucaaagau

SEQ ID NO: 627260 - RNA, 14 nt, Escherichia coli CFT073
caguuagcuuuucu

SEQ ID NO: 627261 - RNA, 21 nt, Escherichia coli CFT073
caguuaagcaacugacuggcu

SEQ ID NO: 627262 - RNA, 22 nt, Escherichia coli CFT073
caguucaggcugaggcguuuca

SEQ ID NO: 627263 - RNA, 12 nt, Escherichia coli CFT073
caguucagucag

SEQ ID NO: 627264 - RNA, 21 nt, Escherichia coli CFT073
caguucagcaacacuacaccc

SEQ ID NO: 627265 - RNA, 21 nt, Escherichia coli CFT073
caguucaaagcguggugagac

SEQ ID NO: 627266 - RNA, 18 nt, Escherichia coli CFT073
caguucacagcgcagauu

SEQ ID NO: 627267 - RNA, 19 nt, Escherichia coli CFT073
caguucacagcgcagauua

SEQ ID NO: 627268 - RNA, 21 nt, Escherichia coli CFT073
caguucaccaccuggcggcgu

SEQ ID NO: 627269 - RNA, 21 nt, Escherichia coli CFT073
caguuccuuaacuucaucggc

SEQ ID NO: 627270 - RNA, 19 nt, Escherichia coli CFT073
caguucgccuuccagcagc

SEQ ID NO: 627271 - RNA, 17 nt, Escherichia coli CFT073
caguuccugcuuugaca

SEQ ID NO: 627272 - RNA, 19 nt, Escherichia coli CFT073
caguucauccauuaacagc

SEQ ID NO: 627273 - RNA, 22 nt, Escherichia coli CFT073
caguucaucuacuacuggagac

SEQ ID NO: 627274 - RNA, 19 nt, Escherichia coli CFT073
caguuccauccaccagccc

SEQ ID NO: 627275 - RNA, 18 nt, Escherichia coli CFT073
caguucccagggcuuucg

SEQ ID NO: 627276 - RNA, 15 nt, Escherichia coli CFT073
caguucccccugcca

SEQ ID NO: 627277 - RNA, 14 nt, Escherichia coli CFT073
caguaaauccauaa

SEQ ID NO: 627278 - RNA, 15 nt, Escherichia coli CFT073
caguaaaugcuggcg

SEQ ID NO: 627279 - RNA, 19 nt, Escherichia coli CFT073
caguaaauggugauaucac

SEQ ID NO: 627280 - RNA, 16 nt, Escherichia coli CFT073
caguaaauaaaaaauc

SEQ ID NO: 627281 - RNA, 18 nt, Escherichia coli CFT073
caguaaauaaaaaaucca

SEQ ID NO: 627282 - RNA, 22 nt, Escherichia coli CFT073
caguaaugaucugaucaaacuc

SEQ ID NO: 627283 - RNA, 16 nt, Escherichia coli CFT073
caguaaucgcgccagc

SEQ ID NO: 627284 - RNA, 15 nt, Escherichia coli CFT073
caguaauccaccguu

SEQ ID NO: 627285 - RNA, 13 nt, Escherichia coli CFT073
caguaauccagca

SEQ ID NO: 627286 - RNA, 15 nt, Escherichia coli CFT073
caguaacgcucccug

SEQ ID NO: 627287 - RNA, 17 nt, Escherichia coli CFT073
caguaacggcgcuugaa

SEQ ID NO: 627288 - RNA, 17 nt, Escherichia coli CFT073
caguaaauccgccacuu

SEQ ID NO: 627289 - RNA, 16 nt, Escherichia coli CFT073
caguaacccagcacca

SEQ ID NO: 627290 - RNA, 14 nt, Escherichia coli CFT073
cagguucguaagcg

SEQ ID NO: 627291 - RNA, 21 nt, Escherichia coli CFT073
caggugcagcccauaagcaaa

SEQ ID NO: 627292 - RNA, 18 nt, Escherichia coli CFT073
cagguuaucggauuuagu

SEQ ID NO: 627293 - RNA, 21 nt, Escherichia coli CFT073
cagguuauugacguuccccug

SEQ ID NO: 627294 - RNA, 20 nt, Escherichia coli CFT073
caguauuucuuuguuucccc

SEQ ID NO: 627295 - RNA, 23 nt, Escherichia coli CFT073
caguauuucuuuguuuccccugg

SEQ ID NO: 627296 - RNA, 15 nt, Escherichia coli CFT073
caguauugccaugca

SEQ ID NO: 627297 - RNA, 12 nt, Escherichia coli CFT073
caguccacaucu

SEQ ID NO: 627298 - RNA, 15 nt, Escherichia coli CFT073
cagucauuuucuuca

SEQ ID NO: 627299 - RNA, 15 nt, Escherichia coli CFT073
caguauguaauuaaa

SEQ ID NO: 627300 - RNA, 17 nt, Escherichia coli CFT073
caguauguaauuaaaca

SEQ ID NO: 627301 - RNA, 14 nt, Escherichia coli CFT073
caguauuaccagac

SEQ ID NO: 627302 - RNA, 16 nt, Escherichia coli CFT073
caguccaccuggccug

SEQ ID NO: 627303 - RNA, 17 nt, Escherichia coli CFT073
caguccacggcugcggc

SEQ ID NO: 627304 - RNA, 14 nt, Escherichia coli CFT073
cagucccaguucau

SEQ ID NO: 627305 - RNA, 13 nt, Escherichia coli CFT073
cagucccaucuuc

SEQ ID NO: 627306 - RNA, 15 nt, Escherichia coli CFT073
caguaggggcaggga

SEQ ID NO: 627307 - RNA, 15 nt, Escherichia coli CFT073
caguagccuuuaucu

SEQ ID NO: 627308 - RNA, 17 nt, Escherichia coli CFT073
caguagcgcaauaacca

SEQ ID NO: 627309 - RNA, 17 nt, Escherichia coli CFT073
caguagcgccucuucca

SEQ ID NO: 627310 - RNA, 23 nt, Escherichia coli CFT073
caguacggcuucgaucaggaacu

SEQ ID NO: 627311 - RNA, 15 nt, Escherichia coli CFT073
caguacggcaaagau

SEQ ID NO: 627312 - RNA, 23 nt, Escherichia coli CFT073
caguacggcagcaaucgaccagg

SEQ ID NO: 627313 - RNA, 17 nt, Escherichia coli CFT073
caguacgcgcccgccgc

SEQ ID NO: 627314 - RNA, 22 nt, Escherichia coli CFT073
caguacgcggacacuuuccugc

SEQ ID NO: 627315 - RNA, 23 nt, Escherichia coli CFT073
caguacgcggacacuuuccugcu

SEQ ID NO: 627316 - RNA, 20 nt, Escherichia coli CFT073
caguacgaaauaacugaaua

SEQ ID NO: 627317 - RNA, 23 nt, Escherichia coli CFT073
caggucggugugaaugaccaggu

SEQ ID NO: 627318 - RNA, 19 nt, Escherichia coli CFT073
caggugacgcuggcagcag

SEQ ID NO: 627319 - RNA, 18 nt, Escherichia coli CFT073
caggugauggcagccauu

SEQ ID NO: 627320 - RNA, 22 nt, Escherichia coli CFT073
caggugauuagucuuuaucugc

SEQ ID NO: 627321 - RNA, 18 nt, Escherichia coli CFT073
caggugaucccccugggc

SEQ ID NO: 627322 - RNA, 23 nt, Escherichia coli CFT073
caggugaucccccugggccaccu

SEQ ID NO: 627323 - RNA, 16 nt, Escherichia coli CFT073
cagguagucaaaagca

SEQ ID NO: 627324 - RNA, 17 nt, Escherichia coli CFT073
cagguagucaaaagcac

SEQ ID NO: 627325 - RNA, 22 nt, Escherichia coli CFT073
cagguagucaaaagcacucaga

SEQ ID NO: 627326 - RNA, 19 nt, Escherichia coli CFT073
cagguaucguuacgccagu

SEQ ID NO: 627327 - RNA, 20 nt, Escherichia coli CFT073
cagguagcguuucaccucuu

SEQ ID NO: 627328 - RNA, 19 nt, Escherichia coli CFT073
cagguagcgccuuuacuga

SEQ ID NO: 627329 - RNA, 12 nt, Escherichia coli CFT073
caggucaccaga

SEQ ID NO: 627330 - RNA, 12 nt, Escherichia coli CFT073
caggucaucacu

SEQ ID NO: 627331 - RNA, 16 nt, Escherichia coli CFT073
cagggaucaacauuca

SEQ ID NO: 627332 - RNA, 18 nt, Escherichia coli CFT073
cagggaucaacauucaga

SEQ ID NO: 627333 - RNA, 15 nt, Escherichia coli CFT073
cagggauuguuuaaa

SEQ ID NO: 627334 - RNA, 18 nt, Escherichia coli CFT073
cagggaucauccacccgc

SEQ ID NO: 627335 - RNA, 23 nt, Escherichia coli CFT073
cagguaagaguuucaacaucauu

SEQ ID NO: 627336 - RNA, 17 nt, Escherichia coli CFT073
cagggcaaaauuucccc

SEQ ID NO: 627337 - RNA, 13 nt, Escherichia coli CFT073
cagggcaaacagc

SEQ ID NO: 627338 - RNA, 20 nt, Escherichia coli CFT073
cagguaauuugaucaaauac

SEQ ID NO: 627339 - RNA, 14 nt, Escherichia coli CFT073
caggcgucgcgcag

SEQ ID NO: 627340 - RNA, 19 nt, Escherichia coli CFT073
cagggaaacagccacccau

SEQ ID NO: 627341 - RNA, 15 nt, Escherichia coli CFT073
cagggaaagaaacgc

SEQ ID NO: 627342 - RNA, 18 nt, Escherichia coli CFT073
cagggaaaaaagccccgc

SEQ ID NO: 627343 - RNA, 22 nt, Escherichia coli CFT073
cagggaaaaaagccccgcagcc

SEQ ID NO: 627344 - RNA, 23 nt, Escherichia coli CFT073
cagggaaaaaagccccgcagcca

SEQ ID NO: 627345 - RNA, 15 nt, Escherichia coli CFT073
caggcuuuauucuga

SEQ ID NO: 627346 - RNA, 23 nt, Escherichia coli CFT073
caggcuuuauucugacgccacca

SEQ ID NO: 627347 - RNA, 13 nt, Escherichia coli CFT073
caggcuuccuggc

SEQ ID NO: 627348 - RNA, 20 nt, Escherichia coli CFT073
caggcuguuguucagugcau

SEQ ID NO: 627349 - RNA, 19 nt, Escherichia coli CFT073
caggcuuacacuuccuuua

SEQ ID NO: 627350 - RNA, 17 nt, Escherichia coli CFT073
caggcuuacguuaccca

SEQ ID NO: 627351 - RNA, 20 nt, Escherichia coli CFT073
caggcuuacguuacccagca

SEQ ID NO: 627352 - RNA, 22 nt, Escherichia coli CFT073
caggcugguguaaaaacugcca

SEQ ID NO: 627353 - RNA, 13 nt, Escherichia coli CFT073
caggccugcaaaa

SEQ ID NO: 627354 - RNA, 18 nt, Escherichia coli CFT073
caggcgagucgagauccc

SEQ ID NO: 627355 - RNA, 16 nt, Escherichia coli CFT073
caggcgagcugccagu

SEQ ID NO: 627356 - RNA, 15 nt, Escherichia coli CFT073
caggcgaucuucccg

SEQ ID NO: 627357 - RNA, 15 nt, Escherichia coli CFT073
caggcgauuucaaau

SEQ ID NO: 627358 - RNA, 15 nt, Escherichia coli CFT073
caggcgcuuuuucuu

SEQ ID NO: 627359 - RNA, 21 nt, Escherichia coli CFT073
caggcgcuuaucgucccaggc

SEQ ID NO: 627360 - RNA, 13 nt, Escherichia coli CFT073
caggcgcugaucg

SEQ ID NO: 627361 - RNA, 20 nt, Escherichia coli CFT073
caggauaacggcagaagcag

SEQ ID NO: 627362 - RNA, 20 nt, Escherichia coli CFT073
caggauaaccuuccaccguu

SEQ ID NO: 627363 - RNA, 15 nt, Escherichia coli CFT073
caggaaccaaaugcc

SEQ ID NO: 627364 - RNA, 12 nt, Escherichia coli CFT073
caggaaauaaau

SEQ ID NO: 627365 - RNA, 15 nt, Escherichia coli CFT073
caggaaaucaaugcc

SEQ ID NO: 627366 - RNA, 15 nt, Escherichia coli CFT073
caggaaauaaauaau

SEQ ID NO: 627367 - RNA, 13 nt, Escherichia coli CFT073
caggaaaugggug

SEQ ID NO: 627368 - RNA, 15 nt, Escherichia coli CFT073
caggauagaaaacga

SEQ ID NO: 627369 - RNA, 21 nt, Escherichia coli CFT073
caggaucagaccgccaaucag

SEQ ID NO: 627370 - RNA, 17 nt, Escherichia coli CFT073
caggauccgcucugccc

SEQ ID NO: 627371 - RNA, 21 nt, Escherichia coli CFT073
caggaugccguuaauaauaaa

SEQ ID NO: 627372 - RNA, 23 nt, Escherichia coli CFT073
caggauggcauuugcaacaccgu

SEQ ID NO: 627373 - RNA, 22 nt, Escherichia coli CFT073
caggcaaaguaggccguacagc

SEQ ID NO: 627374 - RNA, 19 nt, Escherichia coli CFT073
caggcaaaaaugucacucg

SEQ ID NO: 627375 - RNA, 15 nt, Escherichia coli CFT073
caggcaaaccaguac

SEQ ID NO: 627376 - RNA, 20 nt, Escherichia coli CFT073
caggcaaauuauuaauuaaa

SEQ ID NO: 627377 - RNA, 16 nt, Escherichia coli CFT073
caggcacacugccagu

SEQ ID NO: 627378 - RNA, 22 nt, Escherichia coli CFT073
caggcaagccuugcagccagaa

SEQ ID NO: 627379 - RNA, 18 nt, Escherichia coli CFT073
caggcaaguagcgccaga

SEQ ID NO: 627380 - RNA, 15 nt, Escherichia coli CFT073
caggcaucuuuuuca

SEQ ID NO: 627381 - RNA, 13 nt, Escherichia coli CFT073
caggcaugcaaua

SEQ ID NO: 627382 - RNA, 14 nt, Escherichia coli CFT073
caggcaugcaauau

SEQ ID NO: 627383 - RNA, 20 nt, Escherichia coli CFT073
caggcaucuuccagcgucgg

SEQ ID NO: 627384 - RNA, 23 nt, Escherichia coli CFT073
caggcauuagugcgcaguugccg

SEQ ID NO: 627385 - RNA, 23 nt, Escherichia coli CFT073
caggcauuauggcgcaguugccg

SEQ ID NO: 627386 - RNA, 14 nt, Escherichia coli CFT073
caggcaucacuuua

SEQ ID NO: 627387 - RNA, 23 nt, Escherichia coli CFT073
caggccacucaugccuuucauau

SEQ ID NO: 627388 - RNA, 23 nt, Escherichia coli CFT073
caggccaaaagcuaacagcgccg

SEQ ID NO: 627389 - RNA, 14 nt, Escherichia coli CFT073
caggccaauagugc

SEQ ID NO: 627390 - RNA, 14 nt, Escherichia coli CFT073
caggccaccaggcc

SEQ ID NO: 627391 - RNA, 13 nt, Escherichia coli CFT073
caggccaucgcca

SEQ ID NO: 627392 - RNA, 22 nt, Escherichia coli CFT073
caggccaguuuuggcauaaccg

SEQ ID NO: 627393 - RNA, 21 nt, Escherichia coli CFT073
caggccauaugacaccaacgc

SEQ ID NO: 627394 - RNA, 19 nt, Escherichia coli CFT073
caggaaaaagaucagcggc

SEQ ID NO: 627395 - RNA, 23 nt, Escherichia coli CFT073
caggaaagaaccggguaaagacu

SEQ ID NO: 627396 - RNA, 23 nt, Escherichia coli CFT073
caggaaaaugagaugguuuugcu

SEQ ID NO: 627397 - RNA, 15 nt, Escherichia coli CFT073
caggaaacccaacgc

SEQ ID NO: 627398 - RNA, 21 nt, Escherichia coli CFT073
caggaaacccaacgcaaagag

SEQ ID NO: 627399 - RNA, 13 nt, Escherichia coli CFT073
cagcuuuuacagc

SEQ ID NO: 627400 - RNA, 20 nt, Escherichia coli CFT073
cagcuuuuucagcguuuucu

SEQ ID NO: 627401 - RNA, 13 nt, Escherichia coli CFT073
cagcuuuuuccug

SEQ ID NO: 627402 - RNA, 21 nt, Escherichia coli CFT073
cagcuuuugaccaggucauaa

SEQ ID NO: 627403 - RNA, 21 nt, Escherichia coli CFT073
cagcuucgccagcgcgcggcu

SEQ ID NO: 627404 - RNA, 15 nt, Escherichia coli CFT073
cagcuucgcuaccug

SEQ ID NO: 627405 - RNA, 21 nt, Escherichia coli CFT073
cagcuucucgugaaauucacg

SEQ ID NO: 627406 - RNA, 17 nt, Escherichia coli CFT073
cagcuugcgauccugca

SEQ ID NO: 627407 - RNA, 18 nt, Escherichia coli CFT073
cagcuucugcacgaugcu

SEQ ID NO: 627408 - RNA, 14 nt, Escherichia coli CFT073
cagcuugcgccgcc

SEQ ID NO: 627409 - RNA, 15 nt, Escherichia coli CFT073
cagcuugcgccgccc

SEQ ID NO: 627410 - RNA, 17 nt, Escherichia coli CFT073
cagcuugcgccgcccgc

SEQ ID NO: 627411 - RNA, 18 nt, Escherichia coli CFT073
cagcuugcgccgcccgcc

SEQ ID NO: 627412 - RNA, 21 nt, Escherichia coli CFT073
cagcugggcgauuuucuacuu

SEQ ID NO: 627413 - RNA, 14 nt, Escherichia coli CFT073
cagcugcucccagc

SEQ ID NO: 627414 - RNA, 13 nt, Escherichia coli CFT073
cagcugcucccag

SEQ ID NO: 627415 - RNA, 21 nt, Escherichia coli CFT073
cagcugauguagucauacugc

SEQ ID NO: 627416 - RNA, 14 nt, Escherichia coli CFT073
cagcugcacgccac

SEQ ID NO: 627417 - RNA, 16 nt, Escherichia coli CFT073
cagcugccaggcaccg

SEQ ID NO: 627418 - RNA, 15 nt, Escherichia coli CFT073
cagcugcaguaccag

SEQ ID NO: 627419 - RNA, 16 nt, Escherichia coli CFT073
cagcugcgcguuaucu

SEQ ID NO: 627420 - RNA, 18 nt, Escherichia coli CFT073
cagcucucgcguuacuac

SEQ ID NO: 627421 - RNA, 21 nt, Escherichia coli CFT073
cagcucuguagcaacgauaac

SEQ ID NO: 627422 - RNA, 22 nt, Escherichia coli CFT073
cagcucugcugucaccgaagcg

SEQ ID NO: 627423 - RNA, 19 nt, Escherichia coli CFT073
cagcucuuccgacuugcuu

SEQ ID NO: 627424 - RNA, 21 nt, Escherichia coli CFT073
cagcugacugacuucaacagg

SEQ ID NO: 627425 - RNA, 18 nt, Escherichia coli CFT073
cagcugaccgguugcugg

SEQ ID NO: 627426 - RNA, 23 nt, Escherichia coli CFT073
cagcugaaaucaccgccaccagc

SEQ ID NO: 627427 - RNA, 20 nt, Escherichia coli CFT073
cagcuaauugauuguacauu

SEQ ID NO: 627428 - RNA, 16 nt, Escherichia coli CFT073
cagcuaccguuucaac

SEQ ID NO: 627429 - RNA, 17 nt, Escherichia coli CFT073
cagcucaaucgccucgc

SEQ ID NO: 627430 - RNA, 12 nt, Escherichia coli CFT073
cagcucaccuca

SEQ ID NO: 627431 - RNA, 17 nt, Escherichia coli CFT073
cagcucaccucaccuuu

SEQ ID NO: 627432 - RNA, 17 nt, Escherichia coli CFT073
cagcucacgcgccagcu

SEQ ID NO: 627433 - RNA, 14 nt, Escherichia coli CFT073
cagcucacggccag

SEQ ID NO: 627434 - RNA, 17 nt, Escherichia coli CFT073
cagcucauauuccugca

SEQ ID NO: 627435 - RNA, 18 nt, Escherichia coli CFT073
cagcucauauuccugcau

SEQ ID NO: 627436 - RNA, 23 nt, Escherichia coli CFT073
cagcucauauuccugcauugcuu

SEQ ID NO: 627437 - RNA, 17 nt, Escherichia coli CFT073
cagcucuaucugcacug

SEQ ID NO: 627438 - RNA, 19 nt, Escherichia coli CFT073
cagcucuaucugcacugcu

SEQ ID NO: 627439 - RNA, 22 nt, Escherichia coli CFT073
cagcucuaucugcacugcucau

SEQ ID NO: 627440 - RNA, 22 nt, Escherichia coli CFT073
cagcucucagacaauuacucgc

SEQ ID NO: 627441 - RNA, 20 nt, Escherichia coli CFT073
cagcggggcgaaaucuucuc

SEQ ID NO: 627442 - RNA, 12 nt, Escherichia coli CFT073
cagcgguaaauc

SEQ ID NO: 627443 - RNA, 19 nt, Escherichia coli CFT073
cagcggugauuuccgccgc

SEQ ID NO: 627444 - RNA, 23 nt, Escherichia coli CFT073
cacugagguaacucucaugcuuc

SEQ ID NO: 627445 - RNA, 21 nt, Escherichia coli CFT073
cagcgggcgaaucaacuccag

SEQ ID NO: 627446 - RNA, 19 nt, Escherichia coli CFT073
cagcgggaugucgcggaaa

SEQ ID NO: 627447 - RNA, 17 nt, Escherichia coli CFT073
cagcgggauuuccggca

SEQ ID NO: 627448 - RNA, 21 nt, Escherichia coli CFT073
cacugauauggugguaacuac

SEQ ID NO: 627449 - RNA, 23 nt, Escherichia coli CFT073
cagcguaacggcucacccccauc

SEQ ID NO: 627450 - RNA, 21 nt, Escherichia coli CFT073
cagcguaauaaccaacggcga

SEQ ID NO: 627451 - RNA, 15 nt, Escherichia coli CFT073
cagcguaauagccug

SEQ ID NO: 627452 - RNA, 18 nt, Escherichia coli CFT073
cagcguaauagccugaug

SEQ ID NO: 627453 - RNA, 17 nt, Escherichia coli CFT073
cagcgguuccccgcucu

SEQ ID NO: 627454 - RNA, 15 nt, Escherichia coli CFT073
cagcgguuccuggcg

SEQ ID NO: 627455 - RNA, 16 nt, Escherichia coli CFT073
cagcgguuguagccac

SEQ ID NO: 627456 - RNA, 12 nt, Escherichia coli CFT073
cagcgguuuugc

SEQ ID NO: 627457 - RNA, 15 nt, Escherichia coli CFT073
cagcgguuuugccag

SEQ ID NO: 627458 - RNA, 14 nt, Escherichia coli CFT073
cagcgucaguucuc

SEQ ID NO: 627459 - RNA, 16 nt, Escherichia coli CFT073
cagcgucaguucucug

SEQ ID NO: 627460 - RNA, 15 nt, Escherichia coli CFT073
cagcgucagcagcaa

SEQ ID NO: 627461 - RNA, 21 nt, Escherichia coli CFT073
cagcgucacaucaggccaucc

SEQ ID NO: 627462 - RNA, 17 nt, Escherichia coli CFT073
cagcguaugcagccagg

SEQ ID NO: 627463 - RNA, 20 nt, Escherichia coli CFT073
cagcguaccugccgcgccuu

SEQ ID NO: 627464 - RNA, 16 nt, Escherichia coli CFT073
cagcguccagcccucc

SEQ ID NO: 627465 - RNA, 21 nt, Escherichia coli CFT073
cagcgucaucaauccugcagc

SEQ ID NO: 627466 - RNA, 13 nt, Escherichia coli CFT073
cagcuaacuccuu

SEQ ID NO: 627467 - RNA, 16 nt, Escherichia coli CFT073
cagcguuucgccauaa

SEQ ID NO: 627468 - RNA, 17 nt, Escherichia coli CFT073
cagcguuuccagcacca

SEQ ID NO: 627469 - RNA, 20 nt, Escherichia coli CFT073
cagcguuuccagcaccaguu

SEQ ID NO: 627470 - RNA, 16 nt, Escherichia coli CFT073
cagcguuugcugaaaa

SEQ ID NO: 627471 - RNA, 14 nt, Escherichia coli CFT073
cagcguuugcugcu

SEQ ID NO: 627472 - RNA, 18 nt, Escherichia coli CFT073
cagcguuuucuucaauga

SEQ ID NO: 627473 - RNA, 22 nt, Escherichia coli CFT073
cagcguugcccccugaagcagu

SEQ ID NO: 627474 - RNA, 17 nt, Escherichia coli CFT073
cagcgugguuuucucaa

SEQ ID NO: 627475 - RNA, 15 nt, Escherichia coli CFT073
cagcguguugaggaa

SEQ ID NO: 627476 - RNA, 16 nt, Escherichia coli CFT073
cagcguguugaggaag

SEQ ID NO: 627477 - RNA, 17 nt, Escherichia coli CFT073
cagcguguugcggcgcu

SEQ ID NO: 627478 - RNA, 16 nt, Escherichia coli CFT073
cagcguuaauuuccuc

SEQ ID NO: 627479 - RNA, 18 nt, Escherichia coli CFT073
cagcguuaauuuccucuu

SEQ ID NO: 627480 - RNA, 14 nt, Escherichia coli CFT073
cagcguucccagcc

SEQ ID NO: 627481 - RNA, 14 nt, Escherichia coli CFT073
cagcguuccccaga

SEQ ID NO: 627482 - RNA, 15 nt, Escherichia coli CFT073
cagcgugccaggcgc

SEQ ID NO: 627483 - RNA, 15 nt, Escherichia coli CFT073
cagcgugaagcuacc

SEQ ID NO: 627484 - RNA, 14 nt, Escherichia coli CFT073
cagcgucuguuuua

SEQ ID NO: 627485 - RNA, 15 nt, Escherichia coli CFT073
cagcgugaacugggc

SEQ ID NO: 627486 - RNA, 15 nt, Escherichia coli CFT073
cagcgugcguugacc

SEQ ID NO: 627487 - RNA, 17 nt, Escherichia coli CFT073
cagcgugccgaagaaca

SEQ ID NO: 627488 - RNA, 19 nt, Escherichia coli CFT073
cagcgugccgcgaucccag

SEQ ID NO: 627489 - RNA, 21 nt, Escherichia coli CFT073
cagcgugccgcgaucccagac

SEQ ID NO: 627490 - RNA, 15 nt, Escherichia coli CFT073
cagcgucgcaucagg

SEQ ID NO: 627491 - RNA, 14 nt, Escherichia coli CFT073
cagcgucgccagca

SEQ ID NO: 627492 - RNA, 17 nt, Escherichia coli CFT073
cagcgucgggccacgcu

SEQ ID NO: 627493 - RNA, 17 nt, Escherichia coli CFT073
cagcgucgguuccugau

SEQ ID NO: 627494 - RNA, 15 nt, Escherichia coli CFT073
cccaugacaucccca

SEQ ID NO: 627495 - RNA, 16 nt, Escherichia coli CFT073
cccaugacauccccau

SEQ ID NO: 627496 - RNA, 14 nt, Escherichia coli CFT073
cccaucucuucuuc

SEQ ID NO: 627497 - RNA, 14 nt, Escherichia coli CFT073
cccaucugccccau

SEQ ID NO: 627498 - RNA, 16 nt, Escherichia coli CFT073
cccaucguugaaaaaa

SEQ ID NO: 627499 - RNA, 18 nt, Escherichia coli CFT073
cccaucaccggcacaaaa

SEQ ID NO: 627500 - RNA, 20 nt, Escherichia coli CFT073
cccaucagacgggagaucgc

SEQ ID NO: 627501 - RNA, 23 nt, Escherichia coli CFT073
cccaucaucuggcugugauccau

SEQ ID NO: 627502 - RNA, 19 nt, Escherichia coli CFT073
cccauaacccacaccauaa

SEQ ID NO: 627503 - RNA, 13 nt, Escherichia coli CFT073
cccauacccacca

SEQ ID NO: 627504 - RNA, 14 nt, Escherichia coli CFT073
cccauaaucaaugc

SEQ ID NO: 627505 - RNA, 19 nt, Escherichia coli CFT073
cccauauuggcaacagcca

SEQ ID NO: 627506 - RNA, 19 nt, Escherichia coli CFT073
cccaguugugcugccagcc

SEQ ID NO: 627507 - RNA, 23 nt, Escherichia coli CFT073
cccaguugaugaccagugcagau

SEQ ID NO: 627508 - RNA, 15 nt, Escherichia coli CFT073
cccaguuuaccgaaa

SEQ ID NO: 627509 - RNA, 21 nt, Escherichia coli CFT073
cccaguuucaugauauguuuu

SEQ ID NO: 627510 - RNA, 18 nt, Escherichia coli CFT073
cccaguuucuucaggcca

SEQ ID NO: 627511 - RNA, 14 nt, Escherichia coli CFT073
cccaguuuuccauc

SEQ ID NO: 627512 - RNA, 20 nt, Escherichia coli CFT073
cccaguuacugccaucuucc

SEQ ID NO: 627513 - RNA, 15 nt, Escherichia coli CFT073
cccaguucaaacggc

SEQ ID NO: 627514 - RNA, 15 nt, Escherichia coli CFT073
cccagcuuaguaagc

SEQ ID NO: 627515 - RNA, 19 nt, Escherichia coli CFT073
cccagcuuaguaagcccag

SEQ ID NO: 627516 - RNA, 13 nt, Escherichia coli CFT073
cccagcccagcgc

SEQ ID NO: 627517 - RNA, 14 nt, Escherichia coli CFT073
cccagccaguccug

SEQ ID NO: 627518 - RNA, 19 nt, Escherichia coli CFT073
cccagugaauccagcaugc

SEQ ID NO: 627519 - RNA, 22 nt, Escherichia coli CFT073
cccagugaauccagcaugcuca

SEQ ID NO: 627520 - RNA, 15 nt, Escherichia coli CFT073
cccagucgucauccc

SEQ ID NO: 627521 - RNA, 21 nt, Escherichia coli CFT073
cccagucgucaucccaguccu

SEQ ID NO: 627522 - RNA, 17 nt, Escherichia coli CFT073
cccagucgccaguaauc

SEQ ID NO: 627523 - RNA, 15 nt, Escherichia coli CFT073
cccagucccaccauc

SEQ ID NO: 627524 - RNA, 19 nt, Escherichia coli CFT073
cccagucccguacccagca

SEQ ID NO: 627525 - RNA, 21 nt, Escherichia coli CFT073
cccagguuugacgccugcagc

SEQ ID NO: 627526 - RNA, 19 nt, Escherichia coli CFT073
cccaguaaacacaccacag

SEQ ID NO: 627527 - RNA, 17 nt, Escherichia coli CFT073
cccccugaagcaguuuc

SEQ ID NO: 627528 - RNA, 17 nt, Escherichia coli CFT073
ccccaguugugcugcca

SEQ ID NO: 627529 - RNA, 14 nt, Escherichia coli CFT073
ccccaucagcgcca

SEQ ID NO: 627530 - RNA, 22 nt, Escherichia coli CFT073
ccccauauuggcaacagccauc

SEQ ID NO: 627531 - RNA, 17 nt, Escherichia coli CFT073
cccauugccccauguug

SEQ ID NO: 627532 - RNA, 13 nt, Escherichia coli CFT073
cccauuuauuucu

SEQ ID NO: 627533 - RNA, 17 nt, Escherichia coli CFT073
ccccaguaaacacacca

SEQ ID NO: 627534 - RNA, 21 nt, Escherichia coli CFT073
ccccaguaaacacaccacagc

SEQ ID NO: 627535 - RNA, 23 nt, Escherichia coli CFT073
ccccagcgcacuacgccgcaaau

SEQ ID NO: 627536 - RNA, 13 nt, Escherichia coli CFT073
ccccgguuucucu

SEQ ID NO: 627537 - RNA, 14 nt, Escherichia coli CFT073
ccccgguuuuacuu

SEQ ID NO: 627538 - RNA, 21 nt, Escherichia coli CFT073
ccccgugaugaacugcgguaa

SEQ ID NO: 627539 - RNA, 18 nt, Escherichia coli CFT073
ccccggucagcagcacca

SEQ ID NO: 627540 - RNA, 21 nt, Escherichia coli CFT073
ccccuaaacgcgccgcuuuuu

SEQ ID NO: 627541 - RNA, 21 nt, Escherichia coli CFT073
ccccuagaacggggcuauacc

SEQ ID NO: 627542 - RNA, 12 nt, Escherichia coli CFT073
ccccuccagcga

SEQ ID NO: 627543 - RNA, 20 nt, Escherichia coli CFT073
ccccuauaucaacgcccaua

SEQ ID NO: 627544 - RNA, 17 nt, Escherichia coli CFT073
cccccugcaauaaacaa

SEQ ID NO: 627545 - RNA, 12 nt, Escherichia coli CFT073
ccccggcaggaa

SEQ ID NO: 627546 - RNA, 21 nt, Escherichia coli CFT073
ccccggcgaucccagagcggg

SEQ ID NO: 627547 - RNA, 21 nt, Escherichia coli CFT073
ccccgggaagucaccuuucag

SEQ ID NO: 627548 - RNA, 15 nt, Escherichia coli CFT073
cccaacgcagcaaca

SEQ ID NO: 627549 - RNA, 16 nt, Escherichia coli CFT073
cccaacugccugaugc

SEQ ID NO: 627550 - RNA, 13 nt, Escherichia coli CFT073
cccaagcgggggg

SEQ ID NO: 627551 - RNA, 20 nt, Escherichia coli CFT073
cccaauccaguacaugaagc

SEQ ID NO: 627552 - RNA, 15 nt, Escherichia coli CFT073
cccaaucccccacuu

SEQ ID NO: 627553 - RNA, 15 nt, Escherichia coli CFT073
cccaauucuuccugg

SEQ ID NO: 627554 - RNA, 22 nt, Escherichia coli CFT073
cccacaaaauaaccgccaccag

SEQ ID NO: 627555 - RNA, 18 nt, Escherichia coli CFT073
cccaauguaaccacaggc

SEQ ID NO: 627556 - RNA, 20 nt, Escherichia coli CFT073
cccacaguuucagccccauc

SEQ ID NO: 627557 - RNA, 16 nt, Escherichia coli CFT073
cccacaucacaccauc

SEQ ID NO: 627558 - RNA, 15 nt, Escherichia coli CFT073
cccacccaacauggu

SEQ ID NO: 627559 - RNA, 14 nt, Escherichia coli CFT073
cccacauguugcag

SEQ ID NO: 627560 - RNA, 18 nt, Escherichia coli CFT073
cccacaagcccgccagac

SEQ ID NO: 627561 - RNA, 14 nt, Escherichia coli CFT073
cccaccauaaucag

SEQ ID NO: 627562 - RNA, 23 nt, Escherichia coli CFT073
cccaccauaaucagcguaugcag

SEQ ID NO: 627563 - RNA, 23 nt, Escherichia coli CFT073
cccagaugcugggcgaucggcag

SEQ ID NO: 627564 - RNA, 18 nt, Escherichia coli CFT073
cccagcaacgaaacaccg

SEQ ID NO: 627565 - RNA, 18 nt, Escherichia coli CFT073
cccagaauccccacaaac

SEQ ID NO: 627566 - RNA, 16 nt, Escherichia coli CFT073
cccagaagacgagccg

SEQ ID NO: 627567 - RNA, 17 nt, Escherichia coli CFT073
cccagaagacgagccgu

SEQ ID NO: 627568 - RNA, 22 nt, Escherichia coli CFT073
cccagaccuaacuuggcaaagc

SEQ ID NO: 627569 - RNA, 14 nt, Escherichia coli CFT073
cccacuucauccga

SEQ ID NO: 627570 - RNA, 19 nt, Escherichia coli CFT073
cccacugcggcgcaacacg

SEQ ID NO: 627571 - RNA, 16 nt, Escherichia coli CFT073
cccacuuucugcgcaa

SEQ ID NO: 627572 - RNA, 19 nt, Escherichia coli CFT073
cccacuuuuauuucacccc

SEQ ID NO: 627573 - RNA, 18 nt, Escherichia coli CFT073
cccacuuuucaguuacca

SEQ ID NO: 627574 - RNA, 18 nt, Escherichia coli CFT073
cccagaaaauacucagca

SEQ ID NO: 627575 - RNA, 21 nt, Escherichia coli CFT073
cccagaaaauacucagcaccc

SEQ ID NO: 627576 - RNA, 22 nt, Escherichia coli CFT073
cccagaaaauacucagcacccc

SEQ ID NO: 627577 - RNA, 13 nt, Escherichia coli CFT073
cccaccgcagccc

SEQ ID NO: 627578 - RNA, 12 nt, Escherichia coli CFT073
cccacugcaugg

SEQ ID NO: 627579 - RNA, 14 nt, Escherichia coli CFT073
ccauuaaccagcca

SEQ ID NO: 627580 - RNA, 22 nt, Escherichia coli CFT073
ccauuaacccauuuaaaaauca

SEQ ID NO: 627581 - RNA, 13 nt, Escherichia coli CFT073
ccauuaaugccgc

SEQ ID NO: 627582 - RNA, 16 nt, Escherichia coli CFT073
ccauuaauaccgccaa

SEQ ID NO: 627583 - RNA, 21 nt, Escherichia coli CFT073
ccauuaccaccaccuuacaua

SEQ ID NO: 627584 - RNA, 20 nt, Escherichia coli CFT073
ccauuaaaucagccuuaauc

SEQ ID NO: 627585 - RNA, 12 nt, Escherichia coli CFT073
ccauuaaacacc

SEQ ID NO: 627586 - RNA, 12 nt, Escherichia coli CFT073
ccauguugccug

SEQ ID NO: 627587 - RNA, 19 nt, Escherichia coli CFT073
ccauguuuuccuuuucgca

SEQ ID NO: 627588 - RNA, 13 nt, Escherichia coli CFT073
ccauucaaucuuc

SEQ ID NO: 627589 - RNA, 22 nt, Escherichia coli CFT073
ccauucacaaaaacaguaagca

SEQ ID NO: 627590 - RNA, 20 nt, Escherichia coli CFT073
ccauuagcaaauuauccccc

SEQ ID NO: 627591 - RNA, 21 nt, Escherichia coli CFT073
ccauuagcaaauuauccccca

SEQ ID NO: 627592 - RNA, 16 nt, Escherichia coli CFT073
ccauuaucauugagca

SEQ ID NO: 627593 - RNA, 16 nt, Escherichia coli CFT073
ccauuccccagccgau

SEQ ID NO: 627594 - RNA, 18 nt, Escherichia coli CFT073
ccauucuccgcucuucau

SEQ ID NO: 627595 - RNA, 19 nt, Escherichia coli CFT073
ccauucuccgcucuucauc

SEQ ID NO: 627596 - RNA, 15 nt, Escherichia coli CFT073
ccauugcuuuuuuga

SEQ ID NO: 627597 - RNA, 14 nt, Escherichia coli CFT073
ccauugcucuuuca

SEQ ID NO: 627598 - RNA, 22 nt, Escherichia coli CFT073
ccauugcucuuucacuuuaccu

SEQ ID NO: 627599 - RNA, 15 nt, Escherichia coli CFT073
ccauugggccacuca

SEQ ID NO: 627600 - RNA, 16 nt, Escherichia coli CFT073
ccaugugcuuuuccuc

SEQ ID NO: 627601 - RNA, 18 nt, Escherichia coli CFT073
ccauguugacuucaaucu

SEQ ID NO: 627602 - RNA, 19 nt, Escherichia coli CFT073
ccauguugaucccugcacc

SEQ ID NO: 627603 - RNA, 15 nt, Escherichia coli CFT073
ccauguaccagacug

SEQ ID NO: 627604 - RNA, 18 nt, Escherichia coli CFT073
ccauggaacucuuucuga

SEQ ID NO: 627605 - RNA, 20 nt, Escherichia coli CFT073
ccauggcauuaaauucagca

SEQ ID NO: 627606 - RNA, 15 nt, Escherichia coli CFT073
ccaugcuuguuuauu

SEQ ID NO: 627607 - RNA, 19 nt, Escherichia coli CFT073
ccaugcuggcuguuuacau

SEQ ID NO: 627608 - RNA, 14 nt, Escherichia coli CFT073
ccaugcugagcuuc

SEQ ID NO: 627609 - RNA, 18 nt, Escherichia coli CFT073
ccaugcuaauagcugcgc

SEQ ID NO: 627610 - RNA, 16 nt, Escherichia coli CFT073
ccaugcugagcuucuu

SEQ ID NO: 627611 - RNA, 17 nt, Escherichia coli CFT073
ccaugcggcgaggaauc

SEQ ID NO: 627612 - RNA, 14 nt, Escherichia coli CFT073
ccaugcgcugggcg

SEQ ID NO: 627613 - RNA, 20 nt, Escherichia coli CFT073
ccaugaguaauuuuucuuuc

SEQ ID NO: 627614 - RNA, 12 nt, Escherichia coli CFT073
ccaugagacaaa

SEQ ID NO: 627615 - RNA, 23 nt, Escherichia coli CFT073
ccaugagacaaaacgaccaccuu

SEQ ID NO: 627616 - RNA, 14 nt, Escherichia coli CFT073
ccaugauaaacggc

SEQ ID NO: 627617 - RNA, 14 nt, Escherichia coli CFT073
ccaugauauuggca

SEQ ID NO: 627618 - RNA, 15 nt, Escherichia coli CFT073
ccaugaccaccgcag

SEQ ID NO: 627619 - RNA, 20 nt, Escherichia coli CFT073
ccaugaccaccgcagcaacc

SEQ ID NO: 627620 - RNA, 18 nt, Escherichia coli CFT073
ccaugaccgcuccgccau

SEQ ID NO: 627621 - RNA, 15 nt, Escherichia coli CFT073
ccaucuuccagcauc

SEQ ID NO: 627622 - RNA, 14 nt, Escherichia coli CFT073
ccaugacaucccca

SEQ ID NO: 627623 - RNA, 16 nt, Escherichia coli CFT073
ccaugacaucuccagc

SEQ ID NO: 627624 - RNA, 14 nt, Escherichia coli CFT073
ccaugaugacaaca

SEQ ID NO: 627625 - RNA, 17 nt, Escherichia coli CFT073
ccaugaugacaacauag

SEQ ID NO: 627626 - RNA, 16 nt, Escherichia coli CFT073
ccaugaugaccccaga

SEQ ID NO: 627627 - RNA, 19 nt, Escherichia coli CFT073
ccaugauuccccagccacg

SEQ ID NO: 627628 - RNA, 13 nt, Escherichia coli CFT073
ccaugccaaacag

SEQ ID NO: 627629 - RNA, 16 nt, Escherichia coli CFT073
ccaugccacaguaaaa

SEQ ID NO: 627630 - RNA, 15 nt, Escherichia coli CFT073
ccaugcacugcaacg

SEQ ID NO: 627631 - RNA, 20 nt, Escherichia coli CFT073
ccaugcaauauuguagcaac

SEQ ID NO: 627632 - RNA, 19 nt, Escherichia coli CFT073
ccaugcccaguuuauucuu

SEQ ID NO: 627633 - RNA, 15 nt, Escherichia coli CFT073
ccaugccgccacucu

SEQ ID NO: 627634 - RNA, 17 nt, Escherichia coli CFT073
ccaugccaguuucuuuu

SEQ ID NO: 627635 - RNA, 13 nt, Escherichia coli CFT073
ccaugccaucugc

SEQ ID NO: 627636 - RNA, 14 nt, Escherichia coli CFT073
ccaugccgcccagc

SEQ ID NO: 627637 - RNA, 14 nt, Escherichia coli CFT073
ccaucuccagugcg

SEQ ID NO: 627638 - RNA, 15 nt, Escherichia coli CFT073
ccaucguugaaaaaa

SEQ ID NO: 627639 - RNA, 18 nt, Escherichia coli CFT073
ccaucguugaauacauuc

SEQ ID NO: 627640 - RNA, 15 nt, Escherichia coli CFT073
ccaucucagugguga

SEQ ID NO: 627641 - RNA, 14 nt, Escherichia coli CFT073
ccaucucugcaacg

SEQ ID NO: 627642 - RNA, 22 nt, Escherichia coli CFT073
ccaucucggauaaggcuuccua

SEQ ID NO: 627643 - RNA, 23 nt, Escherichia coli CFT073
ccaucucggauaaggcuuccuac

SEQ ID NO: 627644 - RNA, 13 nt, Escherichia coli CFT073
ccaucugaacuca

SEQ ID NO: 627645 - RNA, 19 nt, Escherichia coli CFT073
ccaucugaauaaacggcuc

SEQ ID NO: 627646 - RNA, 14 nt, Escherichia coli CFT073
ccaucugauucuuc

SEQ ID NO: 627647 - RNA, 17 nt, Escherichia coli CFT073
ccaucugauucuuccca

SEQ ID NO: 627648 - RNA, 14 nt, Escherichia coli CFT073
ccaucgcuuuucgu

SEQ ID NO: 627649 - RNA, 22 nt, Escherichia coli CFT073
ccaucgugcuucacuucagcga

SEQ ID NO: 627650 - RNA, 15 nt, Escherichia coli CFT073
ccaucguuaaaaaac

SEQ ID NO: 627651 - RNA, 18 nt, Escherichia coli CFT073
ccaucgcuacauaacgca

SEQ ID NO: 627652 - RNA, 20 nt, Escherichia coli CFT073
ccaucgcuacauaacgcagc

SEQ ID NO: 627653 - RNA, 20 nt, Escherichia coli CFT073
ccaucgcuagauaggucacc

SEQ ID NO: 627654 - RNA, 17 nt, Escherichia coli CFT073
ccaucgcgauccacgcu

SEQ ID NO: 627655 - RNA, 12 nt, Escherichia coli CFT073
ccaucgccgccu

SEQ ID NO: 627656 - RNA, 20 nt, Escherichia coli CFT073
ccauccacagaguguauuca

SEQ ID NO: 627657 - RNA, 18 nt, Escherichia coli CFT073
ccauccaucaacgccagc

SEQ ID NO: 627658 - RNA, 15 nt, Escherichia coli CFT073
ccauccagcucaagu

SEQ ID NO: 627659 - RNA, 12 nt, Escherichia coli CFT073
ccaucauuuuua

SEQ ID NO: 627660 - RNA, 14 nt, Escherichia coli CFT073
ccaucaccucuuca

SEQ ID NO: 627661 - RNA, 19 nt, Escherichia coli CFT073
ccaucacgccccaaugcgc

SEQ ID NO: 627662 - RNA, 15 nt, Escherichia coli CFT073
ccaucacgccugcuu

SEQ ID NO: 627663 - RNA, 14 nt, Escherichia coli CFT073
ccaucaccgccacu

SEQ ID NO: 627664 - RNA, 13 nt, Escherichia coli CFT073
ccaucaccgccag

SEQ ID NO: 627665 - RNA, 17 nt, Escherichia coli CFT073
ccauccuuaugcagcgg

SEQ ID NO: 627666 - RNA, 19 nt, Escherichia coli CFT073
ccaucgacaccagccagac

SEQ ID NO: 627667 - RNA, 18 nt, Escherichia coli CFT073
ccauccgucauucauuua

SEQ ID NO: 627668 - RNA, 14 nt, Escherichia coli CFT073
ccaucccacacugu

SEQ ID NO: 627669 - RNA, 19 nt, Escherichia coli CFT073
ccaucccagacaccaccca

SEQ ID NO: 627670 - RNA, 20 nt, Escherichia coli CFT073
ccauauuuaacuccuucuaa

SEQ ID NO: 627671 - RNA, 16 nt, Escherichia coli CFT073
ccaucaaacagccccu

SEQ ID NO: 627672 - RNA, 17 nt, Escherichia coli CFT073
ccaucaaaggcuucaac

SEQ ID NO: 627673 - RNA, 12 nt, Escherichia coli CFT073
ccaucacacccu

SEQ ID NO: 627674 - RNA, 17 nt, Escherichia coli CFT073
ccaucacauccugauag

SEQ ID NO: 627675 - RNA, 21 nt, Escherichia coli CFT073
ccauauaccgcgguucccagc

SEQ ID NO: 627676 - RNA, 19 nt, Escherichia coli CFT073
ccauauuggcaacagccau

SEQ ID NO: 627677 - RNA, 12 nt, Escherichia coli CFT073
ccauauauaaaa

SEQ ID NO: 627678 - RNA, 18 nt, Escherichia coli CFT073
ccauaguugucggugugu

SEQ ID NO: 627679 - RNA, 19 nt, Escherichia coli CFT073
ccauauaaacauaucacuu

SEQ ID NO: 627680 - RNA, 16 nt, Escherichia coli CFT073
ccauacgggcaugugu

SEQ ID NO: 627681 - RNA, 16 nt, Escherichia coli CFT073
ccauaaucugcgggua

SEQ ID NO: 627682 - RNA, 15 nt, Escherichia coli CFT073
ccauaaugccccagc

SEQ ID NO: 627683 - RNA, 19 nt, Escherichia coli CFT073
ccauaaugccccagcgcac

SEQ ID NO: 627684 - RNA, 12 nt, Escherichia coli CFT073
ccauacucaucu

SEQ ID NO: 627685 - RNA, 16 nt, Escherichia coli CFT073
ccauacucaucuucca

SEQ ID NO: 627686 - RNA, 21 nt, Escherichia coli CFT073
ccauagcccaugcaucggcca

SEQ ID NO: 627687 - RNA, 21 nt, Escherichia coli CFT073
ccaguuuggugacgccacaac

SEQ ID NO: 627688 - RNA, 21 nt, Escherichia coli CFT073
ccauaaaaggcaccuggaaau

SEQ ID NO: 627689 - RNA, 18 nt, Escherichia coli CFT073
ccauaaaaucacaggucg

SEQ ID NO: 627690 - RNA, 15 nt, Escherichia coli CFT073
ccauaaacaccagca

SEQ ID NO: 627691 - RNA, 19 nt, Escherichia coli CFT073
ccauaauaaccucaugguu

SEQ ID NO: 627692 - RNA, 11 nt, Escherichia coli CFT073
ccauaauauuu

SEQ ID NO: 627693 - RNA, 15 nt, Escherichia coli CFT073
ccauaaucaaugcca

SEQ ID NO: 627694 - RNA, 12 nt, Escherichia coli CFT073
ccauaaucacgc

SEQ ID NO: 627695 - RNA, 20 nt, Escherichia coli CFT073
ccaguuucuuuuaacaaacu

SEQ ID NO: 627696 - RNA, 21 nt, Escherichia coli CFT073
ccaguuugcaggccaaacagc

SEQ ID NO: 627697 - RNA, 15 nt, Escherichia coli CFT073
ccaguuucugcccaa

SEQ ID NO: 627698 - RNA, 14 nt, Escherichia coli CFT073
ccaguuucuucagg

SEQ ID NO: 627699 - RNA, 16 nt, Escherichia coli CFT073
ccaguucccccugcca

SEQ ID NO: 627700 - RNA, 14 nt, Escherichia coli CFT073
ccaguuucggacgc

SEQ ID NO: 627701 - RNA, 18 nt, Escherichia coli CFT073
ccaguucaccaccuggcg

SEQ ID NO: 627702 - RNA, 22 nt, Escherichia coli CFT073
ccaguucacgcgauuuuucauc

SEQ ID NO: 627703 - RNA, 19 nt, Escherichia coli CFT073
ccaguucaguaaaaccauu

SEQ ID NO: 627704 - RNA, 20 nt, Escherichia coli CFT073
ccaguucaugacgcaggcgu

SEQ ID NO: 627705 - RNA, 17 nt, Escherichia coli CFT073
ccaguucaugacgugac

SEQ ID NO: 627706 - RNA, 13 nt, Escherichia coli CFT073
ccaguuaucacga

SEQ ID NO: 627707 - RNA, 19 nt, Escherichia coli CFT073
ccaguuaagcgaguuauug

SEQ ID NO: 627708 - RNA, 23 nt, Escherichia coli CFT073
ccaguuacccagcggauaaagca

SEQ ID NO: 627709 - RNA, 14 nt, Escherichia coli CFT073
ccaguuaccgccgg

SEQ ID NO: 627710 - RNA, 17 nt, Escherichia coli CFT073
ccaguguuguauucaga

SEQ ID NO: 627711 - RNA, 22 nt, Escherichia coli CFT073
ccaguguuuuaccggcaacucu

SEQ ID NO: 627712 - RNA, 15 nt, Escherichia coli CFT073
ccagugguaaaaaag

SEQ ID NO: 627713 - RNA, 13 nt, Escherichia coli CFT073
ccaguagaacaau

SEQ ID NO: 627714 - RNA, 14 nt, Escherichia coli CFT073
ccaguagaacaauu

SEQ ID NO: 627715 - RNA, 13 nt, Escherichia coli CFT073
ccaguggcauccg

SEQ ID NO: 627716 - RNA, 21 nt, Escherichia coli CFT073
ccaguacgcgggcaacgccuu

SEQ ID NO: 627717 - RNA, 16 nt, Escherichia coli CFT073
ccaguacgccuucacg

SEQ ID NO: 627718 - RNA, 17 nt, Escherichia coli CFT073
ccaguaccuucguccau

SEQ ID NO: 627719 - RNA, 19 nt, Escherichia coli CFT073
ccaguaccgccagugcagc

SEQ ID NO: 627720 - RNA, 15 nt, Escherichia coli CFT073
ccaguaccgccgcca

SEQ ID NO: 627721 - RNA, 16 nt, Escherichia coli CFT073
ccaguacagcccgccg

SEQ ID NO: 627722 - RNA, 14 nt, Escherichia coli CFT073
ccaguaccagcagc

SEQ ID NO: 627723 - RNA, 14 nt, Escherichia coli CFT073
ccaguaaugcgccc

SEQ ID NO: 627724 - RNA, 21 nt, Escherichia coli CFT073
ccagcccgacgauaccgccgc

SEQ ID NO: 627725 - RNA, 17 nt, Escherichia coli CFT073
ccagcccgaucggcugg

SEQ ID NO: 627726 - RNA, 14 nt, Escherichia coli CFT073
ccagcggcaggccg

SEQ ID NO: 627727 - RNA, 13 nt, Escherichia coli CFT073
ccagcggcagcuc

SEQ ID NO: 627728 - RNA, 18 nt, Escherichia coli CFT073
ccagcgguuguagccacg

SEQ ID NO: 627729 - RNA, 21 nt, Escherichia coli CFT073
ccagcgguuguagccacgucu

SEQ ID NO: 627730 - RNA, 23 nt, Escherichia coli CFT073
ccagcguaaauccugacgcuggg

SEQ ID NO: 627731 - RNA, 17 nt, Escherichia coli CFT073
ccagcguaccaguggcg

SEQ ID NO: 627732 - RNA, 20 nt, Escherichia coli CFT073
ccagcguacguaacuucuua

SEQ ID NO: 627733 - RNA, 19 nt, Escherichia coli CFT073
ccagcguguugaggaagcg

SEQ ID NO: 627734 - RNA, 21 nt, Escherichia coli CFT073
ccagcguggcgaacggauagc

SEQ ID NO: 627735 - RNA, 20 nt, Escherichia coli CFT073
ccagcguagugauaccccgc

SEQ ID NO: 627736 - RNA, 19 nt, Escherichia coli CFT073
ccagcucggggugguuguc

SEQ ID NO: 627737 - RNA, 16 nt, Escherichia coli CFT073
ccagcucgugcagaac

SEQ ID NO: 627738 - RNA, 18 nt, Escherichia coli CFT073
ccagcuccggcacuuccc

SEQ ID NO: 627739 - RNA, 21 nt, Escherichia coli CFT073
ccagcuccgccgguugccccg

SEQ ID NO: 627740 - RNA, 12 nt, Escherichia coli CFT073
ccagcuccagcc

SEQ ID NO: 627741 - RNA, 21 nt, Escherichia coli CFT073
ccagcuccacacgcucuucca

SEQ ID NO: 627742 - RNA, 20 nt, Escherichia coli CFT073
ccagcuuucgcuuagagccc

SEQ ID NO: 627743 - RNA, 14 nt, Escherichia coli CFT073
ccagcuuuugacca

SEQ ID NO: 627744 - RNA, 18 nt, Escherichia coli CFT073
ccaggaacaacgacaggc

SEQ ID NO: 627745 - RNA, 16 nt, Escherichia coli CFT073
ccaggaaccugugaca

SEQ ID NO: 627746 - RNA, 21 nt, Escherichia coli CFT073
ccaggaaccugugacagcagc

SEQ ID NO: 627747 - RNA, 13 nt, Escherichia coli CFT073
ccaggaacgccau

SEQ ID NO: 627748 - RNA, 22 nt, Escherichia coli CFT073
ccaggaaccugugacagcagcg

SEQ ID NO: 627749 - RNA, 20 nt, Escherichia coli CFT073
ccaggacuggcgauaucaau

SEQ ID NO: 627750 - RNA, 14 nt, Escherichia coli CFT073
ccaggaucagcaaa

SEQ ID NO: 627751 - RNA, 20 nt, Escherichia coli CFT073
ccaggcaaauucuguuucau

SEQ ID NO: 627752 - RNA, 11 nt, Escherichia coli CFT073
ccagcuugaag

SEQ ID NO: 627753 - RNA, 15 nt, Escherichia coli CFT073
ccagcuugccuucac

SEQ ID NO: 627754 - RNA, 21 nt, Escherichia coli CFT073
ccagcuugccuucacaggccg

SEQ ID NO: 627755 - RNA, 17 nt, Escherichia coli CFT073
ccagcuugcgacaugcg

SEQ ID NO: 627756 - RNA, 19 nt, Escherichia coli CFT073
ccagcuggcgccaggcuuc

SEQ ID NO: 627757 - RNA, 14 nt, Escherichia coli CFT073
ccagcuucagauuc

SEQ ID NO: 627758 - RNA, 15 nt, Escherichia coli CFT073
ccagcuguccgauuu

SEQ ID NO: 627759 - RNA, 16 nt, Escherichia coli CFT073
ccagcuguccgauuug

SEQ ID NO: 627760 - RNA, 19 nt, Escherichia coli CFT073
ccagcucuuccgacuugcu

SEQ ID NO: 627761 - RNA, 20 nt, Escherichia coli CFT073
ccagcucugcgcccugcauc

SEQ ID NO: 627762 - RNA, 22 nt, Escherichia coli CFT073
ccagcucugcgcccugcaucac

SEQ ID NO: 627763 - RNA, 12 nt, Escherichia coli CFT073
ccagcucuucug

SEQ ID NO: 627764 - RNA, 16 nt, Escherichia coli CFT073
ccagcucuucuggauc

SEQ ID NO: 627765 - RNA, 21 nt, Escherichia coli CFT073
ccagcucuuuaccugacagac

SEQ ID NO: 627766 - RNA, 21 nt, Escherichia coli CFT073
ccagguuaacccacagcgcac

SEQ ID NO: 627767 - RNA, 17 nt, Escherichia coli CFT073
ccagguuaacgcaggcg

SEQ ID NO: 627768 - RNA, 15 nt, Escherichia coli CFT073
ccaguaagccauuga

SEQ ID NO: 627769 - RNA, 21 nt, Escherichia coli CFT073
ccaguaaucgggcaacugcug

SEQ ID NO: 627770 - RNA, 19 nt, Escherichia coli CFT073
ccaguaagcaguccagcgc

SEQ ID NO: 627771 - RNA, 14 nt, Escherichia coli CFT073
ccagguuugacccc

SEQ ID NO: 627772 - RNA, 19 nt, Escherichia coli CFT073
ccagguuuucuuucaccuc

SEQ ID NO: 627773 - RNA, 21 nt, Escherichia coli CFT073
ccagguuuucuuucaccucuu

SEQ ID NO: 627774 - RNA, 22 nt, Escherichia coli CFT073
ccagguuuucuuucaccucuuc

SEQ ID NO: 627775 - RNA, 17 nt, Escherichia coli CFT073
ccaguaaaaagcauuac

SEQ ID NO: 627776 - RNA, 12 nt, Escherichia coli CFT073
ccaguaaaagga

SEQ ID NO: 627777 - RNA, 21 nt, Escherichia coli CFT073
ccaguaaaaggauuggguuaa

SEQ ID NO: 627778 - RNA, 15 nt, Escherichia coli CFT073
ccaguaaacacacca

SEQ ID NO: 627779 - RNA, 23 nt, Escherichia coli CFT073
ccaguaaacacaccacagcaccc

SEQ ID NO: 627780 - RNA, 18 nt, Escherichia coli CFT073
ccaguaaaccaaucaauu

SEQ ID NO: 627781 - RNA, 18 nt, Escherichia coli CFT073
ccaguaaagcagcgaagc

SEQ ID NO: 627782 - RNA, 21 nt, Escherichia coli CFT073
ccagguaaacauauacagggg

SEQ ID NO: 627783 - RNA, 20 nt, Escherichia coli CFT073
ccagggcuuuuuuauuucau

SEQ ID NO: 627784 - RNA, 20 nt, Escherichia coli CFT073
ccaggugcagcccauaagca

SEQ ID NO: 627785 - RNA, 16 nt, Escherichia coli CFT073
ccaggugaaaaauaaa

SEQ ID NO: 627786 - RNA, 20 nt, Escherichia coli CFT073
ccagguagcguuucaccucu

SEQ ID NO: 627787 - RNA, 22 nt, Escherichia coli CFT073
ccagguagcaaacaaaaaguac

SEQ ID NO: 627788 - RNA, 18 nt, Escherichia coli CFT073
ccagguacgcaggcggcu

SEQ ID NO: 627789 - RNA, 17 nt, Escherichia coli CFT073
ccagggaaacagccacc

SEQ ID NO: 627790 - RNA, 20 nt, Escherichia coli CFT073
ccaggcuuaauugcgcagcg

SEQ ID NO: 627791 - RNA, 14 nt, Escherichia coli CFT073
ccaggcuuacacuu

SEQ ID NO: 627792 - RNA, 19 nt, Escherichia coli CFT073
ccagggccuccugcagcgu

SEQ ID NO: 627793 - RNA, 23 nt, Escherichia coli CFT073
ccagggcgauaucuuucuucagc

SEQ ID NO: 627794 - RNA, 13 nt, Escherichia coli CFT073
ccagggccaguac

SEQ ID NO: 627795 - RNA, 20 nt, Escherichia coli CFT073
ccaggcaguuuauccagcca

SEQ ID NO: 627796 - RNA, 18 nt, Escherichia coli CFT073
ccaggcacaccagcaaua

SEQ ID NO: 627797 - RNA, 22 nt, Escherichia coli CFT073
ccagccaaaacguaaaguggcg

SEQ ID NO: 627798 - RNA, 23 nt, Escherichia coli CFT073
ccagcaugugguuaccaucaacc

SEQ ID NO: 627799 - RNA, 18 nt, Escherichia coli CFT073
ccagcauguugucccagu

SEQ ID NO: 627800 - RNA, 20 nt, Escherichia coli CFT073
ccagcauucccgccaccauu

SEQ ID NO: 627801 - RNA, 21 nt, Escherichia coli CFT073
ccagcauugucaggaucacca

SEQ ID NO: 627802 - RNA, 11 nt, Escherichia coli CFT073
ccagcauuucc

SEQ ID NO: 627803 - RNA, 14 nt, Escherichia coli CFT073
ccagccacaaacca

SEQ ID NO: 627804 - RNA, 15 nt, Escherichia coli CFT073
ccagccacaaaccau

SEQ ID NO: 627805 - RNA, 17 nt, Escherichia coli CFT073
ccagccacaaaccauga

SEQ ID NO: 627806 - RNA, 14 nt, Escherichia coli CFT073
ccagccacugcgcc

SEQ ID NO: 627807 - RNA, 16 nt, Escherichia coli CFT073
ccagccagaaaucacc

SEQ ID NO: 627808 - RNA, 13 nt, Escherichia coli CFT073
ccagccagaagaa

SEQ ID NO: 627809 - RNA, 19 nt, Escherichia coli CFT073
ccagccagacucagcaaca

SEQ ID NO: 627810 - RNA, 15 nt, Escherichia coli CFT073
ccagccagaguugaa

SEQ ID NO: 627811 - RNA, 22 nt, Escherichia coli CFT073
ccagccagguguugauccacgg

SEQ ID NO: 627812 - RNA, 14 nt, Escherichia coli CFT073
ccagccaguagcac

SEQ ID NO: 627813 - RNA, 16 nt, Escherichia coli CFT073
ccagccaucgacacca

SEQ ID NO: 627814 - RNA, 13 nt, Escherichia coli CFT073
ccagccagcgccg

SEQ ID NO: 627815 - RNA, 13 nt, Escherichia coli CFT073
ccagccacaccac

SEQ ID NO: 627816 - RNA, 12 nt, Escherichia coli CFT073
ccagcaucuccu

SEQ ID NO: 627817 - RNA, 17 nt, Escherichia coli CFT073
ccagcaucuccugcaac

SEQ ID NO: 627818 - RNA, 18 nt, Escherichia coli CFT073
ccagcaucgccacggccu

SEQ ID NO: 627819 - RNA, 13 nt, Escherichia coli CFT073
ccagcaucgacca

SEQ ID NO: 627820 - RNA, 17 nt, Escherichia coli CFT073
ccagcaucauaaauggg

SEQ ID NO: 627821 - RNA, 22 nt, Escherichia coli CFT073
ccagcaugaugcucucccaaau

SEQ ID NO: 627822 - RNA, 18 nt, Escherichia coli CFT073
ccagcaucacgcccgcuu

SEQ ID NO: 627823 - RNA, 17 nt, Escherichia coli CFT073
ccagcagcccuugcuuc

SEQ ID NO: 627824 - RNA, 22 nt, Escherichia coli CFT073
ccagcagcgaaucagcccagcc

SEQ ID NO: 627825 - RNA, 18 nt, Escherichia coli CFT073
ccagcagcgacucacgaa

SEQ ID NO: 627826 - RNA, 15 nt, Escherichia coli CFT073
ccagcagcaucacca

SEQ ID NO: 627827 - RNA, 20 nt, Escherichia coli CFT073
ccagaugaguaauccgaagu

SEQ ID NO: 627828 - RNA, 17 nt, Escherichia coli CFT073
ccagaucggacuucaug

SEQ ID NO: 627829 - RNA, 18 nt, Escherichia coli CFT073
ccagaucuaucuggcgcg

SEQ ID NO: 627830 - RNA, 23 nt, Escherichia coli CFT073
ccagcaauaagccaguccagaaa

SEQ ID NO: 627831 - RNA, 21 nt, Escherichia coli CFT073
ccagcaauacaaaugaguuau

SEQ ID NO: 627832 - RNA, 15 nt, Escherichia coli CFT073
ccagcaauccccaga

SEQ ID NO: 627833 - RNA, 19 nt, Escherichia coli CFT073
ccagcaauccccagacaaa

SEQ ID NO: 627834 - RNA, 20 nt, Escherichia coli CFT073
ccagcaacgcugauuucucu

SEQ ID NO: 627835 - RNA, 18 nt, Escherichia coli CFT073
ccagcaacguuucgcugg

SEQ ID NO: 627836 - RNA, 22 nt, Escherichia coli CFT073
ccagcaacguuucgcuggaugu

SEQ ID NO: 627837 - RNA, 20 nt, Escherichia coli CFT073
ccagcaagagcaaauaaaac

SEQ ID NO: 627838 - RNA, 21 nt, Escherichia coli CFT073
ccagcaagagcaaauaaaaca

SEQ ID NO: 627839 - RNA, 23 nt, Escherichia coli CFT073
ccagcaagagcaaauaaaacauc

SEQ ID NO: 627840 - RNA, 17 nt, Escherichia coli CFT073
ccagcaacugauacacc

SEQ ID NO: 627841 - RNA, 15 nt, Escherichia coli CFT073
ccagcacaaaguggc

SEQ ID NO: 627842 - RNA, 13 nt, Escherichia coli CFT073
ccagcaaugccag

SEQ ID NO: 627843 - RNA, 16 nt, Escherichia coli CFT073
ccagcaccaggcuugc

SEQ ID NO: 627844 - RNA, 21 nt, Escherichia coli CFT073
ccagcacaccgucagccagca

SEQ ID NO: 627845 - RNA, 14 nt, Escherichia coli CFT073
ccagcagaccagca

SEQ ID NO: 627846 - RNA, 12 nt, Escherichia coli CFT073
ccagcacugccg

SEQ ID NO: 627847 - RNA, 13 nt, Escherichia coli CFT073
ccagcacugccgc

SEQ ID NO: 627848 - RNA, 15 nt, Escherichia coli CFT073
ccagcacuucgcugg

SEQ ID NO: 627849 - RNA, 15 nt, Escherichia coli CFT073
ccagcaccgcuggcu

SEQ ID NO: 627850 - RNA, 16 nt, Escherichia coli CFT073
ccagcacguugugccc

SEQ ID NO: 627851 - RNA, 23 nt, Escherichia coli CFT073
ccagaaaccaucuauaaaauccu

SEQ ID NO: 627852 - RNA, 17 nt, Escherichia coli CFT073
ccagaaaccagccacgg

SEQ ID NO: 627853 - RNA, 17 nt, Escherichia coli CFT073
ccagaaacgccaccauu

SEQ ID NO: 627854 - RNA, 20 nt, Escherichia coli CFT073
ccagaacgcugccuugcucu

SEQ ID NO: 627855 - RNA, 21 nt, Escherichia coli CFT073
ccagaacgcugccuugcucuu

SEQ ID NO: 627856 - RNA, 22 nt, Escherichia coli CFT073
ccagaacgcugccuugcucuuc

SEQ ID NO: 627857 - RNA, 23 nt, Escherichia coli CFT073
ccagaaagacgguuaacgccagc

SEQ ID NO: 627858 - RNA, 15 nt, Escherichia coli CFT073
ccagaagaaccgcca

SEQ ID NO: 627859 - RNA, 20 nt, Escherichia coli CFT073
ccagaacucacgcacuuccg

SEQ ID NO: 627860 - RNA, 17 nt, Escherichia coli CFT073
ccagaagaugcguucac

SEQ ID NO: 627861 - RNA, 19 nt, Escherichia coli CFT073
ccagaaucgcaaccagcca

SEQ ID NO: 627862 - RNA, 23 nt, Escherichia coli CFT073
ccagaauuccgugccagcaccaa

SEQ ID NO: 627863 - RNA, 15 nt, Escherichia coli CFT073
ccagaauugaccagu

SEQ ID NO: 627864 - RNA, 22 nt, Escherichia coli CFT073
ccagaauuuccagaaagugagu

SEQ ID NO: 627865 - RNA, 17 nt, Escherichia coli CFT073
ccagacaaaccacgccu

SEQ ID NO: 627866 - RNA, 20 nt, Escherichia coli CFT073
ccagacaaaugucagaaaga

SEQ ID NO: 627867 - RNA, 21 nt, Escherichia coli CFT073
ccagacaacagucaaccgccu

SEQ ID NO: 627868 - RNA, 20 nt, Escherichia coli CFT073
ccagacaccggcuuucaccu

SEQ ID NO: 627869 - RNA, 20 nt, Escherichia coli CFT073
ccagaaaaggaguuuuuccu

SEQ ID NO: 627870 - RNA, 13 nt, Escherichia coli CFT073
ccagaaaauacuc

SEQ ID NO: 627871 - RNA, 17 nt, Escherichia coli CFT073
ccagaaaauacucagca

SEQ ID NO: 627872 - RNA, 18 nt, Escherichia coli CFT073
ccacuuuuuucacccaca

SEQ ID NO: 627873 - RNA, 21 nt, Escherichia coli CFT073
ccacuuuuuucacccacacuu

SEQ ID NO: 627874 - RNA, 20 nt, Escherichia coli CFT073
ccacuuuggugaaugccuga

SEQ ID NO: 627875 - RNA, 18 nt, Escherichia coli CFT073
ccacuuuuaaaucgccaa

SEQ ID NO: 627876 - RNA, 22 nt, Escherichia coli CFT073
ccacuuuucaguuaccagccgg

SEQ ID NO: 627877 - RNA, 14 nt, Escherichia coli CFT073
ccacuuuugccgca

SEQ ID NO: 627878 - RNA, 16 nt, Escherichia coli CFT073
ccacuuugcgcuccug

SEQ ID NO: 627879 - RNA, 18 nt, Escherichia coli CFT073
ccacuuugcuuucagauu

SEQ ID NO: 627880 - RNA, 22 nt, Escherichia coli CFT073
ccacuuuaugauccagcuuguc

SEQ ID NO: 627881 - RNA, 23 nt, Escherichia coli CFT073
ccacgugaguguggccaguucca

SEQ ID NO: 627882 - RNA, 13 nt, Escherichia coli CFT073
ccacguucauuuc

SEQ ID NO: 627883 - RNA, 14 nt, Escherichia coli CFT073
ccacguuccccaga

SEQ ID NO: 627884 - RNA, 22 nt, Escherichia coli CFT073
ccagacgcaacagaaacgccau

SEQ ID NO: 627885 - RNA, 16 nt, Escherichia coli CFT073
ccagacgcccgcgccc

SEQ ID NO: 627886 - RNA, 15 nt, Escherichia coli CFT073
ccagacgcgccgcca

SEQ ID NO: 627887 - RNA, 19 nt, Escherichia coli CFT073
ccagacgcgcguccccugc

SEQ ID NO: 627888 - RNA, 17 nt, Escherichia coli CFT073
ccagacgauuuucccug

SEQ ID NO: 627889 - RNA, 22 nt, Escherichia coli CFT073
ccagacgauuuucccugaguua

SEQ ID NO: 627890 - RNA, 16 nt, Escherichia coli CFT073
ccagacgcaacagaaa

SEQ ID NO: 627891 - RNA, 12 nt, Escherichia coli CFT073
ccagaccugaau

SEQ ID NO: 627892 - RNA, 23 nt, Escherichia coli CFT073
ccagaccaauugccgcaccaacc

SEQ ID NO: 627893 - RNA, 22 nt, Escherichia coli CFT073
ccagaccaauuuuucccucuuc

SEQ ID NO: 627894 - RNA, 16 nt, Escherichia coli CFT073
ccagaccagcaauaaa

SEQ ID NO: 627895 - RNA, 20 nt, Escherichia coli CFT073
ccagacccgguuuauuuauu

SEQ ID NO: 627896 - RNA, 15 nt, Escherichia coli CFT073
ccagaccgaacagca

SEQ ID NO: 627897 - RNA, 14 nt, Escherichia coli CFT073
ccagaccaauagaa

SEQ ID NO: 627898 - RNA, 18 nt, Escherichia coli CFT073
ccagacagucgccgcuuc

SEQ ID NO: 627899 - RNA, 16 nt, Escherichia coli CFT073
ccagacaucaccagua

SEQ ID NO: 627900 - RNA, 16 nt, Escherichia coli CFT073
ccagagcaucuacugg

SEQ ID NO: 627901 - RNA, 16 nt, Escherichia coli CFT073
ccagagcacugcauuc

SEQ ID NO: 627902 - RNA, 14 nt, Escherichia coli CFT073
ccagagcagcaaca

SEQ ID NO: 627903 - RNA, 11 nt, Escherichia coli CFT073
ccagagccgcg

SEQ ID NO: 627904 - RNA, 21 nt, Escherichia coli CFT073
ccagagcugcguagacuuccc

SEQ ID NO: 627905 - RNA, 19 nt, Escherichia coli CFT073
ccagagcuuuugccaucuc

SEQ ID NO: 627906 - RNA, 17 nt, Escherichia coli CFT073
ccagagcuuugggccca

SEQ ID NO: 627907 - RNA, 11 nt, Escherichia coli CFT073
ccagagcuuuu

SEQ ID NO: 627908 - RNA, 22 nt, Escherichia coli CFT073
ccagagacucggugaccaucca

SEQ ID NO: 627909 - RNA, 15 nt, Escherichia coli CFT073
ccagagaauauuaac

SEQ ID NO: 627910 - RNA, 17 nt, Escherichia coli CFT073
ccagacuggagcacugc

SEQ ID NO: 627911 - RNA, 20 nt, Escherichia coli CFT073
ccagacuggagcacugcgcc

SEQ ID NO: 627912 - RNA, 19 nt, Escherichia coli CFT073
ccagacguccaaucggcca

SEQ ID NO: 627913 - RNA, 16 nt, Escherichia coli CFT073
ccagacucagcaacag

SEQ ID NO: 627914 - RNA, 20 nt, Escherichia coli CFT073
ccagacucagcaacagguaa

SEQ ID NO: 627915 - RNA, 14 nt, Escherichia coli CFT073
ccagacucaccagc

SEQ ID NO: 627916 - RNA, 17 nt, Escherichia coli CFT073
ccagacucaccagcauc

SEQ ID NO: 627917 - RNA, 19 nt, Escherichia coli CFT073
ccagacuccagcagugcug

SEQ ID NO: 627918 - RNA, 13 nt, Escherichia coli CFT073
ccagacugacaug

SEQ ID NO: 627919 - RNA, 18 nt, Escherichia coli CFT073
ccagacugcgcauuaaau

SEQ ID NO: 627920 - RNA, 20 nt, Escherichia coli CFT073
ccacaguuugcugcuguuac

SEQ ID NO: 627921 - RNA, 14 nt, Escherichia coli CFT073
ccacaguuucauau

SEQ ID NO: 627922 - RNA, 21 nt, Escherichia coli CFT073
ccacaguuucauaucugccag

SEQ ID NO: 627923 - RNA, 23 nt, Escherichia coli CFT073
ccacauauguuuaaccggcagcu

SEQ ID NO: 627924 - RNA, 14 nt, Escherichia coli CFT073
ccacaucagcauau

SEQ ID NO: 627925 - RNA, 15 nt, Escherichia coli CFT073
ccacauucagcagcc

SEQ ID NO: 627926 - RNA, 15 nt, Escherichia coli CFT073
ccacauguugcgcuu

SEQ ID NO: 627927 - RNA, 21 nt, Escherichia coli CFT073
ccacaugaucauucaccagcc

SEQ ID NO: 627928 - RNA, 20 nt, Escherichia coli CFT073
ccacaugccugcauaaagga

SEQ ID NO: 627929 - RNA, 20 nt, Escherichia coli CFT073
ccacauggagcuuuaaacac

SEQ ID NO: 627930 - RNA, 19 nt, Escherichia coli CFT073
ccaccaaaugcagcaacca

SEQ ID NO: 627931 - RNA, 14 nt, Escherichia coli CFT073
ccaccaaagauguc

SEQ ID NO: 627932 - RNA, 21 nt, Escherichia coli CFT073
ccaccaauaaccggcacuuca

SEQ ID NO: 627933 - RNA, 18 nt, Escherichia coli CFT073
ccaccaauguggaaagcc

SEQ ID NO: 627934 - RNA, 14 nt, Escherichia coli CFT073
ccacauuuuccauc

SEQ ID NO: 627935 - RNA, 18 nt, Escherichia coli CFT073
ccacauuuuccaucacga

SEQ ID NO: 627936 - RNA, 15 nt, Escherichia coli CFT073
ccaccaaacugcgcc

SEQ ID NO: 627937 - RNA, 18 nt, Escherichia coli CFT073
ccaccaccucuuccagcg

SEQ ID NO: 627938 - RNA, 12 nt, Escherichia coli CFT073
ccaccaccagcg

SEQ ID NO: 627939 - RNA, 16 nt, Escherichia coli CFT073
ccaccaccagcgcacu

SEQ ID NO: 627940 - RNA, 12 nt, Escherichia coli CFT073
ccaccacccugu

SEQ ID NO: 627941 - RNA, 16 nt, Escherichia coli CFT073
ccaccacaccagacca

SEQ ID NO: 627942 - RNA, 15 nt, Escherichia coli CFT073
ccaccacucaaaagc

SEQ ID NO: 627943 - RNA, 18 nt, Escherichia coli CFT073
ccaccacucaaaagcgua

SEQ ID NO: 627944 - RNA, 21 nt, Escherichia coli CFT073
ccaccacugacaaucgccagu

SEQ ID NO: 627945 - RNA, 14 nt, Escherichia coli CFT073
ccaccacuucuuuc

SEQ ID NO: 627946 - RNA, 17 nt, Escherichia coli CFT073
ccaccacuucuuucacg

SEQ ID NO: 627947 - RNA, 22 nt, Escherichia coli CFT073
ccaccagcacaccgucagccag

SEQ ID NO: 627948 - RNA, 13 nt, Escherichia coli CFT073
ccaccacgccaag

SEQ ID NO: 627949 - RNA, 19 nt, Escherichia coli CFT073
ccaccaggaacgcgccaag

SEQ ID NO: 627950 - RNA, 13 nt, Escherichia coli CFT073
ccaccaggaacgc

SEQ ID NO: 627951 - RNA, 22 nt, Escherichia coli CFT073
ccaccagcggaauuccggcuuc

SEQ ID NO: 627952 - RNA, 16 nt, Escherichia coli CFT073
ccaccagcgucagaaa

SEQ ID NO: 627953 - RNA, 13 nt, Escherichia coli CFT073
ccaccagcgccgc

SEQ ID NO: 627954 - RNA, 12 nt, Escherichia coli CFT073
ccaccagcagcu

SEQ ID NO: 627955 - RNA, 14 nt, Escherichia coli CFT073
ccaccagccaacaa

SEQ ID NO: 627956 - RNA, 23 nt, Escherichia coli CFT073
ccaccagcgacagccagcccauc

SEQ ID NO: 627957 - RNA, 16 nt, Escherichia coli CFT073
ccaccagcgccaccac

SEQ ID NO: 627958 - RNA, 16 nt, Escherichia coli CFT073
ccaccaguaacgcucc

SEQ ID NO: 627959 - RNA, 17 nt, Escherichia coli CFT073
ccaccagugaauaagcg

SEQ ID NO: 627960 - RNA, 18 nt, Escherichia coli CFT073
ccaccaucaccucucacg

SEQ ID NO: 627961 - RNA, 23 nt, Escherichia coli CFT073
ccaccaucaccucucacgacgcu

SEQ ID NO: 627962 - RNA, 22 nt, Escherichia coli CFT073
ccaccaugcuaauagcugcgcc

SEQ ID NO: 627963 - RNA, 16 nt, Escherichia coli CFT073
ccaccauuuuacgccc

SEQ ID NO: 627964 - RNA, 15 nt, Escherichia coli CFT073
ccacccaccgcagcc

SEQ ID NO: 627965 - RNA, 19 nt, Escherichia coli CFT073
ccacccauuacacugaaaa

SEQ ID NO: 627966 - RNA, 14 nt, Escherichia coli CFT073
ccaccccacaccag

SEQ ID NO: 627967 - RNA, 14 nt, Escherichia coli CFT073
ccacggaauagaac

SEQ ID NO: 627968 - RNA, 20 nt, Escherichia coli CFT073
ccacggaauauuucaccggu

SEQ ID NO: 627969 - RNA, 22 nt, Escherichia coli CFT073
ccacgcuggacgccgaugcgcu

SEQ ID NO: 627970 - RNA, 17 nt, Escherichia coli CFT073
ccacgcugcgcugcacc

SEQ ID NO: 627971 - RNA, 19 nt, Escherichia coli CFT073
ccacgcugcgcuugcugcc

SEQ ID NO: 627972 - RNA, 17 nt, Escherichia coli CFT073
ccacgcucuggugagug

SEQ ID NO: 627973 - RNA, 20 nt, Escherichia coli CFT073
ccacgguccgccauuuccag

SEQ ID NO: 627974 - RNA, 21 nt, Escherichia coli CFT073
ccacggugguuccacucugcc

SEQ ID NO: 627975 - RNA, 21 nt, Escherichia coli CFT073
ccacggcuauaccccaccccg

SEQ ID NO: 627976 - RNA, 16 nt, Escherichia coli CFT073
ccacggcaugaaagcg

SEQ ID NO: 627977 - RNA, 19 nt, Escherichia coli CFT073
ccacgauauguucaggaua

SEQ ID NO: 627978 - RNA, 19 nt, Escherichia coli CFT073
ccacgaucccuugcaguug

SEQ ID NO: 627979 - RNA, 13 nt, Escherichia coli CFT073
ccacgagcggcgu

SEQ ID NO: 627980 - RNA, 20 nt, Escherichia coli CFT073
ccacgaggaucgauaucacc

SEQ ID NO: 627981 - RNA, 23 nt, Escherichia coli CFT073
ccacgaggaucgauaucaccaau

SEQ ID NO: 627982 - RNA, 14 nt, Escherichia coli CFT073
ccaccuucaacguu

SEQ ID NO: 627983 - RNA, 21 nt, Escherichia coli CFT073
ccaccuugcggaaacugucaa

SEQ ID NO: 627984 - RNA, 14 nt, Escherichia coli CFT073
ccaccuccacgccc

SEQ ID NO: 627985 - RNA, 17 nt, Escherichia coli CFT073
ccaccucgcaacaaugu

SEQ ID NO: 627986 - RNA, 14 nt, Escherichia coli CFT073
ccaccgaaacuugc

SEQ ID NO: 627987 - RNA, 15 nt, Escherichia coli CFT073
ccaccgacaccgcau

SEQ ID NO: 627988 - RNA, 14 nt, Escherichia coli CFT073
ccaccguacgccag

SEQ ID NO: 627989 - RNA, 19 nt, Escherichia coli CFT073
ccacagacaaacagcucga

SEQ ID NO: 627990 - RNA, 21 nt, Escherichia coli CFT073
ccacacgacgcgccagcagcg

SEQ ID NO: 627991 - RNA, 14 nt, Escherichia coli CFT073
ccacaccugccacc

SEQ ID NO: 627992 - RNA, 17 nt, Escherichia coli CFT073
ccacaccugccaccagc

SEQ ID NO: 627993 - RNA, 15 nt, Escherichia coli CFT073
ccacaagcccgccag

SEQ ID NO: 627994 - RNA, 23 nt, Escherichia coli CFT073
ccacaccaaucaacaauugcggg

SEQ ID NO: 627995 - RNA, 19 nt, Escherichia coli CFT073
ccacaccgcccagcgagcu

SEQ ID NO: 627996 - RNA, 20 nt, Escherichia coli CFT073
ccacaccgcccagcgagcug

SEQ ID NO: 627997 - RNA, 14 nt, Escherichia coli CFT073
ccacaccggcgcau

SEQ ID NO: 627998 - RNA, 16 nt, Escherichia coli CFT073
ccacaccauaaugacc

SEQ ID NO: 627999 - RNA, 14 nt, Escherichia coli CFT073
ccacacccgcaaga

SEQ ID NO: 628000 - RNA, 15 nt, Escherichia coli CFT073
ccacagcucugcugu

SEQ ID NO: 628001 - RNA, 19 nt, Escherichia coli CFT073
ccacagcgcgucuucaucg

SEQ ID NO: 628002 - RNA, 19 nt, Escherichia coli CFT073
ccacagcaccccauagcca

SEQ ID NO: 628003 - RNA, 12 nt, Escherichia coli CFT073
ccacagcaagca

SEQ ID NO: 628004 - RNA, 22 nt, Escherichia coli CFT073
ccacaguaagccgguaaucacc

SEQ ID NO: 628005 - RNA, 16 nt, Escherichia coli CFT073
ccacaggcuggcguca

SEQ ID NO: 628006 - RNA, 16 nt, Escherichia coli CFT073
ccacaggccggagcca

SEQ ID NO: 628007 - RNA, 19 nt, Escherichia coli CFT073
ccaauguucaguuugccca

SEQ ID NO: 628008 - RNA, 13 nt, Escherichia coli CFT073
ccaauuaaauauc

SEQ ID NO: 628009 - RNA, 16 nt, Escherichia coli CFT073
ccaauguaaccacagg

SEQ ID NO: 628010 - RNA, 19 nt, Escherichia coli CFT073
ccaauguggagagcaacau

SEQ ID NO: 628011 - RNA, 17 nt, Escherichia coli CFT073
ccaauguacggaauaag

SEQ ID NO: 628012 - RNA, 23 nt, Escherichia coli CFT073
ccaauggaauagcgaagaauacg

SEQ ID NO: 628013 - RNA, 16 nt, Escherichia coli CFT073
ccaaugcugcacccca

SEQ ID NO: 628014 - RNA, 18 nt, Escherichia coli CFT073
ccaaugcugcaccccaca

SEQ ID NO: 628015 - RNA, 22 nt, Escherichia coli CFT073
ccaauggcguauaccugauuac

SEQ ID NO: 628016 - RNA, 21 nt, Escherichia coli CFT073
ccaaugcgcgccccugauggc

SEQ ID NO: 628017 - RNA, 19 nt, Escherichia coli CFT073
ccaaugcugguaauggcuu

SEQ ID NO: 628018 - RNA, 18 nt, Escherichia coli CFT073
ccaauuuauuuuaucgcu

SEQ ID NO: 628019 - RNA, 12 nt, Escherichia coli CFT073
ccacaaaccacc

SEQ ID NO: 628020 - RNA, 17 nt, Escherichia coli CFT073
ccacaacaccuuucacg

SEQ ID NO: 628021 - RNA, 23 nt, Escherichia coli CFT073
ccacaaaccaugauuccccagcc

SEQ ID NO: 628022 - RNA, 13 nt, Escherichia coli CFT073
ccacaaacagaau

SEQ ID NO: 628023 - RNA, 20 nt, Escherichia coli CFT073
ccacaaucggcgggaaaaau

SEQ ID NO: 628024 - RNA, 24 nt, Escherichia coli CFT073
ccacaauugcaguaugaaacgccu

SEQ ID NO: 628025 - RNA, 22 nt, Escherichia coli CFT073
ccacaauaaagcgauaaauggc

SEQ ID NO: 628026 - RNA, 21 nt, Escherichia coli CFT073
ccacaaucaacgccaccauca

SEQ ID NO: 628027 - RNA, 14 nt, Escherichia coli CFT073
ccacaaccucagca

SEQ ID NO: 628028 - RNA, 17 nt, Escherichia coli CFT073
ccacaacgugggccagg

SEQ ID NO: 628029 - RNA, 21 nt, Escherichia coli CFT073
ccaauaccgcccacuaccagc

SEQ ID NO: 628030 - RNA, 23 nt, Escherichia coli CFT073
ccaauagaaagugacagcccggc

SEQ ID NO: 628031 - RNA, 18 nt, Escherichia coli CFT073
ccaauagaaagugacagc

SEQ ID NO: 628032 - RNA, 14 nt, Escherichia coli CFT073
ccaauaccaaaauc

SEQ ID NO: 628033 - RNA, 15 nt, Escherichia coli CFT073
ccaauaccagcauca

SEQ ID NO: 628034 - RNA, 22 nt, Escherichia coli CFT073
ccaauaauugagccgauaaagc

SEQ ID NO: 628035 - RNA, 23 nt, Escherichia coli CFT073
ccaauaaagaaucacugguuacc

SEQ ID NO: 628036 - RNA, 23 nt, Escherichia coli CFT073
ccaauaacucaaguuguaauucc

SEQ ID NO: 628037 - RNA, 16 nt, Escherichia coli CFT073
ccaaugacuauuugcg

SEQ ID NO: 628038 - RNA, 16 nt, Escherichia coli CFT073
ccaaucugcuggaaag

SEQ ID NO: 628039 - RNA, 15 nt, Escherichia coli CFT073
ccaaucucccagccg

SEQ ID NO: 628040 - RNA, 15 nt, Escherichia coli CFT073
ccaaucguucaacca

SEQ ID NO: 628041 - RNA, 20 nt, Escherichia coli CFT073
ccaaucaauucucgccagug

SEQ ID NO: 628042 - RNA, 17 nt, Escherichia coli CFT073
ccaaucagcacacauaa

SEQ ID NO: 628043 - RNA, 18 nt, Escherichia coli CFT073
ccaauauugcgcuguuac

SEQ ID NO: 628044 - RNA, 15 nt, Escherichia coli CFT073
ccaauccgccagcca

SEQ ID NO: 628045 - RNA, 14 nt, Escherichia coli CFT073
ccaaucccgccaua

SEQ ID NO: 628046 - RNA, 13 nt, Escherichia coli CFT073
ccaagccaagcca

SEQ ID NO: 628047 - RNA, 16 nt, Escherichia coli CFT073
ccaagccaagccagag

SEQ ID NO: 628048 - RNA, 16 nt, Escherichia coli CFT073
ccaagccagagcagcg

SEQ ID NO: 628049 - RNA, 13 nt, Escherichia coli CFT073
ccaagaaacuggc

SEQ ID NO: 628050 - RNA, 20 nt, Escherichia coli CFT073
ccaagacugaguuuuauucu

SEQ ID NO: 628051 - RNA, 22 nt, Escherichia coli CFT073
ccaagaugcggggauuuucgca

SEQ ID NO: 628052 - RNA, 16 nt, Escherichia coli CFT073
ccaaguuuaugcaaua

SEQ ID NO: 628053 - RNA, 23 nt, Escherichia coli CFT073
ccaaguuuaugcaauagcgccug

SEQ ID NO: 628054 - RNA, 12 nt, Escherichia coli CFT073
ccaaguuucaau

SEQ ID NO: 628055 - RNA, 17 nt, Escherichia coli CFT073
ccaagucuggcaggaaa

SEQ ID NO: 628056 - RNA, 17 nt, Escherichia coli CFT073
ccaaggccaagagcaaa

SEQ ID NO: 628057 - RNA, 22 nt, Escherichia coli CFT073
ccaacauggucaucaucauuaa

SEQ ID NO: 628058 - RNA, 16 nt, Escherichia coli CFT073
ccaaccaacgcgccgc

SEQ ID NO: 628059 - RNA, 14 nt, Escherichia coli CFT073
ccaaccacugcucu

SEQ ID NO: 628060 - RNA, 10 nt, Escherichia coli CFT073
ccaaccagcu

SEQ ID NO: 628061 - RNA, 12 nt, Escherichia coli CFT073
ccaacaggcgag

SEQ ID NO: 628062 - RNA, 21 nt, Escherichia coli CFT073
ccaacaguugcccaaucgagc

SEQ ID NO: 628063 - RNA, 18 nt, Escherichia coli CFT073
ccaaccccaauguaacca

SEQ ID NO: 628064 - RNA, 22 nt, Escherichia coli CFT073
ccaacccuggugcaauuacgcu

SEQ ID NO: 628065 - RNA, 22 nt, Escherichia coli CFT073
ccaaccgcaauaaccaucagcu

SEQ ID NO: 628066 - RNA, 11 nt, Escherichia coli CFT073
ccaacacccac

SEQ ID NO: 628067 - RNA, 19 nt, Escherichia coli CFT073
ccaacacuuccccggacgc

SEQ ID NO: 628068 - RNA, 13 nt, Escherichia coli CFT073
ccaacagcagcca

SEQ ID NO: 628069 - RNA, 24 nt, Escherichia coli CFT073
ccaacaauauuggguuguugcacu

SEQ ID NO: 628070 - RNA, 17 nt, Escherichia coli CFT073
ccaacaauaaaaagcgg

SEQ ID NO: 628071 - RNA, 21 nt, Escherichia coli CFT073
ccaacaauaaaaagcggcagg

SEQ ID NO: 628072 - RNA, 19 nt, Escherichia coli CFT073
ccaacaaggcgcuaaaagc

SEQ ID NO: 628073 - RNA, 14 nt, Escherichia coli CFT073
ccaacaacagcgcg

SEQ ID NO: 628074 - RNA, 21 nt, Escherichia coli CFT073
ccaacaacccugcaucagaac

SEQ ID NO: 628075 - RNA, 16 nt, Escherichia coli CFT073
ccaaaugucaccagcc

SEQ ID NO: 628076 - RNA, 21 nt, Escherichia coli CFT073
ccaacgcggcccaacauaauc

SEQ ID NO: 628077 - RNA, 16 nt, Escherichia coli CFT073
ccaacgcuaaauacug

SEQ ID NO: 628078 - RNA, 18 nt, Escherichia coli CFT073
ccaacgcuagcagcagcg

SEQ ID NO: 628079 - RNA, 14 nt, Escherichia coli CFT073
ccaacgcgccaccg

SEQ ID NO: 628080 - RNA, 19 nt, Escherichia coli CFT073
ccaacgcgccaccgaccag

SEQ ID NO: 628081 - RNA, 19 nt, Escherichia coli CFT073
ccaacguucguacugcccu

SEQ ID NO: 628082 - RNA, 18 nt, Escherichia coli CFT073
ccaacggugaaaaaccaa

SEQ ID NO: 628083 - RNA, 16 nt, Escherichia coli CFT073
ccaacggucagcgcac

SEQ ID NO: 628084 - RNA, 17 nt, Escherichia coli CFT073
ccaacggugaaaaacca

SEQ ID NO: 628085 - RNA, 19 nt, Escherichia coli CFT073
ccaaccgggccgcagagau

SEQ ID NO: 628086 - RNA, 17 nt, Escherichia coli CFT073
ccaacgaucccaacuga

SEQ ID NO: 628087 - RNA, 20 nt, Escherichia coli CFT073
ccaacgaucccaacugaucu

SEQ ID NO: 628088 - RNA, 19 nt, Escherichia coli CFT073
ccaacgcagacgcauacug

SEQ ID NO: 628089 - RNA, 20 nt, Escherichia coli CFT073
ccaacgcauagacagccaca

SEQ ID NO: 628090 - RNA, 21 nt, Escherichia coli CFT073
ccaacugugaauccugcauac

SEQ ID NO: 628091 - RNA, 22 nt, Escherichia coli CFT073
ccaacugugccgcgaccaccuc

SEQ ID NO: 628092 - RNA, 19 nt, Escherichia coli CFT073
ccaacuggcgcagcaguuc

SEQ ID NO: 628093 - RNA, 21 nt, Escherichia coli CFT073
ccaagaaagauaguaaccguu

SEQ ID NO: 628094 - RNA, 22 nt, Escherichia coli CFT073
ccaacuucggggagcgauauca

SEQ ID NO: 628095 - RNA, 13 nt, Escherichia coli CFT073
ccaacuucaugac

SEQ ID NO: 628096 - RNA, 13 nt, Escherichia coli CFT073
ccaacugaaagaa

SEQ ID NO: 628097 - RNA, 18 nt, Escherichia coli CFT073
ccaacugauuuucaucuu

SEQ ID NO: 628098 - RNA, 15 nt, Escherichia coli CFT073
ccaaaaugcuugacg

SEQ ID NO: 628099 - RNA, 11 nt, Escherichia coli CFT073
ccaaaauuuga

SEQ ID NO: 628100 - RNA, 18 nt, Escherichia coli CFT073
ccaaacagcgugccgcga

SEQ ID NO: 628101 - RNA, 12 nt, Escherichia coli CFT073
ccaaacaccagg

SEQ ID NO: 628102 - RNA, 14 nt, Escherichia coli CFT073
ccaaacagaccaau

SEQ ID NO: 628103 - RNA, 11 nt, Escherichia coli CFT073
ccaaacagcag

SEQ ID NO: 628104 - RNA, 16 nt, Escherichia coli CFT073
ccaaaccagccgccaa

SEQ ID NO: 628105 - RNA, 13 nt, Escherichia coli CFT073
ccaaaccauugcu

SEQ ID NO: 628106 - RNA, 18 nt, Escherichia coli CFT073
ccaaaccauugcuuaaag

SEQ ID NO: 628107 - RNA, 23 nt, Escherichia coli CFT073
ccaaaaagaauaaauauccuccg

SEQ ID NO: 628108 - RNA, 23 nt, Escherichia coli CFT073
ccaaaaaggggaaaaauucaggg

SEQ ID NO: 628109 - RNA, 14 nt, Escherichia coli CFT073
cauuucuggaaugc

SEQ ID NO: 628110 - RNA, 21 nt, Escherichia coli CFT073
cauuucugacgaugguguuua

SEQ ID NO: 628111 - RNA, 19 nt, Escherichia coli CFT073
ccaaaacggacauguugcu

SEQ ID NO: 628112 - RNA, 19 nt, Escherichia coli CFT073
ccaaaaaucgacuguggua

SEQ ID NO: 628113 - RNA, 13 nt, Escherichia coli CFT073
ccaaaggugacug

SEQ ID NO: 628114 - RNA, 19 nt, Escherichia coli CFT073
ccaaagucgauagcuguac

SEQ ID NO: 628115 - RNA, 15 nt, Escherichia coli CFT073
ccaaagucaucaauu

SEQ ID NO: 628116 - RNA, 21 nt, Escherichia coli CFT073
ccaaagucaucaauugcaauc

SEQ ID NO: 628117 - RNA, 18 nt, Escherichia coli CFT073
ccaaaucguugcugcuca

SEQ ID NO: 628118 - RNA, 17 nt, Escherichia coli CFT073
ccaaaucgucaacguaa

SEQ ID NO: 628119 - RNA, 18 nt, Escherichia coli CFT073
ccaaauagcucaaugaaa

SEQ ID NO: 628120 - RNA, 12 nt, Escherichia coli CFT073
ccaaauauuucu

SEQ ID NO: 628121 - RNA, 13 nt, Escherichia coli CFT073
ccaaauccagcgc

SEQ ID NO: 628122 - RNA, 14 nt, Escherichia coli CFT073
ccaaacucauccac

SEQ ID NO: 628123 - RNA, 16 nt, Escherichia coli CFT073
ccaaacucauccacca

SEQ ID NO: 628124 - RNA, 13 nt, Escherichia coli CFT073
ccaaacugcgccc

SEQ ID NO: 628125 - RNA, 21 nt, Escherichia coli CFT073
ccaaacgguaucuuuccagcc

SEQ ID NO: 628126 - RNA, 14 nt, Escherichia coli CFT073
ccaaacuggaauag

SEQ ID NO: 628127 - RNA, 13 nt, Escherichia coli CFT073
ccaaacugcggga

SEQ ID NO: 628128 - RNA, 11 nt, Escherichia coli CFT073
ccaaacugcuc

SEQ ID NO: 628129 - RNA, 20 nt, Escherichia coli CFT073
ccaaacugguaacuguaggu

SEQ ID NO: 628130 - RNA, 19 nt, Escherichia coli CFT073
ccaaacuuaugcagcugcu

SEQ ID NO: 628131 - RNA, 22 nt, Escherichia coli CFT073
ccaaacuuaugcagcugcucga

SEQ ID NO: 628132 - RNA, 21 nt, Escherichia coli CFT073
ccaaagaccaggaaacccaac

SEQ ID NO: 628133 - RNA, 16 nt, Escherichia coli CFT073
ccaaagggagcagacu

SEQ ID NO: 628134 - RNA, 19 nt, Escherichia coli CFT073
ccaaagggagcagacugua

SEQ ID NO: 628135 - RNA, 22 nt, Escherichia coli CFT073
ccaaagaauuggcuuuaucugu

SEQ ID NO: 628136 - RNA, 18 nt, Escherichia coli CFT073
ccaaagcaccacuccuca

SEQ ID NO: 628137 - RNA, 19 nt, Escherichia coli CFT073
ccaaagcaccacuccucaa

SEQ ID NO: 628138 - RNA, 15 nt, Escherichia coli CFT073
cgaauuuauuuguga

SEQ ID NO: 628139 - RNA, 18 nt, Escherichia coli CFT073
cgaauuuccgcgaccuga

SEQ ID NO: 628140 - RNA, 20 nt, Escherichia coli CFT073
cgacaaaaauaccaccaaug

SEQ ID NO: 628141 - RNA, 22 nt, Escherichia coli CFT073
cgaauuuguuccccaugcuggu

SEQ ID NO: 628142 - RNA, 20 nt, Escherichia coli CFT073
cgacaaacgcuguaauuacc

SEQ ID NO: 628143 - RNA, 21 nt, Escherichia coli CFT073
cgacaaaaucagaaacaaaua

SEQ ID NO: 628144 - RNA, 15 nt, Escherichia coli CFT073
cgacaaaauccccuu

SEQ ID NO: 628145 - RNA, 18 nt, Escherichia coli CFT073
cgacaauaaucaccacac

SEQ ID NO: 628146 - RNA, 14 nt, Escherichia coli CFT073
cgacaauauugaug

SEQ ID NO: 628147 - RNA, 18 nt, Escherichia coli CFT073
cgacaauauugaugcucg

SEQ ID NO: 628148 - RNA, 15 nt, Escherichia coli CFT073
cgacaaucagguaag

SEQ ID NO: 628149 - RNA, 20 nt, Escherichia coli CFT073
cgacaauccaguugguucaa

SEQ ID NO: 628150 - RNA, 16 nt, Escherichia coli CFT073
cgacaaucgcaaauau

SEQ ID NO: 628151 - RNA, 14 nt, Escherichia coli CFT073
cgacaaauguugca

SEQ ID NO: 628152 - RNA, 20 nt, Escherichia coli CFT073
cgacaaagcucaccugagua

SEQ ID NO: 628153 - RNA, 12 nt, Escherichia coli CFT073
cgacaaaguuga

SEQ ID NO: 628154 - RNA, 18 nt, Escherichia coli CFT073
cgacagacggcgacgcgc

SEQ ID NO: 628155 - RNA, 20 nt, Escherichia coli CFT073
cgacacggcucaaccuucuu

SEQ ID NO: 628156 - RNA, 19 nt, Escherichia coli CFT073
cgacacgcaucacgcgcau

SEQ ID NO: 628157 - RNA, 13 nt, Escherichia coli CFT073
cgacaaugguuaa

SEQ ID NO: 628158 - RNA, 15 nt, Escherichia coli CFT073
cgacacaaucaaauc

SEQ ID NO: 628159 - RNA, 15 nt, Escherichia coli CFT073
cgacacaauccaugc

SEQ ID NO: 628160 - RNA, 15 nt, Escherichia coli CFT073
cgacaccacgcgcau

SEQ ID NO: 628161 - RNA, 11 nt, Escherichia coli CFT073
cgacaccagca

SEQ ID NO: 628162 - RNA, 14 nt, Escherichia coli CFT073
cgacaccagccauc

SEQ ID NO: 628163 - RNA, 17 nt, Escherichia coli CFT073
cgaauggguucgauuuc

SEQ ID NO: 628164 - RNA, 23 nt, Escherichia coli CFT073
cgaauggcugcacuuucaguacg

SEQ ID NO: 628165 - RNA, 23 nt, Escherichia coli CFT073
cgaauugagaugacgccacuggc

SEQ ID NO: 628166 - RNA, 22 nt, Escherichia coli CFT073
cgaauugcaucuacgcucucuu

SEQ ID NO: 628167 - RNA, 11 nt, Escherichia coli CFT073
cgaauuccuga

SEQ ID NO: 628168 - RNA, 17 nt, Escherichia coli CFT073
cgaaucgcuucauuuac

SEQ ID NO: 628169 - RNA, 22 nt, Escherichia coli CFT073
cgaaucgauaaccccagaugga

SEQ ID NO: 628170 - RNA, 20 nt, Escherichia coli CFT073
cgaaucuguucuggaaaaaa

SEQ ID NO: 628171 - RNA, 18 nt, Escherichia coli CFT073
cgaaugccgcagcacccu

SEQ ID NO: 628172 - RNA, 19 nt, Escherichia coli CFT073
cgaaugccgcagcacccug

SEQ ID NO: 628173 - RNA, 18 nt, Escherichia coli CFT073
cgaauaguggaguaugag

SEQ ID NO: 628174 - RNA, 15 nt, Escherichia coli CFT073
cgaauauguuuuuga

SEQ ID NO: 628175 - RNA, 14 nt, Escherichia coli CFT073
cgaaucaacuccag

SEQ ID NO: 628176 - RNA, 14 nt, Escherichia coli CFT073
cgaauccggcagcg

SEQ ID NO: 628177 - RNA, 22 nt, Escherichia coli CFT073
cgaauccggcagcgaaccgucg

SEQ ID NO: 628178 - RNA, 14 nt, Escherichia coli CFT073
cgaauccagcaagc

SEQ ID NO: 628179 - RNA, 13 nt, Escherichia coli CFT073
cgaauaauccagc

SEQ ID NO: 628180 - RNA, 21 nt, Escherichia coli CFT073
cgaauacccggugcguauucg

SEQ ID NO: 628181 - RNA, 13 nt, Escherichia coli CFT073
cgaauaccuucuu

SEQ ID NO: 628182 - RNA, 21 nt, Escherichia coli CFT073
cgaauagagccuggcugcgug

SEQ ID NO: 628183 - RNA, 22 nt, Escherichia coli CFT073
cgaauacgacagucaauauuca

SEQ ID NO: 628184 - RNA, 15 nt, Escherichia coli CFT073
cgaauacguaauguc

SEQ ID NO: 628185 - RNA, 22 nt, Escherichia coli CFT073
cgaaguucuuccggcagccagg

SEQ ID NO: 628186 - RNA, 11 nt, Escherichia coli CFT073
cgaaguugaag

SEQ ID NO: 628187 - RNA, 21 nt, Escherichia coli CFT073
cgaaguugauugccagcaggg

SEQ ID NO: 628188 - RNA, 19 nt, Escherichia coli CFT073
cgaagugguuccacgcccg

SEQ ID NO: 628189 - RNA, 12 nt, Escherichia coli CFT073
cgaaguuuuccu

SEQ ID NO: 628190 - RNA, 16 nt, Escherichia coli CFT073
cgaaguuuuccucagu

SEQ ID NO: 628191 - RNA, 13 nt, Escherichia coli CFT073
cgaaguuccugca

SEQ ID NO: 628192 - RNA, 16 nt, Escherichia coli CFT073
cgaauaaauuccgcuc

SEQ ID NO: 628193 - RNA, 23 nt, Escherichia coli CFT073
cgaagguucgaauccuuccccca

SEQ ID NO: 628194 - RNA, 19 nt, Escherichia coli CFT073
cgaaguacuccuguucacc

SEQ ID NO: 628195 - RNA, 13 nt, Escherichia coli CFT073
cgaaggugcauug

SEQ ID NO: 628196 - RNA, 17 nt, Escherichia coli CFT073
cgaaggugaacgccacc

SEQ ID NO: 628197 - RNA, 11 nt, Escherichia coli CFT073
cgaagcggcug

SEQ ID NO: 628198 - RNA, 20 nt, Escherichia coli CFT073
cgaagcggcacugcucuuua

SEQ ID NO: 628199 - RNA, 15 nt, Escherichia coli CFT073
cgaagcgccaauacc

SEQ ID NO: 628200 - RNA, 15 nt, Escherichia coli CFT073
cgaagcugaccagac

SEQ ID NO: 628201 - RNA, 13 nt, Escherichia coli CFT073
cgaagaaaaacug

SEQ ID NO: 628202 - RNA, 16 nt, Escherichia coli CFT073
cgaagaacauaaacag

SEQ ID NO: 628203 - RNA, 13 nt, Escherichia coli CFT073
cgaagaaccagua

SEQ ID NO: 628204 - RNA, 13 nt, Escherichia coli CFT073
cgaagacaaaacc

SEQ ID NO: 628205 - RNA, 17 nt, Escherichia coli CFT073
cgaagacaaaaccaacg

SEQ ID NO: 628206 - RNA, 20 nt, Escherichia coli CFT073
cgaagaauacgccccagaau

SEQ ID NO: 628207 - RNA, 14 nt, Escherichia coli CFT073
cgaagacaucaucg

SEQ ID NO: 628208 - RNA, 22 nt, Escherichia coli CFT073
cgaagacaucgcagggaucauc

SEQ ID NO: 628209 - RNA, 20 nt, Escherichia coli CFT073
cgaagaguaaccaaacgugg

SEQ ID NO: 628210 - RNA, 16 nt, Escherichia coli CFT073
cgaagaguuccagcgc

SEQ ID NO: 628211 - RNA, 19 nt, Escherichia coli CFT073
cgaacuccgccccggcaau

SEQ ID NO: 628212 - RNA, 21 nt, Escherichia coli CFT073
cgaacugucgauuuguacucu

SEQ ID NO: 628213 - RNA, 16 nt, Escherichia coli CFT073
cgaacguuuucaccac

SEQ ID NO: 628214 - RNA, 16 nt, Escherichia coli CFT073
cgaacggcuguugaug

SEQ ID NO: 628215 - RNA, 12 nt, Escherichia coli CFT073
cgacaggaacca

SEQ ID NO: 628216 - RNA, 23 nt, Escherichia coli CFT073
cgacagccauaaagaaaucaccu

SEQ ID NO: 628217 - RNA, 12 nt, Escherichia coli CFT073
cgacagccaucc

SEQ ID NO: 628218 - RNA, 16 nt, Escherichia coli CFT073
cgacaguaccagcagu

SEQ ID NO: 628219 - RNA, 21 nt, Escherichia coli CFT073
cgacaggcuuacguuacccag

SEQ ID NO: 628220 - RNA, 12 nt, Escherichia coli CFT073
cgacaucgccac

SEQ ID NO: 628221 - RNA, 21 nt, Escherichia coli CFT073
cgacauacuugacuaagucuc

SEQ ID NO: 628222 - RNA, 19 nt, Escherichia coli CFT073
cgacauccaugcacugcaa

SEQ ID NO: 628223 - RNA, 18 nt, Escherichia coli CFT073
cgacaucgacucaccacg

SEQ ID NO: 628224 - RNA, 15 nt, Escherichia coli CFT073
cgacauaauuuuucu

SEQ ID NO: 628225 - RNA, 14 nt, Escherichia coli CFT073
cgacauagccaucc

SEQ ID NO: 628226 - RNA, 16 nt, Escherichia coli CFT073
cgacaucaacgccuga

SEQ ID NO: 628227 - RNA, 21 nt, Escherichia coli CFT073
cgacaucgucuccagcgaauc

SEQ ID NO: 628228 - RNA, 13 nt, Escherichia coli CFT073
cgacaucuucucu

SEQ ID NO: 628229 - RNA, 13 nt, Escherichia coli CFT073
cgacauugccagu

SEQ ID NO: 628230 - RNA, 19 nt, Escherichia coli CFT073
cgaccaacugcaaggccau

SEQ ID NO: 628231 - RNA, 20 nt, Escherichia coli CFT073
cgaccaaacuuauccgccag

SEQ ID NO: 628232 - RNA, 19 nt, Escherichia coli CFT073
cgaccaccucggcacugac

SEQ ID NO: 628233 - RNA, 15 nt, Escherichia coli CFT073
cgaccacucuuucga

SEQ ID NO: 628234 - RNA, 12 nt, Escherichia coli CFT073
cgaccacuucau

SEQ ID NO: 628235 - RNA, 13 nt, Escherichia coli CFT073
cgaccacuucaug

SEQ ID NO: 628236 - RNA, 12 nt, Escherichia coli CFT073
cgaccacuucca

SEQ ID NO: 628237 - RNA, 15 nt, Escherichia coli CFT073
cgaccagcaccgcca

SEQ ID NO: 628238 - RNA, 22 nt, Escherichia coli CFT073
cgaccagcaccgccagcagcag

SEQ ID NO: 628239 - RNA, 14 nt, Escherichia coli CFT073
cgacccauuacgua

SEQ ID NO: 628240 - RNA, 21 nt, Escherichia coli CFT073
cgaccaucuccuuacugcccc

SEQ ID NO: 628241 - RNA, 22 nt, Escherichia coli CFT073
cgaccaguuguaaucugcacca

SEQ ID NO: 628242 - RNA, 12 nt, Escherichia coli CFT073
cgaccaggcaaa

SEQ ID NO: 628243 - RNA, 13 nt, Escherichia coli CFT073
cgaccaggcaaac

SEQ ID NO: 628244 - RNA, 14 nt, Escherichia coli CFT073
cgaccugauccauu

SEQ ID NO: 628245 - RNA, 22 nt, Escherichia coli CFT073
cgaccguaaauucucccgcccc

SEQ ID NO: 628246 - RNA, 22 nt, Escherichia coli CFT073
cgaccgucuuuauccagcacca

SEQ ID NO: 628247 - RNA, 15 nt, Escherichia coli CFT073
cgaccgccgcucacc

SEQ ID NO: 628248 - RNA, 22 nt, Escherichia coli CFT073
cgaccgauuaauuccccugcca

SEQ ID NO: 628249 - RNA, 16 nt, Escherichia coli CFT073
cgacccuaaccggcgc

SEQ ID NO: 628250 - RNA, 17 nt, Escherichia coli CFT073
cgacccgguucaauuuc

SEQ ID NO: 628251 - RNA, 18 nt, Escherichia coli CFT073
cgaacagacaaaaagaau

SEQ ID NO: 628252 - RNA, 14 nt, Escherichia coli CFT073
cgaacagaccaaac

SEQ ID NO: 628253 - RNA, 13 nt, Escherichia coli CFT073
cgaacagucgcug

SEQ ID NO: 628254 - RNA, 18 nt, Escherichia coli CFT073
cgaacagucgcugaucac

SEQ ID NO: 628255 - RNA, 21 nt, Escherichia coli CFT073
cgaaccacugauggaauuuca

SEQ ID NO: 628256 - RNA, 20 nt, Escherichia coli CFT073
cgaaccggggccgaaacccc

SEQ ID NO: 628257 - RNA, 13 nt, Escherichia coli CFT073
cgaaccagugcuc

SEQ ID NO: 628258 - RNA, 17 nt, Escherichia coli CFT073
cgaaccagugcuccacc

SEQ ID NO: 628259 - RNA, 23 nt, Escherichia coli CFT073
cgaaauggugugcaugguguuca

SEQ ID NO: 628260 - RNA, 18 nt, Escherichia coli CFT073
cgaaauugcugacgcaaa

SEQ ID NO: 628261 - RNA, 21 nt, Escherichia coli CFT073
cgaacaccagcaguaaaccac

SEQ ID NO: 628262 - RNA, 14 nt, Escherichia coli CFT073
cgaacaccagcagu

SEQ ID NO: 628263 - RNA, 20 nt, Escherichia coli CFT073
cgaaauagcccgguuuacca

SEQ ID NO: 628264 - RNA, 14 nt, Escherichia coli CFT073
cgaaauagccgaaa

SEQ ID NO: 628265 - RNA, 20 nt, Escherichia coli CFT073
cgaaauagcgccauaaaacu

SEQ ID NO: 628266 - RNA, 14 nt, Escherichia coli CFT073
cgaaauaaaagugu

SEQ ID NO: 628267 - RNA, 14 nt, Escherichia coli CFT073
cgaaauaaacaagc

SEQ ID NO: 628268 - RNA, 18 nt, Escherichia coli CFT073
cgaaauaacugaauaaua

SEQ ID NO: 628269 - RNA, 22 nt, Escherichia coli CFT073
cgaaauacaaguccccgcuucg

SEQ ID NO: 628270 - RNA, 21 nt, Escherichia coli CFT073
cgaaaucauucgcagcugcag

SEQ ID NO: 628271 - RNA, 14 nt, Escherichia coli CFT073
cgaaaugaauaauc

SEQ ID NO: 628272 - RNA, 16 nt, Escherichia coli CFT073
cgaaaucggcaccgcc

SEQ ID NO: 628273 - RNA, 20 nt, Escherichia coli CFT073
cgaaauggcugccaaugaua

SEQ ID NO: 628274 - RNA, 17 nt, Escherichia coli CFT073
cgaaauggccauccauu

SEQ ID NO: 628275 - RNA, 18 nt, Escherichia coli CFT073
cgaaagcguauccaucac

SEQ ID NO: 628276 - RNA, 17 nt, Escherichia coli CFT073
cgaaagcgucagcuuuc

SEQ ID NO: 628277 - RNA, 14 nt, Escherichia coli CFT073
cgaaagcgugagug

SEQ ID NO: 628278 - RNA, 22 nt, Escherichia coli CFT073
cgaaacuugcgugauauuacau

SEQ ID NO: 628279 - RNA, 16 nt, Escherichia coli CFT073
cgaaagcgggcuugau

SEQ ID NO: 628280 - RNA, 15 nt, Escherichia coli CFT073
cgaaacgcaguuuaa

SEQ ID NO: 628281 - RNA, 17 nt, Escherichia coli CFT073
cgaaaccuucagcaucg

SEQ ID NO: 628282 - RNA, 15 nt, Escherichia coli CFT073
ccuuuuggcacacuu

SEQ ID NO: 628283 - RNA, 15 nt, Escherichia coli CFT073
ccuuuugcccggcaa

SEQ ID NO: 628284 - RNA, 10 nt, Escherichia coli CFT073
ccuuuuuaau

SEQ ID NO: 628285 - RNA, 13 nt, Escherichia coli CFT073
cgaaaaaaaagau

SEQ ID NO: 628286 - RNA, 21 nt, Escherichia coli CFT073
ccuuuuuuugucuguuugcuc

SEQ ID NO: 628287 - RNA, 16 nt, Escherichia coli CFT073
cgaaaagcuucuuccu

SEQ ID NO: 628288 - RNA, 17 nt, Escherichia coli CFT073
cgaaaacgauguuugcu

SEQ ID NO: 628289 - RNA, 20 nt, Escherichia coli CFT073
cgaaaacgcauaucuucuga

SEQ ID NO: 628290 - RNA, 15 nt, Escherichia coli CFT073
cgaaaacgcuccaac

SEQ ID NO: 628291 - RNA, 19 nt, Escherichia coli CFT073
cgaaaaaucgacaaaauca

SEQ ID NO: 628292 - RNA, 20 nt, Escherichia coli CFT073
cgaaaaagucccuucccagc

SEQ ID NO: 628293 - RNA, 17 nt, Escherichia coli CFT073
cgaaaaggauaaauaaa

SEQ ID NO: 628294 - RNA, 14 nt, Escherichia coli CFT073
cgaaaaucauuuau

SEQ ID NO: 628295 - RNA, 16 nt, Escherichia coli CFT073
cgaaaaucgccugaac

SEQ ID NO: 628296 - RNA, 21 nt, Escherichia coli CFT073
cgaaaccauauuaaauggccc

SEQ ID NO: 628297 - RNA, 20 nt, Escherichia coli CFT073
cgaaacagcgccccaugaua

SEQ ID NO: 628298 - RNA, 19 nt, Escherichia coli CFT073
cgaaaauuuggauuuuugc

SEQ ID NO: 628299 - RNA, 23 nt, Escherichia coli CFT073
ccuuucauggucgucaccgccag

SEQ ID NO: 628300 - RNA, 14 nt, Escherichia coli CFT073
ccuuucagccccag

SEQ ID NO: 628301 - RNA, 17 nt, Escherichia coli CFT073
ccuuuccccggcagcau

SEQ ID NO: 628302 - RNA, 13 nt, Escherichia coli CFT073
ccuuuaucugccc

SEQ ID NO: 628303 - RNA, 14 nt, Escherichia coli CFT073
ccuuuaucugcccu

SEQ ID NO: 628304 - RNA, 17 nt, Escherichia coli CFT073
ccuuuaucugcccuuua

SEQ ID NO: 628305 - RNA, 13 nt, Escherichia coli CFT073
ccuuuauugcgaa

SEQ ID NO: 628306 - RNA, 18 nt, Escherichia coli CFT073
ccuuuaguaugcugauau

SEQ ID NO: 628307 - RNA, 17 nt, Escherichia coli CFT073
ccuuucuccgcgaccug

SEQ ID NO: 628308 - RNA, 11 nt, Escherichia coli CFT073
ccuuuguauuu

SEQ ID NO: 628309 - RNA, 15 nt, Escherichia coli CFT073
ccuuguuuaaggaaa

SEQ ID NO: 628310 - RNA, 19 nt, Escherichia coli CFT073
ccuugugggccugaaagcu

SEQ ID NO: 628311 - RNA, 21 nt, Escherichia coli CFT073
ccuuguggaaauuccagcggc

SEQ ID NO: 628312 - RNA, 15 nt, Escherichia coli CFT073
ccuuuaaacuguuuc

SEQ ID NO: 628313 - RNA, 15 nt, Escherichia coli CFT073
ccuuuaacacgcaac

SEQ ID NO: 628314 - RNA, 21 nt, Escherichia coli CFT073
ccuuuacggcgcgucaaguua

SEQ ID NO: 628315 - RNA, 17 nt, Escherichia coli CFT073
ccuuguauuaauaccag

SEQ ID NO: 628316 - RNA, 13 nt, Escherichia coli CFT073
ccuugcuucgcca

SEQ ID NO: 628317 - RNA, 18 nt, Escherichia coli CFT073
ccuugcuccacgcucaga

SEQ ID NO: 628318 - RNA, 15 nt, Escherichia coli CFT073
ccuugcugcuccagc

SEQ ID NO: 628319 - RNA, 19 nt, Escherichia coli CFT073
ccuugcucauccauugcuu

SEQ ID NO: 628320 - RNA, 21 nt, Escherichia coli CFT073
ccuugcggaucggcuggcggc

SEQ ID NO: 628321 - RNA, 21 nt, Escherichia coli CFT073
ccuugcgauaucccauuuacu

SEQ ID NO: 628322 - RNA, 19 nt, Escherichia coli CFT073
ccuugcgcgacaugcucug

SEQ ID NO: 628323 - RNA, 16 nt, Escherichia coli CFT073
ccuugagugacauggc

SEQ ID NO: 628324 - RNA, 21 nt, Escherichia coli CFT073
ccuugaugaaaaaaccagaaa

SEQ ID NO: 628325 - RNA, 22 nt, Escherichia coli CFT073
ccuugcagauauugcaccccaa

SEQ ID NO: 628326 - RNA, 16 nt, Escherichia coli CFT073
ccuugcaguugaucca

SEQ ID NO: 628327 - RNA, 17 nt, Escherichia coli CFT073
ccuucguacugugcgcc

SEQ ID NO: 628328 - RNA, 13 nt, Escherichia coli CFT073
ccuucguccagca

SEQ ID NO: 628329 - RNA, 19 nt, Escherichia coli CFT073
ccuucguccaucccacacu

SEQ ID NO: 628330 - RNA, 19 nt, Escherichia coli CFT073
ccuucguguauuuugcauc

SEQ ID NO: 628331 - RNA, 13 nt, Escherichia coli CFT073
ccuucuaaagcaa

SEQ ID NO: 628332 - RNA, 15 nt, Escherichia coli CFT073
ccuucuggcgacccg

SEQ ID NO: 628333 - RNA, 17 nt, Escherichia coli CFT073
ccuucuguaaccuuuuc

SEQ ID NO: 628334 - RNA, 21 nt, Escherichia coli CFT073
ccuucuguuauauauuacccu

SEQ ID NO: 628335 - RNA, 18 nt, Escherichia coli CFT073
ccuucugcgcccgcccgc

SEQ ID NO: 628336 - RNA, 20 nt, Escherichia coli CFT073
ccuucugagcccacuguuug

SEQ ID NO: 628337 - RNA, 19 nt, Escherichia coli CFT073
ccuucugagaucaaugcgc

SEQ ID NO: 628338 - RNA, 14 nt, Escherichia coli CFT073
ccuucugcacgcga

SEQ ID NO: 628339 - RNA, 16 nt, Escherichia coli CFT073
ccuucuugaacccuuu

SEQ ID NO: 628340 - RNA, 23 nt, Escherichia coli CFT073
ccuucuugcucgaagaguuccag

SEQ ID NO: 628341 - RNA, 14 nt, Escherichia coli CFT073
ccuucuucuuucag

SEQ ID NO: 628342 - RNA, 18 nt, Escherichia coli CFT073
ccuucuucgaaaugcugg

SEQ ID NO: 628343 - RNA, 23 nt, Escherichia coli CFT073
ccuugaaaucguuugcauccagu

SEQ ID NO: 628344 - RNA, 14 nt, Escherichia coli CFT073
ccuucccugcagua

SEQ ID NO: 628345 - RNA, 14 nt, Escherichia coli CFT073
ccuucccuucguug

SEQ ID NO: 628346 - RNA, 12 nt, Escherichia coli CFT073
ccuucccuuuca

SEQ ID NO: 628347 - RNA, 21 nt, Escherichia coli CFT073
ccuuccauuaucgccaggugu

SEQ ID NO: 628348 - RNA, 15 nt, Escherichia coli CFT073
ccuucccccaccacc

SEQ ID NO: 628349 - RNA, 21 nt, Escherichia coli CFT073
ccuucccgacguaacaucuga

SEQ ID NO: 628350 - RNA, 18 nt, Escherichia coli CFT073
ccuucccgcaaugcaauc

SEQ ID NO: 628351 - RNA, 14 nt, Escherichia coli CFT073
ccuuccgccagucg

SEQ ID NO: 628352 - RNA, 19 nt, Escherichia coli CFT073
ccuuccugacucacacgca

SEQ ID NO: 628353 - RNA, 19 nt, Escherichia coli CFT073
ccuuccugaacggucgagg

SEQ ID NO: 628354 - RNA, 19 nt, Escherichia coli CFT073
ccuuccagaaacaucccca

SEQ ID NO: 628355 - RNA, 12 nt, Escherichia coli CFT073
ccuuccagcagc

SEQ ID NO: 628356 - RNA, 13 nt, Escherichia coli CFT073
ccuuccagcagcu

SEQ ID NO: 628357 - RNA, 15 nt, Escherichia coli CFT073
ccuuccagcuccagc

SEQ ID NO: 628358 - RNA, 13 nt, Escherichia coli CFT073
ccugugguuuaua

SEQ ID NO: 628359 - RNA, 14 nt, Escherichia coli CFT073
ccuguuaaucagcu

SEQ ID NO: 628360 - RNA, 13 nt, Escherichia coli CFT073
ccuguuaauucuc

SEQ ID NO: 628361 - RNA, 18 nt, Escherichia coli CFT073
ccuguuaauucucccugc

SEQ ID NO: 628362 - RNA, 16 nt, Escherichia coli CFT073
ccuucgccgcuuuaau

SEQ ID NO: 628363 - RNA, 13 nt, Escherichia coli CFT073
ccuucggcaaauc

SEQ ID NO: 628364 - RNA, 14 nt, Escherichia coli CFT073
ccuucggccccauc

SEQ ID NO: 628365 - RNA, 20 nt, Escherichia coli CFT073
ccuucgcaaaaaaccauccc

SEQ ID NO: 628366 - RNA, 13 nt, Escherichia coli CFT073
ccuucgccaccgu

SEQ ID NO: 628367 - RNA, 13 nt, Escherichia coli CFT073
ccuucgccagugg

SEQ ID NO: 628368 - RNA, 15 nt, Escherichia coli CFT073
ccuucgauauauuuu

SEQ ID NO: 628369 - RNA, 16 nt, Escherichia coli CFT073
ccuucgauauauuuuu

SEQ ID NO: 628370 - RNA, 16 nt, Escherichia coli CFT073
ccuucgauauccagau

SEQ ID NO: 628371 - RNA, 17 nt, Escherichia coli CFT073
cgcagcaaagcccgggc

SEQ ID NO: 628372 - RNA, 18 nt, Escherichia coli CFT073
cgcagcacgacucucccc

SEQ ID NO: 628373 - RNA, 12 nt, Escherichia coli CFT073
cgcagcacggcg

SEQ ID NO: 628374 - RNA, 19 nt, Escherichia coli CFT073
cgcagcucacuucgaucca

SEQ ID NO: 628375 - RNA, 17 nt, Escherichia coli CFT073
cgcagcuaucagcgaga

SEQ ID NO: 628376 - RNA, 17 nt, Escherichia coli CFT073
cgcagcuauccugccgg

SEQ ID NO: 628377 - RNA, 13 nt, Escherichia coli CFT073
cgcagcuccagcc

SEQ ID NO: 628378 - RNA, 15 nt, Escherichia coli CFT073
cgcagcuccagagua

SEQ ID NO: 628379 - RNA, 12 nt, Escherichia coli CFT073
cgcagcuccagc

SEQ ID NO: 628380 - RNA, 22 nt, Escherichia coli CFT073
cgcagcucuuuauccagcagcc

SEQ ID NO: 628381 - RNA, 23 nt, Escherichia coli CFT073
cgcagcucuuuauccagcagcca

SEQ ID NO: 628382 - RNA, 13 nt, Escherichia coli CFT073
cgcagucucuuua

SEQ ID NO: 628383 - RNA, 13 nt, Escherichia coli CFT073
cgcagguaagaua

SEQ ID NO: 628384 - RNA, 16 nt, Escherichia coli CFT073
cgcagguagcagcagc

SEQ ID NO: 628385 - RNA, 21 nt, Escherichia coli CFT073
cgcaugcauuuucaauaacug

SEQ ID NO: 628386 - RNA, 23 nt, Escherichia coli CFT073
cgcaugacacacucugaccuguc

SEQ ID NO: 628387 - RNA, 15 nt, Escherichia coli CFT073
cgcaucuggucagau

SEQ ID NO: 628388 - RNA, 13 nt, Escherichia coli CFT073
cgcauccggcauu

SEQ ID NO: 628389 - RNA, 19 nt, Escherichia coli CFT073
cgcauccggcauuguucau

SEQ ID NO: 628390 - RNA, 15 nt, Escherichia coli CFT073
cgcauccgacauuuu

SEQ ID NO: 628391 - RNA, 16 nt, Escherichia coli CFT073
cgcauccgccagcagc

SEQ ID NO: 628392 - RNA, 17 nt, Escherichia coli CFT073
cgcauccgccagcagcu

SEQ ID NO: 628393 - RNA, 13 nt, Escherichia coli CFT073
cgcauccggcaag

SEQ ID NO: 628394 - RNA, 16 nt, Escherichia coli CFT073
cgcauccggcaaucaa

SEQ ID NO: 628395 - RNA, 17 nt, Escherichia coli CFT073
cgcauccggcauaauac

SEQ ID NO: 628396 - RNA, 16 nt, Escherichia coli CFT073
cgcauccggcaucagu

SEQ ID NO: 628397 - RNA, 12 nt, Escherichia coli CFT073
cgcaucgaucuu

SEQ ID NO: 628398 - RNA, 14 nt, Escherichia coli CFT073
cgcaucacagacca

SEQ ID NO: 628399 - RNA, 18 nt, Escherichia coli CFT073
cgcaucacgaccgcuuca

SEQ ID NO: 628400 - RNA, 20 nt, Escherichia coli CFT073
cgcaucaggcaacaaacuca

SEQ ID NO: 628401 - RNA, 13 nt, Escherichia coli CFT073
cgcauccaccaga

SEQ ID NO: 628402 - RNA, 23 nt, Escherichia coli CFT073
cgcaucaguuucgaucagcaauu

SEQ ID NO: 628403 - RNA, 15 nt, Escherichia coli CFT073
cgcaucauccgucgg

SEQ ID NO: 628404 - RNA, 18 nt, Escherichia coli CFT073
cgcaucaugaaacgccca

SEQ ID NO: 628405 - RNA, 18 nt, Escherichia coli CFT073
cgcauccagccaacguuu

SEQ ID NO: 628406 - RNA, 12 nt, Escherichia coli CFT073
cgcauauuguuc

SEQ ID NO: 628407 - RNA, 15 nt, Escherichia coli CFT073
cgcauagcaccaccg

SEQ ID NO: 628408 - RNA, 17 nt, Escherichia coli CFT073
cgcauagccuccggcca

SEQ ID NO: 628409 - RNA, 19 nt, Escherichia coli CFT073
cgcauagccuccggccacg

SEQ ID NO: 628410 - RNA, 23 nt, Escherichia coli CFT073
cgcauagcuaauccccuccagcg

SEQ ID NO: 628411 - RNA, 17 nt, Escherichia coli CFT073
cgcauacugauuaccca

SEQ ID NO: 628412 - RNA, 18 nt, Escherichia coli CFT073
cgcaguucaccugguuca

SEQ ID NO: 628413 - RNA, 15 nt, Escherichia coli CFT073
cgccagaaacgggug

SEQ ID NO: 628414 - RNA, 19 nt, Escherichia coli CFT073
cgccacuucuggcggcggc

SEQ ID NO: 628415 - RNA, 16 nt, Escherichia coli CFT073
cgccacuuucacgccg

SEQ ID NO: 628416 - RNA, 23 nt, Escherichia coli CFT073
cgccacuuuuuucacccacacuu

SEQ ID NO: 628417 - RNA, 14 nt, Escherichia coli CFT073
cgccagaaucaccg

SEQ ID NO: 628418 - RNA, 16 nt, Escherichia coli CFT073
cgccagaaucaccgga

SEQ ID NO: 628419 - RNA, 23 nt, Escherichia coli CFT073
cgccagaacacgcucccagcagu

SEQ ID NO: 628420 - RNA, 13 nt, Escherichia coli CFT073
cgccagagcuggc

SEQ ID NO: 628421 - RNA, 18 nt, Escherichia coli CFT073
cgccagacucucgccaga

SEQ ID NO: 628422 - RNA, 14 nt, Escherichia coli CFT073
cgccagacugauca

SEQ ID NO: 628423 - RNA, 21 nt, Escherichia coli CFT073
cgccagacugaucaucgccca

SEQ ID NO: 628424 - RNA, 14 nt, Escherichia coli CFT073
cgccagaccugcgc

SEQ ID NO: 628425 - RNA, 16 nt, Escherichia coli CFT073
cgccagaccugcgcau

SEQ ID NO: 628426 - RNA, 19 nt, Escherichia coli CFT073
cgccagacgugcacgcagc

SEQ ID NO: 628427 - RNA, 19 nt, Escherichia coli CFT073
cgccagacucaccagcauc

SEQ ID NO: 628428 - RNA, 18 nt, Escherichia coli CFT073
cgccagacaauugccgcu

SEQ ID NO: 628429 - RNA, 14 nt, Escherichia coli CFT073
cgccagacacugga

SEQ ID NO: 628430 - RNA, 21 nt, Escherichia coli CFT073
cgccagaccagcuaccacgcc

SEQ ID NO: 628431 - RNA, 21 nt, Escherichia coli CFT073
cgccacggacauaaagcccgc

SEQ ID NO: 628432 - RNA, 16 nt, Escherichia coli CFT073
cgccaccgaccaggca

SEQ ID NO: 628433 - RNA, 21 nt, Escherichia coli CFT073
cgccaccgaccaggcaaacca

SEQ ID NO: 628434 - RNA, 13 nt, Escherichia coli CFT073
cgccacgccaaga

SEQ ID NO: 628435 - RNA, 15 nt, Escherichia coli CFT073
cgccacgccaccagc

SEQ ID NO: 628436 - RNA, 19 nt, Escherichia coli CFT073
cgccaaguuucaauauccg

SEQ ID NO: 628437 - RNA, 12 nt, Escherichia coli CFT073
cgccaauaaucu

SEQ ID NO: 628438 - RNA, 21 nt, Escherichia coli CFT073
cgccaauaaucugcccggcau

SEQ ID NO: 628439 - RNA, 13 nt, Escherichia coli CFT073
cgccaauaaugaa

SEQ ID NO: 628440 - RNA, 21 nt, Escherichia coli CFT073
cgccaauagccgcaccgagcg

SEQ ID NO: 628441 - RNA, 20 nt, Escherichia coli CFT073
cgccaaucagcgcagcaccc

SEQ ID NO: 628442 - RNA, 21 nt, Escherichia coli CFT073
cgccaaaaggcaauucaauua

SEQ ID NO: 628443 - RNA, 19 nt, Escherichia coli CFT073
cgccaaacugugcaccgcc

SEQ ID NO: 628444 - RNA, 13 nt, Escherichia coli CFT073
cgccaaagccagu

SEQ ID NO: 628445 - RNA, 15 nt, Escherichia coli CFT073
cgccaaaucguugcu

SEQ ID NO: 628446 - RNA, 19 nt, Escherichia coli CFT073
cgccaaauggcaggcacag

SEQ ID NO: 628447 - RNA, 23 nt, Escherichia coli CFT073
cgccaacgugguuuaccaccagc

SEQ ID NO: 628448 - RNA, 15 nt, Escherichia coli CFT073
cgccaacguguugcu

SEQ ID NO: 628449 - RNA, 21 nt, Escherichia coli CFT073
cgccaacggugaaaaaccaau

SEQ ID NO: 628450 - RNA, 20 nt, Escherichia coli CFT073
cgccaaccgcugauugcugg

SEQ ID NO: 628451 - RNA, 21 nt, Escherichia coli CFT073
cgcauugccgccauuuauaaa

SEQ ID NO: 628452 - RNA, 17 nt, Escherichia coli CFT073
cgcauuggacagguuca

SEQ ID NO: 628453 - RNA, 18 nt, Escherichia coli CFT073
cgcauuauccuuuaucug

SEQ ID NO: 628454 - RNA, 20 nt, Escherichia coli CFT073
cgcauuauggugaagaagcc

SEQ ID NO: 628455 - RNA, 15 nt, Escherichia coli CFT073
cgcauuaaauaccaa

SEQ ID NO: 628456 - RNA, 16 nt, Escherichia coli CFT073
cgcauuaacucacugg

SEQ ID NO: 628457 - RNA, 16 nt, Escherichia coli CFT073
cgcauguaacugccuu

SEQ ID NO: 628458 - RNA, 13 nt, Escherichia coli CFT073
cgcacaaccgccg

SEQ ID NO: 628459 - RNA, 16 nt, Escherichia coli CFT073
cgcaccaaccacugcu

SEQ ID NO: 628460 - RNA, 20 nt, Escherichia coli CFT073
cgcaccaacggucagcgcac

SEQ ID NO: 628461 - RNA, 13 nt, Escherichia coli CFT073
cgcaccaacucca

SEQ ID NO: 628462 - RNA, 14 nt, Escherichia coli CFT073
cgcacauugugcgc

SEQ ID NO: 628463 - RNA, 23 nt, Escherichia coli CFT073
cgcacaugucaguugcauaccau

SEQ ID NO: 628464 - RNA, 21 nt, Escherichia coli CFT073
cgcaaucgccuccagcgcugg

SEQ ID NO: 628465 - RNA, 16 nt, Escherichia coli CFT073
cgcaaucgcggcagcg

SEQ ID NO: 628466 - RNA, 18 nt, Escherichia coli CFT073
cgcaaucagcaccgcgcg

SEQ ID NO: 628467 - RNA, 15 nt, Escherichia coli CFT073
cgcaauguccauaaa

SEQ ID NO: 628468 - RNA, 21 nt, Escherichia coli CFT073
cgcaauggccguuccggcaac

SEQ ID NO: 628469 - RNA, 18 nt, Escherichia coli CFT073
cgcaauggccguuccggc

SEQ ID NO: 628470 - RNA, 14 nt, Escherichia coli CFT073
cgcaacgccgccaa

SEQ ID NO: 628471 - RNA, 12 nt, Escherichia coli CFT073
cgcaagccaggu

SEQ ID NO: 628472 - RNA, 17 nt, Escherichia coli CFT073
cgcaagcggcccggaga

SEQ ID NO: 628473 - RNA, 21 nt, Escherichia coli CFT073
cgcaaggcacaaagucgcgcg

SEQ ID NO: 628474 - RNA, 14 nt, Escherichia coli CFT073
cgcaaggcauugag

SEQ ID NO: 628475 - RNA, 22 nt, Escherichia coli CFT073
cgcaagcugcugacauacggcg

SEQ ID NO: 628476 - RNA, 18 nt, Escherichia coli CFT073
cgcaaaauaccagcaauu

SEQ ID NO: 628477 - RNA, 21 nt, Escherichia coli CFT073
cgcaacagugaaauacaguua

SEQ ID NO: 628478 - RNA, 14 nt, Escherichia coli CFT073
cgcagaccaaccgu

SEQ ID NO: 628479 - RNA, 13 nt, Escherichia coli CFT073
cgcagacaccaga

SEQ ID NO: 628480 - RNA, 16 nt, Escherichia coli CFT073
cgcacuauacaaccag

SEQ ID NO: 628481 - RNA, 15 nt, Escherichia coli CFT073
cgcagaaucucugcg

SEQ ID NO: 628482 - RNA, 20 nt, Escherichia coli CFT073
cgcagaauggcgaacgcuaa

SEQ ID NO: 628483 - RNA, 17 nt, Escherichia coli CFT073
cgcacguugccagcaac

SEQ ID NO: 628484 - RNA, 18 nt, Escherichia coli CFT073
cgcacguugccagcaacu

SEQ ID NO: 628485 - RNA, 18 nt, Escherichia coli CFT073
cgcaccgaagucuuaagu

SEQ ID NO: 628486 - RNA, 16 nt, Escherichia coli CFT073
cgcaccaccagcagcu

SEQ ID NO: 628487 - RNA, 19 nt, Escherichia coli CFT073
cgcacgaggaacagcgcgc

SEQ ID NO: 628488 - RNA, 16 nt, Escherichia coli CFT073
cgcacgcaacccgcuc

SEQ ID NO: 628489 - RNA, 13 nt, Escherichia coli CFT073
cgaucaacagaau

SEQ ID NO: 628490 - RNA, 14 nt, Escherichia coli CFT073
cgaucaacccaguu

SEQ ID NO: 628491 - RNA, 11 nt, Escherichia coli CFT073
cgaucaccgca

SEQ ID NO: 628492 - RNA, 18 nt, Escherichia coli CFT073
cgaugccguuaaggccaa

SEQ ID NO: 628493 - RNA, 15 nt, Escherichia coli CFT073
cgaugcgaccgccgc

SEQ ID NO: 628494 - RNA, 17 nt, Escherichia coli CFT073
cgauggugaugagcuga

SEQ ID NO: 628495 - RNA, 15 nt, Escherichia coli CFT073
cgauggguuugaaaa

SEQ ID NO: 628496 - RNA, 12 nt, Escherichia coli CFT073
cgauggcugggg

SEQ ID NO: 628497 - RNA, 18 nt, Escherichia coli CFT073
cgauggcgggccuggaag

SEQ ID NO: 628498 - RNA, 21 nt, Escherichia coli CFT073
cgauggauggggcgucaacgc

SEQ ID NO: 628499 - RNA, 17 nt, Escherichia coli CFT073
cgaugcuuuccagcugu

SEQ ID NO: 628500 - RNA, 21 nt, Escherichia coli CFT073
cgaugcuuuccagcuguacca

SEQ ID NO: 628501 - RNA, 23 nt, Escherichia coli CFT073
cgauuuauuuuucuggcgcggcg

SEQ ID NO: 628502 - RNA, 11 nt, Escherichia coli CFT073
cgauuucacaa

SEQ ID NO: 628503 - RNA, 18 nt, Escherichia coli CFT073
cgauuucacgcucagcaa

SEQ ID NO: 628504 - RNA, 14 nt, Escherichia coli CFT073
cgauuucagaucag

SEQ ID NO: 628505 - RNA, 20 nt, Escherichia coli CFT073
cgauuucagggguaggaaaa

SEQ ID NO: 628506 - RNA, 20 nt, Escherichia coli CFT073
cgauuugcguaaaaccugcc

SEQ ID NO: 628507 - RNA, 21 nt, Escherichia coli CFT073
cgauuucuacuuauucaccac

SEQ ID NO: 628508 - RNA, 20 nt, Escherichia coli CFT073
cgauuucucaucaauuaaug

SEQ ID NO: 628509 - RNA, 12 nt, Escherichia coli CFT073
cgauuuguucug

SEQ ID NO: 628510 - RNA, 14 nt, Escherichia coli CFT073
cgauuuuucaucac

SEQ ID NO: 628511 - RNA, 17 nt, Escherichia coli CFT073
cgcaaaacccgcuucuu

SEQ ID NO: 628512 - RNA, 14 nt, Escherichia coli CFT073
cgauugaagcagcg

SEQ ID NO: 628513 - RNA, 18 nt, Escherichia coli CFT073
cgauugaagcagcgcugg

SEQ ID NO: 628514 - RNA, 15 nt, Escherichia coli CFT073
cgauuguuccugcuc

SEQ ID NO: 628515 - RNA, 13 nt, Escherichia coli CFT073
cgauucgccgucu

SEQ ID NO: 628516 - RNA, 19 nt, Escherichia coli CFT073
cgauucggcaaucacaaca

SEQ ID NO: 628517 - RNA, 17 nt, Escherichia coli CFT073
cgauucuggugagagca

SEQ ID NO: 628518 - RNA, 18 nt, Escherichia coli CFT073
cgauguuguacaugcugc

SEQ ID NO: 628519 - RNA, 14 nt, Escherichia coli CFT073
cgauguuaccguuu

SEQ ID NO: 628520 - RNA, 18 nt, Escherichia coli CFT073
cgauguggcucagccaga

SEQ ID NO: 628521 - RNA, 22 nt, Escherichia coli CFT073
cgauuccgccgauggugcagca

SEQ ID NO: 628522 - RNA, 22 nt, Escherichia coli CFT073
cgagccgucccuaacaugccac

SEQ ID NO: 628523 - RNA, 23 nt, Escherichia coli CFT073
cgagccgucccuaacaugccacu

SEQ ID NO: 628524 - RNA, 18 nt, Escherichia coli CFT073
cgagcugccaguugcgcu

SEQ ID NO: 628525 - RNA, 13 nt, Escherichia coli CFT073
cgagcuggaagcc

SEQ ID NO: 628526 - RNA, 18 nt, Escherichia coli CFT073
cgagcggccaaagggagc

SEQ ID NO: 628527 - RNA, 18 nt, Escherichia coli CFT073
cgagcggcgggcuuuaau

SEQ ID NO: 628528 - RNA, 14 nt, Escherichia coli CFT073
cgaggccagccaga

SEQ ID NO: 628529 - RNA, 20 nt, Escherichia coli CFT073
cgagggaagcaauaagcacu

SEQ ID NO: 628530 - RNA, 16 nt, Escherichia coli CFT073
cgaggcuuauccggca

SEQ ID NO: 628531 - RNA, 12 nt, Escherichia coli CFT073
cgaggagaggcc

SEQ ID NO: 628532 - RNA, 18 nt, Escherichia coli CFT073
cgaggaucgauaucacca

SEQ ID NO: 628533 - RNA, 17 nt, Escherichia coli CFT073
cgaggaucucugcaaga

SEQ ID NO: 628534 - RNA, 22 nt, Escherichia coli CFT073
cgaggaaucguucauaccacgc

SEQ ID NO: 628535 - RNA, 16 nt, Escherichia coli CFT073
cgaggaaugacggauc

SEQ ID NO: 628536 - RNA, 17 nt, Escherichia coli CFT073
cgagcuuucgaccagcc

SEQ ID NO: 628537 - RNA, 14 nt, Escherichia coli CFT073
cgagcuuaacugcc

SEQ ID NO: 628538 - RNA, 16 nt, Escherichia coli CFT073
cgagcuucgacuuccu

SEQ ID NO: 628539 - RNA, 19 nt, Escherichia coli CFT073
cgagcuucgacuuccugca

SEQ ID NO: 628540 - RNA, 20 nt, Escherichia coli CFT073
cgagcuggugauaaccgcgc

SEQ ID NO: 628541 - RNA, 19 nt, Escherichia coli CFT073
cgaggaacagcgcgcugac

SEQ ID NO: 628542 - RNA, 22 nt, Escherichia coli CFT073
cgauagucguugccacacgacg

SEQ ID NO: 628543 - RNA, 15 nt, Escherichia coli CFT073
cgauaguacauuucu

SEQ ID NO: 628544 - RNA, 15 nt, Escherichia coli CFT073
cgauauguucaggau

SEQ ID NO: 628545 - RNA, 23 nt, Escherichia coli CFT073
cgauauguucaggauauuuauau

SEQ ID NO: 628546 - RNA, 19 nt, Escherichia coli CFT073
cgauauuaguggcaaccgc

SEQ ID NO: 628547 - RNA, 15 nt, Escherichia coli CFT073
cgauaugccggcauc

SEQ ID NO: 628548 - RNA, 23 nt, Escherichia coli CFT073
cgauauggcugcgcuugaggaug

SEQ ID NO: 628549 - RNA, 17 nt, Escherichia coli CFT073
cgauaugggcagcucua

SEQ ID NO: 628550 - RNA, 19 nt, Escherichia coli CFT073
cgauagcagcccagaucag

SEQ ID NO: 628551 - RNA, 21 nt, Escherichia coli CFT073
cgauagcaagcgcugugaaac

SEQ ID NO: 628552 - RNA, 15 nt, Escherichia coli CFT073
cgauacaaaagcacc

SEQ ID NO: 628553 - RNA, 18 nt, Escherichia coli CFT073
cgauacagaccccggcau

SEQ ID NO: 628554 - RNA, 19 nt, Escherichia coli CFT073
cgauaauacgcuaaauaaa

SEQ ID NO: 628555 - RNA, 17 nt, Escherichia coli CFT073
cgauaauaucggccugg

SEQ ID NO: 628556 - RNA, 19 nt, Escherichia coli CFT073
cgauaauauugaugcacac

SEQ ID NO: 628557 - RNA, 13 nt, Escherichia coli CFT073
cgauaacugcucu

SEQ ID NO: 628558 - RNA, 16 nt, Escherichia coli CFT073
cgauaagccagcaacc

SEQ ID NO: 628559 - RNA, 14 nt, Escherichia coli CFT073
cgauaacggucgua

SEQ ID NO: 628560 - RNA, 16 nt, Escherichia coli CFT073
cgaguuuccaucagac

SEQ ID NO: 628561 - RNA, 17 nt, Escherichia coli CFT073
cgaguguaauccugcca

SEQ ID NO: 628562 - RNA, 15 nt, Escherichia coli CFT073
cgaguuagcauggcu

SEQ ID NO: 628563 - RNA, 19 nt, Escherichia coli CFT073
cgaggugccaccagugcag

SEQ ID NO: 628564 - RNA, 22 nt, Escherichia coli CFT073
cgagguugaugauugcgccgcc

SEQ ID NO: 628565 - RNA, 20 nt, Escherichia coli CFT073
cgagguggaacaucaggauc

SEQ ID NO: 628566 - RNA, 18 nt, Escherichia coli CFT073
cgaguagccagcugccug

SEQ ID NO: 628567 - RNA, 12 nt, Escherichia coli CFT073
cgaguaaaaaaa

SEQ ID NO: 628568 - RNA, 15 nt, Escherichia coli CFT073
cgaguaaaaaaacau

SEQ ID NO: 628569 - RNA, 18 nt, Escherichia coli CFT073
cgagugcgggcgagagga

SEQ ID NO: 628570 - RNA, 17 nt, Escherichia coli CFT073
cgagugcauccagugcc

SEQ ID NO: 628571 - RNA, 14 nt, Escherichia coli CFT073
cgagugguaugacu

SEQ ID NO: 628572 - RNA, 22 nt, Escherichia coli CFT073
cgagucgcugagcgugccccug

SEQ ID NO: 628573 - RNA, 17 nt, Escherichia coli CFT073
cgagucgccuuuuucca

SEQ ID NO: 628574 - RNA, 16 nt, Escherichia coli CFT073
cgagucgucaguucca

SEQ ID NO: 628575 - RNA, 20 nt, Escherichia coli CFT073
cgagaaguuuuucgucaccu

SEQ ID NO: 628576 - RNA, 18 nt, Escherichia coli CFT073
cgagaauaaaacaagcag

SEQ ID NO: 628577 - RNA, 14 nt, Escherichia coli CFT073
cgagaauuuccaga

SEQ ID NO: 628578 - RNA, 15 nt, Escherichia coli CFT073
cgagacgagcaagaa

SEQ ID NO: 628579 - RNA, 22 nt, Escherichia coli CFT073
cgagaagacaauccccgccagc

SEQ ID NO: 628580 - RNA, 22 nt, Escherichia coli CFT073
cgagaagccgaccagcaccgcc

SEQ ID NO: 628581 - RNA, 22 nt, Escherichia coli CFT073
cgagaacaccgaaccaaaguag

SEQ ID NO: 628582 - RNA, 14 nt, Escherichia coli CFT073
cgagaggaauuuau

SEQ ID NO: 628583 - RNA, 20 nt, Escherichia coli CFT073
cgagauauugauacaggaaa

SEQ ID NO: 628584 - RNA, 21 nt, Escherichia coli CFT073
cgagauauuucaccagcgcac

SEQ ID NO: 628585 - RNA, 16 nt, Escherichia coli CFT073
cgagaucaacagcaua

SEQ ID NO: 628586 - RNA, 14 nt, Escherichia coli CFT073
cgagauacucaagc

SEQ ID NO: 628587 - RNA, 23 nt, Escherichia coli CFT073
cgagauaaugguuuccagcaucg

SEQ ID NO: 628588 - RNA, 13 nt, Escherichia coli CFT073
cgagauaauguuc

SEQ ID NO: 628589 - RNA, 20 nt, Escherichia coli CFT073
cgagagacgcuugucaccgu

SEQ ID NO: 628590 - RNA, 15 nt, Escherichia coli CFT073
cgagagagaaaauaa

SEQ ID NO: 628591 - RNA, 19 nt, Escherichia coli CFT073
cgagauauccacauuaacg

SEQ ID NO: 628592 - RNA, 22 nt, Escherichia coli CFT073
cgagaucuucgccaucccggca

SEQ ID NO: 628593 - RNA, 19 nt, Escherichia coli CFT073
cgagauugugaacacaagc

SEQ ID NO: 628594 - RNA, 17 nt, Escherichia coli CFT073
cgagauucauccaguuc

SEQ ID NO: 628595 - RNA, 19 nt, Escherichia coli CFT073
cgagccagugcccgcgauu

SEQ ID NO: 628596 - RNA, 15 nt, Escherichia coli CFT073
cgagccauaaaauca

SEQ ID NO: 628597 - RNA, 15 nt, Escherichia coli CFT073
cgagccauaaaccga

SEQ ID NO: 628598 - RNA, 22 nt, Escherichia coli CFT073
cgagcauuucggcuuuauuuuc

SEQ ID NO: 628599 - RNA, 19 nt, Escherichia coli CFT073
cgagcauccgauccuggac

SEQ ID NO: 628600 - RNA, 23 nt, Escherichia coli CFT073
cgagcaucgcgaggaaugacgga

SEQ ID NO: 628601 - RNA, 16 nt, Escherichia coli CFT073
cgagcaguaauccagc

SEQ ID NO: 628602 - RNA, 20 nt, Escherichia coli CFT073
cgagcaguuuggacaugccc

SEQ ID NO: 628603 - RNA, 21 nt, Escherichia coli CFT073
cgagcaaugagcuauguuuga

SEQ ID NO: 628604 - RNA, 13 nt, Escherichia coli CFT073
cgagcagcaauau

SEQ ID NO: 628605 - RNA, 22 nt, Escherichia coli CFT073
cgacggcgaaucaaccgcgccu

SEQ ID NO: 628606 - RNA, 13 nt, Escherichia coli CFT073
cgacgguuaaauu

SEQ ID NO: 628607 - RNA, 15 nt, Escherichia coli CFT073
cgacgguuuccaggc

SEQ ID NO: 628608 - RNA, 15 nt, Escherichia coli CFT073
cgacgguauuaacuc

SEQ ID NO: 628609 - RNA, 20 nt, Escherichia coli CFT073
cgacgucgauuucuggaugg

SEQ ID NO: 628610 - RNA, 13 nt, Escherichia coli CFT073
cgacggcaccaaa

SEQ ID NO: 628611 - RNA, 15 nt, Escherichia coli CFT073
cgacgcuugccgcgu

SEQ ID NO: 628612 - RNA, 15 nt, Escherichia coli CFT073
cgacgcgcuggcaaa

SEQ ID NO: 628613 - RNA, 21 nt, Escherichia coli CFT073
cgacuuccugcaaucuuuccu

SEQ ID NO: 628614 - RNA, 22 nt, Escherichia coli CFT073
cgacuguuuauuguugauucga

SEQ ID NO: 628615 - RNA, 18 nt, Escherichia coli CFT073
cgacuuauucuucaacaa

SEQ ID NO: 628616 - RNA, 14 nt, Escherichia coli CFT073
cgacuuugccuggc

SEQ ID NO: 628617 - RNA, 19 nt, Escherichia coli CFT073
cgacuugcuuuucgcuucc

SEQ ID NO: 628618 - RNA, 17 nt, Escherichia coli CFT073
cgacugugaaguauuaa

SEQ ID NO: 628619 - RNA, 13 nt, Escherichia coli CFT073
cgacuggccaugg

SEQ ID NO: 628620 - RNA, 14 nt, Escherichia coli CFT073
cgacuggcgcggca

SEQ ID NO: 628621 - RNA, 17 nt, Escherichia coli CFT073
cgacuggggcuggaaga

SEQ ID NO: 628622 - RNA, 20 nt, Escherichia coli CFT073
cgacugccagccacacugcg

SEQ ID NO: 628623 - RNA, 20 nt, Escherichia coli CFT073
cgacugaaaggucaucauca

SEQ ID NO: 628624 - RNA, 17 nt, Escherichia coli CFT073
cgacucugaaugccagu

SEQ ID NO: 628625 - RNA, 20 nt, Escherichia coli CFT073
cgacugcaagccaugacgca

SEQ ID NO: 628626 - RNA, 18 nt, Escherichia coli CFT073
cgacgucgguuuccagca

SEQ ID NO: 628627 - RNA, 15 nt, Escherichia coli CFT073
cgacucaaaucacgc

SEQ ID NO: 628628 - RNA, 18 nt, Escherichia coli CFT073
cgacucaaaucacgcagu

SEQ ID NO: 628629 - RNA, 16 nt, Escherichia coli CFT073
ccugaaugccgcgccc

SEQ ID NO: 628630 - RNA, 22 nt, Escherichia coli CFT073
ccugaaucagccaguaaaccaa

SEQ ID NO: 628631 - RNA, 23 nt, Escherichia coli CFT073
ccugaaucagccaguaaaccaau

SEQ ID NO: 628632 - RNA, 23 nt, Escherichia coli CFT073
ccugaauccgcgauuaucccaua

SEQ ID NO: 628633 - RNA, 16 nt, Escherichia coli CFT073
ccugaauaaacgccau

SEQ ID NO: 628634 - RNA, 11 nt, Escherichia coli CFT073
ccugaauaauc

SEQ ID NO: 628635 - RNA, 23 nt, Escherichia coli CFT073
ccugcaaucuuuccugcacaaug

SEQ ID NO: 628636 - RNA, 19 nt, Escherichia coli CFT073
ccugaauugacuacaaaaa

SEQ ID NO: 628637 - RNA, 21 nt, Escherichia coli CFT073
ccugaauugacuacaaaaaaa

SEQ ID NO: 628638 - RNA, 17 nt, Escherichia coli CFT073
ccugcacaaugccuuuu

SEQ ID NO: 628639 - RNA, 19 nt, Escherichia coli CFT073
ccugcaccggugcauccac

SEQ ID NO: 628640 - RNA, 14 nt, Escherichia coli CFT073
ccugcacugguggc

SEQ ID NO: 628641 - RNA, 18 nt, Escherichia coli CFT073
ccugcacugucccaaaau

SEQ ID NO: 628642 - RNA, 16 nt, Escherichia coli CFT073
ccugcaguaaagcccg

SEQ ID NO: 628643 - RNA, 18 nt, Escherichia coli CFT073
ccugcagugcgcgaacca

SEQ ID NO: 628644 - RNA, 21 nt, Escherichia coli CFT073
ccugcauaaaggcaaaacagu

SEQ ID NO: 628645 - RNA, 13 nt, Escherichia coli CFT073
ccugcauacugac

SEQ ID NO: 628646 - RNA, 23 nt, Escherichia coli CFT073
ccugcauaucgguaaaugcuuua

SEQ ID NO: 628647 - RNA, 11 nt, Escherichia coli CFT073
ccugcauaucg

SEQ ID NO: 628648 - RNA, 15 nt, Escherichia coli CFT073
ccugccccaucugcc

SEQ ID NO: 628649 - RNA, 14 nt, Escherichia coli CFT073
ccugcccgauaaaa

SEQ ID NO: 628650 - RNA, 15 nt, Escherichia coli CFT073
ccugcccgcuccagc

SEQ ID NO: 628651 - RNA, 13 nt, Escherichia coli CFT073
ccugcccgcugcc

SEQ ID NO: 628652 - RNA, 17 nt, Escherichia coli CFT073
ccugcccgcugccagga

SEQ ID NO: 628653 - RNA, 21 nt, Escherichia coli CFT073
ccugcccggagccaucccugc

SEQ ID NO: 628654 - RNA, 15 nt, Escherichia coli CFT073
ccugcggacagucac

SEQ ID NO: 628655 - RNA, 19 nt, Escherichia coli CFT073
ccugcggagaucaccacau

SEQ ID NO: 628656 - RNA, 23 nt, Escherichia coli CFT073
ccugcgcuggcaggccugcuuug

SEQ ID NO: 628657 - RNA, 15 nt, Escherichia coli CFT073
ccugcggccagcagc

SEQ ID NO: 628658 - RNA, 18 nt, Escherichia coli CFT073
ccugcgcggcaaugcgcc

SEQ ID NO: 628659 - RNA, 14 nt, Escherichia coli CFT073
ccugcgucgccauc

SEQ ID NO: 628660 - RNA, 18 nt, Escherichia coli CFT073
ccugcgguugaaacacag

SEQ ID NO: 628661 - RNA, 16 nt, Escherichia coli CFT073
ccugcggguucuuacc

SEQ ID NO: 628662 - RNA, 20 nt, Escherichia coli CFT073
ccugcggggagaaugccagc

SEQ ID NO: 628663 - RNA, 17 nt, Escherichia coli CFT073
ccugcggcggcaucgcc

SEQ ID NO: 628664 - RNA, 13 nt, Escherichia coli CFT073
ccugcgauaaacc

SEQ ID NO: 628665 - RNA, 15 nt, Escherichia coli CFT073
ccugcgagccgccgc

SEQ ID NO: 628666 - RNA, 23 nt, Escherichia coli CFT073
ccugcgcacgcguaauauccagc

SEQ ID NO: 628667 - RNA, 14 nt, Escherichia coli CFT073
ccugcgcaaggcau

SEQ ID NO: 628668 - RNA, 23 nt, Escherichia coli CFT073
ccugcgcauuucgcucuucacau

SEQ ID NO: 628669 - RNA, 15 nt, Escherichia coli CFT073
ccugcgccagccagc

SEQ ID NO: 628670 - RNA, 18 nt, Escherichia coli CFT073
ccugcgccaccacaacau

SEQ ID NO: 628671 - RNA, 14 nt, Escherichia coli CFT073
ccugcgccaccguu

SEQ ID NO: 628672 - RNA, 19 nt, Escherichia coli CFT073
ccuggcacuguucauugau

SEQ ID NO: 628673 - RNA, 13 nt, Escherichia coli CFT073
ccuggcacagcag

SEQ ID NO: 628674 - RNA, 19 nt, Escherichia coli CFT073
ccuggcaauagcgcacgcc

SEQ ID NO: 628675 - RNA, 16 nt, Escherichia coli CFT073
ccuggcgggaauaaaa

SEQ ID NO: 628676 - RNA, 23 nt, Escherichia coli CFT073
ccuggcgggaauaaaagccagga

SEQ ID NO: 628677 - RNA, 23 nt, Escherichia coli CFT073
ccuggaggagaguaugcgcguca

SEQ ID NO: 628678 - RNA, 21 nt, Escherichia coli CFT073
ccuggagaguguuuuaucugu

SEQ ID NO: 628679 - RNA, 24 nt, Escherichia coli CFT073
ccugcugauaagacgcauccacca

SEQ ID NO: 628680 - RNA, 14 nt, Escherichia coli CFT073
ccugcugcacagag

SEQ ID NO: 628681 - RNA, 14 nt, Escherichia coli CFT073
ccuggacuuuaaac

SEQ ID NO: 628682 - RNA, 12 nt, Escherichia coli CFT073
ccugcuaacagu

SEQ ID NO: 628683 - RNA, 23 nt, Escherichia coli CFT073
ccugcuaccgggaucuccuccag

SEQ ID NO: 628684 - RNA, 22 nt, Escherichia coli CFT073
ccugcucaaguaauaaagcacc

SEQ ID NO: 628685 - RNA, 16 nt, Escherichia coli CFT073
ccugcgucugaugaaa

SEQ ID NO: 628686 - RNA, 15 nt, Escherichia coli CFT073
ccuguacgucgagaa

SEQ ID NO: 628687 - RNA, 21 nt, Escherichia coli CFT073
ccuguaaguuacuaaaaguaa

SEQ ID NO: 628688 - RNA, 13 nt, Escherichia coli CFT073
ccuggucaaagac

SEQ ID NO: 628689 - RNA, 18 nt, Escherichia coli CFT073
ccugggcuucauccagca

SEQ ID NO: 628690 - RNA, 18 nt, Escherichia coli CFT073
ccuggguuagccagaaca

SEQ ID NO: 628691 - RNA, 20 nt, Escherichia coli CFT073
ccuguaggucggauaagacg

SEQ ID NO: 628692 - RNA, 16 nt, Escherichia coli CFT073
ccuguaggccugauaa

SEQ ID NO: 628693 - RNA, 17 nt, Escherichia coli CFT073
ccugucagacuuaagcc

SEQ ID NO: 628694 - RNA, 22 nt, Escherichia coli CFT073
ccuguccagacggagcugccag

SEQ ID NO: 628695 - RNA, 23 nt, Escherichia coli CFT073
ccugucgcuuuugcaucuucagu

SEQ ID NO: 628696 - RNA, 15 nt, Escherichia coli CFT073
ccugugcgauuuccu

SEQ ID NO: 628697 - RNA, 16 nt, Escherichia coli CFT073
ccugugcgauuuccuu

SEQ ID NO: 628698 - RNA, 16 nt, Escherichia coli CFT073
ccugucuaaccgccug

SEQ ID NO: 628699 - RNA, 18 nt, Escherichia coli CFT073
ccugugccgccgcccggc

SEQ ID NO: 628700 - RNA, 16 nt, Escherichia coli CFT073
ccugucgugacaucca

SEQ ID NO: 628701 - RNA, 18 nt, Escherichia coli CFT073
ccugugcgcccuguucug

SEQ ID NO: 628702 - RNA, 18 nt, Escherichia coli CFT073
ccugugggccgauggcua

SEQ ID NO: 628703 - RNA, 13 nt, Escherichia coli CFT073
ccuguggcuuuuu

SEQ ID NO: 628704 - RNA, 17 nt, Escherichia coli CFT073
ccucgguuaacagcgca

SEQ ID NO: 628705 - RNA, 13 nt, Escherichia coli CFT073
ccugaaaacgaaa

SEQ ID NO: 628706 - RNA, 23 nt, Escherichia coli CFT073
ccugaaacgcggcguaaccaccc

SEQ ID NO: 628707 - RNA, 19 nt, Escherichia coli CFT073
ccucuuucaccagaucgcc

SEQ ID NO: 628708 - RNA, 23 nt, Escherichia coli CFT073
ccucuuuguaccaguuaaagcuc

SEQ ID NO: 628709 - RNA, 17 nt, Escherichia coli CFT073
ccugaaagcugagaaaa

SEQ ID NO: 628710 - RNA, 17 nt, Escherichia coli CFT073
ccugaacaccagaacca

SEQ ID NO: 628711 - RNA, 22 nt, Escherichia coli CFT073
ccugaacuuguuuacaaauaau

SEQ ID NO: 628712 - RNA, 16 nt, Escherichia coli CFT073
ccucgugcaccgccug

SEQ ID NO: 628713 - RNA, 20 nt, Escherichia coli CFT073
ccucgucggcgguuuucauc

SEQ ID NO: 628714 - RNA, 18 nt, Escherichia coli CFT073
ccucuaaaccccaaccac

SEQ ID NO: 628715 - RNA, 18 nt, Escherichia coli CFT073
ccucguuucgcccugccu

SEQ ID NO: 628716 - RNA, 20 nt, Escherichia coli CFT073
ccucugcaccagaacucccu

SEQ ID NO: 628717 - RNA, 17 nt, Escherichia coli CFT073
ccucuugcauuguguaa

SEQ ID NO: 628718 - RNA, 14 nt, Escherichia coli CFT073
ccucuucuuuaaaa

SEQ ID NO: 628719 - RNA, 16 nt, Escherichia coli CFT073
ccucuucuuuuagcuc

SEQ ID NO: 628720 - RNA, 23 nt, Escherichia coli CFT073
ccucccgcuguuuguucaagcgc

SEQ ID NO: 628721 - RNA, 17 nt, Escherichia coli CFT073
ccuccccaucgucagcc

SEQ ID NO: 628722 - RNA, 15 nt, Escherichia coli CFT073
ccuccaugaaaauag

SEQ ID NO: 628723 - RNA, 18 nt, Escherichia coli CFT073
ccucccauucaucgccac

SEQ ID NO: 628724 - RNA, 20 nt, Escherichia coli CFT073
ccuccauaagaguagcccga

SEQ ID NO: 628725 - RNA, 23 nt, Escherichia coli CFT073
ccucccguaacgacgcagaaaug

SEQ ID NO: 628726 - RNA, 22 nt, Escherichia coli CFT073
ccucccguuuuuagauuguuuu

SEQ ID NO: 628727 - RNA, 14 nt, Escherichia coli CFT073
ccuccggcguacag

SEQ ID NO: 628728 - RNA, 17 nt, Escherichia coli CFT073
ccuccugcggcuucaac

SEQ ID NO: 628729 - RNA, 19 nt, Escherichia coli CFT073
ccuccugucuaaccgccug

SEQ ID NO: 628730 - RNA, 12 nt, Escherichia coli CFT073
ccuccugcagcg

SEQ ID NO: 628731 - RNA, 13 nt, Escherichia coli CFT073
ccuccugcagcgu

SEQ ID NO: 628732 - RNA, 22 nt, Escherichia coli CFT073
ccuccugcaaaugcugacgugu

SEQ ID NO: 628733 - RNA, 11 nt, Escherichia coli CFT073
ccuccaccacu

SEQ ID NO: 628734 - RNA, 12 nt, Escherichia coli CFT073
ccucauuuaaaa

SEQ ID NO: 628735 - RNA, 15 nt, Escherichia coli CFT073
ccuccaaaaaacaaa

SEQ ID NO: 628736 - RNA, 19 nt, Escherichia coli CFT073
ccucauuuucaauucuaga

SEQ ID NO: 628737 - RNA, 22 nt, Escherichia coli CFT073
ccuccagcgagcuggcgcugau

SEQ ID NO: 628738 - RNA, 22 nt, Escherichia coli CFT073
ccucaucaauauugucuucauc

SEQ ID NO: 628739 - RNA, 17 nt, Escherichia coli CFT073
ccuaccugcaguucauc

SEQ ID NO: 628740 - RNA, 16 nt, Escherichia coli CFT073
ccuacgggaacagugc

SEQ ID NO: 628741 - RNA, 18 nt, Escherichia coli CFT073
ccuacgggaacagugcuc

SEQ ID NO: 628742 - RNA, 22 nt, Escherichia coli CFT073
ccggcuccaguuaacgccgcgc

SEQ ID NO: 628743 - RNA, 14 nt, Escherichia coli CFT073
ccggcuacgugccg

SEQ ID NO: 628744 - RNA, 20 nt, Escherichia coli CFT073
ccggcguuuuuauuauuaaa

SEQ ID NO: 628745 - RNA, 16 nt, Escherichia coli CFT073
ccggcguuucuggcaa

SEQ ID NO: 628746 - RNA, 19 nt, Escherichia coli CFT073
ccggcugcugcaaugccau

SEQ ID NO: 628747 - RNA, 15 nt, Escherichia coli CFT073
ccggcugaccuggaa

SEQ ID NO: 628748 - RNA, 15 nt, Escherichia coli CFT073
ccggcuuccugcagc

SEQ ID NO: 628749 - RNA, 16 nt, Escherichia coli CFT073
ccggcuuccugcagcg

SEQ ID NO: 628750 - RNA, 16 nt, Escherichia coli CFT073
ccggcuucuuuugcug

SEQ ID NO: 628751 - RNA, 16 nt, Escherichia coli CFT073
ccggcguaugcccagg

SEQ ID NO: 628752 - RNA, 22 nt, Escherichia coli CFT073
ccggcguccaccugcgucgcgc

SEQ ID NO: 628753 - RNA, 23 nt, Escherichia coli CFT073
ccggcgucagauucggauccagc

SEQ ID NO: 628754 - RNA, 18 nt, Escherichia coli CFT073
ccggcggcuugcaccagc

SEQ ID NO: 628755 - RNA, 19 nt, Escherichia coli CFT073
ccggcggcuugcaccagca

SEQ ID NO: 628756 - RNA, 11 nt, Escherichia coli CFT073
ccggccacagc

SEQ ID NO: 628757 - RNA, 12 nt, Escherichia coli CFT073
ccggcggcagca

SEQ ID NO: 628758 - RNA, 14 nt, Escherichia coli CFT073
ccggcggcacagcc

SEQ ID NO: 628759 - RNA, 15 nt, Escherichia coli CFT073
ccgguaugacgagga

SEQ ID NO: 628760 - RNA, 16 nt, Escherichia coli CFT073
ccgguaguaagcguuu

SEQ ID NO: 628761 - RNA, 21 nt, Escherichia coli CFT073
ccgguauaacuugccaggccg

SEQ ID NO: 628762 - RNA, 12 nt, Escherichia coli CFT073
ccgguaucacuc

SEQ ID NO: 628763 - RNA, 13 nt, Escherichia coli CFT073
ccgguccuucauc

SEQ ID NO: 628764 - RNA, 14 nt, Escherichia coli CFT073
ccgguccuggcgau

SEQ ID NO: 628765 - RNA, 22 nt, Escherichia coli CFT073
ccggucuuucuuuuuuucacuu

SEQ ID NO: 628766 - RNA, 15 nt, Escherichia coli CFT073
ccgguaaagcaauga

SEQ ID NO: 628767 - RNA, 18 nt, Escherichia coli CFT073
ccggguuuaacccuguac

SEQ ID NO: 628768 - RNA, 20 nt, Escherichia coli CFT073
ccgggucagcccccacgcca

SEQ ID NO: 628769 - RNA, 19 nt, Escherichia coli CFT073
ccgggugugacaacaacau

SEQ ID NO: 628770 - RNA, 19 nt, Escherichia coli CFT073
ccgggguuuugcugauuaa

SEQ ID NO: 628771 - RNA, 20 nt, Escherichia coli CFT073
ccgggaacaccgguauucuc

SEQ ID NO: 628772 - RNA, 13 nt, Escherichia coli CFT073
ccgggagcuguuu

SEQ ID NO: 628773 - RNA, 15 nt, Escherichia coli CFT073
ccgggcuuggggugu

SEQ ID NO: 628774 - RNA, 21 nt, Escherichia coli CFT073
ccggggagauauuccccagac

SEQ ID NO: 628775 - RNA, 19 nt, Escherichia coli CFT073
ccguuccucaccguuuaau

SEQ ID NO: 628776 - RNA, 19 nt, Escherichia coli CFT073
ccguuuguaggccugauaa

SEQ ID NO: 628777 - RNA, 14 nt, Escherichia coli CFT073
ccguuuucacccuc

SEQ ID NO: 628778 - RNA, 14 nt, Escherichia coli CFT073
ccuaaauuuuucca

SEQ ID NO: 628779 - RNA, 17 nt, Escherichia coli CFT073
ccuaacaaccaucccca

SEQ ID NO: 628780 - RNA, 15 nt, Escherichia coli CFT073
ccguuugccagaacu

SEQ ID NO: 628781 - RNA, 16 nt, Escherichia coli CFT073
ccuaacucuuccugcg

SEQ ID NO: 628782 - RNA, 14 nt, Escherichia coli CFT073
ccuaacucuuucaa

SEQ ID NO: 628783 - RNA, 18 nt, Escherichia coli CFT073
ccuaacaaccauccccaa

SEQ ID NO: 628784 - RNA, 21 nt, Escherichia coli CFT073
ccuaacacagcaauaauaaua

SEQ ID NO: 628785 - RNA, 23 nt, Escherichia coli CFT073
ccuaacagggcgcuguugcuauc

SEQ ID NO: 628786 - RNA, 13 nt, Escherichia coli CFT073
ccuaacaucaucc

SEQ ID NO: 628787 - RNA, 20 nt, Escherichia coli CFT073
ccuaaugucgacauaaucaa

SEQ ID NO: 628788 - RNA, 20 nt, Escherichia coli CFT073
ccuacaugauuucugcaaua

SEQ ID NO: 628789 - RNA, 17 nt, Escherichia coli CFT073
ccuacauauccgcgccu

SEQ ID NO: 628790 - RNA, 18 nt, Escherichia coli CFT073
ccuacagguaagguaaug

SEQ ID NO: 628791 - RNA, 14 nt, Escherichia coli CFT073
ccgugagcaaugca

SEQ ID NO: 628792 - RNA, 20 nt, Escherichia coli CFT073
ccgugaaaacagcaaccucc

SEQ ID NO: 628793 - RNA, 19 nt, Escherichia coli CFT073
ccgugaacgugaccaugag

SEQ ID NO: 628794 - RNA, 18 nt, Escherichia coli CFT073
ccgucuucgucuggcugu

SEQ ID NO: 628795 - RNA, 19 nt, Escherichia coli CFT073
ccgucuucuucccagaccc

SEQ ID NO: 628796 - RNA, 19 nt, Escherichia coli CFT073
ccgugcaucuccugaaaca

SEQ ID NO: 628797 - RNA, 16 nt, Escherichia coli CFT073
ccgugccccauauggc

SEQ ID NO: 628798 - RNA, 18 nt, Escherichia coli CFT073
ccguggcaaauugcccaa

SEQ ID NO: 628799 - RNA, 19 nt, Escherichia coli CFT073
ccgugguggcagccagcca

SEQ ID NO: 628800 - RNA, 13 nt, Escherichia coli CFT073
ccgugcgcuuuuu

SEQ ID NO: 628801 - RNA, 17 nt, Escherichia coli CFT073
ccguuauguuucaucca

SEQ ID NO: 628802 - RNA, 19 nt, Escherichia coli CFT073
ccguuauguuucauccagg

SEQ ID NO: 628803 - RNA, 17 nt, Escherichia coli CFT073
ccguuccacccagcuca

SEQ ID NO: 628804 - RNA, 13 nt, Escherichia coli CFT073
ccguucauccgcu

SEQ ID NO: 628805 - RNA, 15 nt, Escherichia coli CFT073
ccgugucccagguug

SEQ ID NO: 628806 - RNA, 19 nt, Escherichia coli CFT073
ccguaacgccuuucaggug

SEQ ID NO: 628807 - RNA, 18 nt, Escherichia coli CFT073
ccguaagcaaacagagca

SEQ ID NO: 628808 - RNA, 17 nt, Escherichia coli CFT073
ccguagcguaaaucauc

SEQ ID NO: 628809 - RNA, 15 nt, Escherichia coli CFT073
ccguagcccaucagc

SEQ ID NO: 628810 - RNA, 18 nt, Escherichia coli CFT073
ccguagcccaucagcugg

SEQ ID NO: 628811 - RNA, 13 nt, Escherichia coli CFT073
ccguaggccagcg

SEQ ID NO: 628812 - RNA, 14 nt, Escherichia coli CFT073
ccguaguuccacau

SEQ ID NO: 628813 - RNA, 13 nt, Escherichia coli CFT073
ccguaguggccac

SEQ ID NO: 628814 - RNA, 22 nt, Escherichia coli CFT073
ccguagugggucagcggcggcu

SEQ ID NO: 628815 - RNA, 18 nt, Escherichia coli CFT073
ccgucacguuuugcgccg

SEQ ID NO: 628816 - RNA, 14 nt, Escherichia coli CFT073
ccgucagcaaaaua

SEQ ID NO: 628817 - RNA, 22 nt, Escherichia coli CFT073
ccguaacaggugauaauccaga

SEQ ID NO: 628818 - RNA, 18 nt, Escherichia coli CFT073
ccguaacauaacagccau

SEQ ID NO: 628819 - RNA, 21 nt, Escherichia coli CFT073
ccguaaccaccagcacugauu

SEQ ID NO: 628820 - RNA, 20 nt, Escherichia coli CFT073
ccguaaagcccauaccacag

SEQ ID NO: 628821 - RNA, 14 nt, Escherichia coli CFT073
ccgguuuucugccu

SEQ ID NO: 628822 - RNA, 16 nt, Escherichia coli CFT073
ccgguuuugcaggaaa

SEQ ID NO: 628823 - RNA, 18 nt, Escherichia coli CFT073
ccgguuuuacuuugccuu

SEQ ID NO: 628824 - RNA, 12 nt, Escherichia coli CFT073
ccgguuuuucaa

SEQ ID NO: 628825 - RNA, 16 nt, Escherichia coli CFT073
ccggugaccaucagca

SEQ ID NO: 628826 - RNA, 13 nt, Escherichia coli CFT073
ccggugccaucuc

SEQ ID NO: 628827 - RNA, 22 nt, Escherichia coli CFT073
ccggugccauuucgcugguacc

SEQ ID NO: 628828 - RNA, 17 nt, Escherichia coli CFT073
ccggugccaaagucauc

SEQ ID NO: 628829 - RNA, 12 nt, Escherichia coli CFT073
ccgucugcugcu

SEQ ID NO: 628830 - RNA, 18 nt, Escherichia coli CFT073
ccgucugcaccgagagaa

SEQ ID NO: 628831 - RNA, 19 nt, Escherichia coli CFT073
ccgucugccacuucuucca

SEQ ID NO: 628832 - RNA, 14 nt, Escherichia coli CFT073
ccgucgucccuucc

SEQ ID NO: 628833 - RNA, 17 nt, Escherichia coli CFT073
ccgucguagccaccauc

SEQ ID NO: 628834 - RNA, 16 nt, Escherichia coli CFT073
ccgucagcgcaugauu

SEQ ID NO: 628835 - RNA, 19 nt, Escherichia coli CFT073
ccgucagcaaaguaccauc

SEQ ID NO: 628836 - RNA, 15 nt, Escherichia coli CFT073
ccgucagcagaucca

SEQ ID NO: 628837 - RNA, 18 nt, Escherichia coli CFT073
ccgucgagaaucaacaca

SEQ ID NO: 628838 - RNA, 13 nt, Escherichia coli CFT073
ccgcuuuuuucau

SEQ ID NO: 628839 - RNA, 14 nt, Escherichia coli CFT073
ccgcuuucaacgcg

SEQ ID NO: 628840 - RNA, 14 nt, Escherichia coli CFT073
ccgcuuugcagaau

SEQ ID NO: 628841 - RNA, 13 nt, Escherichia coli CFT073
ccgcuuuccucau

SEQ ID NO: 628842 - RNA, 17 nt, Escherichia coli CFT073
ccggaagcgccaccagc

SEQ ID NO: 628843 - RNA, 12 nt, Escherichia coli CFT073
ccggaagacuga

SEQ ID NO: 628844 - RNA, 15 nt, Escherichia coli CFT073
ccggaaguccgagga

SEQ ID NO: 628845 - RNA, 19 nt, Escherichia coli CFT073
ccggaaucagaauccggug

SEQ ID NO: 628846 - RNA, 14 nt, Escherichia coli CFT073
ccggaaccaccaga

SEQ ID NO: 628847 - RNA, 21 nt, Escherichia coli CFT073
ccggaaccggauuuucaccau

SEQ ID NO: 628848 - RNA, 22 nt, Escherichia coli CFT073
ccggaacgggagaaacccggcc

SEQ ID NO: 628849 - RNA, 21 nt, Escherichia coli CFT073
ccggaauuucuuucagcaguu

SEQ ID NO: 628850 - RNA, 17 nt, Escherichia coli CFT073
ccggagacaaacagggu

SEQ ID NO: 628851 - RNA, 18 nt, Escherichia coli CFT073
ccggacuccagacaccgc

SEQ ID NO: 628852 - RNA, 19 nt, Escherichia coli CFT073
ccggacguuugauuuuuaa

SEQ ID NO: 628853 - RNA, 15 nt, Escherichia coli CFT073
ccggcaauaaaacag

SEQ ID NO: 628854 - RNA, 19 nt, Escherichia coli CFT073
ccggcaauaaaacagggcg

SEQ ID NO: 628855 - RNA, 24 nt, Escherichia coli CFT073
ccggcacgaauugcuuccaguaac

SEQ ID NO: 628856 - RNA, 19 nt, Escherichia coli CFT073
ccggcaacguugccaguac

SEQ ID NO: 628857 - RNA, 23 nt, Escherichia coli CFT073
ccggcaacguugccaguaccauc

SEQ ID NO: 628858 - RNA, 18 nt, Escherichia coli CFT073
ccggcaacgaccgcgagc

SEQ ID NO: 628859 - RNA, 18 nt, Escherichia coli CFT073
ccggcaacgucaguccca

SEQ ID NO: 628860 - RNA, 22 nt, Escherichia coli CFT073
ccggauaagguguucacgccgc

SEQ ID NO: 628861 - RNA, 18 nt, Escherichia coli CFT073
ccggauacaaaaaaggcc

SEQ ID NO: 628862 - RNA, 21 nt, Escherichia coli CFT073
ccggcagagaggacucugccg

SEQ ID NO: 628863 - RNA, 22 nt, Escherichia coli CFT073
ccggcacugaaagagucgccag

SEQ ID NO: 628864 - RNA, 13 nt, Escherichia coli CFT073
ccggcagagaaaa

SEQ ID NO: 628865 - RNA, 22 nt, Escherichia coli CFT073
ccggcagagaaaaugccgcaca

SEQ ID NO: 628866 - RNA, 23 nt, Escherichia coli CFT073
ccggcaggaauaucgaucgccgc

SEQ ID NO: 628867 - RNA, 23 nt, Escherichia coli CFT073
ccggcauuucggcccaugacaaa

SEQ ID NO: 628868 - RNA, 20 nt, Escherichia coli CFT073
ccggcauuucuugugcaaug

SEQ ID NO: 628869 - RNA, 15 nt, Escherichia coli CFT073
ccgcuaacugauacc

SEQ ID NO: 628870 - RNA, 23 nt, Escherichia coli CFT073
ccgcuaacaugguuaaaaucucc

SEQ ID NO: 628871 - RNA, 15 nt, Escherichia coli CFT073
ccgcguuggcgcagc

SEQ ID NO: 628872 - RNA, 19 nt, Escherichia coli CFT073
ccgcguuccugacgaucaa

SEQ ID NO: 628873 - RNA, 23 nt, Escherichia coli CFT073
ccgcguuccugacgaucaagcga

SEQ ID NO: 628874 - RNA, 21 nt, Escherichia coli CFT073
ccgcguaaacgugcggcugug

SEQ ID NO: 628875 - RNA, 23 nt, Escherichia coli CFT073
ccgcguaaacgugcggcugugcg

SEQ ID NO: 628876 - RNA, 14 nt, Escherichia coli CFT073
ccgcgucaaucugc

SEQ ID NO: 628877 - RNA, 15 nt, Escherichia coli CFT073
ccgcguacgccgcuc

SEQ ID NO: 628878 - RNA, 15 nt, Escherichia coli CFT073
ccgcuguugccagca

SEQ ID NO: 628879 - RNA, 17 nt, Escherichia coli CFT073
ccgcuguuaugcacacg

SEQ ID NO: 628880 - RNA, 19 nt, Escherichia coli CFT073
ccgcuggcgcagcaggcgg

SEQ ID NO: 628881 - RNA, 21 nt, Escherichia coli CFT073
ccgcuggcgcagcgugcucuc

SEQ ID NO: 628882 - RNA, 13 nt, Escherichia coli CFT073
ccgcuggcauaca

SEQ ID NO: 628883 - RNA, 17 nt, Escherichia coli CFT073
ccgcucugcaucccggc

SEQ ID NO: 628884 - RNA, 22 nt, Escherichia coli CFT073
ccgcucugcaucccggcaggaa

SEQ ID NO: 628885 - RNA, 19 nt, Escherichia coli CFT073
ccgcucacgcagcggcggc

SEQ ID NO: 628886 - RNA, 14 nt, Escherichia coli CFT073
ccgcuauguuuauu

SEQ ID NO: 628887 - RNA, 19 nt, Escherichia coli CFT073
ccgcuauuauacugcgcuu

SEQ ID NO: 628888 - RNA, 19 nt, Escherichia coli CFT073
ccgccguuaccuucggccc

SEQ ID NO: 628889 - RNA, 21 nt, Escherichia coli CFT073
ccgccguuaccuucggcccca

SEQ ID NO: 628890 - RNA, 14 nt, Escherichia coli CFT073
ccgccguugcucuu

SEQ ID NO: 628891 - RNA, 16 nt, Escherichia coli CFT073
ccgccuaauaccagaa

SEQ ID NO: 628892 - RNA, 13 nt, Escherichia coli CFT073
ccgccucagccag

SEQ ID NO: 628893 - RNA, 15 nt, Escherichia coli CFT073
ccgccucagccagaa

SEQ ID NO: 628894 - RNA, 20 nt, Escherichia coli CFT073
ccgccucaucaucgcgcguu

SEQ ID NO: 628895 - RNA, 20 nt, Escherichia coli CFT073
ccgccucugccgcaauggcc

SEQ ID NO: 628896 - RNA, 23 nt, Escherichia coli CFT073
ccgccgguggcguuuccagcagu

SEQ ID NO: 628897 - RNA, 23 nt, Escherichia coli CFT073
ccgccugcauaaaggcaaaacag

SEQ ID NO: 628898 - RNA, 23 nt, Escherichia coli CFT073
ccgccugauuuacuuacuucugc

SEQ ID NO: 628899 - RNA, 20 nt, Escherichia coli CFT073
ccgcgacgacgacaggcaag

SEQ ID NO: 628900 - RNA, 14 nt, Escherichia coli CFT073
ccgcgagugcgggc

SEQ ID NO: 628901 - RNA, 22 nt, Escherichia coli CFT073
ccgcgccggaaaccagcggcac

SEQ ID NO: 628902 - RNA, 16 nt, Escherichia coli CFT073
ccgcgccgcgcggagc

SEQ ID NO: 628903 - RNA, 15 nt, Escherichia coli CFT073
ccgcgccgcagccgg

SEQ ID NO: 628904 - RNA, 15 nt, Escherichia coli CFT073
ccgccaugccgacgg

SEQ ID NO: 628905 - RNA, 17 nt, Escherichia coli CFT073
ccgcccagugccagcac

SEQ ID NO: 628906 - RNA, 17 nt, Escherichia coli CFT073
ccgccccaaagggcggc

SEQ ID NO: 628907 - RNA, 14 nt, Escherichia coli CFT073
ccgcccauccaggg

SEQ ID NO: 628908 - RNA, 14 nt, Escherichia coli CFT073
ccgcccccgccagc

SEQ ID NO: 628909 - RNA, 15 nt, Escherichia coli CFT073
ccgcccccgccagcg

SEQ ID NO: 628910 - RNA, 13 nt, Escherichia coli CFT073
ccgccgagaaaua

SEQ ID NO: 628911 - RNA, 22 nt, Escherichia coli CFT073
ccgccgagaaauaucagcagca

SEQ ID NO: 628912 - RNA, 20 nt, Escherichia coli CFT073
ccgccgaagucccuacugcu

SEQ ID NO: 628913 - RNA, 23 nt, Escherichia coli CFT073
ccgcccguuuucuccagcgccgc

SEQ ID NO: 628914 - RNA, 17 nt, Escherichia coli CFT073
ccgcccgaugaauagca

SEQ ID NO: 628915 - RNA, 18 nt, Escherichia coli CFT073
ccgccccggguuuccugg

SEQ ID NO: 628916 - RNA, 12 nt, Escherichia coli CFT073
ccgccgcuccuc

SEQ ID NO: 628917 - RNA, 19 nt, Escherichia coli CFT073
ccgccggaaagcaguaccg

SEQ ID NO: 628918 - RNA, 22 nt, Escherichia coli CFT073
ccgccggaucgaauaacuccgc

SEQ ID NO: 628919 - RNA, 23 nt, Escherichia coli CFT073
ccgccgccacuucuggcggcggc

SEQ ID NO: 628920 - RNA, 15 nt, Escherichia coli CFT073
ccgccgccacaauca

SEQ ID NO: 628921 - RNA, 22 nt, Escherichia coli CFT073
ccgauuuuauguaaagacuuca

SEQ ID NO: 628922 - RNA, 18 nt, Escherichia coli CFT073
ccgauuuugccuucauac

SEQ ID NO: 628923 - RNA, 20 nt, Escherichia coli CFT073
ccgauuucaugaagcugaca

SEQ ID NO: 628924 - RNA, 20 nt, Escherichia coli CFT073
ccgauuguacuuuaaaauaa

SEQ ID NO: 628925 - RNA, 19 nt, Escherichia coli CFT073
ccgcaaagguugcagcucc

SEQ ID NO: 628926 - RNA, 20 nt, Escherichia coli CFT073
ccgcaaagguugcagcuccc

SEQ ID NO: 628927 - RNA, 13 nt, Escherichia coli CFT073
ccgcaacauauaa

SEQ ID NO: 628928 - RNA, 15 nt, Escherichia coli CFT073
ccgcaacauauaagu

SEQ ID NO: 628929 - RNA, 19 nt, Escherichia coli CFT073
ccgcaaccgccaacagcag

SEQ ID NO: 628930 - RNA, 23 nt, Escherichia coli CFT073
ccgcaaccggccguaagaaaguc

SEQ ID NO: 628931 - RNA, 14 nt, Escherichia coli CFT073
ccgcaaagaaacgc

SEQ ID NO: 628932 - RNA, 15 nt, Escherichia coli CFT073
ccgcaacgccgccaa

SEQ ID NO: 628933 - RNA, 18 nt, Escherichia coli CFT073
ccgauuaauugccgccag

SEQ ID NO: 628934 - RNA, 22 nt, Escherichia coli CFT073
ccgauuaauuccccugccagaa

SEQ ID NO: 628935 - RNA, 21 nt, Escherichia coli CFT073
ccgauggugcagcagacgcug

SEQ ID NO: 628936 - RNA, 19 nt, Escherichia coli CFT073
ccgauugccauguuuuccu

SEQ ID NO: 628937 - RNA, 22 nt, Escherichia coli CFT073
ccgauugccauguuuuccuuuu

SEQ ID NO: 628938 - RNA, 17 nt, Escherichia coli CFT073
ccgauuacucagcaacu

SEQ ID NO: 628939 - RNA, 18 nt, Escherichia coli CFT073
ccgaugccgcuacaaaau

SEQ ID NO: 628940 - RNA, 18 nt, Escherichia coli CFT073
ccgaugaucgccaucagc

SEQ ID NO: 628941 - RNA, 14 nt, Escherichia coli CFT073
ccgcacccgccaga

SEQ ID NO: 628942 - RNA, 23 nt, Escherichia coli CFT073
ccgcacggucacuacacgaccau

SEQ ID NO: 628943 - RNA, 17 nt, Escherichia coli CFT073
ccgcacucuacuucuuc

SEQ ID NO: 628944 - RNA, 11 nt, Escherichia coli CFT073
ccgcacuugag

SEQ ID NO: 628945 - RNA, 17 nt, Escherichia coli CFT073
ccgcacuugaguaauua

SEQ ID NO: 628946 - RNA, 18 nt, Escherichia coli CFT073
ccgcacuugaguaauuaa

SEQ ID NO: 628947 - RNA, 14 nt, Escherichia coli CFT073
ccgcaccaccagca

SEQ ID NO: 628948 - RNA, 15 nt, Escherichia coli CFT073
ccgcaccaccgagua

SEQ ID NO: 628949 - RNA, 13 nt, Escherichia coli CFT073
ccgcaccaggcag

SEQ ID NO: 628950 - RNA, 15 nt, Escherichia coli CFT073
ccgcagguagcagca

SEQ ID NO: 628951 - RNA, 23 nt, Escherichia coli CFT073
ccgcagucagggucuggugcuga

SEQ ID NO: 628952 - RNA, 13 nt, Escherichia coli CFT073
ccgcagcuccagc

SEQ ID NO: 628953 - RNA, 17 nt, Escherichia coli CFT073
ccgauaaccgcaaaacc

SEQ ID NO: 628954 - RNA, 14 nt, Escherichia coli CFT073
ccgauaaaacauua

SEQ ID NO: 628955 - RNA, 15 nt, Escherichia coli CFT073
ccgauaaaacauuac

SEQ ID NO: 628956 - RNA, 13 nt, Escherichia coli CFT073
ccgauaaauaaua

SEQ ID NO: 628957 - RNA, 16 nt, Escherichia coli CFT073
ccgauccacugaaaca

SEQ ID NO: 628958 - RNA, 19 nt, Escherichia coli CFT073
ccgaucaguaccagcccgc

SEQ ID NO: 628959 - RNA, 16 nt, Escherichia coli CFT073
ccgagcgcaagccacg

SEQ ID NO: 628960 - RNA, 15 nt, Escherichia coli CFT073
ccgagccgguugccu

SEQ ID NO: 628961 - RNA, 15 nt, Escherichia coli CFT073
ccgagagaacugcug

SEQ ID NO: 628962 - RNA, 22 nt, Escherichia coli CFT073
ccgagagaagcgcguucauccc

SEQ ID NO: 628963 - RNA, 19 nt, Escherichia coli CFT073
ccgagaucuuuaauacacg

SEQ ID NO: 628964 - RNA, 15 nt, Escherichia coli CFT073
ccgagauaaaugcca

SEQ ID NO: 628965 - RNA, 21 nt, Escherichia coli CFT073
ccgagauauugauacaggaaa

SEQ ID NO: 628966 - RNA, 20 nt, Escherichia coli CFT073
ccgagcacaaagccgugcca

SEQ ID NO: 628967 - RNA, 14 nt, Escherichia coli CFT073
cccuucaagcgucc

SEQ ID NO: 628968 - RNA, 15 nt, Escherichia coli CFT073
cccuuauucacgcca

SEQ ID NO: 628969 - RNA, 16 nt, Escherichia coli CFT073
cccuuaguaacgccag

SEQ ID NO: 628970 - RNA, 16 nt, Escherichia coli CFT073
cccuuaccccgcccga

SEQ ID NO: 628971 - RNA, 20 nt, Escherichia coli CFT073
cccuucaucacgcaguguca

SEQ ID NO: 628972 - RNA, 14 nt, Escherichia coli CFT073
cccuucaucacgca

SEQ ID NO: 628973 - RNA, 20 nt, Escherichia coli CFT073
cccuuccagauucaguuuca

SEQ ID NO: 628974 - RNA, 14 nt, Escherichia coli CFT073
cccuucccgcaaug

SEQ ID NO: 628975 - RNA, 19 nt, Escherichia coli CFT073
cccuuccgcuuuuaacauc

SEQ ID NO: 628976 - RNA, 11 nt, Escherichia coli CFT073
cccuuccugcc

SEQ ID NO: 628977 - RNA, 12 nt, Escherichia coli CFT073
cccuuccugccc

SEQ ID NO: 628978 - RNA, 13 nt, Escherichia coli CFT073
cccuuccugcccu

SEQ ID NO: 628979 - RNA, 15 nt, Escherichia coli CFT073
cccuucgauaaaggc

SEQ ID NO: 628980 - RNA, 16 nt, Escherichia coli CFT073
cccuucgccgccgcug

SEQ ID NO: 628981 - RNA, 16 nt, Escherichia coli CFT073
cccuguaauugccuga

SEQ ID NO: 628982 - RNA, 16 nt, Escherichia coli CFT073
cccuguggggauuucc

SEQ ID NO: 628983 - RNA, 13 nt, Escherichia coli CFT073
cccuguugccugc

SEQ ID NO: 628984 - RNA, 17 nt, Escherichia coli CFT073
cccuggucgguuucagc

SEQ ID NO: 628985 - RNA, 18 nt, Escherichia coli CFT073
cccugggugacaaucacc

SEQ ID NO: 628986 - RNA, 18 nt, Escherichia coli CFT073
cccuggucauaggcugcc

SEQ ID NO: 628987 - RNA, 14 nt, Escherichia coli CFT073
cccuuuuucauccc

SEQ ID NO: 628988 - RNA, 23 nt, Escherichia coli CFT073
ccgaaaaucgccugaacaccaga

SEQ ID NO: 628989 - RNA, 15 nt, Escherichia coli CFT073
cccuucucgcuccug

SEQ ID NO: 628990 - RNA, 16 nt, Escherichia coli CFT073
cccuucuuucacuuca

SEQ ID NO: 628991 - RNA, 19 nt, Escherichia coli CFT073
ccgaagaguaaccaaacgu

SEQ ID NO: 628992 - RNA, 15 nt, Escherichia coli CFT073
ccgaagaucaccacc

SEQ ID NO: 628993 - RNA, 17 nt, Escherichia coli CFT073
ccgaauagaacauaaug

SEQ ID NO: 628994 - RNA, 17 nt, Escherichia coli CFT073
ccgaaguucauccauac

SEQ ID NO: 628995 - RNA, 21 nt, Escherichia coli CFT073
ccgaaguucauccauaccaca

SEQ ID NO: 628996 - RNA, 20 nt, Escherichia coli CFT073
ccgaaguucguacacccgcc

SEQ ID NO: 628997 - RNA, 14 nt, Escherichia coli CFT073
ccgaaccaaacgag

SEQ ID NO: 628998 - RNA, 13 nt, Escherichia coli CFT073
ccgaaccauguca

SEQ ID NO: 628999 - RNA, 19 nt, Escherichia coli CFT073
ccgaacagugccagacaaa

SEQ ID NO: 629000 - RNA, 19 nt, Escherichia coli CFT073
cccugaccuuaauaaacuc

SEQ ID NO: 629001 - RNA, 21 nt, Escherichia coli CFT073
cccugacugguuaguuucagc

SEQ ID NO: 629002 - RNA, 23 nt, Escherichia coli CFT073
cccugagcaacaauuuucccuuc

SEQ ID NO: 629003 - RNA, 16 nt, Escherichia coli CFT073
cccugagcaucaauac

SEQ ID NO: 629004 - RNA, 19 nt, Escherichia coli CFT073
cccugacaccaucacccaa

SEQ ID NO: 629005 - RNA, 18 nt, Escherichia coli CFT073
cccugaaucgccacgcca

SEQ ID NO: 629006 - RNA, 19 nt, Escherichia coli CFT073
cccugaaucgccacgccaa

SEQ ID NO: 629007 - RNA, 19 nt, Escherichia coli CFT073
cccugaaagcgacagcgca

SEQ ID NO: 629008 - RNA, 19 nt, Escherichia coli CFT073
cccugauggcugauuaccc

SEQ ID NO: 629009 - RNA, 14 nt, Escherichia coli CFT073
cccugcaaacgggg

SEQ ID NO: 629010 - RNA, 19 nt, Escherichia coli CFT073
cccugaguuuucaguaccg

SEQ ID NO: 629011 - RNA, 15 nt, Escherichia coli CFT073
cccugaucacccaca

SEQ ID NO: 629012 - RNA, 16 nt, Escherichia coli CFT073
cccugaucacccacac

SEQ ID NO: 629013 - RNA, 16 nt, Escherichia coli CFT073
cccugcaauaaacaaa

SEQ ID NO: 629014 - RNA, 15 nt, Escherichia coli CFT073
cccugcaacacucgu

SEQ ID NO: 629015 - RNA, 13 nt, Escherichia coli CFT073
cccucuccacgca

SEQ ID NO: 629016 - RNA, 23 nt, Escherichia coli CFT073
cccucucggcauauaccgucagc

SEQ ID NO: 629017 - RNA, 15 nt, Escherichia coli CFT073
cccucuguccgccag

SEQ ID NO: 629018 - RNA, 14 nt, Escherichia coli CFT073
cccucuucagccgc

SEQ ID NO: 629019 - RNA, 13 nt, Escherichia coli CFT073
ccccuuaccccgc

SEQ ID NO: 629020 - RNA, 17 nt, Escherichia coli CFT073
ccccuuaccccgcccga

SEQ ID NO: 629021 - RNA, 14 nt, Escherichia coli CFT073
ccccugggccaccu

SEQ ID NO: 629022 - RNA, 16 nt, Escherichia coli CFT073
ccccuggugcuugcca

SEQ ID NO: 629023 - RNA, 23 nt, Escherichia coli CFT073
cccuggacaacauuccuguugac

SEQ ID NO: 629024 - RNA, 22 nt, Escherichia coli CFT073
cccugcucgucggcaaagcggg

SEQ ID NO: 629025 - RNA, 19 nt, Escherichia coli CFT073
cccugcugaauccccuucu

SEQ ID NO: 629026 - RNA, 18 nt, Escherichia coli CFT073
cccugcgcgggugaaaac

SEQ ID NO: 629027 - RNA, 19 nt, Escherichia coli CFT073
cccugcgcaaggcauugag

SEQ ID NO: 629028 - RNA, 16 nt, Escherichia coli CFT073
cccugcccgcugccag

SEQ ID NO: 629029 - RNA, 15 nt, Escherichia coli CFT073
cccugccaucacuau

SEQ ID NO: 629030 - RNA, 20 nt, Escherichia coli CFT073
cccugccaucacuauucaga

SEQ ID NO: 629031 - RNA, 22 nt, Escherichia coli CFT073
cccugccagcgauacucucgcg

SEQ ID NO: 629032 - RNA, 18 nt, Escherichia coli CFT073
cccugcagucaccugccc

SEQ ID NO: 629033 - RNA, 22 nt, Escherichia coli CFT073
cccugcagucaccugcccuccg

SEQ ID NO: 629034 - RNA, 18 nt, Escherichia coli CFT073
cccugcauaaucaggauc

SEQ ID NO: 629035 - RNA, 23 nt, Escherichia coli CFT073
cccugcauauaaucgauccccaa

SEQ ID NO: 629036 - RNA, 21 nt, Escherichia coli CFT073
cggugcucauuagcccggcaa

SEQ ID NO: 629037 - RNA, 16 nt, Escherichia coli CFT073
cggugcgcgcuggcau

SEQ ID NO: 629038 - RNA, 15 nt, Escherichia coli CFT073
cggugcguugucauc

SEQ ID NO: 629039 - RNA, 17 nt, Escherichia coli CFT073
cggugcgguaagcugcg

SEQ ID NO: 629040 - RNA, 13 nt, Escherichia coli CFT073
cgguguuuuccac

SEQ ID NO: 629041 - RNA, 16 nt, Escherichia coli CFT073
cgguguggccugcuuu

SEQ ID NO: 629042 - RNA, 16 nt, Escherichia coli CFT073
cgguguaggccugaua

SEQ ID NO: 629043 - RNA, 17 nt, Escherichia coli CFT073
cggugugcggguuuucu

SEQ ID NO: 629044 - RNA, 16 nt, Escherichia coli CFT073
cggugguuaccaguaa

SEQ ID NO: 629045 - RNA, 21 nt, Escherichia coli CFT073
cgguguaaccaccgcaggcag

SEQ ID NO: 629046 - RNA, 19 nt, Escherichia coli CFT073
cggugguguaaccuucacc

SEQ ID NO: 629047 - RNA, 18 nt, Escherichia coli CFT073
cgguggcguuuccagcag

SEQ ID NO: 629048 - RNA, 23 nt, Escherichia coli CFT073
cggugccgcgauaccacccgcag

SEQ ID NO: 629049 - RNA, 13 nt, Escherichia coli CFT073
cggugcgagcgcc

SEQ ID NO: 629050 - RNA, 19 nt, Escherichia coli CFT073
cggugagacgccagaaccg

SEQ ID NO: 629051 - RNA, 21 nt, Escherichia coli CFT073
cggugaauucaguaccagcac

SEQ ID NO: 629052 - RNA, 15 nt, Escherichia coli CFT073
cggugacacuuugug

SEQ ID NO: 629053 - RNA, 23 nt, Escherichia coli CFT073
cggugacaucaauacgguugacg

SEQ ID NO: 629054 - RNA, 15 nt, Escherichia coli CFT073
cggugagccaggacg

SEQ ID NO: 629055 - RNA, 12 nt, Escherichia coli CFT073
cggugauaaacc

SEQ ID NO: 629056 - RNA, 18 nt, Escherichia coli CFT073
cggugauaaucaucccac

SEQ ID NO: 629057 - RNA, 13 nt, Escherichia coli CFT073
cggucuggcagcu

SEQ ID NO: 629058 - RNA, 16 nt, Escherichia coli CFT073
cggucugccaacuuug

SEQ ID NO: 629059 - RNA, 22 nt, Escherichia coli CFT073
cggucagaaaauuauuuuaaau

SEQ ID NO: 629060 - RNA, 15 nt, Escherichia coli CFT073
cguacauugcugaca

SEQ ID NO: 629061 - RNA, 18 nt, Escherichia coli CFT073
cguacauugcugacaugg

SEQ ID NO: 629062 - RNA, 16 nt, Escherichia coli CFT073
cguaccugccgcgccu

SEQ ID NO: 629063 - RNA, 22 nt, Escherichia coli CFT073
cguaccggaaccugacggcgca

SEQ ID NO: 629064 - RNA, 17 nt, Escherichia coli CFT073
cguaccgggcuuccggc

SEQ ID NO: 629065 - RNA, 16 nt, Escherichia coli CFT073
cguacguuaacagccu

SEQ ID NO: 629066 - RNA, 23 nt, Escherichia coli CFT073
cguacuacgcgccgccagccaca

SEQ ID NO: 629067 - RNA, 16 nt, Escherichia coli CFT073
cguacucaccgcucac

SEQ ID NO: 629068 - RNA, 21 nt, Escherichia coli CFT073
cguacggcuucagacaccguu

SEQ ID NO: 629069 - RNA, 14 nt, Escherichia coli CFT073
cguaauuugccguu

SEQ ID NO: 629070 - RNA, 19 nt, Escherichia coli CFT073
cguaauucacguaucagca

SEQ ID NO: 629071 - RNA, 16 nt, Escherichia coli CFT073
cguacagauacauuuc

SEQ ID NO: 629072 - RNA, 20 nt, Escherichia coli CFT073
cguacaaccgcgaacuggac

SEQ ID NO: 629073 - RNA, 12 nt, Escherichia coli CFT073
cguacaccaaca

SEQ ID NO: 629074 - RNA, 15 nt, Escherichia coli CFT073
cguacacccgccaga

SEQ ID NO: 629075 - RNA, 15 nt, Escherichia coli CFT073
cguaaucucuuucca

SEQ ID NO: 629076 - RNA, 20 nt, Escherichia coli CFT073
cguaaugcuucuaccgucug

SEQ ID NO: 629077 - RNA, 18 nt, Escherichia coli CFT073
cguaauccguaugacaaa

SEQ ID NO: 629078 - RNA, 22 nt, Escherichia coli CFT073
cgguucgagguaguagccgucu

SEQ ID NO: 629079 - RNA, 20 nt, Escherichia coli CFT073
cgguucggcucaaugauaac

SEQ ID NO: 629080 - RNA, 17 nt, Escherichia coli CFT073
cgguuuuuugaacagac

SEQ ID NO: 629081 - RNA, 16 nt, Escherichia coli CFT073
cguaaaaacccgcuuc

SEQ ID NO: 629082 - RNA, 15 nt, Escherichia coli CFT073
cguaaaaaucggcaa

SEQ ID NO: 629083 - RNA, 15 nt, Escherichia coli CFT073
cgguugccagcgcca

SEQ ID NO: 629084 - RNA, 22 nt, Escherichia coli CFT073
cgguugccagcgccagcgcacc

SEQ ID NO: 629085 - RNA, 14 nt, Escherichia coli CFT073
cgguugaucuccgc

SEQ ID NO: 629086 - RNA, 12 nt, Escherichia coli CFT073
cguaacaggaaa

SEQ ID NO: 629087 - RNA, 15 nt, Escherichia coli CFT073
cguaaaucuucaagc

SEQ ID NO: 629088 - RNA, 15 nt, Escherichia coli CFT073
cguaaaucuuuacca

SEQ ID NO: 629089 - RNA, 18 nt, Escherichia coli CFT073
cguaaaucgucaguagcg

SEQ ID NO: 629090 - RNA, 17 nt, Escherichia coli CFT073
cguaaauuccccacccc

SEQ ID NO: 629091 - RNA, 18 nt, Escherichia coli CFT073
cguaaaauauugcugcua

SEQ ID NO: 629092 - RNA, 19 nt, Escherichia coli CFT073
cguaaagucaaaauucaac

SEQ ID NO: 629093 - RNA, 20 nt, Escherichia coli CFT073
cguaaccaaugccacccagc

SEQ ID NO: 629094 - RNA, 14 nt, Escherichia coli CFT073
cguaaguggaacua

SEQ ID NO: 629095 - RNA, 22 nt, Escherichia coli CFT073
cguaaguuaacugcacaccgcg

SEQ ID NO: 629096 - RNA, 20 nt, Escherichia coli CFT073
cguaaggcaucgcuaaucug

SEQ ID NO: 629097 - RNA, 15 nt, Escherichia coli CFT073
cggggccgaaacccc

SEQ ID NO: 629098 - RNA, 17 nt, Escherichia coli CFT073
cggggcuauaccagaua

SEQ ID NO: 629099 - RNA, 19 nt, Escherichia coli CFT073
cggggccguugacgauguc

SEQ ID NO: 629100 - RNA, 19 nt, Escherichia coli CFT073
cggggcauagcguaacuua

SEQ ID NO: 629101 - RNA, 13 nt, Escherichia coli CFT073
cggggaucacucc

SEQ ID NO: 629102 - RNA, 14 nt, Escherichia coli CFT073
cggggacugguuga

SEQ ID NO: 629103 - RNA, 18 nt, Escherichia coli CFT073
cggggagaaugccagcag

SEQ ID NO: 629104 - RNA, 20 nt, Escherichia coli CFT073
cggggagaaugccagcagca

SEQ ID NO: 629105 - RNA, 22 nt, Escherichia coli CFT073
cggggagaaugccagcagcacc

SEQ ID NO: 629106 - RNA, 21 nt, Escherichia coli CFT073
cgggccaaaaaucuccuccug

SEQ ID NO: 629107 - RNA, 14 nt, Escherichia coli CFT073
cgggccacauacug

SEQ ID NO: 629108 - RNA, 18 nt, Escherichia coli CFT073
cgggccaccaugcccagu

SEQ ID NO: 629109 - RNA, 17 nt, Escherichia coli CFT073
cgggcugagucccccaa

SEQ ID NO: 629110 - RNA, 14 nt, Escherichia coli CFT073
cgggcuggcggggc

SEQ ID NO: 629111 - RNA, 13 nt, Escherichia coli CFT073
cgggucacugcgg

SEQ ID NO: 629112 - RNA, 15 nt, Escherichia coli CFT073
cggguaaagacuauc

SEQ ID NO: 629113 - RNA, 15 nt, Escherichia coli CFT073
cggguaaucaucgcc

SEQ ID NO: 629114 - RNA, 22 nt, Escherichia coli CFT073
cgggugcggaucauaugcacaa

SEQ ID NO: 629115 - RNA, 20 nt, Escherichia coli CFT073
cgggugaagagauccaccag

SEQ ID NO: 629116 - RNA, 18 nt, Escherichia coli CFT073
cgguacggaagguccagu

SEQ ID NO: 629117 - RNA, 20 nt, Escherichia coli CFT073
cgguacugaccaucagcagc

SEQ ID NO: 629118 - RNA, 20 nt, Escherichia coli CFT073
cgguagccugcaauuuccgc

SEQ ID NO: 629119 - RNA, 22 nt, Escherichia coli CFT073
cgguagaaaaauucaaccucug

SEQ ID NO: 629120 - RNA, 15 nt, Escherichia coli CFT073
cgguaauguuuugca

SEQ ID NO: 629121 - RNA, 22 nt, Escherichia coli CFT073
cgguaauugcacguccaguggc

SEQ ID NO: 629122 - RNA, 13 nt, Escherichia coli CFT073
cgguacacgcaga

SEQ ID NO: 629123 - RNA, 14 nt, Escherichia coli CFT073
cgguacacgcagac

SEQ ID NO: 629124 - RNA, 19 nt, Escherichia coli CFT073
cgguauuaguuaaaugauu

SEQ ID NO: 629125 - RNA, 13 nt, Escherichia coli CFT073
cgguauugcucca

SEQ ID NO: 629126 - RNA, 20 nt, Escherichia coli CFT073
cgguauugagcuucucuggc

SEQ ID NO: 629127 - RNA, 14 nt, Escherichia coli CFT073
cgguaucuuuccag

SEQ ID NO: 629128 - RNA, 16 nt, Escherichia coli CFT073
cgguaugacccagcgc

SEQ ID NO: 629129 - RNA, 17 nt, Escherichia coli CFT073
cggucacugacaccagc

SEQ ID NO: 629130 - RNA, 16 nt, Escherichia coli CFT073
cgguaguuccaccagu

SEQ ID NO: 629131 - RNA, 13 nt, Escherichia coli CFT073
cgguagucggcgc

SEQ ID NO: 629132 - RNA, 21 nt, Escherichia coli CFT073
cgguauaguccgccagaauac

SEQ ID NO: 629133 - RNA, 20 nt, Escherichia coli CFT073
cgguaucaccacccagcggu

SEQ ID NO: 629134 - RNA, 16 nt, Escherichia coli CFT073
cgguauaacuugccag

SEQ ID NO: 629135 - RNA, 16 nt, Escherichia coli CFT073
cgguauaacccaguac

SEQ ID NO: 629136 - RNA, 20 nt, Escherichia coli CFT073
cgguauccggcucauaucuu

SEQ ID NO: 629137 - RNA, 20 nt, Escherichia coli CFT073
cgguaaguuuucgccggauc

SEQ ID NO: 629138 - RNA, 15 nt, Escherichia coli CFT073
cgguaacuuaucugu

SEQ ID NO: 629139 - RNA, 17 nt, Escherichia coli CFT073
cgguaacgccaucccug

SEQ ID NO: 629140 - RNA, 15 nt, Escherichia coli CFT073
cgguaacugcuugaa

SEQ ID NO: 629141 - RNA, 15 nt, Escherichia coli CFT073
cgguaaaauggucag

SEQ ID NO: 629142 - RNA, 13 nt, Escherichia coli CFT073
cgguaaacgucgc

SEQ ID NO: 629143 - RNA, 18 nt, Escherichia coli CFT073
cgguaaaagcccaucauu

SEQ ID NO: 629144 - RNA, 21 nt, Escherichia coli CFT073
cgguaaaagcccaucauugac

SEQ ID NO: 629145 - RNA, 14 nt, Escherichia coli CFT073
cgguaaaaucaucc

SEQ ID NO: 629146 - RNA, 16 nt, Escherichia coli CFT073
cgguaaagcccucacc

SEQ ID NO: 629147 - RNA, 22 nt, Escherichia coli CFT073
cgguaaaucgacccugaugaau

SEQ ID NO: 629148 - RNA, 14 nt, Escherichia coli CFT073
cgguaaauugcccc

SEQ ID NO: 629149 - RNA, 16 nt, Escherichia coli CFT073
cgguaaccauccauau

SEQ ID NO: 629150 - RNA, 13 nt, Escherichia coli CFT073
cgguaacccuuca

SEQ ID NO: 629151 - RNA, 22 nt, Escherichia coli CFT073
cggguuuugaauucuugcugac

SEQ ID NO: 629152 - RNA, 14 nt, Escherichia coli CFT073
cggguuuucaauga

SEQ ID NO: 629153 - RNA, 15 nt, Escherichia coli CFT073
cggguuuacgcgcgc

SEQ ID NO: 629154 - RNA, 14 nt, Escherichia coli CFT073
cggguugcggauca

SEQ ID NO: 629155 - RNA, 15 nt, Escherichia coli CFT073
cggguggucuucaua

SEQ ID NO: 629156 - RNA, 19 nt, Escherichia coli CFT073
cggguggugcgcaccaggc

SEQ ID NO: 629157 - RNA, 17 nt, Escherichia coli CFT073
cggguuacggaaacucu

SEQ ID NO: 629158 - RNA, 23 nt, Escherichia coli CFT073
cggguguacauaaccgaagaagc

SEQ ID NO: 629159 - RNA, 20 nt, Escherichia coli CFT073
cgggugucccguaacggaaa

SEQ ID NO: 629160 - RNA, 17 nt, Escherichia coli CFT073
cggguuaaccagcacca

SEQ ID NO: 629161 - RNA, 20 nt, Escherichia coli CFT073
cggguuaaccagcaccagcu

SEQ ID NO: 629162 - RNA, 13 nt, Escherichia coli CFT073
cgggaccagcacg

SEQ ID NO: 629163 - RNA, 17 nt, Escherichia coli CFT073
cgggacaacaaacgcaa

SEQ ID NO: 629164 - RNA, 17 nt, Escherichia coli CFT073
cgggagagccccagccg

SEQ ID NO: 629165 - RNA, 18 nt, Escherichia coli CFT073
cgggagauuuucuccugc

SEQ ID NO: 629166 - RNA, 14 nt, Escherichia coli CFT073
cgggagcaauuugu

SEQ ID NO: 629167 - RNA, 15 nt, Escherichia coli CFT073
cggcuugcaccagca

SEQ ID NO: 629168 - RNA, 22 nt, Escherichia coli CFT073
cggcuugcgcgcaaucagcacc

SEQ ID NO: 629169 - RNA, 18 nt, Escherichia coli CFT073
cggcuuguacgccgccgc

SEQ ID NO: 629170 - RNA, 14 nt, Escherichia coli CFT073
cgggaaaccaacuc

SEQ ID NO: 629171 - RNA, 22 nt, Escherichia coli CFT073
cgggaaacgagccauaaaauca

SEQ ID NO: 629172 - RNA, 17 nt, Escherichia coli CFT073
cggcugcgcuucuucca

SEQ ID NO: 629173 - RNA, 22 nt, Escherichia coli CFT073
cggcugcgcuucuuccagcauc

SEQ ID NO: 629174 - RNA, 14 nt, Escherichia coli CFT073
cggcuucuggccuc

SEQ ID NO: 629175 - RNA, 18 nt, Escherichia coli CFT073
cggcugcuucggucagca

SEQ ID NO: 629176 - RNA, 17 nt, Escherichia coli CFT073
cgggaucuccacaagca

SEQ ID NO: 629177 - RNA, 21 nt, Escherichia coli CFT073
cgggauaccccgcauccugaa

SEQ ID NO: 629178 - RNA, 20 nt, Escherichia coli CFT073
cgggauauaugucaccagca

SEQ ID NO: 629179 - RNA, 14 nt, Escherichia coli CFT073
cgggaucagguaag

SEQ ID NO: 629180 - RNA, 18 nt, Escherichia coli CFT073
cgggauucgaaccuguga

SEQ ID NO: 629181 - RNA, 14 nt, Escherichia coli CFT073
cgggauuugguucu

SEQ ID NO: 629182 - RNA, 17 nt, Escherichia coli CFT073
cgggauuuuacuuccca

SEQ ID NO: 629183 - RNA, 18 nt, Escherichia coli CFT073
cgggauuuuacuucccag

SEQ ID NO: 629184 - RNA, 21 nt, Escherichia coli CFT073
cgggcaaggcugucgcaaauu

SEQ ID NO: 629185 - RNA, 15 nt, Escherichia coli CFT073
cgggcagacaaaaca

SEQ ID NO: 629186 - RNA, 18 nt, Escherichia coli CFT073
cggcucguccgcgcgcac

SEQ ID NO: 629187 - RNA, 13 nt, Escherichia coli CFT073
cggcucuuuugcu

SEQ ID NO: 629188 - RNA, 18 nt, Escherichia coli CFT073
cggcugacaugcaguuga

SEQ ID NO: 629189 - RNA, 23 nt, Escherichia coli CFT073
cggcugauaacaauaucaaaugc

SEQ ID NO: 629190 - RNA, 17 nt, Escherichia coli CFT073
cggcucggcuccgggcg

SEQ ID NO: 629191 - RNA, 18 nt, Escherichia coli CFT073
cggcuccgccccaaugcg

SEQ ID NO: 629192 - RNA, 13 nt, Escherichia coli CFT073
cggcuccccgccc

SEQ ID NO: 629193 - RNA, 13 nt, Escherichia coli CFT073
cggcucccgcagc

SEQ ID NO: 629194 - RNA, 18 nt, Escherichia coli CFT073
cggcucccgcagccacuc

SEQ ID NO: 629195 - RNA, 23 nt, Escherichia coli CFT073
cggcucccgcagccacuccuuau

SEQ ID NO: 629196 - RNA, 20 nt, Escherichia coli CFT073
cggcuccagacgcccgcgcc

SEQ ID NO: 629197 - RNA, 22 nt, Escherichia coli CFT073
cggcuccagacgcccgcgccca

SEQ ID NO: 629198 - RNA, 22 nt, Escherichia coli CFT073
cggcuccagcaaugucauaaac

SEQ ID NO: 629199 - RNA, 21 nt, Escherichia coli CFT073
cggcguuuagugggucccaga

SEQ ID NO: 629200 - RNA, 23 nt, Escherichia coli CFT073
cggcguuucacauucuccgccga

SEQ ID NO: 629201 - RNA, 18 nt, Escherichia coli CFT073
cggcguuuuguagagcag

SEQ ID NO: 629202 - RNA, 22 nt, Escherichia coli CFT073
cggcguuuuguagagcagcacg

SEQ ID NO: 629203 - RNA, 18 nt, Escherichia coli CFT073
cggcguuuuuucaucacu

SEQ ID NO: 629204 - RNA, 20 nt, Escherichia coli CFT073
cggcguuuuuucaucacugc

SEQ ID NO: 629205 - RNA, 13 nt, Escherichia coli CFT073
cggcgugauaaaa

SEQ ID NO: 629206 - RNA, 22 nt, Escherichia coli CFT073
cggcgugaacgccuuauccggc

SEQ ID NO: 629207 - RNA, 20 nt, Escherichia coli CFT073
cggcgucuuguugaacagac

SEQ ID NO: 629208 - RNA, 20 nt, Escherichia coli CFT073
cggcgucgguuucgcgcagg

SEQ ID NO: 629209 - RNA, 18 nt, Escherichia coli CFT073
cggcggguuaaccagcac

SEQ ID NO: 629210 - RNA, 12 nt, Escherichia coli CFT073
cggcggaacgcc

SEQ ID NO: 629211 - RNA, 23 nt, Escherichia coli CFT073
cggcggugacuagcagcauuuca

SEQ ID NO: 629212 - RNA, 15 nt, Escherichia coli CFT073
cggcggugucgccag

SEQ ID NO: 629213 - RNA, 21 nt, Escherichia coli CFT073
cggcgucauaauccggcaaca

SEQ ID NO: 629214 - RNA, 23 nt, Escherichia coli CFT073
cggcgaaacuggguuaccgccuu

SEQ ID NO: 629215 - RNA, 18 nt, Escherichia coli CFT073
cggcccaugacaaacuca

SEQ ID NO: 629216 - RNA, 17 nt, Escherichia coli CFT073
cggcgaaggcaucggca

SEQ ID NO: 629217 - RNA, 19 nt, Escherichia coli CFT073
cggcgaagagagcgccagu

SEQ ID NO: 629218 - RNA, 15 nt, Escherichia coli CFT073
cggcgaucugcaccu

SEQ ID NO: 629219 - RNA, 13 nt, Escherichia coli CFT073
cggcgacgcgcgc

SEQ ID NO: 629220 - RNA, 14 nt, Escherichia coli CFT073
cggcgacgcgcgcg

SEQ ID NO: 629221 - RNA, 19 nt, Escherichia coli CFT073
cggcgaccguucgccaggu

SEQ ID NO: 629222 - RNA, 14 nt, Escherichia coli CFT073
cggcgcacaaccgc

SEQ ID NO: 629223 - RNA, 13 nt, Escherichia coli CFT073
cggcgcagagccc

SEQ ID NO: 629224 - RNA, 23 nt, Escherichia coli CFT073
cggcgcaggucgcgcauuaccuc

SEQ ID NO: 629225 - RNA, 14 nt, Escherichia coli CFT073
cggcgcauccgcca

SEQ ID NO: 629226 - RNA, 17 nt, Escherichia coli CFT073
cggcgcauccgccagca

SEQ ID NO: 629227 - RNA, 15 nt, Escherichia coli CFT073
cggcgcgagcgccuu

SEQ ID NO: 629228 - RNA, 21 nt, Escherichia coli CFT073
cggcgcggcggguuaaccagc

SEQ ID NO: 629229 - RNA, 15 nt, Escherichia coli CFT073
cggcauugccgucgg

SEQ ID NO: 629230 - RNA, 20 nt, Escherichia coli CFT073
cggcauugccgucgggauuc

SEQ ID NO: 629231 - RNA, 19 nt, Escherichia coli CFT073
cggcauuguucugcaaauu

SEQ ID NO: 629232 - RNA, 16 nt, Escherichia coli CFT073
cggcauuuccagaccu

SEQ ID NO: 629233 - RNA, 15 nt, Escherichia coli CFT073
cggcauuuugcugau

SEQ ID NO: 629234 - RNA, 23 nt, Escherichia coli CFT073
cggcauuuuuuaucacuucuucu

SEQ ID NO: 629235 - RNA, 14 nt, Escherichia coli CFT073
cggccaaagggagc

SEQ ID NO: 629236 - RNA, 22 nt, Escherichia coli CFT073
cggcauuuuucggcgucagaac

SEQ ID NO: 629237 - RNA, 17 nt, Escherichia coli CFT073
cggcauggggucaggug

SEQ ID NO: 629238 - RNA, 13 nt, Escherichia coli CFT073
cggcaugaugucc

SEQ ID NO: 629239 - RNA, 23 nt, Escherichia coli CFT073
cggcaugauguccugcggacagu

SEQ ID NO: 629240 - RNA, 15 nt, Escherichia coli CFT073
cggcaugaacaaagc

SEQ ID NO: 629241 - RNA, 16 nt, Escherichia coli CFT073
cggcaugacgccgggc

SEQ ID NO: 629242 - RNA, 14 nt, Escherichia coli CFT073
cggcaggaaaauag

SEQ ID NO: 629243 - RNA, 22 nt, Escherichia coli CFT073
cggccagcgggcgucaaaauca

SEQ ID NO: 629244 - RNA, 22 nt, Escherichia coli CFT073
cggccaguuucggacgcggcac

SEQ ID NO: 629245 - RNA, 20 nt, Escherichia coli CFT073
cggcaaucauucccagaccu

SEQ ID NO: 629246 - RNA, 12 nt, Escherichia coli CFT073
cggcaaucgcca

SEQ ID NO: 629247 - RNA, 12 nt, Escherichia coli CFT073
cggcaaucacaa

SEQ ID NO: 629248 - RNA, 14 nt, Escherichia coli CFT073
cggcaauggcugcg

SEQ ID NO: 629249 - RNA, 12 nt, Escherichia coli CFT073
cggcaauggucg

SEQ ID NO: 629250 - RNA, 16 nt, Escherichia coli CFT073
cggcaaugugaaggug

SEQ ID NO: 629251 - RNA, 21 nt, Escherichia coli CFT073
cggcaauguuaccgaucgcca

SEQ ID NO: 629252 - RNA, 20 nt, Escherichia coli CFT073
cggcaaucuuuaccggucag

SEQ ID NO: 629253 - RNA, 16 nt, Escherichia coli CFT073
cggcaaugaaacucaa

SEQ ID NO: 629254 - RNA, 15 nt, Escherichia coli CFT073
cggcaaucgcugcua

SEQ ID NO: 629255 - RNA, 13 nt, Escherichia coli CFT073
cggcaagcaaauu

SEQ ID NO: 629256 - RNA, 19 nt, Escherichia coli CFT073
cggcaagaaauaccgaaga

SEQ ID NO: 629257 - RNA, 16 nt, Escherichia coli CFT073
cggcaagaucagcauc

SEQ ID NO: 629258 - RNA, 17 nt, Escherichia coli CFT073
cggcaagccgacaauaa

SEQ ID NO: 629259 - RNA, 14 nt, Escherichia coli CFT073
cggcaauaaacagc

SEQ ID NO: 629260 - RNA, 16 nt, Escherichia coli CFT073
cggcaauaacucccag

SEQ ID NO: 629261 - RNA, 16 nt, Escherichia coli CFT073
cggcaaggccaauacc

SEQ ID NO: 629262 - RNA, 22 nt, Escherichia coli CFT073
cggauaucccccuuucugcaug

SEQ ID NO: 629263 - RNA, 16 nt, Escherichia coli CFT073
cggauaucgaggauca

SEQ ID NO: 629264 - RNA, 16 nt, Escherichia coli CFT073
cggauagccauccccg

SEQ ID NO: 629265 - RNA, 22 nt, Escherichia coli CFT073
cggauacgguuuuuugaacaga

SEQ ID NO: 629266 - RNA, 16 nt, Escherichia coli CFT073
cggaucgaagacauca

SEQ ID NO: 629267 - RNA, 18 nt, Escherichia coli CFT073
cggaucgaagacaucauc

SEQ ID NO: 629268 - RNA, 20 nt, Escherichia coli CFT073
cggcaaccgcgccaagccug

SEQ ID NO: 629269 - RNA, 22 nt, Escherichia coli CFT073
cggcaaccgcgccaagccugau

SEQ ID NO: 629270 - RNA, 18 nt, Escherichia coli CFT073
cggaucaguuuauccaua

SEQ ID NO: 629271 - RNA, 23 nt, Escherichia coli CFT073
cggaucaugguagcgugauggcc

SEQ ID NO: 629272 - RNA, 16 nt, Escherichia coli CFT073
cggcaacuggaaauga

SEQ ID NO: 629273 - RNA, 20 nt, Escherichia coli CFT073
cggcaacgaaucacuggugu

SEQ ID NO: 629274 - RNA, 22 nt, Escherichia coli CFT073
cggcaacgaccgcgagcaaaau

SEQ ID NO: 629275 - RNA, 16 nt, Escherichia coli CFT073
cggcacuagucccucc

SEQ ID NO: 629276 - RNA, 14 nt, Escherichia coli CFT073
cggcagauaaacaa

SEQ ID NO: 629277 - RNA, 14 nt, Escherichia coli CFT073
cggcagcagcaccc

SEQ ID NO: 629278 - RNA, 14 nt, Escherichia coli CFT073
cggcagcaacagca

SEQ ID NO: 629279 - RNA, 19 nt, Escherichia coli CFT073
cggcagcaggugcgccagc

SEQ ID NO: 629280 - RNA, 21 nt, Escherichia coli CFT073
cggcaccuaucgcgucgccgg

SEQ ID NO: 629281 - RNA, 20 nt, Escherichia coli CFT073
cggcaauucucacugauuac

SEQ ID NO: 629282 - RNA, 13 nt, Escherichia coli CFT073
cggcacaccagcc

SEQ ID NO: 629283 - RNA, 15 nt, Escherichia coli CFT073
cggcacaccagccag

SEQ ID NO: 629284 - RNA, 16 nt, Escherichia coli CFT073
cggcacagaaacgcca

SEQ ID NO: 629285 - RNA, 12 nt, Escherichia coli CFT073
cggcaccgccgc

SEQ ID NO: 629286 - RNA, 14 nt, Escherichia coli CFT073
cggcaccgccgcca

SEQ ID NO: 629287 - RNA, 15 nt, Escherichia coli CFT073
cggaauuugcugcug

SEQ ID NO: 629288 - RNA, 11 nt, Escherichia coli CFT073
cggacaaaucg

SEQ ID NO: 629289 - RNA, 19 nt, Escherichia coli CFT073
cggaaugaggcacgacaca

SEQ ID NO: 629290 - RNA, 19 nt, Escherichia coli CFT073
cggaauggucaccacaaau

SEQ ID NO: 629291 - RNA, 19 nt, Escherichia coli CFT073
cggaauggacuguucacca

SEQ ID NO: 629292 - RNA, 20 nt, Escherichia coli CFT073
cggacaauaauaucuuucuu

SEQ ID NO: 629293 - RNA, 20 nt, Escherichia coli CFT073
cggacaccucaccaaauugu

SEQ ID NO: 629294 - RNA, 20 nt, Escherichia coli CFT073
cggacauaaagcccgcuuca

SEQ ID NO: 629295 - RNA, 17 nt, Escherichia coli CFT073
cggacauguuuuccagc

SEQ ID NO: 629296 - RNA, 21 nt, Escherichia coli CFT073
cggacauguuuuccagcacau

SEQ ID NO: 629297 - RNA, 23 nt, Escherichia coli CFT073
cggacagucacguagcggcggca

SEQ ID NO: 629298 - RNA, 20 nt, Escherichia coli CFT073
cggaccccgcgcucgcgcag

SEQ ID NO: 629299 - RNA, 15 nt, Escherichia coli CFT073
cggaccacgcacagc

SEQ ID NO: 629300 - RNA, 23 nt, Escherichia coli CFT073
cggaccacgcacagcccgccgcc

SEQ ID NO: 629301 - RNA, 14 nt, Escherichia coli CFT073
cggacgcgcaggag

SEQ ID NO: 629302 - RNA, 17 nt, Escherichia coli CFT073
cggacgcccgccgacca

SEQ ID NO: 629303 - RNA, 22 nt, Escherichia coli CFT073
cggacgaccgugcgccagcaaa

SEQ ID NO: 629304 - RNA, 13 nt, Escherichia coli CFT073
cggaccuuuugcc

SEQ ID NO: 629305 - RNA, 16 nt, Escherichia coli CFT073
cggacuuaacgucaca

SEQ ID NO: 629306 - RNA, 19 nt, Escherichia coli CFT073
cggacuucaagcggacgau

SEQ ID NO: 629307 - RNA, 19 nt, Escherichia coli CFT073
cggagacagcuuagacaac

SEQ ID NO: 629308 - RNA, 16 nt, Escherichia coli CFT073
cggagaauccagcccc

SEQ ID NO: 629309 - RNA, 23 nt, Escherichia coli CFT073
cggacguugaguuuacgcagcag

SEQ ID NO: 629310 - RNA, 18 nt, Escherichia coli CFT073
cggacguuugauuuuuaa

SEQ ID NO: 629311 - RNA, 15 nt, Escherichia coli CFT073
cggacguuugccaug

SEQ ID NO: 629312 - RNA, 15 nt, Escherichia coli CFT073
cggaguaagaauaaa

SEQ ID NO: 629313 - RNA, 14 nt, Escherichia coli CFT073
cggagaucaccaca

SEQ ID NO: 629314 - RNA, 11 nt, Escherichia coli CFT073
cggagaggggg

SEQ ID NO: 629315 - RNA, 17 nt, Escherichia coli CFT073
cggagaguaaacgguga

SEQ ID NO: 629316 - RNA, 15 nt, Escherichia coli CFT073
cggaggcgauaauga

SEQ ID NO: 629317 - RNA, 21 nt, Escherichia coli CFT073
cgcuucaaaccuucauccauc

SEQ ID NO: 629318 - RNA, 14 nt, Escherichia coli CFT073
cgcuucaaccaccu

SEQ ID NO: 629319 - RNA, 16 nt, Escherichia coli CFT073
cgcuucgcccgccagc

SEQ ID NO: 629320 - RNA, 21 nt, Escherichia coli CFT073
cgcuucgauucccagcuuuua

SEQ ID NO: 629321 - RNA, 18 nt, Escherichia coli CFT073
cgcuucccaaagacgacg

SEQ ID NO: 629322 - RNA, 19 nt, Escherichia coli CFT073
cgcuucccaacgcagcaac

SEQ ID NO: 629323 - RNA, 14 nt, Escherichia coli CFT073
cgcuuccaguucca

SEQ ID NO: 629324 - RNA, 14 nt, Escherichia coli CFT073
cgcuucaggaauaa

SEQ ID NO: 629325 - RNA, 14 nt, Escherichia coli CFT073
cgcuugacaaaaag

SEQ ID NO: 629326 - RNA, 15 nt, Escherichia coli CFT073
cgcuugcucgcgcac

SEQ ID NO: 629327 - RNA, 17 nt, Escherichia coli CFT073
cgcuugcggccagcaca

SEQ ID NO: 629328 - RNA, 22 nt, Escherichia coli CFT073
cgcuugcggccagcacaucuca

SEQ ID NO: 629329 - RNA, 23 nt, Escherichia coli CFT073
cgcuugcugccaguuaccaccgc

SEQ ID NO: 629330 - RNA, 14 nt, Escherichia coli CFT073
cgcuucuucagccu

SEQ ID NO: 629331 - RNA, 22 nt, Escherichia coli CFT073
cgcuucuuccagcaucgccccc

SEQ ID NO: 629332 - RNA, 20 nt, Escherichia coli CFT073
cgcuucugucgcuucacgca

SEQ ID NO: 629333 - RNA, 18 nt, Escherichia coli CFT073
cgcuucgugcuuaaucau

SEQ ID NO: 629334 - RNA, 16 nt, Escherichia coli CFT073
cgcuucggcgccuuuu

SEQ ID NO: 629335 - RNA, 15 nt, Escherichia coli CFT073
cggaauccacuugcg

SEQ ID NO: 629336 - RNA, 15 nt, Escherichia coli CFT073
cggaaucccuuccgc

SEQ ID NO: 629337 - RNA, 23 nt, Escherichia coli CFT073
cggaauccaacaacugcgcacga

SEQ ID NO: 629338 - RNA, 13 nt, Escherichia coli CFT073
cggaauaaauguc

SEQ ID NO: 629339 - RNA, 17 nt, Escherichia coli CFT073
cggaaguguguaucuuc

SEQ ID NO: 629340 - RNA, 15 nt, Escherichia coli CFT073
cggaauaagggauca

SEQ ID NO: 629341 - RNA, 12 nt, Escherichia coli CFT073
cggaauaauaau

SEQ ID NO: 629342 - RNA, 15 nt, Escherichia coli CFT073
cggaauaaucagaug

SEQ ID NO: 629343 - RNA, 23 nt, Escherichia coli CFT073
cggaagggaacagagagcgccuc

SEQ ID NO: 629344 - RNA, 14 nt, Escherichia coli CFT073
cggaagcgccacca

SEQ ID NO: 629345 - RNA, 23 nt, Escherichia coli CFT073
cggaagauuauuucgcugcggau

SEQ ID NO: 629346 - RNA, 12 nt, Escherichia coli CFT073
cggaagccacca

SEQ ID NO: 629347 - RNA, 13 nt, Escherichia coli CFT073
cggaagccaccac

SEQ ID NO: 629348 - RNA, 14 nt, Escherichia coli CFT073
cggaagccccaggu

SEQ ID NO: 629349 - RNA, 21 nt, Escherichia coli CFT073
cggaagccccaggucaauaau

SEQ ID NO: 629350 - RNA, 15 nt, Escherichia coli CFT073
cgcuuugauccgcca

SEQ ID NO: 629351 - RNA, 16 nt, Escherichia coli CFT073
cgcuuugauccgccag

SEQ ID NO: 629352 - RNA, 19 nt, Escherichia coli CFT073
cgcuuuguucaugucagau

SEQ ID NO: 629353 - RNA, 11 nt, Escherichia coli CFT073
cgcuuuuaacc

SEQ ID NO: 629354 - RNA, 16 nt, Escherichia coli CFT073
cgcuuucucuucggcu

SEQ ID NO: 629355 - RNA, 16 nt, Escherichia coli CFT073
cggaacauccggcaaa

SEQ ID NO: 629356 - RNA, 14 nt, Escherichia coli CFT073
cggaagagacuauu

SEQ ID NO: 629357 - RNA, 14 nt, Escherichia coli CFT073
cggaacccagcgcg

SEQ ID NO: 629358 - RNA, 20 nt, Escherichia coli CFT073
cggaagaccugacuguucca

SEQ ID NO: 629359 - RNA, 22 nt, Escherichia coli CFT073
cgcggcaauggucccuugcugg

SEQ ID NO: 629360 - RNA, 20 nt, Escherichia coli CFT073
cgcggauagccauccccgcc

SEQ ID NO: 629361 - RNA, 15 nt, Escherichia coli CFT073
cgcggaccccgcgcu

SEQ ID NO: 629362 - RNA, 20 nt, Escherichia coli CFT073
cgcgcuuuaccaucgcgcac

SEQ ID NO: 629363 - RNA, 17 nt, Escherichia coli CFT073
cgcgcuuuuuuuaugcc

SEQ ID NO: 629364 - RNA, 21 nt, Escherichia coli CFT073
cgcgcuuuuuuuaugcccugg

SEQ ID NO: 629365 - RNA, 15 nt, Escherichia coli CFT073
cgcgcuguuccaggu

SEQ ID NO: 629366 - RNA, 14 nt, Escherichia coli CFT073
cgcgcuggcgcagc

SEQ ID NO: 629367 - RNA, 13 nt, Escherichia coli CFT073
cgcgcuggcgcag

SEQ ID NO: 629368 - RNA, 16 nt, Escherichia coli CFT073
cgcgggaaaaaguacu

SEQ ID NO: 629369 - RNA, 18 nt, Escherichia coli CFT073
cgcgggauaaucgcgccg

SEQ ID NO: 629370 - RNA, 13 nt, Escherichia coli CFT073
cgcggcuaacucc

SEQ ID NO: 629371 - RNA, 20 nt, Escherichia coli CFT073
cgcggcgaaggugccugccc

SEQ ID NO: 629372 - RNA, 16 nt, Escherichia coli CFT073
cgcggcgagagccuuc

SEQ ID NO: 629373 - RNA, 15 nt, Escherichia coli CFT073
cgcgcucaucagcgg

SEQ ID NO: 629374 - RNA, 22 nt, Escherichia coli CFT073
cgcgcucgaagcgggugcgcag

SEQ ID NO: 629375 - RNA, 17 nt, Escherichia coli CFT073
cgcgcuccggcacuuaa

SEQ ID NO: 629376 - RNA, 15 nt, Escherichia coli CFT073
cgcgcuccaucaugu

SEQ ID NO: 629377 - RNA, 19 nt, Escherichia coli CFT073
cgcgcguuaacucccgcgc

SEQ ID NO: 629378 - RNA, 18 nt, Escherichia coli CFT073
cgcgcgugccggaacgcc

SEQ ID NO: 629379 - RNA, 21 nt, Escherichia coli CFT073
cgcgcgugccggaacgccgcu

SEQ ID NO: 629380 - RNA, 23 nt, Escherichia coli CFT073
cgcgcuaacggagaauccagccc

SEQ ID NO: 629381 - RNA, 15 nt, Escherichia coli CFT073
cgcgcuaccacuucc

SEQ ID NO: 629382 - RNA, 13 nt, Escherichia coli CFT073
cgcgcugccagau

SEQ ID NO: 629383 - RNA, 16 nt, Escherichia coli CFT073
cgcgcucuuuaaaggc

SEQ ID NO: 629384 - RNA, 18 nt, Escherichia coli CFT073
cgcgcugagacccggcca

SEQ ID NO: 629385 - RNA, 18 nt, Escherichia coli CFT073
cgcgcggcgaaccagccg

SEQ ID NO: 629386 - RNA, 21 nt, Escherichia coli CFT073
cgccagauccggcuuacaucu

SEQ ID NO: 629387 - RNA, 20 nt, Escherichia coli CFT073
cgccagauagccgccagaga

SEQ ID NO: 629388 - RNA, 11 nt, Escherichia coli CFT073
cgccagaucag

SEQ ID NO: 629389 - RNA, 12 nt, Escherichia coli CFT073
cgccagaugcgg

SEQ ID NO: 629390 - RNA, 22 nt, Escherichia coli CFT073
cgccagauggcuuugcccuuuc

SEQ ID NO: 629391 - RNA, 16 nt, Escherichia coli CFT073
cgccagauugcugcug

SEQ ID NO: 629392 - RNA, 17 nt, Escherichia coli CFT073
cgccagauuguuaucca

SEQ ID NO: 629393 - RNA, 19 nt, Escherichia coli CFT073
cgccagauuguuauccagc

SEQ ID NO: 629394 - RNA, 16 nt, Escherichia coli CFT073
cgccagcaacugauac

SEQ ID NO: 629395 - RNA, 20 nt, Escherichia coli CFT073
cgcgcgaauauggcggcggc

SEQ ID NO: 629396 - RNA, 19 nt, Escherichia coli CFT073
cgcgccuggcgugcccccg

SEQ ID NO: 629397 - RNA, 14 nt, Escherichia coli CFT073
cgcgccugccaggc

SEQ ID NO: 629398 - RNA, 12 nt, Escherichia coli CFT073
cgcgcgcagcac

SEQ ID NO: 629399 - RNA, 17 nt, Escherichia coli CFT073
cgcucaucugcugcguu

SEQ ID NO: 629400 - RNA, 12 nt, Escherichia coli CFT073
cgcuccaugcug

SEQ ID NO: 629401 - RNA, 18 nt, Escherichia coli CFT073
cgcucccgcaggagcgcc

SEQ ID NO: 629402 - RNA, 19 nt, Escherichia coli CFT073
cgcucccggauaccccagc

SEQ ID NO: 629403 - RNA, 19 nt, Escherichia coli CFT073
cgcucgagagagaaaauaa

SEQ ID NO: 629404 - RNA, 23 nt, Escherichia coli CFT073
cgcuccgggccguaacugugcca

SEQ ID NO: 629405 - RNA, 14 nt, Escherichia coli CFT073
cgcugcacuuucuc

SEQ ID NO: 629406 - RNA, 14 nt, Escherichia coli CFT073
cgcugcaccaguaa

SEQ ID NO: 629407 - RNA, 23 nt, Escherichia coli CFT073
cgcugagccgacgccagcguuca

SEQ ID NO: 629408 - RNA, 12 nt, Escherichia coli CFT073
cgcugauucaag

SEQ ID NO: 629409 - RNA, 15 nt, Escherichia coli CFT073
cgcugauucuuccca

SEQ ID NO: 629410 - RNA, 15 nt, Escherichia coli CFT073
cgcugacgugcugca

SEQ ID NO: 629411 - RNA, 18 nt, Escherichia coli CFT073
cgcugacugaaucaggaa

SEQ ID NO: 629412 - RNA, 20 nt, Escherichia coli CFT073
cgcucuugcuuacgcagaca

SEQ ID NO: 629413 - RNA, 14 nt, Escherichia coli CFT073
cgcucuucaucuuc

SEQ ID NO: 629414 - RNA, 15 nt, Escherichia coli CFT073
cgcucuucaucuucc

SEQ ID NO: 629415 - RNA, 21 nt, Escherichia coli CFT073
cgcucuucgaggccgcggcuc

SEQ ID NO: 629416 - RNA, 17 nt, Escherichia coli CFT073
cgcucuggaugaaaucc

SEQ ID NO: 629417 - RNA, 19 nt, Escherichia coli CFT073
cgcucggcgcaaucgccag

SEQ ID NO: 629418 - RNA, 15 nt, Escherichia coli CFT073
cgcucuuuuauuagc

SEQ ID NO: 629419 - RNA, 23 nt, Escherichia coli CFT073
cgcucuuuuauuagccgcggccu

SEQ ID NO: 629420 - RNA, 15 nt, Escherichia coli CFT073
cgcucuuuaaaggcc

SEQ ID NO: 629421 - RNA, 17 nt, Escherichia coli CFT073
cgcugaaacuucaccaa

SEQ ID NO: 629422 - RNA, 23 nt, Escherichia coli CFT073
cgcugaaauguaaaaguugcagu

SEQ ID NO: 629423 - RNA, 21 nt, Escherichia coli CFT073
cgcucggcaacaccucagcca

SEQ ID NO: 629424 - RNA, 16 nt, Escherichia coli CFT073
cgcucgcgccgcaucc

SEQ ID NO: 629425 - RNA, 18 nt, Escherichia coli CFT073
cgcucgcgcagcucauca

SEQ ID NO: 629426 - RNA, 13 nt, Escherichia coli CFT073
cgcucgcgccgca

SEQ ID NO: 629427 - RNA, 20 nt, Escherichia coli CFT073
cgcucaucagcggguuuucu

SEQ ID NO: 629428 - RNA, 14 nt, Escherichia coli CFT073
cgcucaucaggcca

SEQ ID NO: 629429 - RNA, 14 nt, Escherichia coli CFT073
cgcucaauguugcu

SEQ ID NO: 629430 - RNA, 17 nt, Escherichia coli CFT073
cgcucaauguugcugcu

SEQ ID NO: 629431 - RNA, 15 nt, Escherichia coli CFT073
cgcucacaccacaac

SEQ ID NO: 629432 - RNA, 22 nt, Escherichia coli CFT073
cgcuauaccggaaaaggccacg

SEQ ID NO: 629433 - RNA, 18 nt, Escherichia coli CFT073
cgcucaauaaucaaucuu

SEQ ID NO: 629434 - RNA, 22 nt, Escherichia coli CFT073
cgcucaacuuccugaaucgccg

SEQ ID NO: 629435 - RNA, 13 nt, Escherichia coli CFT073
cgcucaauauaac

SEQ ID NO: 629436 - RNA, 18 nt, Escherichia coli CFT073
cgcucaauauauucuuua

SEQ ID NO: 629437 - RNA, 19 nt, Escherichia coli CFT073
cgcucaauauccugaccuu

SEQ ID NO: 629438 - RNA, 14 nt, Escherichia coli CFT073
cgcguuuacagagc

SEQ ID NO: 629439 - RNA, 17 nt, Escherichia coli CFT073
cgcuaagauaccccagc

SEQ ID NO: 629440 - RNA, 14 nt, Escherichia coli CFT073
cgcuaccacuuccc

SEQ ID NO: 629441 - RNA, 17 nt, Escherichia coli CFT073
cgcuaccagagccgcgc

SEQ ID NO: 629442 - RNA, 13 nt, Escherichia coli CFT073
cgcuagcagcagc

SEQ ID NO: 629443 - RNA, 14 nt, Escherichia coli CFT073
cgcguuauuuuuga

SEQ ID NO: 629444 - RNA, 19 nt, Escherichia coli CFT073
cgcguuagcuuaauaagaa

SEQ ID NO: 629445 - RNA, 20 nt, Escherichia coli CFT073
cgcguacauugcugacaugg

SEQ ID NO: 629446 - RNA, 18 nt, Escherichia coli CFT073
cgcguaauucacguauca

SEQ ID NO: 629447 - RNA, 16 nt, Escherichia coli CFT073
cgcguaauauccagcg

SEQ ID NO: 629448 - RNA, 22 nt, Escherichia coli CFT073
cgcgggauguacguucgcgggc

SEQ ID NO: 629449 - RNA, 19 nt, Escherichia coli CFT073
cgcgucaaucacacugacu

SEQ ID NO: 629450 - RNA, 17 nt, Escherichia coli CFT073
cgugcagcgcaaucgcc

SEQ ID NO: 629451 - RNA, 22 nt, Escherichia coli CFT073
cgugcagggugagggcaauaau

SEQ ID NO: 629452 - RNA, 16 nt, Escherichia coli CFT073
cgugcaguagcagcag

SEQ ID NO: 629453 - RNA, 19 nt, Escherichia coli CFT073
cgugcauagcagcacacca

SEQ ID NO: 629454 - RNA, 20 nt, Escherichia coli CFT073
cgugcauagcagcacaccac

SEQ ID NO: 629455 - RNA, 16 nt, Escherichia coli CFT073
cgugcaucucuucaaa

SEQ ID NO: 629456 - RNA, 14 nt, Escherichia coli CFT073
cgugauuuuuguag

SEQ ID NO: 629457 - RNA, 15 nt, Escherichia coli CFT073
cgugauuuuuguagg

SEQ ID NO: 629458 - RNA, 18 nt, Escherichia coli CFT073
cgugauuuuuguaggucg

SEQ ID NO: 629459 - RNA, 17 nt, Escherichia coli CFT073
cgugcaaaaucaaacag

SEQ ID NO: 629460 - RNA, 18 nt, Escherichia coli CFT073
cgugcaaaaucaaacaga

SEQ ID NO: 629461 - RNA, 12 nt, Escherichia coli CFT073
cgugccagaacu

SEQ ID NO: 629462 - RNA, 13 nt, Escherichia coli CFT073
cgugccagagcau

SEQ ID NO: 629463 - RNA, 17 nt, Escherichia coli CFT073
cgugccagagcaucuac

SEQ ID NO: 629464 - RNA, 23 nt, Escherichia coli CFT073
cgugccagauguuuaaacugggc

SEQ ID NO: 629465 - RNA, 20 nt, Escherichia coli CFT073
cgugccgaagaacauaaaca

SEQ ID NO: 629466 - RNA, 18 nt, Escherichia coli CFT073
cgugccugacggacgcgc

SEQ ID NO: 629467 - RNA, 14 nt, Escherichia coli CFT073
cgugauguggaaau

SEQ ID NO: 629468 - RNA, 15 nt, Escherichia coli CFT073
cgugauuccugcaau

SEQ ID NO: 629469 - RNA, 21 nt, Escherichia coli CFT073
cgugaucgucuucaaccgcag

SEQ ID NO: 629470 - RNA, 23 nt, Escherichia coli CFT073
cgugaucgucuucaaccgcagug

SEQ ID NO: 629471 - RNA, 14 nt, Escherichia coli CFT073
cgugauaugcccac

SEQ ID NO: 629472 - RNA, 20 nt, Escherichia coli CFT073
cgugagcagggugaauaaaa

SEQ ID NO: 629473 - RNA, 18 nt, Escherichia coli CFT073
cgugaaguuugccugaug

SEQ ID NO: 629474 - RNA, 14 nt, Escherichia coli CFT073
cgugaacgugacca

SEQ ID NO: 629475 - RNA, 16 nt, Escherichia coli CFT073
cgugaacgugcaaaau

SEQ ID NO: 629476 - RNA, 21 nt, Escherichia coli CFT073
cgugaacgccuuauccgaccu

SEQ ID NO: 629477 - RNA, 19 nt, Escherichia coli CFT073
cgugaaugguuucgcccac

SEQ ID NO: 629478 - RNA, 21 nt, Escherichia coli CFT073
cgugacagcauaccuucacaa

SEQ ID NO: 629479 - RNA, 22 nt, Escherichia coli CFT073
cgugacauccauauccagugca

SEQ ID NO: 629480 - RNA, 20 nt, Escherichia coli CFT073
cgugaccacccauggaauga

SEQ ID NO: 629481 - RNA, 16 nt, Escherichia coli CFT073
cgugacugccgccagc

SEQ ID NO: 629482 - RNA, 20 nt, Escherichia coli CFT073
cgugacguuucaucgcagac

SEQ ID NO: 629483 - RNA, 20 nt, Escherichia coli CFT073
cgugaccguaaacuuuagca

SEQ ID NO: 629484 - RNA, 23 nt, Escherichia coli CFT073
cgugaaacgcgucugaccgucuu

SEQ ID NO: 629485 - RNA, 13 nt, Escherichia coli CFT073
cgucuucguccca

SEQ ID NO: 629486 - RNA, 14 nt, Escherichia coli CFT073
cgucuuccacuuca

SEQ ID NO: 629487 - RNA, 16 nt, Escherichia coli CFT073
cgucuuccacuucauc

SEQ ID NO: 629488 - RNA, 15 nt, Escherichia coli CFT073
cgucuucccgcagcc

SEQ ID NO: 629489 - RNA, 12 nt, Escherichia coli CFT073
cgucuuaucugg

SEQ ID NO: 629490 - RNA, 16 nt, Escherichia coli CFT073
cgucuuaucaggccuu

SEQ ID NO: 629491 - RNA, 15 nt, Escherichia coli CFT073
cgucuuauccgaccu

SEQ ID NO: 629492 - RNA, 16 nt, Escherichia coli CFT073
cgucugcugaagcaua

SEQ ID NO: 629493 - RNA, 23 nt, Escherichia coli CFT073
cgucugguaucgcgccagccagu

SEQ ID NO: 629494 - RNA, 16 nt, Escherichia coli CFT073
cgucugguucgccaaa

SEQ ID NO: 629495 - RNA, 14 nt, Escherichia coli CFT073
cgucugguuuuccu

SEQ ID NO: 629496 - RNA, 17 nt, Escherichia coli CFT073
cgucuggcauuuugcug

SEQ ID NO: 629497 - RNA, 13 nt, Escherichia coli CFT073
cgucugccacggc

SEQ ID NO: 629498 - RNA, 19 nt, Escherichia coli CFT073
cgucugccacggcagaaug

SEQ ID NO: 629499 - RNA, 23 nt, Escherichia coli CFT073
cgucugccacuucuuccagcggc

SEQ ID NO: 629500 - RNA, 15 nt, Escherichia coli CFT073
cgucugacggccuuc

SEQ ID NO: 629501 - RNA, 21 nt, Escherichia coli CFT073
cgucucauaacggauugcauc

SEQ ID NO: 629502 - RNA, 23 nt, Escherichia coli CFT073
cgucuccagacaauccgcagcaa

SEQ ID NO: 629503 - RNA, 23 nt, Escherichia coli CFT073
cgucguuucgugcucuggcaggc

SEQ ID NO: 629504 - RNA, 17 nt, Escherichia coli CFT073
cgucuacaggcgcgacc

SEQ ID NO: 629505 - RNA, 19 nt, Escherichia coli CFT073
cgucgucuuuauccuggcu

SEQ ID NO: 629506 - RNA, 13 nt, Escherichia coli CFT073
cgucgucgccaau

SEQ ID NO: 629507 - RNA, 22 nt, Escherichia coli CFT073
cgucguucgccagucuccaggc

SEQ ID NO: 629508 - RNA, 17 nt, Escherichia coli CFT073
cgucggcgucagcgcca

SEQ ID NO: 629509 - RNA, 21 nt, Escherichia coli CFT073
cgucgcaagacgaaaaaugaa

SEQ ID NO: 629510 - RNA, 20 nt, Escherichia coli CFT073
cgucgcaauacccugaccca

SEQ ID NO: 629511 - RNA, 22 nt, Escherichia coli CFT073
cgucgauuguuauaccagucca

SEQ ID NO: 629512 - RNA, 16 nt, Escherichia coli CFT073
cgucgcaucaggcaug

SEQ ID NO: 629513 - RNA, 17 nt, Escherichia coli CFT073
cgucgcccugggugaca

SEQ ID NO: 629514 - RNA, 15 nt, Escherichia coli CFT073
cgucgccagaaagua

SEQ ID NO: 629515 - RNA, 13 nt, Escherichia coli CFT073
cgucgauaaacau

SEQ ID NO: 629516 - RNA, 19 nt, Escherichia coli CFT073
cgucgcuaucgaugccgcu

SEQ ID NO: 629517 - RNA, 16 nt, Escherichia coli CFT073
cgucgccuucauacca

SEQ ID NO: 629518 - RNA, 18 nt, Escherichia coli CFT073
cgucgccuuucacuuccg

SEQ ID NO: 629519 - RNA, 18 nt, Escherichia coli CFT073
cgucgccucgccgagcag

SEQ ID NO: 629520 - RNA, 19 nt, Escherichia coli CFT073
cgucgccucgccgagcagc

SEQ ID NO: 629521 - RNA, 23 nt, Escherichia coli CFT073
cguccucacuuaaagcaacacca

SEQ ID NO: 629522 - RNA, 17 nt, Escherichia coli CFT073
cguccggacuggcauug

SEQ ID NO: 629523 - RNA, 14 nt, Escherichia coli CFT073
cguccggcacucaa

SEQ ID NO: 629524 - RNA, 22 nt, Escherichia coli CFT073
cgucccugguacagcagacggc

SEQ ID NO: 629525 - RNA, 20 nt, Escherichia coli CFT073
cgucccaucggcaaucauuc

SEQ ID NO: 629526 - RNA, 15 nt, Escherichia coli CFT073
cgucccaggcaaauc

SEQ ID NO: 629527 - RNA, 20 nt, Escherichia coli CFT073
cguccauuuacccacagaca

SEQ ID NO: 629528 - RNA, 21 nt, Escherichia coli CFT073
cguccauuacccgagaauuuu

SEQ ID NO: 629529 - RNA, 15 nt, Escherichia coli CFT073
cguccaguggcaucc

SEQ ID NO: 629530 - RNA, 18 nt, Escherichia coli CFT073
cguccagucgccugcuuu

SEQ ID NO: 629531 - RNA, 16 nt, Escherichia coli CFT073
cguccagugaccgcug

SEQ ID NO: 629532 - RNA, 15 nt, Escherichia coli CFT073
cguccaguuguguca

SEQ ID NO: 629533 - RNA, 19 nt, Escherichia coli CFT073
cguccagcgccugaauaau

SEQ ID NO: 629534 - RNA, 15 nt, Escherichia coli CFT073
cguccagcagcaaug

SEQ ID NO: 629535 - RNA, 22 nt, Escherichia coli CFT073
cguccagcuugccuucacaggc

SEQ ID NO: 629536 - RNA, 15 nt, Escherichia coli CFT073
cguacuucacauacu

SEQ ID NO: 629537 - RNA, 12 nt, Escherichia coli CFT073
cguacugcaacg

SEQ ID NO: 629538 - RNA, 22 nt, Escherichia coli CFT073
cguacuggcaaucgccagcggc

SEQ ID NO: 629539 - RNA, 14 nt, Escherichia coli CFT073
cguacuguguugua

SEQ ID NO: 629540 - RNA, 21 nt, Escherichia coli CFT073
cguacucugccacuacccgca

SEQ ID NO: 629541 - RNA, 13 nt, Escherichia coli CFT073
cguacucuucaau

SEQ ID NO: 629542 - RNA, 11 nt, Escherichia coli CFT073
cguccagaacc

SEQ ID NO: 629543 - RNA, 11 nt, Escherichia coli CFT073
cguuguaaaug

SEQ ID NO: 629544 - RNA, 14 nt, Escherichia coli CFT073
cguuuccauaaccg

SEQ ID NO: 629545 - RNA, 17 nt, Escherichia coli CFT073
cguuuccagcaccaguu

SEQ ID NO: 629546 - RNA, 20 nt, Escherichia coli CFT073
cguuuaccucgucaccaccu

SEQ ID NO: 629547 - RNA, 16 nt, Escherichia coli CFT073
cguuuaauugccucuu

SEQ ID NO: 629548 - RNA, 19 nt, Escherichia coli CFT073
cguugaaaaaauuuuaucc

SEQ ID NO: 629549 - RNA, 20 nt, Escherichia coli CFT073
cguugcuggcaaucaccucu

SEQ ID NO: 629550 - RNA, 16 nt, Escherichia coli CFT073
cguugcugucgcgcag

SEQ ID NO: 629551 - RNA, 13 nt, Escherichia coli CFT073
cguuggcaucaag

SEQ ID NO: 629552 - RNA, 24 nt, Escherichia coli CFT073
cguucgcggggcuaccgccagacc

SEQ ID NO: 629553 - RNA, 16 nt, Escherichia coli CFT073
cguucucuucacgcca

SEQ ID NO: 629554 - RNA, 11 nt, Escherichia coli CFT073
cguucuuccuc

SEQ ID NO: 629555 - RNA, 22 nt, Escherichia coli CFT073
cguucuucugcuucauguugca

SEQ ID NO: 629556 - RNA, 19 nt, Escherichia coli CFT073
cuaaacccgaccacuucca

SEQ ID NO: 629557 - RNA, 16 nt, Escherichia coli CFT073
cuaaaagcaaacugug

SEQ ID NO: 629558 - RNA, 18 nt, Escherichia coli CFT073
cuaaaagcauagccccag

SEQ ID NO: 629559 - RNA, 24 nt, Escherichia coli CFT073
cuaaaagcauagccccagcgcaga

SEQ ID NO: 629560 - RNA, 15 nt, Escherichia coli CFT073
cuaaaacuucauuug

SEQ ID NO: 629561 - RNA, 19 nt, Escherichia coli CFT073
cguuuuuucaucacugcgc

SEQ ID NO: 629562 - RNA, 16 nt, Escherichia coli CFT073
cguuuuuugaaacagg

SEQ ID NO: 629563 - RNA, 16 nt, Escherichia coli CFT073
cguuuuuuucuucucg

SEQ ID NO: 629564 - RNA, 15 nt, Escherichia coli CFT073
cguuuccuuccagaa

SEQ ID NO: 629565 - RNA, 19 nt, Escherichia coli CFT073
cguuucgcccguucuuccu

SEQ ID NO: 629566 - RNA, 13 nt, Escherichia coli CFT073
cguuuuaaugauu

SEQ ID NO: 629567 - RNA, 20 nt, Escherichia coli CFT073
cguuuguaggccugauaaga

SEQ ID NO: 629568 - RNA, 14 nt, Escherichia coli CFT073
cguuuguuagcaug

SEQ ID NO: 629569 - RNA, 22 nt, Escherichia coli CFT073
cguuugcgcgacguugcuucuc

SEQ ID NO: 629570 - RNA, 15 nt, Escherichia coli CFT073
cguuugcguuccggc

SEQ ID NO: 629571 - RNA, 22 nt, Escherichia coli CFT073
cuaacgccagcgcgaccgccau

SEQ ID NO: 629572 - RNA, 19 nt, Escherichia coli CFT073
cuaacuguuucgcggcaaa

SEQ ID NO: 629573 - RNA, 22 nt, Escherichia coli CFT073
cuaacggagaauccagccccac

SEQ ID NO: 629574 - RNA, 16 nt, Escherichia coli CFT073
cuaacgagcaguuugg

SEQ ID NO: 629575 - RNA, 19 nt, Escherichia coli CFT073
cuaaccuuauggugucuau

SEQ ID NO: 629576 - RNA, 17 nt, Escherichia coli CFT073
cuaaccgcuuuuccggc

SEQ ID NO: 629577 - RNA, 21 nt, Escherichia coli CFT073
cuaacauuuuaguuuacauua

SEQ ID NO: 629578 - RNA, 13 nt, Escherichia coli CFT073
cuaagucuuucug

SEQ ID NO: 629579 - RNA, 19 nt, Escherichia coli CFT073
cuaagcugcgggaaauaac

SEQ ID NO: 629580 - RNA, 20 nt, Escherichia coli CFT073
cuaagcaggguugcagcgga

SEQ ID NO: 629581 - RNA, 15 nt, Escherichia coli CFT073
cuaagccauuuaacu

SEQ ID NO: 629582 - RNA, 17 nt, Escherichia coli CFT073
cuaagcguuuucugcca

SEQ ID NO: 629583 - RNA, 19 nt, Escherichia coli CFT073
cuaagcguuuucugccaga

SEQ ID NO: 629584 - RNA, 17 nt, Escherichia coli CFT073
cuaagcuacguagcuca

SEQ ID NO: 629585 - RNA, 22 nt, Escherichia coli CFT073
cuaagccccugagcgaauaccc

SEQ ID NO: 629586 - RNA, 17 nt, Escherichia coli CFT073
cuaacauccgaauugcu

SEQ ID NO: 629587 - RNA, 14 nt, Escherichia coli CFT073
cuaacaugacacca

SEQ ID NO: 629588 - RNA, 17 nt, Escherichia coli CFT073
cuaacaugguuaaaauc

SEQ ID NO: 629589 - RNA, 18 nt, Escherichia coli CFT073
cuaacaugguuaaaaucu

SEQ ID NO: 629590 - RNA, 12 nt, Escherichia coli CFT073
cuaacaucaucc

SEQ ID NO: 629591 - RNA, 16 nt, Escherichia coli CFT073
cuaacagcgccgcgau

SEQ ID NO: 629592 - RNA, 19 nt, Escherichia coli CFT073
cuaacaaucucaaccgcuu

SEQ ID NO: 629593 - RNA, 23 nt, Escherichia coli CFT073
cuaacaauucacacucugccagc

SEQ ID NO: 629594 - RNA, 14 nt, Escherichia coli CFT073
cuaaaugcucgccg

SEQ ID NO: 629595 - RNA, 19 nt, Escherichia coli CFT073
cuaaagcauucucccgccu

SEQ ID NO: 629596 - RNA, 21 nt, Escherichia coli CFT073
cuaaaugucaucccuuccugc

SEQ ID NO: 629597 - RNA, 15 nt, Escherichia coli CFT073
cuaaagcaacuccau

SEQ ID NO: 629598 - RNA, 18 nt, Escherichia coli CFT073
cuaaagcacccagcaauc

SEQ ID NO: 629599 - RNA, 15 nt, Escherichia coli CFT073
cguguacccagcagc

SEQ ID NO: 629600 - RNA, 14 nt, Escherichia coli CFT073
cguguauaucacca

SEQ ID NO: 629601 - RNA, 21 nt, Escherichia coli CFT073
cgugucauaacuggucaucaa

SEQ ID NO: 629602 - RNA, 12 nt, Escherichia coli CFT073
cgugguuccggc

SEQ ID NO: 629603 - RNA, 14 nt, Escherichia coli CFT073
cgugguugguuuca

SEQ ID NO: 629604 - RNA, 16 nt, Escherichia coli CFT073
cgugguuuaccaccag

SEQ ID NO: 629605 - RNA, 20 nt, Escherichia coli CFT073
cgugguuugcgcauucagaa

SEQ ID NO: 629606 - RNA, 20 nt, Escherichia coli CFT073
cgugugcgagugcauccagu

SEQ ID NO: 629607 - RNA, 13 nt, Escherichia coli CFT073
cguuaaccaugca

SEQ ID NO: 629608 - RNA, 18 nt, Escherichia coli CFT073
cguuaacggcauuuucca

SEQ ID NO: 629609 - RNA, 20 nt, Escherichia coli CFT073
cguuaacggcauuuuccagc

SEQ ID NO: 629610 - RNA, 23 nt, Escherichia coli CFT073
cguuaaggccaaacaccaggcua

SEQ ID NO: 629611 - RNA, 19 nt, Escherichia coli CFT073
cguuacccuuguggauaac

SEQ ID NO: 629612 - RNA, 14 nt, Escherichia coli CFT073
cguuaaucgccugc

SEQ ID NO: 629613 - RNA, 17 nt, Escherichia coli CFT073
cguuaaugacuuuugga

SEQ ID NO: 629614 - RNA, 21 nt, Escherichia coli CFT073
cguguuucaucucaucaaugg

SEQ ID NO: 629615 - RNA, 17 nt, Escherichia coli CFT073
cguguuuccgggccgaa

SEQ ID NO: 629616 - RNA, 14 nt, Escherichia coli CFT073
cguuaaaaaacagu

SEQ ID NO: 629617 - RNA, 13 nt, Escherichia coli CFT073
cguguugcugcau

SEQ ID NO: 629618 - RNA, 13 nt, Escherichia coli CFT073
cguguucugaaua

SEQ ID NO: 629619 - RNA, 15 nt, Escherichia coli CFT073
cguguucugaauaaa

SEQ ID NO: 629620 - RNA, 15 nt, Escherichia coli CFT073
cguuccacguccugc

SEQ ID NO: 629621 - RNA, 13 nt, Escherichia coli CFT073
cguuccagauucc

SEQ ID NO: 629622 - RNA, 12 nt, Escherichia coli CFT073
cguucacugccg

SEQ ID NO: 629623 - RNA, 18 nt, Escherichia coli CFT073
cguucagcacuucaccca

SEQ ID NO: 629624 - RNA, 19 nt, Escherichia coli CFT073
cguucaaucuguccuucca

SEQ ID NO: 629625 - RNA, 23 nt, Escherichia coli CFT073
cguucacgccgcauccggcaauc

SEQ ID NO: 629626 - RNA, 19 nt, Escherichia coli CFT073
cguucacgcagcucacgca

SEQ ID NO: 629627 - RNA, 14 nt, Escherichia coli CFT073
cguucccagagaau

SEQ ID NO: 629628 - RNA, 15 nt, Escherichia coli CFT073
cguucccagagaaug

SEQ ID NO: 629629 - RNA, 16 nt, Escherichia coli CFT073
cguuccccgucaucau

SEQ ID NO: 629630 - RNA, 19 nt, Escherichia coli CFT073
cguucgccagucuccaggc

SEQ ID NO: 629631 - RNA, 22 nt, Escherichia coli CFT073
cguuauuauuacguccaccaga

SEQ ID NO: 629632 - RNA, 19 nt, Escherichia coli CFT073
cguucaauaauauuaaucc

SEQ ID NO: 629633 - RNA, 12 nt, Escherichia coli CFT073
cguuauuuugcu

SEQ ID NO: 629634 - RNA, 15 nt, Escherichia coli CFT073
cguucaaaacggcug

SEQ ID NO: 629635 - RNA, 21 nt, Escherichia coli CFT073
cguucaaaacggcuggugauu

SEQ ID NO: 629636 - RNA, 17 nt, Escherichia coli CFT073
cguucaacaagccacgc

SEQ ID NO: 629637 - RNA, 15 nt, Escherichia coli CFT073
cguuagaaagcugcu

SEQ ID NO: 629638 - RNA, 19 nt, Escherichia coli CFT073
cguuagaaagcugcugcuu

SEQ ID NO: 629639 - RNA, 18 nt, Escherichia coli CFT073
cguuagaaaacgccugcu

SEQ ID NO: 629640 - RNA, 17 nt, Escherichia coli CFT073
cguuagcgaguugauca

SEQ ID NO: 629641 - RNA, 19 nt, Escherichia coli CFT073
cguuaccggcuucgacagg

SEQ ID NO: 629642 - RNA, 21 nt, Escherichia coli CFT073
cguuacgccccgguuucucuu

SEQ ID NO: 629643 - RNA, 14 nt, Escherichia coli CFT073
cguggcccgccagc

SEQ ID NO: 629644 - RNA, 19 nt, Escherichia coli CFT073
cguggcgucgcaucuggca

SEQ ID NO: 629645 - RNA, 18 nt, Escherichia coli CFT073
cguggcggagugccgcgu

SEQ ID NO: 629646 - RNA, 18 nt, Escherichia coli CFT073
cgugguaucgccacugcg

SEQ ID NO: 629647 - RNA, 20 nt, Escherichia coli CFT073
cguggucggcaaaauacaug

SEQ ID NO: 629648 - RNA, 17 nt, Escherichia coli CFT073
cgugguggcuacuucuu

SEQ ID NO: 629649 - RNA, 14 nt, Escherichia coli CFT073
cgugggcaggccag

SEQ ID NO: 629650 - RNA, 22 nt, Escherichia coli CFT073
cgugcugcuuuuaaugcugucu

SEQ ID NO: 629651 - RNA, 22 nt, Escherichia coli CFT073
cgugcugguggucagcagcuuu

SEQ ID NO: 629652 - RNA, 14 nt, Escherichia coli CFT073
cgugcuucauucac

SEQ ID NO: 629653 - RNA, 20 nt, Escherichia coli CFT073
cguggagugguucgguccgc

SEQ ID NO: 629654 - RNA, 17 nt, Escherichia coli CFT073
cgugcgacgccauugcu

SEQ ID NO: 629655 - RNA, 16 nt, Escherichia coli CFT073
cgugcgggaccagcac

SEQ ID NO: 629656 - RNA, 13 nt, Escherichia coli CFT073
cucagcauaugcu

SEQ ID NO: 629657 - RNA, 15 nt, Escherichia coli CFT073
cucagcauauucuug

SEQ ID NO: 629658 - RNA, 15 nt, Escherichia coli CFT073
cucagcaccccgagg

SEQ ID NO: 629659 - RNA, 20 nt, Escherichia coli CFT073
cucagcaauauaggccgccg

SEQ ID NO: 629660 - RNA, 22 nt, Escherichia coli CFT073
cucagcccagauuagccauucu

SEQ ID NO: 629661 - RNA, 19 nt, Escherichia coli CFT073
cucagccaaauccagcgca

SEQ ID NO: 629662 - RNA, 11 nt, Escherichia coli CFT073
cucagcugcca

SEQ ID NO: 629663 - RNA, 23 nt, Escherichia coli CFT073
cucaggcaaagcuguuucagugu

SEQ ID NO: 629664 - RNA, 17 nt, Escherichia coli CFT073
cucacuuuguaggccug

SEQ ID NO: 629665 - RNA, 21 nt, Escherichia coli CFT073
cucacuuuguaggccugauaa

SEQ ID NO: 629666 - RNA, 13 nt, Escherichia coli CFT073
cucaccugaguac

SEQ ID NO: 629667 - RNA, 20 nt, Escherichia coli CFT073
cucaccugaguaccuugcug

SEQ ID NO: 629668 - RNA, 15 nt, Escherichia coli CFT073
cucaccuuccacgcg

SEQ ID NO: 629669 - RNA, 20 nt, Escherichia coli CFT073
cucaccgguaaagucagcgu

SEQ ID NO: 629670 - RNA, 16 nt, Escherichia coli CFT073
cucaccguugaaaucg

SEQ ID NO: 629671 - RNA, 15 nt, Escherichia coli CFT073
cucagacucauuaaa

SEQ ID NO: 629672 - RNA, 15 nt, Escherichia coli CFT073
cucagcaacagguaa

SEQ ID NO: 629673 - RNA, 15 nt, Escherichia coli CFT073
cucagcaacuuccug

SEQ ID NO: 629674 - RNA, 15 nt, Escherichia coli CFT073
cucagaauucuggga

SEQ ID NO: 629675 - RNA, 17 nt, Escherichia coli CFT073
cucagaauucugggaug

SEQ ID NO: 629676 - RNA, 16 nt, Escherichia coli CFT073
cucagaaucacgccaa

SEQ ID NO: 629677 - RNA, 17 nt, Escherichia coli CFT073
cucagaaucacgccaac

SEQ ID NO: 629678 - RNA, 14 nt, Escherichia coli CFT073
cucacuugagguaa

SEQ ID NO: 629679 - RNA, 15 nt, Escherichia coli CFT073
cucagaaaucagaua

SEQ ID NO: 629680 - RNA, 21 nt, Escherichia coli CFT073
cucaucugacguucagccgcu

SEQ ID NO: 629681 - RNA, 16 nt, Escherichia coli CFT073
cucaucgucaaaugaa

SEQ ID NO: 629682 - RNA, 14 nt, Escherichia coli CFT073
cucaucggcauaca

SEQ ID NO: 629683 - RNA, 12 nt, Escherichia coli CFT073
cucauuaaacca

SEQ ID NO: 629684 - RNA, 13 nt, Escherichia coli CFT073
cucaucuuccauu

SEQ ID NO: 629685 - RNA, 12 nt, Escherichia coli CFT073
cucaugcuucau

SEQ ID NO: 629686 - RNA, 14 nt, Escherichia coli CFT073
cucauggccuuugc

SEQ ID NO: 629687 - RNA, 22 nt, Escherichia coli CFT073
cucaucaauuugcuucuggcug

SEQ ID NO: 629688 - RNA, 21 nt, Escherichia coli CFT073
cucaucaccacagacaaacag

SEQ ID NO: 629689 - RNA, 23 nt, Escherichia coli CFT073
cucaucaauacccgguccuucau

SEQ ID NO: 629690 - RNA, 22 nt, Escherichia coli CFT073
cucaucaauggauucaugauac

SEQ ID NO: 629691 - RNA, 14 nt, Escherichia coli CFT073
cucauauuuaagcc

SEQ ID NO: 629692 - RNA, 14 nt, Escherichia coli CFT073
cucaucaaaaaaac

SEQ ID NO: 629693 - RNA, 17 nt, Escherichia coli CFT073
cuauuuacagauuuccc

SEQ ID NO: 629694 - RNA, 15 nt, Escherichia coli CFT073
cucaaaauuucucuu

SEQ ID NO: 629695 - RNA, 13 nt, Escherichia coli CFT073
cuauuuuuucaau

SEQ ID NO: 629696 - RNA, 20 nt, Escherichia coli CFT073
cucaaacagcguaaugccaa

SEQ ID NO: 629697 - RNA, 22 nt, Escherichia coli CFT073
cucaaacaccgucgcaauaccc

SEQ ID NO: 629698 - RNA, 17 nt, Escherichia coli CFT073
cucaaacgccagcaugu

SEQ ID NO: 629699 - RNA, 21 nt, Escherichia coli CFT073
cucaaacgccagcauguuguc

SEQ ID NO: 629700 - RNA, 17 nt, Escherichia coli CFT073
cucaaagcaguauuucu

SEQ ID NO: 629701 - RNA, 18 nt, Escherichia coli CFT073
cucaaagcaguauuucuu

SEQ ID NO: 629702 - RNA, 20 nt, Escherichia coli CFT073
cuauuuuugcuacgccacug

SEQ ID NO: 629703 - RNA, 20 nt, Escherichia coli CFT073
cuauuuuuggaggugaaggu

SEQ ID NO: 629704 - RNA, 20 nt, Escherichia coli CFT073
cucaaugccagcgacuguga

SEQ ID NO: 629705 - RNA, 14 nt, Escherichia coli CFT073
cucaauggcauccg

SEQ ID NO: 629706 - RNA, 18 nt, Escherichia coli CFT073
cucaaugguguuuuccac

SEQ ID NO: 629707 - RNA, 17 nt, Escherichia coli CFT073
cucaccaucaaacagcc

SEQ ID NO: 629708 - RNA, 13 nt, Escherichia coli CFT073
cucaccaucaagu

SEQ ID NO: 629709 - RNA, 18 nt, Escherichia coli CFT073
cucaaccgcuucuuucuc

SEQ ID NO: 629710 - RNA, 17 nt, Escherichia coli CFT073
cucaaggagucagggag

SEQ ID NO: 629711 - RNA, 23 nt, Escherichia coli CFT073
cucaagcugaccgauaaccugcc

SEQ ID NO: 629712 - RNA, 12 nt, Escherichia coli CFT073
cucaacccauuu

SEQ ID NO: 629713 - RNA, 21 nt, Escherichia coli CFT073
cucaaguaauaaagcacccug

SEQ ID NO: 629714 - RNA, 16 nt, Escherichia coli CFT073
cucaaucggaaaacaa

SEQ ID NO: 629715 - RNA, 20 nt, Escherichia coli CFT073
cucaaucggaaaacaaccgc

SEQ ID NO: 629716 - RNA, 16 nt, Escherichia coli CFT073
cucaaucugcgcuucu

SEQ ID NO: 629717 - RNA, 13 nt, Escherichia coli CFT073
cuauacagcagcc

SEQ ID NO: 629718 - RNA, 14 nt, Escherichia coli CFT073
cuagcgcuuuuucu

SEQ ID NO: 629719 - RNA, 14 nt, Escherichia coli CFT073
cuauaaaccugcug

SEQ ID NO: 629720 - RNA, 15 nt, Escherichia coli CFT073
cuaugcugccacacu

SEQ ID NO: 629721 - RNA, 16 nt, Escherichia coli CFT073
cuaugcugccacacug

SEQ ID NO: 629722 - RNA, 17 nt, Escherichia coli CFT073
cuaugggauauuuuuuu

SEQ ID NO: 629723 - RNA, 18 nt, Escherichia coli CFT073
cuauggucggcauugccg

SEQ ID NO: 629724 - RNA, 18 nt, Escherichia coli CFT073
cuaucuuauuuccagaua

SEQ ID NO: 629725 - RNA, 22 nt, Escherichia coli CFT073
cuaucgccgagauacucaagca

SEQ ID NO: 629726 - RNA, 23 nt, Escherichia coli CFT073
cuaucgaacaugcgggucuuacu

SEQ ID NO: 629727 - RNA, 18 nt, Escherichia coli CFT073
cuauauauuuaguucaua

SEQ ID NO: 629728 - RNA, 20 nt, Escherichia coli CFT073
cuauauauuuaguucauaua

SEQ ID NO: 629729 - RNA, 23 nt, Escherichia coli CFT073
cuauaugacucauaaaaauauau

SEQ ID NO: 629730 - RNA, 16 nt, Escherichia coli CFT073
cuagccucccugccuc

SEQ ID NO: 629731 - RNA, 17 nt, Escherichia coli CFT073
cuagccucccugccucc

SEQ ID NO: 629732 - RNA, 11 nt, Escherichia coli CFT073
cuagauaagca

SEQ ID NO: 629733 - RNA, 14 nt, Escherichia coli CFT073
cuacguucucacuu

SEQ ID NO: 629734 - RNA, 18 nt, Escherichia coli CFT073
cuacguuaaaacacacua

SEQ ID NO: 629735 - RNA, 15 nt, Escherichia coli CFT073
cuagaagcuccggua

SEQ ID NO: 629736 - RNA, 20 nt, Escherichia coli CFT073
cuacgaacugagacugucug

SEQ ID NO: 629737 - RNA, 18 nt, Escherichia coli CFT073
cuaccuuauccagcagau

SEQ ID NO: 629738 - RNA, 20 nt, Escherichia coli CFT073
cuaccuuaacgguaucuuuc

SEQ ID NO: 629739 - RNA, 22 nt, Escherichia coli CFT073
cuaccuuaacgguaucuuucca

SEQ ID NO: 629740 - RNA, 12 nt, Escherichia coli CFT073
cuacgcaucaau

SEQ ID NO: 629741 - RNA, 14 nt, Escherichia coli CFT073
cuacgcaucaugcc

SEQ ID NO: 629742 - RNA, 12 nt, Escherichia coli CFT073
cuacgccacagc

SEQ ID NO: 629743 - RNA, 22 nt, Escherichia coli CFT073
cuacgccaucaguuucagagcg

SEQ ID NO: 629744 - RNA, 20 nt, Escherichia coli CFT073
cuacgcucgcgguagcccag

SEQ ID NO: 629745 - RNA, 21 nt, Escherichia coli CFT073
cuacgcucucuucaaacgcuu

SEQ ID NO: 629746 - RNA, 19 nt, Escherichia coli CFT073
cuacgcuuaucaggccuac

SEQ ID NO: 629747 - RNA, 15 nt, Escherichia coli CFT073
cuaauagcaaaauau

SEQ ID NO: 629748 - RNA, 20 nt, Escherichia coli CFT073
cuaccgcccugagcaucaau

SEQ ID NO: 629749 - RNA, 19 nt, Escherichia coli CFT073
cuaccguuucaacuucugc

SEQ ID NO: 629750 - RNA, 14 nt, Escherichia coli CFT073
cuaccugccgccac

SEQ ID NO: 629751 - RNA, 13 nt, Escherichia coli CFT073
cucuaaaaucauc

SEQ ID NO: 629752 - RNA, 13 nt, Escherichia coli CFT073
cucgugccacagu

SEQ ID NO: 629753 - RNA, 15 nt, Escherichia coli CFT073
cucgugccacaguuu

SEQ ID NO: 629754 - RNA, 21 nt, Escherichia coli CFT073
cucgugcgguaucaccaccca

SEQ ID NO: 629755 - RNA, 21 nt, Escherichia coli CFT073
cucuaccgcuucgcguaaaau

SEQ ID NO: 629756 - RNA, 14 nt, Escherichia coli CFT073
cucuaccagcccca

SEQ ID NO: 629757 - RNA, 17 nt, Escherichia coli CFT073
cucuacgcgcugaccuu

SEQ ID NO: 629758 - RNA, 13 nt, Escherichia coli CFT073
cucgugcaccgcc

SEQ ID NO: 629759 - RNA, 20 nt, Escherichia coli CFT073
cucgugcagaacauccagcu

SEQ ID NO: 629760 - RNA, 15 nt, Escherichia coli CFT073
cucgucccuuugccu

SEQ ID NO: 629761 - RNA, 20 nt, Escherichia coli CFT073
cucggaaugccggaaucaga

SEQ ID NO: 629762 - RNA, 20 nt, Escherichia coli CFT073
cucgcugcgaaguuuuuccg

SEQ ID NO: 629763 - RNA, 22 nt, Escherichia coli CFT073
cucgcugcucacaccaugccag

SEQ ID NO: 629764 - RNA, 16 nt, Escherichia coli CFT073
cucggcugccuggaua

SEQ ID NO: 629765 - RNA, 21 nt, Escherichia coli CFT073
cucggugaccgagcgcccgcc

SEQ ID NO: 629766 - RNA, 21 nt, Escherichia coli CFT073
cucggcgcuaaucaugucugg

SEQ ID NO: 629767 - RNA, 18 nt, Escherichia coli CFT073
cucgcgcuugcggaagca

SEQ ID NO: 629768 - RNA, 22 nt, Escherichia coli CFT073
cucgcgcagauagagcgccugc

SEQ ID NO: 629769 - RNA, 17 nt, Escherichia coli CFT073
cucgcucucgccgcgcu

SEQ ID NO: 629770 - RNA, 16 nt, Escherichia coli CFT073
cucgcucgagagagaa

SEQ ID NO: 629771 - RNA, 19 nt, Escherichia coli CFT073
cucgcucgagagagaaaau

SEQ ID NO: 629772 - RNA, 18 nt, Escherichia coli CFT073
cucgcugacaucaacaau

SEQ ID NO: 629773 - RNA, 13 nt, Escherichia coli CFT073
cucgcuauuuaca

SEQ ID NO: 629774 - RNA, 21 nt, Escherichia coli CFT073
cucgcguucgauagcgcgcca

SEQ ID NO: 629775 - RNA, 17 nt, Escherichia coli CFT073
cucgcgguagcccagcc

SEQ ID NO: 629776 - RNA, 22 nt, Escherichia coli CFT073
cucgauaccagauuaauuauug

SEQ ID NO: 629777 - RNA, 13 nt, Escherichia coli CFT073
cucgauaugcgcu

SEQ ID NO: 629778 - RNA, 18 nt, Escherichia coli CFT073
cucgccagagagcggagc

SEQ ID NO: 629779 - RNA, 21 nt, Escherichia coli CFT073
cucgauguuguacaugcugcu

SEQ ID NO: 629780 - RNA, 17 nt, Escherichia coli CFT073
cucgacagccucuucca

SEQ ID NO: 629781 - RNA, 21 nt, Escherichia coli CFT073
cucgacagccucuuccagaga

SEQ ID NO: 629782 - RNA, 23 nt, Escherichia coli CFT073
cucgacuuuagucgcuugcagga

SEQ ID NO: 629783 - RNA, 21 nt, Escherichia coli CFT073
cuccugccaguuauagcgcag

SEQ ID NO: 629784 - RNA, 19 nt, Escherichia coli CFT073
cuccgccagugacugcgcc

SEQ ID NO: 629785 - RNA, 23 nt, Escherichia coli CFT073
cuccgccccggcaauaaaacagg

SEQ ID NO: 629786 - RNA, 19 nt, Escherichia coli CFT073
cuccgcaccgcgguacagc

SEQ ID NO: 629787 - RNA, 12 nt, Escherichia coli CFT073
cuccggcagcag

SEQ ID NO: 629788 - RNA, 17 nt, Escherichia coli CFT073
cuccggcgcauccauga

SEQ ID NO: 629789 - RNA, 17 nt, Escherichia coli CFT073
cuccggccugcacugca

SEQ ID NO: 629790 - RNA, 18 nt, Escherichia coli CFT073
cuccgggcggcguauuua

SEQ ID NO: 629791 - RNA, 16 nt, Escherichia coli CFT073
cuccucaacaaucguc

SEQ ID NO: 629792 - RNA, 12 nt, Escherichia coli CFT073
cucccccucuuc

SEQ ID NO: 629793 - RNA, 12 nt, Escherichia coli CFT073
cucccgcaguaa

SEQ ID NO: 629794 - RNA, 17 nt, Escherichia coli CFT073
cucccgcaggagcgccg

SEQ ID NO: 629795 - RNA, 11 nt, Escherichia coli CFT073
cucccgccccc

SEQ ID NO: 629796 - RNA, 15 nt, Escherichia coli CFT073
cucccuuucugccac

SEQ ID NO: 629797 - RNA, 19 nt, Escherichia coli CFT073
cucccuugcgggaucaggc

SEQ ID NO: 629798 - RNA, 18 nt, Escherichia coli CFT073
cuccgcacaaacgccacc

SEQ ID NO: 629799 - RNA, 19 nt, Escherichia coli CFT073
cucccuguuccuguauuug

SEQ ID NO: 629800 - RNA, 18 nt, Escherichia coli CFT073
cucccugaugugaugccc

SEQ ID NO: 629801 - RNA, 15 nt, Escherichia coli CFT073
cucccucuccacgca

SEQ ID NO: 629802 - RNA, 21 nt, Escherichia coli CFT073
cucccauuuuauccucuucaa

SEQ ID NO: 629803 - RNA, 18 nt, Escherichia coli CFT073
cucccauaaugccccagc

SEQ ID NO: 629804 - RNA, 19 nt, Escherichia coli CFT073
cucccauaaugccccagcg

SEQ ID NO: 629805 - RNA, 19 nt, Escherichia coli CFT073
cucccacggaauagaaccu

SEQ ID NO: 629806 - RNA, 13 nt, Escherichia coli CFT073
cuccagcccuuuc

SEQ ID NO: 629807 - RNA, 14 nt, Escherichia coli CFT073
cuccagcccuuucg

SEQ ID NO: 629808 - RNA, 21 nt, Escherichia coli CFT073
cuccagcgggcgaaucaacuc

SEQ ID NO: 629809 - RNA, 17 nt, Escherichia coli CFT073
cuccagcuuaacauccc

SEQ ID NO: 629810 - RNA, 15 nt, Escherichia coli CFT073
cuccaggcagaaaca

SEQ ID NO: 629811 - RNA, 19 nt, Escherichia coli CFT073
cuccaggcagaaacaucau

SEQ ID NO: 629812 - RNA, 16 nt, Escherichia coli CFT073
cuccaggcgaagacaa

SEQ ID NO: 629813 - RNA, 22 nt, Escherichia coli CFT073
cuccagucccauaacauauuca

SEQ ID NO: 629814 - RNA, 15 nt, Escherichia coli CFT073
cuccagggcagguaa

SEQ ID NO: 629815 - RNA, 15 nt, Escherichia coli CFT073
cuccagguuaacgga

SEQ ID NO: 629816 - RNA, 17 nt, Escherichia coli CFT073
cuccauccccagcucuu

SEQ ID NO: 629817 - RNA, 20 nt, Escherichia coli CFT073
cuccauaauugccagcuugc

SEQ ID NO: 629818 - RNA, 14 nt, Escherichia coli CFT073
cuccagauaacaau

SEQ ID NO: 629819 - RNA, 12 nt, Escherichia coli CFT073
cuccagcaaugu

SEQ ID NO: 629820 - RNA, 16 nt, Escherichia coli CFT073
cuccagcaguccccag

SEQ ID NO: 629821 - RNA, 22 nt, Escherichia coli CFT073
cuccagcaucagauggggaugg

SEQ ID NO: 629822 - RNA, 22 nt, Escherichia coli CFT073
cucauuuugggcgggaucucca

SEQ ID NO: 629823 - RNA, 14 nt, Escherichia coli CFT073
cucauuucccaaca

SEQ ID NO: 629824 - RNA, 15 nt, Escherichia coli CFT073
cucauuaaucaauuu

SEQ ID NO: 629825 - RNA, 14 nt, Escherichia coli CFT073
cucauuugcagaaa

SEQ ID NO: 629826 - RNA, 13 nt, Escherichia coli CFT073
cuccacuuccugc

SEQ ID NO: 629827 - RNA, 23 nt, Escherichia coli CFT073
cuccacugggaguuuuucuacua

SEQ ID NO: 629828 - RNA, 17 nt, Escherichia coli CFT073
cuccacuucaccgcgaa

SEQ ID NO: 629829 - RNA, 16 nt, Escherichia coli CFT073
cuccacucugccaggc

SEQ ID NO: 629830 - RNA, 17 nt, Escherichia coli CFT073
cuccacgcccagcgcag

SEQ ID NO: 629831 - RNA, 17 nt, Escherichia coli CFT073
cugauauuuaaacggug

SEQ ID NO: 629832 - RNA, 22 nt, Escherichia coli CFT073
cugauauuuaaacgguguaaaa

SEQ ID NO: 629833 - RNA, 15 nt, Escherichia coli CFT073
cugauauugcuccag

SEQ ID NO: 629834 - RNA, 19 nt, Escherichia coli CFT073
cugaucaauaaauuuuuuc

SEQ ID NO: 629835 - RNA, 17 nt, Escherichia coli CFT073
cugaucaccguagaagg

SEQ ID NO: 629836 - RNA, 15 nt, Escherichia coli CFT073
cugauauacccuuca

SEQ ID NO: 629837 - RNA, 16 nt, Escherichia coli CFT073
cugauagugcugccau

SEQ ID NO: 629838 - RNA, 17 nt, Escherichia coli CFT073
cugauauaucaccuucc

SEQ ID NO: 629839 - RNA, 17 nt, Escherichia coli CFT073
cugauauggugguaacu

SEQ ID NO: 629840 - RNA, 19 nt, Escherichia coli CFT073
cugauauggugguaacuac

SEQ ID NO: 629841 - RNA, 16 nt, Escherichia coli CFT073
cugauauucagcgccc

SEQ ID NO: 629842 - RNA, 13 nt, Escherichia coli CFT073
cugauccgcuucg

SEQ ID NO: 629843 - RNA, 14 nt, Escherichia coli CFT073
cugauccugacaag

SEQ ID NO: 629844 - RNA, 18 nt, Escherichia coli CFT073
cugauccugcaacaacac

SEQ ID NO: 629845 - RNA, 23 nt, Escherichia coli CFT073
cugauacuccaugaguaacaguc

SEQ ID NO: 629846 - RNA, 16 nt, Escherichia coli CFT073
cugauaguaguuugau

SEQ ID NO: 629847 - RNA, 17 nt, Escherichia coli CFT073
cugauaguaguuugaug

SEQ ID NO: 629848 - RNA, 15 nt, Escherichia coli CFT073
cugauaaucaucuuc

SEQ ID NO: 629849 - RNA, 20 nt, Escherichia coli CFT073
cugauaaugcagauaacuua

SEQ ID NO: 629850 - RNA, 12 nt, Escherichia coli CFT073
cugauaauaaua

SEQ ID NO: 629851 - RNA, 15 nt, Escherichia coli CFT073
cugauacccggcaca

SEQ ID NO: 629852 - RNA, 18 nt, Escherichia coli CFT073
cugauacccggcuaacag

SEQ ID NO: 629853 - RNA, 20 nt, Escherichia coli CFT073
cugauacccggcuaacaguc

SEQ ID NO: 629854 - RNA, 15 nt, Escherichia coli CFT073
cugauaaaccagacc

SEQ ID NO: 629855 - RNA, 14 nt, Escherichia coli CFT073
cugauaaaucaccu

SEQ ID NO: 629856 - RNA, 13 nt, Escherichia coli CFT073
cugauaacacagc

SEQ ID NO: 629857 - RNA, 18 nt, Escherichia coli CFT073
cugauaaccgccgccaaa

SEQ ID NO: 629858 - RNA, 18 nt, Escherichia coli CFT073
cugauaaggcauuuacgc

SEQ ID NO: 629859 - RNA, 18 nt, Escherichia coli CFT073
cugauaaccuuccagcuu

SEQ ID NO: 629860 - RNA, 20 nt, Escherichia coli CFT073
cugauaacgaaucgggcaaa

SEQ ID NO: 629861 - RNA, 22 nt, Escherichia coli CFT073
cugauaacgccacgccaccagc

SEQ ID NO: 629862 - RNA, 18 nt, Escherichia coli CFT073
cugauaacuuuuuauccg

SEQ ID NO: 629863 - RNA, 13 nt, Escherichia coli CFT073
cugauaagacacg

SEQ ID NO: 629864 - RNA, 20 nt, Escherichia coli CFT073
cugauaagacgcgccagcgu

SEQ ID NO: 629865 - RNA, 19 nt, Escherichia coli CFT073
cugagugggcgucagcagu

SEQ ID NO: 629866 - RNA, 18 nt, Escherichia coli CFT073
cugagugcgaaaaucaau

SEQ ID NO: 629867 - RNA, 19 nt, Escherichia coli CFT073
cugagugcgaaaaucaaua

SEQ ID NO: 629868 - RNA, 14 nt, Escherichia coli CFT073
cugaguuaauuaaa

SEQ ID NO: 629869 - RNA, 17 nt, Escherichia coli CFT073
cugaguuaauuaaaucc

SEQ ID NO: 629870 - RNA, 23 nt, Escherichia coli CFT073
cugauaaaaaacccgcuuuuuga

SEQ ID NO: 629871 - RNA, 20 nt, Escherichia coli CFT073
cugagguaacucucaugcuu

SEQ ID NO: 629872 - RNA, 15 nt, Escherichia coli CFT073
cugaguaaaucaccu

SEQ ID NO: 629873 - RNA, 15 nt, Escherichia coli CFT073
cugaguaauagccug

SEQ ID NO: 629874 - RNA, 18 nt, Escherichia coli CFT073
cugaguaauagccugaug

SEQ ID NO: 629875 - RNA, 19 nt, Escherichia coli CFT073
cugaggaucgggcagugcu

SEQ ID NO: 629876 - RNA, 23 nt, Escherichia coli CFT073
cugaggccggaugccgcugcuau

SEQ ID NO: 629877 - RNA, 13 nt, Escherichia coli CFT073
cugagcuucuuca

SEQ ID NO: 629878 - RNA, 17 nt, Escherichia coli CFT073
cugagcuucuucaaaaa

SEQ ID NO: 629879 - RNA, 16 nt, Escherichia coli CFT073
cucuaucuuauuuucc

SEQ ID NO: 629880 - RNA, 11 nt, Escherichia coli CFT073
cucuacucgcu

SEQ ID NO: 629881 - RNA, 20 nt, Escherichia coli CFT073
cugcaaugccguuugcugca

SEQ ID NO: 629882 - RNA, 16 nt, Escherichia coli CFT073
cugcaauugcggcagg

SEQ ID NO: 629883 - RNA, 23 nt, Escherichia coli CFT073
cugcacaaccggaaccagcgccu

SEQ ID NO: 629884 - RNA, 12 nt, Escherichia coli CFT073
cugcaauuucau

SEQ ID NO: 629885 - RNA, 15 nt, Escherichia coli CFT073
cugcaauaccgccgu

SEQ ID NO: 629886 - RNA, 18 nt, Escherichia coli CFT073
cugcaaucgucugcugaa

SEQ ID NO: 629887 - RNA, 15 nt, Escherichia coli CFT073
cugcaaucuuuccug

SEQ ID NO: 629888 - RNA, 18 nt, Escherichia coli CFT073
cugcacgguuuuuccagc

SEQ ID NO: 629889 - RNA, 19 nt, Escherichia coli CFT073
cugcacgguuuuuccagcu

SEQ ID NO: 629890 - RNA, 20 nt, Escherichia coli CFT073
cugcacggucacaucgcuga

SEQ ID NO: 629891 - RNA, 23 nt, Escherichia coli CFT073
cugcacuuugugucagugucaga

SEQ ID NO: 629892 - RNA, 17 nt, Escherichia coli CFT073
cugcacugguggcaccu

SEQ ID NO: 629893 - RNA, 23 nt, Escherichia coli CFT073
cugcacugguggcaccucgugcg

SEQ ID NO: 629894 - RNA, 13 nt, Escherichia coli CFT073
cugcacuguccca

SEQ ID NO: 629895 - RNA, 23 nt, Escherichia coli CFT073
cugcaggcaacgaccagaaaugc

SEQ ID NO: 629896 - RNA, 20 nt, Escherichia coli CFT073
cugcagauaacuggccagcg

SEQ ID NO: 629897 - RNA, 18 nt, Escherichia coli CFT073
cugcagaggccgccgcaa

SEQ ID NO: 629898 - RNA, 15 nt, Escherichia coli CFT073
cugcagggauggcuc

SEQ ID NO: 629899 - RNA, 16 nt, Escherichia coli CFT073
cugcagucaccugccc

SEQ ID NO: 629900 - RNA, 15 nt, Escherichia coli CFT073
cugcagugguaaaca

SEQ ID NO: 629901 - RNA, 17 nt, Escherichia coli CFT073
cugauuguucagucgau

SEQ ID NO: 629902 - RNA, 15 nt, Escherichia coli CFT073
cugcaaaaucuguug

SEQ ID NO: 629903 - RNA, 19 nt, Escherichia coli CFT073
cugcaaagcugauaaucau

SEQ ID NO: 629904 - RNA, 20 nt, Escherichia coli CFT073
cugcaaagcugaugguugaa

SEQ ID NO: 629905 - RNA, 13 nt, Escherichia coli CFT073
cugcaaauaaaua

SEQ ID NO: 629906 - RNA, 14 nt, Escherichia coli CFT073
cugcaaaucaccac

SEQ ID NO: 629907 - RNA, 19 nt, Escherichia coli CFT073
cugcaacguuuuaagcaaa

SEQ ID NO: 629908 - RNA, 16 nt, Escherichia coli CFT073
cugcaacuucacggcu

SEQ ID NO: 629909 - RNA, 16 nt, Escherichia coli CFT073
cugcaacuucgcauuu

SEQ ID NO: 629910 - RNA, 21 nt, Escherichia coli CFT073
cugcaagacgcgucauacgau

SEQ ID NO: 629911 - RNA, 22 nt, Escherichia coli CFT073
cugauguugaaugugaccgacc

SEQ ID NO: 629912 - RNA, 15 nt, Escherichia coli CFT073
cugauguucgccaga

SEQ ID NO: 629913 - RNA, 20 nt, Escherichia coli CFT073
cugaugugcuccgcucauca

SEQ ID NO: 629914 - RNA, 20 nt, Escherichia coli CFT073
cugauuaauuuucgcccguu

SEQ ID NO: 629915 - RNA, 20 nt, Escherichia coli CFT073
cugauuaccuuccugccaga

SEQ ID NO: 629916 - RNA, 16 nt, Escherichia coli CFT073
cugauuacucauuaau

SEQ ID NO: 629917 - RNA, 19 nt, Escherichia coli CFT073
cugauuacucauuaaucaa

SEQ ID NO: 629918 - RNA, 13 nt, Escherichia coli CFT073
cugauugcauaau

SEQ ID NO: 629919 - RNA, 22 nt, Escherichia coli CFT073
cugaucuuuaaucgcuccggaa

SEQ ID NO: 629920 - RNA, 22 nt, Escherichia coli CFT073
cugaugaaagcaugucaggcag

SEQ ID NO: 629921 - RNA, 22 nt, Escherichia coli CFT073
cugaucugccagcagacgccgg

SEQ ID NO: 629922 - RNA, 13 nt, Escherichia coli CFT073
cugaucuacagcc

SEQ ID NO: 629923 - RNA, 20 nt, Escherichia coli CFT073
cugccugcggcgaucuucaa

SEQ ID NO: 629924 - RNA, 19 nt, Escherichia coli CFT073
cugccuggauaaggccacc

SEQ ID NO: 629925 - RNA, 17 nt, Escherichia coli CFT073
cugcgcagauuagccgg

SEQ ID NO: 629926 - RNA, 22 nt, Escherichia coli CFT073
cugccucccauucaucgccacc

SEQ ID NO: 629927 - RNA, 16 nt, Escherichia coli CFT073
cugccugcagcugcuc

SEQ ID NO: 629928 - RNA, 19 nt, Escherichia coli CFT073
cugccugauccugagcuaa

SEQ ID NO: 629929 - RNA, 14 nt, Escherichia coli CFT073
cugcgcccgcagcg

SEQ ID NO: 629930 - RNA, 18 nt, Escherichia coli CFT073
cugcgccaacgucugccu

SEQ ID NO: 629931 - RNA, 22 nt, Escherichia coli CFT073
cugcgcauuaaauaccaagcca

SEQ ID NO: 629932 - RNA, 15 nt, Escherichia coli CFT073
cugcgcauuucccag

SEQ ID NO: 629933 - RNA, 20 nt, Escherichia coli CFT073
cugcgcauuucccagcaaga

SEQ ID NO: 629934 - RNA, 22 nt, Escherichia coli CFT073
cugcgcauuucgcucuucacau

SEQ ID NO: 629935 - RNA, 17 nt, Escherichia coli CFT073
cugcgcgggugaaaacg

SEQ ID NO: 629936 - RNA, 13 nt, Escherichia coli CFT073
cugcgcgaaauag

SEQ ID NO: 629937 - RNA, 13 nt, Escherichia coli CFT073
cugcgccuuccag

SEQ ID NO: 629938 - RNA, 16 nt, Escherichia coli CFT073
cugcgcgacucccuga

SEQ ID NO: 629939 - RNA, 22 nt, Escherichia coli CFT073
cugcgccuuuuuucgccgcagc

SEQ ID NO: 629940 - RNA, 18 nt, Escherichia coli CFT073
cugcgccgaucgucgcuc

SEQ ID NO: 629941 - RNA, 14 nt, Escherichia coli CFT073
cugcgcccgccagc

SEQ ID NO: 629942 - RNA, 20 nt, Escherichia coli CFT073
cugcgcccgcccgcuguaag

SEQ ID NO: 629943 - RNA, 23 nt, Escherichia coli CFT073
cugcguuuucacaguaauuuccu

SEQ ID NO: 629944 - RNA, 22 nt, Escherichia coli CFT073
cugcguuuucgaaaaagcgcug

SEQ ID NO: 629945 - RNA, 22 nt, Escherichia coli CFT073
cugcuaaaucggggaucauuaa

SEQ ID NO: 629946 - RNA, 22 nt, Escherichia coli CFT073
cugcguuucauguaacgcugca

SEQ ID NO: 629947 - RNA, 22 nt, Escherichia coli CFT073
cugcguuagaaaacgccugcuc

SEQ ID NO: 629948 - RNA, 12 nt, Escherichia coli CFT073
cugcguuauaca

SEQ ID NO: 629949 - RNA, 13 nt, Escherichia coli CFT073
cugcguuauacau

SEQ ID NO: 629950 - RNA, 16 nt, Escherichia coli CFT073
cugcguugcucaugca

SEQ ID NO: 629951 - RNA, 17 nt, Escherichia coli CFT073
cugcguugcucaugcaa

SEQ ID NO: 629952 - RNA, 20 nt, Escherichia coli CFT073
cugcguggaguaaagcccga

SEQ ID NO: 629953 - RNA, 17 nt, Escherichia coli CFT073
cugcgguguaaaccagc

SEQ ID NO: 629954 - RNA, 15 nt, Escherichia coli CFT073
cugcgguucagcuuu

SEQ ID NO: 629955 - RNA, 16 nt, Escherichia coli CFT073
cugcgguucagcuuuu

SEQ ID NO: 629956 - RNA, 20 nt, Escherichia coli CFT073
cugcggguugcucucgccag

SEQ ID NO: 629957 - RNA, 16 nt, Escherichia coli CFT073
cugcgggcgcaccgca

SEQ ID NO: 629958 - RNA, 21 nt, Escherichia coli CFT073
cugcggggagaaugccagcag

SEQ ID NO: 629959 - RNA, 13 nt, Escherichia coli CFT073
cugcgggagcgcu

SEQ ID NO: 629960 - RNA, 21 nt, Escherichia coli CFT073
cugcggaauagcggguacagc

SEQ ID NO: 629961 - RNA, 18 nt, Escherichia coli CFT073
cugcgcuuuguucauguc

SEQ ID NO: 629962 - RNA, 20 nt, Escherichia coli CFT073
cugcgcuuuuaauucacuuc

SEQ ID NO: 629963 - RNA, 22 nt, Escherichia coli CFT073
cugcgcuuuuaauucacuucug

SEQ ID NO: 629964 - RNA, 20 nt, Escherichia coli CFT073
cugcgcguggucagcacaaa

SEQ ID NO: 629965 - RNA, 16 nt, Escherichia coli CFT073
cugcgcguuacuggca

SEQ ID NO: 629966 - RNA, 17 nt, Escherichia coli CFT073
cugcgcuugcgcggcag

SEQ ID NO: 629967 - RNA, 18 nt, Escherichia coli CFT073
cugcgcuugcgcggcagc

SEQ ID NO: 629968 - RNA, 17 nt, Escherichia coli CFT073
cugcgcuugcggccagc

SEQ ID NO: 629969 - RNA, 15 nt, Escherichia coli CFT073
cugcgcuuucugcuu

SEQ ID NO: 629970 - RNA, 17 nt, Escherichia coli CFT073
cugccgagcgcaagcca

SEQ ID NO: 629971 - RNA, 24 nt, Escherichia coli CFT073
cugccgacgccaggcucggauaac

SEQ ID NO: 629972 - RNA, 17 nt, Escherichia coli CFT073
cugccggaguauuucau

SEQ ID NO: 629973 - RNA, 15 nt, Escherichia coli CFT073
cugccggaacgugca

SEQ ID NO: 629974 - RNA, 12 nt, Escherichia coli CFT073
cugccucaggca

SEQ ID NO: 629975 - RNA, 13 nt, Escherichia coli CFT073
cugccguugaucu

SEQ ID NO: 629976 - RNA, 15 nt, Escherichia coli CFT073
cugccgucaauuuua

SEQ ID NO: 629977 - RNA, 15 nt, Escherichia coli CFT073
cugccgguuccagcu

SEQ ID NO: 629978 - RNA, 17 nt, Escherichia coli CFT073
cugccgguuccagcuuc

SEQ ID NO: 629979 - RNA, 19 nt, Escherichia coli CFT073
cugccgguuccagcuucag

SEQ ID NO: 629980 - RNA, 22 nt, Escherichia coli CFT073
cugccgguucggcgucgccgcu

SEQ ID NO: 629981 - RNA, 14 nt, Escherichia coli CFT073
cugccguaacugcg

SEQ ID NO: 629982 - RNA, 15 nt, Escherichia coli CFT073
cugccguaacugcgc

SEQ ID NO: 629983 - RNA, 21 nt, Escherichia coli CFT073
cugccgggaagcucucuucca

SEQ ID NO: 629984 - RNA, 19 nt, Escherichia coli CFT073
cugccgggaauacugcaac

SEQ ID NO: 629985 - RNA, 20 nt, Escherichia coli CFT073
cugccgggggcgaccugugc

SEQ ID NO: 629986 - RNA, 22 nt, Escherichia coli CFT073
cugccgggggcgaccugugccg

SEQ ID NO: 629987 - RNA, 20 nt, Escherichia coli CFT073
cugccagagucagcaaugcc

SEQ ID NO: 629988 - RNA, 23 nt, Escherichia coli CFT073
cugccagagucagcaaugccaga

SEQ ID NO: 629989 - RNA, 12 nt, Escherichia coli CFT073
cugccagaagca

SEQ ID NO: 629990 - RNA, 15 nt, Escherichia coli CFT073
cugccacuacccgca

SEQ ID NO: 629991 - RNA, 21 nt, Escherichia coli CFT073
cugccagaaaucggccuucca

SEQ ID NO: 629992 - RNA, 16 nt, Escherichia coli CFT073
cugccaccagcacacc

SEQ ID NO: 629993 - RNA, 21 nt, Escherichia coli CFT073
cugccaccaggaacgcgccaa

SEQ ID NO: 629994 - RNA, 18 nt, Escherichia coli CFT073
cugccaccguguauuucu

SEQ ID NO: 629995 - RNA, 13 nt, Escherichia coli CFT073
cugccacgccacg

SEQ ID NO: 629996 - RNA, 22 nt, Escherichia coli CFT073
cugccaguuaccaccgccagau

SEQ ID NO: 629997 - RNA, 12 nt, Escherichia coli CFT073
cugccaguugcg

SEQ ID NO: 629998 - RNA, 23 nt, Escherichia coli CFT073
cugccaguaagcaguccagcgcc

SEQ ID NO: 629999 - RNA, 23 nt, Escherichia coli CFT073
cugccaggugaucccccugggcc

SEQ ID NO: 630000 - RNA, 23 nt, Escherichia coli CFT073
cugccaggcagcgauuaacugcg

SEQ ID NO: 630001 - RNA, 15 nt, Escherichia coli CFT073
cugccccagagacaa

SEQ ID NO: 630002 - RNA, 15 nt, Escherichia coli CFT073
cugccccagugggcu

SEQ ID NO: 630003 - RNA, 16 nt, Escherichia coli CFT073
cugccccaucugcccc

SEQ ID NO: 630004 - RNA, 13 nt, Escherichia coli CFT073
cugcccgcuccag

SEQ ID NO: 630005 - RNA, 15 nt, Escherichia coli CFT073
cugcccgcuccagcu

SEQ ID NO: 630006 - RNA, 21 nt, Escherichia coli CFT073
cugcccaggcaaaaaggccua

SEQ ID NO: 630007 - RNA, 20 nt, Escherichia coli CFT073
cugcccagccgguaaggcca

SEQ ID NO: 630008 - RNA, 21 nt, Escherichia coli CFT073
cugcccagccgguaaggccaa

SEQ ID NO: 630009 - RNA, 22 nt, Escherichia coli CFT073
cugccaugucagacaacaugcc

SEQ ID NO: 630010 - RNA, 14 nt, Escherichia coli CFT073
cugccaucaucuuc

SEQ ID NO: 630011 - RNA, 12 nt, Escherichia coli CFT073
cugccaugcagu

SEQ ID NO: 630012 - RNA, 13 nt, Escherichia coli CFT073
cugggcuguuacc

SEQ ID NO: 630013 - RNA, 14 nt, Escherichia coli CFT073
cuggggcuggaaga

SEQ ID NO: 630014 - RNA, 17 nt, Escherichia coli CFT073
cugggugaugguccagu

SEQ ID NO: 630015 - RNA, 22 nt, Escherichia coli CFT073
cuggguguauuguuccucguuc

SEQ ID NO: 630016 - RNA, 14 nt, Escherichia coli CFT073
cugguaaucaccac

SEQ ID NO: 630017 - RNA, 22 nt, Escherichia coli CFT073
cugguaaucgcggguugccauu

SEQ ID NO: 630018 - RNA, 21 nt, Escherichia coli CFT073
cugguaccugucgcuuuugca

SEQ ID NO: 630019 - RNA, 14 nt, Escherichia coli CFT073
cugggcuucaccac

SEQ ID NO: 630020 - RNA, 14 nt, Escherichia coli CFT073
cugggcgagguggg

SEQ ID NO: 630021 - RNA, 19 nt, Escherichia coli CFT073
cugggcgaucggcaggaaa

SEQ ID NO: 630022 - RNA, 23 nt, Escherichia coli CFT073
cugggcgauuuucuacuucuuuc

SEQ ID NO: 630023 - RNA, 14 nt, Escherichia coli CFT073
cugggccugcauau

SEQ ID NO: 630024 - RNA, 21 nt, Escherichia coli CFT073
cuggcgucacgccgaccagac

SEQ ID NO: 630025 - RNA, 16 nt, Escherichia coli CFT073
cuggcguacccaucaa

SEQ ID NO: 630026 - RNA, 13 nt, Escherichia coli CFT073
cuggcguagagau

SEQ ID NO: 630027 - RNA, 19 nt, Escherichia coli CFT073
cuggcgggaauaaaagcca

SEQ ID NO: 630028 - RNA, 15 nt, Escherichia coli CFT073
cuggcggcgcucgau

SEQ ID NO: 630029 - RNA, 12 nt, Escherichia coli CFT073
cuggcggcggcg

SEQ ID NO: 630030 - RNA, 21 nt, Escherichia coli CFT073
cuggcggcguuuugcuuuuua

SEQ ID NO: 630031 - RNA, 19 nt, Escherichia coli CFT073
cuggugagugcgguuuugu

SEQ ID NO: 630032 - RNA, 14 nt, Escherichia coli CFT073
cuggucuggugaau

SEQ ID NO: 630033 - RNA, 20 nt, Escherichia coli CFT073
cuggugaaagagccaucauu

SEQ ID NO: 630034 - RNA, 14 nt, Escherichia coli CFT073
cuggugcccaucac

SEQ ID NO: 630035 - RNA, 15 nt, Escherichia coli CFT073
cuggugcaggcguua

SEQ ID NO: 630036 - RNA, 15 nt, Escherichia coli CFT073
cuggugccagcgcca

SEQ ID NO: 630037 - RNA, 20 nt, Escherichia coli CFT073
cuggucgguuucagccagga

SEQ ID NO: 630038 - RNA, 14 nt, Escherichia coli CFT073
cuggucgcgcggca

SEQ ID NO: 630039 - RNA, 16 nt, Escherichia coli CFT073
cuggucgaggaucucu

SEQ ID NO: 630040 - RNA, 14 nt, Escherichia coli CFT073
cuggucaucaaguu

SEQ ID NO: 630041 - RNA, 22 nt, Escherichia coli CFT073
cuggucaauggcgaccacugac

SEQ ID NO: 630042 - RNA, 14 nt, Escherichia coli CFT073
cuggucacuaccug

SEQ ID NO: 630043 - RNA, 22 nt, Escherichia coli CFT073
cugguacgcgcaccgcgugaug

SEQ ID NO: 630044 - RNA, 18 nt, Escherichia coli CFT073
cugguacucaaccgccac

SEQ ID NO: 630045 - RNA, 16 nt, Escherichia coli CFT073
cugguagcgcauuuca

SEQ ID NO: 630046 - RNA, 14 nt, Escherichia coli CFT073
cugguaugccugga

SEQ ID NO: 630047 - RNA, 14 nt, Escherichia coli CFT073
cugucgccagugag

SEQ ID NO: 630048 - RNA, 17 nt, Escherichia coli CFT073
cuguccgauuuguucuc

SEQ ID NO: 630049 - RNA, 20 nt, Escherichia coli CFT073
cugucggcaaaucaauagug

SEQ ID NO: 630050 - RNA, 17 nt, Escherichia coli CFT073
cugucggagcucccccu

SEQ ID NO: 630051 - RNA, 23 nt, Escherichia coli CFT073
cugucggcaagauacugcauaau

SEQ ID NO: 630052 - RNA, 15 nt, Escherichia coli CFT073
cugucgcgcagcacu

SEQ ID NO: 630053 - RNA, 15 nt, Escherichia coli CFT073
cugucgcgucaauca

SEQ ID NO: 630054 - RNA, 15 nt, Escherichia coli CFT073
cugucgcuucacgca

SEQ ID NO: 630055 - RNA, 19 nt, Escherichia coli CFT073
cugucggguaagcgccaca

SEQ ID NO: 630056 - RNA, 20 nt, Escherichia coli CFT073
cugucggguaagcgccacaa

SEQ ID NO: 630057 - RNA, 22 nt, Escherichia coli CFT073
cugucagaccuccguuuuucug

SEQ ID NO: 630058 - RNA, 20 nt, Escherichia coli CFT073
cugucacgcuggcaucaauc

SEQ ID NO: 630059 - RNA, 24 nt, Escherichia coli CFT073
cugucaccgggcaaacgcuggaug

SEQ ID NO: 630060 - RNA, 15 nt, Escherichia coli CFT073
cugucaccucugcaa

SEQ ID NO: 630061 - RNA, 22 nt, Escherichia coli CFT073
cugucccaaaaugucggaugcg

SEQ ID NO: 630062 - RNA, 22 nt, Escherichia coli CFT073
cugucaguagcaaacacugccu

SEQ ID NO: 630063 - RNA, 14 nt, Escherichia coli CFT073
cugucagucugcuu

SEQ ID NO: 630064 - RNA, 13 nt, Escherichia coli CFT073
cugucaccaauca

SEQ ID NO: 630065 - RNA, 14 nt, Escherichia coli CFT073
cuguaauucguaac

SEQ ID NO: 630066 - RNA, 15 nt, Escherichia coli CFT073
cuguaauugccgcuc

SEQ ID NO: 630067 - RNA, 14 nt, Escherichia coli CFT073
cuguaaaucugccg

SEQ ID NO: 630068 - RNA, 20 nt, Escherichia coli CFT073
cuguaaaaaaggcagccauc

SEQ ID NO: 630069 - RNA, 15 nt, Escherichia coli CFT073
cugguuuugaaaaga

SEQ ID NO: 630070 - RNA, 13 nt, Escherichia coli CFT073
cuggugccugcac

SEQ ID NO: 630071 - RNA, 17 nt, Escherichia coli CFT073
cuggugccugcacuggu

SEQ ID NO: 630072 - RNA, 23 nt, Escherichia coli CFT073
cuguacaucgcgccaacaaaagc

SEQ ID NO: 630073 - RNA, 13 nt, Escherichia coli CFT073
cuguacaguaauc

SEQ ID NO: 630074 - RNA, 14 nt, Escherichia coli CFT073
cuguaccaccagaa

SEQ ID NO: 630075 - RNA, 22 nt, Escherichia coli CFT073
cuguaccaccagaaucgccagc

SEQ ID NO: 630076 - RNA, 21 nt, Escherichia coli CFT073
cuguaccagcggcuuccagca

SEQ ID NO: 630077 - RNA, 18 nt, Escherichia coli CFT073
cuguaggucggauaagac

SEQ ID NO: 630078 - RNA, 19 nt, Escherichia coli CFT073
cuguaggucggauaagacg

SEQ ID NO: 630079 - RNA, 20 nt, Escherichia coli CFT073
cuguaccuggucgauaauaa

SEQ ID NO: 630080 - RNA, 19 nt, Escherichia coli CFT073
cuguaguccaggccugauu

SEQ ID NO: 630081 - RNA, 21 nt, Escherichia coli CFT073
cuggcauugccagaaaccagc

SEQ ID NO: 630082 - RNA, 21 nt, Escherichia coli CFT073
cuggcauacuccggcggcagc

SEQ ID NO: 630083 - RNA, 23 nt, Escherichia coli CFT073
cuggcaucaaucgcucccagccc

SEQ ID NO: 630084 - RNA, 19 nt, Escherichia coli CFT073
cuggcaguggaauauaauu

SEQ ID NO: 630085 - RNA, 15 nt, Escherichia coli CFT073
cuggcagugugccug

SEQ ID NO: 630086 - RNA, 14 nt, Escherichia coli CFT073
cuggcccaugccag

SEQ ID NO: 630087 - RNA, 15 nt, Escherichia coli CFT073
cuggaggagauauug

SEQ ID NO: 630088 - RNA, 16 nt, Escherichia coli CFT073
cuggagguuuagccaa

SEQ ID NO: 630089 - RNA, 14 nt, Escherichia coli CFT073
cuggauaaccuguu

SEQ ID NO: 630090 - RNA, 21 nt, Escherichia coli CFT073
cuggauaaucacaauggucaa

SEQ ID NO: 630091 - RNA, 19 nt, Escherichia coli CFT073
cuggcaagaaacgcuccac

SEQ ID NO: 630092 - RNA, 21 nt, Escherichia coli CFT073
cuggcaagaaacgcuccacca

SEQ ID NO: 630093 - RNA, 22 nt, Escherichia coli CFT073
cuggcaagaaacgcuccaccac

SEQ ID NO: 630094 - RNA, 20 nt, Escherichia coli CFT073
cuggcaagaagaucagcaaa

SEQ ID NO: 630095 - RNA, 17 nt, Escherichia coli CFT073
cuggcaaguucgucuuc

SEQ ID NO: 630096 - RNA, 13 nt, Escherichia coli CFT073
cuggcaaucgcca

SEQ ID NO: 630097 - RNA, 17 nt, Escherichia coli CFT073
cuggcaaucaccucuuu

SEQ ID NO: 630098 - RNA, 16 nt, Escherichia coli CFT073
cuggcacaugcauaaa

SEQ ID NO: 630099 - RNA, 18 nt, Escherichia coli CFT073
cuggcaccaucagcucug

SEQ ID NO: 630100 - RNA, 21 nt, Escherichia coli CFT073
cuggcaccgguacacaaccgc

SEQ ID NO: 630101 - RNA, 16 nt, Escherichia coli CFT073
cuggcgacugccagcc

SEQ ID NO: 630102 - RNA, 19 nt, Escherichia coli CFT073
cuggcgauauugccgcgau

SEQ ID NO: 630103 - RNA, 16 nt, Escherichia coli CFT073
cuggccugcgaccagu

SEQ ID NO: 630104 - RNA, 18 nt, Escherichia coli CFT073
cuggccuccagcacuucc

SEQ ID NO: 630105 - RNA, 16 nt, Escherichia coli CFT073
cuggccguuugcugcu

SEQ ID NO: 630106 - RNA, 18 nt, Escherichia coli CFT073
cuggcggcaaucgccaga

SEQ ID NO: 630107 - RNA, 13 nt, Escherichia coli CFT073
cuggcggcagcag

SEQ ID NO: 630108 - RNA, 14 nt, Escherichia coli CFT073
cuggcgcuggcaug

SEQ ID NO: 630109 - RNA, 12 nt, Escherichia coli CFT073
cuggcgcuuuga

SEQ ID NO: 630110 - RNA, 18 nt, Escherichia coli CFT073
cuggcgcuuugaaacgca

SEQ ID NO: 630111 - RNA, 15 nt, Escherichia coli CFT073
cuggcgcugcucagg

SEQ ID NO: 630112 - RNA, 18 nt, Escherichia coli CFT073
cuggcgcuaacguuaauc

SEQ ID NO: 630113 - RNA, 15 nt, Escherichia coli CFT073
cuggaagaaaacauu

SEQ ID NO: 630114 - RNA, 17 nt, Escherichia coli CFT073
cuggaaccacagcgccg

SEQ ID NO: 630115 - RNA, 15 nt, Escherichia coli CFT073
cuggaaaucaauggu

SEQ ID NO: 630116 - RNA, 16 nt, Escherichia coli CFT073
cuggaauggaaacagc

SEQ ID NO: 630117 - RNA, 23 nt, Escherichia coli CFT073
cuggaauggaaacagcaccaucc

SEQ ID NO: 630118 - RNA, 16 nt, Escherichia coli CFT073
cuggaaucaucaagca

SEQ ID NO: 630119 - RNA, 22 nt, Escherichia coli CFT073
cuggaaucaucaagcacuugca

SEQ ID NO: 630120 - RNA, 13 nt, Escherichia coli CFT073
cuggaagaccagc

SEQ ID NO: 630121 - RNA, 17 nt, Escherichia coli CFT073
cuggaagccauuuugca

SEQ ID NO: 630122 - RNA, 17 nt, Escherichia coli CFT073
cuggagagcgccgggca

SEQ ID NO: 630123 - RNA, 19 nt, Escherichia coli CFT073
cuggagagcgccgggcaaa

SEQ ID NO: 630124 - RNA, 18 nt, Escherichia coli CFT073
cuggagcaguauugauag

SEQ ID NO: 630125 - RNA, 17 nt, Escherichia coli CFT073
cuggagcaaacgcgcca

SEQ ID NO: 630126 - RNA, 22 nt, Escherichia coli CFT073
cuggacccgaugaucaaaaaaa

SEQ ID NO: 630127 - RNA, 22 nt, Escherichia coli CFT073
cugcuucuuaccaccuuccucu

SEQ ID NO: 630128 - RNA, 16 nt, Escherichia coli CFT073
cugcucagcacgccac

SEQ ID NO: 630129 - RNA, 12 nt, Escherichia coli CFT073
cugcucaaugga

SEQ ID NO: 630130 - RNA, 16 nt, Escherichia coli CFT073
cugcucaaguaauaaa

SEQ ID NO: 630131 - RNA, 21 nt, Escherichia coli CFT073
cugcuauggcgcguccggcgu

SEQ ID NO: 630132 - RNA, 20 nt, Escherichia coli CFT073
cugcuauucccgcaaaaucu

SEQ ID NO: 630133 - RNA, 14 nt, Escherichia coli CFT073
cugcuuuagggugg

SEQ ID NO: 630134 - RNA, 21 nt, Escherichia coli CFT073
cugcuuuaucagaucacgcau

SEQ ID NO: 630135 - RNA, 15 nt, Escherichia coli CFT073
cugcuugaauuuauc

SEQ ID NO: 630136 - RNA, 23 nt, Escherichia coli CFT073
cugcuugaauuuaucuucaccaa

SEQ ID NO: 630137 - RNA, 23 nt, Escherichia coli CFT073
cugcuuuucauacaaucgguaac

SEQ ID NO: 630138 - RNA, 16 nt, Escherichia coli CFT073
cugcuuugacacuuca

SEQ ID NO: 630139 - RNA, 17 nt, Escherichia coli CFT073
cuguuuuuuaauucagg

SEQ ID NO: 630140 - RNA, 20 nt, Escherichia coli CFT073
cuguuucuguugccagcagu

SEQ ID NO: 630141 - RNA, 18 nt, Escherichia coli CFT073
cuguuucgcggcaaacug

SEQ ID NO: 630142 - RNA, 18 nt, Escherichia coli CFT073
cuguuucgcuucuucagc

SEQ ID NO: 630143 - RNA, 15 nt, Escherichia coli CFT073
cuguuucaguaacug

SEQ ID NO: 630144 - RNA, 15 nt, Escherichia coli CFT073
cuguuuauugaggau

SEQ ID NO: 630145 - RNA, 22 nt, Escherichia coli CFT073
cuguuuauugaggauauuacug

SEQ ID NO: 630146 - RNA, 15 nt, Escherichia coli CFT073
cuguuuauuguugau

SEQ ID NO: 630147 - RNA, 19 nt, Escherichia coli CFT073
cuguuuagccgcuucugca

SEQ ID NO: 630148 - RNA, 23 nt, Escherichia coli CFT073
cuguuuagccgcuucugcagcuu

SEQ ID NO: 630149 - RNA, 20 nt, Escherichia coli CFT073
cuguuugcgucagcuucaga

SEQ ID NO: 630150 - RNA, 16 nt, Escherichia coli CFT073
cuguuuucagcaccag

SEQ ID NO: 630151 - RNA, 21 nt, Escherichia coli CFT073
cuguucuuucaacacaugcac

SEQ ID NO: 630152 - RNA, 13 nt, Escherichia coli CFT073
cuguucugauuuu

SEQ ID NO: 630153 - RNA, 18 nt, Escherichia coli CFT073
cugucuaaccgccugccu

SEQ ID NO: 630154 - RNA, 19 nt, Escherichia coli CFT073
cugucuaaugauucauaaa

SEQ ID NO: 630155 - RNA, 12 nt, Escherichia coli CFT073
cugucuaccagc

SEQ ID NO: 630156 - RNA, 22 nt, Escherichia coli CFT073
cugucucauggguauaaccgcc

SEQ ID NO: 630157 - RNA, 16 nt, Escherichia coli CFT073
cugucugcugugugau

SEQ ID NO: 630158 - RNA, 21 nt, Escherichia coli CFT073
cugucucauuguguacauccu

SEQ ID NO: 630159 - RNA, 15 nt, Escherichia coli CFT073
cugucugauaaaaaa

SEQ ID NO: 630160 - RNA, 22 nt, Escherichia coli CFT073
cuguuggaaucacucaucaugc

SEQ ID NO: 630161 - RNA, 16 nt, Escherichia coli CFT073
cuguuuagccgcuucu

SEQ ID NO: 630162 - RNA, 18 nt, Escherichia coli CFT073
cuguuuaauaugcaauuc

SEQ ID NO: 630163 - RNA, 22 nt, Escherichia coli CFT073
cuguugugccacauccagcggc

SEQ ID NO: 630164 - RNA, 17 nt, Escherichia coli CFT073
cuguuguuccagcuucc

SEQ ID NO: 630165 - RNA, 19 nt, Escherichia coli CFT073
cuguuggugccagauagcc

SEQ ID NO: 630166 - RNA, 18 nt, Escherichia coli CFT073
cuguugguaacuuacuga

SEQ ID NO: 630167 - RNA, 17 nt, Escherichia coli CFT073
cuuaauuuugguaauuc

SEQ ID NO: 630168 - RNA, 16 nt, Escherichia coli CFT073
cuuaccuccugucuaa

SEQ ID NO: 630169 - RNA, 11 nt, Escherichia coli CFT073
cuuaaucaacu

SEQ ID NO: 630170 - RNA, 14 nt, Escherichia coli CFT073
cuuaaucaacucac

SEQ ID NO: 630171 - RNA, 18 nt, Escherichia coli CFT073
cuuaaucaauugcaggaa

SEQ ID NO: 630172 - RNA, 13 nt, Escherichia coli CFT073
cuuaaucaccagc

SEQ ID NO: 630173 - RNA, 16 nt, Escherichia coli CFT073
cuuaaucaucaaugcc

SEQ ID NO: 630174 - RNA, 18 nt, Escherichia coli CFT073
cuuaauugcccaaagcca

SEQ ID NO: 630175 - RNA, 16 nt, Escherichia coli CFT073
cuuaauagcugccagc

SEQ ID NO: 630176 - RNA, 17 nt, Escherichia coli CFT073
cuuaauagcuucuucuu

SEQ ID NO: 630177 - RNA, 17 nt, Escherichia coli CFT073
cuuaucagcauacgcca

SEQ ID NO: 630178 - RNA, 14 nt, Escherichia coli CFT073
cuuaucaggcauug

SEQ ID NO: 630179 - RNA, 15 nt, Escherichia coli CFT073
cuuaucaaucucugc

SEQ ID NO: 630180 - RNA, 14 nt, Escherichia coli CFT073
cuuaucacagagga

SEQ ID NO: 630181 - RNA, 13 nt, Escherichia coli CFT073
cuuaucaugccua

SEQ ID NO: 630182 - RNA, 13 nt, Escherichia coli CFT073
cuuaucaggccua

SEQ ID NO: 630183 - RNA, 12 nt, Escherichia coli CFT073
cuuaucaggccu

SEQ ID NO: 630184 - RNA, 18 nt, Escherichia coli CFT073
cuuaucaggccuacaagu

SEQ ID NO: 630185 - RNA, 21 nt, Escherichia coli CFT073
cuuaucaggccuacaggugca

SEQ ID NO: 630186 - RNA, 21 nt, Escherichia coli CFT073
cuuaucaggccuacauauccg

SEQ ID NO: 630187 - RNA, 22 nt, Escherichia coli CFT073
cuuaucaggucaauugaacucu

SEQ ID NO: 630188 - RNA, 13 nt, Escherichia coli CFT073
cuuauccugagua

SEQ ID NO: 630189 - RNA, 22 nt, Escherichia coli CFT073
cuuaucgcccugaauuucaaua

SEQ ID NO: 630190 - RNA, 15 nt, Escherichia coli CFT073
cuuauccagcgccug

SEQ ID NO: 630191 - RNA, 22 nt, Escherichia coli CFT073
cuuauccgacauuucugcugcc

SEQ ID NO: 630192 - RNA, 20 nt, Escherichia coli CFT073
cuuaucccuucgagcggggg

SEQ ID NO: 630193 - RNA, 20 nt, Escherichia coli CFT073
cuuauauaggugauaaagua

SEQ ID NO: 630194 - RNA, 14 nt, Escherichia coli CFT073
cuuacuauauaaac

SEQ ID NO: 630195 - RNA, 16 nt, Escherichia coli CFT073
cuuacucaugauguca

SEQ ID NO: 630196 - RNA, 19 nt, Escherichia coli CFT073
cuuauuaacagucagucac

SEQ ID NO: 630197 - RNA, 19 nt, Escherichia coli CFT073
cuuauuaaugcuuucagua

SEQ ID NO: 630198 - RNA, 20 nt, Escherichia coli CFT073
cuuaucguuagcauggguau

SEQ ID NO: 630199 - RNA, 15 nt, Escherichia coli CFT073
cuuaucgucccaggc

SEQ ID NO: 630200 - RNA, 17 nt, Escherichia coli CFT073
cuuaucuaauaaacauu

SEQ ID NO: 630201 - RNA, 19 nt, Escherichia coli CFT073
cuuauuauauugucuuaaa

SEQ ID NO: 630202 - RNA, 14 nt, Escherichia coli CFT073
cuucacaaaggcuu

SEQ ID NO: 630203 - RNA, 15 nt, Escherichia coli CFT073
cuucacaaaggcuug

SEQ ID NO: 630204 - RNA, 16 nt, Escherichia coli CFT073
cuucacaaaggcuugc

SEQ ID NO: 630205 - RNA, 22 nt, Escherichia coli CFT073
cuucaauuuuuuccggcgaacc

SEQ ID NO: 630206 - RNA, 18 nt, Escherichia coli CFT073
cuucacaaccgccaucca

SEQ ID NO: 630207 - RNA, 21 nt, Escherichia coli CFT073
cuucacacugaugacaggcua

SEQ ID NO: 630208 - RNA, 18 nt, Escherichia coli CFT073
cuucacaugauaauaaaa

SEQ ID NO: 630209 - RNA, 22 nt, Escherichia coli CFT073
cuucacauuguuaaagcccugc

SEQ ID NO: 630210 - RNA, 20 nt, Escherichia coli CFT073
cuucaccacgccccacgcca

SEQ ID NO: 630211 - RNA, 20 nt, Escherichia coli CFT073
cuucagaucgaaaucuuuuu

SEQ ID NO: 630212 - RNA, 22 nt, Escherichia coli CFT073
cuucacggguugcgccuguguu

SEQ ID NO: 630213 - RNA, 16 nt, Escherichia coli CFT073
cuucacgggcaaccac

SEQ ID NO: 630214 - RNA, 15 nt, Escherichia coli CFT073
cuucacgcaccauaa

SEQ ID NO: 630215 - RNA, 17 nt, Escherichia coli CFT073
cuucacgcccgccccag

SEQ ID NO: 630216 - RNA, 19 nt, Escherichia coli CFT073
cuucagcaucgacauucaa

SEQ ID NO: 630217 - RNA, 14 nt, Escherichia coli CFT073
cuucagcaaggcuu

SEQ ID NO: 630218 - RNA, 20 nt, Escherichia coli CFT073
cuucagcaaggcuuuccaga

SEQ ID NO: 630219 - RNA, 21 nt, Escherichia coli CFT073
cuucagcaaggcuuuccagac

SEQ ID NO: 630220 - RNA, 13 nt, Escherichia coli CFT073
cuucagcaagagu

SEQ ID NO: 630221 - RNA, 19 nt, Escherichia coli CFT073
cuucagcaagaguuuuaaa

SEQ ID NO: 630222 - RNA, 13 nt, Escherichia coli CFT073
cuucagcaaucuc

SEQ ID NO: 630223 - RNA, 21 nt, Escherichia coli CFT073
cuucagcaauuuguucacacc

SEQ ID NO: 630224 - RNA, 14 nt, Escherichia coli CFT073
cuucagccagugcu

SEQ ID NO: 630225 - RNA, 23 nt, Escherichia coli CFT073
cuucagccaguuuuucagcgcca

SEQ ID NO: 630226 - RNA, 23 nt, Escherichia coli CFT073
cuucagccacucggacaccucac

SEQ ID NO: 630227 - RNA, 19 nt, Escherichia coli CFT073
cuucagccagaggcggcaa

SEQ ID NO: 630228 - RNA, 20 nt, Escherichia coli CFT073
cuucagcgaaaucacgcacu

SEQ ID NO: 630229 - RNA, 22 nt, Escherichia coli CFT073
cuucagugagcugucugucaaa

SEQ ID NO: 630230 - RNA, 23 nt, Escherichia coli CFT073
cuucagucaggcgauuguuuaga

SEQ ID NO: 630231 - RNA, 16 nt, Escherichia coli CFT073
cuucaguggaaucauc

SEQ ID NO: 630232 - RNA, 19 nt, Escherichia coli CFT073
cuucaggugcgcaauauca

SEQ ID NO: 630233 - RNA, 19 nt, Escherichia coli CFT073
cuucaguaaauacugcgca

SEQ ID NO: 630234 - RNA, 16 nt, Escherichia coli CFT073
cuucagcguaucccag

SEQ ID NO: 630235 - RNA, 14 nt, Escherichia coli CFT073
cuucauccagcagc

SEQ ID NO: 630236 - RNA, 19 nt, Escherichia coli CFT073
cuucaucaucgcagauuuc

SEQ ID NO: 630237 - RNA, 22 nt, Escherichia coli CFT073
cuucauccaucggcgcuucaau

SEQ ID NO: 630238 - RNA, 23 nt, Escherichia coli CFT073
cuucaucccuuucgcuucaagca

SEQ ID NO: 630239 - RNA, 14 nt, Escherichia coli CFT073
cuucauccgccccg

SEQ ID NO: 630240 - RNA, 22 nt, Escherichia coli CFT073
cuucauccgccccggcuucaaa

SEQ ID NO: 630241 - RNA, 18 nt, Escherichia coli CFT073
cuucauccggauacagcc

SEQ ID NO: 630242 - RNA, 18 nt, Escherichia coli CFT073
cuucauagauagccagca

SEQ ID NO: 630243 - RNA, 22 nt, Escherichia coli CFT073
cuucauagauagccagcaacau

SEQ ID NO: 630244 - RNA, 12 nt, Escherichia coli CFT073
cuucauaggcuu

SEQ ID NO: 630245 - RNA, 15 nt, Escherichia coli CFT073
cuucauagguaaaca

SEQ ID NO: 630246 - RNA, 19 nt, Escherichia coli CFT073
cuucauagucucgcccacg

SEQ ID NO: 630247 - RNA, 13 nt, Escherichia coli CFT073
cuucgauucccag

SEQ ID NO: 630248 - RNA, 19 nt, Escherichia coli CFT073
cuucgcaaaaaaccauccc

SEQ ID NO: 630249 - RNA, 14 nt, Escherichia coli CFT073
cuucgcaaacaccc

SEQ ID NO: 630250 - RNA, 16 nt, Escherichia coli CFT073
cuucgaugguuggaau

SEQ ID NO: 630251 - RNA, 18 nt, Escherichia coli CFT073
cuucgaugguuggaauug

SEQ ID NO: 630252 - RNA, 13 nt, Escherichia coli CFT073
cuucgauccagug

SEQ ID NO: 630253 - RNA, 12 nt, Escherichia coli CFT073
cuuccucgccag

SEQ ID NO: 630254 - RNA, 12 nt, Escherichia coli CFT073
cuuccucgcucu

SEQ ID NO: 630255 - RNA, 18 nt, Escherichia coli CFT073
cuuccggccagcaugccu

SEQ ID NO: 630256 - RNA, 23 nt, Escherichia coli CFT073
cuuccggcaagcaaauuaauuac

SEQ ID NO: 630257 - RNA, 17 nt, Escherichia coli CFT073
cuuccggcacaucgccg

SEQ ID NO: 630258 - RNA, 19 nt, Escherichia coli CFT073
cuuccggaaccaccagauc

SEQ ID NO: 630259 - RNA, 22 nt, Escherichia coli CFT073
cuuccggaguaaugaaaccgaa

SEQ ID NO: 630260 - RNA, 16 nt, Escherichia coli CFT073
cuucgcggaauuucag

SEQ ID NO: 630261 - RNA, 15 nt, Escherichia coli CFT073
cuucgccugaaacag

SEQ ID NO: 630262 - RNA, 18 nt, Escherichia coli CFT073
cuucgccugaaacagaag

SEQ ID NO: 630263 - RNA, 17 nt, Escherichia coli CFT073
cuucgccggaauuucuu

SEQ ID NO: 630264 - RNA, 23 nt, Escherichia coli CFT073
cuucgccacuuuaugauccagcu

SEQ ID NO: 630265 - RNA, 22 nt, Escherichia coli CFT073
cuucgccagacguugauaacca

SEQ ID NO: 630266 - RNA, 13 nt, Escherichia coli CFT073
cuucgccagcgcg

SEQ ID NO: 630267 - RNA, 21 nt, Escherichia coli CFT073
cuucgccagguuuuggaauac

SEQ ID NO: 630268 - RNA, 14 nt, Escherichia coli CFT073
cuucgccaaugacc

SEQ ID NO: 630269 - RNA, 18 nt, Escherichia coli CFT073
cuucgccacagcggcauc

SEQ ID NO: 630270 - RNA, 14 nt, Escherichia coli CFT073
cuucgccaaaucgu

SEQ ID NO: 630271 - RNA, 22 nt, Escherichia coli CFT073
cuuccauucuccgcucuucauc

SEQ ID NO: 630272 - RNA, 23 nt, Escherichia coli CFT073
cuuccgcaaacaggcgcagaacu

SEQ ID NO: 630273 - RNA, 20 nt, Escherichia coli CFT073
cuuccgaccgcccuuuuucu

SEQ ID NO: 630274 - RNA, 23 nt, Escherichia coli CFT073
cuuccgccaccacgcccagcgac

SEQ ID NO: 630275 - RNA, 18 nt, Escherichia coli CFT073
cuuccgccaucaaucgac

SEQ ID NO: 630276 - RNA, 18 nt, Escherichia coli CFT073
cuuccgcgccaaacauuu

SEQ ID NO: 630277 - RNA, 13 nt, Escherichia coli CFT073
cuucauguugcag

SEQ ID NO: 630278 - RNA, 17 nt, Escherichia coli CFT073
cuucauuaccuucaaua

SEQ ID NO: 630279 - RNA, 15 nt, Escherichia coli CFT073
cuucauucaccaguu

SEQ ID NO: 630280 - RNA, 20 nt, Escherichia coli CFT073
cuucauucagaaaaacuaca

SEQ ID NO: 630281 - RNA, 19 nt, Escherichia coli CFT073
cuucauucagacaggcgaa

SEQ ID NO: 630282 - RNA, 12 nt, Escherichia coli CFT073
cuucauugcucu

SEQ ID NO: 630283 - RNA, 21 nt, Escherichia coli CFT073
cuucauuaucgauccuuacca

SEQ ID NO: 630284 - RNA, 22 nt, Escherichia coli CFT073
cuucauuaucgauccuuaccag

SEQ ID NO: 630285 - RNA, 13 nt, Escherichia coli CFT073
cuucauugcucuc

SEQ ID NO: 630286 - RNA, 20 nt, Escherichia coli CFT073
cuucauuugucucaaaacug

SEQ ID NO: 630287 - RNA, 22 nt, Escherichia coli CFT073
cuuccaguaaccagccguuaug

SEQ ID NO: 630288 - RNA, 20 nt, Escherichia coli CFT073
cuuccaguacgcgcaacccc

SEQ ID NO: 630289 - RNA, 19 nt, Escherichia coli CFT073
cuuccaguuugcucaaauc

SEQ ID NO: 630290 - RNA, 21 nt, Escherichia coli CFT073
cuuccaguugccgacgcuccu

SEQ ID NO: 630291 - RNA, 24 nt, Escherichia coli CFT073
cuuccaguugccgacgcuccugau

SEQ ID NO: 630292 - RNA, 23 nt, Escherichia coli CFT073
cuuccauacggcguuaacuuguu

SEQ ID NO: 630293 - RNA, 13 nt, Escherichia coli CFT073
cuuccaucacaaa

SEQ ID NO: 630294 - RNA, 23 nt, Escherichia coli CFT073
cuuccaucaccgccacuaucgcc

SEQ ID NO: 630295 - RNA, 18 nt, Escherichia coli CFT073
cuuucgauaagacauaac

SEQ ID NO: 630296 - RNA, 21 nt, Escherichia coli CFT073
cuuucgagcaauuuuccuuga

SEQ ID NO: 630297 - RNA, 22 nt, Escherichia coli CFT073
cuuucgauuucggcgugcgcgc

SEQ ID NO: 630298 - RNA, 16 nt, Escherichia coli CFT073
cuuucgccacaaagcu

SEQ ID NO: 630299 - RNA, 18 nt, Escherichia coli CFT073
cuuucgcccagcguugca

SEQ ID NO: 630300 - RNA, 15 nt, Escherichia coli CFT073
cuuucgcuucaacca

SEQ ID NO: 630301 - RNA, 13 nt, Escherichia coli CFT073
cuuucgcuugaca

SEQ ID NO: 630302 - RNA, 16 nt, Escherichia coli CFT073
cuuucgcuuucucuuc

SEQ ID NO: 630303 - RNA, 19 nt, Escherichia coli CFT073
cuuucuccggcagcuuuac

SEQ ID NO: 630304 - RNA, 14 nt, Escherichia coli CFT073
cuuucucuucaucu

SEQ ID NO: 630305 - RNA, 21 nt, Escherichia coli CFT073
cuuucucuucuaguucaugua

SEQ ID NO: 630306 - RNA, 14 nt, Escherichia coli CFT073
cuuucugaaggauu

SEQ ID NO: 630307 - RNA, 17 nt, Escherichia coli CFT073
cuuucaucuguuuucaa

SEQ ID NO: 630308 - RNA, 18 nt, Escherichia coli CFT073
cuuucaucuguuuucaau

SEQ ID NO: 630309 - RNA, 22 nt, Escherichia coli CFT073
cuuucaucuguuuucaaugucu

SEQ ID NO: 630310 - RNA, 14 nt, Escherichia coli CFT073
cuuucauacugccg

SEQ ID NO: 630311 - RNA, 20 nt, Escherichia coli CFT073
cuuucauaugauaggcuuca

SEQ ID NO: 630312 - RNA, 12 nt, Escherichia coli CFT073
cuuuccaguuca

SEQ ID NO: 630313 - RNA, 21 nt, Escherichia coli CFT073
cuuucccagcaggaucaauac

SEQ ID NO: 630314 - RNA, 17 nt, Escherichia coli CFT073
cuuuccauucuuuccca

SEQ ID NO: 630315 - RNA, 16 nt, Escherichia coli CFT073
cuuuccaucuuuccuc

SEQ ID NO: 630316 - RNA, 19 nt, Escherichia coli CFT073
cuuuccaugccaucugcca

SEQ ID NO: 630317 - RNA, 22 nt, Escherichia coli CFT073
cuuucccuucacucugcugcca

SEQ ID NO: 630318 - RNA, 16 nt, Escherichia coli CFT073
cuuucccggcaaucac

SEQ ID NO: 630319 - RNA, 17 nt, Escherichia coli CFT073
cuuucccggcaaucacc

SEQ ID NO: 630320 - RNA, 18 nt, Escherichia coli CFT073
cuuuccuaaacuccucgc

SEQ ID NO: 630321 - RNA, 20 nt, Escherichia coli CFT073
cuuuccuaaacuccucgccu

SEQ ID NO: 630322 - RNA, 16 nt, Escherichia coli CFT073
cuuuccggcagaagca

SEQ ID NO: 630323 - RNA, 16 nt, Escherichia coli CFT073
cuuuauucauaaucaa

SEQ ID NO: 630324 - RNA, 20 nt, Escherichia coli CFT073
cuuuauucaccaguaaggca

SEQ ID NO: 630325 - RNA, 18 nt, Escherichia coli CFT073
cuuuauccagcagccaga

SEQ ID NO: 630326 - RNA, 16 nt, Escherichia coli CFT073
cuuuauguaauccugu

SEQ ID NO: 630327 - RNA, 20 nt, Escherichia coli CFT073
cuuucacgccgggaaauuuu

SEQ ID NO: 630328 - RNA, 16 nt, Escherichia coli CFT073
cuuucaccucuucauu

SEQ ID NO: 630329 - RNA, 17 nt, Escherichia coli CFT073
cuuucaccucuucauua

SEQ ID NO: 630330 - RNA, 16 nt, Escherichia coli CFT073
cuuucacgcgcugacc

SEQ ID NO: 630331 - RNA, 18 nt, Escherichia coli CFT073
cuuucacucaguguugga

SEQ ID NO: 630332 - RNA, 13 nt, Escherichia coli CFT073
cuuucacuccauu

SEQ ID NO: 630333 - RNA, 22 nt, Escherichia coli CFT073
cuuucaguggcuuaucuuccug

SEQ ID NO: 630334 - RNA, 20 nt, Escherichia coli CFT073
cuuucacccggcgcuaauuc

SEQ ID NO: 630335 - RNA, 17 nt, Escherichia coli CFT073
cuuucaccagugggaaa

SEQ ID NO: 630336 - RNA, 22 nt, Escherichia coli CFT073
cuuucacccggaucaauuaauc

SEQ ID NO: 630337 - RNA, 13 nt, Escherichia coli CFT073
cuuucaccagauc

SEQ ID NO: 630338 - RNA, 23 nt, Escherichia coli CFT073
cuuucaccagcgccugcgcggca

SEQ ID NO: 630339 - RNA, 19 nt, Escherichia coli CFT073
cuuuauagugugcaaucac

SEQ ID NO: 630340 - RNA, 13 nt, Escherichia coli CFT073
cuuuaucaagcac

SEQ ID NO: 630341 - RNA, 17 nt, Escherichia coli CFT073
cuuuaucaagcaccaac

SEQ ID NO: 630342 - RNA, 19 nt, Escherichia coli CFT073
cuuuauaucugguuugcca

SEQ ID NO: 630343 - RNA, 23 nt, Escherichia coli CFT073
cuuuauagaacagagucugacca

SEQ ID NO: 630344 - RNA, 20 nt, Escherichia coli CFT073
cuuuaaugacugaacgugaa

SEQ ID NO: 630345 - RNA, 20 nt, Escherichia coli CFT073
cuuuaccgguuucaauccag

SEQ ID NO: 630346 - RNA, 16 nt, Escherichia coli CFT073
cuuuacccgcaccgga

SEQ ID NO: 630347 - RNA, 19 nt, Escherichia coli CFT073
cuuuacccggccacagaau

SEQ ID NO: 630348 - RNA, 18 nt, Escherichia coli CFT073
cuuguacucuacaaccag

SEQ ID NO: 630349 - RNA, 15 nt, Escherichia coli CFT073
cuuguaaaacagcca

SEQ ID NO: 630350 - RNA, 19 nt, Escherichia coli CFT073
cuuguaacgaguacaaaaa

SEQ ID NO: 630351 - RNA, 16 nt, Escherichia coli CFT073
cuugugcgcuuguuca

SEQ ID NO: 630352 - RNA, 16 nt, Escherichia coli CFT073
cuuguccugccauugu

SEQ ID NO: 630353 - RNA, 20 nt, Escherichia coli CFT073
cuuguggcgcaggggcagaa

SEQ ID NO: 630354 - RNA, 15 nt, Escherichia coli CFT073
cuuguggcucgccau

SEQ ID NO: 630355 - RNA, 20 nt, Escherichia coli CFT073
cuuuaaaaaaauuaauuuuu

SEQ ID NO: 630356 - RNA, 13 nt, Escherichia coli CFT073
cuuuaaaggccag

SEQ ID NO: 630357 - RNA, 14 nt, Escherichia coli CFT073
cuuuaaacacgauu

SEQ ID NO: 630358 - RNA, 18 nt, Escherichia coli CFT073
cuuuaauagauaauuuug

SEQ ID NO: 630359 - RNA, 15 nt, Escherichia coli CFT073
cuuuaauaacacgaa

SEQ ID NO: 630360 - RNA, 14 nt, Escherichia coli CFT073
cuuuaaauuauuug

SEQ ID NO: 630361 - RNA, 21 nt, Escherichia coli CFT073
cuuguucgauacaaaaacccg

SEQ ID NO: 630362 - RNA, 20 nt, Escherichia coli CFT073
cuuguucgcccugcagugcg

SEQ ID NO: 630363 - RNA, 17 nt, Escherichia coli CFT073
cuuguuggaucaugcuc

SEQ ID NO: 630364 - RNA, 14 nt, Escherichia coli CFT073
cuuguugaacagac

SEQ ID NO: 630365 - RNA, 15 nt, Escherichia coli CFT073
cuuguuugcccagaa

SEQ ID NO: 630366 - RNA, 19 nt, Escherichia coli CFT073
cuugcggaagcgucaaggu

SEQ ID NO: 630367 - RNA, 16 nt, Escherichia coli CFT073
cuugcggaucggcugg

SEQ ID NO: 630368 - RNA, 21 nt, Escherichia coli CFT073
cuugcucagauugcugacaac

SEQ ID NO: 630369 - RNA, 16 nt, Escherichia coli CFT073
cuugcucguuuucaau

SEQ ID NO: 630370 - RNA, 22 nt, Escherichia coli CFT073
cuugcucguuuucaauggcgcu

SEQ ID NO: 630371 - RNA, 17 nt, Escherichia coli CFT073
cuugcuccacgcucaga

SEQ ID NO: 630372 - RNA, 14 nt, Escherichia coli CFT073
cuugcucgaagagu

SEQ ID NO: 630373 - RNA, 19 nt, Escherichia coli CFT073
cuugcugauugcggucagc

SEQ ID NO: 630374 - RNA, 16 nt, Escherichia coli CFT073
cuugcugaugcacgca

SEQ ID NO: 630375 - RNA, 18 nt, Escherichia coli CFT073
cuugcaggaucagcuccg

SEQ ID NO: 630376 - RNA, 16 nt, Escherichia coli CFT073
cuugcagauaauuuug

SEQ ID NO: 630377 - RNA, 21 nt, Escherichia coli CFT073
cuugcagauaauuuugcaguc

SEQ ID NO: 630378 - RNA, 23 nt, Escherichia coli CFT073
cuugcagauaauuuugcaguccc

SEQ ID NO: 630379 - RNA, 18 nt, Escherichia coli CFT073
cuugcagucggcuuucuc

SEQ ID NO: 630380 - RNA, 19 nt, Escherichia coli CFT073
cuugccucccugcaaagaa

SEQ ID NO: 630381 - RNA, 23 nt, Escherichia coli CFT073
cuugccgucuucuucccagaccc

SEQ ID NO: 630382 - RNA, 20 nt, Escherichia coli CFT073
cuugcgcgcaaucagcaccg

SEQ ID NO: 630383 - RNA, 23 nt, Escherichia coli CFT073
cuugagggauucgacgcaaacaa

SEQ ID NO: 630384 - RNA, 22 nt, Escherichia coli CFT073
cuugcaccuuucgguagcaggg

SEQ ID NO: 630385 - RNA, 21 nt, Escherichia coli CFT073
cuugauuauuucccucguuuu

SEQ ID NO: 630386 - RNA, 13 nt, Escherichia coli CFT073
cuucuuucaucau

SEQ ID NO: 630387 - RNA, 12 nt, Escherichia coli CFT073
cuucuuuaauua

SEQ ID NO: 630388 - RNA, 23 nt, Escherichia coli CFT073
cuucuuuaguugagcuuuuuccg

SEQ ID NO: 630389 - RNA, 13 nt, Escherichia coli CFT073
cuucuuucagagu

SEQ ID NO: 630390 - RNA, 15 nt, Escherichia coli CFT073
cuugagccgccacca

SEQ ID NO: 630391 - RNA, 17 nt, Escherichia coli CFT073
cuugagccgccaccaga

SEQ ID NO: 630392 - RNA, 12 nt, Escherichia coli CFT073
cuucucugugac

SEQ ID NO: 630393 - RNA, 22 nt, Escherichia coli CFT073
cuucucgcucgagagagaaaau

SEQ ID NO: 630394 - RNA, 14 nt, Escherichia coli CFT073
cuucucgcacuucu

SEQ ID NO: 630395 - RNA, 22 nt, Escherichia coli CFT073
cuucucgcacuucugaugcagg

SEQ ID NO: 630396 - RNA, 14 nt, Escherichia coli CFT073
cuucuccggccuac

SEQ ID NO: 630397 - RNA, 17 nt, Escherichia coli CFT073
cuucuccggccuacaaa

SEQ ID NO: 630398 - RNA, 14 nt, Escherichia coli CFT073
cuucucuuccccgg

SEQ ID NO: 630399 - RNA, 21 nt, Escherichia coli CFT073
cuucucuugcuggauuucccu

SEQ ID NO: 630400 - RNA, 18 nt, Escherichia coli CFT073
cuucugaaucagaucaag

SEQ ID NO: 630401 - RNA, 16 nt, Escherichia coli CFT073
cuucugacauagccac

SEQ ID NO: 630402 - RNA, 21 nt, Escherichia coli CFT073
cuucugacauagccacucacc

SEQ ID NO: 630403 - RNA, 15 nt, Escherichia coli CFT073
cuucugaccgggauu

SEQ ID NO: 630404 - RNA, 17 nt, Escherichia coli CFT073
cuucugaucuacagccu

SEQ ID NO: 630405 - RNA, 17 nt, Escherichia coli CFT073
cuucugccaauuuuucg

SEQ ID NO: 630406 - RNA, 22 nt, Escherichia coli CFT073
cuucugccaauuuuucgcucuu

SEQ ID NO: 630407 - RNA, 14 nt, Escherichia coli CFT073
cuucugcugugacu

SEQ ID NO: 630408 - RNA, 17 nt, Escherichia coli CFT073
cuucugcugugacuuca

SEQ ID NO: 630409 - RNA, 13 nt, Escherichia coli CFT073
cuucugccgcuuc

SEQ ID NO: 630410 - RNA, 16 nt, Escherichia coli CFT073
cuucugccgcuuuaga

SEQ ID NO: 630411 - RNA, 17 nt, Escherichia coli CFT073
cuucuucacaaaucuua

SEQ ID NO: 630412 - RNA, 16 nt, Escherichia coli CFT073
cuucuuaggcauugcc

SEQ ID NO: 630413 - RNA, 22 nt, Escherichia coli CFT073
cuucuguuauauauuacccuuu

SEQ ID NO: 630414 - RNA, 17 nt, Escherichia coli CFT073
cuucuguuuuaucaauu

SEQ ID NO: 630415 - RNA, 15 nt, Escherichia coli CFT073
cuucugguaacagcg

SEQ ID NO: 630416 - RNA, 20 nt, Escherichia coli CFT073
cuucugguaacagcggacgg

SEQ ID NO: 630417 - RNA, 14 nt, Escherichia coli CFT073
cuucuggugaugca

SEQ ID NO: 630418 - RNA, 23 nt, Escherichia coli CFT073
cuucuggcggcggcaacgucacc

SEQ ID NO: 630419 - RNA, 18 nt, Escherichia coli CFT073
cuucugucacgcuggcau

SEQ ID NO: 630420 - RNA, 13 nt, Escherichia coli CFT073
cuucugucgcuuc

SEQ ID NO: 630421 - RNA, 22 nt, Escherichia coli CFT073
cuucugucgcuucacgcagguu

SEQ ID NO: 630422 - RNA, 15 nt, Escherichia coli CFT073
cuucuguaacuggaa

SEQ ID NO: 630423 - RNA, 14 nt, Escherichia coli CFT073
cuucuucuuaugca

SEQ ID NO: 630424 - RNA, 18 nt, Escherichia coli CFT073
cuucuugcagcuuaauca

SEQ ID NO: 630425 - RNA, 17 nt, Escherichia coli CFT073
cuucuugcgcaaaccug

SEQ ID NO: 630426 - RNA, 16 nt, Escherichia coli CFT073
cuucuugcguuuuuug

SEQ ID NO: 630427 - RNA, 15 nt, Escherichia coli CFT073
cuucuucuaucguuu

SEQ ID NO: 630428 - RNA, 10 nt, Escherichia coli CFT073
gaagaaaaac

SEQ ID NO: 630429 - RNA, 12 nt, Escherichia coli CFT073
gaagaaaaacug

SEQ ID NO: 630430 - RNA, 13 nt, Escherichia coli CFT073
gaagaaaaacugg

SEQ ID NO: 630431 - RNA, 14 nt, Escherichia coli CFT073
gaacuuuacugccu

SEQ ID NO: 630432 - RNA, 12 nt, Escherichia coli CFT073
gaacuuucucug

SEQ ID NO: 630433 - RNA, 14 nt, Escherichia coli CFT073
gaacuuuuucuuca

SEQ ID NO: 630434 - RNA, 16 nt, Escherichia coli CFT073
gaacuuuuucuucacc

SEQ ID NO: 630435 - RNA, 16 nt, Escherichia coli CFT073
gaacuucggcagagaa

SEQ ID NO: 630436 - RNA, 14 nt, Escherichia coli CFT073
gaagaagcuugcuu

SEQ ID NO: 630437 - RNA, 12 nt, Escherichia coli CFT073
gaagaaaucagu

SEQ ID NO: 630438 - RNA, 19 nt, Escherichia coli CFT073
gaagaaaaugguuugccag

SEQ ID NO: 630439 - RNA, 13 nt, Escherichia coli CFT073
gaagaaguaaaac

SEQ ID NO: 630440 - RNA, 18 nt, Escherichia coli CFT073
gaagacggccaucccagu

SEQ ID NO: 630441 - RNA, 14 nt, Escherichia coli CFT073
gaagacuuugcccu

SEQ ID NO: 630442 - RNA, 16 nt, Escherichia coli CFT073
gaagacugugauuguu

SEQ ID NO: 630443 - RNA, 21 nt, Escherichia coli CFT073
gaagcaacugguuaucacgaa

SEQ ID NO: 630444 - RNA, 16 nt, Escherichia coli CFT073
gaagcaaaauaaccgg

SEQ ID NO: 630445 - RNA, 15 nt, Escherichia coli CFT073
gaagcaaaccaggcc

SEQ ID NO: 630446 - RNA, 16 nt, Escherichia coli CFT073
gaagauuaagagaacc

SEQ ID NO: 630447 - RNA, 22 nt, Escherichia coli CFT073
gaagauucguauuuaaaaccgg

SEQ ID NO: 630448 - RNA, 21 nt, Escherichia coli CFT073
gaagcacuaccuugcuucuua

SEQ ID NO: 630449 - RNA, 16 nt, Escherichia coli CFT073
gaagcagcaucagcaa

SEQ ID NO: 630450 - RNA, 18 nt, Escherichia coli CFT073
gaagcaguuucaccagca

SEQ ID NO: 630451 - RNA, 14 nt, Escherichia coli CFT073
gaagcagcgcugga

SEQ ID NO: 630452 - RNA, 16 nt, Escherichia coli CFT073
gaagcagcgcuggaga

SEQ ID NO: 630453 - RNA, 15 nt, Escherichia coli CFT073
gaagcagcuccagaa

SEQ ID NO: 630454 - RNA, 23 nt, Escherichia coli CFT073
gaagaggccgccguaggagugcc

SEQ ID NO: 630455 - RNA, 15 nt, Escherichia coli CFT073
gaagagguguaauac

SEQ ID NO: 630456 - RNA, 15 nt, Escherichia coli CFT073
gaagagcggcucugg

SEQ ID NO: 630457 - RNA, 12 nt, Escherichia coli CFT073
gaagaggagagu

SEQ ID NO: 630458 - RNA, 18 nt, Escherichia coli CFT073
gaagaucaccacauucag

SEQ ID NO: 630459 - RNA, 13 nt, Escherichia coli CFT073
gaagaucaccacc

SEQ ID NO: 630460 - RNA, 15 nt, Escherichia coli CFT073
gaagaucaccaccga

SEQ ID NO: 630461 - RNA, 14 nt, Escherichia coli CFT073
gaagaucaugauga

SEQ ID NO: 630462 - RNA, 13 nt, Escherichia coli CFT073
gaagcgccaauac

SEQ ID NO: 630463 - RNA, 17 nt, Escherichia coli CFT073
gaagcgccaccagcgcc

SEQ ID NO: 630464 - RNA, 20 nt, Escherichia coli CFT073
gaagcgcagcgcaucaggca

SEQ ID NO: 630465 - RNA, 19 nt, Escherichia coli CFT073
gaagcgcgccguaugcgaa

SEQ ID NO: 630466 - RNA, 17 nt, Escherichia coli CFT073
gaagcggcacugcucuu

SEQ ID NO: 630467 - RNA, 15 nt, Escherichia coli CFT073
gaagcgaacaucgag

SEQ ID NO: 630468 - RNA, 21 nt, Escherichia coli CFT073
gaagccguuggucaucaucag

SEQ ID NO: 630469 - RNA, 18 nt, Escherichia coli CFT073
gaagccauuaaacaccag

SEQ ID NO: 630470 - RNA, 22 nt, Escherichia coli CFT073
gaagcccauuucaguauugagc

SEQ ID NO: 630471 - RNA, 15 nt, Escherichia coli CFT073
gaagccaccacgcca

SEQ ID NO: 630472 - RNA, 18 nt, Escherichia coli CFT073
gaagccaccacgccaaga

SEQ ID NO: 630473 - RNA, 13 nt, Escherichia coli CFT073
gaagcaugaguaa

SEQ ID NO: 630474 - RNA, 17 nt, Escherichia coli CFT073
gaagccgaacagucgcu

SEQ ID NO: 630475 - RNA, 19 nt, Escherichia coli CFT073
gaagccgcuccggcagcag

SEQ ID NO: 630476 - RNA, 22 nt, Escherichia coli CFT073
gaagccggaauauucuuccggc

SEQ ID NO: 630477 - RNA, 19 nt, Escherichia coli CFT073
gaaggaaccuguucaacaa

SEQ ID NO: 630478 - RNA, 22 nt, Escherichia coli CFT073
gaagcuuaucacagaggaagag

SEQ ID NO: 630479 - RNA, 16 nt, Escherichia coli CFT073
gaagcuugcuucuuug

SEQ ID NO: 630480 - RNA, 16 nt, Escherichia coli CFT073
gaaggauauaaaaaua

SEQ ID NO: 630481 - RNA, 16 nt, Escherichia coli CFT073
gaagcucucuuccagu

SEQ ID NO: 630482 - RNA, 15 nt, Escherichia coli CFT073
gaagcucauaugcag

SEQ ID NO: 630483 - RNA, 12 nt, Escherichia coli CFT073
gaagcguacugu

SEQ ID NO: 630484 - RNA, 15 nt, Escherichia coli CFT073
gaagcgggugcgcag

SEQ ID NO: 630485 - RNA, 21 nt, Escherichia coli CFT073
gaagcggguuucgagagcauc

SEQ ID NO: 630486 - RNA, 20 nt, Escherichia coli CFT073
gaagcggccgucagaucgcc

SEQ ID NO: 630487 - RNA, 14 nt, Escherichia coli CFT073
gaacugcaacucac

SEQ ID NO: 630488 - RNA, 23 nt, Escherichia coli CFT073
gaacugaugaacggugcgcaggc

SEQ ID NO: 630489 - RNA, 19 nt, Escherichia coli CFT073
gaacugcgguaauccgggu

SEQ ID NO: 630490 - RNA, 23 nt, Escherichia coli CFT073
gaacuucaggugacauuaaagcu

SEQ ID NO: 630491 - RNA, 20 nt, Escherichia coli CFT073
gaacucuuccgggaaaacau

SEQ ID NO: 630492 - RNA, 13 nt, Escherichia coli CFT073
gaacugaaaggca

SEQ ID NO: 630493 - RNA, 19 nt, Escherichia coli CFT073
gaacugacuuccacuuccu

SEQ ID NO: 630494 - RNA, 17 nt, Escherichia coli CFT073
gaacuccgaucccugcg

SEQ ID NO: 630495 - RNA, 18 nt, Escherichia coli CFT073
gaacucacagggcugcug

SEQ ID NO: 630496 - RNA, 22 nt, Escherichia coli CFT073
gaacucaggcugccagaucauc

SEQ ID NO: 630497 - RNA, 15 nt, Escherichia coli CFT073
gaacguucugcuguu

SEQ ID NO: 630498 - RNA, 15 nt, Escherichia coli CFT073
gaacguuuaaugccg

SEQ ID NO: 630499 - RNA, 15 nt, Escherichia coli CFT073
gaacgugucaacgcu

SEQ ID NO: 630500 - RNA, 16 nt, Escherichia coli CFT073
gaacgucugccuccca

SEQ ID NO: 630501 - RNA, 17 nt, Escherichia coli CFT073
gaacgugcaaaaucaaa

SEQ ID NO: 630502 - RNA, 18 nt, Escherichia coli CFT073
gaacuaacagcacaucga

SEQ ID NO: 630503 - RNA, 13 nt, Escherichia coli CFT073
gaacuacccgguu

SEQ ID NO: 630504 - RNA, 14 nt, Escherichia coli CFT073
gaacucacagggcu

SEQ ID NO: 630505 - RNA, 18 nt, Escherichia coli CFT073
gaacucaacgccuucuuc

SEQ ID NO: 630506 - RNA, 19 nt, Escherichia coli CFT073
gaacgcuuuugcaucggca

SEQ ID NO: 630507 - RNA, 22 nt, Escherichia coli CFT073
gaacggauagagcgcugcgcag

SEQ ID NO: 630508 - RNA, 20 nt, Escherichia coli CFT073
gaacgguaggccggauaagg

SEQ ID NO: 630509 - RNA, 20 nt, Escherichia coli CFT073
gaacggugcgaccaaacugc

SEQ ID NO: 630510 - RNA, 14 nt, Escherichia coli CFT073
gaaccuaagcaauu

SEQ ID NO: 630511 - RNA, 15 nt, Escherichia coli CFT073
gaaccgucacuguug

SEQ ID NO: 630512 - RNA, 12 nt, Escherichia coli CFT073
gaaccgugaccg

SEQ ID NO: 630513 - RNA, 15 nt, Escherichia coli CFT073
gaaccguaaacagau

SEQ ID NO: 630514 - RNA, 23 nt, Escherichia coli CFT073
gaaccucacagaggucuuuucuc

SEQ ID NO: 630515 - RNA, 20 nt, Escherichia coli CFT073
gaaccugacggcgcaacgca

SEQ ID NO: 630516 - RNA, 22 nt, Escherichia coli CFT073
gaacgagaaaagccaaccugca

SEQ ID NO: 630517 - RNA, 19 nt, Escherichia coli CFT073
gaaccuucgggcgcuucca

SEQ ID NO: 630518 - RNA, 18 nt, Escherichia coli CFT073
gaaccugugacagcagcg

SEQ ID NO: 630519 - RNA, 15 nt, Escherichia coli CFT073
gaaccuguuuucacc

SEQ ID NO: 630520 - RNA, 13 nt, Escherichia coli CFT073
gaacgccugugcg

SEQ ID NO: 630521 - RNA, 16 nt, Escherichia coli CFT073
gaacgccuuauccggc

SEQ ID NO: 630522 - RNA, 19 nt, Escherichia coli CFT073
gaacgaguugcgguuucaa

SEQ ID NO: 630523 - RNA, 14 nt, Escherichia coli CFT073
gaacgccaccaacg

SEQ ID NO: 630524 - RNA, 17 nt, Escherichia coli CFT073
gaacgccaaauucuuua

SEQ ID NO: 630525 - RNA, 19 nt, Escherichia coli CFT073
gaacccgcaguccugcagg

SEQ ID NO: 630526 - RNA, 18 nt, Escherichia coli CFT073
gaacccggguaggcugcu

SEQ ID NO: 630527 - RNA, 17 nt, Escherichia coli CFT073
gaacccguuggcacagg

SEQ ID NO: 630528 - RNA, 15 nt, Escherichia coli CFT073
gaaccgccccacccc

SEQ ID NO: 630529 - RNA, 23 nt, Escherichia coli CFT073
gaaccgggcggacuuucacuuca

SEQ ID NO: 630530 - RNA, 15 nt, Escherichia coli CFT073
gaaccgccuggcgcu

SEQ ID NO: 630531 - RNA, 22 nt, Escherichia coli CFT073
gaaccgccuggcgcugcucagg

SEQ ID NO: 630532 - RNA, 14 nt, Escherichia coli CFT073
gaaccggaaaucca

SEQ ID NO: 630533 - RNA, 19 nt, Escherichia coli CFT073
gaacccccugaaagcgaca

SEQ ID NO: 630534 - RNA, 22 nt, Escherichia coli CFT073
gaacccagcgcgauacgcagua

SEQ ID NO: 630535 - RNA, 13 nt, Escherichia coli CFT073
gaaccaucaccuc

SEQ ID NO: 630536 - RNA, 21 nt, Escherichia coli CFT073
gaaccagggaaaaaagccccg

SEQ ID NO: 630537 - RNA, 16 nt, Escherichia coli CFT073
gaaccagugaauacug

SEQ ID NO: 630538 - RNA, 18 nt, Escherichia coli CFT073
gaaccagugcuccaccuu

SEQ ID NO: 630539 - RNA, 13 nt, Escherichia coli CFT073
gaaccacagcgcc

SEQ ID NO: 630540 - RNA, 14 nt, Escherichia coli CFT073
gaaccacagcgccg

SEQ ID NO: 630541 - RNA, 21 nt, Escherichia coli CFT073
gaaccacggaaaggcaguuca

SEQ ID NO: 630542 - RNA, 23 nt, Escherichia coli CFT073
gaaccagaccgccuuugaucucu

SEQ ID NO: 630543 - RNA, 20 nt, Escherichia coli CFT073
gaauuaaucccuuaaaaccg

SEQ ID NO: 630544 - RNA, 14 nt, Escherichia coli CFT073
gaauuaaugccucu

SEQ ID NO: 630545 - RNA, 16 nt, Escherichia coli CFT073
gaauuaugcagccuuc

SEQ ID NO: 630546 - RNA, 21 nt, Escherichia coli CFT073
gaauuaugcagccuucauuca

SEQ ID NO: 630547 - RNA, 22 nt, Escherichia coli CFT073
gaauuaugcccaaugagcugaa

SEQ ID NO: 630548 - RNA, 20 nt, Escherichia coli CFT073
gaauuauucagaguauauau

SEQ ID NO: 630549 - RNA, 21 nt, Escherichia coli CFT073
gaauuauucagaguauauauu

SEQ ID NO: 630550 - RNA, 23 nt, Escherichia coli CFT073
gaauuauucagaguauauauucg

SEQ ID NO: 630551 - RNA, 23 nt, Escherichia coli CFT073
gaauucaacuaacugacuuucuu

SEQ ID NO: 630552 - RNA, 18 nt, Escherichia coli CFT073
gaauuccggcagagaaag

SEQ ID NO: 630553 - RNA, 18 nt, Escherichia coli CFT073
gaauuccgugccagcacc

SEQ ID NO: 630554 - RNA, 22 nt, Escherichia coli CFT073
gaauuguccagaucuuucgcca

SEQ ID NO: 630555 - RNA, 14 nt, Escherichia coli CFT073
gaauugugaugguu

SEQ ID NO: 630556 - RNA, 16 nt, Escherichia coli CFT073
gaauugcuuccaguaa

SEQ ID NO: 630557 - RNA, 20 nt, Escherichia coli CFT073
gaauugcuuccaguaacacu

SEQ ID NO: 630558 - RNA, 15 nt, Escherichia coli CFT073
gaauuggcgucagua

SEQ ID NO: 630559 - RNA, 19 nt, Escherichia coli CFT073
gaauuggcaucaggcuggu

SEQ ID NO: 630560 - RNA, 17 nt, Escherichia coli CFT073
gaauuggguucuuuccu

SEQ ID NO: 630561 - RNA, 23 nt, Escherichia coli CFT073
gaauuucagguucugaccagcca

SEQ ID NO: 630562 - RNA, 15 nt, Escherichia coli CFT073
gaauugaccaguaau

SEQ ID NO: 630563 - RNA, 20 nt, Escherichia coli CFT073
gaauugcaucuacgcucucu

SEQ ID NO: 630564 - RNA, 16 nt, Escherichia coli CFT073
gaauucugcagacugu

SEQ ID NO: 630565 - RNA, 18 nt, Escherichia coli CFT073
gaauggguucgauuucau

SEQ ID NO: 630566 - RNA, 18 nt, Escherichia coli CFT073
gaauggcugcacuuucag

SEQ ID NO: 630567 - RNA, 11 nt, Escherichia coli CFT073
gaauggcuggg

SEQ ID NO: 630568 - RNA, 21 nt, Escherichia coli CFT073
gaaugguaaucagcgacugcu

SEQ ID NO: 630569 - RNA, 23 nt, Escherichia coli CFT073
gaaugguaaucagcgacugcucc

SEQ ID NO: 630570 - RNA, 23 nt, Escherichia coli CFT073
gaauggugaaguuauuaaugaca

SEQ ID NO: 630571 - RNA, 16 nt, Escherichia coli CFT073
gaaugguuucacgcug

SEQ ID NO: 630572 - RNA, 12 nt, Escherichia coli CFT073
gaauuaaaauau

SEQ ID NO: 630573 - RNA, 23 nt, Escherichia coli CFT073
gaauuaaaauguguacuucucug

SEQ ID NO: 630574 - RNA, 22 nt, Escherichia coli CFT073
gaauuaacuuaucaagaaagcu

SEQ ID NO: 630575 - RNA, 14 nt, Escherichia coli CFT073
gaaugcaggcgcgc

SEQ ID NO: 630576 - RNA, 13 nt, Escherichia coli CFT073
gaaugcagcagca

SEQ ID NO: 630577 - RNA, 14 nt, Escherichia coli CFT073
gaaugccagcagca

SEQ ID NO: 630578 - RNA, 19 nt, Escherichia coli CFT073
gaaugcagucacgccagua

SEQ ID NO: 630579 - RNA, 18 nt, Escherichia coli CFT073
gaaugccgcgccccaucu

SEQ ID NO: 630580 - RNA, 18 nt, Escherichia coli CFT073
gaaugccggaaucagaau

SEQ ID NO: 630581 - RNA, 16 nt, Escherichia coli CFT073
gaaugccggauuucau

SEQ ID NO: 630582 - RNA, 17 nt, Escherichia coli CFT073
gaaugcgcuugcagacg

SEQ ID NO: 630583 - RNA, 19 nt, Escherichia coli CFT073
gaaugcucgcuggcaggcc

SEQ ID NO: 630584 - RNA, 13 nt, Escherichia coli CFT073
gaauggcaucuga

SEQ ID NO: 630585 - RNA, 15 nt, Escherichia coli CFT073
gaauggaaacagcac

SEQ ID NO: 630586 - RNA, 13 nt, Escherichia coli CFT073
gaaugaaguaaac

SEQ ID NO: 630587 - RNA, 13 nt, Escherichia coli CFT073
gaaugaagcagaa

SEQ ID NO: 630588 - RNA, 16 nt, Escherichia coli CFT073
gaaugaagcagaagcc

SEQ ID NO: 630589 - RNA, 19 nt, Escherichia coli CFT073
gaaucuucauagucucgcc

SEQ ID NO: 630590 - RNA, 17 nt, Escherichia coli CFT073
gaaucuuuagcggcgga

SEQ ID NO: 630591 - RNA, 15 nt, Escherichia coli CFT073
gaaugacgaucaacc

SEQ ID NO: 630592 - RNA, 19 nt, Escherichia coli CFT073
gaaugacggaucuuccagc

SEQ ID NO: 630593 - RNA, 19 nt, Escherichia coli CFT073
gaaugaggcacgacacaau

SEQ ID NO: 630594 - RNA, 21 nt, Escherichia coli CFT073
gaaugaugcggcgcuuucagc

SEQ ID NO: 630595 - RNA, 17 nt, Escherichia coli CFT073
gaaucgcguugccaguu

SEQ ID NO: 630596 - RNA, 13 nt, Escherichia coli CFT073
gaaucgccagcau

SEQ ID NO: 630597 - RNA, 18 nt, Escherichia coli CFT073
gaaucgccagcaucggca

SEQ ID NO: 630598 - RNA, 22 nt, Escherichia coli CFT073
gaaucggugcgcgauggucagu

SEQ ID NO: 630599 - RNA, 21 nt, Escherichia coli CFT073
gaaucucugcgcuauccagcg

SEQ ID NO: 630600 - RNA, 14 nt, Escherichia coli CFT073
gaaucucuuuuguu

SEQ ID NO: 630601 - RNA, 13 nt, Escherichia coli CFT073
gaaucucaggcaa

SEQ ID NO: 630602 - RNA, 14 nt, Escherichia coli CFT073
gaaucuaagauccc

SEQ ID NO: 630603 - RNA, 18 nt, Escherichia coli CFT073
gaaucggaucaaucccca

SEQ ID NO: 630604 - RNA, 20 nt, Escherichia coli CFT073
gaaucagcagauccaucgcc

SEQ ID NO: 630605 - RNA, 20 nt, Escherichia coli CFT073
gaaucaggcgauuagcgaua

SEQ ID NO: 630606 - RNA, 13 nt, Escherichia coli CFT073
gaaucauaggcuu

SEQ ID NO: 630607 - RNA, 20 nt, Escherichia coli CFT073
gaaucaucauaucgucauua

SEQ ID NO: 630608 - RNA, 20 nt, Escherichia coli CFT073
gaaucauccaggcuuuaaac

SEQ ID NO: 630609 - RNA, 16 nt, Escherichia coli CFT073
gaaucacuucaucgcc

SEQ ID NO: 630610 - RNA, 22 nt, Escherichia coli CFT073
gaaucagaauccggugccuuac

SEQ ID NO: 630611 - RNA, 22 nt, Escherichia coli CFT073
gaaucaccucuuuuucgacuuc

SEQ ID NO: 630612 - RNA, 14 nt, Escherichia coli CFT073
gaaucacgaggcac

SEQ ID NO: 630613 - RNA, 18 nt, Escherichia coli CFT073
gaaucacagcuauaccgc

SEQ ID NO: 630614 - RNA, 11 nt, Escherichia coli CFT073
gaaucaacaca

SEQ ID NO: 630615 - RNA, 13 nt, Escherichia coli CFT073
gaaucgcaaccag

SEQ ID NO: 630616 - RNA, 18 nt, Escherichia coli CFT073
gaaucgauaacugcucuc

SEQ ID NO: 630617 - RNA, 18 nt, Escherichia coli CFT073
gaauccuuuggacucauu

SEQ ID NO: 630618 - RNA, 19 nt, Escherichia coli CFT073
gaauccuucccccaccacc

SEQ ID NO: 630619 - RNA, 15 nt, Escherichia coli CFT073
gaauccuucccccac

SEQ ID NO: 630620 - RNA, 16 nt, Escherichia coli CFT073
gaauccggucccuucu

SEQ ID NO: 630621 - RNA, 21 nt, Escherichia coli CFT073
gaauccgcaccaacuccacuu

SEQ ID NO: 630622 - RNA, 23 nt, Escherichia coli CFT073
gaaucccuuccgcuuuuaacauc

SEQ ID NO: 630623 - RNA, 17 nt, Escherichia coli CFT073
gaauccgcaccaacucc

SEQ ID NO: 630624 - RNA, 21 nt, Escherichia coli CFT073
gaauccccaggagcuuacaua

SEQ ID NO: 630625 - RNA, 12 nt, Escherichia coli CFT073
gaauccagcgcg

SEQ ID NO: 630626 - RNA, 16 nt, Escherichia coli CFT073
gaauccacuggcuguu

SEQ ID NO: 630627 - RNA, 20 nt, Escherichia coli CFT073
gaauccacuggcuguuaucg

SEQ ID NO: 630628 - RNA, 19 nt, Escherichia coli CFT073
gaauccagcacgaagaggc

SEQ ID NO: 630629 - RNA, 14 nt, Escherichia coli CFT073
gaauccaggccaga

SEQ ID NO: 630630 - RNA, 15 nt, Escherichia coli CFT073
gaaguuuuccucagu

SEQ ID NO: 630631 - RNA, 13 nt, Escherichia coli CFT073
gaaguuuuuccag

SEQ ID NO: 630632 - RNA, 15 nt, Escherichia coli CFT073
gaauaaaaagcgaua

SEQ ID NO: 630633 - RNA, 19 nt, Escherichia coli CFT073
gaaguucguccccaccagu

SEQ ID NO: 630634 - RNA, 15 nt, Escherichia coli CFT073
gaaguggugauucag

SEQ ID NO: 630635 - RNA, 16 nt, Escherichia coli CFT073
gaagugauccgccgug

SEQ ID NO: 630636 - RNA, 15 nt, Escherichia coli CFT073
gaagugaugaaaaac

SEQ ID NO: 630637 - RNA, 18 nt, Escherichia coli CFT073
gaagucaccuuucagcca

SEQ ID NO: 630638 - RNA, 17 nt, Escherichia coli CFT073
gaagucgaacuucucuu

SEQ ID NO: 630639 - RNA, 22 nt, Escherichia coli CFT073
gaagucguuaguaaccacugug

SEQ ID NO: 630640 - RNA, 17 nt, Escherichia coli CFT073
gaagucgcugcugccug

SEQ ID NO: 630641 - RNA, 17 nt, Escherichia coli CFT073
gaaggcgcuuggcuucc

SEQ ID NO: 630642 - RNA, 22 nt, Escherichia coli CFT073
gaagggcuggccaauuggcugg

SEQ ID NO: 630643 - RNA, 24 nt, Escherichia coli CFT073
gaagguguugaaaugagaaaacua

SEQ ID NO: 630644 - RNA, 20 nt, Escherichia coli CFT073
gaaggugguuaccgccagca

SEQ ID NO: 630645 - RNA, 19 nt, Escherichia coli CFT073
gaagguugccauaucuucc

SEQ ID NO: 630646 - RNA, 14 nt, Escherichia coli CFT073
gaagguugccgggg

SEQ ID NO: 630647 - RNA, 15 nt, Escherichia coli CFT073
gaagguaccgcaaug

SEQ ID NO: 630648 - RNA, 19 nt, Escherichia coli CFT073
gaaguaugacgaguauauu

SEQ ID NO: 630649 - RNA, 21 nt, Escherichia coli CFT073
gaaguaugacgaguauauucu

SEQ ID NO: 630650 - RNA, 23 nt, Escherichia coli CFT073
gaaguagaucguacucaaucccu

SEQ ID NO: 630651 - RNA, 17 nt, Escherichia coli CFT073
gaaguaauaaucaacgc

SEQ ID NO: 630652 - RNA, 20 nt, Escherichia coli CFT073
gaaguacgcaguaaauaaaa

SEQ ID NO: 630653 - RNA, 23 nt, Escherichia coli CFT073
gaauaaucguaaucagcaucuca

SEQ ID NO: 630654 - RNA, 19 nt, Escherichia coli CFT073
gaauaaucguucccgcggc

SEQ ID NO: 630655 - RNA, 17 nt, Escherichia coli CFT073
gaauaaugcaaaaaggc

SEQ ID NO: 630656 - RNA, 12 nt, Escherichia coli CFT073
gaauaaugccuu

SEQ ID NO: 630657 - RNA, 21 nt, Escherichia coli CFT073
gaauaaugguauuaagccagu

SEQ ID NO: 630658 - RNA, 19 nt, Escherichia coli CFT073
gaauacacugcugauaauc

SEQ ID NO: 630659 - RNA, 12 nt, Escherichia coli CFT073
gaauacauucau

SEQ ID NO: 630660 - RNA, 14 nt, Escherichia coli CFT073
gaauaccugaaacu

SEQ ID NO: 630661 - RNA, 16 nt, Escherichia coli CFT073
gaauaccugagacaaa

SEQ ID NO: 630662 - RNA, 15 nt, Escherichia coli CFT073
gaauaccuucuuccu

SEQ ID NO: 630663 - RNA, 17 nt, Escherichia coli CFT073
gaauaccuugcugcucc

SEQ ID NO: 630664 - RNA, 13 nt, Escherichia coli CFT073
gaauacccagcaa

SEQ ID NO: 630665 - RNA, 14 nt, Escherichia coli CFT073
gaauacccagcaau

SEQ ID NO: 630666 - RNA, 23 nt, Escherichia coli CFT073
gaauaccccagcggcaaccagca

SEQ ID NO: 630667 - RNA, 18 nt, Escherichia coli CFT073
gaauaccguauucaacga

SEQ ID NO: 630668 - RNA, 21 nt, Escherichia coli CFT073
gaauacguugcaaauauucca

SEQ ID NO: 630669 - RNA, 17 nt, Escherichia coli CFT073
gaauaacgcggcaggag

SEQ ID NO: 630670 - RNA, 23 nt, Escherichia coli CFT073
gaauaacacccauaaaaaaaccc

SEQ ID NO: 630671 - RNA, 15 nt, Escherichia coli CFT073
gaauaagaauaugaa

SEQ ID NO: 630672 - RNA, 12 nt, Escherichia coli CFT073
gaauaagacagu

SEQ ID NO: 630673 - RNA, 14 nt, Escherichia coli CFT073
gaauaacuuccugu

SEQ ID NO: 630674 - RNA, 14 nt, Escherichia coli CFT073
gaauaauccccaca

SEQ ID NO: 630675 - RNA, 18 nt, Escherichia coli CFT073
gaauaauccccacaucag

SEQ ID NO: 630676 - RNA, 15 nt, Escherichia coli CFT073
gaauaauccgcccgg

SEQ ID NO: 630677 - RNA, 19 nt, Escherichia coli CFT073
gaauaaucugaaaaccagg

SEQ ID NO: 630678 - RNA, 19 nt, Escherichia coli CFT073
gaauagcuuuacccagguc

SEQ ID NO: 630679 - RNA, 20 nt, Escherichia coli CFT073
gaauagccuuuagcgagcga

SEQ ID NO: 630680 - RNA, 20 nt, Escherichia coli CFT073
gaauagcgaaccgguaugac

SEQ ID NO: 630681 - RNA, 16 nt, Escherichia coli CFT073
gaauagcgccacgcca

SEQ ID NO: 630682 - RNA, 17 nt, Escherichia coli CFT073
gaauagcucaguuggua

SEQ ID NO: 630683 - RNA, 14 nt, Escherichia coli CFT073
gaauagaacauaau

SEQ ID NO: 630684 - RNA, 17 nt, Escherichia coli CFT073
gaauagauuaugaaauu

SEQ ID NO: 630685 - RNA, 21 nt, Escherichia coli CFT073
gaauagaaccuaagaaccaga

SEQ ID NO: 630686 - RNA, 22 nt, Escherichia coli CFT073
gaauaugggaggaaaaguaauc

SEQ ID NO: 630687 - RNA, 13 nt, Escherichia coli CFT073
gaauauugcugaa

SEQ ID NO: 630688 - RNA, 18 nt, Escherichia coli CFT073
gaauauucuguucaugca

SEQ ID NO: 630689 - RNA, 22 nt, Escherichia coli CFT073
gaauauucuuccggcuucgugu

SEQ ID NO: 630690 - RNA, 23 nt, Escherichia coli CFT073
gaauaucguauccgguuuuccag

SEQ ID NO: 630691 - RNA, 20 nt, Escherichia coli CFT073
gaauaugaacaaagcaaaua

SEQ ID NO: 630692 - RNA, 21 nt, Escherichia coli CFT073
gaauaucauugccgguuggcg

SEQ ID NO: 630693 - RNA, 13 nt, Escherichia coli CFT073
gaauaucaccacu

SEQ ID NO: 630694 - RNA, 15 nt, Escherichia coli CFT073
gaauaucaccacuga

SEQ ID NO: 630695 - RNA, 13 nt, Escherichia coli CFT073
gaaccaaccgcaa

SEQ ID NO: 630696 - RNA, 15 nt, Escherichia coli CFT073
gaaccaaaguagaua

SEQ ID NO: 630697 - RNA, 19 nt, Escherichia coli CFT073
gaaccaaaguuugcaaacc

SEQ ID NO: 630698 - RNA, 16 nt, Escherichia coli CFT073
gaacauucggcaaugg

SEQ ID NO: 630699 - RNA, 16 nt, Escherichia coli CFT073
gaacauccccugcgcg

SEQ ID NO: 630700 - RNA, 15 nt, Escherichia coli CFT073
gaacaucacugcaaa

SEQ ID NO: 630701 - RNA, 15 nt, Escherichia coli CFT073
gaacaguaaagcgca

SEQ ID NO: 630702 - RNA, 16 nt, Escherichia coli CFT073
gaacaggucgaugcac

SEQ ID NO: 630703 - RNA, 17 nt, Escherichia coli CFT073
gaacagugccagacaaa

SEQ ID NO: 630704 - RNA, 16 nt, Escherichia coli CFT073
gaacauaaacacccac

SEQ ID NO: 630705 - RNA, 18 nt, Escherichia coli CFT073
gaacagcuuuuuccugcg

SEQ ID NO: 630706 - RNA, 18 nt, Escherichia coli CFT073
gaacagcgucgcaucagg

SEQ ID NO: 630707 - RNA, 13 nt, Escherichia coli CFT073
gaacagcaacuca

SEQ ID NO: 630708 - RNA, 23 nt, Escherichia coli CFT073
gaacagaaauggcuggcagcaga

SEQ ID NO: 630709 - RNA, 23 nt, Escherichia coli CFT073
gaacacuucuucuguuucugucg

SEQ ID NO: 630710 - RNA, 14 nt, Escherichia coli CFT073
gaacacgaccugcc

SEQ ID NO: 630711 - RNA, 15 nt, Escherichia coli CFT073
gaacacgcucccagc

SEQ ID NO: 630712 - RNA, 23 nt, Escherichia coli CFT073
gaacacgguaguuaaacuuucau

SEQ ID NO: 630713 - RNA, 13 nt, Escherichia coli CFT073
gaacaauuaauac

SEQ ID NO: 630714 - RNA, 18 nt, Escherichia coli CFT073
gaacaaucugguuuuugg

SEQ ID NO: 630715 - RNA, 19 nt, Escherichia coli CFT073
gaacaaguucgcuccagcc

SEQ ID NO: 630716 - RNA, 13 nt, Escherichia coli CFT073
gaacaagcaagag

SEQ ID NO: 630717 - RNA, 14 nt, Escherichia coli CFT073
gaacaagaaacaga

SEQ ID NO: 630718 - RNA, 13 nt, Escherichia coli CFT073
gaacaccauaaug

SEQ ID NO: 630719 - RNA, 13 nt, Escherichia coli CFT073
gaacacccagaau

SEQ ID NO: 630720 - RNA, 15 nt, Escherichia coli CFT073
gaacaccggcagcgg

SEQ ID NO: 630721 - RNA, 14 nt, Escherichia coli CFT073
gaacaauuucagca

SEQ ID NO: 630722 - RNA, 21 nt, Escherichia coli CFT073
gaacaauuucagcaauaauca

SEQ ID NO: 630723 - RNA, 19 nt, Escherichia coli CFT073
gaacacauaccuggucuga

SEQ ID NO: 630724 - RNA, 14 nt, Escherichia coli CFT073
gaacaccagcaccg

SEQ ID NO: 630725 - RNA, 12 nt, Escherichia coli CFT073
gaacaccagcag

SEQ ID NO: 630726 - RNA, 20 nt, Escherichia coli CFT073
gaaauguugaauugcagggu

SEQ ID NO: 630727 - RNA, 19 nt, Escherichia coli CFT073
gaaaugucaaacaguucac

SEQ ID NO: 630728 - RNA, 20 nt, Escherichia coli CFT073
gaaauuacgauguguggcau

SEQ ID NO: 630729 - RNA, 16 nt, Escherichia coli CFT073
gaaauuagcgucacca

SEQ ID NO: 630730 - RNA, 20 nt, Escherichia coli CFT073
gaaauuaagaucagaagcau

SEQ ID NO: 630731 - RNA, 18 nt, Escherichia coli CFT073
gaaauuccagcggcagga

SEQ ID NO: 630732 - RNA, 17 nt, Escherichia coli CFT073
gaaauucaccaccgcaa

SEQ ID NO: 630733 - RNA, 13 nt, Escherichia coli CFT073
gaaauuccugaga

SEQ ID NO: 630734 - RNA, 12 nt, Escherichia coli CFT073
gaacaaaacagc

SEQ ID NO: 630735 - RNA, 16 nt, Escherichia coli CFT073
gaacaaagcaaauaau

SEQ ID NO: 630736 - RNA, 19 nt, Escherichia coli CFT073
gaacaaaugaaagcagcag

SEQ ID NO: 630737 - RNA, 19 nt, Escherichia coli CFT073
gaacaaccaagacuauuaa

SEQ ID NO: 630738 - RNA, 15 nt, Escherichia coli CFT073
gaaauugcugccgcu

SEQ ID NO: 630739 - RNA, 14 nt, Escherichia coli CFT073
gaaaucgaucauca

SEQ ID NO: 630740 - RNA, 17 nt, Escherichia coli CFT073
gaaauccucaaccggug

SEQ ID NO: 630741 - RNA, 12 nt, Escherichia coli CFT073
gaaaucaccacc

SEQ ID NO: 630742 - RNA, 14 nt, Escherichia coli CFT073
gaaaucagcacaga

SEQ ID NO: 630743 - RNA, 23 nt, Escherichia coli CFT073
gaaaucagcacagagauaaaagg

SEQ ID NO: 630744 - RNA, 19 nt, Escherichia coli CFT073
gaaaucauucgcagcugca

SEQ ID NO: 630745 - RNA, 21 nt, Escherichia coli CFT073
gaaaucauucgcagcugcagu

SEQ ID NO: 630746 - RNA, 17 nt, Escherichia coli CFT073
gaaaucagcgagauaau

SEQ ID NO: 630747 - RNA, 21 nt, Escherichia coli CFT073
gaaaugagauauuucagagcu

SEQ ID NO: 630748 - RNA, 14 nt, Escherichia coli CFT073
gaaaugagaaaacu

SEQ ID NO: 630749 - RNA, 22 nt, Escherichia coli CFT073
gaaaugauguuugcgacaaacu

SEQ ID NO: 630750 - RNA, 14 nt, Escherichia coli CFT073
gaaaucuuccagug

SEQ ID NO: 630751 - RNA, 19 nt, Escherichia coli CFT073
gaaaugacgcuuuauucau

SEQ ID NO: 630752 - RNA, 22 nt, Escherichia coli CFT073
gaaaugaauaaucugaaaacca

SEQ ID NO: 630753 - RNA, 23 nt, Escherichia coli CFT073
gaaaugucauuacgaucaagaau

SEQ ID NO: 630754 - RNA, 15 nt, Escherichia coli CFT073
gaaauguaggguuac

SEQ ID NO: 630755 - RNA, 14 nt, Escherichia coli CFT073
gaaauguaaaaguu

SEQ ID NO: 630756 - RNA, 17 nt, Escherichia coli CFT073
gaaauguaaaaguugca

SEQ ID NO: 630757 - RNA, 10 nt, Escherichia coli CFT073
gaaauggcug

SEQ ID NO: 630758 - RNA, 13 nt, Escherichia coli CFT073
gaaauggcugguc

SEQ ID NO: 630759 - RNA, 15 nt, Escherichia coli CFT073
gaaauggcuggucag

SEQ ID NO: 630760 - RNA, 21 nt, Escherichia coli CFT073
gaaaugccaaauguauccauc

SEQ ID NO: 630761 - RNA, 14 nt, Escherichia coli CFT073
gaaagccgacugca

SEQ ID NO: 630762 - RNA, 22 nt, Escherichia coli CFT073
gaaagccgcuggcgcagcaggc

SEQ ID NO: 630763 - RNA, 16 nt, Escherichia coli CFT073
gaaagcgacagcgcac

SEQ ID NO: 630764 - RNA, 19 nt, Escherichia coli CFT073
gaaagcgucagcuuucaga

SEQ ID NO: 630765 - RNA, 20 nt, Escherichia coli CFT073
gaaagcguauccaucacuaa

SEQ ID NO: 630766 - RNA, 20 nt, Escherichia coli CFT073
gaaagcgcggcgacaauaau

SEQ ID NO: 630767 - RNA, 14 nt, Escherichia coli CFT073
gaaagcgccagcaa

SEQ ID NO: 630768 - RNA, 14 nt, Escherichia coli CFT073
gaaagcaguuuaua

SEQ ID NO: 630769 - RNA, 16 nt, Escherichia coli CFT073
gaaagcaguuuauaaa

SEQ ID NO: 630770 - RNA, 22 nt, Escherichia coli CFT073
gaaagcagauaacccagcagcc

SEQ ID NO: 630771 - RNA, 16 nt, Escherichia coli CFT073
gaaagcaccugcacag

SEQ ID NO: 630772 - RNA, 20 nt, Escherichia coli CFT073
gaaagcaccugcacaggcau

SEQ ID NO: 630773 - RNA, 20 nt, Escherichia coli CFT073
gaaagcaauuaacagugaca

SEQ ID NO: 630774 - RNA, 14 nt, Escherichia coli CFT073
gaaagauacaaaac

SEQ ID NO: 630775 - RNA, 21 nt, Escherichia coli CFT073
gaaagaucacaauguaaauca

SEQ ID NO: 630776 - RNA, 20 nt, Escherichia coli CFT073
gaaagcaaaaaagaaggaaa

SEQ ID NO: 630777 - RNA, 15 nt, Escherichia coli CFT073
gaaaggucaucauca

SEQ ID NO: 630778 - RNA, 12 nt, Escherichia coli CFT073
gaaaguaaauua

SEQ ID NO: 630779 - RNA, 16 nt, Escherichia coli CFT073
gaaaguaaauuauucu

SEQ ID NO: 630780 - RNA, 20 nt, Escherichia coli CFT073
gaaaguaaauuauucugaca

SEQ ID NO: 630781 - RNA, 14 nt, Escherichia coli CFT073
gaaagucgagugaa

SEQ ID NO: 630782 - RNA, 19 nt, Escherichia coli CFT073
gaaaguagcggaaccgcag

SEQ ID NO: 630783 - RNA, 20 nt, Escherichia coli CFT073
gaaaggaacaaucuugcaaa

SEQ ID NO: 630784 - RNA, 12 nt, Escherichia coli CFT073
gaaagggaagaa

SEQ ID NO: 630785 - RNA, 20 nt, Escherichia coli CFT073
gaaagggcgucgauauccac

SEQ ID NO: 630786 - RNA, 22 nt, Escherichia coli CFT073
gaaauaacuucuauucaccagc

SEQ ID NO: 630787 - RNA, 12 nt, Escherichia coli CFT073
gaaauaacaaau

SEQ ID NO: 630788 - RNA, 15 nt, Escherichia coli CFT073
gaaauaaaacaaaua

SEQ ID NO: 630789 - RNA, 12 nt, Escherichia coli CFT073
gaaauaaaauca

SEQ ID NO: 630790 - RNA, 19 nt, Escherichia coli CFT073
gaaaguuucaaaggugcca

SEQ ID NO: 630791 - RNA, 20 nt, Escherichia coli CFT073
gaaaguuucaaaggugccaa

SEQ ID NO: 630792 - RNA, 20 nt, Escherichia coli CFT073
gaaaguuaccgcgccauguu

SEQ ID NO: 630793 - RNA, 14 nt, Escherichia coli CFT073
gaaauauauucccc

SEQ ID NO: 630794 - RNA, 15 nt, Escherichia coli CFT073
gaaauagcggguuug

SEQ ID NO: 630795 - RNA, 15 nt, Escherichia coli CFT073
gaaauauacacgaaa

SEQ ID NO: 630796 - RNA, 16 nt, Escherichia coli CFT073
gaaauacuaaauauga

SEQ ID NO: 630797 - RNA, 17 nt, Escherichia coli CFT073
gaaauaccccgccagca

SEQ ID NO: 630798 - RNA, 18 nt, Escherichia coli CFT073
gaaauagccgaaaacgcu

SEQ ID NO: 630799 - RNA, 17 nt, Escherichia coli CFT073
gaaauagaccggagaaa

SEQ ID NO: 630800 - RNA, 21 nt, Escherichia coli CFT073
gaaacggguuagcguuugccc

SEQ ID NO: 630801 - RNA, 18 nt, Escherichia coli CFT073
gaaacgcucauaaauugc

SEQ ID NO: 630802 - RNA, 21 nt, Escherichia coli CFT073
gaaacgcucauaaauugcagc

SEQ ID NO: 630803 - RNA, 22 nt, Escherichia coli CFT073
gaaacgguuaaucuguugaaaa

SEQ ID NO: 630804 - RNA, 15 nt, Escherichia coli CFT073
gaaacucgaugacaa

SEQ ID NO: 630805 - RNA, 13 nt, Escherichia coli CFT073
gaaagaauauagg

SEQ ID NO: 630806 - RNA, 16 nt, Escherichia coli CFT073
gaaagacugaauugcc

SEQ ID NO: 630807 - RNA, 12 nt, Escherichia coli CFT073
gaaagagcaaug

SEQ ID NO: 630808 - RNA, 15 nt, Escherichia coli CFT073
gaaacuugguuacgc

SEQ ID NO: 630809 - RNA, 12 nt, Escherichia coli CFT073
gaaacuuauuca

SEQ ID NO: 630810 - RNA, 12 nt, Escherichia coli CFT073
gaaacuuccagc

SEQ ID NO: 630811 - RNA, 11 nt, Escherichia coli CFT073
gaaacuuucca

SEQ ID NO: 630812 - RNA, 24 nt, Escherichia coli CFT073
gaaacuuuccaugccaucugccag

SEQ ID NO: 630813 - RNA, 15 nt, Escherichia coli CFT073
gaaacugugauugug

SEQ ID NO: 630814 - RNA, 12 nt, Escherichia coli CFT073
gaaacuggaugg

SEQ ID NO: 630815 - RNA, 20 nt, Escherichia coli CFT073
gaaaccgucuucccgcagcc

SEQ ID NO: 630816 - RNA, 14 nt, Escherichia coli CFT073
gaaaccgagauaaa

SEQ ID NO: 630817 - RNA, 14 nt, Escherichia coli CFT073
gaaacgccugauga

SEQ ID NO: 630818 - RNA, 24 nt, Escherichia coli CFT073
gaaacgagccauaaaaucacaggu

SEQ ID NO: 630819 - RNA, 17 nt, Escherichia coli CFT073
gaaacgaaacccaaauc

SEQ ID NO: 630820 - RNA, 21 nt, Escherichia coli CFT073
gaaaccuuacgccauccccga

SEQ ID NO: 630821 - RNA, 16 nt, Escherichia coli CFT073
gaaaccugaauccacu

SEQ ID NO: 630822 - RNA, 17 nt, Escherichia coli CFT073
gaaaccuucagcaucga

SEQ ID NO: 630823 - RNA, 19 nt, Escherichia coli CFT073
gaaacagcaccauccgccc

SEQ ID NO: 630824 - RNA, 15 nt, Escherichia coli CFT073
gaaacaugaacauca

SEQ ID NO: 630825 - RNA, 22 nt, Escherichia coli CFT073
gaaacaucauccccaucgccgc

SEQ ID NO: 630826 - RNA, 23 nt, Escherichia coli CFT073
gaaacagguggcguuugccaccu

SEQ ID NO: 630827 - RNA, 13 nt, Escherichia coli CFT073
gaaacccaacgca

SEQ ID NO: 630828 - RNA, 17 nt, Escherichia coli CFT073
gaaaccauccagcagac

SEQ ID NO: 630829 - RNA, 20 nt, Escherichia coli CFT073
gaaaccauccagcagacgcu

SEQ ID NO: 630830 - RNA, 21 nt, Escherichia coli CFT073
gaaaccaaacuuaugcagcug

SEQ ID NO: 630831 - RNA, 19 nt, Escherichia coli CFT073
gaaaccacggugauucccg

SEQ ID NO: 630832 - RNA, 13 nt, Escherichia coli CFT073
gaaaccagcagcc

SEQ ID NO: 630833 - RNA, 11 nt, Escherichia coli CFT073
gaaaauugucu

SEQ ID NO: 630834 - RNA, 20 nt, Escherichia coli CFT073
gaaaaugguuugccagcaga

SEQ ID NO: 630835 - RNA, 18 nt, Escherichia coli CFT073
gaaaauuaacgggcaggu

SEQ ID NO: 630836 - RNA, 19 nt, Escherichia coli CFT073
gaaaauuacgaaagcaaaa

SEQ ID NO: 630837 - RNA, 20 nt, Escherichia coli CFT073
gaaaauuacgaaagcaaaau

SEQ ID NO: 630838 - RNA, 21 nt, Escherichia coli CFT073
gaaaauuuuuucagauaaaag

SEQ ID NO: 630839 - RNA, 23 nt, Escherichia coli CFT073
gaaacaaaucacuauuaaagaaa

SEQ ID NO: 630840 - RNA, 15 nt, Escherichia coli CFT073
gaaacacacuuucca

SEQ ID NO: 630841 - RNA, 16 nt, Escherichia coli CFT073
gaaacacacuuuccag

SEQ ID NO: 630842 - RNA, 22 nt, Escherichia coli CFT073
gaaaaucaugaauuuugaagga

SEQ ID NO: 630843 - RNA, 15 nt, Escherichia coli CFT073
gaaaaucauuuaucu

SEQ ID NO: 630844 - RNA, 16 nt, Escherichia coli CFT073
gaaaaucaccucauca

SEQ ID NO: 630845 - RNA, 21 nt, Escherichia coli CFT073
gaaaaucucaauguauucccg

SEQ ID NO: 630846 - RNA, 17 nt, Escherichia coli CFT073
gaaaaucgggcgacagc

SEQ ID NO: 630847 - RNA, 17 nt, Escherichia coli CFT073
gaaaauauugcuguaaa

SEQ ID NO: 630848 - RNA, 15 nt, Escherichia coli CFT073
gaaaaugcauucuua

SEQ ID NO: 630849 - RNA, 17 nt, Escherichia coli CFT073
gaaaaugccacugcgcc

SEQ ID NO: 630850 - RNA, 19 nt, Escherichia coli CFT073
gaaaaugcucgccuugcug

SEQ ID NO: 630851 - RNA, 18 nt, Escherichia coli CFT073
gaaaaugcuuuccagaga

SEQ ID NO: 630852 - RNA, 22 nt, Escherichia coli CFT073
gaaaaugcuuuccagagagaca

SEQ ID NO: 630853 - RNA, 24 nt, Escherichia coli CFT073
gaaaaugcuuuccagagagacauu

SEQ ID NO: 630854 - RNA, 13 nt, Escherichia coli CFT073
gaaaauggcgcuc

SEQ ID NO: 630855 - RNA, 22 nt, Escherichia coli CFT073
gaaaaucuucucucauccgcca

SEQ ID NO: 630856 - RNA, 14 nt, Escherichia coli CFT073
gaaaaucugcggga

SEQ ID NO: 630857 - RNA, 19 nt, Escherichia coli CFT073
gaaaagcgagaguuacagc

SEQ ID NO: 630858 - RNA, 18 nt, Escherichia coli CFT073
gaaaagcaguggcacuaa

SEQ ID NO: 630859 - RNA, 15 nt, Escherichia coli CFT073
gaaaagagaugaaug

SEQ ID NO: 630860 - RNA, 14 nt, Escherichia coli CFT073
gaaaagaccagcca

SEQ ID NO: 630861 - RNA, 23 nt, Escherichia coli CFT073
gaaaacucgucugauuucuuauu

SEQ ID NO: 630862 - RNA, 24 nt, Escherichia coli CFT073
gaaaacucgcuaaccacuguucug

SEQ ID NO: 630863 - RNA, 11 nt, Escherichia coli CFT073
gaaaacgcugu

SEQ ID NO: 630864 - RNA, 14 nt, Escherichia coli CFT073
gaaaauacucagca

SEQ ID NO: 630865 - RNA, 20 nt, Escherichia coli CFT073
gaaaauagacguucuucuuc

SEQ ID NO: 630866 - RNA, 12 nt, Escherichia coli CFT073
gaaaauaauccu

SEQ ID NO: 630867 - RNA, 18 nt, Escherichia coli CFT073
gaaaauaauccgcuguaa

SEQ ID NO: 630868 - RNA, 19 nt, Escherichia coli CFT073
gaaaauacagcaauggaaa

SEQ ID NO: 630869 - RNA, 17 nt, Escherichia coli CFT073
gaaaauaaaucaaaguc

SEQ ID NO: 630870 - RNA, 20 nt, Escherichia coli CFT073
gaaaauaacguaguguaaau

SEQ ID NO: 630871 - RNA, 22 nt, Escherichia coli CFT073
gaaaaguuuauuacucagcgca

SEQ ID NO: 630872 - RNA, 19 nt, Escherichia coli CFT073
gaaaagguaaggauaaaaa

SEQ ID NO: 630873 - RNA, 21 nt, Escherichia coli CFT073
gaaaagguaaggauaaaaaag

SEQ ID NO: 630874 - RNA, 22 nt, Escherichia coli CFT073
gaaaaggaguuuuuccuuucug

SEQ ID NO: 630875 - RNA, 14 nt, Escherichia coli CFT073
gaaaaaucaaaaac

SEQ ID NO: 630876 - RNA, 22 nt, Escherichia coli CFT073
gaaaaauaaaagcgugaaacaa

SEQ ID NO: 630877 - RNA, 23 nt, Escherichia coli CFT073
gaaaaaugaauaccaagucucaa

SEQ ID NO: 630878 - RNA, 15 nt, Escherichia coli CFT073
gaaaaaucuccagcg

SEQ ID NO: 630879 - RNA, 17 nt, Escherichia coli CFT073
gaaaaacggaaagcaac

SEQ ID NO: 630880 - RNA, 18 nt, Escherichia coli CFT073
gaaaaacgggucgccaga

SEQ ID NO: 630881 - RNA, 17 nt, Escherichia coli CFT073
gaaaaagcgcucccgca

SEQ ID NO: 630882 - RNA, 14 nt, Escherichia coli CFT073
gaaaaccauaauga

SEQ ID NO: 630883 - RNA, 15 nt, Escherichia coli CFT073
gaaaacgccaccaga

SEQ ID NO: 630884 - RNA, 14 nt, Escherichia coli CFT073
gaaaacgcccggca

SEQ ID NO: 630885 - RNA, 16 nt, Escherichia coli CFT073
gaaaacgccuuucagc

SEQ ID NO: 630886 - RNA, 21 nt, Escherichia coli CFT073
gaaaacgcuccaacgacaaca

SEQ ID NO: 630887 - RNA, 14 nt, Escherichia coli CFT073
gaaaaauucaaccu

SEQ ID NO: 630888 - RNA, 16 nt, Escherichia coli CFT073
cuuuuuucccaauaau

SEQ ID NO: 630889 - RNA, 20 nt, Escherichia coli CFT073
cuuuuuuguucuguaaucca

SEQ ID NO: 630890 - RNA, 15 nt, Escherichia coli CFT073
cuuuuuuauuucauc

SEQ ID NO: 630891 - RNA, 20 nt, Escherichia coli CFT073
cuuuuuuagguacaaagcca

SEQ ID NO: 630892 - RNA, 20 nt, Escherichia coli CFT073
cuuuuuuacgccugcaauuu

SEQ ID NO: 630893 - RNA, 17 nt, Escherichia coli CFT073
cuuuuuuaagauccagu

SEQ ID NO: 630894 - RNA, 20 nt, Escherichia coli CFT073
cuuuuuuucacuuucgccag

SEQ ID NO: 630895 - RNA, 19 nt, Escherichia coli CFT073
gaaaaaccguguuuaugaa

SEQ ID NO: 630896 - RNA, 15 nt, Escherichia coli CFT073
gaaaaaccugacgcu

SEQ ID NO: 630897 - RNA, 20 nt, Escherichia coli CFT073
gaaaaaccuuaaagcgaaac

SEQ ID NO: 630898 - RNA, 18 nt, Escherichia coli CFT073
gaaaaaccaaucucccag

SEQ ID NO: 630899 - RNA, 16 nt, Escherichia coli CFT073
gaaaaaauuuuaucca

SEQ ID NO: 630900 - RNA, 15 nt, Escherichia coli CFT073
cuuuuguuucccgau

SEQ ID NO: 630901 - RNA, 16 nt, Escherichia coli CFT073
cuuuuuaccguaacag

SEQ ID NO: 630902 - RNA, 13 nt, Escherichia coli CFT073
cuuuuuauaccgu

SEQ ID NO: 630903 - RNA, 15 nt, Escherichia coli CFT073
cuuuuuccugccgcu

SEQ ID NO: 630904 - RNA, 13 nt, Escherichia coli CFT073
cuuuuucaugcua

SEQ ID NO: 630905 - RNA, 21 nt, Escherichia coli CFT073
cuuuuucaugcuauuccuuga

SEQ ID NO: 630906 - RNA, 20 nt, Escherichia coli CFT073
cuuuuucgacuuccaccagc

SEQ ID NO: 630907 - RNA, 20 nt, Escherichia coli CFT073
cuuuuugaacgaguugcggu

SEQ ID NO: 630908 - RNA, 15 nt, Escherichia coli CFT073
cuuuuucggaaagcc

SEQ ID NO: 630909 - RNA, 21 nt, Escherichia coli CFT073
cuuuuucggaaagcccacccc

SEQ ID NO: 630910 - RNA, 15 nt, Escherichia coli CFT073
cuuuuucugaagacg

SEQ ID NO: 630911 - RNA, 21 nt, Escherichia coli CFT073
cuuuuugauaaguacauuaaa

SEQ ID NO: 630912 - RNA, 13 nt, Escherichia coli CFT073
cuuuuugcauaau

SEQ ID NO: 630913 - RNA, 17 nt, Escherichia coli CFT073
cuuuuugcauuuccgcu

SEQ ID NO: 630914 - RNA, 13 nt, Escherichia coli CFT073
cuuuugaaacugu

SEQ ID NO: 630915 - RNA, 18 nt, Escherichia coli CFT073
cuuuugauugucgauucu

SEQ ID NO: 630916 - RNA, 18 nt, Escherichia coli CFT073
cuuuugcaucuucagucg

SEQ ID NO: 630917 - RNA, 15 nt, Escherichia coli CFT073
cuuuugguuuuucaa

SEQ ID NO: 630918 - RNA, 20 nt, Escherichia coli CFT073
cuuuugcuaaggucaccagu

SEQ ID NO: 630919 - RNA, 20 nt, Escherichia coli CFT073
cuuuucgcauguaacugccu

SEQ ID NO: 630920 - RNA, 14 nt, Escherichia coli CFT073
cuuuucuccugcuu

SEQ ID NO: 630921 - RNA, 23 nt, Escherichia coli CFT073
cuuuuagcuguggugcaauccac

SEQ ID NO: 630922 - RNA, 19 nt, Escherichia coli CFT073
cuuuuaccugcuuaaucau

SEQ ID NO: 630923 - RNA, 16 nt, Escherichia coli CFT073
cuuuuauucauguuga

SEQ ID NO: 630924 - RNA, 17 nt, Escherichia coli CFT073
cuuuuauucauguugau

SEQ ID NO: 630925 - RNA, 14 nt, Escherichia coli CFT073
cuuuucaaacacuu

SEQ ID NO: 630926 - RNA, 16 nt, Escherichia coli CFT073
cuuuucaaacacuucu

SEQ ID NO: 630927 - RNA, 13 nt, Escherichia coli CFT073
cuuuucaccagcg

SEQ ID NO: 630928 - RNA, 12 nt, Escherichia coli CFT073
cuuuucaggccu

SEQ ID NO: 630929 - RNA, 17 nt, Escherichia coli CFT073
cuuuuccacucacacag

SEQ ID NO: 630930 - RNA, 13 nt, Escherichia coli CFT073
cuuuuccauauca

SEQ ID NO: 630931 - RNA, 15 nt, Escherichia coli CFT073
cuuuucccacuaacu

SEQ ID NO: 630932 - RNA, 16 nt, Escherichia coli CFT073
cuuucugagcaucaca

SEQ ID NO: 630933 - RNA, 16 nt, Escherichia coli CFT073
cuuucuugccacuggc

SEQ ID NO: 630934 - RNA, 18 nt, Escherichia coli CFT073
cuuucuugccacuggccu

SEQ ID NO: 630935 - RNA, 13 nt, Escherichia coli CFT073
cuuucuuuucccu

SEQ ID NO: 630936 - RNA, 15 nt, Escherichia coli CFT073
cuuucuuuucccugu

SEQ ID NO: 630937 - RNA, 14 nt, Escherichia coli CFT073
cuuucuugcgcccg

SEQ ID NO: 630938 - RNA, 23 nt, Escherichia coli CFT073
cuuucuuuuuguugcgcugaaac

SEQ ID NO: 630939 - RNA, 17 nt, Escherichia coli CFT073
cuuugugcgaucaggca

SEQ ID NO: 630940 - RNA, 15 nt, Escherichia coli CFT073
cuuugugcucuuccu

SEQ ID NO: 630941 - RNA, 18 nt, Escherichia coli CFT073
cuuugugucagugucaga

SEQ ID NO: 630942 - RNA, 18 nt, Escherichia coli CFT073
cuuuguuaaacagugccc

SEQ ID NO: 630943 - RNA, 19 nt, Escherichia coli CFT073
cuuuguuaaacagugccca

SEQ ID NO: 630944 - RNA, 21 nt, Escherichia coli CFT073
cuuuguuacccccauccacgc

SEQ ID NO: 630945 - RNA, 14 nt, Escherichia coli CFT073
cuuugucugcaauc

SEQ ID NO: 630946 - RNA, 20 nt, Escherichia coli CFT073
cuuugucugcaaucugauuc

SEQ ID NO: 630947 - RNA, 17 nt, Escherichia coli CFT073
cuuuguaggccugauaa

SEQ ID NO: 630948 - RNA, 21 nt, Escherichia coli CFT073
cuuuguaggccugauaagacg

SEQ ID NO: 630949 - RNA, 20 nt, Escherichia coli CFT073
cuuuguccagugcaacuuua

SEQ ID NO: 630950 - RNA, 13 nt, Escherichia coli CFT073
cuuuuaaaucauc

SEQ ID NO: 630951 - RNA, 19 nt, Escherichia coli CFT073
cuuuuaaaccuuguuuaau

SEQ ID NO: 630952 - RNA, 13 nt, Escherichia coli CFT073
cuuuuaaaugcac

SEQ ID NO: 630953 - RNA, 17 nt, Escherichia coli CFT073
cuuuuaaaugcacagga

SEQ ID NO: 630954 - RNA, 21 nt, Escherichia coli CFT073
cuuuuaaaugcccgacaaaaa

SEQ ID NO: 630955 - RNA, 22 nt, Escherichia coli CFT073
cuuuuaaaugcccgacaaaaau

SEQ ID NO: 630956 - RNA, 20 nt, Escherichia coli CFT073
cuuuuaaccggcgaccaaga

SEQ ID NO: 630957 - RNA, 20 nt, Escherichia coli CFT073
cuuuuaacacguugcaacug

SEQ ID NO: 630958 - RNA, 15 nt, Escherichia coli CFT073
cuuuguuuccccugg

SEQ ID NO: 630959 - RNA, 14 nt, Escherichia coli CFT073
aaaaaaagaacaac

SEQ ID NO: 630960 - RNA, 17 nt, Escherichia coli CFT073
aaaaaaccagaaaggga

SEQ ID NO: 630961 - RNA, 12 nt, Escherichia coli CFT073
aaaaaauuaauu

SEQ ID NO: 630962 - RNA, 17 nt, Escherichia coli CFT073
aaaaacaaagaaugcca

SEQ ID NO: 630963 - RNA, 15 nt, Escherichia coli CFT073
aaaaaagaaaugccu

SEQ ID NO: 630964 - RNA, 13 nt, Escherichia coli CFT073
aaaaaagaaggaa

SEQ ID NO: 630965 - RNA, 20 nt, Escherichia coli CFT073
aaaaaagccaccaaccacaa

SEQ ID NO: 630966 - RNA, 18 nt, Escherichia coli CFT073
aaaaaagcaagauuaaaa

SEQ ID NO: 630967 - RNA, 16 nt, Escherichia coli CFT073
aaaaaggggaaaaauu

SEQ ID NO: 630968 - RNA, 17 nt, Escherichia coli CFT073
aaaaaguaguuccagca

SEQ ID NO: 630969 - RNA, 22 nt, Escherichia coli CFT073
aaaaagcggcgaguguguggaa

SEQ ID NO: 630970 - RNA, 20 nt, Escherichia coli CFT073
aaaaagcuugucauuaccac

SEQ ID NO: 630971 - RNA, 10 nt, Escherichia coli CFT073
aaaaagcuca

SEQ ID NO: 630972 - RNA, 20 nt, Escherichia coli CFT073
aaaaagcgucucgccagagu

SEQ ID NO: 630973 - RNA, 22 nt, Escherichia coli CFT073
aaaaagcgucgccgucaaaagg

SEQ ID NO: 630974 - RNA, 18 nt, Escherichia coli CFT073
aaaaagaaggaaaauaca

SEQ ID NO: 630975 - RNA, 19 nt, Escherichia coli CFT073
aaaaagccaauuacaaaaa

SEQ ID NO: 630976 - RNA, 19 nt, Escherichia coli CFT073
aaaaagcaagauuaaaaua

SEQ ID NO: 630977 - RNA, 13 nt, Escherichia coli CFT073
aaaaagaaggaaa

SEQ ID NO: 630978 - RNA, 23 nt, Escherichia coli CFT073
aaaaacggcaacggcguuaagca

SEQ ID NO: 630979 - RNA, 19 nt, Escherichia coli CFT073
aaaaacucaaaaaaaauuu

SEQ ID NO: 630980 - RNA, 17 nt, Escherichia coli CFT073
aaaaacccaucaaccuu

SEQ ID NO: 630981 - RNA, 17 nt, Escherichia coli CFT073
aaaaacggaaagcagau

SEQ ID NO: 630982 - RNA, 21 nt, Escherichia coli CFT073
aaaaaccugucuggauuuacu

SEQ ID NO: 630983 - RNA, 13 nt, Escherichia coli CFT073
aaaaaccugaccu

SEQ ID NO: 630984 - RNA, 19 nt, Escherichia coli CFT073
aaaaacgaaaguuaaucca

SEQ ID NO: 630985 - RNA, 16 nt, Escherichia coli CFT073
aaaaacgaacauuauu

SEQ ID NO: 630986 - RNA, 17 nt, Escherichia coli CFT073
aaaaacacaaaguaaac

SEQ ID NO: 630987 - RNA, 14 nt, Escherichia coli CFT073
aaaaacggaaagca

SEQ ID NO: 630988 - RNA, 13 nt, Escherichia coli CFT073
aaaaacggaauuu

SEQ ID NO: 630989 - RNA, 12 nt, Escherichia coli CFT073
aaaaacccugcc

SEQ ID NO: 630990 - RNA, 22 nt, Escherichia coli CFT073
aaaaaccuaauacucuggcugg

SEQ ID NO: 630991 - RNA, 19 nt, Escherichia coli CFT073
aaaaacucauuuuauaucu

SEQ ID NO: 630992 - RNA, 13 nt, Escherichia coli CFT073
aaaaacucaaaaa

SEQ ID NO: 630993 - RNA, 22 nt, Escherichia coli CFT073
aaaaaugcugcaaucauugcuu

SEQ ID NO: 630994 - RNA, 12 nt, Escherichia coli CFT073
aaaaaugcagca

SEQ ID NO: 630995 - RNA, 17 nt, Escherichia coli CFT073
aaaaauggagagaacca

SEQ ID NO: 630996 - RNA, 13 nt, Escherichia coli CFT073
aaaaaugguuugc

SEQ ID NO: 630997 - RNA, 21 nt, Escherichia coli CFT073
aaaaauugcgcaacuuuuucu

SEQ ID NO: 630998 - RNA, 21 nt, Escherichia coli CFT073
aaaaccugaccuagcaaacua

SEQ ID NO: 630999 - RNA, 14 nt, Escherichia coli CFT073
aaaaccugucugga

SEQ ID NO: 631000 - RNA, 14 nt, Escherichia coli CFT073
aaaacccaucaacc

SEQ ID NO: 631001 - RNA, 17 nt, Escherichia coli CFT073
aaaacccgcugauuaag

SEQ ID NO: 631002 - RNA, 15 nt, Escherichia coli CFT073
aaaaccgacuuaaaa

SEQ ID NO: 631003 - RNA, 13 nt, Escherichia coli CFT073
aaaaccgaggagc

SEQ ID NO: 631004 - RNA, 11 nt, Escherichia coli CFT073
aaaacagccaa

SEQ ID NO: 631005 - RNA, 13 nt, Escherichia coli CFT073
aaaacagccagca

SEQ ID NO: 631006 - RNA, 20 nt, Escherichia coli CFT073
aaaacagcgcccaacacuuc

SEQ ID NO: 631007 - RNA, 13 nt, Escherichia coli CFT073
aaaacaaaaaccg

SEQ ID NO: 631008 - RNA, 21 nt, Escherichia coli CFT073
aaaacauaucccaccagcgcc

SEQ ID NO: 631009 - RNA, 14 nt, Escherichia coli CFT073
aaaacaguaccaga

SEQ ID NO: 631010 - RNA, 12 nt, Escherichia coli CFT073
aaacaugcagcc

SEQ ID NO: 631011 - RNA, 16 nt, Escherichia coli CFT073
aaacaucuuccacaug

SEQ ID NO: 631012 - RNA, 16 nt, Escherichia coli CFT073
aaacaucauaauaauu

SEQ ID NO: 631013 - RNA, 19 nt, Escherichia coli CFT073
aaaccaauggucgugguaa

SEQ ID NO: 631014 - RNA, 20 nt, Escherichia coli CFT073
aaaccacauggagcuuuaaa

SEQ ID NO: 631015 - RNA, 23 nt, Escherichia coli CFT073
aaaccacccgcggcgaucugcac

SEQ ID NO: 631016 - RNA, 18 nt, Escherichia coli CFT073
aaaccacuuaacguuacc

SEQ ID NO: 631017 - RNA, 16 nt, Escherichia coli CFT073
aaacccggccacagcg

SEQ ID NO: 631018 - RNA, 20 nt, Escherichia coli CFT073
aaacccgcgaugaccaaaaa

SEQ ID NO: 631019 - RNA, 23 nt, Escherichia coli CFT073
aaacccgcgaugaccaaaaacgu

SEQ ID NO: 631020 - RNA, 11 nt, Escherichia coli CFT073
aaacccgcuca

SEQ ID NO: 631021 - RNA, 14 nt, Escherichia coli CFT073
aaacccaggcuuaa

SEQ ID NO: 631022 - RNA, 11 nt, Escherichia coli CFT073
aaacccagccg

SEQ ID NO: 631023 - RNA, 19 nt, Escherichia coli CFT073
aaaccauuaccaaucugcu

SEQ ID NO: 631024 - RNA, 20 nt, Escherichia coli CFT073
aaaccaucaccuaaagcuau

SEQ ID NO: 631025 - RNA, 16 nt, Escherichia coli CFT073
aaaccauauuaaaugg

SEQ ID NO: 631026 - RNA, 16 nt, Escherichia coli CFT073
aaaccaucaauccacu

SEQ ID NO: 631027 - RNA, 13 nt, Escherichia coli CFT073
aaaccaucccugg

SEQ ID NO: 631028 - RNA, 21 nt, Escherichia coli CFT073
aaaccagaaagggaagaacau

SEQ ID NO: 631029 - RNA, 15 nt, Escherichia coli CFT073
aaaccagagaauauu

SEQ ID NO: 631030 - RNA, 22 nt, Escherichia coli CFT073
aaaccagauaauaaaaaaggca

SEQ ID NO: 631031 - RNA, 14 nt, Escherichia coli CFT073
aaaccagccgccaa

SEQ ID NO: 631032 - RNA, 19 nt, Escherichia coli CFT073
aaaccagccgccaacucca

SEQ ID NO: 631033 - RNA, 19 nt, Escherichia coli CFT073
aaaccagcgcauggcggua

SEQ ID NO: 631034 - RNA, 13 nt, Escherichia coli CFT073
aaaccgacugccu

SEQ ID NO: 631035 - RNA, 16 nt, Escherichia coli CFT073
aaaccgagauaaaugc

SEQ ID NO: 631036 - RNA, 18 nt, Escherichia coli CFT073
aaaccgagauaaaugcca

SEQ ID NO: 631037 - RNA, 20 nt, Escherichia coli CFT073
aaaccgaugccgugcggcug

SEQ ID NO: 631038 - RNA, 13 nt, Escherichia coli CFT073
aaaccgcacucac

SEQ ID NO: 631039 - RNA, 15 nt, Escherichia coli CFT073
aaacccuuucugcug

SEQ ID NO: 631040 - RNA, 19 nt, Escherichia coli CFT073
aaaccgccgacgcgaagca

SEQ ID NO: 631041 - RNA, 20 nt, Escherichia coli CFT073
aaaccgcgccaugucugcau

SEQ ID NO: 631042 - RNA, 18 nt, Escherichia coli CFT073
aaaccgcucucauccauu

SEQ ID NO: 631043 - RNA, 21 nt, Escherichia coli CFT073
aaacagugcccauacccgaug

SEQ ID NO: 631044 - RNA, 11 nt, Escherichia coli CFT073
aaacaguaagu

SEQ ID NO: 631045 - RNA, 15 nt, Escherichia coli CFT073
aaacaguucugcagc

SEQ ID NO: 631046 - RNA, 11 nt, Escherichia coli CFT073
aaacauacaca

SEQ ID NO: 631047 - RNA, 20 nt, Escherichia coli CFT073
aaacauacccacgaaaucuu

SEQ ID NO: 631048 - RNA, 19 nt, Escherichia coli CFT073
aaacaucaccaaugacagc

SEQ ID NO: 631049 - RNA, 19 nt, Escherichia coli CFT073
aaacauaucacuuuuauau

SEQ ID NO: 631050 - RNA, 17 nt, Escherichia coli CFT073
aaacagcacaucuccca

SEQ ID NO: 631051 - RNA, 23 nt, Escherichia coli CFT073
aaacagagcugcaaaaguaccau

SEQ ID NO: 631052 - RNA, 13 nt, Escherichia coli CFT073
aaacagaguagaa

SEQ ID NO: 631053 - RNA, 17 nt, Escherichia coli CFT073
aaacagaguagaaauau

SEQ ID NO: 631054 - RNA, 16 nt, Escherichia coli CFT073
aaacagaaaaaaaaca

SEQ ID NO: 631055 - RNA, 16 nt, Escherichia coli CFT073
aaacagaauggcaucu

SEQ ID NO: 631056 - RNA, 23 nt, Escherichia coli CFT073
aaacagccuuguauuaauaccag

SEQ ID NO: 631057 - RNA, 14 nt, Escherichia coli CFT073
aaacagccagcagc

SEQ ID NO: 631058 - RNA, 15 nt, Escherichia coli CFT073
aaacagcagauggca

SEQ ID NO: 631059 - RNA, 21 nt, Escherichia coli CFT073
aaacagcgccugcaaaauaau

SEQ ID NO: 631060 - RNA, 17 nt, Escherichia coli CFT073
aaacagcguaaugccaa

SEQ ID NO: 631061 - RNA, 16 nt, Escherichia coli CFT073
aaacagcguauaaacc

SEQ ID NO: 631062 - RNA, 12 nt, Escherichia coli CFT073
aaacaauaauug

SEQ ID NO: 631063 - RNA, 13 nt, Escherichia coli CFT073
aaacaauacgauc

SEQ ID NO: 631064 - RNA, 17 nt, Escherichia coli CFT073
aaacaauggcauaaccg

SEQ ID NO: 631065 - RNA, 17 nt, Escherichia coli CFT073
aaaauugccuguugcgc

SEQ ID NO: 631066 - RNA, 19 nt, Escherichia coli CFT073
aaaauuguaguguugcagu

SEQ ID NO: 631067 - RNA, 13 nt, Escherichia coli CFT073
aaacaccgaaccg

SEQ ID NO: 631068 - RNA, 22 nt, Escherichia coli CFT073
aaacaccgcuguugccagcagc

SEQ ID NO: 631069 - RNA, 24 nt, Escherichia coli CFT073
aaacaccgcuguugccagcagcaa

SEQ ID NO: 631070 - RNA, 13 nt, Escherichia coli CFT073
aaacaccaggcua

SEQ ID NO: 631071 - RNA, 23 nt, Escherichia coli CFT073
aaacacccaucgccguaccuuug

SEQ ID NO: 631072 - RNA, 19 nt, Escherichia coli CFT073
aaacacgaucuucugccaa

SEQ ID NO: 631073 - RNA, 17 nt, Escherichia coli CFT073
aaacaccguaccaucau

SEQ ID NO: 631074 - RNA, 23 nt, Escherichia coli CFT073
aaacacugagguaacucucaugc

SEQ ID NO: 631075 - RNA, 21 nt, Escherichia coli CFT073
aaacacugcuuuuaaaugccc

SEQ ID NO: 631076 - RNA, 14 nt, Escherichia coli CFT073
aaacacaucaguga

SEQ ID NO: 631077 - RNA, 15 nt, Escherichia coli CFT073
aaacacaucagugau

SEQ ID NO: 631078 - RNA, 12 nt, Escherichia coli CFT073
aaacaccagcaa

SEQ ID NO: 631079 - RNA, 13 nt, Escherichia coli CFT073
aaacaccagcagc

SEQ ID NO: 631080 - RNA, 14 nt, Escherichia coli CFT073
aaacaccagcagca

SEQ ID NO: 631081 - RNA, 13 nt, Escherichia coli CFT073
aaacaccagcagu

SEQ ID NO: 631082 - RNA, 22 nt, Escherichia coli CFT073
aaaagcuugucauuaccacaac

SEQ ID NO: 631083 - RNA, 22 nt, Escherichia coli CFT073
aaaagcuguaaggugaaagcaa

SEQ ID NO: 631084 - RNA, 15 nt, Escherichia coli CFT073
aaaaagaaggaaaau

SEQ ID NO: 631085 - RNA, 11 nt, Escherichia coli CFT073
aaaacgccugc

SEQ ID NO: 631086 - RNA, 13 nt, Escherichia coli CFT073
aaaacgccugcuc

SEQ ID NO: 631087 - RNA, 16 nt, Escherichia coli CFT073
aaaacgcgcgcgaaua

SEQ ID NO: 631088 - RNA, 18 nt, Escherichia coli CFT073
aaaacgcgcucacugcac

SEQ ID NO: 631089 - RNA, 16 nt, Escherichia coli CFT073
aaaacggaaagcaaca

SEQ ID NO: 631090 - RNA, 19 nt, Escherichia coli CFT073
aaaacgcccaaugcccaga

SEQ ID NO: 631091 - RNA, 22 nt, Escherichia coli CFT073
aaaacgccggagagaaaaaucu

SEQ ID NO: 631092 - RNA, 14 nt, Escherichia coli CFT073
aaaacgaaugacug

SEQ ID NO: 631093 - RNA, 14 nt, Escherichia coli CFT073
aaaagggaacccga

SEQ ID NO: 631094 - RNA, 17 nt, Escherichia coli CFT073
aaaaggucgccugucuu

SEQ ID NO: 631095 - RNA, 14 nt, Escherichia coli CFT073
aaaaggugauuuau

SEQ ID NO: 631096 - RNA, 18 nt, Escherichia coli CFT073
aaaaggugccacagcagu

SEQ ID NO: 631097 - RNA, 14 nt, Escherichia coli CFT073
aaaagggcagcagg

SEQ ID NO: 631098 - RNA, 15 nt, Escherichia coli CFT073
aaaauacaaacgcca

SEQ ID NO: 631099 - RNA, 22 nt, Escherichia coli CFT073
aaaauacaaacgccauaaacuu

SEQ ID NO: 631100 - RNA, 13 nt, Escherichia coli CFT073
aaaauaacguagu

SEQ ID NO: 631101 - RNA, 17 nt, Escherichia coli CFT073
aaaauaaccggcaagca

SEQ ID NO: 631102 - RNA, 14 nt, Escherichia coli CFT073
aaaauaaccgucuu

SEQ ID NO: 631103 - RNA, 13 nt, Escherichia coli CFT073
aaaaguugcaguc

SEQ ID NO: 631104 - RNA, 20 nt, Escherichia coli CFT073
aaaaguuuauuacucagcgc

SEQ ID NO: 631105 - RNA, 13 nt, Escherichia coli CFT073
aaaauacaggaaa

SEQ ID NO: 631106 - RNA, 15 nt, Escherichia coli CFT073
aaaauacacaauccg

SEQ ID NO: 631107 - RNA, 15 nt, Escherichia coli CFT073
aaaauaccagcaauu

SEQ ID NO: 631108 - RNA, 21 nt, Escherichia coli CFT073
aaaauaccauuagucacauua

SEQ ID NO: 631109 - RNA, 12 nt, Escherichia coli CFT073
aaaauaccaaua

SEQ ID NO: 631110 - RNA, 15 nt, Escherichia coli CFT073
aaaauaccaccaaug

SEQ ID NO: 631111 - RNA, 14 nt, Escherichia coli CFT073
aaaauauucccguc

SEQ ID NO: 631112 - RNA, 20 nt, Escherichia coli CFT073
aaaauaucguaggccugcuc

SEQ ID NO: 631113 - RNA, 20 nt, Escherichia coli CFT073
aaaaucuuucagaguuguac

SEQ ID NO: 631114 - RNA, 21 nt, Escherichia coli CFT073
aaaaucuucguuaucccaggc

SEQ ID NO: 631115 - RNA, 19 nt, Escherichia coli CFT073
aaaaucuuccagaaugccu

SEQ ID NO: 631116 - RNA, 17 nt, Escherichia coli CFT073
aaaaucucucguauuuc

SEQ ID NO: 631117 - RNA, 13 nt, Escherichia coli CFT073
aaaaucagcauca

SEQ ID NO: 631118 - RNA, 17 nt, Escherichia coli CFT073
aaaaucagcuuccuugc

SEQ ID NO: 631119 - RNA, 17 nt, Escherichia coli CFT073
aaaaucaugcaaauuca

SEQ ID NO: 631120 - RNA, 12 nt, Escherichia coli CFT073
aaaauguugcgc

SEQ ID NO: 631121 - RNA, 19 nt, Escherichia coli CFT073
aaaauguugcgccucaaga

SEQ ID NO: 631122 - RNA, 23 nt, Escherichia coli CFT073
aaaauguuuacgccugguugagu

SEQ ID NO: 631123 - RNA, 18 nt, Escherichia coli CFT073
aaaauuacgaaagcaaaa

SEQ ID NO: 631124 - RNA, 20 nt, Escherichia coli CFT073
aaaaugguuugccagcagag

SEQ ID NO: 631125 - RNA, 19 nt, Escherichia coli CFT073
aaaauggucagccagcggc

SEQ ID NO: 631126 - RNA, 24 nt, Escherichia coli CFT073
aaaauggcguugcuggcgugaaau

SEQ ID NO: 631127 - RNA, 24 nt, Escherichia coli CFT073
aaaauggcguuuccuuccagaaac

SEQ ID NO: 631128 - RNA, 23 nt, Escherichia coli CFT073
aaaaugacauuaaguaacaauau

SEQ ID NO: 631129 - RNA, 18 nt, Escherichia coli CFT073
aaagaguacaucucuccg

SEQ ID NO: 631130 - RNA, 22 nt, Escherichia coli CFT073
aaagaucugcgugaguuuuugu

SEQ ID NO: 631131 - RNA, 13 nt, Escherichia coli CFT073
aaagcaacaccau

SEQ ID NO: 631132 - RNA, 12 nt, Escherichia coli CFT073
aaagcaacucca

SEQ ID NO: 631133 - RNA, 20 nt, Escherichia coli CFT073
aaagcaacuccaucaagcua

SEQ ID NO: 631134 - RNA, 23 nt, Escherichia coli CFT073
aaagcaagaccaacacccacagc

SEQ ID NO: 631135 - RNA, 18 nt, Escherichia coli CFT073
aaagcaagauuaaaauau

SEQ ID NO: 631136 - RNA, 11 nt, Escherichia coli CFT073
aaagcaauaaa

SEQ ID NO: 631137 - RNA, 14 nt, Escherichia coli CFT073
aaagcaauaucuuu

SEQ ID NO: 631138 - RNA, 14 nt, Escherichia coli CFT073
aaagcaauuccagc

SEQ ID NO: 631139 - RNA, 17 nt, Escherichia coli CFT073
aaagcaauuccagcgcc

SEQ ID NO: 631140 - RNA, 17 nt, Escherichia coli CFT073
aaagcaccacuuaaucu

SEQ ID NO: 631141 - RNA, 19 nt, Escherichia coli CFT073
aaagcacagaaucuaagau

SEQ ID NO: 631142 - RNA, 23 nt, Escherichia coli CFT073
aaagauuauugcuugaucaggaa

SEQ ID NO: 631143 - RNA, 18 nt, Escherichia coli CFT073
aaagaucuuauugccauu

SEQ ID NO: 631144 - RNA, 21 nt, Escherichia coli CFT073
aaagaugucaccauuggcauu

SEQ ID NO: 631145 - RNA, 20 nt, Escherichia coli CFT073
aaagauguuuugccugaaaa

SEQ ID NO: 631146 - RNA, 22 nt, Escherichia coli CFT073
aaagauguuuugccugaaaaau

SEQ ID NO: 631147 - RNA, 24 nt, Escherichia coli CFT073
aaagauguuuugccugaaaaauga

SEQ ID NO: 631148 - RNA, 14 nt, Escherichia coli CFT073
aaaccuaacaaggc

SEQ ID NO: 631149 - RNA, 20 nt, Escherichia coli CFT073
aaaccguauucaucgccauu

SEQ ID NO: 631150 - RNA, 18 nt, Escherichia coli CFT073
aaaccguaaagcacuggu

SEQ ID NO: 631151 - RNA, 19 nt, Escherichia coli CFT073
aaaccguguuuaugaaagu

SEQ ID NO: 631152 - RNA, 17 nt, Escherichia coli CFT073
aaaccuccagcaucaga

SEQ ID NO: 631153 - RNA, 18 nt, Escherichia coli CFT073
aaagaaaauaccgaacau

SEQ ID NO: 631154 - RNA, 21 nt, Escherichia coli CFT073
aaagaaugcgcucaauauaac

SEQ ID NO: 631155 - RNA, 12 nt, Escherichia coli CFT073
aaagcgccagcg

SEQ ID NO: 631156 - RNA, 23 nt, Escherichia coli CFT073
aaagcgcaaaauaccagcaauuu

SEQ ID NO: 631157 - RNA, 15 nt, Escherichia coli CFT073
aaagcgcugaauauc

SEQ ID NO: 631158 - RNA, 17 nt, Escherichia coli CFT073
aaagcucacuuugucug

SEQ ID NO: 631159 - RNA, 15 nt, Escherichia coli CFT073
aaagcuaucccuugu

SEQ ID NO: 631160 - RNA, 14 nt, Escherichia coli CFT073
aaagcguauuaugc

SEQ ID NO: 631161 - RNA, 19 nt, Escherichia coli CFT073
aaagcgggcaguguuuagu

SEQ ID NO: 631162 - RNA, 20 nt, Escherichia coli CFT073
aaagcguacccgccugauag

SEQ ID NO: 631163 - RNA, 21 nt, Escherichia coli CFT073
aaagccucaaugcugaaagca

SEQ ID NO: 631164 - RNA, 12 nt, Escherichia coli CFT073
aaagccugauac

SEQ ID NO: 631165 - RNA, 21 nt, Escherichia coli CFT073
aaagccuguaccaaaaucauc

SEQ ID NO: 631166 - RNA, 14 nt, Escherichia coli CFT073
aaagccugcuggca

SEQ ID NO: 631167 - RNA, 13 nt, Escherichia coli CFT073
aaagcgaagcgaa

SEQ ID NO: 631168 - RNA, 16 nt, Escherichia coli CFT073
aaagcgaccaaccauc

SEQ ID NO: 631169 - RNA, 18 nt, Escherichia coli CFT073
aaagcaucagacugcuuu

SEQ ID NO: 631170 - RNA, 18 nt, Escherichia coli CFT073
aaagcauacaaugcaaua

SEQ ID NO: 631171 - RNA, 16 nt, Escherichia coli CFT073
aaaguaaauaagaaaa

SEQ ID NO: 631172 - RNA, 14 nt, Escherichia coli CFT073
aaaguaaacaauaa

SEQ ID NO: 631173 - RNA, 16 nt, Escherichia coli CFT073
aaaggucaucaucacu

SEQ ID NO: 631174 - RNA, 19 nt, Escherichia coli CFT073
aaaggugacguccagaacc

SEQ ID NO: 631175 - RNA, 22 nt, Escherichia coli CFT073
aaaggugacuggcagaaugaag

SEQ ID NO: 631176 - RNA, 14 nt, Escherichia coli CFT073
aaaggugccacagc

SEQ ID NO: 631177 - RNA, 13 nt, Escherichia coli CFT073
aaaggcugugaaa

SEQ ID NO: 631178 - RNA, 14 nt, Escherichia coli CFT073
aaagguaaggauaa

SEQ ID NO: 631179 - RNA, 12 nt, Escherichia coli CFT073
aaagcuuuuuau

SEQ ID NO: 631180 - RNA, 18 nt, Escherichia coli CFT073
aaagcuuuaauuucaggc

SEQ ID NO: 631181 - RNA, 13 nt, Escherichia coli CFT073
aaagcucuucaug

SEQ ID NO: 631182 - RNA, 12 nt, Escherichia coli CFT073
aaagcugagaaa

SEQ ID NO: 631183 - RNA, 14 nt, Escherichia coli CFT073
aaagcugagaaaau

SEQ ID NO: 631184 - RNA, 19 nt, Escherichia coli CFT073
aaagcuuaugcuguacuuu

SEQ ID NO: 631185 - RNA, 19 nt, Escherichia coli CFT073
aaaguuggcgauaaaguug

SEQ ID NO: 631186 - RNA, 20 nt, Escherichia coli CFT073
aaaguuggcguucacugccg

SEQ ID NO: 631187 - RNA, 21 nt, Escherichia coli CFT073
aaaguugaagcugaacagucg

SEQ ID NO: 631188 - RNA, 20 nt, Escherichia coli CFT073
aaaguuagccacagccuggg

SEQ ID NO: 631189 - RNA, 22 nt, Escherichia coli CFT073
aaaguuaguaccgaacagccag

SEQ ID NO: 631190 - RNA, 17 nt, Escherichia coli CFT073
aaaguuuugugcuuugu

SEQ ID NO: 631191 - RNA, 20 nt, Escherichia coli CFT073
aaaguuugcaacuuucgcuu

SEQ ID NO: 631192 - RNA, 14 nt, Escherichia coli CFT073
aaaguuuuuaaaua

SEQ ID NO: 631193 - RNA, 19 nt, Escherichia coli CFT073
aaaguuuccuguuucucau

SEQ ID NO: 631194 - RNA, 20 nt, Escherichia coli CFT073
aaaguuuccuguuucucauu

SEQ ID NO: 631195 - RNA, 14 nt, Escherichia coli CFT073
aaaguuugcaacuu

SEQ ID NO: 631196 - RNA, 18 nt, Escherichia coli CFT073
aaauaaacuuacugacau

SEQ ID NO: 631197 - RNA, 18 nt, Escherichia coli CFT073
aaagugaaauauuucuuu

SEQ ID NO: 631198 - RNA, 22 nt, Escherichia coli CFT073
aaagugaucccacaucacaucc

SEQ ID NO: 631199 - RNA, 13 nt, Escherichia coli CFT073
aaaguguaggaaa

SEQ ID NO: 631200 - RNA, 23 nt, Escherichia coli CFT073
aaagugccgccagcuucgcuucc

SEQ ID NO: 631201 - RNA, 13 nt, Escherichia coli CFT073
aaagugaaaaaca

SEQ ID NO: 631202 - RNA, 20 nt, Escherichia coli CFT073
aaauagaccggagaaaagac

SEQ ID NO: 631203 - RNA, 13 nt, Escherichia coli CFT073
aaauauaaaccgu

SEQ ID NO: 631204 - RNA, 14 nt, Escherichia coli CFT073
aaauaucagcagca

SEQ ID NO: 631205 - RNA, 14 nt, Escherichia coli CFT073
aaauaucaaaaaca

SEQ ID NO: 631206 - RNA, 23 nt, Escherichia coli CFT073
aaauaucaaaaacaaauuuugaa

SEQ ID NO: 631207 - RNA, 17 nt, Escherichia coli CFT073
aaauaucgauauacacc

SEQ ID NO: 631208 - RNA, 23 nt, Escherichia coli CFT073
aaauaauuccccaccugaacuuc

SEQ ID NO: 631209 - RNA, 18 nt, Escherichia coli CFT073
aaauacagcaauggaaaa

SEQ ID NO: 631210 - RNA, 15 nt, Escherichia coli CFT073
aaauacaggaaauaa

SEQ ID NO: 631211 - RNA, 20 nt, Escherichia coli CFT073
aaauacaaacgccauaaacu

SEQ ID NO: 631212 - RNA, 14 nt, Escherichia coli CFT073
aaauacgcaucaua

SEQ ID NO: 631213 - RNA, 14 nt, Escherichia coli CFT073
aaauacgacugaua

SEQ ID NO: 631214 - RNA, 15 nt, Escherichia coli CFT073
aaauagaaagugacu

SEQ ID NO: 631215 - RNA, 11 nt, Escherichia coli CFT073
aaauacaugac

SEQ ID NO: 631216 - RNA, 22 nt, Escherichia coli CFT073
aaauaccccgccagcagaauga

SEQ ID NO: 631217 - RNA, 19 nt, Escherichia coli CFT073
aaauaccauuagucacauu

SEQ ID NO: 631218 - RNA, 17 nt, Escherichia coli CFT073
aaauacccaaaaaauag

SEQ ID NO: 631219 - RNA, 14 nt, Escherichia coli CFT073
aaauaccacucagc

SEQ ID NO: 631220 - RNA, 19 nt, Escherichia coli CFT073
aaauuucggauauuuucca

SEQ ID NO: 631221 - RNA, 20 nt, Escherichia coli CFT073
aaauuucucccgcuaacuga

SEQ ID NO: 631222 - RNA, 12 nt, Escherichia coli CFT073
aaauuucaggca

SEQ ID NO: 631223 - RNA, 17 nt, Escherichia coli CFT073
aaauuucaggcaacaaa

SEQ ID NO: 631224 - RNA, 18 nt, Escherichia coli CFT073
aaauuucaggcaacaaaa

SEQ ID NO: 631225 - RNA, 20 nt, Escherichia coli CFT073
aaauuucaggcaacaaaaaa

SEQ ID NO: 631226 - RNA, 12 nt, Escherichia coli CFT073
aaauuucuuccc

SEQ ID NO: 631227 - RNA, 16 nt, Escherichia coli CFT073
aaauuucuucccuuuc

SEQ ID NO: 631228 - RNA, 18 nt, Escherichia coli CFT073
aaauuucuucccuuucug

SEQ ID NO: 631229 - RNA, 21 nt, Escherichia coli CFT073
aaauuucucuuucacuccauu

SEQ ID NO: 631230 - RNA, 17 nt, Escherichia coli CFT073
aaauuugcauaaaaauu

SEQ ID NO: 631231 - RNA, 23 nt, Escherichia coli CFT073
aaauuuuaacgcauaauaaaggc

SEQ ID NO: 631232 - RNA, 14 nt, Escherichia coli CFT073
aaauuuaacauuac

SEQ ID NO: 631233 - RNA, 14 nt, Escherichia coli CFT073
aaauuguuuugcua

SEQ ID NO: 631234 - RNA, 21 nt, Escherichia coli CFT073
aaauuguugccggagaaacuc

SEQ ID NO: 631235 - RNA, 17 nt, Escherichia coli CFT073
aaauugucguuauugau

SEQ ID NO: 631236 - RNA, 15 nt, Escherichia coli CFT073
aaauugugauaaaaa

SEQ ID NO: 631237 - RNA, 17 nt, Escherichia coli CFT073
aaauugugauaaaaauc

SEQ ID NO: 631238 - RNA, 22 nt, Escherichia coli CFT073
aaauugugucgacauagccauc

SEQ ID NO: 631239 - RNA, 23 nt, Escherichia coli CFT073
aaauuguaguguugcaguaaauu

SEQ ID NO: 631240 - RNA, 21 nt, Escherichia coli CFT073
aaauugcugugauuaagcagc

SEQ ID NO: 631241 - RNA, 13 nt, Escherichia coli CFT073
aaauugccccaga

SEQ ID NO: 631242 - RNA, 17 nt, Escherichia coli CFT073
aaauugcguaaagccug

SEQ ID NO: 631243 - RNA, 23 nt, Escherichia coli CFT073
aaauugcguaaagccugcuggca

SEQ ID NO: 631244 - RNA, 19 nt, Escherichia coli CFT073
aaauugcccggcuacgugc

SEQ ID NO: 631245 - RNA, 14 nt, Escherichia coli CFT073
aaauugccugaugc

SEQ ID NO: 631246 - RNA, 21 nt, Escherichia coli CFT073
aaauucagugugccacuucaa

SEQ ID NO: 631247 - RNA, 17 nt, Escherichia coli CFT073
aaauucaaccucuguuc

SEQ ID NO: 631248 - RNA, 13 nt, Escherichia coli CFT073
aaauugaagaguu

SEQ ID NO: 631249 - RNA, 11 nt, Escherichia coli CFT073
aacaagccacg

SEQ ID NO: 631250 - RNA, 13 nt, Escherichia coli CFT073
aacaagacaucac

SEQ ID NO: 631251 - RNA, 15 nt, Escherichia coli CFT073
aacaagaaacagaua

SEQ ID NO: 631252 - RNA, 16 nt, Escherichia coli CFT073
aacaagaaacagauaa

SEQ ID NO: 631253 - RNA, 14 nt, Escherichia coli CFT073
aacaagauuagcca

SEQ ID NO: 631254 - RNA, 23 nt, Escherichia coli CFT073
aacaacuuucgggcgcaaaaaca

SEQ ID NO: 631255 - RNA, 18 nt, Escherichia coli CFT073
aacaacccugcaucagaa

SEQ ID NO: 631256 - RNA, 18 nt, Escherichia coli CFT073
aacaacgcaacuccagcu

SEQ ID NO: 631257 - RNA, 13 nt, Escherichia coli CFT073
aacaacaccagca

SEQ ID NO: 631258 - RNA, 21 nt, Escherichia coli CFT073
aacaacaccagcaggugauac

SEQ ID NO: 631259 - RNA, 16 nt, Escherichia coli CFT073
aacaacacaccaccac

SEQ ID NO: 631260 - RNA, 17 nt, Escherichia coli CFT073
aacaaaguuugcaacuu

SEQ ID NO: 631261 - RNA, 20 nt, Escherichia coli CFT073
aacaaauaucuuucuaccau

SEQ ID NO: 631262 - RNA, 18 nt, Escherichia coli CFT073
aacaaaacauacuuucuc

SEQ ID NO: 631263 - RNA, 21 nt, Escherichia coli CFT073
aacaaaacucaacgguccaau

SEQ ID NO: 631264 - RNA, 21 nt, Escherichia coli CFT073
aacaaagugcgcguuguucau

SEQ ID NO: 631265 - RNA, 18 nt, Escherichia coli CFT073
aacaaagcucacuuuguc

SEQ ID NO: 631266 - RNA, 15 nt, Escherichia coli CFT073
aacaaagaaauguuc

SEQ ID NO: 631267 - RNA, 20 nt, Escherichia coli CFT073
aacaaacuccccgcaaacca

SEQ ID NO: 631268 - RNA, 14 nt, Escherichia coli CFT073
aacaaagaaauguu

SEQ ID NO: 631269 - RNA, 15 nt, Escherichia coli CFT073
aacaaacgcaaacac

SEQ ID NO: 631270 - RNA, 14 nt, Escherichia coli CFT073
aacaaacgcauaaa

SEQ ID NO: 631271 - RNA, 12 nt, Escherichia coli CFT073
aaauuuugagug

SEQ ID NO: 631272 - RNA, 15 nt, Escherichia coli CFT073
aaauuuugaacagaa

SEQ ID NO: 631273 - RNA, 21 nt, Escherichia coli CFT073
aaauuuucagcgugcccacgu

SEQ ID NO: 631274 - RNA, 18 nt, Escherichia coli CFT073
aaauuuuuccguuuucca

SEQ ID NO: 631275 - RNA, 22 nt, Escherichia coli CFT073
aaauuuuuucgcugaaggucag

SEQ ID NO: 631276 - RNA, 19 nt, Escherichia coli CFT073
aacaaaaaacccaucaacc

SEQ ID NO: 631277 - RNA, 13 nt, Escherichia coli CFT073
aacaaaaccacac

SEQ ID NO: 631278 - RNA, 15 nt, Escherichia coli CFT073
aacaaaaaugcaggc

SEQ ID NO: 631279 - RNA, 19 nt, Escherichia coli CFT073
aaauggggacaucaaagaa

SEQ ID NO: 631280 - RNA, 18 nt, Escherichia coli CFT073
aaauggcgaacgggauaa

SEQ ID NO: 631281 - RNA, 16 nt, Escherichia coli CFT073
aaaugccaucugaacu

SEQ ID NO: 631282 - RNA, 16 nt, Escherichia coli CFT073
aaaugcauacaugcuu

SEQ ID NO: 631283 - RNA, 22 nt, Escherichia coli CFT073
aaaugccacugcgccgggcaga

SEQ ID NO: 631284 - RNA, 15 nt, Escherichia coli CFT073
aaaugaucaauaauu

SEQ ID NO: 631285 - RNA, 16 nt, Escherichia coli CFT073
aaaugcagcaaccaga

SEQ ID NO: 631286 - RNA, 18 nt, Escherichia coli CFT073
aaaugcacgcugccuggu

SEQ ID NO: 631287 - RNA, 14 nt, Escherichia coli CFT073
aaaugcaacauuau

SEQ ID NO: 631288 - RNA, 19 nt, Escherichia coli CFT073
aaaugcaacauuaucugau

SEQ ID NO: 631289 - RNA, 19 nt, Escherichia coli CFT073
aaaugcacaauaauauuau

SEQ ID NO: 631290 - RNA, 12 nt, Escherichia coli CFT073
aaauggucacac

SEQ ID NO: 631291 - RNA, 16 nt, Escherichia coli CFT073
aaauggucacacacaa

SEQ ID NO: 631292 - RNA, 18 nt, Escherichia coli CFT073
aaauuacuggauaaccug

SEQ ID NO: 631293 - RNA, 16 nt, Escherichia coli CFT073
aaauuaggucaaagaa

SEQ ID NO: 631294 - RNA, 18 nt, Escherichia coli CFT073
aaaaagcaagauuaaaau

SEQ ID NO: 631295 - RNA, 22 nt, Escherichia coli CFT073
aaaucuuucacuuuugccagac

SEQ ID NO: 631296 - RNA, 16 nt, Escherichia coli CFT073
aaaugacauuaaguaa

SEQ ID NO: 631297 - RNA, 23 nt, Escherichia coli CFT073
aaaugacauucacgcugucggca

SEQ ID NO: 631298 - RNA, 16 nt, Escherichia coli CFT073
aaaugaccauaaaagg

SEQ ID NO: 631299 - RNA, 19 nt, Escherichia coli CFT073
aaaugaccauaaaaggcac

SEQ ID NO: 631300 - RNA, 21 nt, Escherichia coli CFT073
aaaugacccauuuucucggcu

SEQ ID NO: 631301 - RNA, 19 nt, Escherichia coli CFT073
aaaugacgcuuuauucaug

SEQ ID NO: 631302 - RNA, 17 nt, Escherichia coli CFT073
aaaugacgggccaagca

SEQ ID NO: 631303 - RNA, 23 nt, Escherichia coli CFT073
aaaugagcguauagagcagcggc

SEQ ID NO: 631304 - RNA, 23 nt, Escherichia coli CFT073
aaaugacucacguuacuuaacac

SEQ ID NO: 631305 - RNA, 20 nt, Escherichia coli CFT073
aaaucugcgggaacauaugc

SEQ ID NO: 631306 - RNA, 18 nt, Escherichia coli CFT073
aaaucugccgauuucaac

SEQ ID NO: 631307 - RNA, 17 nt, Escherichia coli CFT073
aaaucuucucacugccc

SEQ ID NO: 631308 - RNA, 18 nt, Escherichia coli CFT073
aaaucggugggcugacau

SEQ ID NO: 631309 - RNA, 14 nt, Escherichia coli CFT073
aaaucgguuuguaa

SEQ ID NO: 631310 - RNA, 17 nt, Escherichia coli CFT073
aaaucgucgagggauuu

SEQ ID NO: 631311 - RNA, 22 nt, Escherichia coli CFT073
aaaucgaagcguacugucugcu

SEQ ID NO: 631312 - RNA, 16 nt, Escherichia coli CFT073
aaaucgagaagacaau

SEQ ID NO: 631313 - RNA, 15 nt, Escherichia coli CFT073
aaaucggcaccgccg

SEQ ID NO: 631314 - RNA, 18 nt, Escherichia coli CFT073
aaauccgccgccacuuga

SEQ ID NO: 631315 - RNA, 23 nt, Escherichia coli CFT073
aaaucccgucuggcgaauaaugg

SEQ ID NO: 631316 - RNA, 17 nt, Escherichia coli CFT073
aaauccaggucagaacu

SEQ ID NO: 631317 - RNA, 15 nt, Escherichia coli CFT073
aaauccagcaccgcu

SEQ ID NO: 631318 - RNA, 21 nt, Escherichia coli CFT073
aaauccagccagcgccgcgcg

SEQ ID NO: 631319 - RNA, 16 nt, Escherichia coli CFT073
aaauccagaaaaaaag

SEQ ID NO: 631320 - RNA, 14 nt, Escherichia coli CFT073
aaaucccgcugaau

SEQ ID NO: 631321 - RNA, 23 nt, Escherichia coli CFT073
aaaucccgccgauggcgggauuu

SEQ ID NO: 631322 - RNA, 20 nt, Escherichia coli CFT073
aaaucccgcugaauuccccu

SEQ ID NO: 631323 - RNA, 19 nt, Escherichia coli CFT073
aaauauuauauguguuggu

SEQ ID NO: 631324 - RNA, 18 nt, Escherichia coli CFT073
aaauauuaagaaaggcag

SEQ ID NO: 631325 - RNA, 22 nt, Escherichia coli CFT073
aagagugugaauauucagaaua

SEQ ID NO: 631326 - RNA, 23 nt, Escherichia coli CFT073
aagauaaggugucaauccuucuu

SEQ ID NO: 631327 - RNA, 18 nt, Escherichia coli CFT073
aagaguuguaauuuaaau

SEQ ID NO: 631328 - RNA, 13 nt, Escherichia coli CFT073
aagaguuuuaaaa

SEQ ID NO: 631329 - RNA, 20 nt, Escherichia coli CFT073
aagaguuuuaaaaccauuag

SEQ ID NO: 631330 - RNA, 23 nt, Escherichia coli CFT073
aagaguuuucuuaagauaagaau

SEQ ID NO: 631331 - RNA, 17 nt, Escherichia coli CFT073
aagaucaauacaaccua

SEQ ID NO: 631332 - RNA, 16 nt, Escherichia coli CFT073
aagaucaaaccucacc

SEQ ID NO: 631333 - RNA, 17 nt, Escherichia coli CFT073
aagaucaacuucgcugc

SEQ ID NO: 631334 - RNA, 16 nt, Escherichia coli CFT073
aagaucacaauguaaa

SEQ ID NO: 631335 - RNA, 18 nt, Escherichia coli CFT073
aagauauuauuaaaugcu

SEQ ID NO: 631336 - RNA, 18 nt, Escherichia coli CFT073
aagauacggauucuuaac

SEQ ID NO: 631337 - RNA, 22 nt, Escherichia coli CFT073
aagauagacuguugaaauacaa

SEQ ID NO: 631338 - RNA, 15 nt, Escherichia coli CFT073
aagagaucaaagucu

SEQ ID NO: 631339 - RNA, 18 nt, Escherichia coli CFT073
aagagaucaaagucucug

SEQ ID NO: 631340 - RNA, 21 nt, Escherichia coli CFT073
aagagauaaacgaccacucuu

SEQ ID NO: 631341 - RNA, 14 nt, Escherichia coli CFT073
aagagauaaacuca

SEQ ID NO: 631342 - RNA, 17 nt, Escherichia coli CFT073
aagagauaaacucacuc

SEQ ID NO: 631343 - RNA, 12 nt, Escherichia coli CFT073
aagagagcaaca

SEQ ID NO: 631344 - RNA, 18 nt, Escherichia coli CFT073
aagagagcaacagcagau

SEQ ID NO: 631345 - RNA, 15 nt, Escherichia coli CFT073
aagagagaagccagg

SEQ ID NO: 631346 - RNA, 13 nt, Escherichia coli CFT073
aagagagaagcca

SEQ ID NO: 631347 - RNA, 15 nt, Escherichia coli CFT073
aagagcaaauaaaac

SEQ ID NO: 631348 - RNA, 19 nt, Escherichia coli CFT073
aagagcaaauaaaacauca

SEQ ID NO: 631349 - RNA, 14 nt, Escherichia coli CFT073
aagagauccaggcc

SEQ ID NO: 631350 - RNA, 17 nt, Escherichia coli CFT073
aagagauccaggccaga

SEQ ID NO: 631351 - RNA, 21 nt, Escherichia coli CFT073
aagagauccgcacucaacuua

SEQ ID NO: 631352 - RNA, 19 nt, Escherichia coli CFT073
aagagcgauccguucagau

SEQ ID NO: 631353 - RNA, 21 nt, Escherichia coli CFT073
aagaggaggcuauagcaggua

SEQ ID NO: 631354 - RNA, 15 nt, Escherichia coli CFT073
aagaguaaccaaacg

SEQ ID NO: 631355 - RNA, 16 nt, Escherichia coli CFT073
aagaguaaagcccgcc

SEQ ID NO: 631356 - RNA, 15 nt, Escherichia coli CFT073
aagacguagcaagca

SEQ ID NO: 631357 - RNA, 23 nt, Escherichia coli CFT073
aagacgcugauucacuuucugaa

SEQ ID NO: 631358 - RNA, 18 nt, Escherichia coli CFT073
aagacgccucgcauuuuu

SEQ ID NO: 631359 - RNA, 14 nt, Escherichia coli CFT073
aagacgcgccagcg

SEQ ID NO: 631360 - RNA, 22 nt, Escherichia coli CFT073
aagacgcaucaggcaaaagaug

SEQ ID NO: 631361 - RNA, 14 nt, Escherichia coli CFT073
aagacgagccgucc

SEQ ID NO: 631362 - RNA, 13 nt, Escherichia coli CFT073
aagacgaguagaa

SEQ ID NO: 631363 - RNA, 10 nt, Escherichia coli CFT073
aagacgacga

SEQ ID NO: 631364 - RNA, 14 nt, Escherichia coli CFT073
aagacgaaaaauga

SEQ ID NO: 631365 - RNA, 17 nt, Escherichia coli CFT073
aagaccugucucuuaua

SEQ ID NO: 631366 - RNA, 18 nt, Escherichia coli CFT073
aagaccugucucuuauac

SEQ ID NO: 631367 - RNA, 19 nt, Escherichia coli CFT073
aagaccguuucggugauga

SEQ ID NO: 631368 - RNA, 22 nt, Escherichia coli CFT073
aagaccagcgaaaccugaaucc

SEQ ID NO: 631369 - RNA, 17 nt, Escherichia coli CFT073
aagaccaggaaacccaa

SEQ ID NO: 631370 - RNA, 15 nt, Escherichia coli CFT073
aagacuguaaauacu

SEQ ID NO: 631371 - RNA, 18 nt, Escherichia coli CFT073
aagacuccagcgccagcg

SEQ ID NO: 631372 - RNA, 14 nt, Escherichia coli CFT073
aagacuauuaauau

SEQ ID NO: 631373 - RNA, 17 nt, Escherichia coli CFT073
aagacuauauuaaagau

SEQ ID NO: 631374 - RNA, 20 nt, Escherichia coli CFT073
aagaaugcuccccagaccaa

SEQ ID NO: 631375 - RNA, 12 nt, Escherichia coli CFT073
aagaaugcucgc

SEQ ID NO: 631376 - RNA, 16 nt, Escherichia coli CFT073
aagaauugcagauacc

SEQ ID NO: 631377 - RNA, 22 nt, Escherichia coli CFT073
aagaauugcagauaccacauca

SEQ ID NO: 631378 - RNA, 12 nt, Escherichia coli CFT073
aagaauuggcuu

SEQ ID NO: 631379 - RNA, 13 nt, Escherichia coli CFT073
aagaaugaaauuc

SEQ ID NO: 631380 - RNA, 20 nt, Escherichia coli CFT073
aagaaaguucgacaacuuuu

SEQ ID NO: 631381 - RNA, 12 nt, Escherichia coli CFT073
aagaaaccauug

SEQ ID NO: 631382 - RNA, 20 nt, Escherichia coli CFT073
aagaaaccauugcagccaau

SEQ ID NO: 631383 - RNA, 17 nt, Escherichia coli CFT073
aagaaacgccaucugaa

SEQ ID NO: 631384 - RNA, 14 nt, Escherichia coli CFT073
aagacaacauugau

SEQ ID NO: 631385 - RNA, 21 nt, Escherichia coli CFT073
aagaauuucucaguuguuugc

SEQ ID NO: 631386 - RNA, 22 nt, Escherichia coli CFT073
aagacaucgcccgauucacaua

SEQ ID NO: 631387 - RNA, 16 nt, Escherichia coli CFT073
aagacagcgaaaacga

SEQ ID NO: 631388 - RNA, 21 nt, Escherichia coli CFT073
aagacauagcacauaaaaugg

SEQ ID NO: 631389 - RNA, 21 nt, Escherichia coli CFT073
aagacaucgcccgauucacau

SEQ ID NO: 631390 - RNA, 23 nt, Escherichia coli CFT073
aacucuggauguuucaugaagca

SEQ ID NO: 631391 - RNA, 19 nt, Escherichia coli CFT073
aacucuggggaaaugccau

SEQ ID NO: 631392 - RNA, 16 nt, Escherichia coli CFT073
aacugacuuucuuuuc

SEQ ID NO: 631393 - RNA, 17 nt, Escherichia coli CFT073
aacugacuuucuuuucc

SEQ ID NO: 631394 - RNA, 18 nt, Escherichia coli CFT073
aacugacuuccacuuccu

SEQ ID NO: 631395 - RNA, 13 nt, Escherichia coli CFT073
aacucuucaagau

SEQ ID NO: 631396 - RNA, 13 nt, Escherichia coli CFT073
aacucucaugcuu

SEQ ID NO: 631397 - RNA, 14 nt, Escherichia coli CFT073
aacucuaaugccuu

SEQ ID NO: 631398 - RNA, 20 nt, Escherichia coli CFT073
aacucuaccuggucaccgac

SEQ ID NO: 631399 - RNA, 16 nt, Escherichia coli CFT073
aacucggaaaaugcau

SEQ ID NO: 631400 - RNA, 20 nt, Escherichia coli CFT073
aacucgucgcugauauugcu

SEQ ID NO: 631401 - RNA, 13 nt, Escherichia coli CFT073
aacucgaugacaa

SEQ ID NO: 631402 - RNA, 16 nt, Escherichia coli CFT073
aacucgaccugcaacu

SEQ ID NO: 631403 - RNA, 17 nt, Escherichia coli CFT073
aacucgaccugcaacug

SEQ ID NO: 631404 - RNA, 13 nt, Escherichia coli CFT073
aacucgccuucag

SEQ ID NO: 631405 - RNA, 16 nt, Escherichia coli CFT073
aacucgccuucagguu

SEQ ID NO: 631406 - RNA, 22 nt, Escherichia coli CFT073
aacucgccuuugucuuucugga

SEQ ID NO: 631407 - RNA, 16 nt, Escherichia coli CFT073
aacucgcuuaagccau

SEQ ID NO: 631408 - RNA, 16 nt, Escherichia coli CFT073
aacucgcggcuaacac

SEQ ID NO: 631409 - RNA, 19 nt, Escherichia coli CFT073
aacuccggccugcacugca

SEQ ID NO: 631410 - RNA, 17 nt, Escherichia coli CFT073
aacuccccgcaaaccag

SEQ ID NO: 631411 - RNA, 15 nt, Escherichia coli CFT073
aacuccccuucuggc

SEQ ID NO: 631412 - RNA, 13 nt, Escherichia coli CFT073
aacuccagaauac

SEQ ID NO: 631413 - RNA, 13 nt, Escherichia coli CFT073
aacuccauaccac

SEQ ID NO: 631414 - RNA, 21 nt, Escherichia coli CFT073
aacuauaugacucauaaaaau

SEQ ID NO: 631415 - RNA, 12 nt, Escherichia coli CFT073
aacuauggcauu

SEQ ID NO: 631416 - RNA, 21 nt, Escherichia coli CFT073
aacggcgguuucgcaaaccaa

SEQ ID NO: 631417 - RNA, 20 nt, Escherichia coli CFT073
aacggcgugagaaccgcacc

SEQ ID NO: 631418 - RNA, 12 nt, Escherichia coli CFT073
aacggcggauga

SEQ ID NO: 631419 - RNA, 14 nt, Escherichia coli CFT073
aacggcgcuugaac

SEQ ID NO: 631420 - RNA, 21 nt, Escherichia coli CFT073
aacgggcaggguggugacacc

SEQ ID NO: 631421 - RNA, 21 nt, Escherichia coli CFT073
aacgggcauggugucaccacc

SEQ ID NO: 631422 - RNA, 17 nt, Escherichia coli CFT073
aacggcugggaaaucac

SEQ ID NO: 631423 - RNA, 14 nt, Escherichia coli CFT073
aacucaaugccgga

SEQ ID NO: 631424 - RNA, 13 nt, Escherichia coli CFT073
aacucaccaucaa

SEQ ID NO: 631425 - RNA, 23 nt, Escherichia coli CFT073
aacucaccauccugaucgccauc

SEQ ID NO: 631426 - RNA, 22 nt, Escherichia coli CFT073
aacucacccugaugcccaaaaa

SEQ ID NO: 631427 - RNA, 21 nt, Escherichia coli CFT073
aacucaccgaugaucgccauc

SEQ ID NO: 631428 - RNA, 18 nt, Escherichia coli CFT073
aacucaccggcauuuuuu

SEQ ID NO: 631429 - RNA, 14 nt, Escherichia coli CFT073
aacucaccuuuaaa

SEQ ID NO: 631430 - RNA, 19 nt, Escherichia coli CFT073
aacucaggaacaucagcau

SEQ ID NO: 631431 - RNA, 17 nt, Escherichia coli CFT073
aacucaggaacuuagua

SEQ ID NO: 631432 - RNA, 12 nt, Escherichia coli CFT073
aacucacgcaga

SEQ ID NO: 631433 - RNA, 15 nt, Escherichia coli CFT073
aacucacugccagca

SEQ ID NO: 631434 - RNA, 12 nt, Escherichia coli CFT073
aacuccacuuca

SEQ ID NO: 631435 - RNA, 14 nt, Escherichia coli CFT073
aacuccaccaauaa

SEQ ID NO: 631436 - RNA, 19 nt, Escherichia coli CFT073
aacucauugccagcccuaa

SEQ ID NO: 631437 - RNA, 14 nt, Escherichia coli CFT073
aacucauccaccac

SEQ ID NO: 631438 - RNA, 14 nt, Escherichia coli CFT073
aacucauacugagc

SEQ ID NO: 631439 - RNA, 17 nt, Escherichia coli CFT073
aacuguaucccagccca

SEQ ID NO: 631440 - RNA, 17 nt, Escherichia coli CFT073
aacugucuucaccauag

SEQ ID NO: 631441 - RNA, 20 nt, Escherichia coli CFT073
aacugugaguacccuuucac

SEQ ID NO: 631442 - RNA, 22 nt, Escherichia coli CFT073
aacugugcaccgcccugcauca

SEQ ID NO: 631443 - RNA, 21 nt, Escherichia coli CFT073
aacugugccgcgaccaccucg

SEQ ID NO: 631444 - RNA, 15 nt, Escherichia coli CFT073
aacugccuuaaacuc

SEQ ID NO: 631445 - RNA, 17 nt, Escherichia coli CFT073
aacugccuuucccuuuc

SEQ ID NO: 631446 - RNA, 19 nt, Escherichia coli CFT073
aacugccuuucccuuucuu

SEQ ID NO: 631447 - RNA, 16 nt, Escherichia coli CFT073
aacugccgucagggcc

SEQ ID NO: 631448 - RNA, 19 nt, Escherichia coli CFT073
aacugccgucagggccugc

SEQ ID NO: 631449 - RNA, 21 nt, Escherichia coli CFT073
aacugccguuaacgacaaagu

SEQ ID NO: 631450 - RNA, 16 nt, Escherichia coli CFT073
aacugcgccagaccca

SEQ ID NO: 631451 - RNA, 19 nt, Escherichia coli CFT073
aacugaucacguuuuccuu

SEQ ID NO: 631452 - RNA, 19 nt, Escherichia coli CFT073
aacugauccugacaaggug

SEQ ID NO: 631453 - RNA, 16 nt, Escherichia coli CFT073
aacugaucugccagca

SEQ ID NO: 631454 - RNA, 15 nt, Escherichia coli CFT073
aacugccagaagcgg

SEQ ID NO: 631455 - RNA, 20 nt, Escherichia coli CFT073
aacuucgccaggauagaaaa

SEQ ID NO: 631456 - RNA, 16 nt, Escherichia coli CFT073
aacuucgguuaccaca

SEQ ID NO: 631457 - RNA, 21 nt, Escherichia coli CFT073
aacuucauuugucucaaaacu

SEQ ID NO: 631458 - RNA, 16 nt, Escherichia coli CFT073
aacuuccugcuggcug

SEQ ID NO: 631459 - RNA, 14 nt, Escherichia coli CFT073
aacuuccccuuuca

SEQ ID NO: 631460 - RNA, 15 nt, Escherichia coli CFT073
aacuuccccuuucac

SEQ ID NO: 631461 - RNA, 22 nt, Escherichia coli CFT073
aacuguuaaauaacggccuggc

SEQ ID NO: 631462 - RNA, 23 nt, Escherichia coli CFT073
aacuguucgagguaauccagcgu

SEQ ID NO: 631463 - RNA, 23 nt, Escherichia coli CFT073
aacuguuucgcggcaaacugcau

SEQ ID NO: 631464 - RNA, 13 nt, Escherichia coli CFT073
aacuuuacuaaaa

SEQ ID NO: 631465 - RNA, 15 nt, Escherichia coli CFT073
aacuuuacuaaaaag

SEQ ID NO: 631466 - RNA, 13 nt, Escherichia coli CFT073
aacuuuacugccu

SEQ ID NO: 631467 - RNA, 17 nt, Escherichia coli CFT073
aacuucucaccaucaaa

SEQ ID NO: 631468 - RNA, 15 nt, Escherichia coli CFT073
aacuuuuaucaauuu

SEQ ID NO: 631469 - RNA, 20 nt, Escherichia coli CFT073
aacuuuuaucaauuuugauu

SEQ ID NO: 631470 - RNA, 20 nt, Escherichia coli CFT073
aacuuuucaccagcgucagu

SEQ ID NO: 631471 - RNA, 19 nt, Escherichia coli CFT073
aacuuuguauucaguucau

SEQ ID NO: 631472 - RNA, 22 nt, Escherichia coli CFT073
aagaaaaugguuugccagcaga

SEQ ID NO: 631473 - RNA, 23 nt, Escherichia coli CFT073
aagaaaaugguuugccagcagag

SEQ ID NO: 631474 - RNA, 13 nt, Escherichia coli CFT073
aagaaacaccaga

SEQ ID NO: 631475 - RNA, 21 nt, Escherichia coli CFT073
aagaaacaccagaaugcccca

SEQ ID NO: 631476 - RNA, 19 nt, Escherichia coli CFT073
aacgcgacuuaaaccgcug

SEQ ID NO: 631477 - RNA, 16 nt, Escherichia coli CFT073
aacgccuuauccggcc

SEQ ID NO: 631478 - RNA, 13 nt, Escherichia coli CFT073
aacgccuuccaga

SEQ ID NO: 631479 - RNA, 18 nt, Escherichia coli CFT073
aacgccuuguucgcccug

SEQ ID NO: 631480 - RNA, 15 nt, Escherichia coli CFT073
aacgccuuuaccacc

SEQ ID NO: 631481 - RNA, 21 nt, Escherichia coli CFT073
aacgccuuucagccccagcgc

SEQ ID NO: 631482 - RNA, 20 nt, Escherichia coli CFT073
aacgccaauaaucugcccgg

SEQ ID NO: 631483 - RNA, 22 nt, Escherichia coli CFT073
aacgccaauucauuccuugaaa

SEQ ID NO: 631484 - RNA, 13 nt, Escherichia coli CFT073
aacgccaaauucu

SEQ ID NO: 631485 - RNA, 21 nt, Escherichia coli CFT073
aacgccacgacguuuuccauc

SEQ ID NO: 631486 - RNA, 23 nt, Escherichia coli CFT073
aacgccacgauacguuccacguc

SEQ ID NO: 631487 - RNA, 14 nt, Escherichia coli CFT073
aacgccugcaccag

SEQ ID NO: 631488 - RNA, 18 nt, Escherichia coli CFT073
aacgccugcggcugauaa

SEQ ID NO: 631489 - RNA, 17 nt, Escherichia coli CFT073
aacgcgcuuugaugcgu

SEQ ID NO: 631490 - RNA, 13 nt, Escherichia coli CFT073
aacgcgccaagau

SEQ ID NO: 631491 - RNA, 12 nt, Escherichia coli CFT073
aacgcgccagcg

SEQ ID NO: 631492 - RNA, 17 nt, Escherichia coli CFT073
aacggccugaccauuac

SEQ ID NO: 631493 - RNA, 21 nt, Escherichia coli CFT073
aacggcgaugcuuugaccucc

SEQ ID NO: 631494 - RNA, 21 nt, Escherichia coli CFT073
aacggcaucgccaaccaucgc

SEQ ID NO: 631495 - RNA, 14 nt, Escherichia coli CFT073
aacggccaaaagca

SEQ ID NO: 631496 - RNA, 17 nt, Escherichia coli CFT073
aacggccaaaagcacaa

SEQ ID NO: 631497 - RNA, 14 nt, Escherichia coli CFT073
aacggccccagagc

SEQ ID NO: 631498 - RNA, 15 nt, Escherichia coli CFT073
aacggcccauaccac

SEQ ID NO: 631499 - RNA, 12 nt, Escherichia coli CFT073
aacggcagagaa

SEQ ID NO: 631500 - RNA, 19 nt, Escherichia coli CFT073
aacggcagagaaaccacau

SEQ ID NO: 631501 - RNA, 22 nt, Escherichia coli CFT073
aacggcagaguuguucugcgac

SEQ ID NO: 631502 - RNA, 16 nt, Escherichia coli CFT073
aacggcaacaauuucc

SEQ ID NO: 631503 - RNA, 16 nt, Escherichia coli CFT073
aacgcugacauauuuu

SEQ ID NO: 631504 - RNA, 18 nt, Escherichia coli CFT073
aacgcugacggugccagg

SEQ ID NO: 631505 - RNA, 12 nt, Escherichia coli CFT073
aacggagccuuu

SEQ ID NO: 631506 - RNA, 17 nt, Escherichia coli CFT073
aacgcguuuuguagcgu

SEQ ID NO: 631507 - RNA, 23 nt, Escherichia coli CFT073
aacgcuaaauacugaccguccgg

SEQ ID NO: 631508 - RNA, 16 nt, Escherichia coli CFT073
aacgcuagcagcagcg

SEQ ID NO: 631509 - RNA, 21 nt, Escherichia coli CFT073
aacgcucccagccaguccugu

SEQ ID NO: 631510 - RNA, 20 nt, Escherichia coli CFT073
aacgcuaucggcauaaccaa

SEQ ID NO: 631511 - RNA, 20 nt, Escherichia coli CFT073
aacgcucggcaacaccucag

SEQ ID NO: 631512 - RNA, 21 nt, Escherichia coli CFT073
aacgacccucagcugccaggg

SEQ ID NO: 631513 - RNA, 17 nt, Escherichia coli CFT073
aacgaccgcgagcaaaa

SEQ ID NO: 631514 - RNA, 20 nt, Escherichia coli CFT073
aacgaccgcgggacaaauaa

SEQ ID NO: 631515 - RNA, 18 nt, Escherichia coli CFT073
aacgacauccgccagcgc

SEQ ID NO: 631516 - RNA, 15 nt, Escherichia coli CFT073
aacgaccagaaaugc

SEQ ID NO: 631517 - RNA, 15 nt, Escherichia coli CFT073
aacgacgggcgcugg

SEQ ID NO: 631518 - RNA, 16 nt, Escherichia coli CFT073
aacgacguaccgucac

SEQ ID NO: 631519 - RNA, 19 nt, Escherichia coli CFT073
aacgacaguaucgugacaa

SEQ ID NO: 631520 - RNA, 14 nt, Escherichia coli CFT073
aacgaaucugcaaa

SEQ ID NO: 631521 - RNA, 18 nt, Escherichia coli CFT073
aacgaaucugcaaaucug

SEQ ID NO: 631522 - RNA, 18 nt, Escherichia coli CFT073
aacgacaaaaauaccacc

SEQ ID NO: 631523 - RNA, 19 nt, Escherichia coli CFT073
aacgaagauggcauacaac

SEQ ID NO: 631524 - RNA, 20 nt, Escherichia coli CFT073
aacgaaucgggcaacguuga

SEQ ID NO: 631525 - RNA, 19 nt, Escherichia coli CFT073
aacgaacucuucgcccagg

SEQ ID NO: 631526 - RNA, 20 nt, Escherichia coli CFT073
aacgagucgccuaccaucaa

SEQ ID NO: 631527 - RNA, 16 nt, Escherichia coli CFT073
aacgauaacaaucacc

SEQ ID NO: 631528 - RNA, 19 nt, Escherichia coli CFT073
aacgauaacaaucaccaaa

SEQ ID NO: 631529 - RNA, 23 nt, Escherichia coli CFT073
aacgaggaggacuauuuacagau

SEQ ID NO: 631530 - RNA, 20 nt, Escherichia coli CFT073
aacgagcgauccaacuaaau

SEQ ID NO: 631531 - RNA, 17 nt, Escherichia coli CFT073
aacgauaauccagcaga

SEQ ID NO: 631532 - RNA, 21 nt, Escherichia coli CFT073
aacgauaguggcucaggcucu

SEQ ID NO: 631533 - RNA, 17 nt, Escherichia coli CFT073
aacgcagccccagcgca

SEQ ID NO: 631534 - RNA, 14 nt, Escherichia coli CFT073
aacgcagcaucgcc

SEQ ID NO: 631535 - RNA, 15 nt, Escherichia coli CFT073
aacgcagcauuuccu

SEQ ID NO: 631536 - RNA, 12 nt, Escherichia coli CFT073
aacgcaggaugu

SEQ ID NO: 631537 - RNA, 17 nt, Escherichia coli CFT073
aacgcaggccgcccaaa

SEQ ID NO: 631538 - RNA, 15 nt, Escherichia coli CFT073
aacgcaguuugcgag

SEQ ID NO: 631539 - RNA, 17 nt, Escherichia coli CFT073
aacgcauaucuucugaa

SEQ ID NO: 631540 - RNA, 13 nt, Escherichia coli CFT073
aaccuuguuggau

SEQ ID NO: 631541 - RNA, 16 nt, Escherichia coli CFT073
aaccuugcuggcgauu

SEQ ID NO: 631542 - RNA, 13 nt, Escherichia coli CFT073
aaccuuccagcuu

SEQ ID NO: 631543 - RNA, 23 nt, Escherichia coli CFT073
aaccuucauccaucggcgcuuca

SEQ ID NO: 631544 - RNA, 22 nt, Escherichia coli CFT073
aaccuucggaaauggucacaca

SEQ ID NO: 631545 - RNA, 16 nt, Escherichia coli CFT073
aaccuuuuagcugugg

SEQ ID NO: 631546 - RNA, 23 nt, Escherichia coli CFT073
aaccuuuucccgauauaaccauc

SEQ ID NO: 631547 - RNA, 16 nt, Escherichia coli CFT073
aaccuuuaugcagcuc

SEQ ID NO: 631548 - RNA, 22 nt, Escherichia coli CFT073
aaccuuugaacagccagaauga

SEQ ID NO: 631549 - RNA, 13 nt, Escherichia coli CFT073
aaccucucagaau

SEQ ID NO: 631550 - RNA, 18 nt, Escherichia coli CFT073
aaccugcagguuggcuuu

SEQ ID NO: 631551 - RNA, 23 nt, Escherichia coli CFT073
aaccugcuguguaauuugcguuu

SEQ ID NO: 631552 - RNA, 18 nt, Escherichia coli CFT073
aaccugcgccucaguuuc

SEQ ID NO: 631553 - RNA, 18 nt, Escherichia coli CFT073
aaccuguaaaguacaaua

SEQ ID NO: 631554 - RNA, 14 nt, Escherichia coli CFT073
aaccuguuaaugcg

SEQ ID NO: 631555 - RNA, 13 nt, Escherichia coli CFT073
aaccuguuuucac

SEQ ID NO: 631556 - RNA, 18 nt, Escherichia coli CFT073
aacccgcgaugaccaaaa

SEQ ID NO: 631557 - RNA, 19 nt, Escherichia coli CFT073
aaccggugugguaaauuuu

SEQ ID NO: 631558 - RNA, 22 nt, Escherichia coli CFT073
aaccggugcgcgaucuuccucu

SEQ ID NO: 631559 - RNA, 21 nt, Escherichia coli CFT073
aaccguaguggccacagauaa

SEQ ID NO: 631560 - RNA, 22 nt, Escherichia coli CFT073
aaccguaguggccacagauaau

SEQ ID NO: 631561 - RNA, 16 nt, Escherichia coli CFT073
aaccgucuuugcugau

SEQ ID NO: 631562 - RNA, 15 nt, Escherichia coli CFT073
aaccgucgagauaca

SEQ ID NO: 631563 - RNA, 13 nt, Escherichia coli CFT073
aaccgugcuucag

SEQ ID NO: 631564 - RNA, 13 nt, Escherichia coli CFT073
aaccguucauuuc

SEQ ID NO: 631565 - RNA, 16 nt, Escherichia coli CFT073
aaccuaacgcugucgg

SEQ ID NO: 631566 - RNA, 18 nt, Escherichia coli CFT073
aaccuaagaaccagaauu

SEQ ID NO: 631567 - RNA, 16 nt, Escherichia coli CFT073
aaccucaaaaagaaac

SEQ ID NO: 631568 - RNA, 21 nt, Escherichia coli CFT073
aaccucacagaggucuuuucu

SEQ ID NO: 631569 - RNA, 11 nt, Escherichia coli CFT073
aaccuccagca

SEQ ID NO: 631570 - RNA, 20 nt, Escherichia coli CFT073
aaccuccuccggcaucuuua

SEQ ID NO: 631571 - RNA, 19 nt, Escherichia coli CFT073
aacccauuuucagccggca

SEQ ID NO: 631572 - RNA, 17 nt, Escherichia coli CFT073
aaccauaaucucaucgg

SEQ ID NO: 631573 - RNA, 21 nt, Escherichia coli CFT073
aaccauaauuugugauuuguc

SEQ ID NO: 631574 - RNA, 21 nt, Escherichia coli CFT073
aaccaguuuuugcgcccauga

SEQ ID NO: 631575 - RNA, 23 nt, Escherichia coli CFT073
aaccaguuuuugcgcccaugaug

SEQ ID NO: 631576 - RNA, 21 nt, Escherichia coli CFT073
aaccaguucauuuuucucaac

SEQ ID NO: 631577 - RNA, 17 nt, Escherichia coli CFT073
aacccccugaaagcgac

SEQ ID NO: 631578 - RNA, 15 nt, Escherichia coli CFT073
aaccagaauuuccag

SEQ ID NO: 631579 - RNA, 17 nt, Escherichia coli CFT073
aaccagacaacagucaa

SEQ ID NO: 631580 - RNA, 15 nt, Escherichia coli CFT073
aaccagagaauauua

SEQ ID NO: 631581 - RNA, 13 nt, Escherichia coli CFT073
aaccagagacaga

SEQ ID NO: 631582 - RNA, 12 nt, Escherichia coli CFT073
aaccagcaaugc

SEQ ID NO: 631583 - RNA, 13 nt, Escherichia coli CFT073
aaccagcaaugcc

SEQ ID NO: 631584 - RNA, 14 nt, Escherichia coli CFT073
aaccagcaaugcca

SEQ ID NO: 631585 - RNA, 12 nt, Escherichia coli CFT073
aaccagcaccag

SEQ ID NO: 631586 - RNA, 20 nt, Escherichia coli CFT073
aaccagcaccggcaaauugg

SEQ ID NO: 631587 - RNA, 16 nt, Escherichia coli CFT073
aaccagaucugacgau

SEQ ID NO: 631588 - RNA, 19 nt, Escherichia coli CFT073
aaccagaucugacgauuau

SEQ ID NO: 631589 - RNA, 22 nt, Escherichia coli CFT073
aaccagcaccuuuuccaguggc

SEQ ID NO: 631590 - RNA, 20 nt, Escherichia coli CFT073
aaccagccguuauguugauu

SEQ ID NO: 631591 - RNA, 15 nt, Escherichia coli CFT073
aaccagcagcaucac

SEQ ID NO: 631592 - RNA, 16 nt, Escherichia coli CFT073
aaccagcagcaucacc

SEQ ID NO: 631593 - RNA, 19 nt, Escherichia coli CFT073
aaccagcaggucgauaauu

SEQ ID NO: 631594 - RNA, 16 nt, Escherichia coli CFT073
aaccaggaugauauuc

SEQ ID NO: 631595 - RNA, 19 nt, Escherichia coli CFT073
aaccagcggcgcauccgcc

SEQ ID NO: 631596 - RNA, 22 nt, Escherichia coli CFT073
aaccagcguuuccagcaccagu

SEQ ID NO: 631597 - RNA, 23 nt, Escherichia coli CFT073
aaccagcguuuccagcaccaguu

SEQ ID NO: 631598 - RNA, 21 nt, Escherichia coli CFT073
aaccaggucaaugcaacccca

SEQ ID NO: 631599 - RNA, 18 nt, Escherichia coli CFT073
aaccaguagcaaaacuca

SEQ ID NO: 631600 - RNA, 20 nt, Escherichia coli CFT073
aaccacuuaacguuaccuuu

SEQ ID NO: 631601 - RNA, 15 nt, Escherichia coli CFT073
aaccagaaagggaag

SEQ ID NO: 631602 - RNA, 13 nt, Escherichia coli CFT073
aaccacaguucaa

SEQ ID NO: 631603 - RNA, 13 nt, Escherichia coli CFT073
aaccacagcgccg

SEQ ID NO: 631604 - RNA, 13 nt, Escherichia coli CFT073
aaccacaucaauc

SEQ ID NO: 631605 - RNA, 23 nt, Escherichia coli CFT073
aaccaccacaccugccaccagca

SEQ ID NO: 631606 - RNA, 21 nt, Escherichia coli CFT073
aaccaccccacuuuacccgug

SEQ ID NO: 631607 - RNA, 17 nt, Escherichia coli CFT073
aaccaccggaaugguca

SEQ ID NO: 631608 - RNA, 14 nt, Escherichia coli CFT073
aaccacacuucuuc

SEQ ID NO: 631609 - RNA, 20 nt, Escherichia coli CFT073
aaccaaaguuugcaaaccca

SEQ ID NO: 631610 - RNA, 14 nt, Escherichia coli CFT073
aaccaaacagcgcc

SEQ ID NO: 631611 - RNA, 14 nt, Escherichia coli CFT073
aaccaaacagucac

SEQ ID NO: 631612 - RNA, 20 nt, Escherichia coli CFT073
aaccaaacguggucgccagc

SEQ ID NO: 631613 - RNA, 15 nt, Escherichia coli CFT073
aaccaaaccagccgc

SEQ ID NO: 631614 - RNA, 16 nt, Escherichia coli CFT073
aacaucucaauauccg

SEQ ID NO: 631615 - RNA, 16 nt, Escherichia coli CFT073
aacaucgguacacaaa

SEQ ID NO: 631616 - RNA, 20 nt, Escherichia coli CFT073
aacauggagaguuuucauga

SEQ ID NO: 631617 - RNA, 15 nt, Escherichia coli CFT073
aacaugccacuggcu

SEQ ID NO: 631618 - RNA, 14 nt, Escherichia coli CFT073
aacauuuccagcgc

SEQ ID NO: 631619 - RNA, 23 nt, Escherichia coli CFT073
aacauggcgcggcacaccagcca

SEQ ID NO: 631620 - RNA, 14 nt, Escherichia coli CFT073
aacauggucaucau

SEQ ID NO: 631621 - RNA, 15 nt, Escherichia coli CFT073
aacauggucaucauc

SEQ ID NO: 631622 - RNA, 19 nt, Escherichia coli CFT073
aacauuuagcguuaaaauu

SEQ ID NO: 631623 - RNA, 23 nt, Escherichia coli CFT073
aacaguuccgcaaagcccaucac

SEQ ID NO: 631624 - RNA, 22 nt, Escherichia coli CFT073
aacaguguuucuccgccaauuc

SEQ ID NO: 631625 - RNA, 12 nt, Escherichia coli CFT073
aacagugaaauc

SEQ ID NO: 631626 - RNA, 20 nt, Escherichia coli CFT073
aacagugccagacaaaccac

SEQ ID NO: 631627 - RNA, 22 nt, Escherichia coli CFT073
aacagucgcucggcgacacguu

SEQ ID NO: 631628 - RNA, 15 nt, Escherichia coli CFT073
aacagucucaagcac

SEQ ID NO: 631629 - RNA, 16 nt, Escherichia coli CFT073
aacaguucugcagcgu

SEQ ID NO: 631630 - RNA, 18 nt, Escherichia coli CFT073
aacaguugcagucucaug

SEQ ID NO: 631631 - RNA, 19 nt, Escherichia coli CFT073
aacaguuugccaaaccagc

SEQ ID NO: 631632 - RNA, 12 nt, Escherichia coli CFT073
aacaucaaauca

SEQ ID NO: 631633 - RNA, 14 nt, Escherichia coli CFT073
aacaucaaaucaca

SEQ ID NO: 631634 - RNA, 19 nt, Escherichia coli CFT073
aacauaucacuuuuauaua

SEQ ID NO: 631635 - RNA, 23 nt, Escherichia coli CFT073
aacaucaauggaugcaucuucau

SEQ ID NO: 631636 - RNA, 14 nt, Escherichia coli CFT073
aacaucacgccuuc

SEQ ID NO: 631637 - RNA, 15 nt, Escherichia coli CFT073
aacaucacgcugacg

SEQ ID NO: 631638 - RNA, 23 nt, Escherichia coli CFT073
aacaucacgcugacgcaucugua

SEQ ID NO: 631639 - RNA, 12 nt, Escherichia coli CFT073
aacaucauaaua

SEQ ID NO: 631640 - RNA, 21 nt, Escherichia coli CFT073
aacaucggcccgugucccagg

SEQ ID NO: 631641 - RNA, 23 nt, Escherichia coli CFT073
aacaucgccagagaagaaaaccg

SEQ ID NO: 631642 - RNA, 23 nt, Escherichia coli CFT073
aacaaggguaugcuguaaacaac

SEQ ID NO: 631643 - RNA, 20 nt, Escherichia coli CFT073
aacaaggaucgcgacaaaau

SEQ ID NO: 631644 - RNA, 14 nt, Escherichia coli CFT073
aacagcgcgucagc

SEQ ID NO: 631645 - RNA, 15 nt, Escherichia coli CFT073
aacagcggagcaaga

SEQ ID NO: 631646 - RNA, 14 nt, Escherichia coli CFT073
aacagcggcauuac

SEQ ID NO: 631647 - RNA, 15 nt, Escherichia coli CFT073
aacagcguaaugcca

SEQ ID NO: 631648 - RNA, 16 nt, Escherichia coli CFT073
aacagcgugccgcgau

SEQ ID NO: 631649 - RNA, 16 nt, Escherichia coli CFT073
aacagcucgacaccaa

SEQ ID NO: 631650 - RNA, 23 nt, Escherichia coli CFT073
aacagcuugcuguuucgcugacg

SEQ ID NO: 631651 - RNA, 15 nt, Escherichia coli CFT073
aacagcuuuuuccug

SEQ ID NO: 631652 - RNA, 14 nt, Escherichia coli CFT073
aacaguaugcaaca

SEQ ID NO: 631653 - RNA, 16 nt, Escherichia coli CFT073
aacaguaugcaacaac

SEQ ID NO: 631654 - RNA, 21 nt, Escherichia coli CFT073
aacaguagacaauuuuucaua

SEQ ID NO: 631655 - RNA, 20 nt, Escherichia coli CFT073
aacagguugcggacgcgcag

SEQ ID NO: 631656 - RNA, 19 nt, Escherichia coli CFT073
aacaguaaacucgacuuuc

SEQ ID NO: 631657 - RNA, 14 nt, Escherichia coli CFT073
aacaguaacccagc

SEQ ID NO: 631658 - RNA, 19 nt, Escherichia coli CFT073
aacagggugcagcgagugc

SEQ ID NO: 631659 - RNA, 18 nt, Escherichia coli CFT073
aacaggugauaauccaga

SEQ ID NO: 631660 - RNA, 16 nt, Escherichia coli CFT073
aacaggaguagcucug

SEQ ID NO: 631661 - RNA, 19 nt, Escherichia coli CFT073
aacaggauaucugaaaguu

SEQ ID NO: 631662 - RNA, 23 nt, Escherichia coli CFT073
aacaggcgcagaacuucacucuc

SEQ ID NO: 631663 - RNA, 14 nt, Escherichia coli CFT073
aacaggagccaucu

SEQ ID NO: 631664 - RNA, 17 nt, Escherichia coli CFT073
aagccuaagaagucauu

SEQ ID NO: 631665 - RNA, 14 nt, Escherichia coli CFT073
aagccgugaaucac

SEQ ID NO: 631666 - RNA, 14 nt, Escherichia coli CFT073
aagccgugccagau

SEQ ID NO: 631667 - RNA, 13 nt, Escherichia coli CFT073
aagccgugaauca

SEQ ID NO: 631668 - RNA, 16 nt, Escherichia coli CFT073
aagccguccaccaccg

SEQ ID NO: 631669 - RNA, 16 nt, Escherichia coli CFT073
aagccgggcaggugac

SEQ ID NO: 631670 - RNA, 19 nt, Escherichia coli CFT073
aagccgguaaucaccagca

SEQ ID NO: 631671 - RNA, 16 nt, Escherichia coli CFT073
aagccggucauauugc

SEQ ID NO: 631672 - RNA, 18 nt, Escherichia coli CFT073
aagccguaaacagguuga

SEQ ID NO: 631673 - RNA, 14 nt, Escherichia coli CFT073
aagccggaggaaac

SEQ ID NO: 631674 - RNA, 17 nt, Escherichia coli CFT073
aagccggaugaucaucc

SEQ ID NO: 631675 - RNA, 21 nt, Escherichia coli CFT073
aagccggaugaucauccggcu

SEQ ID NO: 631676 - RNA, 18 nt, Escherichia coli CFT073
aagaucggagccaaaauc

SEQ ID NO: 631677 - RNA, 20 nt, Escherichia coli CFT073
aagaucaugaugaugccaaa

SEQ ID NO: 631678 - RNA, 19 nt, Escherichia coli CFT073
aagaucaugccgacaaaca

SEQ ID NO: 631679 - RNA, 17 nt, Escherichia coli CFT073
aagccuugcugaaucaa

SEQ ID NO: 631680 - RNA, 16 nt, Escherichia coli CFT073
aagccuuuuaccgccu

SEQ ID NO: 631681 - RNA, 16 nt, Escherichia coli CFT073
aagcgaaaucaacacg

SEQ ID NO: 631682 - RNA, 22 nt, Escherichia coli CFT073
aagcgagaguaauuaaacugau

SEQ ID NO: 631683 - RNA, 15 nt, Escherichia coli CFT073
aagcgauaaccuuca

SEQ ID NO: 631684 - RNA, 14 nt, Escherichia coli CFT073
aagcgaccaaccau

SEQ ID NO: 631685 - RNA, 15 nt, Escherichia coli CFT073
aagcgaccaaccauc

SEQ ID NO: 631686 - RNA, 15 nt, Escherichia coli CFT073
aagcgagaacugccu

SEQ ID NO: 631687 - RNA, 17 nt, Escherichia coli CFT073
aagccuuccgcaaacag

SEQ ID NO: 631688 - RNA, 18 nt, Escherichia coli CFT073
aagccuuacuucacauca

SEQ ID NO: 631689 - RNA, 15 nt, Escherichia coli CFT073
aagccugcaucacga

SEQ ID NO: 631690 - RNA, 19 nt, Escherichia coli CFT073
aagccucacgguucauuag

SEQ ID NO: 631691 - RNA, 23 nt, Escherichia coli CFT073
aagcgcgcagguaguuaucugcc

SEQ ID NO: 631692 - RNA, 18 nt, Escherichia coli CFT073
aagcgcggcagugacagc

SEQ ID NO: 631693 - RNA, 22 nt, Escherichia coli CFT073
aagcgcgaucaguugcucggca

SEQ ID NO: 631694 - RNA, 15 nt, Escherichia coli CFT073
aagcgccucaagcuc

SEQ ID NO: 631695 - RNA, 18 nt, Escherichia coli CFT073
aagcgccaggaaucuggu

SEQ ID NO: 631696 - RNA, 23 nt, Escherichia coli CFT073
aagcgccagauaugaucgaaaau

SEQ ID NO: 631697 - RNA, 17 nt, Escherichia coli CFT073
aagcgccgaguaaaaaa

SEQ ID NO: 631698 - RNA, 19 nt, Escherichia coli CFT073
aagcgccgaguaaaaaaac

SEQ ID NO: 631699 - RNA, 16 nt, Escherichia coli CFT073
aagcgcaucaggcaac

SEQ ID NO: 631700 - RNA, 16 nt, Escherichia coli CFT073
aagcgccaaaucugcc

SEQ ID NO: 631701 - RNA, 17 nt, Escherichia coli CFT073
aagcgcaaaggccagca

SEQ ID NO: 631702 - RNA, 15 nt, Escherichia coli CFT073
aagcggguucaguga

SEQ ID NO: 631703 - RNA, 15 nt, Escherichia coli CFT073
aagcgguguuuucag

SEQ ID NO: 631704 - RNA, 17 nt, Escherichia coli CFT073
aagcgguguuuucaggu

SEQ ID NO: 631705 - RNA, 23 nt, Escherichia coli CFT073
aagcuauuaauccauaaccauaa

SEQ ID NO: 631706 - RNA, 18 nt, Escherichia coli CFT073
aagcuauaaaaaaacggc

SEQ ID NO: 631707 - RNA, 12 nt, Escherichia coli CFT073
aagcuauaccuu

SEQ ID NO: 631708 - RNA, 12 nt, Escherichia coli CFT073
aaggcagagcca

SEQ ID NO: 631709 - RNA, 17 nt, Escherichia coli CFT073
aaggcacaacugcgacc

SEQ ID NO: 631710 - RNA, 14 nt, Escherichia coli CFT073
aaggccaauacccg

SEQ ID NO: 631711 - RNA, 15 nt, Escherichia coli CFT073
aaggccagccaggca

SEQ ID NO: 631712 - RNA, 20 nt, Escherichia coli CFT073
aaggcuauccucuaaacccc

SEQ ID NO: 631713 - RNA, 20 nt, Escherichia coli CFT073
aaggccguuuucaacaccgc

SEQ ID NO: 631714 - RNA, 17 nt, Escherichia coli CFT073
aaggccgcuuucagagc

SEQ ID NO: 631715 - RNA, 21 nt, Escherichia coli CFT073
aaggccggaaaagauguguca

SEQ ID NO: 631716 - RNA, 22 nt, Escherichia coli CFT073
aaggccgcgaaccagaccagca

SEQ ID NO: 631717 - RNA, 14 nt, Escherichia coli CFT073
aaggccgccaggca

SEQ ID NO: 631718 - RNA, 13 nt, Escherichia coli CFT073
aaggccggagcau

SEQ ID NO: 631719 - RNA, 12 nt, Escherichia coli CFT073
aaggcuucaacg

SEQ ID NO: 631720 - RNA, 13 nt, Escherichia coli CFT073
aaggcuggcgugu

SEQ ID NO: 631721 - RNA, 17 nt, Escherichia coli CFT073
aaggcugauaacgucca

SEQ ID NO: 631722 - RNA, 22 nt, Escherichia coli CFT073
aaggcugccggaccaucuucca

SEQ ID NO: 631723 - RNA, 15 nt, Escherichia coli CFT073
aaggcucucuuacca

SEQ ID NO: 631724 - RNA, 16 nt, Escherichia coli CFT073
aaggaugagaagcuuc

SEQ ID NO: 631725 - RNA, 22 nt, Escherichia coli CFT073
aaggaucgcgacaaaauacagg

SEQ ID NO: 631726 - RNA, 21 nt, Escherichia coli CFT073
aaggauauucauuaauaacca

SEQ ID NO: 631727 - RNA, 14 nt, Escherichia coli CFT073
aaggauauaaaaau

SEQ ID NO: 631728 - RNA, 19 nt, Escherichia coli CFT073
aaggauauaaaaauaacag

SEQ ID NO: 631729 - RNA, 21 nt, Escherichia coli CFT073
aaggauauggcuugaagcaau

SEQ ID NO: 631730 - RNA, 22 nt, Escherichia coli CFT073
aaggacggaauuugcugcuggc

SEQ ID NO: 631731 - RNA, 18 nt, Escherichia coli CFT073
aaggaccaaagaaugaca

SEQ ID NO: 631732 - RNA, 13 nt, Escherichia coli CFT073
aagcuugucauua

SEQ ID NO: 631733 - RNA, 23 nt, Escherichia coli CFT073
aagcuuuacaguaacguuuaaga

SEQ ID NO: 631734 - RNA, 17 nt, Escherichia coli CFT073
aagcuggaaaucaaugg

SEQ ID NO: 631735 - RNA, 17 nt, Escherichia coli CFT073
aagcuggcgaauggcgu

SEQ ID NO: 631736 - RNA, 15 nt, Escherichia coli CFT073
aaguguuguauuaua

SEQ ID NO: 631737 - RNA, 17 nt, Escherichia coli CFT073
aagugcggcgcaccagc

SEQ ID NO: 631738 - RNA, 20 nt, Escherichia coli CFT073
aagugagcgauucaaauucg

SEQ ID NO: 631739 - RNA, 13 nt, Escherichia coli CFT073
aagugcauauaca

SEQ ID NO: 631740 - RNA, 18 nt, Escherichia coli CFT073
aagugcauauacaaccaa

SEQ ID NO: 631741 - RNA, 13 nt, Escherichia coli CFT073
aaguuaaucagcg

SEQ ID NO: 631742 - RNA, 16 nt, Escherichia coli CFT073
aaguuaauccacagca

SEQ ID NO: 631743 - RNA, 13 nt, Escherichia coli CFT073
aaguucaaccuca

SEQ ID NO: 631744 - RNA, 20 nt, Escherichia coli CFT073
aaguuauuaaugacaauuac

SEQ ID NO: 631745 - RNA, 16 nt, Escherichia coli CFT073
aaguuacuaaaaguaa

SEQ ID NO: 631746 - RNA, 22 nt, Escherichia coli CFT073
aaguuacuaaaaguaaauaaga

SEQ ID NO: 631747 - RNA, 23 nt, Escherichia coli CFT073
aaguucaaguuugcuucagaaga

SEQ ID NO: 631748 - RNA, 23 nt, Escherichia coli CFT073
aaguugaagcugaacagucgcug

SEQ ID NO: 631749 - RNA, 15 nt, Escherichia coli CFT073
aagucuaaugacaaa

SEQ ID NO: 631750 - RNA, 18 nt, Escherichia coli CFT073
aagucucaagagugaaca

SEQ ID NO: 631751 - RNA, 14 nt, Escherichia coli CFT073
aagucggucacagu

SEQ ID NO: 631752 - RNA, 20 nt, Escherichia coli CFT073
aagucguaggccugauaaga

SEQ ID NO: 631753 - RNA, 16 nt, Escherichia coli CFT073
aagucggucacagucu

SEQ ID NO: 631754 - RNA, 17 nt, Escherichia coli CFT073
aagucggggagaaaguu

SEQ ID NO: 631755 - RNA, 15 nt, Escherichia coli CFT073
aagucgaacuucucu

SEQ ID NO: 631756 - RNA, 18 nt, Escherichia coli CFT073
  misc_feature (9)..(9): n is a, c, g or u
aagucucangagugaaca

SEQ ID NO: 631757 - RNA, 12 nt, Escherichia coli CFT073
aagucucagaaa

SEQ ID NO: 631758 - RNA, 16 nt, Escherichia coli CFT073
aagucucagaaaguaa

SEQ ID NO: 631759 - RNA, 12 nt, Escherichia coli CFT073
aagucuccauuu

SEQ ID NO: 631760 - RNA, 18 nt, Escherichia coli CFT073
aagucuccauuuuuuugc

SEQ ID NO: 631761 - RNA, 16 nt, Escherichia coli CFT073
aagugacacugucacc

SEQ ID NO: 631762 - RNA, 14 nt, Escherichia coli CFT073
aagugaacuuucuc

SEQ ID NO: 631763 - RNA, 15 nt, Escherichia coli CFT073
aagugaacuuucucu

SEQ ID NO: 631764 - RNA, 13 nt, Escherichia coli CFT073
aagucauugauaa

SEQ ID NO: 631765 - RNA, 21 nt, Escherichia coli CFT073
aagucauccggcgucaucuua

SEQ ID NO: 631766 - RNA, 19 nt, Escherichia coli CFT073
aagucaggcaauucuuucc

SEQ ID NO: 631767 - RNA, 19 nt, Escherichia coli CFT073
aagucccgaccacacaaag

SEQ ID NO: 631768 - RNA, 22 nt, Escherichia coli CFT073
aagucccgaccacacaaagugc

SEQ ID NO: 631769 - RNA, 20 nt, Escherichia coli CFT073
aaguagccuucaucagauga

SEQ ID NO: 631770 - RNA, 21 nt, Escherichia coli CFT073
aaguaggccguacagcccagg

SEQ ID NO: 631771 - RNA, 22 nt, Escherichia coli CFT073
aaguaggccguacagcccagga

SEQ ID NO: 631772 - RNA, 15 nt, Escherichia coli CFT073
aaguaguaaugauca

SEQ ID NO: 631773 - RNA, 23 nt, Escherichia coli CFT073
aaguaguacgcgggaauagcuca

SEQ ID NO: 631774 - RNA, 18 nt, Escherichia coli CFT073
aaguauggaaaucaccca

SEQ ID NO: 631775 - RNA, 19 nt, Escherichia coli CFT073
aagucacuaauugcagcga

SEQ ID NO: 631776 - RNA, 14 nt, Escherichia coli CFT073
aagucagauuagaa

SEQ ID NO: 631777 - RNA, 19 nt, Escherichia coli CFT073
aagucagauuagaacugau

SEQ ID NO: 631778 - RNA, 20 nt, Escherichia coli CFT073
aagucagauuagaacugaua

SEQ ID NO: 631779 - RNA, 19 nt, Escherichia coli CFT073
aagucacccgauaaauaau

SEQ ID NO: 631780 - RNA, 22 nt, Escherichia coli CFT073
aagucaccgcuuuuuucaucuc

SEQ ID NO: 631781 - RNA, 13 nt, Escherichia coli CFT073
aagucaaacugau

SEQ ID NO: 631782 - RNA, 14 nt, Escherichia coli CFT073
aagucaaacugaua

SEQ ID NO: 631783 - RNA, 21 nt, Escherichia coli CFT073
aaguaccaucguccagcagca

SEQ ID NO: 631784 - RNA, 20 nt, Escherichia coli CFT073
aaguaccaucguccagcagc

SEQ ID NO: 631785 - RNA, 14 nt, Escherichia coli CFT073
aaguacuaaauaau

SEQ ID NO: 631786 - RNA, 21 nt, Escherichia coli CFT073
aaguacgauacaaaagcaccg

SEQ ID NO: 631787 - RNA, 20 nt, Escherichia coli CFT073
aaguagagcgaaacgaaagu

SEQ ID NO: 631788 - RNA, 14 nt, Escherichia coli CFT073
aagggcuaacgugc

SEQ ID NO: 631789 - RNA, 14 nt, Escherichia coli CFT073
aaggcuuuggauug

SEQ ID NO: 631790 - RNA, 14 nt, Escherichia coli CFT073
aagguuuuuuccuu

SEQ ID NO: 631791 - RNA, 17 nt, Escherichia coli CFT073
aaguaaacaaacaugaa

SEQ ID NO: 631792 - RNA, 14 nt, Escherichia coli CFT073
aaguaaacccggca

SEQ ID NO: 631793 - RNA, 15 nt, Escherichia coli CFT073
aaguaaacccggcau

SEQ ID NO: 631794 - RNA, 22 nt, Escherichia coli CFT073
aaguaaaacgguggccacagca

SEQ ID NO: 631795 - RNA, 15 nt, Escherichia coli CFT073
aauacccaaaaaaua

SEQ ID NO: 631796 - RNA, 19 nt, Escherichia coli CFT073
aauacccagacuuuucaga

SEQ ID NO: 631797 - RNA, 20 nt, Escherichia coli CFT073
aauacccagacuuuucagau

SEQ ID NO: 631798 - RNA, 20 nt, Escherichia coli CFT073
aauaccccagcggcaaccag

SEQ ID NO: 631799 - RNA, 23 nt, Escherichia coli CFT073
aauaccccagcggcaaccagcag

SEQ ID NO: 631800 - RNA, 15 nt, Escherichia coli CFT073
aauaccccugccgcc

SEQ ID NO: 631801 - RNA, 22 nt, Escherichia coli CFT073
aauaccguucauuaacgcccca

SEQ ID NO: 631802 - RNA, 19 nt, Escherichia coli CFT073
aauaccaucggcagcgcca

SEQ ID NO: 631803 - RNA, 18 nt, Escherichia coli CFT073
aauaccaucggcagcgcc

SEQ ID NO: 631804 - RNA, 17 nt, Escherichia coli CFT073
aaaaaugagcgaacaau

SEQ ID NO: 631805 - RNA, 19 nt, Escherichia coli CFT073
aaaaaugaugauugaccau

SEQ ID NO: 631806 - RNA, 21 nt, Escherichia coli CFT073
aaaaaugcgcggucagaaaau

SEQ ID NO: 631807 - RNA, 15 nt, Escherichia coli CFT073
aauacagcaauggaa

SEQ ID NO: 631808 - RNA, 16 nt, Escherichia coli CFT073
aauacagcaauggaaa

SEQ ID NO: 631809 - RNA, 19 nt, Escherichia coli CFT073
aauaccaauaaucaauuua

SEQ ID NO: 631810 - RNA, 14 nt, Escherichia coli CFT073
aauaccaagcagac

SEQ ID NO: 631811 - RNA, 19 nt, Escherichia coli CFT073
aauaccaagccaagccaga

SEQ ID NO: 631812 - RNA, 13 nt, Escherichia coli CFT073
aauaccaaaaaua

SEQ ID NO: 631813 - RNA, 16 nt, Escherichia coli CFT073
aauaccagcccuggcu

SEQ ID NO: 631814 - RNA, 12 nt, Escherichia coli CFT073
aauaccagccuu

SEQ ID NO: 631815 - RNA, 17 nt, Escherichia coli CFT073
aauaccagccuucuuca

SEQ ID NO: 631816 - RNA, 22 nt, Escherichia coli CFT073
aauaccacccuugcccaccagc

SEQ ID NO: 631817 - RNA, 14 nt, Escherichia coli CFT073
aauaccaaugaauu

SEQ ID NO: 631818 - RNA, 21 nt, Escherichia coli CFT073
aauaauggccuuuucgccacc

SEQ ID NO: 631819 - RNA, 20 nt, Escherichia coli CFT073
aauaaugcuucuguugcuuu

SEQ ID NO: 631820 - RNA, 24 nt, Escherichia coli CFT073
aauaaugccguugaucagcgcaau

SEQ ID NO: 631821 - RNA, 22 nt, Escherichia coli CFT073
aauaaugccagucccgcgacaa

SEQ ID NO: 631822 - RNA, 13 nt, Escherichia coli CFT073
aauaaugcaaaaa

SEQ ID NO: 631823 - RNA, 14 nt, Escherichia coli CFT073
aauaaugaccaucg

SEQ ID NO: 631824 - RNA, 16 nt, Escherichia coli CFT073
aauaauaacucgcagc

SEQ ID NO: 631825 - RNA, 15 nt, Escherichia coli CFT073
aaaaauagaacugaa

SEQ ID NO: 631826 - RNA, 19 nt, Escherichia coli CFT073
aaaaaucgacaaaaucaga

SEQ ID NO: 631827 - RNA, 18 nt, Escherichia coli CFT073
aaaaaucgacagcaggau

SEQ ID NO: 631828 - RNA, 20 nt, Escherichia coli CFT073
aauaacccguuguaaaugcu

SEQ ID NO: 631829 - RNA, 15 nt, Escherichia coli CFT073
aauaaccacuucuuc

SEQ ID NO: 631830 - RNA, 24 nt, Escherichia coli CFT073
aauaaccagcguuuccagcaccag

SEQ ID NO: 631831 - RNA, 17 nt, Escherichia coli CFT073
aauaaccauuaaauagu

SEQ ID NO: 631832 - RNA, 13 nt, Escherichia coli CFT073
aauaagaaaaagg

SEQ ID NO: 631833 - RNA, 20 nt, Escherichia coli CFT073
aauaagagauccaggccaga

SEQ ID NO: 631834 - RNA, 22 nt, Escherichia coli CFT073
aauaagagauccaggccagaua

SEQ ID NO: 631835 - RNA, 15 nt, Escherichia coli CFT073
aauaaaugcuugacu

SEQ ID NO: 631836 - RNA, 20 nt, Escherichia coli CFT073
aauaaaugcuugacucugug

SEQ ID NO: 631837 - RNA, 17 nt, Escherichia coli CFT073
aaguugauugccagcag

SEQ ID NO: 631838 - RNA, 16 nt, Escherichia coli CFT073
aaguuguaauuccuga

SEQ ID NO: 631839 - RNA, 16 nt, Escherichia coli CFT073
aaguugaucgcccaug

SEQ ID NO: 631840 - RNA, 20 nt, Escherichia coli CFT073
aauaauaaguaaacaaacau

SEQ ID NO: 631841 - RNA, 14 nt, Escherichia coli CFT073
aauaauaauaagua

SEQ ID NO: 631842 - RNA, 23 nt, Escherichia coli CFT073
aauaaguuuuuugcgaaaaauaa

SEQ ID NO: 631843 - RNA, 11 nt, Escherichia coli CFT073
aaaaauaaaag

SEQ ID NO: 631844 - RNA, 12 nt, Escherichia coli CFT073
aaaaauaaaugc

SEQ ID NO: 631845 - RNA, 21 nt, Escherichia coli CFT073
aauaagcuguucagauacacc

SEQ ID NO: 631846 - RNA, 17 nt, Escherichia coli CFT073
aauaagcgcccagcucu

SEQ ID NO: 631847 - RNA, 19 nt, Escherichia coli CFT073
aauaagcgcccauaaagau

SEQ ID NO: 631848 - RNA, 14 nt, Escherichia coli CFT073
aauaagcccggccu

SEQ ID NO: 631849 - RNA, 16 nt, Escherichia coli CFT073
aauaagcacaaagcaa

SEQ ID NO: 631850 - RNA, 18 nt, Escherichia coli CFT073
aauaucgccucuauucga

SEQ ID NO: 631851 - RNA, 18 nt, Escherichia coli CFT073
aauaucgcggcacagaaa

SEQ ID NO: 631852 - RNA, 19 nt, Escherichia coli CFT073
aauaucgcggcacagaaac

SEQ ID NO: 631853 - RNA, 16 nt, Escherichia coli CFT073
aauaucgacauucaau

SEQ ID NO: 631854 - RNA, 23 nt, Escherichia coli CFT073
aauaucgaauggcguuaacaaua

SEQ ID NO: 631855 - RNA, 15 nt, Escherichia coli CFT073
aauaucgauaucgua

SEQ ID NO: 631856 - RNA, 22 nt, Escherichia coli CFT073
aauaucguauccgguuuuccag

SEQ ID NO: 631857 - RNA, 17 nt, Escherichia coli CFT073
aauaucugcaccauuag

SEQ ID NO: 631858 - RNA, 19 nt, Escherichia coli CFT073
aauaucugccggaagacac

SEQ ID NO: 631859 - RNA, 19 nt, Escherichia coli CFT073
aauaucuuuaucugccagc

SEQ ID NO: 631860 - RNA, 20 nt, Escherichia coli CFT073
aauaucuuuccuuaacaaaa

SEQ ID NO: 631861 - RNA, 14 nt, Escherichia coli CFT073
aauaugaaaauggu

SEQ ID NO: 631862 - RNA, 22 nt, Escherichia coli CFT073
aauauccagcagguuuugacga

SEQ ID NO: 631863 - RNA, 20 nt, Escherichia coli CFT073
aauaucauucgguugccagc

SEQ ID NO: 631864 - RNA, 16 nt, Escherichia coli CFT073
aauauccgguuucuga

SEQ ID NO: 631865 - RNA, 15 nt, Escherichia coli CFT073
aauauccuguucaga

SEQ ID NO: 631866 - RNA, 22 nt, Escherichia coli CFT073
aauaucagcccaaaaauugccc

SEQ ID NO: 631867 - RNA, 11 nt, Escherichia coli CFT073
aauaucaacaa

SEQ ID NO: 631868 - RNA, 16 nt, Escherichia coli CFT073
aauauauucauauuuu

SEQ ID NO: 631869 - RNA, 21 nt, Escherichia coli CFT073
aauauauuccuauauauuuag

SEQ ID NO: 631870 - RNA, 14 nt, Escherichia coli CFT073
aauauagucgccca

SEQ ID NO: 631871 - RNA, 19 nt, Escherichia coli CFT073
aauauaaguacuaaauaau

SEQ ID NO: 631872 - RNA, 13 nt, Escherichia coli CFT073
aauagcucugcua

SEQ ID NO: 631873 - RNA, 13 nt, Escherichia coli CFT073
aauagcucaauga

SEQ ID NO: 631874 - RNA, 20 nt, Escherichia coli CFT073
aauagcgucuacuaacgcuu

SEQ ID NO: 631875 - RNA, 16 nt, Escherichia coli CFT073
aauagcguugcagaug

SEQ ID NO: 631876 - RNA, 20 nt, Escherichia coli CFT073
aauagcgaacagacaaaaag

SEQ ID NO: 631877 - RNA, 14 nt, Escherichia coli CFT073
aauagcaauguuuu

SEQ ID NO: 631878 - RNA, 18 nt, Escherichia coli CFT073
aauagcgcagcggucgcu

SEQ ID NO: 631879 - RNA, 14 nt, Escherichia coli CFT073
aauagcgaagaaua

SEQ ID NO: 631880 - RNA, 23 nt, Escherichia coli CFT073
aauagauauagccuaacacagca

SEQ ID NO: 631881 - RNA, 13 nt, Escherichia coli CFT073
aauagacugcacu

SEQ ID NO: 631882 - RNA, 14 nt, Escherichia coli CFT073
aauagauauucauc

SEQ ID NO: 631883 - RNA, 22 nt, Escherichia coli CFT073
aauagaucgccagaaaguggca

SEQ ID NO: 631884 - RNA, 15 nt, Escherichia coli CFT073
aauagauuuucagaa

SEQ ID NO: 631885 - RNA, 14 nt, Escherichia coli CFT073
aauaccuucuuccu

SEQ ID NO: 631886 - RNA, 16 nt, Escherichia coli CFT073
aauaccugacgcaacu

SEQ ID NO: 631887 - RNA, 17 nt, Escherichia coli CFT073
aauaccugacgcaacug

SEQ ID NO: 631888 - RNA, 22 nt, Escherichia coli CFT073
aauaccugacgcaacugcgcuu

SEQ ID NO: 631889 - RNA, 14 nt, Escherichia coli CFT073
aauaccugcaccaa

SEQ ID NO: 631890 - RNA, 14 nt, Escherichia coli CFT073
aauaccugaaacuc

SEQ ID NO: 631891 - RNA, 24 nt, Escherichia coli CFT073
aauaccguucucuuuauaaaguaa

SEQ ID NO: 631892 - RNA, 21 nt, Escherichia coli CFT073
aauaguuucaaugccuuucuu

SEQ ID NO: 631893 - RNA, 18 nt, Escherichia coli CFT073
aauauaaagaaugaaauu

SEQ ID NO: 631894 - RNA, 20 nt, Escherichia coli CFT073
aauaguuacgaaaaggauaa

SEQ ID NO: 631895 - RNA, 18 nt, Escherichia coli CFT073
aauagucgccagcucugc

SEQ ID NO: 631896 - RNA, 20 nt, Escherichia coli CFT073
aauagucgccagcucugcgc

SEQ ID NO: 631897 - RNA, 21 nt, Escherichia coli CFT073
aauagugacagauuugauuau

SEQ ID NO: 631898 - RNA, 20 nt, Escherichia coli CFT073
aauaguagguuguacccaac

SEQ ID NO: 631899 - RNA, 18 nt, Escherichia coli CFT073
aauagucaguauuuuccc

SEQ ID NO: 631900 - RNA, 12 nt, Escherichia coli CFT073
aauagucaguuc

SEQ ID NO: 631901 - RNA, 18 nt, Escherichia coli CFT073
aauaguaagaaccacagc

SEQ ID NO: 631902 - RNA, 20 nt, Escherichia coli CFT073
aauaguacacagacgaaggu

SEQ ID NO: 631903 - RNA, 12 nt, Escherichia coli CFT073
aauagcuuuaac

SEQ ID NO: 631904 - RNA, 13 nt, Escherichia coli CFT073
aauagcuuuaccc

SEQ ID NO: 631905 - RNA, 23 nt, Escherichia coli CFT073
accaccuuacuuacacaucauga

SEQ ID NO: 631906 - RNA, 15 nt, Escherichia coli CFT073
accaccuccacgccc

SEQ ID NO: 631907 - RNA, 21 nt, Escherichia coli CFT073
accaccuccacgcccagcgca

SEQ ID NO: 631908 - RNA, 14 nt, Escherichia coli CFT073
accaccgcccgguu

SEQ ID NO: 631909 - RNA, 12 nt, Escherichia coli CFT073
accacccagcgg

SEQ ID NO: 631910 - RNA, 13 nt, Escherichia coli CFT073
accacccauggaa

SEQ ID NO: 631911 - RNA, 23 nt, Escherichia coli CFT073
accacccgcggcgaucugcaccu

SEQ ID NO: 631912 - RNA, 18 nt, Escherichia coli CFT073
accaccgaagaucaccac

SEQ ID NO: 631913 - RNA, 20 nt, Escherichia coli CFT073
accaccgaagaucaccaccg

SEQ ID NO: 631914 - RNA, 20 nt, Escherichia coli CFT073
accacccuugcccaccagcc

SEQ ID NO: 631915 - RNA, 17 nt, Escherichia coli CFT073
accaccgauaaaauaau

SEQ ID NO: 631916 - RNA, 20 nt, Escherichia coli CFT073
accaccgcaucggcaucaaa

SEQ ID NO: 631917 - RNA, 19 nt, Escherichia coli CFT073
accaccaguaaauuguugc

SEQ ID NO: 631918 - RNA, 18 nt, Escherichia coli CFT073
accaccagcggaauauca

SEQ ID NO: 631919 - RNA, 22 nt, Escherichia coli CFT073
accaccagcgacagccagccca

SEQ ID NO: 631920 - RNA, 13 nt, Escherichia coli CFT073
accaccagcgcac

SEQ ID NO: 631921 - RNA, 16 nt, Escherichia coli CFT073
accaccagcgccacca

SEQ ID NO: 631922 - RNA, 15 nt, Escherichia coli CFT073
accaccagcagcugc

SEQ ID NO: 631923 - RNA, 15 nt, Escherichia coli CFT073
accaccagcaccgcg

SEQ ID NO: 631924 - RNA, 17 nt, Escherichia coli CFT073
accaccaucaaaugcgc

SEQ ID NO: 631925 - RNA, 23 nt, Escherichia coli CFT073
accaccaucguccccgcgacaga

SEQ ID NO: 631926 - RNA, 20 nt, Escherichia coli CFT073
accaccaugcuaauagcugc

SEQ ID NO: 631927 - RNA, 13 nt, Escherichia coli CFT073
accacccagaaca

SEQ ID NO: 631928 - RNA, 22 nt, Escherichia coli CFT073
accacuuuaucggcacccaucg

SEQ ID NO: 631929 - RNA, 19 nt, Escherichia coli CFT073
accacuucauugguuuuca

SEQ ID NO: 631930 - RNA, 20 nt, Escherichia coli CFT073
accacuuccacguuccccag

SEQ ID NO: 631931 - RNA, 15 nt, Escherichia coli CFT073
accacuuccagcaga

SEQ ID NO: 631932 - RNA, 20 nt, Escherichia coli CFT073
accacuuccagcagaccagc

SEQ ID NO: 631933 - RNA, 14 nt, Escherichia coli CFT073
accacuuccugcuc

SEQ ID NO: 631934 - RNA, 14 nt, Escherichia coli CFT073
accacuucuucuug

SEQ ID NO: 631935 - RNA, 21 nt, Escherichia coli CFT073
accacuaucaaccacggcaac

SEQ ID NO: 631936 - RNA, 20 nt, Escherichia coli CFT073
accacuaucgccuuucgcuu

SEQ ID NO: 631937 - RNA, 23 nt, Escherichia coli CFT073
accacucaaaagcguaccgccaa

SEQ ID NO: 631938 - RNA, 17 nt, Escherichia coli CFT073
accacuaccgugucugc

SEQ ID NO: 631939 - RNA, 11 nt, Escherichia coli CFT073
accacuaauuc

SEQ ID NO: 631940 - RNA, 14 nt, Escherichia coli CFT073
accacuccggcaug

SEQ ID NO: 631941 - RNA, 22 nt, Escherichia coli CFT073
accacugacacaggcagcaauc

SEQ ID NO: 631942 - RNA, 22 nt, Escherichia coli CFT073
accacugcgacgcggcgguucu

SEQ ID NO: 631943 - RNA, 14 nt, Escherichia coli CFT073
accacggccagucc

SEQ ID NO: 631944 - RNA, 22 nt, Escherichia coli CFT073
accacggccauauccagccaac

SEQ ID NO: 631945 - RNA, 19 nt, Escherichia coli CFT073
accacgcugcgcugcacca

SEQ ID NO: 631946 - RNA, 20 nt, Escherichia coli CFT073
accacggaguugaccagcuc

SEQ ID NO: 631947 - RNA, 13 nt, Escherichia coli CFT073
accacgcacagcc

SEQ ID NO: 631948 - RNA, 15 nt, Escherichia coli CFT073
accacgcacagcccg

SEQ ID NO: 631949 - RNA, 17 nt, Escherichia coli CFT073
accacgcaggcguaaau

SEQ ID NO: 631950 - RNA, 17 nt, Escherichia coli CFT073
accacgccaagaaacac

SEQ ID NO: 631951 - RNA, 13 nt, Escherichia coli CFT073
accacgccagccg

SEQ ID NO: 631952 - RNA, 21 nt, Escherichia coli CFT073
accaagcccgaugaucaucau

SEQ ID NO: 631953 - RNA, 17 nt, Escherichia coli CFT073
accaaccuuucaucugu

SEQ ID NO: 631954 - RNA, 15 nt, Escherichia coli CFT073
accaacggcgagcca

SEQ ID NO: 631955 - RNA, 17 nt, Escherichia coli CFT073
accaaucggcagaacgg

SEQ ID NO: 631956 - RNA, 22 nt, Escherichia coli CFT073
accaaucugcucuggcagcacc

SEQ ID NO: 631957 - RNA, 23 nt, Escherichia coli CFT073
accaaucugcucuggcagcacca

SEQ ID NO: 631958 - RNA, 12 nt, Escherichia coli CFT073
accaaugacuau

SEQ ID NO: 631959 - RNA, 19 nt, Escherichia coli CFT073
accaaugauaaguuucacu

SEQ ID NO: 631960 - RNA, 15 nt, Escherichia coli CFT073
accaaugacggccag

SEQ ID NO: 631961 - RNA, 12 nt, Escherichia coli CFT073
accaaugcccaa

SEQ ID NO: 631962 - RNA, 16 nt, Escherichia coli CFT073
accaauaucaaucuuc

SEQ ID NO: 631963 - RNA, 20 nt, Escherichia coli CFT073
accaaucagguaagcgaagg

SEQ ID NO: 631964 - RNA, 20 nt, Escherichia coli CFT073
accaaucaauucucgccagu

SEQ ID NO: 631965 - RNA, 16 nt, Escherichia coli CFT073
accaauaaguaagcau

SEQ ID NO: 631966 - RNA, 12 nt, Escherichia coli CFT073
accaauaauccc

SEQ ID NO: 631967 - RNA, 18 nt, Escherichia coli CFT073
accacagugacccgcagc

SEQ ID NO: 631968 - RNA, 12 nt, Escherichia coli CFT073
accacaguucaa

SEQ ID NO: 631969 - RNA, 14 nt, Escherichia coli CFT073
accacauacauaau

SEQ ID NO: 631970 - RNA, 23 nt, Escherichia coli CFT073
accaccaaauaaaaaaacgccag

SEQ ID NO: 631971 - RNA, 22 nt, Escherichia coli CFT073
accaauugccgcaccaaccauc

SEQ ID NO: 631972 - RNA, 21 nt, Escherichia coli CFT073
accaauucaaugccccacaga

SEQ ID NO: 631973 - RNA, 13 nt, Escherichia coli CFT073
accaauggcuuuu

SEQ ID NO: 631974 - RNA, 21 nt, Escherichia coli CFT073
accaauggugagaguuuguuu

SEQ ID NO: 631975 - RNA, 23 nt, Escherichia coli CFT073
accaauguggaaagccccagccc

SEQ ID NO: 631976 - RNA, 22 nt, Escherichia coli CFT073
accaauguuacgaccuuccuga

SEQ ID NO: 631977 - RNA, 19 nt, Escherichia coli CFT073
accaauguugucgcagacg

SEQ ID NO: 631978 - RNA, 15 nt, Escherichia coli CFT073
accaauuaaauaucc

SEQ ID NO: 631979 - RNA, 17 nt, Escherichia coli CFT073
accaauuacacacaaca

SEQ ID NO: 631980 - RNA, 14 nt, Escherichia coli CFT073
accacaaccucagc

SEQ ID NO: 631981 - RNA, 16 nt, Escherichia coli CFT073
accacaccagaccaga

SEQ ID NO: 631982 - RNA, 13 nt, Escherichia coli CFT073
accacaaaccagc

SEQ ID NO: 631983 - RNA, 13 nt, Escherichia coli CFT073
accacaacauucc

SEQ ID NO: 631984 - RNA, 20 nt, Escherichia coli CFT073
acaucgcccucuuucaccag

SEQ ID NO: 631985 - RNA, 22 nt, Escherichia coli CFT073
acaucgcccucuuucaccagau

SEQ ID NO: 631986 - RNA, 19 nt, Escherichia coli CFT073
acaucuuuacaucauucaa

SEQ ID NO: 631987 - RNA, 18 nt, Escherichia coli CFT073
acaucgcagggaucaucc

SEQ ID NO: 631988 - RNA, 13 nt, Escherichia coli CFT073
acaucgcauucgg

SEQ ID NO: 631989 - RNA, 19 nt, Escherichia coli CFT073
acaucgacucaagcguugc

SEQ ID NO: 631990 - RNA, 19 nt, Escherichia coli CFT073
acauccuuuucaccuucaa

SEQ ID NO: 631991 - RNA, 22 nt, Escherichia coli CFT073
acauccuuuucaccuucaaaau

SEQ ID NO: 631992 - RNA, 17 nt, Escherichia coli CFT073
acauggcgaaaaaccua

SEQ ID NO: 631993 - RNA, 13 nt, Escherichia coli CFT073
acauggcaucccc

SEQ ID NO: 631994 - RNA, 19 nt, Escherichia coli CFT073
acauguguucccuguaggu

SEQ ID NO: 631995 - RNA, 11 nt, Escherichia coli CFT073
acaugcugcuu

SEQ ID NO: 631996 - RNA, 16 nt, Escherichia coli CFT073
acaugcuggaaccaca

SEQ ID NO: 631997 - RNA, 14 nt, Escherichia coli CFT073
acaugccacuggcu

SEQ ID NO: 631998 - RNA, 15 nt, Escherichia coli CFT073
acaugauguggaucg

SEQ ID NO: 631999 - RNA, 19 nt, Escherichia coli CFT073
acauuucacguucacguaa

SEQ ID NO: 632000 - RNA, 14 nt, Escherichia coli CFT073
acauuggugccgga

SEQ ID NO: 632001 - RNA, 21 nt, Escherichia coli CFT073
acauugcgccucaccggauaa

SEQ ID NO: 632002 - RNA, 13 nt, Escherichia coli CFT073
acauugcugcuga

SEQ ID NO: 632003 - RNA, 20 nt, Escherichia coli CFT073
acauugccguaauggucugc

SEQ ID NO: 632004 - RNA, 21 nt, Escherichia coli CFT073
acauucggucgaaauaucacu

SEQ ID NO: 632005 - RNA, 17 nt, Escherichia coli CFT073
acauucggcguuaacaa

SEQ ID NO: 632006 - RNA, 18 nt, Escherichia coli CFT073
acauucggcguuaacaau

SEQ ID NO: 632007 - RNA, 16 nt, Escherichia coli CFT073
acauuaaguaacaaua

SEQ ID NO: 632008 - RNA, 21 nt, Escherichia coli CFT073
acauuaucaccgacaaacagc

SEQ ID NO: 632009 - RNA, 18 nt, Escherichia coli CFT073
acauuaagaggcauuuuu

SEQ ID NO: 632010 - RNA, 16 nt, Escherichia coli CFT073
acauguuuuccagcac

SEQ ID NO: 632011 - RNA, 17 nt, Escherichia coli CFT073
acauguuuuccagcaca

SEQ ID NO: 632012 - RNA, 14 nt, Escherichia coli CFT073
acauuaaagcuuua

SEQ ID NO: 632013 - RNA, 14 nt, Escherichia coli CFT073
acauuccagaugcg

SEQ ID NO: 632014 - RNA, 23 nt, Escherichia coli CFT073
acauuccaggcccgcguggauaa

SEQ ID NO: 632015 - RNA, 12 nt, Escherichia coli CFT073
acauucaaugau

SEQ ID NO: 632016 - RNA, 23 nt, Escherichia coli CFT073
acauucaaugauuuaagguuaug

SEQ ID NO: 632017 - RNA, 23 nt, Escherichia coli CFT073
acauaccuaaaagcacgccagac

SEQ ID NO: 632018 - RNA, 16 nt, Escherichia coli CFT073
acauacggcauuuucc

SEQ ID NO: 632019 - RNA, 23 nt, Escherichia coli CFT073
acauacucagcgccugcugcaca

SEQ ID NO: 632020 - RNA, 18 nt, Escherichia coli CFT073
acauacugagaaccuuua

SEQ ID NO: 632021 - RNA, 18 nt, Escherichia coli CFT073
acauagaucuaaaugcca

SEQ ID NO: 632022 - RNA, 22 nt, Escherichia coli CFT073
acauacuguaaauaguauuauu

SEQ ID NO: 632023 - RNA, 21 nt, Escherichia coli CFT073
acauacuuaaauaaugcuucu

SEQ ID NO: 632024 - RNA, 17 nt, Escherichia coli CFT073
acauacugcuugccauu

SEQ ID NO: 632025 - RNA, 19 nt, Escherichia coli CFT073
acauagccacucaccgccg

SEQ ID NO: 632026 - RNA, 16 nt, Escherichia coli CFT073
acauagcacauaaaau

SEQ ID NO: 632027 - RNA, 16 nt, Escherichia coli CFT073
acauagcgugacacca

SEQ ID NO: 632028 - RNA, 19 nt, Escherichia coli CFT073
acauagggaaacuccagcc

SEQ ID NO: 632029 - RNA, 16 nt, Escherichia coli CFT073
acaggcagcuuagaaa

SEQ ID NO: 632030 - RNA, 17 nt, Escherichia coli CFT073
acaggcacuugucacca

SEQ ID NO: 632031 - RNA, 20 nt, Escherichia coli CFT073
acaggcagcaaucacugcca

SEQ ID NO: 632032 - RNA, 20 nt, Escherichia coli CFT073
acaggcaagcauaugacgaa

SEQ ID NO: 632033 - RNA, 13 nt, Escherichia coli CFT073
acaggcaguaaua

SEQ ID NO: 632034 - RNA, 20 nt, Escherichia coli CFT073
acaggcagcuuagaaaggaa

SEQ ID NO: 632035 - RNA, 23 nt, Escherichia coli CFT073
acaggcagcuuagaaaggaacaa

SEQ ID NO: 632036 - RNA, 18 nt, Escherichia coli CFT073
acaggcaauuuugcguuu

SEQ ID NO: 632037 - RNA, 22 nt, Escherichia coli CFT073
acaggccaucacauccugauag

SEQ ID NO: 632038 - RNA, 17 nt, Escherichia coli CFT073
acauacaaaucgugcau

SEQ ID NO: 632039 - RNA, 23 nt, Escherichia coli CFT073
acauacauguauaaaaagaagau

SEQ ID NO: 632040 - RNA, 13 nt, Escherichia coli CFT073
acauaccagcagg

SEQ ID NO: 632041 - RNA, 21 nt, Escherichia coli CFT073
acauacccacgaaaucuucca

SEQ ID NO: 632042 - RNA, 22 nt, Escherichia coli CFT073
acauaauugaccagaucuucau

SEQ ID NO: 632043 - RNA, 16 nt, Escherichia coli CFT073
acauacaaauagccaa

SEQ ID NO: 632044 - RNA, 18 nt, Escherichia coli CFT073
acauauugcagcuucuuc

SEQ ID NO: 632045 - RNA, 23 nt, Escherichia coli CFT073
acauauugcagcuucuucuccag

SEQ ID NO: 632046 - RNA, 14 nt, Escherichia coli CFT073
acauauugcagcuu

SEQ ID NO: 632047 - RNA, 20 nt, Escherichia coli CFT073
acauauguuuaaccggcagc

SEQ ID NO: 632048 - RNA, 22 nt, Escherichia coli CFT073
acauauucgacacauucagaau

SEQ ID NO: 632049 - RNA, 18 nt, Escherichia coli CFT073
acauauccaucguugaau

SEQ ID NO: 632050 - RNA, 19 nt, Escherichia coli CFT073
acauauauuacucauuaau

SEQ ID NO: 632051 - RNA, 13 nt, Escherichia coli CFT073
acauaucaugaaa

SEQ ID NO: 632052 - RNA, 13 nt, Escherichia coli CFT073
acauauagccaaa

SEQ ID NO: 632053 - RNA, 16 nt, Escherichia coli CFT073
acauauagccaaaacu

SEQ ID NO: 632054 - RNA, 20 nt, Escherichia coli CFT073
acauauaaccggcaacagaa

SEQ ID NO: 632055 - RNA, 15 nt, Escherichia coli CFT073
acaucagcgcaccau

SEQ ID NO: 632056 - RNA, 18 nt, Escherichia coli CFT073
acaucagauaaucgccau

SEQ ID NO: 632057 - RNA, 22 nt, Escherichia coli CFT073
acaucagauaaucgccauccug

SEQ ID NO: 632058 - RNA, 16 nt, Escherichia coli CFT073
acaucaggcaaaguca

SEQ ID NO: 632059 - RNA, 17 nt, Escherichia coli CFT073
acaucaggcccacuaca

SEQ ID NO: 632060 - RNA, 12 nt, Escherichia coli CFT073
acaucaggcuga

SEQ ID NO: 632061 - RNA, 16 nt, Escherichia coli CFT073
acaucaucaaagccaa

SEQ ID NO: 632062 - RNA, 23 nt, Escherichia coli CFT073
acauccaugcacugcaacgccuu

SEQ ID NO: 632063 - RNA, 21 nt, Escherichia coli CFT073
acauccagccgucgaagcccc

SEQ ID NO: 632064 - RNA, 14 nt, Escherichia coli CFT073
acaucaacccgccc

SEQ ID NO: 632065 - RNA, 19 nt, Escherichia coli CFT073
acaucaaaucacagcaccu

SEQ ID NO: 632066 - RNA, 19 nt, Escherichia coli CFT073
acaucacucacgacacaua

SEQ ID NO: 632067 - RNA, 14 nt, Escherichia coli CFT073
acaucaaaauuacc

SEQ ID NO: 632068 - RNA, 13 nt, Escherichia coli CFT073
acaucaaacaggc

SEQ ID NO: 632069 - RNA, 19 nt, Escherichia coli CFT073
acauauuuuuguugaaaua

SEQ ID NO: 632070 - RNA, 14 nt, Escherichia coli CFT073
acaggauauauuuc

SEQ ID NO: 632071 - RNA, 21 nt, Escherichia coli CFT073
acaggauauauuucaucaacu

SEQ ID NO: 632072 - RNA, 18 nt, Escherichia coli CFT073
acagcuggaguagauaau

SEQ ID NO: 632073 - RNA, 22 nt, Escherichia coli CFT073
acagcgcgaggguaaacaacau

SEQ ID NO: 632074 - RNA, 22 nt, Escherichia coli CFT073
acagcccuuugauuugucugcc

SEQ ID NO: 632075 - RNA, 15 nt, Escherichia coli CFT073
acagcgcgcugacau

SEQ ID NO: 632076 - RNA, 13 nt, Escherichia coli CFT073
acagcggagcaag

SEQ ID NO: 632077 - RNA, 16 nt, Escherichia coli CFT073
acagccaugccgccac

SEQ ID NO: 632078 - RNA, 19 nt, Escherichia coli CFT073
acagcccaugacaggcaga

SEQ ID NO: 632079 - RNA, 14 nt, Escherichia coli CFT073
acagccccaccagc

SEQ ID NO: 632080 - RNA, 18 nt, Escherichia coli CFT073
acagcccgccggaaagca

SEQ ID NO: 632081 - RNA, 20 nt, Escherichia coli CFT073
acagauaggcaucagcaauu

SEQ ID NO: 632082 - RNA, 18 nt, Escherichia coli CFT073
acagaugaaugaaaacga

SEQ ID NO: 632083 - RNA, 19 nt, Escherichia coli CFT073
acagaugaaugaaaacgaa

SEQ ID NO: 632084 - RNA, 22 nt, Escherichia coli CFT073
acagaugcgacggcaccacauu

SEQ ID NO: 632085 - RNA, 15 nt, Escherichia coli CFT073
acagaguauaaaaaa

SEQ ID NO: 632086 - RNA, 15 nt, Escherichia coli CFT073
acagauaaaucaaua

SEQ ID NO: 632087 - RNA, 14 nt, Escherichia coli CFT073
acagauaaaucauc

SEQ ID NO: 632088 - RNA, 13 nt, Escherichia coli CFT073
acagagugguggg

SEQ ID NO: 632089 - RNA, 17 nt, Escherichia coli CFT073
acagagaacacccagaa

SEQ ID NO: 632090 - RNA, 20 nt, Escherichia coli CFT073
acagagaacaucaauccaaa

SEQ ID NO: 632091 - RNA, 13 nt, Escherichia coli CFT073
acagcauaccuuc

SEQ ID NO: 632092 - RNA, 22 nt, Escherichia coli CFT073
acagcauaccuucacaaaaugc

SEQ ID NO: 632093 - RNA, 22 nt, Escherichia coli CFT073
acagcauaucgcgugcacuaca

SEQ ID NO: 632094 - RNA, 13 nt, Escherichia coli CFT073
acagcaccgcccg

SEQ ID NO: 632095 - RNA, 14 nt, Escherichia coli CFT073
acagcaccgcccgu

SEQ ID NO: 632096 - RNA, 21 nt, Escherichia coli CFT073
acagcaccguuaauccacgcu

SEQ ID NO: 632097 - RNA, 20 nt, Escherichia coli CFT073
acagcacggcagcaacagca

SEQ ID NO: 632098 - RNA, 16 nt, Escherichia coli CFT073
acagcagaacgaccag

SEQ ID NO: 632099 - RNA, 14 nt, Escherichia coli CFT073
acagcagagcaugg

SEQ ID NO: 632100 - RNA, 15 nt, Escherichia coli CFT073
acagauuuauaaaau

SEQ ID NO: 632101 - RNA, 18 nt, Escherichia coli CFT073
acagauuuauaaaaucca

SEQ ID NO: 632102 - RNA, 17 nt, Escherichia coli CFT073
acagauuuugcaggccu

SEQ ID NO: 632103 - RNA, 23 nt, Escherichia coli CFT073
acagauuuugcaggccugauaag

SEQ ID NO: 632104 - RNA, 16 nt, Escherichia coli CFT073
acagcaaaacaccccg

SEQ ID NO: 632105 - RNA, 23 nt, Escherichia coli CFT073
acagcaccauccgcccacaccag

SEQ ID NO: 632106 - RNA, 19 nt, Escherichia coli CFT073
acagcaccccauagccagc

SEQ ID NO: 632107 - RNA, 14 nt, Escherichia coli CFT073
acacuuuccugcuc

SEQ ID NO: 632108 - RNA, 13 nt, Escherichia coli CFT073
acagaaaagcaga

SEQ ID NO: 632109 - RNA, 14 nt, Escherichia coli CFT073
acagaaaagcagag

SEQ ID NO: 632110 - RNA, 18 nt, Escherichia coli CFT073
acacuuucugcaaacaag

SEQ ID NO: 632111 - RNA, 20 nt, Escherichia coli CFT073
acacuucuucuguuucuguc

SEQ ID NO: 632112 - RNA, 22 nt, Escherichia coli CFT073
acacuucuucagccaguuuuuc

SEQ ID NO: 632113 - RNA, 12 nt, Escherichia coli CFT073
acagaacaaaau

SEQ ID NO: 632114 - RNA, 23 nt, Escherichia coli CFT073
acagaacgcgccuuaaaaaccag

SEQ ID NO: 632115 - RNA, 12 nt, Escherichia coli CFT073
acagaacgcugc

SEQ ID NO: 632116 - RNA, 18 nt, Escherichia coli CFT073
acagaaauagagaaagag

SEQ ID NO: 632117 - RNA, 20 nt, Escherichia coli CFT073
acagacagccucaagcaccc

SEQ ID NO: 632118 - RNA, 24 nt, Escherichia coli CFT073
acagaccaaaacgugcagcugccu

SEQ ID NO: 632119 - RNA, 19 nt, Escherichia coli CFT073
acagaccacauuccaggcc

SEQ ID NO: 632120 - RNA, 18 nt, Escherichia coli CFT073
acagacaccaaucagccc

SEQ ID NO: 632121 - RNA, 15 nt, Escherichia coli CFT073
acagaccccggcauu

SEQ ID NO: 632122 - RNA, 15 nt, Escherichia coli CFT073
acagacucaaaccaa

SEQ ID NO: 632123 - RNA, 19 nt, Escherichia coli CFT073
acagacucaaaccaauggc

SEQ ID NO: 632124 - RNA, 13 nt, Escherichia coli CFT073
acagaauaucugc

SEQ ID NO: 632125 - RNA, 12 nt, Escherichia coli CFT073
acagaaucagca

SEQ ID NO: 632126 - RNA, 21 nt, Escherichia coli CFT073
acagaacuuuacuggcucgcc

SEQ ID NO: 632127 - RNA, 19 nt, Escherichia coli CFT073
acagaaugcgcgcgaaaac

SEQ ID NO: 632128 - RNA, 14 nt, Escherichia coli CFT073
acagaaugugaugc

SEQ ID NO: 632129 - RNA, 20 nt, Escherichia coli CFT073
acagaaugugaugccagcac

SEQ ID NO: 632130 - RNA, 22 nt, Escherichia coli CFT073
acagaaugugaugccagcacuc

SEQ ID NO: 632131 - RNA, 12 nt, Escherichia coli CFT073
acagacaaacag

SEQ ID NO: 632132 - RNA, 22 nt, Escherichia coli CFT073
acacuauaucucaaucaaaaga

SEQ ID NO: 632133 - RNA, 14 nt, Escherichia coli CFT073
acacuacaaauuua

SEQ ID NO: 632134 - RNA, 15 nt, Escherichia coli CFT073
acacuaccgccgagc

SEQ ID NO: 632135 - RNA, 13 nt, Escherichia coli CFT073
acaccaugccaga

SEQ ID NO: 632136 - RNA, 17 nt, Escherichia coli CFT073
acacccggagacaaaca

SEQ ID NO: 632137 - RNA, 17 nt, Escherichia coli CFT073
acacuccagucccaguu

SEQ ID NO: 632138 - RNA, 23 nt, Escherichia coli CFT073
acacuccagucccaguucauguu

SEQ ID NO: 632139 - RNA, 14 nt, Escherichia coli CFT073
acacucuauccagc

SEQ ID NO: 632140 - RNA, 13 nt, Escherichia coli CFT073
acacugaaaaaaa

SEQ ID NO: 632141 - RNA, 17 nt, Escherichia coli CFT073
acacucguuucaaauuu

SEQ ID NO: 632142 - RNA, 20 nt, Escherichia coli CFT073
acacugagcgugagugcgaa

SEQ ID NO: 632143 - RNA, 18 nt, Escherichia coli CFT073
acacugaugacaggcuac

SEQ ID NO: 632144 - RNA, 15 nt, Escherichia coli CFT073
acacugguucccaga

SEQ ID NO: 632145 - RNA, 19 nt, Escherichia coli CFT073
acacugguucccaacaaca

SEQ ID NO: 632146 - RNA, 20 nt, Escherichia coli CFT073
acacugguucccaacaacag

SEQ ID NO: 632147 - RNA, 22 nt, Escherichia coli CFT073
acacuggaaacagccaaucaua

SEQ ID NO: 632148 - RNA, 18 nt, Escherichia coli CFT073
acacuguuaccgcugcug

SEQ ID NO: 632149 - RNA, 22 nt, Escherichia coli CFT073
acacuguugagaggacaaauaa

SEQ ID NO: 632150 - RNA, 19 nt, Escherichia coli CFT073
acacauaacgccaauucau

SEQ ID NO: 632151 - RNA, 20 nt, Escherichia coli CFT073
acacaguucuucaaaaauaa

SEQ ID NO: 632152 - RNA, 20 nt, Escherichia coli CFT073
acacauaaccagguaaagac

SEQ ID NO: 632153 - RNA, 18 nt, Escherichia coli CFT073
acaccacgcgccugcagc

SEQ ID NO: 632154 - RNA, 13 nt, Escherichia coli CFT073
acaccacuucauu

SEQ ID NO: 632155 - RNA, 14 nt, Escherichia coli CFT073
acaccacuugcugg

SEQ ID NO: 632156 - RNA, 16 nt, Escherichia coli CFT073
acaccagaaugcccca

SEQ ID NO: 632157 - RNA, 15 nt, Escherichia coli CFT073
acaccagaccagaca

SEQ ID NO: 632158 - RNA, 18 nt, Escherichia coli CFT073
acaccagauccagcaagg

SEQ ID NO: 632159 - RNA, 16 nt, Escherichia coli CFT073
acaccagcaauaaugc

SEQ ID NO: 632160 - RNA, 16 nt, Escherichia coli CFT073
acaccagcaauagcgc

SEQ ID NO: 632161 - RNA, 15 nt, Escherichia coli CFT073
acaccagcacaucau

SEQ ID NO: 632162 - RNA, 13 nt, Escherichia coli CFT073
acaccaguuucca

SEQ ID NO: 632163 - RNA, 14 nt, Escherichia coli CFT073
acaccauauccagc

SEQ ID NO: 632164 - RNA, 15 nt, Escherichia coli CFT073
acaccagggaaauaa

SEQ ID NO: 632165 - RNA, 13 nt, Escherichia coli CFT073
acaccaucuucaa

SEQ ID NO: 632166 - RNA, 12 nt, Escherichia coli CFT073
acaccaucaaca

SEQ ID NO: 632167 - RNA, 14 nt, Escherichia coli CFT073
acaccaucaacaaa

SEQ ID NO: 632168 - RNA, 15 nt, Escherichia coli CFT073
acaccauccagcaac

SEQ ID NO: 632169 - RNA, 16 nt, Escherichia coli CFT073
acacagauaaaucaau

SEQ ID NO: 632170 - RNA, 22 nt, Escherichia coli CFT073
acacagauaaaucaauacguug

SEQ ID NO: 632171 - RNA, 15 nt, Escherichia coli CFT073
acacagcaauaauaa

SEQ ID NO: 632172 - RNA, 23 nt, Escherichia coli CFT073
acacacugcgccgccagugugaa

SEQ ID NO: 632173 - RNA, 13 nt, Escherichia coli CFT073
acacagcuuucuc

SEQ ID NO: 632174 - RNA, 23 nt, Escherichia coli CFT073
acacagcuuucucaaaauacugc

SEQ ID NO: 632175 - RNA, 20 nt, Escherichia coli CFT073
acaauggagcacauugccug

SEQ ID NO: 632176 - RNA, 18 nt, Escherichia coli CFT073
acaauggagcuaaacaga

SEQ ID NO: 632177 - RNA, 23 nt, Escherichia coli CFT073
acaauggagcuaaacagagcugc

SEQ ID NO: 632178 - RNA, 16 nt, Escherichia coli CFT073
acaauguaccagucaa

SEQ ID NO: 632179 - RNA, 21 nt, Escherichia coli CFT073
acaauguaccagucaauaaua

SEQ ID NO: 632180 - RNA, 17 nt, Escherichia coli CFT073
acaaugggcgugaaagg

SEQ ID NO: 632181 - RNA, 20 nt, Escherichia coli CFT073
acaauggucaacauucccug

SEQ ID NO: 632182 - RNA, 18 nt, Escherichia coli CFT073
acaaucucaauuuucacu

SEQ ID NO: 632183 - RNA, 14 nt, Escherichia coli CFT073
acaauaucaucauu

SEQ ID NO: 632184 - RNA, 12 nt, Escherichia coli CFT073
acaauaucaaau

SEQ ID NO: 632185 - RNA, 20 nt, Escherichia coli CFT073
acaauaugaauuaccccugg

SEQ ID NO: 632186 - RNA, 21 nt, Escherichia coli CFT073
acaaucugguuuuugguuuca

SEQ ID NO: 632187 - RNA, 22 nt, Escherichia coli CFT073
acaauguccguaacauaacagc

SEQ ID NO: 632188 - RNA, 22 nt, Escherichia coli CFT073
acaaugucuucacaaccgccau

SEQ ID NO: 632189 - RNA, 12 nt, Escherichia coli CFT073
acaauuugccag

SEQ ID NO: 632190 - RNA, 20 nt, Escherichia coli CFT073
acaauuuaccgaccucaaca

SEQ ID NO: 632191 - RNA, 15 nt, Escherichia coli CFT073
acaauuucagcaaua

SEQ ID NO: 632192 - RNA, 15 nt, Escherichia coli CFT073
acacacacgcccagu

SEQ ID NO: 632193 - RNA, 18 nt, Escherichia coli CFT073
acacaccagauccagcaa

SEQ ID NO: 632194 - RNA, 13 nt, Escherichia coli CFT073
acacaaugcaaga

SEQ ID NO: 632195 - RNA, 20 nt, Escherichia coli CFT073
acacaaugggcaagcgacca

SEQ ID NO: 632196 - RNA, 16 nt, Escherichia coli CFT073
acacaauaccuucugc

SEQ ID NO: 632197 - RNA, 19 nt, Escherichia coli CFT073
acaacucauuacuguaggc

SEQ ID NO: 632198 - RNA, 21 nt, Escherichia coli CFT073
acaacucauuacuguaggcca

SEQ ID NO: 632199 - RNA, 18 nt, Escherichia coli CFT073
acaacuuuugcaggaagc

SEQ ID NO: 632200 - RNA, 20 nt, Escherichia coli CFT073
acaacuucuaauuuuuccag

SEQ ID NO: 632201 - RNA, 14 nt, Escherichia coli CFT073
aauuuuuugaucaa

SEQ ID NO: 632202 - RNA, 16 nt, Escherichia coli CFT073
acaacguacaccgcag

SEQ ID NO: 632203 - RNA, 13 nt, Escherichia coli CFT073
acaacggcaaaca

SEQ ID NO: 632204 - RNA, 13 nt, Escherichia coli CFT073
acaaguccagcac

SEQ ID NO: 632205 - RNA, 15 nt, Escherichia coli CFT073
acaaguccagcaccg

SEQ ID NO: 632206 - RNA, 20 nt, Escherichia coli CFT073
acaaguccguugaaauugcu

SEQ ID NO: 632207 - RNA, 17 nt, Escherichia coli CFT073
acaagucuuuuuugguu

SEQ ID NO: 632208 - RNA, 16 nt, Escherichia coli CFT073
acaauaaacuggcugu

SEQ ID NO: 632209 - RNA, 12 nt, Escherichia coli CFT073
acaauaaaaagc

SEQ ID NO: 632210 - RNA, 12 nt, Escherichia coli CFT073
acaauaauaucu

SEQ ID NO: 632211 - RNA, 13 nt, Escherichia coli CFT073
acaauaauaucuu

SEQ ID NO: 632212 - RNA, 18 nt, Escherichia coli CFT073
acaauagcaaucuguaac

SEQ ID NO: 632213 - RNA, 17 nt, Escherichia coli CFT073
acaauaaucaccacaca

SEQ ID NO: 632214 - RNA, 19 nt, Escherichia coli CFT073
acaauagcgaacagacaaa

SEQ ID NO: 632215 - RNA, 17 nt, Escherichia coli CFT073
acaagcccgccagacca

SEQ ID NO: 632216 - RNA, 17 nt, Escherichia coli CFT073
acaagcauaacaaaaug

SEQ ID NO: 632217 - RNA, 21 nt, Escherichia coli CFT073
acaagccaaauccagcaccac

SEQ ID NO: 632218 - RNA, 12 nt, Escherichia coli CFT073
acaagcagcugc

SEQ ID NO: 632219 - RNA, 13 nt, Escherichia coli CFT073
acaagcacagggc

SEQ ID NO: 632220 - RNA, 16 nt, Escherichia coli CFT073
acaagauuagccauca

SEQ ID NO: 632221 - RNA, 13 nt, Escherichia coli CFT073
acaagaauauugc

SEQ ID NO: 632222 - RNA, 17 nt, Escherichia coli CFT073
acaagaucgcccugagg

SEQ ID NO: 632223 - RNA, 17 nt, Escherichia coli CFT073
acaagacugacaaucaa

SEQ ID NO: 632224 - RNA, 13 nt, Escherichia coli CFT073
acaagacuguaaa

SEQ ID NO: 632225 - RNA, 15 nt, Escherichia coli CFT073
aauucuguuucauua

SEQ ID NO: 632226 - RNA, 13 nt, Escherichia coli CFT073
aauucuuaacacc

SEQ ID NO: 632227 - RNA, 23 nt, Escherichia coli CFT073
aauucgcccuucggcaucacgaa

SEQ ID NO: 632228 - RNA, 19 nt, Escherichia coli CFT073
aauucgcuguaauucuuca

SEQ ID NO: 632229 - RNA, 16 nt, Escherichia coli CFT073
aauucgcuuucacuca

SEQ ID NO: 632230 - RNA, 22 nt, Escherichia coli CFT073
aauucgggcgcugauucuuccc

SEQ ID NO: 632231 - RNA, 20 nt, Escherichia coli CFT073
aauucgugugguaaaaccuu

SEQ ID NO: 632232 - RNA, 18 nt, Escherichia coli CFT073
aauuccggcagagaaagc

SEQ ID NO: 632233 - RNA, 16 nt, Escherichia coli CFT073
aauucgcagaccggga

SEQ ID NO: 632234 - RNA, 20 nt, Escherichia coli CFT073
aauucccugugccagcggca

SEQ ID NO: 632235 - RNA, 14 nt, Escherichia coli CFT073
aauugcaauuuuua

SEQ ID NO: 632236 - RNA, 15 nt, Escherichia coli CFT073
aauugcaauuuuuau

SEQ ID NO: 632237 - RNA, 23 nt, Escherichia coli CFT073
aauugcaccauccccuuuucacg

SEQ ID NO: 632238 - RNA, 16 nt, Escherichia coli CFT073
aauugcaccucagcau

SEQ ID NO: 632239 - RNA, 17 nt, Escherichia coli CFT073
aauugcaccucagcaua

SEQ ID NO: 632240 - RNA, 17 nt, Escherichia coli CFT073
aauugauugauaaugaa

SEQ ID NO: 632241 - RNA, 12 nt, Escherichia coli CFT073
aauugauaacca

SEQ ID NO: 632242 - RNA, 13 nt, Escherichia coli CFT073
aauugauaaccaa

SEQ ID NO: 632243 - RNA, 18 nt, Escherichia coli CFT073
aauugaguuuauagcaag

SEQ ID NO: 632244 - RNA, 23 nt, Escherichia coli CFT073
aauugaugaguaucuuauugaaa

SEQ ID NO: 632245 - RNA, 17 nt, Escherichia coli CFT073
aauugaugcuuuuugcc

SEQ ID NO: 632246 - RNA, 21 nt, Escherichia coli CFT073
aauucuugcugacguaucuua

SEQ ID NO: 632247 - RNA, 16 nt, Escherichia coli CFT073
aauugaccugauaaga

SEQ ID NO: 632248 - RNA, 19 nt, Escherichia coli CFT073
aauugagauaagcaacaaa

SEQ ID NO: 632249 - RNA, 16 nt, Escherichia coli CFT073
aauugagcagcaaaau

SEQ ID NO: 632250 - RNA, 12 nt, Escherichia coli CFT073
aauuaugcagcc

SEQ ID NO: 632251 - RNA, 18 nt, Escherichia coli CFT073
aauuaguaggccggauaa

SEQ ID NO: 632252 - RNA, 18 nt, Escherichia coli CFT073
aauuauuaccgucagaaa

SEQ ID NO: 632253 - RNA, 15 nt, Escherichia coli CFT073
aauuauuagcaacga

SEQ ID NO: 632254 - RNA, 21 nt, Escherichia coli CFT073
aauuauuuuacugguugauuu

SEQ ID NO: 632255 - RNA, 19 nt, Escherichia coli CFT073
aauuagccagucggccaug

SEQ ID NO: 632256 - RNA, 14 nt, Escherichia coli CFT073
aauuagcaagacuu

SEQ ID NO: 632257 - RNA, 18 nt, Escherichia coli CFT073
aauuagcacgauuuugua

SEQ ID NO: 632258 - RNA, 21 nt, Escherichia coli CFT073
aauuagcacgauuuuguaggc

SEQ ID NO: 632259 - RNA, 13 nt, Escherichia coli CFT073
aauuacucaguau

SEQ ID NO: 632260 - RNA, 16 nt, Escherichia coli CFT073
aauuacucaguaugca

SEQ ID NO: 632261 - RNA, 21 nt, Escherichia coli CFT073
aauuacucucgugccagagca

SEQ ID NO: 632262 - RNA, 22 nt, Escherichia coli CFT073
aauuacucucgugccagagcau

SEQ ID NO: 632263 - RNA, 23 nt, Escherichia coli CFT073
aauuacuuacaucugucugauaa

SEQ ID NO: 632264 - RNA, 13 nt, Escherichia coli CFT073
aauuacuucucuu

SEQ ID NO: 632265 - RNA, 15 nt, Escherichia coli CFT073
aauuacuucucuuuc

SEQ ID NO: 632266 - RNA, 15 nt, Escherichia coli CFT073
aauuacugcuuaaau

SEQ ID NO: 632267 - RNA, 15 nt, Escherichia coli CFT073
aauuacuggcggcga

SEQ ID NO: 632268 - RNA, 21 nt, Escherichia coli CFT073
aauuaaucaucaugcuuaaau

SEQ ID NO: 632269 - RNA, 13 nt, Escherichia coli CFT073
aauuaccaacaca

SEQ ID NO: 632270 - RNA, 18 nt, Escherichia coli CFT073
aauuaccuuuuuaccaac

SEQ ID NO: 632271 - RNA, 19 nt, Escherichia coli CFT073
aauuaccgcaccaccagca

SEQ ID NO: 632272 - RNA, 22 nt, Escherichia coli CFT073
aauuaccgcaccaccagcagcu

SEQ ID NO: 632273 - RNA, 18 nt, Escherichia coli CFT073
aauuaccuuuacaugaaa

SEQ ID NO: 632274 - RNA, 13 nt, Escherichia coli CFT073
aauguaucugaag

SEQ ID NO: 632275 - RNA, 19 nt, Escherichia coli CFT073
aauggugguucagauaaau

SEQ ID NO: 632276 - RNA, 23 nt, Escherichia coli CFT073
aauguagcgaacugguuucaaua

SEQ ID NO: 632277 - RNA, 16 nt, Escherichia coli CFT073
aaugguauuaagccag

SEQ ID NO: 632278 - RNA, 14 nt, Escherichia coli CFT073
aauggucacacaca

SEQ ID NO: 632279 - RNA, 21 nt, Escherichia coli CFT073
aaugguacucggcacguuacu

SEQ ID NO: 632280 - RNA, 19 nt, Escherichia coli CFT073
aauugcggguaggcaccug

SEQ ID NO: 632281 - RNA, 20 nt, Escherichia coli CFT073
aauugcgggccaaagaccag

SEQ ID NO: 632282 - RNA, 16 nt, Escherichia coli CFT073
aauugcguaaagccug

SEQ ID NO: 632283 - RNA, 22 nt, Escherichia coli CFT073
aauugcguaaagccugcuggca

SEQ ID NO: 632284 - RNA, 22 nt, Escherichia coli CFT073
aauugcuauugguucacuugcu

SEQ ID NO: 632285 - RNA, 14 nt, Escherichia coli CFT073
aauuuaacauuacu

SEQ ID NO: 632286 - RNA, 14 nt, Escherichia coli CFT073
aauuuaucagauuu

SEQ ID NO: 632287 - RNA, 22 nt, Escherichia coli CFT073
aauuuaucgcagguaagauaau

SEQ ID NO: 632288 - RNA, 18 nt, Escherichia coli CFT073
aauuuaucgcauauccuc

SEQ ID NO: 632289 - RNA, 17 nt, Escherichia coli CFT073
aauuuauuccgagcagc

SEQ ID NO: 632290 - RNA, 14 nt, Escherichia coli CFT073
aauuuaucuuucag

SEQ ID NO: 632291 - RNA, 23 nt, Escherichia coli CFT073
aauuucgucguaaucauaaaaca

SEQ ID NO: 632292 - RNA, 20 nt, Escherichia coli CFT073
aauuuccugcgcuuucugcu

SEQ ID NO: 632293 - RNA, 18 nt, Escherichia coli CFT073
aauuuccgcuuucaacgc

SEQ ID NO: 632294 - RNA, 22 nt, Escherichia coli CFT073
aauuuccggcaccguccucacu

SEQ ID NO: 632295 - RNA, 21 nt, Escherichia coli CFT073
aauuucugugcagccaaaaau

SEQ ID NO: 632296 - RNA, 13 nt, Escherichia coli CFT073
aauuucaguuacu

SEQ ID NO: 632297 - RNA, 17 nt, Escherichia coli CFT073
aauuucaugcucaccaa

SEQ ID NO: 632298 - RNA, 16 nt, Escherichia coli CFT073
aauuucauuauucauu

SEQ ID NO: 632299 - RNA, 17 nt, Escherichia coli CFT073
aauuucaucaucacgaa

SEQ ID NO: 632300 - RNA, 18 nt, Escherichia coli CFT073
aauuucaucgcuacacca

SEQ ID NO: 632301 - RNA, 21 nt, Escherichia coli CFT073
aauuucaucgcuacaccaauc

SEQ ID NO: 632302 - RNA, 16 nt, Escherichia coli CFT073
aauuucauuuucaggg

SEQ ID NO: 632303 - RNA, 11 nt, Escherichia coli CFT073
aauuucauuuu

SEQ ID NO: 632304 - RNA, 18 nt, Escherichia coli CFT073
aauuucaggcaacaaaaa

SEQ ID NO: 632305 - RNA, 19 nt, Escherichia coli CFT073
aauuucagcggcacuguuu

SEQ ID NO: 632306 - RNA, 19 nt, Escherichia coli CFT073
aauuucacaccaucaacaa

SEQ ID NO: 632307 - RNA, 18 nt, Escherichia coli CFT073
aauuucacuuucugacca

SEQ ID NO: 632308 - RNA, 15 nt, Escherichia coli CFT073
aauuuguaacgauuc

SEQ ID NO: 632309 - RNA, 20 nt, Escherichia coli CFT073
aauuugggugcaaugagaau

SEQ ID NO: 632310 - RNA, 15 nt, Escherichia coli CFT073
aauuuggugcucagu

SEQ ID NO: 632311 - RNA, 16 nt, Escherichia coli CFT073
aauuugccaucucugc

SEQ ID NO: 632312 - RNA, 21 nt, Escherichia coli CFT073
aauuugcuugccggaagcaaa

SEQ ID NO: 632313 - RNA, 13 nt, Escherichia coli CFT073
aauuugcucuucu

SEQ ID NO: 632314 - RNA, 14 nt, Escherichia coli CFT073
aauuugcuccagaa

SEQ ID NO: 632315 - RNA, 17 nt, Escherichia coli CFT073
aauuuugcagcauucau

SEQ ID NO: 632316 - RNA, 21 nt, Escherichia coli CFT073
aauuuugcagcauucaucaca

SEQ ID NO: 632317 - RNA, 14 nt, Escherichia coli CFT073
aauuuugugcagca

SEQ ID NO: 632318 - RNA, 13 nt, Escherichia coli CFT073
aauuuugaaauaa

SEQ ID NO: 632319 - RNA, 20 nt, Escherichia coli CFT073
aauuuuauccgcaaagauuu

SEQ ID NO: 632320 - RNA, 17 nt, Escherichia coli CFT073
aauuuuaggaugcugca

SEQ ID NO: 632321 - RNA, 12 nt, Escherichia coli CFT073
aauuuuaggaug

SEQ ID NO: 632322 - RNA, 11 nt, Escherichia coli CFT073
aauuuucccuu

SEQ ID NO: 632323 - RNA, 18 nt, Escherichia coli CFT073
aauuuucccuucccgcaa

SEQ ID NO: 632324 - RNA, 13 nt, Escherichia coli CFT073
aauuuucgacagc

SEQ ID NO: 632325 - RNA, 13 nt, Escherichia coli CFT073
aauuuucagacca

SEQ ID NO: 632326 - RNA, 18 nt, Escherichia coli CFT073
aaugcauggccugaauaa

SEQ ID NO: 632327 - RNA, 15 nt, Escherichia coli CFT073
aaugccgacaucaaa

SEQ ID NO: 632328 - RNA, 16 nt, Escherichia coli CFT073
aaugccgcaaugugcu

SEQ ID NO: 632329 - RNA, 14 nt, Escherichia coli CFT073
aaugccgcgcccca

SEQ ID NO: 632330 - RNA, 17 nt, Escherichia coli CFT073
aaugccggaaucagaau

SEQ ID NO: 632331 - RNA, 18 nt, Escherichia coli CFT073
aaugccggaaucagaauc

SEQ ID NO: 632332 - RNA, 16 nt, Escherichia coli CFT073
aaugcccgcaccaccg

SEQ ID NO: 632333 - RNA, 15 nt, Escherichia coli CFT073
aaugaugauugacca

SEQ ID NO: 632334 - RNA, 19 nt, Escherichia coli CFT073
aaugauggcgcguuuggug

SEQ ID NO: 632335 - RNA, 19 nt, Escherichia coli CFT073
aaugauggugaaagcaaaa

SEQ ID NO: 632336 - RNA, 21 nt, Escherichia coli CFT073
aaugauggugaaagcaaaaaa

SEQ ID NO: 632337 - RNA, 16 nt, Escherichia coli CFT073
aaugaugucaaccauc

SEQ ID NO: 632338 - RNA, 20 nt, Escherichia coli CFT073
aaugaucagcgguuuugcca

SEQ ID NO: 632339 - RNA, 19 nt, Escherichia coli CFT073
aaugauauugauaauaaaa

SEQ ID NO: 632340 - RNA, 15 nt, Escherichia coli CFT073
aaugaucaauaauua

SEQ ID NO: 632341 - RNA, 16 nt, Escherichia coli CFT073
aaugaucaauaauuaa

SEQ ID NO: 632342 - RNA, 15 nt, Escherichia coli CFT073
aaugaucacuggaag

SEQ ID NO: 632343 - RNA, 21 nt, Escherichia coli CFT073
aaugauauuaauguuuucagu

SEQ ID NO: 632344 - RNA, 15 nt, Escherichia coli CFT073
aauggcgucaacaac

SEQ ID NO: 632345 - RNA, 17 nt, Escherichia coli CFT073
aauggcguuaacaauaa

SEQ ID NO: 632346 - RNA, 13 nt, Escherichia coli CFT073
aauggcuggucag

SEQ ID NO: 632347 - RNA, 15 nt, Escherichia coli CFT073
aauggcugccgccag

SEQ ID NO: 632348 - RNA, 14 nt, Escherichia coli CFT073
aauggcugcggacg

SEQ ID NO: 632349 - RNA, 19 nt, Escherichia coli CFT073
aauggcuaucgaaaucaaa

SEQ ID NO: 632350 - RNA, 14 nt, Escherichia coli CFT073
aauggcuuccagua

SEQ ID NO: 632351 - RNA, 13 nt, Escherichia coli CFT073
aauggcuuuugcc

SEQ ID NO: 632352 - RNA, 16 nt, Escherichia coli CFT073
aaugggcgugaaaggu

SEQ ID NO: 632353 - RNA, 17 nt, Escherichia coli CFT073
aauggggauuuacgaug

SEQ ID NO: 632354 - RNA, 21 nt, Escherichia coli CFT073
aaugcugccuucggugggaaa

SEQ ID NO: 632355 - RNA, 23 nt, Escherichia coli CFT073
aaugcuggcuuuuggaccgccaa

SEQ ID NO: 632356 - RNA, 21 nt, Escherichia coli CFT073
aauggcauccgccacuuuaug

SEQ ID NO: 632357 - RNA, 16 nt, Escherichia coli CFT073
aaugccggguaaagau

SEQ ID NO: 632358 - RNA, 16 nt, Escherichia coli CFT073
aaugccgucaccagca

SEQ ID NO: 632359 - RNA, 14 nt, Escherichia coli CFT073
aaugcguaaauugc

SEQ ID NO: 632360 - RNA, 20 nt, Escherichia coli CFT073
aaugcguagguuaacccagc

SEQ ID NO: 632361 - RNA, 13 nt, Escherichia coli CFT073
aaugccugcaaca

SEQ ID NO: 632362 - RNA, 15 nt, Escherichia coli CFT073
aaugcguuccagcau

SEQ ID NO: 632363 - RNA, 19 nt, Escherichia coli CFT073
aaugcguuccaguucgcug

SEQ ID NO: 632364 - RNA, 14 nt, Escherichia coli CFT073
aaugcucacccgcg

SEQ ID NO: 632365 - RNA, 21 nt, Escherichia coli CFT073
aaugcugcaccccacaaacag

SEQ ID NO: 632366 - RNA, 16 nt, Escherichia coli CFT073
aaugcucucuucgcca

SEQ ID NO: 632367 - RNA, 19 nt, Escherichia coli CFT073
aaugcuccccguaggccag

SEQ ID NO: 632368 - RNA, 20 nt, Escherichia coli CFT073
aaugacauuaaguaacaaua

SEQ ID NO: 632369 - RNA, 14 nt, Escherichia coli CFT073
aaugacaacauuuu

SEQ ID NO: 632370 - RNA, 21 nt, Escherichia coli CFT073
aaugacaauuacaaaaugaca

SEQ ID NO: 632371 - RNA, 14 nt, Escherichia coli CFT073
aaugacagccccac

SEQ ID NO: 632372 - RNA, 22 nt, Escherichia coli CFT073
aaugacagccccaccagcaaau

SEQ ID NO: 632373 - RNA, 23 nt, Escherichia coli CFT073
aaugacagccccaccagcaaaua

SEQ ID NO: 632374 - RNA, 18 nt, Escherichia coli CFT073
aaugacaguaucaccaac

SEQ ID NO: 632375 - RNA, 19 nt, Escherichia coli CFT073
aaugacaguaucaccaacu

SEQ ID NO: 632376 - RNA, 18 nt, Escherichia coli CFT073
aaugacggacgcaacuga

SEQ ID NO: 632377 - RNA, 16 nt, Escherichia coli CFT073
aaugacgcuuuauuca

SEQ ID NO: 632378 - RNA, 21 nt, Escherichia coli CFT073
aaugacgcgaauuaucucccc

SEQ ID NO: 632379 - RNA, 14 nt, Escherichia coli CFT073
aaugacgaucaacc

SEQ ID NO: 632380 - RNA, 20 nt, Escherichia coli CFT073
aaugacgacaaagaccugaa

SEQ ID NO: 632381 - RNA, 21 nt, Escherichia coli CFT073
aaugacuaagcgaucgcuaaa

SEQ ID NO: 632382 - RNA, 16 nt, Escherichia coli CFT073
aaugacucacguuacu

SEQ ID NO: 632383 - RNA, 21 nt, Escherichia coli CFT073
aaugagaaaacuaucugaaaa

SEQ ID NO: 632384 - RNA, 21 nt, Escherichia coli CFT073
aaugagcgaacaauaaaguuu

SEQ ID NO: 632385 - RNA, 18 nt, Escherichia coli CFT073
aaugagaucaaacugccc

SEQ ID NO: 632386 - RNA, 22 nt, Escherichia coli CFT073
aaugaguggugaugaccacaga

SEQ ID NO: 632387 - RNA, 14 nt, Escherichia coli CFT073
aaugaggcuuuaau

SEQ ID NO: 632388 - RNA, 15 nt, Escherichia coli CFT073
aaugaguuauacaga

SEQ ID NO: 632389 - RNA, 22 nt, Escherichia coli CFT073
aaugaaagaugaagaguggaac

SEQ ID NO: 632390 - RNA, 14 nt, Escherichia coli CFT073
aaugaaauaaaaca

SEQ ID NO: 632391 - RNA, 15 nt, Escherichia coli CFT073
aaugaaauaaaacaa

SEQ ID NO: 632392 - RNA, 16 nt, Escherichia coli CFT073
aaugaaauaaaacaaa

SEQ ID NO: 632393 - RNA, 19 nt, Escherichia coli CFT073
aaugaaauauuaucuaacc

SEQ ID NO: 632394 - RNA, 22 nt, Escherichia coli CFT073
aaugaacgccaccccacaccag

SEQ ID NO: 632395 - RNA, 18 nt, Escherichia coli CFT073
aaugaauaaguuucagca

SEQ ID NO: 632396 - RNA, 13 nt, Escherichia coli CFT073
aaugaaugaugcg

SEQ ID NO: 632397 - RNA, 17 nt, Escherichia coli CFT073
aaugaauugcuuaacag

SEQ ID NO: 632398 - RNA, 22 nt, Escherichia coli CFT073
aaugaaaacgaauugucccauu

SEQ ID NO: 632399 - RNA, 11 nt, Escherichia coli CFT073
aaugaaaaacc

SEQ ID NO: 632400 - RNA, 17 nt, Escherichia coli CFT073
aaucuuucacuuuugcc

SEQ ID NO: 632401 - RNA, 23 nt, Escherichia coli CFT073
aaucuuucagaguuguaccaccc

SEQ ID NO: 632402 - RNA, 12 nt, Escherichia coli CFT073
aaucuuuaacca

SEQ ID NO: 632403 - RNA, 17 nt, Escherichia coli CFT073
aaucgacguucugccaa

SEQ ID NO: 632404 - RNA, 14 nt, Escherichia coli CFT073
aaucgccagcggca

SEQ ID NO: 632405 - RNA, 18 nt, Escherichia coli CFT073
aaucgccagcggcagcuc

SEQ ID NO: 632406 - RNA, 17 nt, Escherichia coli CFT073
aaucgcccgggcuuuau

SEQ ID NO: 632407 - RNA, 20 nt, Escherichia coli CFT073
aaucgccgcauaauaucuuu

SEQ ID NO: 632408 - RNA, 23 nt, Escherichia coli CFT073
aaucgccgcauaauaucuuuccu

SEQ ID NO: 632409 - RNA, 17 nt, Escherichia coli CFT073
aaucgaaaucaacaugu

SEQ ID NO: 632410 - RNA, 19 nt, Escherichia coli CFT073
aaucgacaaaaucagaaac

SEQ ID NO: 632411 - RNA, 12 nt, Escherichia coli CFT073
aaucgacaccag

SEQ ID NO: 632412 - RNA, 14 nt, Escherichia coli CFT073
aaucgaacuucccg

SEQ ID NO: 632413 - RNA, 18 nt, Escherichia coli CFT073
aaucgccugaacaccaga

SEQ ID NO: 632414 - RNA, 19 nt, Escherichia coli CFT073
aaucgccugaacaccagaa

SEQ ID NO: 632415 - RNA, 19 nt, Escherichia coli CFT073
aaucccgcgaucgggacuu

SEQ ID NO: 632416 - RNA, 23 nt, Escherichia coli CFT073
aaucccgucuucgucuggcugua

SEQ ID NO: 632417 - RNA, 15 nt, Escherichia coli CFT073
aaucccccacuuuua

SEQ ID NO: 632418 - RNA, 17 nt, Escherichia coli CFT073
aauccauaccagcacau

SEQ ID NO: 632419 - RNA, 22 nt, Escherichia coli CFT073
aauccauaccagcacauaacuc

SEQ ID NO: 632420 - RNA, 13 nt, Escherichia coli CFT073
aaucccaucagac

SEQ ID NO: 632421 - RNA, 17 nt, Escherichia coli CFT073
aaucccaucagacggga

SEQ ID NO: 632422 - RNA, 18 nt, Escherichia coli CFT073
aauccccacaaaccaccg

SEQ ID NO: 632423 - RNA, 20 nt, Escherichia coli CFT073
aaucccaucuucgaguaaaa

SEQ ID NO: 632424 - RNA, 21 nt, Escherichia coli CFT073
aaucccaucuucgaguaaaaa

SEQ ID NO: 632425 - RNA, 20 nt, Escherichia coli CFT073
aauccaguugcguaauauca

SEQ ID NO: 632426 - RNA, 12 nt, Escherichia coli CFT073
aauccugccaac

SEQ ID NO: 632427 - RNA, 18 nt, Escherichia coli CFT073
aauccugauggaagacau

SEQ ID NO: 632428 - RNA, 21 nt, Escherichia coli CFT073
aauccuguagauauucuucca

SEQ ID NO: 632429 - RNA, 22 nt, Escherichia coli CFT073
aauccuggccauaccaugacga

SEQ ID NO: 632430 - RNA, 16 nt, Escherichia coli CFT073
aaucguaccagcgaaa

SEQ ID NO: 632431 - RNA, 20 nt, Escherichia coli CFT073
aaucguugauuguugcagau

SEQ ID NO: 632432 - RNA, 16 nt, Escherichia coli CFT073
aaucggugauaaaugc

SEQ ID NO: 632433 - RNA, 21 nt, Escherichia coli CFT073
aaucggcgaagagagcgccag

SEQ ID NO: 632434 - RNA, 15 nt, Escherichia coli CFT073
aaucgggauauugcc

SEQ ID NO: 632435 - RNA, 23 nt, Escherichia coli CFT073
aaucgcuucgugauugcuuugau

SEQ ID NO: 632436 - RNA, 13 nt, Escherichia coli CFT073
aaucgcugcggua

SEQ ID NO: 632437 - RNA, 16 nt, Escherichia coli CFT073
aaucgcucacaacaau

SEQ ID NO: 632438 - RNA, 17 nt, Escherichia coli CFT073
aaucgcucccucuccac

SEQ ID NO: 632439 - RNA, 18 nt, Escherichia coli CFT073
aaucguuugcauccggca

SEQ ID NO: 632440 - RNA, 19 nt, Escherichia coli CFT073
aaucuccagaugacuggcu

SEQ ID NO: 632441 - RNA, 20 nt, Escherichia coli CFT073
aaucuccuguugugaugcaa

SEQ ID NO: 632442 - RNA, 13 nt, Escherichia coli CFT073
aaucucgaaagag

SEQ ID NO: 632443 - RNA, 13 nt, Escherichia coli CFT073
aaucuccugcgca

SEQ ID NO: 632444 - RNA, 21 nt, Escherichia coli CFT073
aauccaguaccaggcaauaaa

SEQ ID NO: 632445 - RNA, 20 nt, Escherichia coli CFT073
aauccagucagcgguuuuga

SEQ ID NO: 632446 - RNA, 14 nt, Escherichia coli CFT073
aauccaggcaucag

SEQ ID NO: 632447 - RNA, 20 nt, Escherichia coli CFT073
aauccaacauagcuaaaaau

SEQ ID NO: 632448 - RNA, 17 nt, Escherichia coli CFT073
aaucauucgcagcugca

SEQ ID NO: 632449 - RNA, 14 nt, Escherichia coli CFT073
aaucauugauaaua

SEQ ID NO: 632450 - RNA, 22 nt, Escherichia coli CFT073
aaucaucugccgguuccagcuu

SEQ ID NO: 632451 - RNA, 23 nt, Escherichia coli CFT073
aaucaucauugcuguuuuacagc

SEQ ID NO: 632452 - RNA, 13 nt, Escherichia coli CFT073
aaucauccagcac

SEQ ID NO: 632453 - RNA, 22 nt, Escherichia coli CFT073
aaucauccaggcuuuaaacccg

SEQ ID NO: 632454 - RNA, 13 nt, Escherichia coli CFT073
aaucaucgccuua

SEQ ID NO: 632455 - RNA, 14 nt, Escherichia coli CFT073
aaaaauucagggga

SEQ ID NO: 632456 - RNA, 13 nt, Escherichia coli CFT073
aaucauauucuuu

SEQ ID NO: 632457 - RNA, 13 nt, Escherichia coli CFT073
aaucaucaugcuu

SEQ ID NO: 632458 - RNA, 17 nt, Escherichia coli CFT073
aaucaucaugcuuaaau

SEQ ID NO: 632459 - RNA, 21 nt, Escherichia coli CFT073
aauaugaauuaacgucaggug

SEQ ID NO: 632460 - RNA, 22 nt, Escherichia coli CFT073
aaucagccauacggucugccag

SEQ ID NO: 632461 - RNA, 18 nt, Escherichia coli CFT073
aaucagccccuucgccag

SEQ ID NO: 632462 - RNA, 16 nt, Escherichia coli CFT073
aaucagcccugcccag

SEQ ID NO: 632463 - RNA, 18 nt, Escherichia coli CFT073
aaucagccguuucaccac

SEQ ID NO: 632464 - RNA, 20 nt, Escherichia coli CFT073
aaucagccuuaaucuucacu

SEQ ID NO: 632465 - RNA, 22 nt, Escherichia coli CFT073
aaucagguaagcgauaaaaaua

SEQ ID NO: 632466 - RNA, 20 nt, Escherichia coli CFT073
aaucaggcggcucaccugca

SEQ ID NO: 632467 - RNA, 16 nt, Escherichia coli CFT073
aaucagcuuauccagc

SEQ ID NO: 632468 - RNA, 19 nt, Escherichia coli CFT073
aaucagcuuccuugcugau

SEQ ID NO: 632469 - RNA, 17 nt, Escherichia coli CFT073
aaucagcuuuuccauau

SEQ ID NO: 632470 - RNA, 19 nt, Escherichia coli CFT073
aaucagcuuuuccauauca

SEQ ID NO: 632471 - RNA, 23 nt, Escherichia coli CFT073
aaaaauuaauuuuuuaauaaaaa

SEQ ID NO: 632472 - RNA, 21 nt, Escherichia coli CFT073
aaucaguucguugaucaacuc

SEQ ID NO: 632473 - RNA, 24 nt, Escherichia coli CFT073
aaucauaaacgccugacgauaggu

SEQ ID NO: 632474 - RNA, 22 nt, Escherichia coli CFT073
aaucaguccacggcugcggcca

SEQ ID NO: 632475 - RNA, 22 nt, Escherichia coli CFT073
aaucauacaggcggaaacguaa

SEQ ID NO: 632476 - RNA, 18 nt, Escherichia coli CFT073
acucuucaacacacugaa

SEQ ID NO: 632477 - RNA, 15 nt, Escherichia coli CFT073
acucuucaagauuaa

SEQ ID NO: 632478 - RNA, 22 nt, Escherichia coli CFT073
acucuggauguuucaugaagca

SEQ ID NO: 632479 - RNA, 19 nt, Escherichia coli CFT073
acucugcaagucuugcugc

SEQ ID NO: 632480 - RNA, 18 nt, Escherichia coli CFT073
acucuguggaaagagcaa

SEQ ID NO: 632481 - RNA, 18 nt, Escherichia coli CFT073
acucuucccuauccggaa

SEQ ID NO: 632482 - RNA, 19 nt, Escherichia coli CFT073
acucuuccagaccaaacau

SEQ ID NO: 632483 - RNA, 20 nt, Escherichia coli CFT073
acucuugccagauuuucuuc

SEQ ID NO: 632484 - RNA, 21 nt, Escherichia coli CFT073
acucuugccagauuuucuuca

SEQ ID NO: 632485 - RNA, 22 nt, Escherichia coli CFT073
acucuugccagauuuucuucag

SEQ ID NO: 632486 - RNA, 15 nt, Escherichia coli CFT073
acucuuggcaccgcc

SEQ ID NO: 632487 - RNA, 17 nt, Escherichia coli CFT073
acucuucguucuucuuc

SEQ ID NO: 632488 - RNA, 16 nt, Escherichia coli CFT073
acucuucuuuaauuaa

SEQ ID NO: 632489 - RNA, 15 nt, Escherichia coli CFT073
acucugaaaacgcug

SEQ ID NO: 632490 - RNA, 19 nt, Escherichia coli CFT073
acucugaccgggaauauaa

SEQ ID NO: 632491 - RNA, 13 nt, Escherichia coli CFT073
acucugccaggca

SEQ ID NO: 632492 - RNA, 14 nt, Escherichia coli CFT073
acucugccaggcag

SEQ ID NO: 632493 - RNA, 18 nt, Escherichia coli CFT073
acucugaugacugaugcu

SEQ ID NO: 632494 - RNA, 17 nt, Escherichia coli CFT073
acucugcuaacucauug

SEQ ID NO: 632495 - RNA, 22 nt, Escherichia coli CFT073
acucugcgcuaaaauuucuuuu

SEQ ID NO: 632496 - RNA, 22 nt, Escherichia coli CFT073
acucuaccuuccuacaagaggu

SEQ ID NO: 632497 - RNA, 17 nt, Escherichia coli CFT073
acucuccagacugcugc

SEQ ID NO: 632498 - RNA, 23 nt, Escherichia coli CFT073
acuccgguuuagugauaugggca

SEQ ID NO: 632499 - RNA, 13 nt, Escherichia coli CFT073
acuccggccugca

SEQ ID NO: 632500 - RNA, 22 nt, Escherichia coli CFT073
acucccgcgcggguaauuaccc

SEQ ID NO: 632501 - RNA, 14 nt, Escherichia coli CFT073
acuccccuuuaaau

SEQ ID NO: 632502 - RNA, 14 nt, Escherichia coli CFT073
acucccgcgccgca

SEQ ID NO: 632503 - RNA, 13 nt, Escherichia coli CFT073
acucaaaaaaaau

SEQ ID NO: 632504 - RNA, 17 nt, Escherichia coli CFT073
acuccccgcaacaguga

SEQ ID NO: 632505 - RNA, 14 nt, Escherichia coli CFT073
acucggcugcugcc

SEQ ID NO: 632506 - RNA, 21 nt, Escherichia coli CFT073
acucggaaaaugcauucuuau

SEQ ID NO: 632507 - RNA, 23 nt, Escherichia coli CFT073
acucgauaccagauuaauuauug

SEQ ID NO: 632508 - RNA, 14 nt, Escherichia coli CFT073
acucgaacaaggca

SEQ ID NO: 632509 - RNA, 18 nt, Escherichia coli CFT073
acucgaauuauucagagu

SEQ ID NO: 632510 - RNA, 14 nt, Escherichia coli CFT073
acucgaccugcaac

SEQ ID NO: 632511 - RNA, 22 nt, Escherichia coli CFT073
acugcgcgagcgucauauagcc

SEQ ID NO: 632512 - RNA, 13 nt, Escherichia coli CFT073
acugcggccagca

SEQ ID NO: 632513 - RNA, 19 nt, Escherichia coli CFT073
acugcgcucuaaaaucauc

SEQ ID NO: 632514 - RNA, 18 nt, Escherichia coli CFT073
acugcgaauuuccugcca

SEQ ID NO: 632515 - RNA, 19 nt, Escherichia coli CFT073
acugcgaccguacaaccaa

SEQ ID NO: 632516 - RNA, 15 nt, Escherichia coli CFT073
acugcgcauuaaaua

SEQ ID NO: 632517 - RNA, 19 nt, Escherichia coli CFT073
acugcgccaacgucugccu

SEQ ID NO: 632518 - RNA, 15 nt, Escherichia coli CFT073
acugcgccacucgau

SEQ ID NO: 632519 - RNA, 13 nt, Escherichia coli CFT073
acugcgcauggaa

SEQ ID NO: 632520 - RNA, 13 nt, Escherichia coli CFT073
acugcgccgggca

SEQ ID NO: 632521 - RNA, 18 nt, Escherichia coli CFT073
acugcgacaccagcaugu

SEQ ID NO: 632522 - RNA, 22 nt, Escherichia coli CFT073
acugccacacaggccauuuccc

SEQ ID NO: 632523 - RNA, 13 nt, Escherichia coli CFT073
acugccaccaucc

SEQ ID NO: 632524 - RNA, 15 nt, Escherichia coli CFT073
acugcauggcggcgu

SEQ ID NO: 632525 - RNA, 17 nt, Escherichia coli CFT073
acugcauucccaucgca

SEQ ID NO: 632526 - RNA, 21 nt, Escherichia coli CFT073
acuggagacagauuuauaaaa

SEQ ID NO: 632527 - RNA, 22 nt, Escherichia coli CFT073
acuggagacagauuuauaaaau

SEQ ID NO: 632528 - RNA, 16 nt, Escherichia coli CFT073
acuggacacugaauaa

SEQ ID NO: 632529 - RNA, 15 nt, Escherichia coli CFT073
acuggauaaccuguu

SEQ ID NO: 632530 - RNA, 13 nt, Escherichia coli CFT073
acuggauacgcug

SEQ ID NO: 632531 - RNA, 19 nt, Escherichia coli CFT073
acuggaaaaccgcacucac

SEQ ID NO: 632532 - RNA, 13 nt, Escherichia coli CFT073
acuggaaaucaaa

SEQ ID NO: 632533 - RNA, 18 nt, Escherichia coli CFT073
acuggaaaugaucccaga

SEQ ID NO: 632534 - RNA, 13 nt, Escherichia coli CFT073
acugcugcauccg

SEQ ID NO: 632535 - RNA, 15 nt, Escherichia coli CFT073
acugcugaaugaggc

SEQ ID NO: 632536 - RNA, 16 nt, Escherichia coli CFT073
acugcucguucagcac

SEQ ID NO: 632537 - RNA, 21 nt, Escherichia coli CFT073
acucuuuuugacguuuuuaca

SEQ ID NO: 632538 - RNA, 18 nt, Escherichia coli CFT073
acucuuuuaccaccgcaa

SEQ ID NO: 632539 - RNA, 15 nt, Escherichia coli CFT073
acucuuucugacgaa

SEQ ID NO: 632540 - RNA, 22 nt, Escherichia coli CFT073
acugagaucugaccuauuucau

SEQ ID NO: 632541 - RNA, 17 nt, Escherichia coli CFT073
acugagcgugagugcga

SEQ ID NO: 632542 - RNA, 20 nt, Escherichia coli CFT073
acugagguaacucucaugcu

SEQ ID NO: 632543 - RNA, 18 nt, Escherichia coli CFT073
acugaguaauagccugau

SEQ ID NO: 632544 - RNA, 23 nt, Escherichia coli CFT073
acugauuuguaugguuuuguagg

SEQ ID NO: 632545 - RNA, 20 nt, Escherichia coli CFT073
acugauuguacuguuacuca

SEQ ID NO: 632546 - RNA, 21 nt, Escherichia coli CFT073
acugcaaauuuuaacgcauaa

SEQ ID NO: 632547 - RNA, 12 nt, Escherichia coli CFT073
acugaguucaua

SEQ ID NO: 632548 - RNA, 15 nt, Escherichia coli CFT073
acugaguuuuauucu

SEQ ID NO: 632549 - RNA, 16 nt, Escherichia coli CFT073
acugauaacuuuuuau

SEQ ID NO: 632550 - RNA, 23 nt, Escherichia coli CFT073
acugauaauaaauaacagugccg

SEQ ID NO: 632551 - RNA, 21 nt, Escherichia coli CFT073
acugauaucuaacagugccug

SEQ ID NO: 632552 - RNA, 13 nt, Escherichia coli CFT073
acugauauuguga

SEQ ID NO: 632553 - RNA, 14 nt, Escherichia coli CFT073
acugaucaauaaau

SEQ ID NO: 632554 - RNA, 22 nt, Escherichia coli CFT073
acugaucaccugcgauaaaccg

SEQ ID NO: 632555 - RNA, 12 nt, Escherichia coli CFT073
acugaucaucau

SEQ ID NO: 632556 - RNA, 16 nt, Escherichia coli CFT073
acugaucgucaucaaa

SEQ ID NO: 632557 - RNA, 20 nt, Escherichia coli CFT073
acuuccagcagaccagcaau

SEQ ID NO: 632558 - RNA, 20 nt, Escherichia coli CFT073
acuuccagcaguucgcccgc

SEQ ID NO: 632559 - RNA, 16 nt, Escherichia coli CFT073
acuuccauuccaccau

SEQ ID NO: 632560 - RNA, 12 nt, Escherichia coli CFT073
acuuccccugcc

SEQ ID NO: 632561 - RNA, 14 nt, Escherichia coli CFT073
acuucccagccccg

SEQ ID NO: 632562 - RNA, 20 nt, Escherichia coli CFT073
acuuccgcgucaaucugccc

SEQ ID NO: 632563 - RNA, 18 nt, Escherichia coli CFT073
acuucauucagaaaaacu

SEQ ID NO: 632564 - RNA, 13 nt, Escherichia coli CFT073
acuuccaacgaac

SEQ ID NO: 632565 - RNA, 22 nt, Escherichia coli CFT073
acuuccaacgaacguuccccgc

SEQ ID NO: 632566 - RNA, 14 nt, Escherichia coli CFT073
acuuccaccacuuc

SEQ ID NO: 632567 - RNA, 18 nt, Escherichia coli CFT073
acuuccaccacuuccugc

SEQ ID NO: 632568 - RNA, 15 nt, Escherichia coli CFT073
acuucauccggauac

SEQ ID NO: 632569 - RNA, 16 nt, Escherichia coli CFT073
acuucaucggcaaagg

SEQ ID NO: 632570 - RNA, 19 nt, Escherichia coli CFT073
acuucaucggaaugcacag

SEQ ID NO: 632571 - RNA, 21 nt, Escherichia coli CFT073
acuucaucggaaugcacagcc

SEQ ID NO: 632572 - RNA, 17 nt, Escherichia coli CFT073
acuucaucacgaugcaa

SEQ ID NO: 632573 - RNA, 18 nt, Escherichia coli CFT073
acuucauccgacaccagc

SEQ ID NO: 632574 - RNA, 23 nt, Escherichia coli CFT073
acuucauccgacaccagccgugc

SEQ ID NO: 632575 - RNA, 23 nt, Escherichia coli CFT073
acuuccgggucgcugucuuucaa

SEQ ID NO: 632576 - RNA, 12 nt, Escherichia coli CFT073
acuuccuuuaga

SEQ ID NO: 632577 - RNA, 16 nt, Escherichia coli CFT073
acuuccugucuucccu

SEQ ID NO: 632578 - RNA, 20 nt, Escherichia coli CFT073
acuuccuucgccgcuuuaau

SEQ ID NO: 632579 - RNA, 16 nt, Escherichia coli CFT073
acuuccugcucuuucg

SEQ ID NO: 632580 - RNA, 17 nt, Escherichia coli CFT073
acuucgccacagcggca

SEQ ID NO: 632581 - RNA, 24 nt, Escherichia coli CFT073
acuucgccagcgugacuauuaaaa

SEQ ID NO: 632582 - RNA, 23 nt, Escherichia coli CFT073
acuucgccggaauuucuuucagc

SEQ ID NO: 632583 - RNA, 23 nt, Escherichia coli CFT073
acuucgcguucuguggcagggca

SEQ ID NO: 632584 - RNA, 15 nt, Escherichia coli CFT073
acuucggcagagaaa

SEQ ID NO: 632585 - RNA, 13 nt, Escherichia coli CFT073
acuucggcaucaa

SEQ ID NO: 632586 - RNA, 15 nt, Escherichia coli CFT073
acuucggcaucaaua

SEQ ID NO: 632587 - RNA, 18 nt, Escherichia coli CFT073
acuucgcucuuaucacca

SEQ ID NO: 632588 - RNA, 18 nt, Escherichia coli CFT073
acuucgcugguguacugc

SEQ ID NO: 632589 - RNA, 24 nt, Escherichia coli CFT073
acuucuuagucccaaacagcagaa

SEQ ID NO: 632590 - RNA, 15 nt, Escherichia coli CFT073
acuucugcugugacu

SEQ ID NO: 632591 - RNA, 20 nt, Escherichia coli CFT073
acuucugcugugacuucagc

SEQ ID NO: 632592 - RNA, 12 nt, Escherichia coli CFT073
acuucugcugca

SEQ ID NO: 632593 - RNA, 15 nt, Escherichia coli CFT073
acuucugcugcacga

SEQ ID NO: 632594 - RNA, 16 nt, Escherichia coli CFT073
acuucugaucuacagc

SEQ ID NO: 632595 - RNA, 15 nt, Escherichia coli CFT073
acuucugaugcaggu

SEQ ID NO: 632596 - RNA, 15 nt, Escherichia coli CFT073
acuucuauucaccag

SEQ ID NO: 632597 - RNA, 20 nt, Escherichia coli CFT073
acuucuuuugucgcuuuaac

SEQ ID NO: 632598 - RNA, 24 nt, Escherichia coli CFT073
acuugacuaagcguuuucugccag

SEQ ID NO: 632599 - RNA, 19 nt, Escherichia coli CFT073
acuugagccgccaccagaa

SEQ ID NO: 632600 - RNA, 16 nt, Escherichia coli CFT073
acuucuucauucaucc

SEQ ID NO: 632601 - RNA, 22 nt, Escherichia coli CFT073
acuucuucacaucaauauucca

SEQ ID NO: 632602 - RNA, 20 nt, Escherichia coli CFT073
acuucuuaaugcccaucucu

SEQ ID NO: 632603 - RNA, 18 nt, Escherichia coli CFT073
acuucuucguuuucugcg

SEQ ID NO: 632604 - RNA, 18 nt, Escherichia coli CFT073
acuucuucuuguucauca

SEQ ID NO: 632605 - RNA, 14 nt, Escherichia coli CFT073
acuucuucuucgcu

SEQ ID NO: 632606 - RNA, 16 nt, Escherichia coli CFT073
acuucuuuuaccuuca

SEQ ID NO: 632607 - RNA, 23 nt, Escherichia coli CFT073
acuuauuaaagaucuuauugcca

SEQ ID NO: 632608 - RNA, 17 nt, Escherichia coli CFT073
acuuauucaaucucuuc

SEQ ID NO: 632609 - RNA, 15 nt, Escherichia coli CFT073
acuuaucaucgcaaa

SEQ ID NO: 632610 - RNA, 13 nt, Escherichia coli CFT073
acuuaucggaaca

SEQ ID NO: 632611 - RNA, 15 nt, Escherichia coli CFT073
acuuaucuuauuccc

SEQ ID NO: 632612 - RNA, 23 nt, Escherichia coli CFT073
acuucaccauucacauccacaca

SEQ ID NO: 632613 - RNA, 18 nt, Escherichia coli CFT073
acuucacaucauccggca

SEQ ID NO: 632614 - RNA, 22 nt, Escherichia coli CFT073
acuucaggugacauuaaagcuu

SEQ ID NO: 632615 - RNA, 14 nt, Escherichia coli CFT073
acuucagguucagc

SEQ ID NO: 632616 - RNA, 12 nt, Escherichia coli CFT073
acuucagcagca

SEQ ID NO: 632617 - RNA, 19 nt, Escherichia coli CFT073
acugugaguggcuccaugu

SEQ ID NO: 632618 - RNA, 19 nt, Escherichia coli CFT073
acuguucauuuuguaggcc

SEQ ID NO: 632619 - RNA, 14 nt, Escherichia coli CFT073
acugugccaaaucu

SEQ ID NO: 632620 - RNA, 15 nt, Escherichia coli CFT073
acuguugcuguagcu

SEQ ID NO: 632621 - RNA, 19 nt, Escherichia coli CFT073
acuguucgagguaauccag

SEQ ID NO: 632622 - RNA, 17 nt, Escherichia coli CFT073
acugucguugugccuuc

SEQ ID NO: 632623 - RNA, 20 nt, Escherichia coli CFT073
acugucguuuagacgcugcg

SEQ ID NO: 632624 - RNA, 17 nt, Escherichia coli CFT073
acuggcagggaaagaaa

SEQ ID NO: 632625 - RNA, 13 nt, Escherichia coli CFT073
acuggaugacgaa

SEQ ID NO: 632626 - RNA, 15 nt, Escherichia coli CFT073
acuggcaaaaacaag

SEQ ID NO: 632627 - RNA, 15 nt, Escherichia coli CFT073
acuguugucgagcaa

SEQ ID NO: 632628 - RNA, 21 nt, Escherichia coli CFT073
acuuacgauuuuaauagcuua

SEQ ID NO: 632629 - RNA, 17 nt, Escherichia coli CFT073
acuuacucauuaaugca

SEQ ID NO: 632630 - RNA, 18 nt, Escherichia coli CFT073
acguuuuccuucaaugau

SEQ ID NO: 632631 - RNA, 14 nt, Escherichia coli CFT073
acguuuuucaucca

SEQ ID NO: 632632 - RNA, 16 nt, Escherichia coli CFT073
acuaaaacuuuauuca

SEQ ID NO: 632633 - RNA, 14 nt, Escherichia coli CFT073
acuaaauaugaaaa

SEQ ID NO: 632634 - RNA, 18 nt, Escherichia coli CFT073
acguuucacggucggcca

SEQ ID NO: 632635 - RNA, 14 nt, Escherichia coli CFT073
acguuucagccacg

SEQ ID NO: 632636 - RNA, 18 nt, Escherichia coli CFT073
acguuucaaacaggcugc

SEQ ID NO: 632637 - RNA, 15 nt, Escherichia coli CFT073
acguuuaauauuacc

SEQ ID NO: 632638 - RNA, 14 nt, Escherichia coli CFT073
acguuuacuucgcu

SEQ ID NO: 632639 - RNA, 16 nt, Escherichia coli CFT073
acguuugauuuuuaac

SEQ ID NO: 632640 - RNA, 19 nt, Escherichia coli CFT073
acguuuuaagcaaauaauu

SEQ ID NO: 632641 - RNA, 14 nt, Escherichia coli CFT073
acguuugccagcca

SEQ ID NO: 632642 - RNA, 19 nt, Escherichia coli CFT073
acguuugccagccacacca

SEQ ID NO: 632643 - RNA, 14 nt, Escherichia coli CFT073
acguugcaaauauu

SEQ ID NO: 632644 - RNA, 15 nt, Escherichia coli CFT073
acguugcaacugcga

SEQ ID NO: 632645 - RNA, 19 nt, Escherichia coli CFT073
acguugccagcaacuguaa

SEQ ID NO: 632646 - RNA, 22 nt, Escherichia coli CFT073
acguugccguaagcaacgccaa

SEQ ID NO: 632647 - RNA, 13 nt, Escherichia coli CFT073
acguuggcagugc

SEQ ID NO: 632648 - RNA, 15 nt, Escherichia coli CFT073
acguuggcgauugca

SEQ ID NO: 632649 - RNA, 19 nt, Escherichia coli CFT073
acguuguccagcuuaauuc

SEQ ID NO: 632650 - RNA, 23 nt, Escherichia coli CFT073
acguugugauguacuaaccaugc

SEQ ID NO: 632651 - RNA, 14 nt, Escherichia coli CFT073
acgugcccuuucag

SEQ ID NO: 632652 - RNA, 14 nt, Escherichia coli CFT073
acgugacauucuga

SEQ ID NO: 632653 - RNA, 13 nt, Escherichia coli CFT073
acgugaauuuuua

SEQ ID NO: 632654 - RNA, 20 nt, Escherichia coli CFT073
acgugacauagagauaacug

SEQ ID NO: 632655 - RNA, 22 nt, Escherichia coli CFT073
acgugacauagagauaacuggc

SEQ ID NO: 632656 - RNA, 15 nt, Escherichia coli CFT073
acgugaccaguacca

SEQ ID NO: 632657 - RNA, 21 nt, Escherichia coli CFT073
acgucuugcugugcagcaagc

SEQ ID NO: 632658 - RNA, 12 nt, Escherichia coli CFT073
acgucugccugg

SEQ ID NO: 632659 - RNA, 21 nt, Escherichia coli CFT073
acgucugccugguuucucucc

SEQ ID NO: 632660 - RNA, 12 nt, Escherichia coli CFT073
acgucuucgcca

SEQ ID NO: 632661 - RNA, 15 nt, Escherichia coli CFT073
acguagcuauauuuu

SEQ ID NO: 632662 - RNA, 15 nt, Escherichia coli CFT073
acguagcgcaacagg

SEQ ID NO: 632663 - RNA, 17 nt, Escherichia coli CFT073
acguagcggaaaucaca

SEQ ID NO: 632664 - RNA, 20 nt, Escherichia coli CFT073
acguaguacccucugcacca

SEQ ID NO: 632665 - RNA, 15 nt, Escherichia coli CFT073
acgucugccacggca

SEQ ID NO: 632666 - RNA, 14 nt, Escherichia coli CFT073
acguaggccucagg

SEQ ID NO: 632667 - RNA, 21 nt, Escherichia coli CFT073
acguuaugcaccgacaaucca

SEQ ID NO: 632668 - RNA, 22 nt, Escherichia coli CFT073
acguuaugcaccgacaauccag

SEQ ID NO: 632669 - RNA, 20 nt, Escherichia coli CFT073
acguuaugcuuacugagaua

SEQ ID NO: 632670 - RNA, 20 nt, Escherichia coli CFT073
acguuacuuaacacccccug

SEQ ID NO: 632671 - RNA, 22 nt, Escherichia coli CFT073
acgugcguaccauuaucaccaa

SEQ ID NO: 632672 - RNA, 22 nt, Escherichia coli CFT073
acguucagcacguuaaguucau

SEQ ID NO: 632673 - RNA, 16 nt, Escherichia coli CFT073
acguuauugguggugu

SEQ ID NO: 632674 - RNA, 14 nt, Escherichia coli CFT073
acuaaccagacgcc

SEQ ID NO: 632675 - RNA, 15 nt, Escherichia coli CFT073
acuaagcguuuucug

SEQ ID NO: 632676 - RNA, 19 nt, Escherichia coli CFT073
acuaagcugcgggaaauaa

SEQ ID NO: 632677 - RNA, 22 nt, Escherichia coli CFT073
acuaagcugcgggaaauaacaa

SEQ ID NO: 632678 - RNA, 14 nt, Escherichia coli CFT073
acuaagauaaucca

SEQ ID NO: 632679 - RNA, 12 nt, Escherichia coli CFT073
acuaacuggcaa

SEQ ID NO: 632680 - RNA, 14 nt, Escherichia coli CFT073
acuaauagcaaaau

SEQ ID NO: 632681 - RNA, 17 nt, Escherichia coli CFT073
acuaauuaauaauauaa

SEQ ID NO: 632682 - RNA, 16 nt, Escherichia coli CFT073
acuaauugcaaacaga

SEQ ID NO: 632683 - RNA, 23 nt, Escherichia coli CFT073
acuacccgcgccaauaacagaau

SEQ ID NO: 632684 - RNA, 16 nt, Escherichia coli CFT073
acuaccgcccgaugaa

SEQ ID NO: 632685 - RNA, 16 nt, Escherichia coli CFT073
acuaccgccgagcaca

SEQ ID NO: 632686 - RNA, 14 nt, Escherichia coli CFT073
acuaccggaaccaa

SEQ ID NO: 632687 - RNA, 24 nt, Escherichia coli CFT073
acuaccccaauaauucuuccuuca

SEQ ID NO: 632688 - RNA, 21 nt, Escherichia coli CFT073
acuacagcggaacuuuuuuca

SEQ ID NO: 632689 - RNA, 22 nt, Escherichia coli CFT073
acuagauuaccagagaaaagau

SEQ ID NO: 632690 - RNA, 16 nt, Escherichia coli CFT073
acuagcgcuuuuucug

SEQ ID NO: 632691 - RNA, 18 nt, Escherichia coli CFT073
acuauauaaaccuucugu

SEQ ID NO: 632692 - RNA, 19 nt, Escherichia coli CFT073
acuauacuccugauggccu

SEQ ID NO: 632693 - RNA, 20 nt, Escherichia coli CFT073
acuauuguauaccaaucguc

SEQ ID NO: 632694 - RNA, 12 nt, Escherichia coli CFT073
acuauugaagcc

SEQ ID NO: 632695 - RNA, 16 nt, Escherichia coli CFT073
acuauuuacagauuuc

SEQ ID NO: 632696 - RNA, 16 nt, Escherichia coli CFT073
acuauuucaucagaag

SEQ ID NO: 632697 - RNA, 22 nt, Escherichia coli CFT073
acggcgcgacuuuaaucaccug

SEQ ID NO: 632698 - RNA, 14 nt, Escherichia coli CFT073
acggcaacaauuuc

SEQ ID NO: 632699 - RNA, 20 nt, Escherichia coli CFT073
acggcaacaauuuccgcagc

SEQ ID NO: 632700 - RNA, 14 nt, Escherichia coli CFT073
acggcgugccgucg

SEQ ID NO: 632701 - RNA, 20 nt, Escherichia coli CFT073
acggcgugagaaccgcaccg

SEQ ID NO: 632702 - RNA, 19 nt, Escherichia coli CFT073
acggcguuuccagcucggc

SEQ ID NO: 632703 - RNA, 13 nt, Escherichia coli CFT073
acggcuaaaaaaa

SEQ ID NO: 632704 - RNA, 15 nt, Escherichia coli CFT073
acggcuuucauauaa

SEQ ID NO: 632705 - RNA, 13 nt, Escherichia coli CFT073
acggcuucucggc

SEQ ID NO: 632706 - RNA, 19 nt, Escherichia coli CFT073
acggcuucgccaaaucguu

SEQ ID NO: 632707 - RNA, 21 nt, Escherichia coli CFT073
acggcuuguguguaaagauug

SEQ ID NO: 632708 - RNA, 22 nt, Escherichia coli CFT073
acggcuuuggcgguuuucucuu

SEQ ID NO: 632709 - RNA, 15 nt, Escherichia coli CFT073
acgggaacagugcuc

SEQ ID NO: 632710 - RNA, 18 nt, Escherichia coli CFT073
acgggcgauacaccuuca

SEQ ID NO: 632711 - RNA, 14 nt, Escherichia coli CFT073
acggcuccccgccc

SEQ ID NO: 632712 - RNA, 16 nt, Escherichia coli CFT073
acggcuccccgcccug

SEQ ID NO: 632713 - RNA, 17 nt, Escherichia coli CFT073
acggcugggaaaucacc

SEQ ID NO: 632714 - RNA, 19 nt, Escherichia coli CFT073
acggcugggaaaucaccac

SEQ ID NO: 632715 - RNA, 15 nt, Escherichia coli CFT073
acggcugggaaauca

SEQ ID NO: 632716 - RNA, 16 nt, Escherichia coli CFT073
acggcugcuaauauuu

SEQ ID NO: 632717 - RNA, 14 nt, Escherichia coli CFT073
acguaccaacugau

SEQ ID NO: 632718 - RNA, 14 nt, Escherichia coli CFT073
acguaccggcgcgu

SEQ ID NO: 632719 - RNA, 18 nt, Escherichia coli CFT073
acguacgcuguucgccag

SEQ ID NO: 632720 - RNA, 23 nt, Escherichia coli CFT073
acguacggcccauaacccacacc

SEQ ID NO: 632721 - RNA, 19 nt, Escherichia coli CFT073
acguacggcuucagacacc

SEQ ID NO: 632722 - RNA, 21 nt, Escherichia coli CFT073
acguaauaaaaucuauuauua

SEQ ID NO: 632723 - RNA, 16 nt, Escherichia coli CFT073
acgguuucaaccagca

SEQ ID NO: 632724 - RNA, 17 nt, Escherichia coli CFT073
acgguuucaaccagcag

SEQ ID NO: 632725 - RNA, 17 nt, Escherichia coli CFT073
acgguuuuuugaacaga

SEQ ID NO: 632726 - RNA, 14 nt, Escherichia coli CFT073
acguaaaugccagc

SEQ ID NO: 632727 - RNA, 16 nt, Escherichia coli CFT073
acguaaaugccagccc

SEQ ID NO: 632728 - RNA, 14 nt, Escherichia coli CFT073
acguaacagagcau

SEQ ID NO: 632729 - RNA, 19 nt, Escherichia coli CFT073
acguaacaguacaauauua

SEQ ID NO: 632730 - RNA, 16 nt, Escherichia coli CFT073
acggugccaugcugag

SEQ ID NO: 632731 - RNA, 22 nt, Escherichia coli CFT073
acgguaccuaccgguggcguga

SEQ ID NO: 632732 - RNA, 15 nt, Escherichia coli CFT073
acggugguaaagccg

SEQ ID NO: 632733 - RNA, 16 nt, Escherichia coli CFT073
acgggcggaggggagg

SEQ ID NO: 632734 - RNA, 21 nt, Escherichia coli CFT073
acgggugauaggguacgaccc

SEQ ID NO: 632735 - RNA, 20 nt, Escherichia coli CFT073
acgguaaaaccgugcuucag

SEQ ID NO: 632736 - RNA, 13 nt, Escherichia coli CFT073
acgguaauauuuu

SEQ ID NO: 632737 - RNA, 17 nt, Escherichia coli CFT073
acgcugcaaaaagccuu

SEQ ID NO: 632738 - RNA, 15 nt, Escherichia coli CFT073
acgcugaucgacgaa

SEQ ID NO: 632739 - RNA, 18 nt, Escherichia coli CFT073
acgcugcauacucugcaa

SEQ ID NO: 632740 - RNA, 22 nt, Escherichia coli CFT073
acgcugcauggcaacuuuaaua

SEQ ID NO: 632741 - RNA, 17 nt, Escherichia coli CFT073
acgcugacaaacugcgu

SEQ ID NO: 632742 - RNA, 20 nt, Escherichia coli CFT073
acgcuucaccacgccccacg

SEQ ID NO: 632743 - RNA, 17 nt, Escherichia coli CFT073
acgcuucaaccagugca

SEQ ID NO: 632744 - RNA, 21 nt, Escherichia coli CFT073
acgcuucgguaaauugcccca

SEQ ID NO: 632745 - RNA, 23 nt, Escherichia coli CFT073
acgcuucugucgcuucacgcagg

SEQ ID NO: 632746 - RNA, 21 nt, Escherichia coli CFT073
acgcuguucaucccgaccagu

SEQ ID NO: 632747 - RNA, 21 nt, Escherichia coli CFT073
acgcuguuccggcggcagggu

SEQ ID NO: 632748 - RNA, 15 nt, Escherichia coli CFT073
acgcugucgcgucuu

SEQ ID NO: 632749 - RNA, 13 nt, Escherichia coli CFT073
acgcugucggcaa

SEQ ID NO: 632750 - RNA, 17 nt, Escherichia coli CFT073
acgcugucggugccauc

SEQ ID NO: 632751 - RNA, 18 nt, Escherichia coli CFT073
acgcugucuuuugaucaa

SEQ ID NO: 632752 - RNA, 14 nt, Escherichia coli CFT073
acgcucaacguuua

SEQ ID NO: 632753 - RNA, 17 nt, Escherichia coli CFT073
acgcucaagaacggcaa

SEQ ID NO: 632754 - RNA, 23 nt, Escherichia coli CFT073
acgccauagggcgugaagacugc

SEQ ID NO: 632755 - RNA, 14 nt, Escherichia coli CFT073
acgccaucaacgaa

SEQ ID NO: 632756 - RNA, 14 nt, Escherichia coli CFT073
acgccaucucuuua

SEQ ID NO: 632757 - RNA, 21 nt, Escherichia coli CFT073
acgccagugucgcaucaggca

SEQ ID NO: 632758 - RNA, 20 nt, Escherichia coli CFT073
acgcucuuucaccaguggga

SEQ ID NO: 632759 - RNA, 13 nt, Escherichia coli CFT073
acgcucuuccagg

SEQ ID NO: 632760 - RNA, 16 nt, Escherichia coli CFT073
acgcucuuccagggua

SEQ ID NO: 632761 - RNA, 18 nt, Escherichia coli CFT073
acgcucuuccaggguaaa

SEQ ID NO: 632762 - RNA, 19 nt, Escherichia coli CFT073
acggaauuuaaaugacaau

SEQ ID NO: 632763 - RNA, 11 nt, Escherichia coli CFT073
acggacaugaa

SEQ ID NO: 632764 - RNA, 17 nt, Escherichia coli CFT073
acggaccgcaugcagca

SEQ ID NO: 632765 - RNA, 15 nt, Escherichia coli CFT073
acggacgcgcggcga

SEQ ID NO: 632766 - RNA, 15 nt, Escherichia coli CFT073
acggacgcaacugau

SEQ ID NO: 632767 - RNA, 22 nt, Escherichia coli CFT073
acggacucggcgucgguaaaga

SEQ ID NO: 632768 - RNA, 16 nt, Escherichia coli CFT073
acggagaauccagccc

SEQ ID NO: 632769 - RNA, 18 nt, Escherichia coli CFT073
acggagaauccagcccca

SEQ ID NO: 632770 - RNA, 23 nt, Escherichia coli CFT073
acggaguaacaaaugugccauuc

SEQ ID NO: 632771 - RNA, 17 nt, Escherichia coli CFT073
acggaguugaccagcuc

SEQ ID NO: 632772 - RNA, 18 nt, Escherichia coli CFT073
acggauaaacguggugcg

SEQ ID NO: 632773 - RNA, 14 nt, Escherichia coli CFT073
acggauccagaacu

SEQ ID NO: 632774 - RNA, 15 nt, Escherichia coli CFT073
acggauccagaacug

SEQ ID NO: 632775 - RNA, 12 nt, Escherichia coli CFT073
acggaucaggca

SEQ ID NO: 632776 - RNA, 15 nt, Escherichia coli CFT073
acggauagccgcccc

SEQ ID NO: 632777 - RNA, 19 nt, Escherichia coli CFT073
acggcaaacacgccgccgg

SEQ ID NO: 632778 - RNA, 22 nt, Escherichia coli CFT073
acggaaaaaccccggucguugu

SEQ ID NO: 632779 - RNA, 14 nt, Escherichia coli CFT073
acggaaaagcaaca

SEQ ID NO: 632780 - RNA, 22 nt, Escherichia coli CFT073
acgcuuuuccacucacacagcu

SEQ ID NO: 632781 - RNA, 21 nt, Escherichia coli CFT073
acggaaagcagauaacccagc

SEQ ID NO: 632782 - RNA, 18 nt, Escherichia coli CFT073
acggaaaucauccagcac

SEQ ID NO: 632783 - RNA, 19 nt, Escherichia coli CFT073
acggaaaucauccagcacg

SEQ ID NO: 632784 - RNA, 16 nt, Escherichia coli CFT073
acggaaugauauuggu

SEQ ID NO: 632785 - RNA, 13 nt, Escherichia coli CFT073
acggaaguuuaau

SEQ ID NO: 632786 - RNA, 14 nt, Escherichia coli CFT073
acggaauaaaccca

SEQ ID NO: 632787 - RNA, 16 nt, Escherichia coli CFT073
acgcuuugcugccuuc

SEQ ID NO: 632788 - RNA, 14 nt, Escherichia coli CFT073
acgcuuucucacca

SEQ ID NO: 632789 - RNA, 22 nt, Escherichia coli CFT073
acgcuuucagcacuucggcauc

SEQ ID NO: 632790 - RNA, 14 nt, Escherichia coli CFT073
acgcuuucacccgg

SEQ ID NO: 632791 - RNA, 22 nt, Escherichia coli CFT073
acgcauuucucgguauuacaau

SEQ ID NO: 632792 - RNA, 13 nt, Escherichia coli CFT073
acgccaaccaccg

SEQ ID NO: 632793 - RNA, 15 nt, Escherichia coli CFT073
acgccaaauucuuua

SEQ ID NO: 632794 - RNA, 20 nt, Escherichia coli CFT073
acgccaacaaaaaugcaggc

SEQ ID NO: 632795 - RNA, 15 nt, Escherichia coli CFT073
acgccaauaaucugc

SEQ ID NO: 632796 - RNA, 23 nt, Escherichia coli CFT073
acgccaauaaucugcccggcauu

SEQ ID NO: 632797 - RNA, 15 nt, Escherichia coli CFT073
acgccaaucugcaaa

SEQ ID NO: 632798 - RNA, 19 nt, Escherichia coli CFT073
acgccaccauucgccaaga

SEQ ID NO: 632799 - RNA, 16 nt, Escherichia coli CFT073
acgccacgacucaaau

SEQ ID NO: 632800 - RNA, 16 nt, Escherichia coli CFT073
acgccacgcucacuca

SEQ ID NO: 632801 - RNA, 17 nt, Escherichia coli CFT073
acgccacucacuaccag

SEQ ID NO: 632802 - RNA, 17 nt, Escherichia coli CFT073
acgccacucacugaugc

SEQ ID NO: 632803 - RNA, 21 nt, Escherichia coli CFT073
acgccagccugcgcuaccaga

SEQ ID NO: 632804 - RNA, 21 nt, Escherichia coli CFT073
acgccagcgaagccagcuccc

SEQ ID NO: 632805 - RNA, 16 nt, Escherichia coli CFT073
acgccagccgccagca

SEQ ID NO: 632806 - RNA, 15 nt, Escherichia coli CFT073
acgccacuaagcagg

SEQ ID NO: 632807 - RNA, 21 nt, Escherichia coli CFT073
acgccagacucucgccagaga

SEQ ID NO: 632808 - RNA, 14 nt, Escherichia coli CFT073
acgccagacagccu

SEQ ID NO: 632809 - RNA, 15 nt, Escherichia coli CFT073
acgccagauccgcca

SEQ ID NO: 632810 - RNA, 14 nt, Escherichia coli CFT073
acgccagcauguug

SEQ ID NO: 632811 - RNA, 13 nt, Escherichia coli CFT073
acgccagccaauc

SEQ ID NO: 632812 - RNA, 18 nt, Escherichia coli CFT073
acgcauguuguuuucaac

SEQ ID NO: 632813 - RNA, 22 nt, Escherichia coli CFT073
acgcauucgccguuaccagcac

SEQ ID NO: 632814 - RNA, 14 nt, Escherichia coli CFT073
acgcaucuuuuuca

SEQ ID NO: 632815 - RNA, 16 nt, Escherichia coli CFT073
acgcauagacagccac

SEQ ID NO: 632816 - RNA, 14 nt, Escherichia coli CFT073
acgcaucagucacg

SEQ ID NO: 632817 - RNA, 17 nt, Escherichia coli CFT073
acgcaucaugccgccca

SEQ ID NO: 632818 - RNA, 18 nt, Escherichia coli CFT073
acgcaucgcgcaccagcg

SEQ ID NO: 632819 - RNA, 16 nt, Escherichia coli CFT073
acgcagucagcacugg

SEQ ID NO: 632820 - RNA, 21 nt, Escherichia coli CFT073
acgcagucgcugaccacgacu

SEQ ID NO: 632821 - RNA, 22 nt, Escherichia coli CFT073
acgcagugucagcaccagagaa

SEQ ID NO: 632822 - RNA, 22 nt, Escherichia coli CFT073
acgcaguugcugacgaucggca

SEQ ID NO: 632823 - RNA, 22 nt, Escherichia coli CFT073
acgcauaaugcgccccgcaacg

SEQ ID NO: 632824 - RNA, 16 nt, Escherichia coli CFT073
acgcacuucuuccggg

SEQ ID NO: 632825 - RNA, 23 nt, Escherichia coli CFT073
acgcacuggcgagcgccagcaug

SEQ ID NO: 632826 - RNA, 23 nt, Escherichia coli CFT073
acgcacuucuucguuuucugcgc

SEQ ID NO: 632827 - RNA, 21 nt, Escherichia coli CFT073
acgcagaccaaagucaaacug

SEQ ID NO: 632828 - RNA, 21 nt, Escherichia coli CFT073
acgcagacgcauacugauuac

SEQ ID NO: 632829 - RNA, 14 nt, Escherichia coli CFT073
acgcagcaaaagca

SEQ ID NO: 632830 - RNA, 23 nt, Escherichia coli CFT073
acgcagcaaaagcaggcaccgcg

SEQ ID NO: 632831 - RNA, 23 nt, Escherichia coli CFT073
acgcaggcguuucacuuucagau

SEQ ID NO: 632832 - RNA, 20 nt, Escherichia coli CFT073
acgcaggcaucuuuuucaau

SEQ ID NO: 632833 - RNA, 20 nt, Escherichia coli CFT073
acgcaggauguaauccggca

SEQ ID NO: 632834 - RNA, 14 nt, Escherichia coli CFT073
acgcagccccagcg

SEQ ID NO: 632835 - RNA, 23 nt, Escherichia coli CFT073
acgcagcgcguuacgcccaagca

SEQ ID NO: 632836 - RNA, 17 nt, Escherichia coli CFT073
acgcacgcgggugccug

SEQ ID NO: 632837 - RNA, 17 nt, Escherichia coli CFT073
acgcaccguaacccuga

SEQ ID NO: 632838 - RNA, 19 nt, Escherichia coli CFT073
acgcaccuugccaaauuua

SEQ ID NO: 632839 - RNA, 11 nt, Escherichia coli CFT073
acgcaccaucc

SEQ ID NO: 632840 - RNA, 12 nt, Escherichia coli CFT073
acgcaccaugca

SEQ ID NO: 632841 - RNA, 24 nt, Escherichia coli CFT073
acgcacccucaaaauuucucuuuc

SEQ ID NO: 632842 - RNA, 17 nt, Escherichia coli CFT073
acgcaccaccagcgccu

SEQ ID NO: 632843 - RNA, 15 nt, Escherichia coli CFT073
acgcaauauccgcca

SEQ ID NO: 632844 - RNA, 18 nt, Escherichia coli CFT073
acgcaaucgaguuugccg

SEQ ID NO: 632845 - RNA, 22 nt, Escherichia coli CFT073
acgcaauaccugacgcaacugc

SEQ ID NO: 632846 - RNA, 22 nt, Escherichia coli CFT073
acgcaacaugucagcaauuacc

SEQ ID NO: 632847 - RNA, 20 nt, Escherichia coli CFT073
acgcaaccugauguuucugc

SEQ ID NO: 632848 - RNA, 17 nt, Escherichia coli CFT073
acgcaacggcugguagc

SEQ ID NO: 632849 - RNA, 17 nt, Escherichia coli CFT073
acgaagcagcaucagca

SEQ ID NO: 632850 - RNA, 15 nt, Escherichia coli CFT073
acgaacucuucgccc

SEQ ID NO: 632851 - RNA, 20 nt, Escherichia coli CFT073
acgaacgcagcgucucauaa

SEQ ID NO: 632852 - RNA, 14 nt, Escherichia coli CFT073
acgaaguugaagug

SEQ ID NO: 632853 - RNA, 13 nt, Escherichia coli CFT073
acgaaguacucaa

SEQ ID NO: 632854 - RNA, 18 nt, Escherichia coli CFT073
acgacuguuggaaucacu

SEQ ID NO: 632855 - RNA, 17 nt, Escherichia coli CFT073
acgaaguuuaauucuuu

SEQ ID NO: 632856 - RNA, 21 nt, Escherichia coli CFT073
acgacuuugcuaccgucgccu

SEQ ID NO: 632857 - RNA, 18 nt, Escherichia coli CFT073
acgauacgcgucccggaa

SEQ ID NO: 632858 - RNA, 17 nt, Escherichia coli CFT073
acgauacaaaagcaccg

SEQ ID NO: 632859 - RNA, 14 nt, Escherichia coli CFT073
acgagacuuauuaa

SEQ ID NO: 632860 - RNA, 18 nt, Escherichia coli CFT073
acgaggcgacgguuucca

SEQ ID NO: 632861 - RNA, 17 nt, Escherichia coli CFT073
acgcaaacugcuucagg

SEQ ID NO: 632862 - RNA, 15 nt, Escherichia coli CFT073
acgcaaacuucgguu

SEQ ID NO: 632863 - RNA, 14 nt, Escherichia coli CFT073
acgcaaacaacuug

SEQ ID NO: 632864 - RNA, 13 nt, Escherichia coli CFT073
acgcaaacaccag

SEQ ID NO: 632865 - RNA, 13 nt, Escherichia coli CFT073
acgcaaaccaccu

SEQ ID NO: 632866 - RNA, 13 nt, Escherichia coli CFT073
acgauuuuuacuc

SEQ ID NO: 632867 - RNA, 17 nt, Escherichia coli CFT073
acgauuacaggaacugc

SEQ ID NO: 632868 - RNA, 17 nt, Escherichia coli CFT073
acgauucucccacagca

SEQ ID NO: 632869 - RNA, 16 nt, Escherichia coli CFT073
acgauuccaacgaaaa

SEQ ID NO: 632870 - RNA, 21 nt, Escherichia coli CFT073
acgaucggcguguuucaucuc

SEQ ID NO: 632871 - RNA, 21 nt, Escherichia coli CFT073
acgaugaccgcaucaauuacc

SEQ ID NO: 632872 - RNA, 22 nt, Escherichia coli CFT073
acgaugaccgcaucaauuaccu

SEQ ID NO: 632873 - RNA, 21 nt, Escherichia coli CFT073
acgaucuggcgucagcggcug

SEQ ID NO: 632874 - RNA, 22 nt, Escherichia coli CFT073
acgaucuucgccugaaacagaa

SEQ ID NO: 632875 - RNA, 15 nt, Escherichia coli CFT073
acgaucgcuuucaac

SEQ ID NO: 632876 - RNA, 20 nt, Escherichia coli CFT073
acgaucaguuacucugcaag

SEQ ID NO: 632877 - RNA, 12 nt, Escherichia coli CFT073
acgaucccaacu

SEQ ID NO: 632878 - RNA, 21 nt, Escherichia coli CFT073
acgaucccggagaagagauaa

SEQ ID NO: 632879 - RNA, 18 nt, Escherichia coli CFT073
acgauggcaauuuucacu

SEQ ID NO: 632880 - RNA, 15 nt, Escherichia coli CFT073
acgauggcguaacca

SEQ ID NO: 632881 - RNA, 15 nt, Escherichia coli CFT073
acgaugccauucagu

SEQ ID NO: 632882 - RNA, 15 nt, Escherichia coli CFT073
acgaugccagcgcug

SEQ ID NO: 632883 - RNA, 16 nt, Escherichia coli CFT073
acgaugccucaucaca

SEQ ID NO: 632884 - RNA, 15 nt, Escherichia coli CFT073
acgaugcacagcucu

SEQ ID NO: 632885 - RNA, 15 nt, Escherichia coli CFT073
acgaugcgaccgccg

SEQ ID NO: 632886 - RNA, 15 nt, Escherichia coli CFT073
accugauccagcucu

SEQ ID NO: 632887 - RNA, 18 nt, Escherichia coli CFT073
accugaguaaaucaccug

SEQ ID NO: 632888 - RNA, 23 nt, Escherichia coli CFT073
accuguuuucccauaauuucagc

SEQ ID NO: 632889 - RNA, 12 nt, Escherichia coli CFT073
accuguuuucac

SEQ ID NO: 632890 - RNA, 14 nt, Escherichia coli CFT073
accuucaaaauuua

SEQ ID NO: 632891 - RNA, 17 nt, Escherichia coli CFT073
accuucaaaauuuaaca

SEQ ID NO: 632892 - RNA, 12 nt, Escherichia coli CFT073
accuuauccagc

SEQ ID NO: 632893 - RNA, 14 nt, Escherichia coli CFT073
accuuauccagcag

SEQ ID NO: 632894 - RNA, 16 nt, Escherichia coli CFT073
accuuauccagcagau

SEQ ID NO: 632895 - RNA, 20 nt, Escherichia coli CFT073
accuuauggugucuaugcau

SEQ ID NO: 632896 - RNA, 21 nt, Escherichia coli CFT073
accuucaagaauccuuauuuu

SEQ ID NO: 632897 - RNA, 23 nt, Escherichia coli CFT073
accuucaauacuggcaaaaucaa

SEQ ID NO: 632898 - RNA, 13 nt, Escherichia coli CFT073
accuuaaccucag

SEQ ID NO: 632899 - RNA, 18 nt, Escherichia coli CFT073
accuuaaaacgaaucucu

SEQ ID NO: 632900 - RNA, 17 nt, Escherichia coli CFT073
accuuaccaaugcugca

SEQ ID NO: 632901 - RNA, 21 nt, Escherichia coli CFT073
accuuuaaacaggccgacaaa

SEQ ID NO: 632902 - RNA, 14 nt, Escherichia coli CFT073
accuugcuucuuac

SEQ ID NO: 632903 - RNA, 16 nt, Escherichia coli CFT073
accuugcggaaacugu

SEQ ID NO: 632904 - RNA, 19 nt, Escherichia coli CFT073
accuugcggaaacugucaa

SEQ ID NO: 632905 - RNA, 19 nt, Escherichia coli CFT073
accuucgaaugccgcagca

SEQ ID NO: 632906 - RNA, 13 nt, Escherichia coli CFT073
accuucgcggcac

SEQ ID NO: 632907 - RNA, 22 nt, Escherichia coli CFT073
accuucgggcgcuuccagccau

SEQ ID NO: 632908 - RNA, 20 nt, Escherichia coli CFT073
accuugauuauccucuguaa

SEQ ID NO: 632909 - RNA, 15 nt, Escherichia coli CFT073
acgaaaaggauaaau

SEQ ID NO: 632910 - RNA, 19 nt, Escherichia coli CFT073
accuuuccccggcagcauc

SEQ ID NO: 632911 - RNA, 12 nt, Escherichia coli CFT073
accuuucaccuc

SEQ ID NO: 632912 - RNA, 15 nt, Escherichia coli CFT073
acgaacacgaaucag

SEQ ID NO: 632913 - RNA, 14 nt, Escherichia coli CFT073
acgaaccgagcggu

SEQ ID NO: 632914 - RNA, 22 nt, Escherichia coli CFT073
accgguucaucacgaaaaucau

SEQ ID NO: 632915 - RNA, 22 nt, Escherichia coli CFT073
accgguggucggcucgucgaga

SEQ ID NO: 632916 - RNA, 20 nt, Escherichia coli CFT073
accgguucggacauguuuuc

SEQ ID NO: 632917 - RNA, 22 nt, Escherichia coli CFT073
accuaucgcgucgccggucagg

SEQ ID NO: 632918 - RNA, 21 nt, Escherichia coli CFT073
accgggcugucgucauaagcg

SEQ ID NO: 632919 - RNA, 13 nt, Escherichia coli CFT073
accggucgugacu

SEQ ID NO: 632920 - RNA, 19 nt, Escherichia coli CFT073
accggucgugacugccgcc

SEQ ID NO: 632921 - RNA, 20 nt, Escherichia coli CFT073
accggugaccaucagcauga

SEQ ID NO: 632922 - RNA, 12 nt, Escherichia coli CFT073
accucagugacc

SEQ ID NO: 632923 - RNA, 14 nt, Escherichia coli CFT073
accucagaaaucuc

SEQ ID NO: 632924 - RNA, 14 nt, Escherichia coli CFT073
accucaauggcagc

SEQ ID NO: 632925 - RNA, 23 nt, Escherichia coli CFT073
accuccugucuaaccgccugccu

SEQ ID NO: 632926 - RNA, 15 nt, Escherichia coli CFT073
accuccguuuuucug

SEQ ID NO: 632927 - RNA, 22 nt, Escherichia coli CFT073
accucuucuacugcaugauuag

SEQ ID NO: 632928 - RNA, 22 nt, Escherichia coli CFT073
accucuuuugcgauuguaauuu

SEQ ID NO: 632929 - RNA, 13 nt, Escherichia coli CFT073
accucuucuuuaa

SEQ ID NO: 632930 - RNA, 17 nt, Escherichia coli CFT073
accugacguugcagguu

SEQ ID NO: 632931 - RNA, 15 nt, Escherichia coli CFT073
accugacgcugcuca

SEQ ID NO: 632932 - RNA, 13 nt, Escherichia coli CFT073
accugacugugac

SEQ ID NO: 632933 - RNA, 21 nt, Escherichia coli CFT073
accugaccgagccagugcccg

SEQ ID NO: 632934 - RNA, 14 nt, Escherichia coli CFT073
accugacauuaagu

SEQ ID NO: 632935 - RNA, 14 nt, Escherichia coli CFT073
accucgucaccacc

SEQ ID NO: 632936 - RNA, 15 nt, Escherichia coli CFT073
accucgucaccaccu

SEQ ID NO: 632937 - RNA, 19 nt, Escherichia coli CFT073
accucgccccgugaugaac

SEQ ID NO: 632938 - RNA, 23 nt, Escherichia coli CFT073
accucgccccgugaugaacugcg

SEQ ID NO: 632939 - RNA, 19 nt, Escherichia coli CFT073
accggcguuucacauucuc

SEQ ID NO: 632940 - RNA, 22 nt, Escherichia coli CFT073
accggcuggcuaacaugcccau

SEQ ID NO: 632941 - RNA, 17 nt, Escherichia coli CFT073
accgggcggacuuucac

SEQ ID NO: 632942 - RNA, 22 nt, Escherichia coli CFT073
accggcuucgucgccagcucuu

SEQ ID NO: 632943 - RNA, 13 nt, Escherichia coli CFT073
accggcaagaaug

SEQ ID NO: 632944 - RNA, 17 nt, Escherichia coli CFT073
accggauugaccaacag

SEQ ID NO: 632945 - RNA, 22 nt, Escherichia coli CFT073
accggauuagucugguugagca

SEQ ID NO: 632946 - RNA, 13 nt, Escherichia coli CFT073
accggauuuucac

SEQ ID NO: 632947 - RNA, 14 nt, Escherichia coli CFT073
accggauuuucacc

SEQ ID NO: 632948 - RNA, 15 nt, Escherichia coli CFT073
accggcaaccagcac

SEQ ID NO: 632949 - RNA, 15 nt, Escherichia coli CFT073
accggagucugugcu

SEQ ID NO: 632950 - RNA, 15 nt, Escherichia coli CFT073
accggagcugcagcc

SEQ ID NO: 632951 - RNA, 23 nt, Escherichia coli CFT073
accggauaagaggcgccagcauc

SEQ ID NO: 632952 - RNA, 16 nt, Escherichia coli CFT073
accggauaaucggcaa

SEQ ID NO: 632953 - RNA, 14 nt, Escherichia coli CFT073
accgcugauugcug

SEQ ID NO: 632954 - RNA, 17 nt, Escherichia coli CFT073
accgcugauugcuggcg

SEQ ID NO: 632955 - RNA, 15 nt, Escherichia coli CFT073
accgcugccaggcac

SEQ ID NO: 632956 - RNA, 21 nt, Escherichia coli CFT073
accgcgcuggcugaaucccug

SEQ ID NO: 632957 - RNA, 16 nt, Escherichia coli CFT073
accgcgccaagccuga

SEQ ID NO: 632958 - RNA, 17 nt, Escherichia coli CFT073
accgcgccauguugccu

SEQ ID NO: 632959 - RNA, 18 nt, Escherichia coli CFT073
accgccuggcgcugcuca

SEQ ID NO: 632960 - RNA, 18 nt, Escherichia coli CFT073
accgcgauauuggucugc

SEQ ID NO: 632961 - RNA, 18 nt, Escherichia coli CFT073
accgcgacaauaucauca

SEQ ID NO: 632962 - RNA, 19 nt, Escherichia coli CFT073
accgccguugauuucacag

SEQ ID NO: 632963 - RNA, 16 nt, Escherichia coli CFT073
accgccugcaaauaaa

SEQ ID NO: 632964 - RNA, 16 nt, Escherichia coli CFT073
accgccguugccuuua

SEQ ID NO: 632965 - RNA, 23 nt, Escherichia coli CFT073
accgccguugccuuuaccgccac

SEQ ID NO: 632966 - RNA, 15 nt, Escherichia coli CFT073
accgccgcucaccug

SEQ ID NO: 632967 - RNA, 14 nt, Escherichia coli CFT073
accgccaacagcag

SEQ ID NO: 632968 - RNA, 15 nt, Escherichia coli CFT073
accgccaacaugcgc

SEQ ID NO: 632969 - RNA, 18 nt, Escherichia coli CFT073
accgccaaucgccacgcc

SEQ ID NO: 632970 - RNA, 14 nt, Escherichia coli CFT073
accgcaucggcauc

SEQ ID NO: 632971 - RNA, 19 nt, Escherichia coli CFT073
accgcauuaucaaggcagu

SEQ ID NO: 632972 - RNA, 16 nt, Escherichia coli CFT073
accgcaugcagcaugg

SEQ ID NO: 632973 - RNA, 13 nt, Escherichia coli CFT073
accgcaucaauua

SEQ ID NO: 632974 - RNA, 21 nt, Escherichia coli CFT073
accgcaucacgacagcaccac

SEQ ID NO: 632975 - RNA, 16 nt, Escherichia coli CFT073
accgcaucauguaaau

SEQ ID NO: 632976 - RNA, 20 nt, Escherichia coli CFT073
accgcaucauguaaaucaau

SEQ ID NO: 632977 - RNA, 17 nt, Escherichia coli CFT073
accgcauccggcaucag

SEQ ID NO: 632978 - RNA, 17 nt, Escherichia coli CFT073
accgcacgacgaaucug

SEQ ID NO: 632979 - RNA, 20 nt, Escherichia coli CFT073
accgcagaagcgauaaccuu

SEQ ID NO: 632980 - RNA, 16 nt, Escherichia coli CFT073
accgcagccgccacaa

SEQ ID NO: 632981 - RNA, 14 nt, Escherichia coli CFT073
accgcaggcggccg

SEQ ID NO: 632982 - RNA, 16 nt, Escherichia coli CFT073
accgcaggcugauaac

SEQ ID NO: 632983 - RNA, 18 nt, Escherichia coli CFT073
accgcccagaccugcguu

SEQ ID NO: 632984 - RNA, 19 nt, Escherichia coli CFT073
accgcccgguuuuuuuacc

SEQ ID NO: 632985 - RNA, 20 nt, Escherichia coli CFT073
accgccgaagacaaacaugc

SEQ ID NO: 632986 - RNA, 22 nt, Escherichia coli CFT073
accgccaggccuaacaccauca

SEQ ID NO: 632987 - RNA, 15 nt, Escherichia coli CFT073
accgccagucacugc

SEQ ID NO: 632988 - RNA, 15 nt, Escherichia coli CFT073
accgccagugcagcg

SEQ ID NO: 632989 - RNA, 15 nt, Escherichia coli CFT073
accgccagcaggaac

SEQ ID NO: 632990 - RNA, 13 nt, Escherichia coli CFT073
accgccacuacca

SEQ ID NO: 632991 - RNA, 14 nt, Escherichia coli CFT073
accgccagaagaac

SEQ ID NO: 632992 - RNA, 14 nt, Escherichia coli CFT073
accgccaccaggaa

SEQ ID NO: 632993 - RNA, 13 nt, Escherichia coli CFT073
accgcaaugaucu

SEQ ID NO: 632994 - RNA, 15 nt, Escherichia coli CFT073
accgcaccaaaucca

SEQ ID NO: 632995 - RNA, 14 nt, Escherichia coli CFT073
accgcaccaccagc

SEQ ID NO: 632996 - RNA, 16 nt, Escherichia coli CFT073
accgcaccaccagcag

SEQ ID NO: 632997 - RNA, 13 nt, Escherichia coli CFT073
accgaugaagccc

SEQ ID NO: 632998 - RNA, 15 nt, Escherichia coli CFT073
accgaugagcugcaa

SEQ ID NO: 632999 - RNA, 21 nt, Escherichia coli CFT073
accgaugccacccauuacacu

SEQ ID NO: 633000 - RNA, 18 nt, Escherichia coli CFT073
accgcaaccgccaacagc

SEQ ID NO: 633001 - RNA, 13 nt, Escherichia coli CFT073
accgagcugguga

SEQ ID NO: 633002 - RNA, 12 nt, Escherichia coli CFT073
accgauccggca

SEQ ID NO: 633003 - RNA, 16 nt, Escherichia coli CFT073
accgauaucaauaaca

SEQ ID NO: 633004 - RNA, 12 nt, Escherichia coli CFT073
accgaucaccac

SEQ ID NO: 633005 - RNA, 13 nt, Escherichia coli CFT073
acccugacccaga

SEQ ID NO: 633006 - RNA, 16 nt, Escherichia coli CFT073
acccugacccagaccg

SEQ ID NO: 633007 - RNA, 16 nt, Escherichia coli CFT073
acccugaccgucuuuu

SEQ ID NO: 633008 - RNA, 17 nt, Escherichia coli CFT073
acccugaccgucuuuuu

SEQ ID NO: 633009 - RNA, 14 nt, Escherichia coli CFT073
accgagaaaaucau

SEQ ID NO: 633010 - RNA, 14 nt, Escherichia coli CFT073
accgagauaaaugc

SEQ ID NO: 633011 - RNA, 17 nt, Escherichia coli CFT073
accgagauaaugguuuc

SEQ ID NO: 633012 - RNA, 17 nt, Escherichia coli CFT073
acccucuguccgccagg

SEQ ID NO: 633013 - RNA, 17 nt, Escherichia coli CFT073
acccucuccccggaggg

SEQ ID NO: 633014 - RNA, 23 nt, Escherichia coli CFT073
acccucgaccaucuccuuacugc

SEQ ID NO: 633015 - RNA, 13 nt, Escherichia coli CFT073
acccuaaagcacc

SEQ ID NO: 633016 - RNA, 13 nt, Escherichia coli CFT073
acccguuuuaaau

SEQ ID NO: 633017 - RNA, 21 nt, Escherichia coli CFT073
acccgugcagguucuuuuaaa

SEQ ID NO: 633018 - RNA, 22 nt, Escherichia coli CFT073
accccgcgcgguguaccgcauc

SEQ ID NO: 633019 - RNA, 13 nt, Escherichia coli CFT073
acccccagacgac

SEQ ID NO: 633020 - RNA, 16 nt, Escherichia coli CFT073
accccaggcugugcgc

SEQ ID NO: 633021 - RNA, 12 nt, Escherichia coli CFT073
acccaccgcagc

SEQ ID NO: 633022 - RNA, 21 nt, Escherichia coli CFT073
acccaccgguccuaacaacca

SEQ ID NO: 633023 - RNA, 16 nt, Escherichia coli CFT073
acccacauguugcgcu

SEQ ID NO: 633024 - RNA, 20 nt, Escherichia coli CFT073
acccaccaauuaaucccgga

SEQ ID NO: 633025 - RNA, 23 nt, Escherichia coli CFT073
acccaucgccguaccuuuguaac

SEQ ID NO: 633026 - RNA, 12 nt, Escherichia coli CFT073
accccagaugga

SEQ ID NO: 633027 - RNA, 11 nt, Escherichia coli CFT073
accccagccag

SEQ ID NO: 633028 - RNA, 12 nt, Escherichia coli CFT073
accccugcauaa

SEQ ID NO: 633029 - RNA, 17 nt, Escherichia coli CFT073
acccgcucaaacaccgu

SEQ ID NO: 633030 - RNA, 14 nt, Escherichia coli CFT073
acccgcgacgcgcu

SEQ ID NO: 633031 - RNA, 17 nt, Escherichia coli CFT073
acccgucagcagaucca

SEQ ID NO: 633032 - RNA, 15 nt, Escherichia coli CFT073
acccggcaucaacca

SEQ ID NO: 633033 - RNA, 13 nt, Escherichia coli CFT073
acccggccacagc

SEQ ID NO: 633034 - RNA, 18 nt, Escherichia coli CFT073
acccggccacagcgccag

SEQ ID NO: 633035 - RNA, 15 nt, Escherichia coli CFT073
acccacagcgcacca

SEQ ID NO: 633036 - RNA, 14 nt, Escherichia coli CFT073
acccacacuucaau

SEQ ID NO: 633037 - RNA, 11 nt, Escherichia coli CFT073
acccaauccag

SEQ ID NO: 633038 - RNA, 20 nt, Escherichia coli CFT073
acccaaucccccacuuuuaa

SEQ ID NO: 633039 - RNA, 21 nt, Escherichia coli CFT073
acccaacuuuguuguuuacca

SEQ ID NO: 633040 - RNA, 21 nt, Escherichia coli CFT073
acccaagcgggaauagcucag

SEQ ID NO: 633041 - RNA, 17 nt, Escherichia coli CFT073
acccaacggcaaacauc

SEQ ID NO: 633042 - RNA, 15 nt, Escherichia coli CFT073
acccaaaaaauagca

SEQ ID NO: 633043 - RNA, 19 nt, Escherichia coli CFT073
acccaaaaaauagcaaagu

SEQ ID NO: 633044 - RNA, 20 nt, Escherichia coli CFT073
acccaacauggucaucauca

SEQ ID NO: 633045 - RNA, 21 nt, Escherichia coli CFT073
acccaacgcaaagagagaagc

SEQ ID NO: 633046 - RNA, 18 nt, Escherichia coli CFT073
accauuggugcuguucug

SEQ ID NO: 633047 - RNA, 19 nt, Escherichia coli CFT073
accauuggugcuguucugc

SEQ ID NO: 633048 - RNA, 22 nt, Escherichia coli CFT073
accauguugcgcagaguuucca

SEQ ID NO: 633049 - RNA, 14 nt, Escherichia coli CFT073
accaugucaucaau

SEQ ID NO: 633050 - RNA, 13 nt, Escherichia coli CFT073
accaugucaucaa

SEQ ID NO: 633051 - RNA, 19 nt, Escherichia coli CFT073
accauuaccaaucugcucu

SEQ ID NO: 633052 - RNA, 12 nt, Escherichia coli CFT073
accauucccugg

SEQ ID NO: 633053 - RNA, 13 nt, Escherichia coli CFT073
accagaaccgccg

SEQ ID NO: 633054 - RNA, 22 nt, Escherichia coli CFT073
accagaaccgccgcugucugaa

SEQ ID NO: 633055 - RNA, 13 nt, Escherichia coli CFT073
accagaaacgcca

SEQ ID NO: 633056 - RNA, 17 nt, Escherichia coli CFT073
accagaaagcgacccgg

SEQ ID NO: 633057 - RNA, 19 nt, Escherichia coli CFT073
accagaaagggaagaacau

SEQ ID NO: 633058 - RNA, 15 nt, Escherichia coli CFT073
accagaacgcugccu

SEQ ID NO: 633059 - RNA, 17 nt, Escherichia coli CFT073
accauaacuagcaacaa

SEQ ID NO: 633060 - RNA, 18 nt, Escherichia coli CFT073
accauaaugacggacagu

SEQ ID NO: 633061 - RNA, 18 nt, Escherichia coli CFT073
accauaaugauggugaaa

SEQ ID NO: 633062 - RNA, 22 nt, Escherichia coli CFT073
accauaaugauggugaaagcaa

SEQ ID NO: 633063 - RNA, 17 nt, Escherichia coli CFT073
accauaauuugugauuu

SEQ ID NO: 633064 - RNA, 21 nt, Escherichia coli CFT073
accaucaaguagcagguaauc

SEQ ID NO: 633065 - RNA, 13 nt, Escherichia coli CFT073
accaucaccucuu

SEQ ID NO: 633066 - RNA, 16 nt, Escherichia coli CFT073
accaugcugaugcuac

SEQ ID NO: 633067 - RNA, 17 nt, Escherichia coli CFT073
accaugccaguuucuuu

SEQ ID NO: 633068 - RNA, 18 nt, Escherichia coli CFT073
accaugccgcccagcagc

SEQ ID NO: 633069 - RNA, 14 nt, Escherichia coli CFT073
accaugcaccaacc

SEQ ID NO: 633070 - RNA, 14 nt, Escherichia coli CFT073
accaugaucugcaa

SEQ ID NO: 633071 - RNA, 15 nt, Escherichia coli CFT073
accaucaccucuuca

SEQ ID NO: 633072 - RNA, 13 nt, Escherichia coli CFT073
accaucagcagca

SEQ ID NO: 633073 - RNA, 13 nt, Escherichia coli CFT073
accaucagcagcg

SEQ ID NO: 633074 - RNA, 23 nt, Escherichia coli CFT073
accaucagcucuguagcaacgau

SEQ ID NO: 633075 - RNA, 17 nt, Escherichia coli CFT073
accaucaggcagaacac

SEQ ID NO: 633076 - RNA, 19 nt, Escherichia coli CFT073
accaucaguggcagagaag

SEQ ID NO: 633077 - RNA, 19 nt, Escherichia coli CFT073
accauccagcaacaacagc

SEQ ID NO: 633078 - RNA, 22 nt, Escherichia coli CFT073
accaucagguauuuauggauga

SEQ ID NO: 633079 - RNA, 12 nt, Escherichia coli CFT073
agcaucaaugac

SEQ ID NO: 633080 - RNA, 23 nt, Escherichia coli CFT073
agcauagccccagcgcagacggc

SEQ ID NO: 633081 - RNA, 18 nt, Escherichia coli CFT073
agcauagccccagcgcag

SEQ ID NO: 633082 - RNA, 21 nt, Escherichia coli CFT073
agcauacuaauaucauugaag

SEQ ID NO: 633083 - RNA, 14 nt, Escherichia coli CFT073
agcauacuccagcc

SEQ ID NO: 633084 - RNA, 20 nt, Escherichia coli CFT073
agcaguuacuccgauuaccg

SEQ ID NO: 633085 - RNA, 18 nt, Escherichia coli CFT073
agcaguguuuccggcauu

SEQ ID NO: 633086 - RNA, 22 nt, Escherichia coli CFT073
agcauacaaugcaauauuuuga

SEQ ID NO: 633087 - RNA, 15 nt, Escherichia coli CFT073
agcauaccuuccagc

SEQ ID NO: 633088 - RNA, 15 nt, Escherichia coli CFT073
agcaguaauuuauag

SEQ ID NO: 633089 - RNA, 18 nt, Escherichia coli CFT073
agcaguacggcaggucaa

SEQ ID NO: 633090 - RNA, 21 nt, Escherichia coli CFT073
agcaguagcgucgccagcagu

SEQ ID NO: 633091 - RNA, 17 nt, Escherichia coli CFT073
agcagugaauacccaga

SEQ ID NO: 633092 - RNA, 20 nt, Escherichia coli CFT073
agcagugaauacccagaauc

SEQ ID NO: 633093 - RNA, 13 nt, Escherichia coli CFT073
agcaguggcacua

SEQ ID NO: 633094 - RNA, 15 nt, Escherichia coli CFT073
agcaucgucacacca

SEQ ID NO: 633095 - RNA, 14 nt, Escherichia coli CFT073
agcaucgucaucag

SEQ ID NO: 633096 - RNA, 15 nt, Escherichia coli CFT073
agcaucgcuagauau

SEQ ID NO: 633097 - RNA, 16 nt, Escherichia coli CFT073
agcaucggcauaccca

SEQ ID NO: 633098 - RNA, 20 nt, Escherichia coli CFT073
agcaucgggauagucaaaua

SEQ ID NO: 633099 - RNA, 13 nt, Escherichia coli CFT073
agcaugacaaaaa

SEQ ID NO: 633100 - RNA, 11 nt, Escherichia coli CFT073
agcaucaccac

SEQ ID NO: 633101 - RNA, 16 nt, Escherichia coli CFT073
agcaucacgcaacauu

SEQ ID NO: 633102 - RNA, 19 nt, Escherichia coli CFT073
agcaucagcgcuaccagag

SEQ ID NO: 633103 - RNA, 14 nt, Escherichia coli CFT073
agcaucagacugcu

SEQ ID NO: 633104 - RNA, 16 nt, Escherichia coli CFT073
agcaucagacugcuuu

SEQ ID NO: 633105 - RNA, 19 nt, Escherichia coli CFT073
agcaucgccaucaacaauu

SEQ ID NO: 633106 - RNA, 16 nt, Escherichia coli CFT073
agcaucgcccccaucg

SEQ ID NO: 633107 - RNA, 22 nt, Escherichia coli CFT073
agcaucagggagcggaauugcg

SEQ ID NO: 633108 - RNA, 16 nt, Escherichia coli CFT073
agcaucaggaugauac

SEQ ID NO: 633109 - RNA, 23 nt, Escherichia coli CFT073
agcaggccgucgcguagcaccac

SEQ ID NO: 633110 - RNA, 20 nt, Escherichia coli CFT073
agcaggccauuugcucuacc

SEQ ID NO: 633111 - RNA, 16 nt, Escherichia coli CFT073
agcagcgguuucuccc

SEQ ID NO: 633112 - RNA, 21 nt, Escherichia coli CFT073
agcagcguaccucuaucuuga

SEQ ID NO: 633113 - RNA, 23 nt, Escherichia coli CFT073
agcagcguaccucuaucuugauu

SEQ ID NO: 633114 - RNA, 16 nt, Escherichia coli CFT073
agcagcgucagcacuu

SEQ ID NO: 633115 - RNA, 18 nt, Escherichia coli CFT073
agcaggaccauacuggcg

SEQ ID NO: 633116 - RNA, 17 nt, Escherichia coli CFT073
agcagcucacgcagcuu

SEQ ID NO: 633117 - RNA, 22 nt, Escherichia coli CFT073
agcagcuccagaauuccgugcc

SEQ ID NO: 633118 - RNA, 23 nt, Escherichia coli CFT073
agcagcuccggcucuaaaucuuc

SEQ ID NO: 633119 - RNA, 14 nt, Escherichia coli CFT073
agcagcgccaggca

SEQ ID NO: 633120 - RNA, 16 nt, Escherichia coli CFT073
agcagcgccaggcaca

SEQ ID NO: 633121 - RNA, 16 nt, Escherichia coli CFT073
agcagcccggcaacca

SEQ ID NO: 633122 - RNA, 15 nt, Escherichia coli CFT073
agcagcggagaaaug

SEQ ID NO: 633123 - RNA, 16 nt, Escherichia coli CFT073
agcagcggcagaucaa

SEQ ID NO: 633124 - RNA, 19 nt, Escherichia coli CFT073
agcagcggcagaucaaauu

SEQ ID NO: 633125 - RNA, 16 nt, Escherichia coli CFT073
agcaaccugcacguua

SEQ ID NO: 633126 - RNA, 17 nt, Escherichia coli CFT073
agcaacgauaacaauca

SEQ ID NO: 633127 - RNA, 21 nt, Escherichia coli CFT073
agcaacgauaacaaucaccaa

SEQ ID NO: 633128 - RNA, 19 nt, Escherichia coli CFT073
agcaacgagacucaauggc

SEQ ID NO: 633129 - RNA, 15 nt, Escherichia coli CFT073
agcaacgaaacaccg

SEQ ID NO: 633130 - RNA, 14 nt, Escherichia coli CFT073
agcaacaucaccaa

SEQ ID NO: 633131 - RNA, 21 nt, Escherichia coli CFT073
agcaaccacaaccucagcagu

SEQ ID NO: 633132 - RNA, 16 nt, Escherichia coli CFT073
agcaaccacuugcagc

SEQ ID NO: 633133 - RNA, 14 nt, Escherichia coli CFT073
agcaaccagcaaug

SEQ ID NO: 633134 - RNA, 16 nt, Escherichia coli CFT073
agcaaccagcaaugcc

SEQ ID NO: 633135 - RNA, 12 nt, Escherichia coli CFT073
agcaaccaggua

SEQ ID NO: 633136 - RNA, 18 nt, Escherichia coli CFT073
agcaaccauuuaaacuca

SEQ ID NO: 633137 - RNA, 12 nt, Escherichia coli CFT073
agcaccuaaauc

SEQ ID NO: 633138 - RNA, 14 nt, Escherichia coli CFT073
agcaccucuccacg

SEQ ID NO: 633139 - RNA, 23 nt, Escherichia coli CFT073
agcaccgggggguugccgccacu

SEQ ID NO: 633140 - RNA, 18 nt, Escherichia coli CFT073
agcacguuaaucaaauca

SEQ ID NO: 633141 - RNA, 19 nt, Escherichia coli CFT073
agcacguuaaucaaaucaa

SEQ ID NO: 633142 - RNA, 14 nt, Escherichia coli CFT073
agcacucacgccag

SEQ ID NO: 633143 - RNA, 17 nt, Escherichia coli CFT073
agcacucacgccaggca

SEQ ID NO: 633144 - RNA, 19 nt, Escherichia coli CFT073
agcacuacggagauuaaac

SEQ ID NO: 633145 - RNA, 14 nt, Escherichia coli CFT073
agcacgucacggac

SEQ ID NO: 633146 - RNA, 18 nt, Escherichia coli CFT073
agcacguaaaucuuuacc

SEQ ID NO: 633147 - RNA, 22 nt, Escherichia coli CFT073
agcacguaaaucuuuaccacgu

SEQ ID NO: 633148 - RNA, 14 nt, Escherichia coli CFT073
agcacgaccgccau

SEQ ID NO: 633149 - RNA, 19 nt, Escherichia coli CFT073
agcacgaccuugccaaggu

SEQ ID NO: 633150 - RNA, 14 nt, Escherichia coli CFT073
agcagcacaccaca

SEQ ID NO: 633151 - RNA, 17 nt, Escherichia coli CFT073
agcagcaccaccgcccg

SEQ ID NO: 633152 - RNA, 13 nt, Escherichia coli CFT073
agcagcagcgcca

SEQ ID NO: 633153 - RNA, 20 nt, Escherichia coli CFT073
agcagcagcgccaacgguga

SEQ ID NO: 633154 - RNA, 21 nt, Escherichia coli CFT073
agcagcagaauuggcaucagg

SEQ ID NO: 633155 - RNA, 16 nt, Escherichia coli CFT073
agcagcaggaccauac

SEQ ID NO: 633156 - RNA, 13 nt, Escherichia coli CFT073
agcagcaucagca

SEQ ID NO: 633157 - RNA, 15 nt, Escherichia coli CFT073
agcagcauacccacc

SEQ ID NO: 633158 - RNA, 14 nt, Escherichia coli CFT073
agcagcaucaccac

SEQ ID NO: 633159 - RNA, 15 nt, Escherichia coli CFT073
agcagcaucaccacg

SEQ ID NO: 633160 - RNA, 16 nt, Escherichia coli CFT073
agcagauccauugcga

SEQ ID NO: 633161 - RNA, 23 nt, Escherichia coli CFT073
agcagauccauugcgaauaagaa

SEQ ID NO: 633162 - RNA, 17 nt, Escherichia coli CFT073
agcagaucgaucuuguu

SEQ ID NO: 633163 - RNA, 15 nt, Escherichia coli CFT073
agcagaggaauaucu

SEQ ID NO: 633164 - RNA, 21 nt, Escherichia coli CFT073
agcagauaccaacccuggugc

SEQ ID NO: 633165 - RNA, 15 nt, Escherichia coli CFT073
agcagaaccagggaa

SEQ ID NO: 633166 - RNA, 18 nt, Escherichia coli CFT073
agcagaaccagggaaaaa

SEQ ID NO: 633167 - RNA, 15 nt, Escherichia coli CFT073
agcagagcaugguua

SEQ ID NO: 633168 - RNA, 21 nt, Escherichia coli CFT073
agcacuuuucgcacugcaggc

SEQ ID NO: 633169 - RNA, 19 nt, Escherichia coli CFT073
agcagaaaagaaccaaugc

SEQ ID NO: 633170 - RNA, 16 nt, Escherichia coli CFT073
agcacuugcagcauau

SEQ ID NO: 633171 - RNA, 20 nt, Escherichia coli CFT073
agcacugacauuauccggcu

SEQ ID NO: 633172 - RNA, 23 nt, Escherichia coli CFT073
agcacuuuaucgaucacauccag

SEQ ID NO: 633173 - RNA, 19 nt, Escherichia coli CFT073
agcacuuuucgcacugcag

SEQ ID NO: 633174 - RNA, 14 nt, Escherichia coli CFT073
agcacuugcaggaa

SEQ ID NO: 633175 - RNA, 20 nt, Escherichia coli CFT073
agcacuugcaggaacaaugc

SEQ ID NO: 633176 - RNA, 14 nt, Escherichia coli CFT073
agcccgccagacca

SEQ ID NO: 633177 - RNA, 20 nt, Escherichia coli CFT073
agcccgcagcguccagcgcc

SEQ ID NO: 633178 - RNA, 23 nt, Escherichia coli CFT073
agcccgcagcguccagcgccugg

SEQ ID NO: 633179 - RNA, 20 nt, Escherichia coli CFT073
agcccgauggcaucaccauc

SEQ ID NO: 633180 - RNA, 19 nt, Escherichia coli CFT073
agcccuuauucacgccaaa

SEQ ID NO: 633181 - RNA, 12 nt, Escherichia coli CFT073
agcccugccgga

SEQ ID NO: 633182 - RNA, 21 nt, Escherichia coli CFT073
agcccugcucgcgcagauaga

SEQ ID NO: 633183 - RNA, 11 nt, Escherichia coli CFT073
agcccuucuuu

SEQ ID NO: 633184 - RNA, 14 nt, Escherichia coli CFT073
agccgaccgcaagg

SEQ ID NO: 633185 - RNA, 12 nt, Escherichia coli CFT073
agcccuuucuuu

SEQ ID NO: 633186 - RNA, 15 nt, Escherichia coli CFT073
agccccuucgccagu

SEQ ID NO: 633187 - RNA, 14 nt, Escherichia coli CFT073
agccccgcagccau

SEQ ID NO: 633188 - RNA, 15 nt, Escherichia coli CFT073
agccccgcagccaug

SEQ ID NO: 633189 - RNA, 22 nt, Escherichia coli CFT073
agccccgcgaacggggcugcca

SEQ ID NO: 633190 - RNA, 15 nt, Escherichia coli CFT073
agccccaggucaaua

SEQ ID NO: 633191 - RNA, 14 nt, Escherichia coli CFT073
agccccaccagcaa

SEQ ID NO: 633192 - RNA, 16 nt, Escherichia coli CFT073
agccccaccagcaaau

SEQ ID NO: 633193 - RNA, 18 nt, Escherichia coli CFT073
agccccauaugcagcacu

SEQ ID NO: 633194 - RNA, 17 nt, Escherichia coli CFT073
agcccaucgccagcgcu

SEQ ID NO: 633195 - RNA, 22 nt, Escherichia coli CFT073
agcccaguaccgccagugcagc

SEQ ID NO: 633196 - RNA, 13 nt, Escherichia coli CFT073
agcccaguuuuuc

SEQ ID NO: 633197 - RNA, 23 nt, Escherichia coli CFT073
agcccauacuuaaugccaguuca

SEQ ID NO: 633198 - RNA, 22 nt, Escherichia coli CFT073
agcccaucaccgccaggccuaa

SEQ ID NO: 633199 - RNA, 18 nt, Escherichia coli CFT073
agcccaucagguccacgc

SEQ ID NO: 633200 - RNA, 18 nt, Escherichia coli CFT073
agcccaucaguguccaga

SEQ ID NO: 633201 - RNA, 12 nt, Escherichia coli CFT073
agcccaccccaa

SEQ ID NO: 633202 - RNA, 22 nt, Escherichia coli CFT073
agcccacuacgcccgcaaucaa

SEQ ID NO: 633203 - RNA, 16 nt, Escherichia coli CFT073
agcccaggccaucgcc

SEQ ID NO: 633204 - RNA, 18 nt, Escherichia coli CFT073
agcccaggccaucgccac

SEQ ID NO: 633205 - RNA, 20 nt, Escherichia coli CFT073
agcccagggaaacagccacc

SEQ ID NO: 633206 - RNA, 22 nt, Escherichia coli CFT073
agcccagggaaacagccaccca

SEQ ID NO: 633207 - RNA, 19 nt, Escherichia coli CFT073
agcccaaagagcaagaacc

SEQ ID NO: 633208 - RNA, 14 nt, Escherichia coli CFT073
agccauuuuacuca

SEQ ID NO: 633209 - RNA, 15 nt, Escherichia coli CFT073
agcccaaaaauugcc

SEQ ID NO: 633210 - RNA, 20 nt, Escherichia coli CFT073
agccaugccgccaccaccag

SEQ ID NO: 633211 - RNA, 19 nt, Escherichia coli CFT073
agccaugcggcaucuucuc

SEQ ID NO: 633212 - RNA, 15 nt, Escherichia coli CFT073
agccauuaaacacca

SEQ ID NO: 633213 - RNA, 21 nt, Escherichia coli CFT073
agccauuaaacaccaguaccu

SEQ ID NO: 633214 - RNA, 18 nt, Escherichia coli CFT073
agccauuaccgauaucaa

SEQ ID NO: 633215 - RNA, 23 nt, Escherichia coli CFT073
agccauuaccgauaucaauaaca

SEQ ID NO: 633216 - RNA, 19 nt, Escherichia coli CFT073
agccauuccugcaccucaa

SEQ ID NO: 633217 - RNA, 18 nt, Escherichia coli CFT073
agccaguucucaccaaag

SEQ ID NO: 633218 - RNA, 21 nt, Escherichia coli CFT073
agccaguucucaccaaaggca

SEQ ID NO: 633219 - RNA, 20 nt, Escherichia coli CFT073
agccaguucaugacgcaggc

SEQ ID NO: 633220 - RNA, 23 nt, Escherichia coli CFT073
agccaguuuuucagcgccagcgc

SEQ ID NO: 633221 - RNA, 16 nt, Escherichia coli CFT073
agccaguuuuucuuuu

SEQ ID NO: 633222 - RNA, 17 nt, Escherichia coli CFT073
agccaguuuuucuuuuu

SEQ ID NO: 633223 - RNA, 15 nt, Escherichia coli CFT073
agccauaaaaucaca

SEQ ID NO: 633224 - RNA, 18 nt, Escherichia coli CFT073
agccauaaaaucacaggu

SEQ ID NO: 633225 - RNA, 17 nt, Escherichia coli CFT073
agccauaaaccgagcca

SEQ ID NO: 633226 - RNA, 22 nt, Escherichia coli CFT073
agccauaaagaaaucaccugcc

SEQ ID NO: 633227 - RNA, 15 nt, Escherichia coli CFT073
agccaggcacgccgc

SEQ ID NO: 633228 - RNA, 22 nt, Escherichia coli CFT073
agccagucgauauggccuucuu

SEQ ID NO: 633229 - RNA, 18 nt, Escherichia coli CFT073
agccagcggcaccgagga

SEQ ID NO: 633230 - RNA, 17 nt, Escherichia coli CFT073
agccaggagccaacacu

SEQ ID NO: 633231 - RNA, 22 nt, Escherichia coli CFT073
agccaggagccaacacuuucac

SEQ ID NO: 633232 - RNA, 22 nt, Escherichia coli CFT073
agccagcugccugccaguaaau

SEQ ID NO: 633233 - RNA, 12 nt, Escherichia coli CFT073
agccaucaccau

SEQ ID NO: 633234 - RNA, 15 nt, Escherichia coli CFT073
agccaucgacaccag

SEQ ID NO: 633235 - RNA, 17 nt, Escherichia coli CFT073
agccaucgacaccagcc

SEQ ID NO: 633236 - RNA, 18 nt, Escherichia coli CFT073
agccaucgacaccagcca

SEQ ID NO: 633237 - RNA, 20 nt, Escherichia coli CFT073
agccaucgacaccagccaga

SEQ ID NO: 633238 - RNA, 19 nt, Escherichia coli CFT073
agccaucgccacugcaaau

SEQ ID NO: 633239 - RNA, 15 nt, Escherichia coli CFT073
agccauaccuggugc

SEQ ID NO: 633240 - RNA, 22 nt, Escherichia coli CFT073
agccauaaucacucuuccccgc

SEQ ID NO: 633241 - RNA, 13 nt, Escherichia coli CFT073
agccauaaucugc

SEQ ID NO: 633242 - RNA, 17 nt, Escherichia coli CFT073
agccauauuuaacuccu

SEQ ID NO: 633243 - RNA, 16 nt, Escherichia coli CFT073
agccaccgcccagaga

SEQ ID NO: 633244 - RNA, 14 nt, Escherichia coli CFT073
agccacgcaccauc

SEQ ID NO: 633245 - RNA, 16 nt, Escherichia coli CFT073
agccagaaaucaccac

SEQ ID NO: 633246 - RNA, 18 nt, Escherichia coli CFT073
agccacggaauaaaccgu

SEQ ID NO: 633247 - RNA, 20 nt, Escherichia coli CFT073
agccagagaagcgacuugug

SEQ ID NO: 633248 - RNA, 14 nt, Escherichia coli CFT073
agccagacaaaugu

SEQ ID NO: 633249 - RNA, 19 nt, Escherichia coli CFT073
agccagauaucgagaaucu

SEQ ID NO: 633250 - RNA, 22 nt, Escherichia coli CFT073
agccagauaucgagaaucugcc

SEQ ID NO: 633251 - RNA, 15 nt, Escherichia coli CFT073
agccagcucgcgcca

SEQ ID NO: 633252 - RNA, 14 nt, Escherichia coli CFT073
agccagcgcauccu

SEQ ID NO: 633253 - RNA, 19 nt, Escherichia coli CFT073
agccaagcgccgccucagc

SEQ ID NO: 633254 - RNA, 22 nt, Escherichia coli CFT073
agccaagcgccgccucagccag

SEQ ID NO: 633255 - RNA, 17 nt, Escherichia coli CFT073
agcauggcacgcuucau

SEQ ID NO: 633256 - RNA, 21 nt, Escherichia coli CFT073
agcauggcacgcuucaucugc

SEQ ID NO: 633257 - RNA, 14 nt, Escherichia coli CFT073
agcauggcuucuuc

SEQ ID NO: 633258 - RNA, 20 nt, Escherichia coli CFT073
agccaacagcagccacacca

SEQ ID NO: 633259 - RNA, 21 nt, Escherichia coli CFT073
agccaacgccuuuaccaccag

SEQ ID NO: 633260 - RNA, 19 nt, Escherichia coli CFT073
agccaaccucaaaaagaaa

SEQ ID NO: 633261 - RNA, 14 nt, Escherichia coli CFT073
agccaacucuucuu

SEQ ID NO: 633262 - RNA, 16 nt, Escherichia coli CFT073
agcaugcugacugcgc

SEQ ID NO: 633263 - RNA, 19 nt, Escherichia coli CFT073
agcaugaguaacccggcgu

SEQ ID NO: 633264 - RNA, 11 nt, Escherichia coli CFT073
agcucaucguu

SEQ ID NO: 633265 - RNA, 18 nt, Escherichia coli CFT073
agcucaucguuacgccca

SEQ ID NO: 633266 - RNA, 20 nt, Escherichia coli CFT073
agcucauaggccugcugaau

SEQ ID NO: 633267 - RNA, 17 nt, Escherichia coli CFT073
agcucaguugguagagc

SEQ ID NO: 633268 - RNA, 19 nt, Escherichia coli CFT073
agcucaucagguauugcua

SEQ ID NO: 633269 - RNA, 19 nt, Escherichia coli CFT073
agcucauaaccuguuccuu

SEQ ID NO: 633270 - RNA, 17 nt, Escherichia coli CFT073
agcucaauauauuaaaa

SEQ ID NO: 633271 - RNA, 14 nt, Escherichia coli CFT073
agcucaaucgccuc

SEQ ID NO: 633272 - RNA, 14 nt, Escherichia coli CFT073
agcucacugauaau

SEQ ID NO: 633273 - RNA, 15 nt, Escherichia coli CFT073
agcucacugauaaua

SEQ ID NO: 633274 - RNA, 18 nt, Escherichia coli CFT073
agcucacugauaauaaua

SEQ ID NO: 633275 - RNA, 15 nt, Escherichia coli CFT073
agcucacgcgccagc

SEQ ID NO: 633276 - RNA, 16 nt, Escherichia coli CFT073
agcucacggccaguca

SEQ ID NO: 633277 - RNA, 19 nt, Escherichia coli CFT073
agcucacggccagucauuu

SEQ ID NO: 633278 - RNA, 19 nt, Escherichia coli CFT073
agcucagcuggauagagua

SEQ ID NO: 633279 - RNA, 14 nt, Escherichia coli CFT073
agcucaaacuggcu

SEQ ID NO: 633280 - RNA, 22 nt, Escherichia coli CFT073
agcucaaacuggcugaugcugg

SEQ ID NO: 633281 - RNA, 14 nt, Escherichia coli CFT073
agcucaacgcaucg

SEQ ID NO: 633282 - RNA, 14 nt, Escherichia coli CFT073
agcuauuaauccau

SEQ ID NO: 633283 - RNA, 19 nt, Escherichia coli CFT073
agcuauguuugaaccagau

SEQ ID NO: 633284 - RNA, 21 nt, Escherichia coli CFT073
agcuauguuugaaccagauau

SEQ ID NO: 633285 - RNA, 13 nt, Escherichia coli CFT073
agcguuuucuuca

SEQ ID NO: 633286 - RNA, 15 nt, Escherichia coli CFT073
agcguuucauuagcc

SEQ ID NO: 633287 - RNA, 15 nt, Escherichia coli CFT073
agcuaaaaauaauca

SEQ ID NO: 633288 - RNA, 17 nt, Escherichia coli CFT073
agcuaaacagagcugca

SEQ ID NO: 633289 - RNA, 17 nt, Escherichia coli CFT073
agcuaaccauccacauu

SEQ ID NO: 633290 - RNA, 20 nt, Escherichia coli CFT073
agcguugaugcucagccucg

SEQ ID NO: 633291 - RNA, 15 nt, Escherichia coli CFT073
agcguugcagagagu

SEQ ID NO: 633292 - RNA, 18 nt, Escherichia coli CFT073
agcguucuaucagggcuu

SEQ ID NO: 633293 - RNA, 23 nt, Escherichia coli CFT073
agcguuucgccauaaaacagcag

SEQ ID NO: 633294 - RNA, 15 nt, Escherichia coli CFT073
agcguuugcggcugu

SEQ ID NO: 633295 - RNA, 21 nt, Escherichia coli CFT073
agcguugcccgauugguucag

SEQ ID NO: 633296 - RNA, 15 nt, Escherichia coli CFT073
agcuaccacgccgau

SEQ ID NO: 633297 - RNA, 18 nt, Escherichia coli CFT073
agcuaccagaauugacca

SEQ ID NO: 633298 - RNA, 20 nt, Escherichia coli CFT073
agcuaauccccuccagcgag

SEQ ID NO: 633299 - RNA, 15 nt, Escherichia coli CFT073
agcuaauauucuuuu

SEQ ID NO: 633300 - RNA, 14 nt, Escherichia coli CFT073
agcuaaucaucauc

SEQ ID NO: 633301 - RNA, 14 nt, Escherichia coli CFT073
agcgggccaguaaa

SEQ ID NO: 633302 - RNA, 20 nt, Escherichia coli CFT073
agcgggggcucccaccgcac

SEQ ID NO: 633303 - RNA, 13 nt, Escherichia coli CFT073
agcggcugcgcag

SEQ ID NO: 633304 - RNA, 21 nt, Escherichia coli CFT073
agcggcuuccccaacacagga

SEQ ID NO: 633305 - RNA, 23 nt, Escherichia coli CFT073
agcggcuuuuucgccgagauauu

SEQ ID NO: 633306 - RNA, 15 nt, Escherichia coli CFT073
agcggcugaauaucc

SEQ ID NO: 633307 - RNA, 19 nt, Escherichia coli CFT073
agcggcuauucuggccgcu

SEQ ID NO: 633308 - RNA, 19 nt, Escherichia coli CFT073
agcggcuaacaacgccgcu

SEQ ID NO: 633309 - RNA, 23 nt, Escherichia coli CFT073
agcgcguuucugcgcuucugcca

SEQ ID NO: 633310 - RNA, 15 nt, Escherichia coli CFT073
agcgcguuugucagc

SEQ ID NO: 633311 - RNA, 17 nt, Escherichia coli CFT073
agcgcgugcgccaccgc

SEQ ID NO: 633312 - RNA, 17 nt, Escherichia coli CFT073
agcgcuaccaucgacac

SEQ ID NO: 633313 - RNA, 16 nt, Escherichia coli CFT073
agcggcgggcuuuaau

SEQ ID NO: 633314 - RNA, 17 nt, Escherichia coli CFT073
agcggcgggcuuuaauc

SEQ ID NO: 633315 - RNA, 14 nt, Escherichia coli CFT073
agcgugauuuugua

SEQ ID NO: 633316 - RNA, 16 nt, Escherichia coli CFT073
agcgugcauagcagca

SEQ ID NO: 633317 - RNA, 16 nt, Escherichia coli CFT073
agcgugccgaagaaca

SEQ ID NO: 633318 - RNA, 14 nt, Escherichia coli CFT073
agcgugcggcggcu

SEQ ID NO: 633319 - RNA, 15 nt, Escherichia coli CFT073
agcguuacccagaca

SEQ ID NO: 633320 - RNA, 15 nt, Escherichia coli CFT073
agcguguuccagcgu

SEQ ID NO: 633321 - RNA, 17 nt, Escherichia coli CFT073
agcguguugcggcgcuu

SEQ ID NO: 633322 - RNA, 14 nt, Escherichia coli CFT073
agcguuccagcagc

SEQ ID NO: 633323 - RNA, 23 nt, Escherichia coli CFT073
agcguucagugaucgccugcaug

SEQ ID NO: 633324 - RNA, 14 nt, Escherichia coli CFT073
agcguuaaaauuuc

SEQ ID NO: 633325 - RNA, 18 nt, Escherichia coli CFT073
agcguuauaaaacacauu

SEQ ID NO: 633326 - RNA, 16 nt, Escherichia coli CFT073
agcguuauauuauuau

SEQ ID NO: 633327 - RNA, 19 nt, Escherichia coli CFT073
agcguucaaacaccaguuc

SEQ ID NO: 633328 - RNA, 12 nt, Escherichia coli CFT073
agcgucuugaau

SEQ ID NO: 633329 - RNA, 18 nt, Escherichia coli CFT073
agcgugaaacaaaucacu

SEQ ID NO: 633330 - RNA, 17 nt, Escherichia coli CFT073
agcgugaaccgccucac

SEQ ID NO: 633331 - RNA, 19 nt, Escherichia coli CFT073
agcgugaagcuaccguaga

SEQ ID NO: 633332 - RNA, 16 nt, Escherichia coli CFT073
agcgucgcauccgaca

SEQ ID NO: 633333 - RNA, 17 nt, Escherichia coli CFT073
agcguaacuuaucaauu

SEQ ID NO: 633334 - RNA, 20 nt, Escherichia coli CFT073
agcgucaucaauccugcagc

SEQ ID NO: 633335 - RNA, 13 nt, Escherichia coli CFT073
agcguccagcgug

SEQ ID NO: 633336 - RNA, 18 nt, Escherichia coli CFT073
agcguccagcgugucugu

SEQ ID NO: 633337 - RNA, 17 nt, Escherichia coli CFT073
agcguccauuuacccac

SEQ ID NO: 633338 - RNA, 17 nt, Escherichia coli CFT073
agcgguuucuccccuuc

SEQ ID NO: 633339 - RNA, 14 nt, Escherichia coli CFT073
agcgguuugaaguu

SEQ ID NO: 633340 - RNA, 16 nt, Escherichia coli CFT073
agcgguuguagccacg

SEQ ID NO: 633341 - RNA, 21 nt, Escherichia coli CFT073
agcgguuguagccacgucugc

SEQ ID NO: 633342 - RNA, 23 nt, Escherichia coli CFT073
agcgauuugucggcaauuucacu

SEQ ID NO: 633343 - RNA, 19 nt, Escherichia coli CFT073
agcgauuuugccagccgca

SEQ ID NO: 633344 - RNA, 15 nt, Escherichia coli CFT073
agcgauuccaguuca

SEQ ID NO: 633345 - RNA, 21 nt, Escherichia coli CFT073
agcgauucccguuuauggucg

SEQ ID NO: 633346 - RNA, 15 nt, Escherichia coli CFT073
agcgcaaauugcugg

SEQ ID NO: 633347 - RNA, 15 nt, Escherichia coli CFT073
agcgcaaaauaccag

SEQ ID NO: 633348 - RNA, 19 nt, Escherichia coli CFT073
agcgcaaaggccagcaauc

SEQ ID NO: 633349 - RNA, 19 nt, Escherichia coli CFT073
agcgcaucaggcaaucuug

SEQ ID NO: 633350 - RNA, 18 nt, Escherichia coli CFT073
agcgcauccaggcaaagu

SEQ ID NO: 633351 - RNA, 18 nt, Escherichia coli CFT073
agcgcaaaucaacuaaaa

SEQ ID NO: 633352 - RNA, 16 nt, Escherichia coli CFT073
agcgcaacuugugcuc

SEQ ID NO: 633353 - RNA, 21 nt, Escherichia coli CFT073
agcgcaauagugauguucugg

SEQ ID NO: 633354 - RNA, 17 nt, Escherichia coli CFT073
agcgcaccagaaacaau

SEQ ID NO: 633355 - RNA, 17 nt, Escherichia coli CFT073
agcgcacagagcacuaa

SEQ ID NO: 633356 - RNA, 11 nt, Escherichia coli CFT073
agcgcacaugc

SEQ ID NO: 633357 - RNA, 15 nt, Escherichia coli CFT073
agcgcacaugcagcu

SEQ ID NO: 633358 - RNA, 22 nt, Escherichia coli CFT073
agcgcaugaacguucaccuaaa

SEQ ID NO: 633359 - RNA, 15 nt, Escherichia coli CFT073
agcgcaugacccagu

SEQ ID NO: 633360 - RNA, 17 nt, Escherichia coli CFT073
agcgcauggcagccagg

SEQ ID NO: 633361 - RNA, 23 nt, Escherichia coli CFT073
agcgccagauaugaucgaaaaug

SEQ ID NO: 633362 - RNA, 22 nt, Escherichia coli CFT073
agcgccagcauaugcacacgca

SEQ ID NO: 633363 - RNA, 17 nt, Escherichia coli CFT073
agcgccagccagauggg

SEQ ID NO: 633364 - RNA, 19 nt, Escherichia coli CFT073
agcgcccguaaaccaagcu

SEQ ID NO: 633365 - RNA, 15 nt, Escherichia coli CFT073
agcgccauaaaacuc

SEQ ID NO: 633366 - RNA, 21 nt, Escherichia coli CFT073
agcgccaguaguugcucaagc

SEQ ID NO: 633367 - RNA, 14 nt, Escherichia coli CFT073
agcgccaggaaucu

SEQ ID NO: 633368 - RNA, 15 nt, Escherichia coli CFT073
agcgccagccauuca

SEQ ID NO: 633369 - RNA, 16 nt, Escherichia coli CFT073
agcgcgcgcgggaaua

SEQ ID NO: 633370 - RNA, 17 nt, Escherichia coli CFT073
agcgccuuuauaagaua

SEQ ID NO: 633371 - RNA, 19 nt, Escherichia coli CFT073
agcgccaucgccaggaaca

SEQ ID NO: 633372 - RNA, 14 nt, Escherichia coli CFT073
agcgccugggaauc

SEQ ID NO: 633373 - RNA, 14 nt, Escherichia coli CFT073
agcgccugcugcug

SEQ ID NO: 633374 - RNA, 18 nt, Escherichia coli CFT073
agcgccucuuccauaauc

SEQ ID NO: 633375 - RNA, 14 nt, Escherichia coli CFT073
agcgacucacgaau

SEQ ID NO: 633376 - RNA, 22 nt, Escherichia coli CFT073
agcgacgugcaguagcagcagg

SEQ ID NO: 633377 - RNA, 22 nt, Escherichia coli CFT073
agcgaauaauucagcccaaaga

SEQ ID NO: 633378 - RNA, 12 nt, Escherichia coli CFT073
agcgaauuuuuc

SEQ ID NO: 633379 - RNA, 13 nt, Escherichia coli CFT073
agcgagaagucgg

SEQ ID NO: 633380 - RNA, 14 nt, Escherichia coli CFT073
agcgagaauacaua

SEQ ID NO: 633381 - RNA, 14 nt, Escherichia coli CFT073
agcgacuccaguuc

SEQ ID NO: 633382 - RNA, 21 nt, Escherichia coli CFT073
agcgagcuggcgcugauaaau

SEQ ID NO: 633383 - RNA, 13 nt, Escherichia coli CFT073
agcgagcaguaca

SEQ ID NO: 633384 - RNA, 22 nt, Escherichia coli CFT073
agcgauauccagcgccagaaug

SEQ ID NO: 633385 - RNA, 19 nt, Escherichia coli CFT073
agcgauauccgggcaaaaa

SEQ ID NO: 633386 - RNA, 21 nt, Escherichia coli CFT073
agcgauccggguaauaaacca

SEQ ID NO: 633387 - RNA, 14 nt, Escherichia coli CFT073
agcgaucuguucau

SEQ ID NO: 633388 - RNA, 20 nt, Escherichia coli CFT073
agcgaucuuugcccauaccc

SEQ ID NO: 633389 - RNA, 12 nt, Escherichia coli CFT073
agcgaugaagua

SEQ ID NO: 633390 - RNA, 13 nt, Escherichia coli CFT073
agcgaugaaguaa

SEQ ID NO: 633391 - RNA, 15 nt, Escherichia coli CFT073
agcgauuaacugcgc

SEQ ID NO: 633392 - RNA, 14 nt, Escherichia coli CFT073
agcgauagaaauca

SEQ ID NO: 633393 - RNA, 14 nt, Escherichia coli CFT073
agcgauacgccaga

SEQ ID NO: 633394 - RNA, 16 nt, Escherichia coli CFT073
agcgauaaaacgccgc

SEQ ID NO: 633395 - RNA, 14 nt, Escherichia coli CFT073
agcgaguugaucac

SEQ ID NO: 633396 - RNA, 22 nt, Escherichia coli CFT073
agcgaggcaaucagcaguauca

SEQ ID NO: 633397 - RNA, 23 nt, Escherichia coli CFT073
agcgagggcuaugcgcaucaagg

SEQ ID NO: 633398 - RNA, 21 nt, Escherichia coli CFT073
agcgaaagcgugagugccccu

SEQ ID NO: 633399 - RNA, 13 nt, Escherichia coli CFT073
agcgaaacagcug

SEQ ID NO: 633400 - RNA, 17 nt, Escherichia coli CFT073
agcgaauaaaccacacc

SEQ ID NO: 633401 - RNA, 22 nt, Escherichia coli CFT073
agccuuugacuauuucaucaga

SEQ ID NO: 633402 - RNA, 20 nt, Escherichia coli CFT073
agccuuuuuuaauauuucau

SEQ ID NO: 633403 - RNA, 18 nt, Escherichia coli CFT073
agccuuuuucagccgcaa

SEQ ID NO: 633404 - RNA, 14 nt, Escherichia coli CFT073
agccuuuuucucug

SEQ ID NO: 633405 - RNA, 14 nt, Escherichia coli CFT073
agccuuaacaagau

SEQ ID NO: 633406 - RNA, 22 nt, Escherichia coli CFT073
agccgcagguaaacucaauuca

SEQ ID NO: 633407 - RNA, 16 nt, Escherichia coli CFT073
agccgcauaguccagu

SEQ ID NO: 633408 - RNA, 22 nt, Escherichia coli CFT073
agccugauguagcgugauuuug

SEQ ID NO: 633409 - RNA, 22 nt, Escherichia coli CFT073
agccugauguagcgugauuuuu

SEQ ID NO: 633410 - RNA, 15 nt, Escherichia coli CFT073
agccugacauuuccg

SEQ ID NO: 633411 - RNA, 21 nt, Escherichia coli CFT073
agccugacgcccguuuucacc

SEQ ID NO: 633412 - RNA, 22 nt, Escherichia coli CFT073
agccugcaauuuccgcuuucaa

SEQ ID NO: 633413 - RNA, 23 nt, Escherichia coli CFT073
agccugcgcuaccagaaagcgac

SEQ ID NO: 633414 - RNA, 23 nt, Escherichia coli CFT073
agccugcacgaccggguuuucaa

SEQ ID NO: 633415 - RNA, 18 nt, Escherichia coli CFT073
agccugccaauggcagga

SEQ ID NO: 633416 - RNA, 22 nt, Escherichia coli CFT073
agccugccaauggcaggaucug

SEQ ID NO: 633417 - RNA, 14 nt, Escherichia coli CFT073
agauuuuuugccag

SEQ ID NO: 633418 - RNA, 14 nt, Escherichia coli CFT073
agcaaaaaauagaa

SEQ ID NO: 633419 - RNA, 12 nt, Escherichia coli CFT073
agcaaaaucacc

SEQ ID NO: 633420 - RNA, 14 nt, Escherichia coli CFT073
agcaaaaucaccau

SEQ ID NO: 633421 - RNA, 19 nt, Escherichia coli CFT073
agcaaaaucguaagcagga

SEQ ID NO: 633422 - RNA, 21 nt, Escherichia coli CFT073
agcaaaaucguaagcaggaga

SEQ ID NO: 633423 - RNA, 17 nt, Escherichia coli CFT073
agcaaacgguuaugaau

SEQ ID NO: 633424 - RNA, 16 nt, Escherichia coli CFT073
agcaaaguaccaucgu

SEQ ID NO: 633425 - RNA, 22 nt, Escherichia coli CFT073
agcaaaguaccaucguccagca

SEQ ID NO: 633426 - RNA, 22 nt, Escherichia coli CFT073
agcaaauaaaacaucaccaaug

SEQ ID NO: 633427 - RNA, 16 nt, Escherichia coli CFT073
agcaaauaauucccca

SEQ ID NO: 633428 - RNA, 17 nt, Escherichia coli CFT073
agcaaauaauuccccac

SEQ ID NO: 633429 - RNA, 21 nt, Escherichia coli CFT073
agcaaauaauuccccaccuga

SEQ ID NO: 633430 - RNA, 19 nt, Escherichia coli CFT073
agcaaauccuuccgccagu

SEQ ID NO: 633431 - RNA, 20 nt, Escherichia coli CFT073
agcaaaucgcggcaguggcu

SEQ ID NO: 633432 - RNA, 16 nt, Escherichia coli CFT073
agcaacaaccaccaca

SEQ ID NO: 633433 - RNA, 20 nt, Escherichia coli CFT073
agcaacaauuugcgguccau

SEQ ID NO: 633434 - RNA, 17 nt, Escherichia coli CFT073
agcaacaacuucagguu

SEQ ID NO: 633435 - RNA, 14 nt, Escherichia coli CFT073
agcaacagcaaaga

SEQ ID NO: 633436 - RNA, 17 nt, Escherichia coli CFT073
agcaaauuaucccccag

SEQ ID NO: 633437 - RNA, 21 nt, Escherichia coli CFT073
agcaaauuaucccccagcacu

SEQ ID NO: 633438 - RNA, 21 nt, Escherichia coli CFT073
agcaaauucuaagcugacuug

SEQ ID NO: 633439 - RNA, 18 nt, Escherichia coli CFT073
agcaacaacacgaucaga

SEQ ID NO: 633440 - RNA, 14 nt, Escherichia coli CFT073
agauuuuuccccac

SEQ ID NO: 633441 - RNA, 15 nt, Escherichia coli CFT073
agauuuuuauuaaua

SEQ ID NO: 633442 - RNA, 16 nt, Escherichia coli CFT073
agauuuaacggcagca

SEQ ID NO: 633443 - RNA, 18 nt, Escherichia coli CFT073
agauuuaacggcagcaag

SEQ ID NO: 633444 - RNA, 22 nt, Escherichia coli CFT073
agauuccugcgucccuacugca

SEQ ID NO: 633445 - RNA, 12 nt, Escherichia coli CFT073
agauucgccaga

SEQ ID NO: 633446 - RNA, 13 nt, Escherichia coli CFT073
agauucgccagau

SEQ ID NO: 633447 - RNA, 20 nt, Escherichia coli CFT073
agauucgcccauuaacaacc

SEQ ID NO: 633448 - RNA, 22 nt, Escherichia coli CFT073
agauucgcggguaagugcggag

SEQ ID NO: 633449 - RNA, 14 nt, Escherichia coli CFT073
agauucuccagcau

SEQ ID NO: 633450 - RNA, 19 nt, Escherichia coli CFT073
agauugauguuaccaacac

SEQ ID NO: 633451 - RNA, 20 nt, Escherichia coli CFT073
agauugaacgcuggcggcag

SEQ ID NO: 633452 - RNA, 18 nt, Escherichia coli CFT073
agauugcaccacaucggu

SEQ ID NO: 633453 - RNA, 17 nt, Escherichia coli CFT073
agauucaacaucucuau

SEQ ID NO: 633454 - RNA, 23 nt, Escherichia coli CFT073
agauucaacaucucuauuacccu

SEQ ID NO: 633455 - RNA, 22 nt, Escherichia coli CFT073
agauucagcagcguggugcuga

SEQ ID NO: 633456 - RNA, 23 nt, Escherichia coli CFT073
agauucaugguacgggacagcag

SEQ ID NO: 633457 - RNA, 18 nt, Escherichia coli CFT073
agauucagcgucgccagc

SEQ ID NO: 633458 - RNA, 15 nt, Escherichia coli CFT073
agauucauccaguuc

SEQ ID NO: 633459 - RNA, 17 nt, Escherichia coli CFT073
agauucauccaguucca

SEQ ID NO: 633460 - RNA, 20 nt, Escherichia coli CFT073
agaugugguuagcuggagag

SEQ ID NO: 633461 - RNA, 18 nt, Escherichia coli CFT073
agauuaaucagcagauau

SEQ ID NO: 633462 - RNA, 20 nt, Escherichia coli CFT073
agauuaagagaaccagcugc

SEQ ID NO: 633463 - RNA, 22 nt, Escherichia coli CFT073
agauuacauugggaagauaaaa

SEQ ID NO: 633464 - RNA, 21 nt, Escherichia coli CFT073
agauuacguaccagauaagca

SEQ ID NO: 633465 - RNA, 17 nt, Escherichia coli CFT073
agaugcauuaccggaga

SEQ ID NO: 633466 - RNA, 17 nt, Escherichia coli CFT073
agaugccgcuauccgcu

SEQ ID NO: 633467 - RNA, 19 nt, Escherichia coli CFT073
agaugcgacguuacaacca

SEQ ID NO: 633468 - RNA, 22 nt, Escherichia coli CFT073
agauggcagccaucauuuuuac

SEQ ID NO: 633469 - RNA, 12 nt, Escherichia coli CFT073
agauggcggcuu

SEQ ID NO: 633470 - RNA, 21 nt, Escherichia coli CFT073
agauggcggaaauaacgcuga

SEQ ID NO: 633471 - RNA, 21 nt, Escherichia coli CFT073
aaaaccauuaccaaucugcuc

SEQ ID NO: 633472 - RNA, 14 nt, Escherichia coli CFT073
aaaaccauuagucu

SEQ ID NO: 633473 - RNA, 16 nt, Escherichia coli CFT073
aaaaccgaggagcaac

SEQ ID NO: 633474 - RNA, 18 nt, Escherichia coli CFT073
agaugaguuauucccgug

SEQ ID NO: 633475 - RNA, 18 nt, Escherichia coli CFT073
agaugaauuuauaaucau

SEQ ID NO: 633476 - RNA, 18 nt, Escherichia coli CFT073
agaugaaugaaaacgaau

SEQ ID NO: 633477 - RNA, 19 nt, Escherichia coli CFT073
agaugaaugaaaacgaauu

SEQ ID NO: 633478 - RNA, 16 nt, Escherichia coli CFT073
agaguugcaccagcaa

SEQ ID NO: 633479 - RNA, 12 nt, Escherichia coli CFT073
agauaaacaacc

SEQ ID NO: 633480 - RNA, 16 nt, Escherichia coli CFT073
agauaaacgauuuuua

SEQ ID NO: 633481 - RNA, 21 nt, Escherichia coli CFT073
agauaaacgaccacucuuucg

SEQ ID NO: 633482 - RNA, 17 nt, Escherichia coli CFT073
agauaaacgaccacucu

SEQ ID NO: 633483 - RNA, 12 nt, Escherichia coli CFT073
agauaaaugcca

SEQ ID NO: 633484 - RNA, 18 nt, Escherichia coli CFT073
agauaaaugccaaagaau

SEQ ID NO: 633485 - RNA, 14 nt, Escherichia coli CFT073
agauagaacugcau

SEQ ID NO: 633486 - RNA, 20 nt, Escherichia coli CFT073
agauagaggucauuaggcca

SEQ ID NO: 633487 - RNA, 11 nt, Escherichia coli CFT073
agauacugcau

SEQ ID NO: 633488 - RNA, 16 nt, Escherichia coli CFT073
agauacugaugaacgc

SEQ ID NO: 633489 - RNA, 17 nt, Escherichia coli CFT073
agauacggauucuuaac

SEQ ID NO: 633490 - RNA, 19 nt, Escherichia coli CFT073
agauacggcgcaucaguuu

SEQ ID NO: 633491 - RNA, 13 nt, Escherichia coli CFT073
agauaagcaacaa

SEQ ID NO: 633492 - RNA, 16 nt, Escherichia coli CFT073
agauaagcaacaaacu

SEQ ID NO: 633493 - RNA, 18 nt, Escherichia coli CFT073
agauaaggcguucacgcc

SEQ ID NO: 633494 - RNA, 16 nt, Escherichia coli CFT073
agauaauaaaaaagaa

SEQ ID NO: 633495 - RNA, 23 nt, Escherichia coli CFT073
agauaucgugcgggaccagcacg

SEQ ID NO: 633496 - RNA, 16 nt, Escherichia coli CFT073
agauauccacaacaau

SEQ ID NO: 633497 - RNA, 15 nt, Escherichia coli CFT073
agauagccagcaaca

SEQ ID NO: 633498 - RNA, 19 nt, Escherichia coli CFT073
agauagccagguuuaccag

SEQ ID NO: 633499 - RNA, 14 nt, Escherichia coli CFT073
agauauauccugaa

SEQ ID NO: 633500 - RNA, 16 nt, Escherichia coli CFT073
agauagcgaaccgcag

SEQ ID NO: 633501 - RNA, 20 nt, Escherichia coli CFT073
agauauagccuaacacagca

SEQ ID NO: 633502 - RNA, 12 nt, Escherichia coli CFT073
agauauuauuaa

SEQ ID NO: 633503 - RNA, 13 nt, Escherichia coli CFT073
agauauuccccca

SEQ ID NO: 633504 - RNA, 15 nt, Escherichia coli CFT073
agauauuucagagcu

SEQ ID NO: 633505 - RNA, 15 nt, Escherichia coli CFT073
agaucacgcaucacc

SEQ ID NO: 633506 - RNA, 13 nt, Escherichia coli CFT073
agaucaucaccag

SEQ ID NO: 633507 - RNA, 14 nt, Escherichia coli CFT073
agaucaucaccagg

SEQ ID NO: 633508 - RNA, 14 nt, Escherichia coli CFT073
agaucagggaaggg

SEQ ID NO: 633509 - RNA, 13 nt, Escherichia coli CFT073
agaucagauaaua

SEQ ID NO: 633510 - RNA, 23 nt, Escherichia coli CFT073
agaucagaacgcagcauuuccuc

SEQ ID NO: 633511 - RNA, 12 nt, Escherichia coli CFT073
agaucagcaaau

SEQ ID NO: 633512 - RNA, 13 nt, Escherichia coli CFT073
agaucagcaaaua

SEQ ID NO: 633513 - RNA, 15 nt, Escherichia coli CFT073
agauccugaaauucc

SEQ ID NO: 633514 - RNA, 20 nt, Escherichia coli CFT073
agauccugauccugcaacaa

SEQ ID NO: 633515 - RNA, 17 nt, Escherichia coli CFT073
agauccugccauuggca

SEQ ID NO: 633516 - RNA, 14 nt, Escherichia coli CFT073
agauccuggcugua

SEQ ID NO: 633517 - RNA, 23 nt, Escherichia coli CFT073
agauccuggcuguauuuuuccag

SEQ ID NO: 633518 - RNA, 13 nt, Escherichia coli CFT073
agauccagcaagg

SEQ ID NO: 633519 - RNA, 22 nt, Escherichia coli CFT073
agauccaaaccgacugccugca

SEQ ID NO: 633520 - RNA, 23 nt, Escherichia coli CFT073
agaucaugaugaugccaaaaugc

SEQ ID NO: 633521 - RNA, 14 nt, Escherichia coli CFT073
agagggaaagauuu

SEQ ID NO: 633522 - RNA, 21 nt, Escherichia coli CFT073
agaggcccuuggcgucuaagg

SEQ ID NO: 633523 - RNA, 23 nt, Escherichia coli CFT073
agaggauauucugcggcuucagc

SEQ ID NO: 633524 - RNA, 16 nt, Escherichia coli CFT073
agaggcgcgcggguga

SEQ ID NO: 633525 - RNA, 23 nt, Escherichia coli CFT073
agaggcgcgcgggugaugugcca

SEQ ID NO: 633526 - RNA, 20 nt, Escherichia coli CFT073
agaggaccugcgucugauga

SEQ ID NO: 633527 - RNA, 22 nt, Escherichia coli CFT073
agaggaccugcgucugaugaaa

SEQ ID NO: 633528 - RNA, 15 nt, Escherichia coli CFT073
agacguuucgccagc

SEQ ID NO: 633529 - RNA, 17 nt, Escherichia coli CFT073
agacguuugagacccca

SEQ ID NO: 633530 - RNA, 23 nt, Escherichia coli CFT073
agacguucuucugcuucauguug

SEQ ID NO: 633531 - RNA, 16 nt, Escherichia coli CFT073
agagaucauacagaug

SEQ ID NO: 633532 - RNA, 15 nt, Escherichia coli CFT073
agagauguugaagaa

SEQ ID NO: 633533 - RNA, 19 nt, Escherichia coli CFT073
agagauguaaagugaaaua

SEQ ID NO: 633534 - RNA, 13 nt, Escherichia coli CFT073
agagauccuggcg

SEQ ID NO: 633535 - RNA, 13 nt, Escherichia coli CFT073
agagcgccgggca

SEQ ID NO: 633536 - RNA, 17 nt, Escherichia coli CFT073
agagcugaagcauggug

SEQ ID NO: 633537 - RNA, 14 nt, Escherichia coli CFT073
agagcugcaaaagu

SEQ ID NO: 633538 - RNA, 23 nt, Escherichia coli CFT073
agagcuguagauauauccugaac

SEQ ID NO: 633539 - RNA, 13 nt, Escherichia coli CFT073
agagcuucaagaa

SEQ ID NO: 633540 - RNA, 20 nt, Escherichia coli CFT073
aaaacauuacuaauuaauaa

SEQ ID NO: 633541 - RNA, 23 nt, Escherichia coli CFT073
aaaacauuacuaauuaauaauau

SEQ ID NO: 633542 - RNA, 13 nt, Escherichia coli CFT073
agagccuggcugc

SEQ ID NO: 633543 - RNA, 13 nt, Escherichia coli CFT073
agagcgacauaca

SEQ ID NO: 633544 - RNA, 15 nt, Escherichia coli CFT073
agagcaggccaguuu

SEQ ID NO: 633545 - RNA, 16 nt, Escherichia coli CFT073
agagcacuaacaugac

SEQ ID NO: 633546 - RNA, 18 nt, Escherichia coli CFT073
agagcacuaacaugacac

SEQ ID NO: 633547 - RNA, 17 nt, Escherichia coli CFT073
agagccguuaaaacgac

SEQ ID NO: 633548 - RNA, 16 nt, Escherichia coli CFT073
agacauuacaaaauac

SEQ ID NO: 633549 - RNA, 17 nt, Escherichia coli CFT073
agacauuacaaaauaca

SEQ ID NO: 633550 - RNA, 14 nt, Escherichia coli CFT073
agacaugguaaaac

SEQ ID NO: 633551 - RNA, 17 nt, Escherichia coli CFT073
agacaucccuuuauuca

SEQ ID NO: 633552 - RNA, 14 nt, Escherichia coli CFT073
agacaucgcaggga

SEQ ID NO: 633553 - RNA, 19 nt, Escherichia coli CFT073
agacaucacucacgacaca

SEQ ID NO: 633554 - RNA, 20 nt, Escherichia coli CFT073
agacauagggaaacuccagc

SEQ ID NO: 633555 - RNA, 17 nt, Escherichia coli CFT073
agaccagccagcaaugu

SEQ ID NO: 633556 - RNA, 18 nt, Escherichia coli CFT073
agaccagccagcaaugua

SEQ ID NO: 633557 - RNA, 14 nt, Escherichia coli CFT073
agaccaucgucagu

SEQ ID NO: 633558 - RNA, 23 nt, Escherichia coli CFT073
agaccacucucuggcaacuuugu

SEQ ID NO: 633559 - RNA, 19 nt, Escherichia coli CFT073
agaccagauuaaucagcag

SEQ ID NO: 633560 - RNA, 19 nt, Escherichia coli CFT073
agaccagcaaagugcgcuu

SEQ ID NO: 633561 - RNA, 21 nt, Escherichia coli CFT073
agaccacaaucaacgccacca

SEQ ID NO: 633562 - RNA, 13 nt, Escherichia coli CFT073
agaccaauugccg

SEQ ID NO: 633563 - RNA, 23 nt, Escherichia coli CFT073
agaccaauccagccggcaaagug

SEQ ID NO: 633564 - RNA, 16 nt, Escherichia coli CFT073
agaccaauccgccagc

SEQ ID NO: 633565 - RNA, 18 nt, Escherichia coli CFT073
agaccaauggcuuuugcc

SEQ ID NO: 633566 - RNA, 12 nt, Escherichia coli CFT073
agaccaaaccau

SEQ ID NO: 633567 - RNA, 13 nt, Escherichia coli CFT073
agaccaauagaaa

SEQ ID NO: 633568 - RNA, 20 nt, Escherichia coli CFT073
aaaacaggucgccagucccu

SEQ ID NO: 633569 - RNA, 20 nt, Escherichia coli CFT073
aaaacaguaccagaccaaca

SEQ ID NO: 633570 - RNA, 18 nt, Escherichia coli CFT073
aaaacagugcuucuaaca

SEQ ID NO: 633571 - RNA, 17 nt, Escherichia coli CFT073
agacgaugcgucuugcc

SEQ ID NO: 633572 - RNA, 16 nt, Escherichia coli CFT073
aaaacauacuuucuca

SEQ ID NO: 633573 - RNA, 17 nt, Escherichia coli CFT073
agacgcaucgcccagcc

SEQ ID NO: 633574 - RNA, 14 nt, Escherichia coli CFT073
agacgcaacagaaa

SEQ ID NO: 633575 - RNA, 20 nt, Escherichia coli CFT073
agacgcacccucaaaauuuc

SEQ ID NO: 633576 - RNA, 22 nt, Escherichia coli CFT073
agacgguugaucucaucuucca

SEQ ID NO: 633577 - RNA, 23 nt, Escherichia coli CFT073
agacgguugaucucaucuuccac

SEQ ID NO: 633578 - RNA, 23 nt, Escherichia coli CFT073
agacggugccagguaaugacguc

SEQ ID NO: 633579 - RNA, 22 nt, Escherichia coli CFT073
agacgguuaaaaacagccagca

SEQ ID NO: 633580 - RNA, 22 nt, Escherichia coli CFT073
agacgccauugaugagaacauc

SEQ ID NO: 633581 - RNA, 20 nt, Escherichia coli CFT073
agacgccacuuuuuucaccc

SEQ ID NO: 633582 - RNA, 16 nt, Escherichia coli CFT073
agacgccccaguaaac

SEQ ID NO: 633583 - RNA, 19 nt, Escherichia coli CFT073
agacgccccaguaaacaca

SEQ ID NO: 633584 - RNA, 20 nt, Escherichia coli CFT073
agacgccccaguaaacacac

SEQ ID NO: 633585 - RNA, 17 nt, Escherichia coli CFT073
agacgggccaugcaccc

SEQ ID NO: 633586 - RNA, 17 nt, Escherichia coli CFT073
agaccgauacacaucgu

SEQ ID NO: 633587 - RNA, 21 nt, Escherichia coli CFT073
agaccauuugaucgcuggcag

SEQ ID NO: 633588 - RNA, 14 nt, Escherichia coli CFT073
agaccgaacagcau

SEQ ID NO: 633589 - RNA, 15 nt, Escherichia coli CFT073
agaccgaagucaaac

SEQ ID NO: 633590 - RNA, 21 nt, Escherichia coli CFT073
agaccgaagucaaacugauau

SEQ ID NO: 633591 - RNA, 17 nt, Escherichia coli CFT073
agaccggcaaccagcac

SEQ ID NO: 633592 - RNA, 13 nt, Escherichia coli CFT073
agaccugcguuca

SEQ ID NO: 633593 - RNA, 19 nt, Escherichia coli CFT073
aaaacagccagcagcgaau

SEQ ID NO: 633594 - RNA, 22 nt, Escherichia coli CFT073
agaccuuaucacaaucggcuuu

SEQ ID NO: 633595 - RNA, 18 nt, Escherichia coli CFT073
agacaccuugcaacuccg

SEQ ID NO: 633596 - RNA, 16 nt, Escherichia coli CFT073
agacaccggcuuucac

SEQ ID NO: 633597 - RNA, 16 nt, Escherichia coli CFT073
agacaauguaucuuuc

SEQ ID NO: 633598 - RNA, 20 nt, Escherichia coli CFT073
agacaauguaucuuucauca

SEQ ID NO: 633599 - RNA, 22 nt, Escherichia coli CFT073
agacaauuacucgccuuucaca

SEQ ID NO: 633600 - RNA, 23 nt, Escherichia coli CFT073
agacaauuacucgccuuucacac

SEQ ID NO: 633601 - RNA, 20 nt, Escherichia coli CFT073
agacagauuuauaaaaucca

SEQ ID NO: 633602 - RNA, 16 nt, Escherichia coli CFT073
agacagccuaccagac

SEQ ID NO: 633603 - RNA, 20 nt, Escherichia coli CFT073
agacagcaucgaccaugcug

SEQ ID NO: 633604 - RNA, 23 nt, Escherichia coli CFT073
agacagcguaauagccugaugua

SEQ ID NO: 633605 - RNA, 13 nt, Escherichia coli CFT073
agacagccucaag

SEQ ID NO: 633606 - RNA, 17 nt, Escherichia coli CFT073
agacacuggaaacagcc

SEQ ID NO: 633607 - RNA, 18 nt, Escherichia coli CFT073
agacagaaacaaaugaaa

SEQ ID NO: 633608 - RNA, 17 nt, Escherichia coli CFT073
agaauuuucccuuuuag

SEQ ID NO: 633609 - RNA, 13 nt, Escherichia coli CFT073
agacaaacagggu

SEQ ID NO: 633610 - RNA, 11 nt, Escherichia coli CFT073
agacaaauaac

SEQ ID NO: 633611 - RNA, 22 nt, Escherichia coli CFT073
agacaaauaacgagcgagaaua

SEQ ID NO: 633612 - RNA, 17 nt, Escherichia coli CFT073
agacaaaauccugccag

SEQ ID NO: 633613 - RNA, 12 nt, Escherichia coli CFT073
agacaauccccg

SEQ ID NO: 633614 - RNA, 21 nt, Escherichia coli CFT073
agacaacaugagaacaguuca

SEQ ID NO: 633615 - RNA, 21 nt, Escherichia coli CFT073
agaauugcagauaccacauca

SEQ ID NO: 633616 - RNA, 17 nt, Escherichia coli CFT073
agaauuaaccagaaaua

SEQ ID NO: 633617 - RNA, 19 nt, Escherichia coli CFT073
agaauguagauauuaaagc

SEQ ID NO: 633618 - RNA, 10 nt, Escherichia coli CFT073
agaaugccag

SEQ ID NO: 633619 - RNA, 11 nt, Escherichia coli CFT073
agaaugccagc

SEQ ID NO: 633620 - RNA, 17 nt, Escherichia coli CFT073
agaaugcagucaguacg

SEQ ID NO: 633621 - RNA, 21 nt, Escherichia coli CFT073
agaaugauauugauaauaaaa

SEQ ID NO: 633622 - RNA, 19 nt, Escherichia coli CFT073
agaaugaaugauacagaaa

SEQ ID NO: 633623 - RNA, 16 nt, Escherichia coli CFT073
agaauccccacugcau

SEQ ID NO: 633624 - RNA, 19 nt, Escherichia coli CFT073
agaauccccacugcauggc

SEQ ID NO: 633625 - RNA, 15 nt, Escherichia coli CFT073
agaaucggaugaccc

SEQ ID NO: 633626 - RNA, 20 nt, Escherichia coli CFT073
agaauccguacgcuuuucca

SEQ ID NO: 633627 - RNA, 15 nt, Escherichia coli CFT073
agaacagaucccaca

SEQ ID NO: 633628 - RNA, 17 nt, Escherichia coli CFT073
agaacagagucugacca

SEQ ID NO: 633629 - RNA, 16 nt, Escherichia coli CFT073
agaacaucaauccaaa

SEQ ID NO: 633630 - RNA, 22 nt, Escherichia coli CFT073
agaaccgcacagguugcacgga

SEQ ID NO: 633631 - RNA, 19 nt, Escherichia coli CFT073
agaaccgcaccgacggugu

SEQ ID NO: 633632 - RNA, 22 nt, Escherichia coli CFT073
agaaccgccaccuccgcuaaau

SEQ ID NO: 633633 - RNA, 20 nt, Escherichia coli CFT073
agaaccgccgcugucugaau

SEQ ID NO: 633634 - RNA, 23 nt, Escherichia coli CFT073
agaaccgccgcugucugaaugau

SEQ ID NO: 633635 - RNA, 20 nt, Escherichia coli CFT073
agaacagaaauggcuggcag

SEQ ID NO: 633636 - RNA, 15 nt, Escherichia coli CFT073
agaacagcggagcaa

SEQ ID NO: 633637 - RNA, 19 nt, Escherichia coli CFT073
agaacaggaauaaaucuau

SEQ ID NO: 633638 - RNA, 17 nt, Escherichia coli CFT073
agaacaguucagcaaca

SEQ ID NO: 633639 - RNA, 19 nt, Escherichia coli CFT073
agaacaguucagcaacacu

SEQ ID NO: 633640 - RNA, 17 nt, Escherichia coli CFT073
agaacauaaacacccac

SEQ ID NO: 633641 - RNA, 15 nt, Escherichia coli CFT073
agaacauaaacagcg

SEQ ID NO: 633642 - RNA, 15 nt, Escherichia coli CFT073
agaaauaucagcagc

SEQ ID NO: 633643 - RNA, 19 nt, Escherichia coli CFT073
agaaauaucagcagcacaa

SEQ ID NO: 633644 - RNA, 23 nt, Escherichia coli CFT073
aaaacacaacgcuuucaacaacc

SEQ ID NO: 633645 - RNA, 18 nt, Escherichia coli CFT073
agaaauugagauaagcaa

SEQ ID NO: 633646 - RNA, 23 nt, Escherichia coli CFT073
agaacuucggcagagaaagcaaa

SEQ ID NO: 633647 - RNA, 20 nt, Escherichia coli CFT073
agaacugguagcgcauuuca

SEQ ID NO: 633648 - RNA, 15 nt, Escherichia coli CFT073
agaacugugccagac

SEQ ID NO: 633649 - RNA, 14 nt, Escherichia coli CFT073
agaacuguuccagc

SEQ ID NO: 633650 - RNA, 12 nt, Escherichia coli CFT073
agaacuuaauca

SEQ ID NO: 633651 - RNA, 22 nt, Escherichia coli CFT073
agaacuccggcgcguugauacc

SEQ ID NO: 633652 - RNA, 16 nt, Escherichia coli CFT073
agaacucggaagcagc

SEQ ID NO: 633653 - RNA, 19 nt, Escherichia coli CFT073
agaacugagcgaucauuag

SEQ ID NO: 633654 - RNA, 19 nt, Escherichia coli CFT073
agaacugacgcccaguuuc

SEQ ID NO: 633655 - RNA, 16 nt, Escherichia coli CFT073
agaacugaucaauaaa

SEQ ID NO: 633656 - RNA, 19 nt, Escherichia coli CFT073
agaacugcaacucaccuuu

SEQ ID NO: 633657 - RNA, 20 nt, Escherichia coli CFT073
agaacugcaacucaccuuua

SEQ ID NO: 633658 - RNA, 19 nt, Escherichia coli CFT073
agaaccuaagaaccagaau

SEQ ID NO: 633659 - RNA, 17 nt, Escherichia coli CFT073
agaacuaguagcaugaa

SEQ ID NO: 633660 - RNA, 18 nt, Escherichia coli CFT073
agaagcacuaccuugcuu

SEQ ID NO: 633661 - RNA, 20 nt, Escherichia coli CFT073
agaagauuuuuugccagcac

SEQ ID NO: 633662 - RNA, 13 nt, Escherichia coli CFT073
agaagauccauga

SEQ ID NO: 633663 - RNA, 21 nt, Escherichia coli CFT073
agaagauccaugaagcaauga

SEQ ID NO: 633664 - RNA, 19 nt, Escherichia coli CFT073
agaaggauaauuaauccuu

SEQ ID NO: 633665 - RNA, 16 nt, Escherichia coli CFT073
agaaggauauaaaaau

SEQ ID NO: 633666 - RNA, 14 nt, Escherichia coli CFT073
agaaggaaaauaca

SEQ ID NO: 633667 - RNA, 23 nt, Escherichia coli CFT073
agaaggaaaauacagcaauggaa

SEQ ID NO: 633668 - RNA, 14 nt, Escherichia coli CFT073
agaaaguuuuucaa

SEQ ID NO: 633669 - RNA, 19 nt, Escherichia coli CFT073
agaaaguugccagauaaau

SEQ ID NO: 633670 - RNA, 20 nt, Escherichia coli CFT073
agaaaguugccagauaaaua

SEQ ID NO: 633671 - RNA, 22 nt, Escherichia coli CFT073
agaaaguugccagauaaauauu

SEQ ID NO: 633672 - RNA, 20 nt, Escherichia coli CFT073
agaaagucgcggaauaucca

SEQ ID NO: 633673 - RNA, 22 nt, Escherichia coli CFT073
agaaagucguaggccugauaag

SEQ ID NO: 633674 - RNA, 22 nt, Escherichia coli CFT073
agaaauaaccgaaucguuuuuu

SEQ ID NO: 633675 - RNA, 23 nt, Escherichia coli CFT073
agaaagcugcugaccaccagcac

SEQ ID NO: 633676 - RNA, 15 nt, Escherichia coli CFT073
agaaaguaaauuauu

SEQ ID NO: 633677 - RNA, 22 nt, Escherichia coli CFT073
agaaaguaacaauagcgaacag

SEQ ID NO: 633678 - RNA, 15 nt, Escherichia coli CFT073
agaaagggaagaaca

SEQ ID NO: 633679 - RNA, 19 nt, Escherichia coli CFT073
agaaagggaagaacaucac

SEQ ID NO: 633680 - RNA, 18 nt, Escherichia coli CFT073
agaaagccggaugaucau

SEQ ID NO: 633681 - RNA, 16 nt, Escherichia coli CFT073
agaaacugaucauuau

SEQ ID NO: 633682 - RNA, 15 nt, Escherichia coli CFT073
agaaaccccggcaca

SEQ ID NO: 633683 - RNA, 16 nt, Escherichia coli CFT073
agaaacccgcaaagag

SEQ ID NO: 633684 - RNA, 11 nt, Escherichia coli CFT073
acuuuugcccu

SEQ ID NO: 633685 - RNA, 19 nt, Escherichia coli CFT073
acuuuuuauuuacucuccu

SEQ ID NO: 633686 - RNA, 16 nt, Escherichia coli CFT073
agaaaaacggaaagca

SEQ ID NO: 633687 - RNA, 21 nt, Escherichia coli CFT073
agaaaaggaguuuuuccuuuc

SEQ ID NO: 633688 - RNA, 16 nt, Escherichia coli CFT073
agaaaagcuguaaggu

SEQ ID NO: 633689 - RNA, 18 nt, Escherichia coli CFT073
agaaacaucggcaguaau

SEQ ID NO: 633690 - RNA, 20 nt, Escherichia coli CFT073
agaaaacgguugauauacca

SEQ ID NO: 633691 - RNA, 17 nt, Escherichia coli CFT073
agaaaagaguauuacau

SEQ ID NO: 633692 - RNA, 20 nt, Escherichia coli CFT073
agaaaacuaucugaaaauga

SEQ ID NO: 633693 - RNA, 19 nt, Escherichia coli CFT073
agaaaacuuaucuuauucc

SEQ ID NO: 633694 - RNA, 22 nt, Escherichia coli CFT073
agaaaagaccagccagcaaugu

SEQ ID NO: 633695 - RNA, 16 nt, Escherichia coli CFT073
agaaaagccaaccugc

SEQ ID NO: 633696 - RNA, 13 nt, Escherichia coli CFT073
aggaaccaaaugc

SEQ ID NO: 633697 - RNA, 16 nt, Escherichia coli CFT073
aggaacauucggcaau

SEQ ID NO: 633698 - RNA, 15 nt, Escherichia coli CFT073
aggaacagccacugg

SEQ ID NO: 633699 - RNA, 14 nt, Escherichia coli CFT073
aggaacagauacug

SEQ ID NO: 633700 - RNA, 11 nt, Escherichia coli CFT073
aggaacgcugc

SEQ ID NO: 633701 - RNA, 23 nt, Escherichia coli CFT073
aggaacucagcgugccaucaaag

SEQ ID NO: 633702 - RNA, 19 nt, Escherichia coli CFT073
aggaacugcaaggagagcc

SEQ ID NO: 633703 - RNA, 16 nt, Escherichia coli CFT073
aggaagaagcccauca

SEQ ID NO: 633704 - RNA, 15 nt, Escherichia coli CFT073
aggaagaagcuugcu

SEQ ID NO: 633705 - RNA, 13 nt, Escherichia coli CFT073
aggaacaaugccu

SEQ ID NO: 633706 - RNA, 18 nt, Escherichia coli CFT073
aggaacagaaugguggcc

SEQ ID NO: 633707 - RNA, 17 nt, Escherichia coli CFT073
aggaaauguuccggguu

SEQ ID NO: 633708 - RNA, 21 nt, Escherichia coli CFT073
aggaaaguccgggcuccauag

SEQ ID NO: 633709 - RNA, 15 nt, Escherichia coli CFT073
agcuuuucuccugcu

SEQ ID NO: 633710 - RNA, 13 nt, Escherichia coli CFT073
agcuuuucuggau

SEQ ID NO: 633711 - RNA, 15 nt, Escherichia coli CFT073
agcuuugcacucugc

SEQ ID NO: 633712 - RNA, 22 nt, Escherichia coli CFT073
agcuuugcccgaucaucaaaaa

SEQ ID NO: 633713 - RNA, 13 nt, Escherichia coli CFT073
agcuuuggcggca

SEQ ID NO: 633714 - RNA, 22 nt, Escherichia coli CFT073
aggacaucccggcagagaaaau

SEQ ID NO: 633715 - RNA, 22 nt, Escherichia coli CFT073
aggacuucaucacgaugcaaau

SEQ ID NO: 633716 - RNA, 21 nt, Escherichia coli CFT073
aggacuggcgauaucaauauu

SEQ ID NO: 633717 - RNA, 17 nt, Escherichia coli CFT073
aggacugguugauaacc

SEQ ID NO: 633718 - RNA, 15 nt, Escherichia coli CFT073
aggagagccaguaca

SEQ ID NO: 633719 - RNA, 20 nt, Escherichia coli CFT073
aggagaguaugcgcgucaga

SEQ ID NO: 633720 - RNA, 19 nt, Escherichia coli CFT073
aggagaggccuucgacuga

SEQ ID NO: 633721 - RNA, 18 nt, Escherichia coli CFT073
aggagaguaugcgcguca

SEQ ID NO: 633722 - RNA, 20 nt, Escherichia coli CFT073
aggaagcuuucgcaguagau

SEQ ID NO: 633723 - RNA, 20 nt, Escherichia coli CFT073
aggaauucagcguggcgaau

SEQ ID NO: 633724 - RNA, 17 nt, Escherichia coli CFT073
agcuugugcaccagcug

SEQ ID NO: 633725 - RNA, 22 nt, Escherichia coli CFT073
agcuugucauuaccacaacaaa

SEQ ID NO: 633726 - RNA, 12 nt, Escherichia coli CFT073
agcuugccuuca

SEQ ID NO: 633727 - RNA, 17 nt, Escherichia coli CFT073
agcuucucgugaaauuc

SEQ ID NO: 633728 - RNA, 19 nt, Escherichia coli CFT073
agcuugagccguaggugaa

SEQ ID NO: 633729 - RNA, 14 nt, Escherichia coli CFT073
agcuugauuucagg

SEQ ID NO: 633730 - RNA, 14 nt, Escherichia coli CFT073
agcuuagaaaggaa

SEQ ID NO: 633731 - RNA, 14 nt, Escherichia coli CFT073
agcuuaauucuguc

SEQ ID NO: 633732 - RNA, 15 nt, Escherichia coli CFT073
agcuuccuugcugau

SEQ ID NO: 633733 - RNA, 21 nt, Escherichia coli CFT073
agcuucgaauagagccuggcu

SEQ ID NO: 633734 - RNA, 20 nt, Escherichia coli CFT073
agcuucgcuucccaacgcag

SEQ ID NO: 633735 - RNA, 21 nt, Escherichia coli CFT073
agcugccugccaguaaauggc

SEQ ID NO: 633736 - RNA, 13 nt, Escherichia coli CFT073
agcugccugcgga

SEQ ID NO: 633737 - RNA, 21 nt, Escherichia coli CFT073
agcugccugcggcgaucuuca

SEQ ID NO: 633738 - RNA, 22 nt, Escherichia coli CFT073
agcucccacaguuucagcccca

SEQ ID NO: 633739 - RNA, 13 nt, Escherichia coli CFT073
agcugccagcccc

SEQ ID NO: 633740 - RNA, 22 nt, Escherichia coli CFT073
agcugcauccgggguucgaauc

SEQ ID NO: 633741 - RNA, 14 nt, Escherichia coli CFT073
agcuccagugccug

SEQ ID NO: 633742 - RNA, 20 nt, Escherichia coli CFT073
agcuccaggagggguuuuug

SEQ ID NO: 633743 - RNA, 21 nt, Escherichia coli CFT073
agcuccagccgcuccccucag

SEQ ID NO: 633744 - RNA, 13 nt, Escherichia coli CFT073
agcuccacaagaa

SEQ ID NO: 633745 - RNA, 22 nt, Escherichia coli CFT073
agcuccacaagaaugccugcca

SEQ ID NO: 633746 - RNA, 22 nt, Escherichia coli CFT073
agcuguccuguaggccugauaa

SEQ ID NO: 633747 - RNA, 19 nt, Escherichia coli CFT073
agcugucugucaaauucac

SEQ ID NO: 633748 - RNA, 17 nt, Escherichia coli CFT073
agcugucguacccaguc

SEQ ID NO: 633749 - RNA, 16 nt, Escherichia coli CFT073
agcugucaccucugca

SEQ ID NO: 633750 - RNA, 23 nt, Escherichia coli CFT073
agcuguccauaccggacuccaga

SEQ ID NO: 633751 - RNA, 17 nt, Escherichia coli CFT073
aggccuaaagcauacaa

SEQ ID NO: 633752 - RNA, 19 nt, Escherichia coli CFT073
aggccuaacaccaucagug

SEQ ID NO: 633753 - RNA, 21 nt, Escherichia coli CFT073
aggccuacauagccccugcaa

SEQ ID NO: 633754 - RNA, 20 nt, Escherichia coli CFT073
aggccuacauuggugccgga

SEQ ID NO: 633755 - RNA, 14 nt, Escherichia coli CFT073
aggccugauaagac

SEQ ID NO: 633756 - RNA, 20 nt, Escherichia coli CFT073
aggccugauaagacgcaacc

SEQ ID NO: 633757 - RNA, 18 nt, Escherichia coli CFT073
aggccccaucgaaucaaa

SEQ ID NO: 633758 - RNA, 18 nt, Escherichia coli CFT073
aggccccgucagcaaaau

SEQ ID NO: 633759 - RNA, 16 nt, Escherichia coli CFT073
aggcccgcgugccgga

SEQ ID NO: 633760 - RNA, 15 nt, Escherichia coli CFT073
aggccgaguagccag

SEQ ID NO: 633761 - RNA, 18 nt, Escherichia coli CFT073
aggccgauacggacucgg

SEQ ID NO: 633762 - RNA, 18 nt, Escherichia coli CFT073
aggcgcgucaaauaaaga

SEQ ID NO: 633763 - RNA, 21 nt, Escherichia coli CFT073
aggcgcgcgggugaugugcca

SEQ ID NO: 633764 - RNA, 23 nt, Escherichia coli CFT073
aggcgcugcuggagcaggugaau

SEQ ID NO: 633765 - RNA, 23 nt, Escherichia coli CFT073
aggcgcucgcgccgcauccgaca

SEQ ID NO: 633766 - RNA, 14 nt, Escherichia coli CFT073
aggcgaucuucccg

SEQ ID NO: 633767 - RNA, 13 nt, Escherichia coli CFT073
aggcgcacugccc

SEQ ID NO: 633768 - RNA, 14 nt, Escherichia coli CFT073
aggcgacaaagccu

SEQ ID NO: 633769 - RNA, 14 nt, Escherichia coli CFT073
aggcgacaaggcuu

SEQ ID NO: 633770 - RNA, 17 nt, Escherichia coli CFT073
aggcgaagacaaaacca

SEQ ID NO: 633771 - RNA, 21 nt, Escherichia coli CFT073
aggcgaccguuuucaccaguu

SEQ ID NO: 633772 - RNA, 12 nt, Escherichia coli CFT073
aggcgacgguuu

SEQ ID NO: 633773 - RNA, 19 nt, Escherichia coli CFT073
aggcgacgguuuccaggca

SEQ ID NO: 633774 - RNA, 15 nt, Escherichia coli CFT073
aggcacgacacaaug

SEQ ID NO: 633775 - RNA, 19 nt, Escherichia coli CFT073
aggcaccugaaucuggcuu

SEQ ID NO: 633776 - RNA, 19 nt, Escherichia coli CFT073
aggcacuggccuuuucaca

SEQ ID NO: 633777 - RNA, 21 nt, Escherichia coli CFT073
aggcacuugucaccaaucuga

SEQ ID NO: 633778 - RNA, 20 nt, Escherichia coli CFT073
aggcagaacaccggcagcgg

SEQ ID NO: 633779 - RNA, 14 nt, Escherichia coli CFT073
aggcaucuuuuuca

SEQ ID NO: 633780 - RNA, 13 nt, Escherichia coli CFT073
aggcaugaucagc

SEQ ID NO: 633781 - RNA, 16 nt, Escherichia coli CFT073
aggcagacgaugaugc

SEQ ID NO: 633782 - RNA, 18 nt, Escherichia coli CFT073
aggccaaaagcuaacagc

SEQ ID NO: 633783 - RNA, 17 nt, Escherichia coli CFT073
aggccauuuccccaauc

SEQ ID NO: 633784 - RNA, 20 nt, Escherichia coli CFT073
aggccauuuuuucgauaauc

SEQ ID NO: 633785 - RNA, 23 nt, Escherichia coli CFT073
aggccauuuuuucgauaaucaaa

SEQ ID NO: 633786 - RNA, 15 nt, Escherichia coli CFT073
aggccaccgcccacc

SEQ ID NO: 633787 - RNA, 12 nt, Escherichia coli CFT073
aggccagauaaa

SEQ ID NO: 633788 - RNA, 16 nt, Escherichia coli CFT073
aggccagauaaaacac

SEQ ID NO: 633789 - RNA, 15 nt, Escherichia coli CFT073
aggcaaaauccuucc

SEQ ID NO: 633790 - RNA, 21 nt, Escherichia coli CFT073
aggcaacaaaaaacccaucaa

SEQ ID NO: 633791 - RNA, 14 nt, Escherichia coli CFT073
aggcaaaaugccag

SEQ ID NO: 633792 - RNA, 17 nt, Escherichia coli CFT073
aggcaaaaugccagccc

SEQ ID NO: 633793 - RNA, 18 nt, Escherichia coli CFT073
aggcaacagauaauaaaa

SEQ ID NO: 633794 - RNA, 19 nt, Escherichia coli CFT073
aggcaacgaccagaaaugc

SEQ ID NO: 633795 - RNA, 16 nt, Escherichia coli CFT073
aggcaccagccccugg

SEQ ID NO: 633796 - RNA, 14 nt, Escherichia coli CFT073
aggcacaccagcaa

SEQ ID NO: 633797 - RNA, 16 nt, Escherichia coli CFT073
aggcaaggaugcguuu

SEQ ID NO: 633798 - RNA, 14 nt, Escherichia coli CFT073
aggcacaauggcca

SEQ ID NO: 633799 - RNA, 14 nt, Escherichia coli CFT073
aggcaagaauccgc

SEQ ID NO: 633800 - RNA, 15 nt, Escherichia coli CFT073
aggauuuacuaaaac

SEQ ID NO: 633801 - RNA, 12 nt, Escherichia coli CFT073
aggagcagaaca

SEQ ID NO: 633802 - RNA, 15 nt, Escherichia coli CFT073
aggagccgcauagac

SEQ ID NO: 633803 - RNA, 16 nt, Escherichia coli CFT073
aggagccgcauagacg

SEQ ID NO: 633804 - RNA, 17 nt, Escherichia coli CFT073
aggugcguuuuacgacu

SEQ ID NO: 633805 - RNA, 18 nt, Escherichia coli CFT073
aggugcaucggggaauug

SEQ ID NO: 633806 - RNA, 18 nt, Escherichia coli CFT073
aggugcuaugcauacaca

SEQ ID NO: 633807 - RNA, 17 nt, Escherichia coli CFT073
aggugauuuuacccccg

SEQ ID NO: 633808 - RNA, 15 nt, Escherichia coli CFT073
aggugauucccagca

SEQ ID NO: 633809 - RNA, 18 nt, Escherichia coli CFT073
aggugauucccagcaaca

SEQ ID NO: 633810 - RNA, 21 nt, Escherichia coli CFT073
aggugcagcccauaagcaaaa

SEQ ID NO: 633811 - RNA, 22 nt, Escherichia coli CFT073
aggucguucaguuuaccgucuu

SEQ ID NO: 633812 - RNA, 15 nt, Escherichia coli CFT073
agguccagccgccug

SEQ ID NO: 633813 - RNA, 22 nt, Escherichia coli CFT073
aggucggauaaggcguuuacgc

SEQ ID NO: 633814 - RNA, 21 nt, Escherichia coli CFT073
agguaucgcgaaaaaaaagau

SEQ ID NO: 633815 - RNA, 17 nt, Escherichia coli CFT073
agguaucgcgaaaaaaa

SEQ ID NO: 633816 - RNA, 18 nt, Escherichia coli CFT073
agguaucgcgaaaaaaaa

SEQ ID NO: 633817 - RNA, 15 nt, Escherichia coli CFT073
aggucauaucuuugc

SEQ ID NO: 633818 - RNA, 16 nt, Escherichia coli CFT073
aggucaucacauccca

SEQ ID NO: 633819 - RNA, 17 nt, Escherichia coli CFT073
aggucaucacaucccag

SEQ ID NO: 633820 - RNA, 19 nt, Escherichia coli CFT073
agguaacgccuggggggga

SEQ ID NO: 633821 - RNA, 22 nt, Escherichia coli CFT073
agguaauauugcguaccugcau

SEQ ID NO: 633822 - RNA, 17 nt, Escherichia coli CFT073
agggugaauaaaagaaa

SEQ ID NO: 633823 - RNA, 20 nt, Escherichia coli CFT073
aggguaauauauaacagaag

SEQ ID NO: 633824 - RNA, 21 nt, Escherichia coli CFT073
agguagcuuaucgcaggcuuc

SEQ ID NO: 633825 - RNA, 21 nt, Escherichia coli CFT073
agguagugcuucuaaaggaag

SEQ ID NO: 633826 - RNA, 17 nt, Escherichia coli CFT073
agguagucaaaagcacu

SEQ ID NO: 633827 - RNA, 13 nt, Escherichia coli CFT073
agguaguagaaau

SEQ ID NO: 633828 - RNA, 21 nt, Escherichia coli CFT073
agguaauuuugcuuauuuaaa

SEQ ID NO: 633829 - RNA, 14 nt, Escherichia coli CFT073
agguacaaagccaa

SEQ ID NO: 633830 - RNA, 19 nt, Escherichia coli CFT073
agguacaaagccaacagca

SEQ ID NO: 633831 - RNA, 17 nt, Escherichia coli CFT073
agguacagacuaaaugu

SEQ ID NO: 633832 - RNA, 18 nt, Escherichia coli CFT073
agguacgcaggcggcugg

SEQ ID NO: 633833 - RNA, 17 nt, Escherichia coli CFT073
aggggcauuuuccagug

SEQ ID NO: 633834 - RNA, 11 nt, Escherichia coli CFT073
aggggcgaggg

SEQ ID NO: 633835 - RNA, 22 nt, Escherichia coli CFT073
aggggcggguuuuuuuauaucu

SEQ ID NO: 633836 - RNA, 20 nt, Escherichia coli CFT073
agggcggcgguggcaaaggu

SEQ ID NO: 633837 - RNA, 21 nt, Escherichia coli CFT073
agggacuccggauucaagcau

SEQ ID NO: 633838 - RNA, 13 nt, Escherichia coli CFT073
agggaagcaauaa

SEQ ID NO: 633839 - RNA, 15 nt, Escherichia coli CFT073
agggaagcgaguuac

SEQ ID NO: 633840 - RNA, 18 nt, Escherichia coli CFT073
agggagguuucgaccaca

SEQ ID NO: 633841 - RNA, 22 nt, Escherichia coli CFT073
agggagcaggccaguaaaaagc

SEQ ID NO: 633842 - RNA, 20 nt, Escherichia coli CFT073
agggaaaggauggcgaugcu

SEQ ID NO: 633843 - RNA, 14 nt, Escherichia coli CFT073
aggcggaaacgcug

SEQ ID NO: 633844 - RNA, 14 nt, Escherichia coli CFT073
aggcuugcugaugc

SEQ ID NO: 633845 - RNA, 13 nt, Escherichia coli CFT073
aggcuugcugcau

SEQ ID NO: 633846 - RNA, 13 nt, Escherichia coli CFT073
aguaugaucuugc

SEQ ID NO: 633847 - RNA, 21 nt, Escherichia coli CFT073
aguauucgucgcaccacuuuu

SEQ ID NO: 633848 - RNA, 14 nt, Escherichia coli CFT073
aguauauugcugau

SEQ ID NO: 633849 - RNA, 14 nt, Escherichia coli CFT073
aguauagcggcaug

SEQ ID NO: 633850 - RNA, 22 nt, Escherichia coli CFT073
aguauccacgcagacaauaaac

SEQ ID NO: 633851 - RNA, 21 nt, Escherichia coli CFT073
aguaucgcucaauauccugac

SEQ ID NO: 633852 - RNA, 17 nt, Escherichia coli CFT073
aguaugacgaguauauu

SEQ ID NO: 633853 - RNA, 19 nt, Escherichia coli CFT073
aguaugacgaguauauucu

SEQ ID NO: 633854 - RNA, 21 nt, Escherichia coli CFT073
aguaucuuauugaaagaucac

SEQ ID NO: 633855 - RNA, 14 nt, Escherichia coli CFT073
aguaucuucacugc

SEQ ID NO: 633856 - RNA, 22 nt, Escherichia coli CFT073
aguagcgccagacugacaauca

SEQ ID NO: 633857 - RNA, 22 nt, Escherichia coli CFT073
aguagcguaaaggcugccagag

SEQ ID NO: 633858 - RNA, 16 nt, Escherichia coli CFT073
aguagcgucgccagca

SEQ ID NO: 633859 - RNA, 18 nt, Escherichia coli CFT073
aguagcccuucagcuugu

SEQ ID NO: 633860 - RNA, 18 nt, Escherichia coli CFT073
aguagcgcagcagauaaa

SEQ ID NO: 633861 - RNA, 19 nt, Escherichia coli CFT073
aguagccacgcgacauaaa

SEQ ID NO: 633862 - RNA, 14 nt, Escherichia coli CFT073
aguagccagcugcc

SEQ ID NO: 633863 - RNA, 20 nt, Escherichia coli CFT073
aguagccagcugccugccag

SEQ ID NO: 633864 - RNA, 14 nt, Escherichia coli CFT073
aguagcaugaagua

SEQ ID NO: 633865 - RNA, 20 nt, Escherichia coli CFT073
aguagcaugaaguaacagaa

SEQ ID NO: 633866 - RNA, 21 nt, Escherichia coli CFT073
aguagcaugaaguaacagaag

SEQ ID NO: 633867 - RNA, 18 nt, Escherichia coli CFT073
aguaccaucuccgcaggc

SEQ ID NO: 633868 - RNA, 20 nt, Escherichia coli CFT073
aguaccaucguccagcagca

SEQ ID NO: 633869 - RNA, 13 nt, Escherichia coli CFT073
aguacccucugca

SEQ ID NO: 633870 - RNA, 22 nt, Escherichia coli CFT073
aguaguacgcgggaauagcuca

SEQ ID NO: 633871 - RNA, 17 nt, Escherichia coli CFT073
aguagguagaauauuuu

SEQ ID NO: 633872 - RNA, 17 nt, Escherichia coli CFT073
aguagcuugaaaucacc

SEQ ID NO: 633873 - RNA, 15 nt, Escherichia coli CFT073
aguagcucaccagca

SEQ ID NO: 633874 - RNA, 19 nt, Escherichia coli CFT073
aguagcucaccagcaggca

SEQ ID NO: 633875 - RNA, 22 nt, Escherichia coli CFT073
aguagcucaccagcaggcacuu

SEQ ID NO: 633876 - RNA, 14 nt, Escherichia coli CFT073
aguagugaaaaaag

SEQ ID NO: 633877 - RNA, 13 nt, Escherichia coli CFT073
aguaguaaugauc

SEQ ID NO: 633878 - RNA, 19 nt, Escherichia coli CFT073
aguaguggaaaccggcauc

SEQ ID NO: 633879 - RNA, 13 nt, Escherichia coli CFT073
aguaguggaugaa

SEQ ID NO: 633880 - RNA, 14 nt, Escherichia coli CFT073
aguaguugcucaag

SEQ ID NO: 633881 - RNA, 15 nt, Escherichia coli CFT073
aguaguuccagcaug

SEQ ID NO: 633882 - RNA, 16 nt, Escherichia coli CFT073
agguuggaucaacagg

SEQ ID NO: 633883 - RNA, 14 nt, Escherichia coli CFT073
agguugaggaacuu

SEQ ID NO: 633884 - RNA, 16 nt, Escherichia coli CFT073
agguggcaguuacugc

SEQ ID NO: 633885 - RNA, 14 nt, Escherichia coli CFT073
aguaaaacugcauu

SEQ ID NO: 633886 - RNA, 16 nt, Escherichia coli CFT073
agguuuaccagcagcc

SEQ ID NO: 633887 - RNA, 23 nt, Escherichia coli CFT073
agguuucaguaacaucacaugcu

SEQ ID NO: 633888 - RNA, 19 nt, Escherichia coli CFT073
aguaauauccccagccuaa

SEQ ID NO: 633889 - RNA, 14 nt, Escherichia coli CFT073
aguaaucaggcuau

SEQ ID NO: 633890 - RNA, 15 nt, Escherichia coli CFT073
aguaauccagcaaac

SEQ ID NO: 633891 - RNA, 12 nt, Escherichia coli CFT073
aguaauaaugcc

SEQ ID NO: 633892 - RNA, 15 nt, Escherichia coli CFT073
aguaaucaaucaccu

SEQ ID NO: 633893 - RNA, 20 nt, Escherichia coli CFT073
aguaauuuauagauucuacg

SEQ ID NO: 633894 - RNA, 14 nt, Escherichia coli CFT073
aguaauuguuucau

SEQ ID NO: 633895 - RNA, 12 nt, Escherichia coli CFT073
aguaccagcacc

SEQ ID NO: 633896 - RNA, 14 nt, Escherichia coli CFT073
aguacaaaaauaag

SEQ ID NO: 633897 - RNA, 23 nt, Escherichia coli CFT073
aguaaggcugcgagguuauccgc

SEQ ID NO: 633898 - RNA, 15 nt, Escherichia coli CFT073
aguaaguguuguauu

SEQ ID NO: 633899 - RNA, 16 nt, Escherichia coli CFT073
aguaauaacaguaaug

SEQ ID NO: 633900 - RNA, 21 nt, Escherichia coli CFT073
aguaauaacccgucagcagau

SEQ ID NO: 633901 - RNA, 16 nt, Escherichia coli CFT073
aguaacagaagaucau

SEQ ID NO: 633902 - RNA, 20 nt, Escherichia coli CFT073
agucgcgcaauugccagaca

SEQ ID NO: 633903 - RNA, 20 nt, Escherichia coli CFT073
agucgcgguccgggccgcaa

SEQ ID NO: 633904 - RNA, 11 nt, Escherichia coli CFT073
aguccggauaa

SEQ ID NO: 633905 - RNA, 16 nt, Escherichia coli CFT073
aguccgccauuauuac

SEQ ID NO: 633906 - RNA, 17 nt, Escherichia coli CFT073
aguauuuucagaaggau

SEQ ID NO: 633907 - RNA, 16 nt, Escherichia coli CFT073
agucggacgacauggu

SEQ ID NO: 633908 - RNA, 16 nt, Escherichia coli CFT073
agucggcuuucucauu

SEQ ID NO: 633909 - RNA, 17 nt, Escherichia coli CFT073
agucggggggaggcugc

SEQ ID NO: 633910 - RNA, 20 nt, Escherichia coli CFT073
agucgggucgccguaagcaa

SEQ ID NO: 633911 - RNA, 14 nt, Escherichia coli CFT073
agucggugccaugg

SEQ ID NO: 633912 - RNA, 17 nt, Escherichia coli CFT073
agucuccaaccaucacc

SEQ ID NO: 633913 - RNA, 11 nt, Escherichia coli CFT073
agucucccuuu

SEQ ID NO: 633914 - RNA, 23 nt, Escherichia coli CFT073
agucucguuucccgcuccaaaau

SEQ ID NO: 633915 - RNA, 13 nt, Escherichia coli CFT073
agucugcauuuuc

SEQ ID NO: 633916 - RNA, 21 nt, Escherichia coli CFT073
agucugcaccuuuaaccccag

SEQ ID NO: 633917 - RNA, 21 nt, Escherichia coli CFT073
agucugauaguaguuugauga

SEQ ID NO: 633918 - RNA, 19 nt, Escherichia coli CFT073
agucugaccacuaucgccu

SEQ ID NO: 633919 - RNA, 21 nt, Escherichia coli CFT073
agucucuucuuugcagggagg

SEQ ID NO: 633920 - RNA, 16 nt, Escherichia coli CFT073
agugaaaaaagcaaga

SEQ ID NO: 633921 - RNA, 14 nt, Escherichia coli CFT073
agugccagaacaga

SEQ ID NO: 633922 - RNA, 15 nt, Escherichia coli CFT073
agugccagaacagaa

SEQ ID NO: 633923 - RNA, 15 nt, Escherichia coli CFT073
agugccagauugaag

SEQ ID NO: 633924 - RNA, 19 nt, Escherichia coli CFT073
agugcccgaccacuucaug

SEQ ID NO: 633925 - RNA, 16 nt, Escherichia coli CFT073
agugcagccauuuuac

SEQ ID NO: 633926 - RNA, 20 nt, Escherichia coli CFT073
agugcagccauuuuacucau

SEQ ID NO: 633927 - RNA, 12 nt, Escherichia coli CFT073
agugcagcgaag

SEQ ID NO: 633928 - RNA, 13 nt, Escherichia coli CFT073
agugcaccagcuu

SEQ ID NO: 633929 - RNA, 14 nt, Escherichia coli CFT073
agugcaacuuuacu

SEQ ID NO: 633930 - RNA, 19 nt, Escherichia coli CFT073
agugcaaaaaaucaacagc

SEQ ID NO: 633931 - RNA, 13 nt, Escherichia coli CFT073
agugauuguccua

SEQ ID NO: 633932 - RNA, 16 nt, Escherichia coli CFT073
agugauuuacuuucuu

SEQ ID NO: 633933 - RNA, 17 nt, Escherichia coli CFT073
agugauuuauuuuuacu

SEQ ID NO: 633934 - RNA, 17 nt, Escherichia coli CFT073
agugaucuggcuggcaa

SEQ ID NO: 633935 - RNA, 20 nt, Escherichia coli CFT073
agugaucagccucucucuga

SEQ ID NO: 633936 - RNA, 14 nt, Escherichia coli CFT073
agugaauggugaag

SEQ ID NO: 633937 - RNA, 17 nt, Escherichia coli CFT073
agugaaucucaggcaaa

SEQ ID NO: 633938 - RNA, 13 nt, Escherichia coli CFT073
agugaauccagca

SEQ ID NO: 633939 - RNA, 15 nt, Escherichia coli CFT073
agugaauccagcaug

SEQ ID NO: 633940 - RNA, 15 nt, Escherichia coli CFT073
aguggcaaauucuug

SEQ ID NO: 633941 - RNA, 17 nt, Escherichia coli CFT073
aguggauuaucuucacc

SEQ ID NO: 633942 - RNA, 22 nt, Escherichia coli CFT073
agugcuucgcggacaucgucca

SEQ ID NO: 633943 - RNA, 17 nt, Escherichia coli CFT073
agugcuucuaacaucau

SEQ ID NO: 633944 - RNA, 21 nt, Escherichia coli CFT073
agugguuaccgaauccagcaa

SEQ ID NO: 633945 - RNA, 22 nt, Escherichia coli CFT073
agugguuaccgaauccagcaag

SEQ ID NO: 633946 - RNA, 14 nt, Escherichia coli CFT073
agugguauugaauc

SEQ ID NO: 633947 - RNA, 13 nt, Escherichia coli CFT073
agugguaccagga

SEQ ID NO: 633948 - RNA, 17 nt, Escherichia coli CFT073
agugcgcgaaccagaga

SEQ ID NO: 633949 - RNA, 13 nt, Escherichia coli CFT073
agugcgggcgaga

SEQ ID NO: 633950 - RNA, 16 nt, Escherichia coli CFT073
agugcgguaaauuuuu

SEQ ID NO: 633951 - RNA, 23 nt, Escherichia coli CFT073
agugcucuuuguaggccugauaa

SEQ ID NO: 633952 - RNA, 12 nt, Escherichia coli CFT073
agugcugcaacc

SEQ ID NO: 633953 - RNA, 20 nt, Escherichia coli CFT073
agugcugcauccugcaccac

SEQ ID NO: 633954 - RNA, 16 nt, Escherichia coli CFT073
agugcugccaucuucu

SEQ ID NO: 633955 - RNA, 14 nt, Escherichia coli CFT073
agugcgaauacccg

SEQ ID NO: 633956 - RNA, 21 nt, Escherichia coli CFT073
agugccugaugcgacgcuuga

SEQ ID NO: 633957 - RNA, 14 nt, Escherichia coli CFT073
agugccuggcauaa

SEQ ID NO: 633958 - RNA, 15 nt, Escherichia coli CFT073
agugcgaaaaucaau

SEQ ID NO: 633959 - RNA, 20 nt, Escherichia coli CFT073
agugcgaaaaucaauaacac

SEQ ID NO: 633960 - RNA, 16 nt, Escherichia coli CFT073
agugccgcgccgcgcg

SEQ ID NO: 633961 - RNA, 14 nt, Escherichia coli CFT073
agugccgccagcuu

SEQ ID NO: 633962 - RNA, 15 nt, Escherichia coli CFT073
agugccguggcaggc

SEQ ID NO: 633963 - RNA, 14 nt, Escherichia coli CFT073
aguuugcaaaccca

SEQ ID NO: 633964 - RNA, 20 nt, Escherichia coli CFT073
aguuugcccgucugcugcug

SEQ ID NO: 633965 - RNA, 19 nt, Escherichia coli CFT073
aguuugaugagaacaccaa

SEQ ID NO: 633966 - RNA, 14 nt, Escherichia coli CFT073
aguuugaaagaugc

SEQ ID NO: 633967 - RNA, 15 nt, Escherichia coli CFT073
aguuuuaaauuacug

SEQ ID NO: 633968 - RNA, 16 nt, Escherichia coli CFT073
aguuuguugagauaau

SEQ ID NO: 633969 - RNA, 18 nt, Escherichia coli CFT073
aguuugguuaagucacgg

SEQ ID NO: 633970 - RNA, 17 nt, Escherichia coli CFT073
aguuuguuaaccaccag

SEQ ID NO: 633971 - RNA, 18 nt, Escherichia coli CFT073
aguuuguuaaccaccagu

SEQ ID NO: 633972 - RNA, 14 nt, Escherichia coli CFT073
aguuucuuaccuac

SEQ ID NO: 633973 - RNA, 15 nt, Escherichia coli CFT073
aguuucuccagugaa

SEQ ID NO: 633974 - RNA, 20 nt, Escherichia coli CFT073
aguuucugcccaaucaaacu

SEQ ID NO: 633975 - RNA, 16 nt, Escherichia coli CFT073
aguuucgugcccgcgu

SEQ ID NO: 633976 - RNA, 16 nt, Escherichia coli CFT073
aguuucgaucagcaau

SEQ ID NO: 633977 - RNA, 17 nt, Escherichia coli CFT073
aguuucgaucagcaauu

SEQ ID NO: 633978 - RNA, 18 nt, Escherichia coli CFT073
aguuucaccagcaguaaa

SEQ ID NO: 633979 - RNA, 17 nt, Escherichia coli CFT073
aguuucaccagcaguaa

SEQ ID NO: 633980 - RNA, 14 nt, Escherichia coli CFT073
aguuucagaccaau

SEQ ID NO: 633981 - RNA, 19 nt, Escherichia coli CFT073
aguuguaugucauaaaaau

SEQ ID NO: 633982 - RNA, 17 nt, Escherichia coli CFT073
aguugugauugugacaa

SEQ ID NO: 633983 - RNA, 21 nt, Escherichia coli CFT073
aguugugugggucuaaaaaca

SEQ ID NO: 633984 - RNA, 21 nt, Escherichia coli CFT073
aguuguuccggagucaacauc

SEQ ID NO: 633985 - RNA, 18 nt, Escherichia coli CFT073
aguuguuuuuuuaacaua

SEQ ID NO: 633986 - RNA, 17 nt, Escherichia coli CFT073
aguuuacgaaccuucac

SEQ ID NO: 633987 - RNA, 17 nt, Escherichia coli CFT073
aguuuauagcaagguga

SEQ ID NO: 633988 - RNA, 16 nt, Escherichia coli CFT073
aguuuauaucuuucuc

SEQ ID NO: 633989 - RNA, 22 nt, Escherichia coli CFT073
aguuuauaucuuucucagucau

SEQ ID NO: 633990 - RNA, 15 nt, Escherichia coli CFT073
aguuuagcucagaau

SEQ ID NO: 633991 - RNA, 16 nt, Escherichia coli CFT073
aguuuauucuuuacug

SEQ ID NO: 633992 - RNA, 15 nt, Escherichia coli CFT073
aguuucaacaucauu

SEQ ID NO: 633993 - RNA, 17 nt, Escherichia coli CFT073
aguucguccccaccagu

SEQ ID NO: 633994 - RNA, 18 nt, Escherichia coli CFT073
aguucgguacguacaaug

SEQ ID NO: 633995 - RNA, 18 nt, Escherichia coli CFT073
aguucgucgcguuugccc

SEQ ID NO: 633996 - RNA, 13 nt, Escherichia coli CFT073
aguuccaguucau

SEQ ID NO: 633997 - RNA, 13 nt, Escherichia coli CFT073
aguuccagcauga

SEQ ID NO: 633998 - RNA, 18 nt, Escherichia coli CFT073
aguuccauccaccagccc

SEQ ID NO: 633999 - RNA, 14 nt, Escherichia coli CFT073
aguuccacuucugc

SEQ ID NO: 634000 - RNA, 16 nt, Escherichia coli CFT073
aguucugccaggcugg

SEQ ID NO: 634001 - RNA, 18 nt, Escherichia coli CFT073
aguucuuccgcagaguaa

SEQ ID NO: 634002 - RNA, 20 nt, Escherichia coli CFT073
aguucuuccggcagccagga

SEQ ID NO: 634003 - RNA, 16 nt, Escherichia coli CFT073
aguucuuaaggcauau

SEQ ID NO: 634004 - RNA, 19 nt, Escherichia coli CFT073
aguugaucgccagagauac

SEQ ID NO: 634005 - RNA, 22 nt, Escherichia coli CFT073
aguugaugaccagugcagauac

SEQ ID NO: 634006 - RNA, 21 nt, Escherichia coli CFT073
aguugauuuuguaaucaacaa

SEQ ID NO: 634007 - RNA, 23 nt, Escherichia coli CFT073
aguugauuacacaaguccagcac

SEQ ID NO: 634008 - RNA, 16 nt, Escherichia coli CFT073
aguucagacgcugcau

SEQ ID NO: 634009 - RNA, 19 nt, Escherichia coli CFT073
aguucacguccggcagcag

SEQ ID NO: 634010 - RNA, 11 nt, Escherichia coli CFT073
aguuauucauu

SEQ ID NO: 634011 - RNA, 20 nt, Escherichia coli CFT073
aguucaccaccuggcggcgu

SEQ ID NO: 634012 - RNA, 22 nt, Escherichia coli CFT073
aguucaccaccuggcggcgugu

SEQ ID NO: 634013 - RNA, 21 nt, Escherichia coli CFT073
aguuaucacgauacaccagau

SEQ ID NO: 634014 - RNA, 15 nt, Escherichia coli CFT073
aguuaucacucugcc

SEQ ID NO: 634015 - RNA, 16 nt, Escherichia coli CFT073
aguuauuaaugacaau

SEQ ID NO: 634016 - RNA, 17 nt, Escherichia coli CFT073
aguuauguauucguuaa

SEQ ID NO: 634017 - RNA, 14 nt, Escherichia coli CFT073
aguguauucaugcc

SEQ ID NO: 634018 - RNA, 16 nt, Escherichia coli CFT073
aguguauucaugcccu

SEQ ID NO: 634019 - RNA, 20 nt, Escherichia coli CFT073
aguuaauuagcuuaucaauc

SEQ ID NO: 634020 - RNA, 23 nt, Escherichia coli CFT073
aguuacgaaaaggauaaauaaaa

SEQ ID NO: 634021 - RNA, 23 nt, Escherichia coli CFT073
aguuaccgccggcuucaucuuua

SEQ ID NO: 634022 - RNA, 18 nt, Escherichia coli CFT073
aguuacuaaaaguaaaua

SEQ ID NO: 634023 - RNA, 13 nt, Escherichia coli CFT073
aguuacugcaacg

SEQ ID NO: 634024 - RNA, 18 nt, Escherichia coli CFT073
aguuacugccaucuuccg

SEQ ID NO: 634025 - RNA, 15 nt, Escherichia coli CFT073
auacaaauagccaau

SEQ ID NO: 634026 - RNA, 15 nt, Escherichia coli CFT073
auacaaacauaaagc

SEQ ID NO: 634027 - RNA, 18 nt, Escherichia coli CFT073
auacaaacucacugccag

SEQ ID NO: 634028 - RNA, 20 nt, Escherichia coli CFT073
auacaacugccgcgccugaa

SEQ ID NO: 634029 - RNA, 16 nt, Escherichia coli CFT073
auacaagaaauaugaa

SEQ ID NO: 634030 - RNA, 13 nt, Escherichia coli CFT073
auacacaucgucg

SEQ ID NO: 634031 - RNA, 16 nt, Escherichia coli CFT073
auacacagauaaacua

SEQ ID NO: 634032 - RNA, 13 nt, Escherichia coli CFT073
auacacacgcacc

SEQ ID NO: 634033 - RNA, 13 nt, Escherichia coli CFT073
auacaaucuggau

SEQ ID NO: 634034 - RNA, 18 nt, Escherichia coli CFT073
auacagcgccucuuuuga

SEQ ID NO: 634035 - RNA, 15 nt, Escherichia coli CFT073
auacagcaauggaaa

SEQ ID NO: 634036 - RNA, 11 nt, Escherichia coli CFT073
auacaccuuca

SEQ ID NO: 634037 - RNA, 14 nt, Escherichia coli CFT073
auacacgaaaugaa

SEQ ID NO: 634038 - RNA, 13 nt, Escherichia coli CFT073
auacaccaccaca

SEQ ID NO: 634039 - RNA, 17 nt, Escherichia coli CFT073
auacacauuuuuuacuc

SEQ ID NO: 634040 - RNA, 23 nt, Escherichia coli CFT073
auacacauuuuuuacucucguuc

SEQ ID NO: 634041 - RNA, 19 nt, Escherichia coli CFT073
auacacggcaggaucugcg

SEQ ID NO: 634042 - RNA, 14 nt, Escherichia coli CFT073
auaauuucagcauc

SEQ ID NO: 634043 - RNA, 17 nt, Escherichia coli CFT073
auaauugucaacggcac

SEQ ID NO: 634044 - RNA, 19 nt, Escherichia coli CFT073
auaaugguauuaagccagu

SEQ ID NO: 634045 - RNA, 11 nt, Escherichia coli CFT073
auaauggcugu

SEQ ID NO: 634046 - RNA, 17 nt, Escherichia coli CFT073
auaauguaaacaagaca

SEQ ID NO: 634047 - RNA, 12 nt, Escherichia coli CFT073
auaauugaauaa

SEQ ID NO: 634048 - RNA, 15 nt, Escherichia coli CFT073
auaauuugaacuggu

SEQ ID NO: 634049 - RNA, 14 nt, Escherichia coli CFT073
auaauuugugacga

SEQ ID NO: 634050 - RNA, 12 nt, Escherichia coli CFT073
auaauuugugau

SEQ ID NO: 634051 - RNA, 22 nt, Escherichia coli CFT073
auaauuugugauuugucauaug

SEQ ID NO: 634052 - RNA, 16 nt, Escherichia coli CFT073
auacaaaacaugugga

SEQ ID NO: 634053 - RNA, 15 nt, Escherichia coli CFT073
auaauuuugaaauaa

SEQ ID NO: 634054 - RNA, 16 nt, Escherichia coli CFT073
auaauuuugaaauaaa

SEQ ID NO: 634055 - RNA, 19 nt, Escherichia coli CFT073
auaauuuugaaauaaaauc

SEQ ID NO: 634056 - RNA, 20 nt, Escherichia coli CFT073
auaauuuugaaauaaaauca

SEQ ID NO: 634057 - RNA, 20 nt, Escherichia coli CFT073
auaauacaggcuacucccag

SEQ ID NO: 634058 - RNA, 14 nt, Escherichia coli CFT073
auaauacccagcaa

SEQ ID NO: 634059 - RNA, 19 nt, Escherichia coli CFT073
auaauacccagcaacgaaa

SEQ ID NO: 634060 - RNA, 19 nt, Escherichia coli CFT073
auaauaaccucaugguuuu

SEQ ID NO: 634061 - RNA, 12 nt, Escherichia coli CFT073
auaauaaauauu

SEQ ID NO: 634062 - RNA, 19 nt, Escherichia coli CFT073
auaauaaaaaagaaaagaa

SEQ ID NO: 634063 - RNA, 13 nt, Escherichia coli CFT073
auaauaaaaagaa

SEQ ID NO: 634064 - RNA, 22 nt, Escherichia coli CFT073
auaaguuuuuugcgaaaaauaa

SEQ ID NO: 634065 - RNA, 23 nt, Escherichia coli CFT073
auaaguuuuuugcgaaaaauaaa

SEQ ID NO: 634066 - RNA, 20 nt, Escherichia coli CFT073
auaaguggcaauauauuugc

SEQ ID NO: 634067 - RNA, 21 nt, Escherichia coli CFT073
auaagaaaguucgacaacuuu

SEQ ID NO: 634068 - RNA, 22 nt, Escherichia coli CFT073
auaagaacugacuuccacuucc

SEQ ID NO: 634069 - RNA, 21 nt, Escherichia coli CFT073
auaaucucgccuuaucagaaa

SEQ ID NO: 634070 - RNA, 14 nt, Escherichia coli CFT073
auaaucgcaucaau

SEQ ID NO: 634071 - RNA, 17 nt, Escherichia coli CFT073
auaaucgauugcacauu

SEQ ID NO: 634072 - RNA, 18 nt, Escherichia coli CFT073
auaaucgacgaggaaaau

SEQ ID NO: 634073 - RNA, 21 nt, Escherichia coli CFT073
auaaucgacgaggaaaaugau

SEQ ID NO: 634074 - RNA, 21 nt, Escherichia coli CFT073
auaaucgaucacguaauaaaa

SEQ ID NO: 634075 - RNA, 23 nt, Escherichia coli CFT073
auaaucuguugauuuaacagcaa

SEQ ID NO: 634076 - RNA, 16 nt, Escherichia coli CFT073
auaaucuguuucucau

SEQ ID NO: 634077 - RNA, 14 nt, Escherichia coli CFT073
auaaucugacuucc

SEQ ID NO: 634078 - RNA, 15 nt, Escherichia coli CFT073
auaaucuucaaauaa

SEQ ID NO: 634079 - RNA, 17 nt, Escherichia coli CFT073
auaaucuucaaauaaac

SEQ ID NO: 634080 - RNA, 22 nt, Escherichia coli CFT073
auaaucuucuauuuuuucaauu

SEQ ID NO: 634081 - RNA, 19 nt, Escherichia coli CFT073
auaaugacgcugaauaauc

SEQ ID NO: 634082 - RNA, 17 nt, Escherichia coli CFT073
auaaugacggacaguac

SEQ ID NO: 634083 - RNA, 13 nt, Escherichia coli CFT073
auaaugaaccaau

SEQ ID NO: 634084 - RNA, 23 nt, Escherichia coli CFT073
auaaugaacgccaccccacacca

SEQ ID NO: 634085 - RNA, 14 nt, Escherichia coli CFT073
auaaucgaaaacau

SEQ ID NO: 634086 - RNA, 14 nt, Escherichia coli CFT073
auaaucgaaaccuu

SEQ ID NO: 634087 - RNA, 15 nt, Escherichia coli CFT073
auaaucgaaccaaac

SEQ ID NO: 634088 - RNA, 19 nt, Escherichia coli CFT073
auaauccuggcagcaucag

SEQ ID NO: 634089 - RNA, 18 nt, Escherichia coli CFT073
auaauccuguagauauuc

SEQ ID NO: 634090 - RNA, 16 nt, Escherichia coli CFT073
auaaucacgcuguuca

SEQ ID NO: 634091 - RNA, 21 nt, Escherichia coli CFT073
auaaucacgcuguucaucccg

SEQ ID NO: 634092 - RNA, 13 nt, Escherichia coli CFT073
auaaucaucccac

SEQ ID NO: 634093 - RNA, 20 nt, Escherichia coli CFT073
auaauagugcuucaaauauu

SEQ ID NO: 634094 - RNA, 19 nt, Escherichia coli CFT073
auaauagguaaacauccgu

SEQ ID NO: 634095 - RNA, 15 nt, Escherichia coli CFT073
auaauauaaggagcc

SEQ ID NO: 634096 - RNA, 20 nt, Escherichia coli CFT073
auaaucacaauggucaacau

SEQ ID NO: 634097 - RNA, 16 nt, Escherichia coli CFT073
auaacuggcaaaaaca

SEQ ID NO: 634098 - RNA, 12 nt, Escherichia coli CFT073
auaacuggccag

SEQ ID NO: 634099 - RNA, 15 nt, Escherichia coli CFT073
auaacuggucaucaa

SEQ ID NO: 634100 - RNA, 20 nt, Escherichia coli CFT073
auaacugaauaauacacaca

SEQ ID NO: 634101 - RNA, 18 nt, Escherichia coli CFT073
auaacucuucccuuuggu

SEQ ID NO: 634102 - RNA, 14 nt, Escherichia coli CFT073
auaacggcucaaac

SEQ ID NO: 634103 - RNA, 15 nt, Escherichia coli CFT073
auaacguccauuccc

SEQ ID NO: 634104 - RNA, 20 nt, Escherichia coli CFT073
auaacgucggcauauuuaaa

SEQ ID NO: 634105 - RNA, 21 nt, Escherichia coli CFT073
auaacgucggcauauuuaaaa

SEQ ID NO: 634106 - RNA, 13 nt, Escherichia coli CFT073
auaacguaaacca

SEQ ID NO: 634107 - RNA, 19 nt, Escherichia coli CFT073
auaacgugacggcuuuuuu

SEQ ID NO: 634108 - RNA, 18 nt, Escherichia coli CFT073
auaaccuguuuauuaugc

SEQ ID NO: 634109 - RNA, 23 nt, Escherichia coli CFT073
auaaccuugcaggccauaugaca

SEQ ID NO: 634110 - RNA, 23 nt, Escherichia coli CFT073
auaacgcgcagcguucauaaaua

SEQ ID NO: 634111 - RNA, 12 nt, Escherichia coli CFT073
auaaccucaugg

SEQ ID NO: 634112 - RNA, 17 nt, Escherichia coli CFT073
auaacccagcagcccga

SEQ ID NO: 634113 - RNA, 14 nt, Escherichia coli CFT073
auaaccgagaauuu

SEQ ID NO: 634114 - RNA, 19 nt, Escherichia coli CFT073
auaaccgccaccaggaaaa

SEQ ID NO: 634115 - RNA, 15 nt, Escherichia coli CFT073
auaaccgccagcaca

SEQ ID NO: 634116 - RNA, 18 nt, Escherichia coli CFT073
auaaccgccgucaacaau

SEQ ID NO: 634117 - RNA, 14 nt, Escherichia coli CFT073
auaaccgcugccag

SEQ ID NO: 634118 - RNA, 17 nt, Escherichia coli CFT073
auaaccgcugccaggca

SEQ ID NO: 634119 - RNA, 17 nt, Escherichia coli CFT073
auaacccgucagcagau

SEQ ID NO: 634120 - RNA, 21 nt, Escherichia coli CFT073
auaacccguuguaaaugcugc

SEQ ID NO: 634121 - RNA, 17 nt, Escherichia coli CFT073
auaaccccgcaauuuca

SEQ ID NO: 634122 - RNA, 20 nt, Escherichia coli CFT073
auaacccgacaaggaacgcc

SEQ ID NO: 634123 - RNA, 15 nt, Escherichia coli CFT073
auaacccaguacaac

SEQ ID NO: 634124 - RNA, 14 nt, Escherichia coli CFT073
auaaccaccacgac

SEQ ID NO: 634125 - RNA, 21 nt, Escherichia coli CFT073
auaaccacuggcacaagacug

SEQ ID NO: 634126 - RNA, 18 nt, Escherichia coli CFT073
auaaccauaauuugugau

SEQ ID NO: 634127 - RNA, 22 nt, Escherichia coli CFT073
auaaauccuuuguacaggauau

SEQ ID NO: 634128 - RNA, 23 nt, Escherichia coli CFT073
auaaaucgcacguugccagcaac

SEQ ID NO: 634129 - RNA, 14 nt, Escherichia coli CFT073
auaacaaucaccaa

SEQ ID NO: 634130 - RNA, 18 nt, Escherichia coli CFT073
auaaauuuuuucugacca

SEQ ID NO: 634131 - RNA, 14 nt, Escherichia coli CFT073
auaacagccaugcc

SEQ ID NO: 634132 - RNA, 10 nt, Escherichia coli CFT073
auaacagaau

SEQ ID NO: 634133 - RNA, 18 nt, Escherichia coli CFT073
auaacacaccguaauugc

SEQ ID NO: 634134 - RNA, 19 nt, Escherichia coli CFT073
auaaauaauaaguaaacaa

SEQ ID NO: 634135 - RNA, 23 nt, Escherichia coli CFT073
auaaaggucaucacaucccagca

SEQ ID NO: 634136 - RNA, 22 nt, Escherichia coli CFT073
auaaagcgaccaaccaucaucc

SEQ ID NO: 634137 - RNA, 14 nt, Escherichia coli CFT073
auaaagcgauaaau

SEQ ID NO: 634138 - RNA, 15 nt, Escherichia coli CFT073
auaaagcgguuuuca

SEQ ID NO: 634139 - RNA, 23 nt, Escherichia coli CFT073
auaaagcccgcuucaaacgcuga

SEQ ID NO: 634140 - RNA, 12 nt, Escherichia coli CFT073
auaaagcagaau

SEQ ID NO: 634141 - RNA, 14 nt, Escherichia coli CFT073
auaaacgccagguu

SEQ ID NO: 634142 - RNA, 14 nt, Escherichia coli CFT073
auaaacccggauac

SEQ ID NO: 634143 - RNA, 23 nt, Escherichia coli CFT073
auaaacccggauacgcucauuuu

SEQ ID NO: 634144 - RNA, 16 nt, Escherichia coli CFT073
auaaaccgagccaaac

SEQ ID NO: 634145 - RNA, 23 nt, Escherichia coli CFT073
auaaaccgccgacgcgaagcaca

SEQ ID NO: 634146 - RNA, 14 nt, Escherichia coli CFT073
auaaacaacaaaau

SEQ ID NO: 634147 - RNA, 23 nt, Escherichia coli CFT073
auaaacaacggcaagaucagcau

SEQ ID NO: 634148 - RNA, 17 nt, Escherichia coli CFT073
auaaacaaugauuacuc

SEQ ID NO: 634149 - RNA, 23 nt, Escherichia coli CFT073
auaaaccacaccgccuaccgcca

SEQ ID NO: 634150 - RNA, 21 nt, Escherichia coli CFT073
auaaaaugcgaaaaaaacucg

SEQ ID NO: 634151 - RNA, 14 nt, Escherichia coli CFT073
auaaaauuauccaa

SEQ ID NO: 634152 - RNA, 23 nt, Escherichia coli CFT073
aguuuuaguugccguucuucccg

SEQ ID NO: 634153 - RNA, 23 nt, Escherichia coli CFT073
aguuuucaugaauaaccccgucu

SEQ ID NO: 634154 - RNA, 22 nt, Escherichia coli CFT073
auaaaaucuauuauuauuuuug

SEQ ID NO: 634155 - RNA, 14 nt, Escherichia coli CFT073
auaaaauaucuucu

SEQ ID NO: 634156 - RNA, 15 nt, Escherichia coli CFT073
aucaauggauucaug

SEQ ID NO: 634157 - RNA, 16 nt, Escherichia coli CFT073
aucaaugugcuuucac

SEQ ID NO: 634158 - RNA, 19 nt, Escherichia coli CFT073
aucaauuaauccagacugc

SEQ ID NO: 634159 - RNA, 19 nt, Escherichia coli CFT073
aucaauuaccuuuuuacca

SEQ ID NO: 634160 - RNA, 17 nt, Escherichia coli CFT073
aucaauuagaauuauua

SEQ ID NO: 634161 - RNA, 16 nt, Escherichia coli CFT073
aucaccggcaucugcu

SEQ ID NO: 634162 - RNA, 13 nt, Escherichia coli CFT073
aucaccguagaag

SEQ ID NO: 634163 - RNA, 15 nt, Escherichia coli CFT073
aucacgccgcuggca

SEQ ID NO: 634164 - RNA, 21 nt, Escherichia coli CFT073
aucacgccacucacuaccagu

SEQ ID NO: 634165 - RNA, 20 nt, Escherichia coli CFT073
aucacggaucaguuuaucca

SEQ ID NO: 634166 - RNA, 18 nt, Escherichia coli CFT073
aucacgguaccuaccggu

SEQ ID NO: 634167 - RNA, 22 nt, Escherichia coli CFT073
aucacgccugcuucuacgcagg

SEQ ID NO: 634168 - RNA, 22 nt, Escherichia coli CFT073
aucacuucuguuugcgccacgc

SEQ ID NO: 634169 - RNA, 16 nt, Escherichia coli CFT073
aucacuugcugcaccu

SEQ ID NO: 634170 - RNA, 18 nt, Escherichia coli CFT073
aucacuuguucagcgaug

SEQ ID NO: 634171 - RNA, 13 nt, Escherichia coli CFT073
aucacuuucagac

SEQ ID NO: 634172 - RNA, 16 nt, Escherichia coli CFT073
aucagacaccagccag

SEQ ID NO: 634173 - RNA, 13 nt, Escherichia coli CFT073
aucagaccgccaa

SEQ ID NO: 634174 - RNA, 17 nt, Escherichia coli CFT073
aucagaccgccaaucag

SEQ ID NO: 634175 - RNA, 19 nt, Escherichia coli CFT073
aucagaccgccaaucagca

SEQ ID NO: 634176 - RNA, 13 nt, Escherichia coli CFT073
aucagcaaauaau

SEQ ID NO: 634177 - RNA, 13 nt, Escherichia coli CFT073
aucagcaaaaugg

SEQ ID NO: 634178 - RNA, 20 nt, Escherichia coli CFT073
aucagcauacuccagccgac

SEQ ID NO: 634179 - RNA, 15 nt, Escherichia coli CFT073
aucagauucagcagc

SEQ ID NO: 634180 - RNA, 17 nt, Escherichia coli CFT073
aucagauugagaguuac

SEQ ID NO: 634181 - RNA, 23 nt, Escherichia coli CFT073
aucagaucguugaacccggcauc

SEQ ID NO: 634182 - RNA, 18 nt, Escherichia coli CFT073
aucagaucguugaacccg

SEQ ID NO: 634183 - RNA, 19 nt, Escherichia coli CFT073
aucagaguacagauucaau

SEQ ID NO: 634184 - RNA, 21 nt, Escherichia coli CFT073
aucagaguauguauacaaaau

SEQ ID NO: 634185 - RNA, 23 nt, Escherichia coli CFT073
aucagagcuggaaguuacucaaa

SEQ ID NO: 634186 - RNA, 15 nt, Escherichia coli CFT073
aucagauaugcgcug

SEQ ID NO: 634187 - RNA, 22 nt, Escherichia coli CFT073
aucagauaugcgcugucauuca

SEQ ID NO: 634188 - RNA, 23 nt, Escherichia coli CFT073
aucagauaauauuuaucuuccca

SEQ ID NO: 634189 - RNA, 20 nt, Escherichia coli CFT073
aucagauaaucaacccccac

SEQ ID NO: 634190 - RNA, 15 nt, Escherichia coli CFT073
aucagacugcuuuuc

SEQ ID NO: 634191 - RNA, 21 nt, Escherichia coli CFT073
aucagacuugugcgcuuguuc

SEQ ID NO: 634192 - RNA, 23 nt, Escherichia coli CFT073
aucagaccuacggauucaaugca

SEQ ID NO: 634193 - RNA, 16 nt, Escherichia coli CFT073
aucagacgacccacga

SEQ ID NO: 634194 - RNA, 22 nt, Escherichia coli CFT073
aucagcuggcgucguuaccacu

SEQ ID NO: 634195 - RNA, 14 nt, Escherichia coli CFT073
aucagcgcuaccag

SEQ ID NO: 634196 - RNA, 17 nt, Escherichia coli CFT073
aucagcgcuaccagagc

SEQ ID NO: 634197 - RNA, 22 nt, Escherichia coli CFT073
aucagcuucugcacgaugcugc

SEQ ID NO: 634198 - RNA, 22 nt, Escherichia coli CFT073
aucagcuuaccgccaaguuuca

SEQ ID NO: 634199 - RNA, 13 nt, Escherichia coli CFT073
aucagcuuaucca

SEQ ID NO: 634200 - RNA, 15 nt, Escherichia coli CFT073
aucagcuuauccagc

SEQ ID NO: 634201 - RNA, 17 nt, Escherichia coli CFT073
aucagcuuauccagcaa

SEQ ID NO: 634202 - RNA, 18 nt, Escherichia coli CFT073
aucagcuuauccagcaac

SEQ ID NO: 634203 - RNA, 24 nt, Escherichia coli CFT073
aucagcgcggcgauaauacccagc

SEQ ID NO: 634204 - RNA, 22 nt, Escherichia coli CFT073
aucagccauuuugcacauucca

SEQ ID NO: 634205 - RNA, 13 nt, Escherichia coli CFT073
aucagcccagccc

SEQ ID NO: 634206 - RNA, 16 nt, Escherichia coli CFT073
aucagcccagcccuga

SEQ ID NO: 634207 - RNA, 18 nt, Escherichia coli CFT073
aucagcaucccaccugaa

SEQ ID NO: 634208 - RNA, 11 nt, Escherichia coli CFT073
aucagcaugac

SEQ ID NO: 634209 - RNA, 19 nt, Escherichia coli CFT073
aucagcaugacaaaaaagc

SEQ ID NO: 634210 - RNA, 17 nt, Escherichia coli CFT073
aucagccacuucaacca

SEQ ID NO: 634211 - RNA, 14 nt, Escherichia coli CFT073
aucagccacuuccu

SEQ ID NO: 634212 - RNA, 19 nt, Escherichia coli CFT073
aucagccacuuccugcucg

SEQ ID NO: 634213 - RNA, 18 nt, Escherichia coli CFT073
aucauccgcacaaucccu

SEQ ID NO: 634214 - RNA, 15 nt, Escherichia coli CFT073
aucauccucuucacc

SEQ ID NO: 634215 - RNA, 11 nt, Escherichia coli CFT073
aucauccugau

SEQ ID NO: 634216 - RNA, 19 nt, Escherichia coli CFT073
aucauccuguucauuuuua

SEQ ID NO: 634217 - RNA, 22 nt, Escherichia coli CFT073
aucaucgccccgcucacgcagc

SEQ ID NO: 634218 - RNA, 23 nt, Escherichia coli CFT073
aucaucgcgaucccccagaaaau

SEQ ID NO: 634219 - RNA, 16 nt, Escherichia coli CFT073
aucaucgacuccagcg

SEQ ID NO: 634220 - RNA, 18 nt, Escherichia coli CFT073
aucaucaucggucaguuu

SEQ ID NO: 634221 - RNA, 24 nt, Escherichia coli CFT073
aucaucauuguugguuaaauaaua

SEQ ID NO: 634222 - RNA, 16 nt, Escherichia coli CFT073
aucaucaugcuuaaau

SEQ ID NO: 634223 - RNA, 12 nt, Escherichia coli CFT073
aucauccagcac

SEQ ID NO: 634224 - RNA, 13 nt, Escherichia coli CFT073
aucauccagcacg

SEQ ID NO: 634225 - RNA, 17 nt, Escherichia coli CFT073
aucauccccguaucuuc

SEQ ID NO: 634226 - RNA, 22 nt, Escherichia coli CFT073
aucauccccguaucuucaugcu

SEQ ID NO: 634227 - RNA, 18 nt, Escherichia coli CFT073
aucauaugcacaaucagc

SEQ ID NO: 634228 - RNA, 15 nt, Escherichia coli CFT073
aucaucaaagaacag

SEQ ID NO: 634229 - RNA, 14 nt, Escherichia coli CFT073
aucaucaaagccaa

SEQ ID NO: 634230 - RNA, 22 nt, Escherichia coli CFT073
aucaucaagguaauuguucgcu

SEQ ID NO: 634231 - RNA, 12 nt, Escherichia coli CFT073
aucaucacuccc

SEQ ID NO: 634232 - RNA, 16 nt, Escherichia coli CFT073
aucaucacuuuuuccg

SEQ ID NO: 634233 - RNA, 14 nt, Escherichia coli CFT073
aucaucaagcacuu

SEQ ID NO: 634234 - RNA, 14 nt, Escherichia coli CFT073
aucaucacccugcg

SEQ ID NO: 634235 - RNA, 22 nt, Escherichia coli CFT073
aucaucacgacauaauuuuucu

SEQ ID NO: 634236 - RNA, 20 nt, Escherichia coli CFT073
aucaucauaucgucauuauc

SEQ ID NO: 634237 - RNA, 20 nt, Escherichia coli CFT073
aucaucaucggcaccgccag

SEQ ID NO: 634238 - RNA, 14 nt, Escherichia coli CFT073
aucaucaggcauga

SEQ ID NO: 634239 - RNA, 17 nt, Escherichia coli CFT073
aaaacgccgccagcuca

SEQ ID NO: 634240 - RNA, 16 nt, Escherichia coli CFT073
aaaacgccgcugguga

SEQ ID NO: 634241 - RNA, 13 nt, Escherichia coli CFT073
aaaacgcuccaac

SEQ ID NO: 634242 - RNA, 13 nt, Escherichia coli CFT073
aaaacgccuuuca

SEQ ID NO: 634243 - RNA, 19 nt, Escherichia coli CFT073
aaaacgcgagccuuuacga

SEQ ID NO: 634244 - RNA, 16 nt, Escherichia coli CFT073
aaaacgcauaccccau

SEQ ID NO: 634245 - RNA, 18 nt, Escherichia coli CFT073
aaaacgcauaccccauca

SEQ ID NO: 634246 - RNA, 23 nt, Escherichia coli CFT073
aaaacgcacgcugucgccaguga

SEQ ID NO: 634247 - RNA, 18 nt, Escherichia coli CFT073
aucaggccaaacagacca

SEQ ID NO: 634248 - RNA, 12 nt, Escherichia coli CFT073
aucaggcauuag

SEQ ID NO: 634249 - RNA, 12 nt, Escherichia coli CFT073
aucaggcauuau

SEQ ID NO: 634250 - RNA, 14 nt, Escherichia coli CFT073
aucaggcccacuac

SEQ ID NO: 634251 - RNA, 17 nt, Escherichia coli CFT073
aucaggccuacaauccc

SEQ ID NO: 634252 - RNA, 22 nt, Escherichia coli CFT073
aucaggcgaauaaauuccgcuc

SEQ ID NO: 634253 - RNA, 17 nt, Escherichia coli CFT073
aucauaaccaacaaaac

SEQ ID NO: 634254 - RNA, 15 nt, Escherichia coli CFT073
aucauaagcgccagg

SEQ ID NO: 634255 - RNA, 21 nt, Escherichia coli CFT073
aucauagcgaauaaucccggc

SEQ ID NO: 634256 - RNA, 15 nt, Escherichia coli CFT073
aucaguuacucugca

SEQ ID NO: 634257 - RNA, 20 nt, Escherichia coli CFT073
aucaguuucgaucagcaauu

SEQ ID NO: 634258 - RNA, 23 nt, Escherichia coli CFT073
aucaguuuguuauauucacuugc

SEQ ID NO: 634259 - RNA, 20 nt, Escherichia coli CFT073
aucauaaaaaucaaaugcug

SEQ ID NO: 634260 - RNA, 17 nt, Escherichia coli CFT073
aucaaguuccguuucca

SEQ ID NO: 634261 - RNA, 14 nt, Escherichia coli CFT073
aucaagucagaugc

SEQ ID NO: 634262 - RNA, 20 nt, Escherichia coli CFT073
aucaauaccauuaucauuga

SEQ ID NO: 634263 - RNA, 16 nt, Escherichia coli CFT073
aucaauaccauuauca

SEQ ID NO: 634264 - RNA, 22 nt, Escherichia coli CFT073
aucaauacccgguccuucaucu

SEQ ID NO: 634265 - RNA, 23 nt, Escherichia coli CFT073
aucaauacccgguccuucaucuu

SEQ ID NO: 634266 - RNA, 20 nt, Escherichia coli CFT073
aucaauacuuuccagcauau

SEQ ID NO: 634267 - RNA, 14 nt, Escherichia coli CFT073
aucaaguauaugau

SEQ ID NO: 634268 - RNA, 12 nt, Escherichia coli CFT073
aucaagguaauu

SEQ ID NO: 634269 - RNA, 15 nt, Escherichia coli CFT073
aucaagcaccgccau

SEQ ID NO: 634270 - RNA, 15 nt, Escherichia coli CFT073
aucaagcaugaucga

SEQ ID NO: 634271 - RNA, 20 nt, Escherichia coli CFT073
aucaagcauuuucucacugg

SEQ ID NO: 634272 - RNA, 15 nt, Escherichia coli CFT073
aucaagcgaaaucaa

SEQ ID NO: 634273 - RNA, 18 nt, Escherichia coli CFT073
aucaagcgccgaguaaaa

SEQ ID NO: 634274 - RNA, 20 nt, Escherichia coli CFT073
aucaagcgccgaguaaaaaa

SEQ ID NO: 634275 - RNA, 13 nt, Escherichia coli CFT073
aucaagcugagua

SEQ ID NO: 634276 - RNA, 17 nt, Escherichia coli CFT073
aucaauauugucuucau

SEQ ID NO: 634277 - RNA, 14 nt, Escherichia coli CFT073
aucaaucaccgcuu

SEQ ID NO: 634278 - RNA, 13 nt, Escherichia coli CFT073
aucaauccaaaca

SEQ ID NO: 634279 - RNA, 18 nt, Escherichia coli CFT073
aucaauccggcaaucaac

SEQ ID NO: 634280 - RNA, 14 nt, Escherichia coli CFT073
aucaauccugcagc

SEQ ID NO: 634281 - RNA, 17 nt, Escherichia coli CFT073
aucaauccugcagcagg

SEQ ID NO: 634282 - RNA, 14 nt, Escherichia coli CFT073
aucaauauccacug

SEQ ID NO: 634283 - RNA, 17 nt, Escherichia coli CFT073
aucaaucucagcgauau

SEQ ID NO: 634284 - RNA, 20 nt, Escherichia coli CFT073
aucaaucgcggugauuuuac

SEQ ID NO: 634285 - RNA, 18 nt, Escherichia coli CFT073
aucaaucgcucccagccc

SEQ ID NO: 634286 - RNA, 15 nt, Escherichia coli CFT073
aucaaugccagcaua

SEQ ID NO: 634287 - RNA, 18 nt, Escherichia coli CFT073
aucaaucuuuacacacaa

SEQ ID NO: 634288 - RNA, 13 nt, Escherichia coli CFT073
aucaaugauaauc

SEQ ID NO: 634289 - RNA, 15 nt, Escherichia coli CFT073
aucaaucuuuuucau

SEQ ID NO: 634290 - RNA, 19 nt, Escherichia coli CFT073
aucaaacuuuuaaauugaa

SEQ ID NO: 634291 - RNA, 19 nt, Escherichia coli CFT073
aucaacaaacgcugacaua

SEQ ID NO: 634292 - RNA, 20 nt, Escherichia coli CFT073
aucaaacgugacauucugac

SEQ ID NO: 634293 - RNA, 16 nt, Escherichia coli CFT073
aucaaacuguucggua

SEQ ID NO: 634294 - RNA, 18 nt, Escherichia coli CFT073
aucaaacgccagaucacc

SEQ ID NO: 634295 - RNA, 18 nt, Escherichia coli CFT073
aucaacaauaaacugcga

SEQ ID NO: 634296 - RNA, 20 nt, Escherichia coli CFT073
aucaacacuucuuugaugcc

SEQ ID NO: 634297 - RNA, 19 nt, Escherichia coli CFT073
aucaacagauaaauggcac

SEQ ID NO: 634298 - RNA, 15 nt, Escherichia coli CFT073
aucaacaggaacaug

SEQ ID NO: 634299 - RNA, 21 nt, Escherichia coli CFT073
aucaaacaacggcacuucaau

SEQ ID NO: 634300 - RNA, 15 nt, Escherichia coli CFT073
aucaaacacaggcag

SEQ ID NO: 634301 - RNA, 14 nt, Escherichia coli CFT073
aucaaacccauuuu

SEQ ID NO: 634302 - RNA, 18 nt, Escherichia coli CFT073
aucaaacagaaaaacgaa

SEQ ID NO: 634303 - RNA, 14 nt, Escherichia coli CFT073
aucaaacagaauau

SEQ ID NO: 634304 - RNA, 22 nt, Escherichia coli CFT073
aucaaacagaauauugugcuca

SEQ ID NO: 634305 - RNA, 12 nt, Escherichia coli CFT073
aucaaaauggua

SEQ ID NO: 634306 - RNA, 15 nt, Escherichia coli CFT073
aucaaaaugguaauu

SEQ ID NO: 634307 - RNA, 17 nt, Escherichia coli CFT073
aucaaccgugagguaug

SEQ ID NO: 634308 - RNA, 19 nt, Escherichia coli CFT073
aucaaccgcgacauacuua

SEQ ID NO: 634309 - RNA, 22 nt, Escherichia coli CFT073
aucaaccgcgacauacuuaaau

SEQ ID NO: 634310 - RNA, 18 nt, Escherichia coli CFT073
aucaacgaugucaaucag

SEQ ID NO: 634311 - RNA, 20 nt, Escherichia coli CFT073
aucaacgccaccaucacuau

SEQ ID NO: 634312 - RNA, 15 nt, Escherichia coli CFT073
aucaagaaagcuuug

SEQ ID NO: 634313 - RNA, 18 nt, Escherichia coli CFT073
aucaagaaaugcauguuc

SEQ ID NO: 634314 - RNA, 12 nt, Escherichia coli CFT073
aucaagaaaaau

SEQ ID NO: 634315 - RNA, 13 nt, Escherichia coli CFT073
aucaagacaugau

SEQ ID NO: 634316 - RNA, 20 nt, Escherichia coli CFT073
aucaagacaugauguuuuaa

SEQ ID NO: 634317 - RNA, 11 nt, Escherichia coli CFT073
auauuccccag

SEQ ID NO: 634318 - RNA, 22 nt, Escherichia coli CFT073
auauucccuacgccuaccacca

SEQ ID NO: 634319 - RNA, 18 nt, Escherichia coli CFT073
auauuccgcaccugccag

SEQ ID NO: 634320 - RNA, 17 nt, Escherichia coli CFT073
auauugcuauagcucau

SEQ ID NO: 634321 - RNA, 20 nt, Escherichia coli CFT073
auauuggagagcgauaauuu

SEQ ID NO: 634322 - RNA, 23 nt, Escherichia coli CFT073
auauugcccuucacuucaccuuu

SEQ ID NO: 634323 - RNA, 16 nt, Escherichia coli CFT073
auauugcguaccugca

SEQ ID NO: 634324 - RNA, 17 nt, Escherichia coli CFT073
auauugcguaccugcau

SEQ ID NO: 634325 - RNA, 16 nt, Escherichia coli CFT073
auaugaugaaggacaa

SEQ ID NO: 634326 - RNA, 11 nt, Escherichia coli CFT073
auauucauuuu

SEQ ID NO: 634327 - RNA, 16 nt, Escherichia coli CFT073
auauucaugaauaaaa

SEQ ID NO: 634328 - RNA, 18 nt, Escherichia coli CFT073
auauucaugaauaaaaaa

SEQ ID NO: 634329 - RNA, 21 nt, Escherichia coli CFT073
auauucauuaauaaccauuaa

SEQ ID NO: 634330 - RNA, 23 nt, Escherichia coli CFT073
auauucacgcuuacucuucguuc

SEQ ID NO: 634331 - RNA, 20 nt, Escherichia coli CFT073
auauucacuugccugcugug

SEQ ID NO: 634332 - RNA, 13 nt, Escherichia coli CFT073
auauucagcagca

SEQ ID NO: 634333 - RNA, 14 nt, Escherichia coli CFT073
auauucagcagcag

SEQ ID NO: 634334 - RNA, 15 nt, Escherichia coli CFT073
auauucauagcacau

SEQ ID NO: 634335 - RNA, 15 nt, Escherichia coli CFT073
auauucaucaaaaug

SEQ ID NO: 634336 - RNA, 14 nt, Escherichia coli CFT073
aucaaaaccuaacu

SEQ ID NO: 634337 - RNA, 22 nt, Escherichia coli CFT073
auauuuugugauuuauuuucca

SEQ ID NO: 634338 - RNA, 13 nt, Escherichia coli CFT073
auauuuuccagca

SEQ ID NO: 634339 - RNA, 22 nt, Escherichia coli CFT073
auauuugcugguggcauuuuua

SEQ ID NO: 634340 - RNA, 23 nt, Escherichia coli CFT073
auauuugcugguggcauuuuuau

SEQ ID NO: 634341 - RNA, 18 nt, Escherichia coli CFT073
auauuuguuuuuguuaau

SEQ ID NO: 634342 - RNA, 22 nt, Escherichia coli CFT073
auauuuguuuuuguuaauugcu

SEQ ID NO: 634343 - RNA, 18 nt, Escherichia coli CFT073
auauugguguugugaagu

SEQ ID NO: 634344 - RNA, 18 nt, Escherichia coli CFT073
auauuuaagccugcauca

SEQ ID NO: 634345 - RNA, 23 nt, Escherichia coli CFT073
auauuuaagccugcaucacgagc

SEQ ID NO: 634346 - RNA, 14 nt, Escherichia coli CFT073
auauuuauuuccuu

SEQ ID NO: 634347 - RNA, 16 nt, Escherichia coli CFT073
auaucugguuaaaaaa

SEQ ID NO: 634348 - RNA, 17 nt, Escherichia coli CFT073
auaucugguuaaaaaaa

SEQ ID NO: 634349 - RNA, 23 nt, Escherichia coli CFT073
auaucuuucccuuucgauaagac

SEQ ID NO: 634350 - RNA, 20 nt, Escherichia coli CFT073
auaucuuuccuuaacaaaaa

SEQ ID NO: 634351 - RNA, 17 nt, Escherichia coli CFT073
auaucuuucucagucau

SEQ ID NO: 634352 - RNA, 22 nt, Escherichia coli CFT073
auaugaacaaagcaaauaaugu

SEQ ID NO: 634353 - RNA, 13 nt, Escherichia coli CFT073
auaucuucuccug

SEQ ID NO: 634354 - RNA, 11 nt, Escherichia coli CFT073
auaucuucccg

SEQ ID NO: 634355 - RNA, 17 nt, Escherichia coli CFT073
auaugaauauugcugaa

SEQ ID NO: 634356 - RNA, 23 nt, Escherichia coli CFT073
auaugaauccaggccagauacug

SEQ ID NO: 634357 - RNA, 16 nt, Escherichia coli CFT073
auaugaaugccagcca

SEQ ID NO: 634358 - RNA, 21 nt, Escherichia coli CFT073
auaugaccauugguaauggga

SEQ ID NO: 634359 - RNA, 18 nt, Escherichia coli CFT073
auaugaccguuuucccca

SEQ ID NO: 634360 - RNA, 19 nt, Escherichia coli CFT073
auaucccggagaauagcgc

SEQ ID NO: 634361 - RNA, 22 nt, Escherichia coli CFT073
auaucccggagaauagcgccau

SEQ ID NO: 634362 - RNA, 13 nt, Escherichia coli CFT073
auaucccauuuac

SEQ ID NO: 634363 - RNA, 14 nt, Escherichia coli CFT073
auaucccauuuacu

SEQ ID NO: 634364 - RNA, 17 nt, Escherichia coli CFT073
auaucccauuucuccac

SEQ ID NO: 634365 - RNA, 19 nt, Escherichia coli CFT073
auaucggcucauaaaaacu

SEQ ID NO: 634366 - RNA, 21 nt, Escherichia coli CFT073
auaucgcuggcugcaguggua

SEQ ID NO: 634367 - RNA, 20 nt, Escherichia coli CFT073
auaucgcugucgccacccca

SEQ ID NO: 634368 - RNA, 17 nt, Escherichia coli CFT073
auaucgcggauaugcag

SEQ ID NO: 634369 - RNA, 16 nt, Escherichia coli CFT073
auaucgcguaaugcuu

SEQ ID NO: 634370 - RNA, 22 nt, Escherichia coli CFT073
auaucgcauaccauccaggaga

SEQ ID NO: 634371 - RNA, 16 nt, Escherichia coli CFT073
auaucgcaucuuuuuu

SEQ ID NO: 634372 - RNA, 17 nt, Escherichia coli CFT073
auauauuucaucaacug

SEQ ID NO: 634373 - RNA, 19 nt, Escherichia coli CFT073
auaucaaaaacaaauuuug

SEQ ID NO: 634374 - RNA, 16 nt, Escherichia coli CFT073
auaucaggcaaacaga

SEQ ID NO: 634375 - RNA, 12 nt, Escherichia coli CFT073
auauccaggcua

SEQ ID NO: 634376 - RNA, 14 nt, Escherichia coli CFT073
auauccauaaaggu

SEQ ID NO: 634377 - RNA, 17 nt, Escherichia coli CFT073
auauccauguaccagac

SEQ ID NO: 634378 - RNA, 14 nt, Escherichia coli CFT073
auaucaucaaggcu

SEQ ID NO: 634379 - RNA, 22 nt, Escherichia coli CFT073
auauaccauaucugguuaaaaa

SEQ ID NO: 634380 - RNA, 14 nt, Escherichia coli CFT073
auauaauaagaaua

SEQ ID NO: 634381 - RNA, 17 nt, Escherichia coli CFT073
auauaagcauguucuuu

SEQ ID NO: 634382 - RNA, 14 nt, Escherichia coli CFT073
auauauauuauauc

SEQ ID NO: 634383 - RNA, 18 nt, Escherichia coli CFT073
auauaucaccuuccagaa

SEQ ID NO: 634384 - RNA, 15 nt, Escherichia coli CFT073
auauaucagccugaa

SEQ ID NO: 634385 - RNA, 22 nt, Escherichia coli CFT073
auauaucagcgccacaucagca

SEQ ID NO: 634386 - RNA, 19 nt, Escherichia coli CFT073
auauauccguggcuuuuua

SEQ ID NO: 634387 - RNA, 22 nt, Escherichia coli CFT073
auauacgaucuucgccugaaac

SEQ ID NO: 634388 - RNA, 22 nt, Escherichia coli CFT073
auauacuucuggguuccuucca

SEQ ID NO: 634389 - RNA, 21 nt, Escherichia coli CFT073
auaguuugggcguuacagcug

SEQ ID NO: 634390 - RNA, 20 nt, Escherichia coli CFT073
auaguuuccaguugaacaau

SEQ ID NO: 634391 - RNA, 18 nt, Escherichia coli CFT073
auaguucuucaacaccaa

SEQ ID NO: 634392 - RNA, 19 nt, Escherichia coli CFT073
auauaaaaaauacgcauca

SEQ ID NO: 634393 - RNA, 22 nt, Escherichia coli CFT073
auauaaacucgccaaaccauug

SEQ ID NO: 634394 - RNA, 21 nt, Escherichia coli CFT073
auauaaaccguccccaaaaaa

SEQ ID NO: 634395 - RNA, 14 nt, Escherichia coli CFT073
auauaaaccuucug

SEQ ID NO: 634396 - RNA, 17 nt, Escherichia coli CFT073
auagugcuucaaauauu

SEQ ID NO: 634397 - RNA, 19 nt, Escherichia coli CFT073
auagugcuucaaauauuga

SEQ ID NO: 634398 - RNA, 20 nt, Escherichia coli CFT073
auagcucaguugguagagca

SEQ ID NO: 634399 - RNA, 15 nt, Escherichia coli CFT073
auagccagacguugu

SEQ ID NO: 634400 - RNA, 15 nt, Escherichia coli CFT073
auagccagcaacauu

SEQ ID NO: 634401 - RNA, 14 nt, Escherichia coli CFT073
auagccugauguag

SEQ ID NO: 634402 - RNA, 15 nt, Escherichia coli CFT073
auagccuauaccuaa

SEQ ID NO: 634403 - RNA, 21 nt, Escherichia coli CFT073
auagcggguuuguuauucaca

SEQ ID NO: 634404 - RNA, 16 nt, Escherichia coli CFT073
auagcgaccaguuugc

SEQ ID NO: 634405 - RNA, 19 nt, Escherichia coli CFT073
auagcgaccaguuugccuu

SEQ ID NO: 634406 - RNA, 19 nt, Escherichia coli CFT073
auagccuuuauuaaugaca

SEQ ID NO: 634407 - RNA, 17 nt, Escherichia coli CFT073
auagcacccgccagcgc

SEQ ID NO: 634408 - RNA, 18 nt, Escherichia coli CFT073
auagcaagcgcugugaaa

SEQ ID NO: 634409 - RNA, 19 nt, Escherichia coli CFT073
auagcauccaguuccacac

SEQ ID NO: 634410 - RNA, 20 nt, Escherichia coli CFT073
auagcauccaguuccacacc

SEQ ID NO: 634411 - RNA, 21 nt, Escherichia coli CFT073
auagaguauccugacgcuguu

SEQ ID NO: 634412 - RNA, 16 nt, Escherichia coli CFT073
auagauaauuuugaaa

SEQ ID NO: 634413 - RNA, 22 nt, Escherichia coli CFT073
auagauaauuuugaaauaaaau

SEQ ID NO: 634414 - RNA, 12 nt, Escherichia coli CFT073
auagauuaaaau

SEQ ID NO: 634415 - RNA, 12 nt, Escherichia coli CFT073
auacuuucucau

SEQ ID NO: 634416 - RNA, 21 nt, Escherichia coli CFT073
auagacuuuacuaauagcaaa

SEQ ID NO: 634417 - RNA, 22 nt, Escherichia coli CFT073
auagacuuuacuaauagcaaaa

SEQ ID NO: 634418 - RNA, 23 nt, Escherichia coli CFT073
auagacuuuacuaauagcaaaau

SEQ ID NO: 634419 - RNA, 19 nt, Escherichia coli CFT073
auacgauccgacaucccgc

SEQ ID NO: 634420 - RNA, 17 nt, Escherichia coli CFT073
auacgaucaucuggcga

SEQ ID NO: 634421 - RNA, 19 nt, Escherichia coli CFT073
auacgcaaugugcagcagu

SEQ ID NO: 634422 - RNA, 15 nt, Escherichia coli CFT073
auaccuugcugcucc

SEQ ID NO: 634423 - RNA, 19 nt, Escherichia coli CFT073
auacgacuuugcgcaggca

SEQ ID NO: 634424 - RNA, 16 nt, Escherichia coli CFT073
auacaggaacagccac

SEQ ID NO: 634425 - RNA, 17 nt, Escherichia coli CFT073
auacaggaacagccacu

SEQ ID NO: 634426 - RNA, 23 nt, Escherichia coli CFT073
auacaggaacagccacuggugag

SEQ ID NO: 634427 - RNA, 17 nt, Escherichia coli CFT073
auacagcgaauagugga

SEQ ID NO: 634428 - RNA, 23 nt, Escherichia coli CFT073
auacaggccaccgcccaccauaa

SEQ ID NO: 634429 - RNA, 17 nt, Escherichia coli CFT073
auaccgcacgcucaaag

SEQ ID NO: 634430 - RNA, 21 nt, Escherichia coli CFT073
auaccgccgaggaacauaaag

SEQ ID NO: 634431 - RNA, 12 nt, Escherichia coli CFT073
auaccugcacca

SEQ ID NO: 634432 - RNA, 22 nt, Escherichia coli CFT073
auaccuguuaauucucccugcg

SEQ ID NO: 634433 - RNA, 17 nt, Escherichia coli CFT073
auaccggacuccagaca

SEQ ID NO: 634434 - RNA, 21 nt, Escherichia coli CFT073
auaccggcgucccaucggcaa

SEQ ID NO: 634435 - RNA, 17 nt, Escherichia coli CFT073
auaccggcguuucuggc

SEQ ID NO: 634436 - RNA, 13 nt, Escherichia coli CFT073
auacucaguccgg

SEQ ID NO: 634437 - RNA, 16 nt, Escherichia coli CFT073
auacucaacucacaca

SEQ ID NO: 634438 - RNA, 19 nt, Escherichia coli CFT073
auacucguugacgaccagu

SEQ ID NO: 634439 - RNA, 15 nt, Escherichia coli CFT073
auacucuaaauaauu

SEQ ID NO: 634440 - RNA, 18 nt, Escherichia coli CFT073
auacucuaaauaauucga

SEQ ID NO: 634441 - RNA, 14 nt, Escherichia coli CFT073
auacucuccuccag

SEQ ID NO: 634442 - RNA, 19 nt, Escherichia coli CFT073
auacucuccuccagguuaa

SEQ ID NO: 634443 - RNA, 17 nt, Escherichia coli CFT073
auacugcaaauauuguc

SEQ ID NO: 634444 - RNA, 21 nt, Escherichia coli CFT073
auacgcgucccggaauccuuc

SEQ ID NO: 634445 - RNA, 18 nt, Escherichia coli CFT073
auacgcuaaauaaacaau

SEQ ID NO: 634446 - RNA, 19 nt, Escherichia coli CFT073
auacgcuccgcccauuucu

SEQ ID NO: 634447 - RNA, 15 nt, Escherichia coli CFT073
auacgcucgaacagc

SEQ ID NO: 634448 - RNA, 13 nt, Escherichia coli CFT073
auacgcuucaacc

SEQ ID NO: 634449 - RNA, 17 nt, Escherichia coli CFT073
auacgcuguggcgcugg

SEQ ID NO: 634450 - RNA, 14 nt, Escherichia coli CFT073
auacugcaucagcg

SEQ ID NO: 634451 - RNA, 18 nt, Escherichia coli CFT073
auacugcauguauggcgc

SEQ ID NO: 634452 - RNA, 22 nt, Escherichia coli CFT073
auacugccgaccagagccaauc

SEQ ID NO: 634453 - RNA, 17 nt, Escherichia coli CFT073
auacugccuauugcucu

SEQ ID NO: 634454 - RNA, 14 nt, Escherichia coli CFT073
auacugccuuuccc

SEQ ID NO: 634455 - RNA, 17 nt, Escherichia coli CFT073
auacuuaaugccaguuc

SEQ ID NO: 634456 - RNA, 17 nt, Escherichia coli CFT073
auacuucaacauaagca

SEQ ID NO: 634457 - RNA, 21 nt, Escherichia coli CFT073
auacuucacaugauaauaaaa

SEQ ID NO: 634458 - RNA, 20 nt, Escherichia coli CFT073
auacuugcgaaucauuaccu

SEQ ID NO: 634459 - RNA, 19 nt, Escherichia coli CFT073
aucgauaacugcucuccca

SEQ ID NO: 634460 - RNA, 14 nt, Escherichia coli CFT073
aucgauaucaccaa

SEQ ID NO: 634461 - RNA, 15 nt, Escherichia coli CFT073
aucgauaucaccaau

SEQ ID NO: 634462 - RNA, 12 nt, Escherichia coli CFT073
aucgccagcagc

SEQ ID NO: 634463 - RNA, 17 nt, Escherichia coli CFT073
aucgccagcaucggcaa

SEQ ID NO: 634464 - RNA, 14 nt, Escherichia coli CFT073
aucgccagcucaag

SEQ ID NO: 634465 - RNA, 14 nt, Escherichia coli CFT073
aucgccagaaagug

SEQ ID NO: 634466 - RNA, 11 nt, Escherichia coli CFT073
aucgccagaga

SEQ ID NO: 634467 - RNA, 23 nt, Escherichia coli CFT073
aucgccagcaaaaucaccaucac

SEQ ID NO: 634468 - RNA, 18 nt, Escherichia coli CFT073
aucgccaccacguucagg

SEQ ID NO: 634469 - RNA, 21 nt, Escherichia coli CFT073
aucgccacgccaagaaacugg

SEQ ID NO: 634470 - RNA, 16 nt, Escherichia coli CFT073
aucgacucugaaugcc

SEQ ID NO: 634471 - RNA, 17 nt, Escherichia coli CFT073
aucgacuucgaagguuc

SEQ ID NO: 634472 - RNA, 18 nt, Escherichia coli CFT073
aucgaggccauauuucac

SEQ ID NO: 634473 - RNA, 21 nt, Escherichia coli CFT073
aucgacgccaguuugaccaua

SEQ ID NO: 634474 - RNA, 23 nt, Escherichia coli CFT073
aucgaccaugcugaugcuaccca

SEQ ID NO: 634475 - RNA, 22 nt, Escherichia coli CFT073
aucgaccaggccaucagcagcg

SEQ ID NO: 634476 - RNA, 21 nt, Escherichia coli CFT073
aucgacagguugaagaucaug

SEQ ID NO: 634477 - RNA, 19 nt, Escherichia coli CFT073
aucgacauaauugaccaga

SEQ ID NO: 634478 - RNA, 20 nt, Escherichia coli CFT073
aucgaagcggucgagaaagg

SEQ ID NO: 634479 - RNA, 16 nt, Escherichia coli CFT073
aucgacaccaguucag

SEQ ID NO: 634480 - RNA, 17 nt, Escherichia coli CFT073
aucgaacagaccaaacu

SEQ ID NO: 634481 - RNA, 15 nt, Escherichia coli CFT073
aucgaacguuuucac

SEQ ID NO: 634482 - RNA, 23 nt, Escherichia coli CFT073
aucgaagauuacgccgaugucau

SEQ ID NO: 634483 - RNA, 11 nt, Escherichia coli CFT073
aucgaaaucaa

SEQ ID NO: 634484 - RNA, 12 nt, Escherichia coli CFT073
auccuguaucuu

SEQ ID NO: 634485 - RNA, 24 nt, Escherichia coli CFT073
auccuguaugacaaaagaauggcu

SEQ ID NO: 634486 - RNA, 13 nt, Escherichia coli CFT073
auccugucaguuc

SEQ ID NO: 634487 - RNA, 16 nt, Escherichia coli CFT073
auccugguuauuucac

SEQ ID NO: 634488 - RNA, 17 nt, Escherichia coli CFT073
auccugguuauuucacu

SEQ ID NO: 634489 - RNA, 14 nt, Escherichia coli CFT073
auccuggucaaagu

SEQ ID NO: 634490 - RNA, 20 nt, Escherichia coli CFT073
auccuggucaggaauggaaa

SEQ ID NO: 634491 - RNA, 11 nt, Escherichia coli CFT073
auccuuccgcc

SEQ ID NO: 634492 - RNA, 15 nt, Escherichia coli CFT073
auccuuccgccaguc

SEQ ID NO: 634493 - RNA, 19 nt, Escherichia coli CFT073
auccuucccccaccaccau

SEQ ID NO: 634494 - RNA, 20 nt, Escherichia coli CFT073
auccgcucgucaaaaacaaa

SEQ ID NO: 634495 - RNA, 15 nt, Escherichia coli CFT073
auccgcucugcccug

SEQ ID NO: 634496 - RNA, 17 nt, Escherichia coli CFT073
auccgcucugcccugcc

SEQ ID NO: 634497 - RNA, 17 nt, Escherichia coli CFT073
auccgcugaugcagcgu

SEQ ID NO: 634498 - RNA, 22 nt, Escherichia coli CFT073
auccgccuuuuuaauuugccag

SEQ ID NO: 634499 - RNA, 21 nt, Escherichia coli CFT073
auccugcuuuuuuccagccau

SEQ ID NO: 634500 - RNA, 20 nt, Escherichia coli CFT073
auccugcgguuugucaucau

SEQ ID NO: 634501 - RNA, 21 nt, Escherichia coli CFT073
auccugcgguuugucaucauu

SEQ ID NO: 634502 - RNA, 14 nt, Escherichia coli CFT073
auccugggcgagga

SEQ ID NO: 634503 - RNA, 19 nt, Escherichia coli CFT073
auccugccaguaagcaguc

SEQ ID NO: 634504 - RNA, 18 nt, Escherichia coli CFT073
auccugccagugcaaaaa

SEQ ID NO: 634505 - RNA, 18 nt, Escherichia coli CFT073
auccugcccgcuccagcu

SEQ ID NO: 634506 - RNA, 19 nt, Escherichia coli CFT073
auccugcccgcuccagcua

SEQ ID NO: 634507 - RNA, 16 nt, Escherichia coli CFT073
auccugccgagauaca

SEQ ID NO: 634508 - RNA, 18 nt, Escherichia coli CFT073
auccugccggugaugagc

SEQ ID NO: 634509 - RNA, 19 nt, Escherichia coli CFT073
aucggcgcauucgaucacc

SEQ ID NO: 634510 - RNA, 22 nt, Escherichia coli CFT073
aucggcgcauucgaucaccgca

SEQ ID NO: 634511 - RNA, 14 nt, Escherichia coli CFT073
aucggcguaaucac

SEQ ID NO: 634512 - RNA, 17 nt, Escherichia coli CFT073
aucggcguuuucugacc

SEQ ID NO: 634513 - RNA, 13 nt, Escherichia coli CFT073
aucggcuuuggca

SEQ ID NO: 634514 - RNA, 21 nt, Escherichia coli CFT073
aucguaguuuuugcccaucau

SEQ ID NO: 634515 - RNA, 12 nt, Escherichia coli CFT073
aucguaccaggc

SEQ ID NO: 634516 - RNA, 11 nt, Escherichia coli CFT073
aucgguaauug

SEQ ID NO: 634517 - RNA, 18 nt, Escherichia coli CFT073
aucgguccggaaauugaa

SEQ ID NO: 634518 - RNA, 19 nt, Escherichia coli CFT073
aucgguccggaaauugaaa

SEQ ID NO: 634519 - RNA, 16 nt, Escherichia coli CFT073
aucggucgacugcgcu

SEQ ID NO: 634520 - RNA, 19 nt, Escherichia coli CFT073
aucggucgccugacguaca

SEQ ID NO: 634521 - RNA, 19 nt, Escherichia coli CFT073
aucggucauuaaggcauaa

SEQ ID NO: 634522 - RNA, 18 nt, Escherichia coli CFT073
aucggugaggaucaccag

SEQ ID NO: 634523 - RNA, 13 nt, Escherichia coli CFT073
aucggugauaaau

SEQ ID NO: 634524 - RNA, 18 nt, Escherichia coli CFT073
aucgcgccaucaaaucug

SEQ ID NO: 634525 - RNA, 21 nt, Escherichia coli CFT073
aucgcggcugacguaaucaug

SEQ ID NO: 634526 - RNA, 13 nt, Escherichia coli CFT073
aucgcuacaccaa

SEQ ID NO: 634527 - RNA, 20 nt, Escherichia coli CFT073
aucgccgcaucauccucuuc

SEQ ID NO: 634528 - RNA, 14 nt, Escherichia coli CFT073
aucgcgccaaucag

SEQ ID NO: 634529 - RNA, 17 nt, Escherichia coli CFT073
aucgccgaacgccacga

SEQ ID NO: 634530 - RNA, 23 nt, Escherichia coli CFT073
aucgccgacaaucucuucgagaa

SEQ ID NO: 634531 - RNA, 14 nt, Escherichia coli CFT073
aucgccgagauacu

SEQ ID NO: 634532 - RNA, 16 nt, Escherichia coli CFT073
aucgcccugcuccagc

SEQ ID NO: 634533 - RNA, 18 nt, Escherichia coli CFT073
aucgcccugcuccagcag

SEQ ID NO: 634534 - RNA, 20 nt, Escherichia coli CFT073
aucgcccugcuccagcagcu

SEQ ID NO: 634535 - RNA, 15 nt, Escherichia coli CFT073
aucgcccuuaccauu

SEQ ID NO: 634536 - RNA, 21 nt, Escherichia coli CFT073
aucgcccggauauccacccgc

SEQ ID NO: 634537 - RNA, 15 nt, Escherichia coli CFT073
aucgcccggcaccag

SEQ ID NO: 634538 - RNA, 19 nt, Escherichia coli CFT073
aucgcccggcaccagcacc

SEQ ID NO: 634539 - RNA, 20 nt, Escherichia coli CFT073
aucgcuagauaggucaccag

SEQ ID NO: 634540 - RNA, 17 nt, Escherichia coli CFT073
aucgcuagauauauauu

SEQ ID NO: 634541 - RNA, 22 nt, Escherichia coli CFT073
aucgcuauuaacccgcaacagc

SEQ ID NO: 634542 - RNA, 18 nt, Escherichia coli CFT073
aucgcucaucugcugcgu

SEQ ID NO: 634543 - RNA, 16 nt, Escherichia coli CFT073
aucgcucccaaaccgc

SEQ ID NO: 634544 - RNA, 23 nt, Escherichia coli CFT073
aucgcuuucaaaagccccugaau

SEQ ID NO: 634545 - RNA, 19 nt, Escherichia coli CFT073
aucgcuuucgcuuucucuu

SEQ ID NO: 634546 - RNA, 17 nt, Escherichia coli CFT073
aucgcuuugugcucuuc

SEQ ID NO: 634547 - RNA, 15 nt, Escherichia coli CFT073
aucgcuuuuucugca

SEQ ID NO: 634548 - RNA, 13 nt, Escherichia coli CFT073
aucggcaggaaca

SEQ ID NO: 634549 - RNA, 11 nt, Escherichia coli CFT073
aucccugcaac

SEQ ID NO: 634550 - RNA, 13 nt, Escherichia coli CFT073
aucccugcaacau

SEQ ID NO: 634551 - RNA, 16 nt, Escherichia coli CFT073
aucccugcaccaauga

SEQ ID NO: 634552 - RNA, 15 nt, Escherichia coli CFT073
aucccugcuguccug

SEQ ID NO: 634553 - RNA, 14 nt, Escherichia coli CFT073
aucccuucaauuau

SEQ ID NO: 634554 - RNA, 14 nt, Escherichia coli CFT073
aucccuucuccaca

SEQ ID NO: 634555 - RNA, 15 nt, Escherichia coli CFT073
aucccuucuccacac

SEQ ID NO: 634556 - RNA, 16 nt, Escherichia coli CFT073
aucccuuuguaagcag

SEQ ID NO: 634557 - RNA, 20 nt, Escherichia coli CFT073
auccgaacgcugacaaacug

SEQ ID NO: 634558 - RNA, 13 nt, Escherichia coli CFT073
aucccguugaaaa

SEQ ID NO: 634559 - RNA, 18 nt, Escherichia coli CFT073
aucccguugaaaaugcug

SEQ ID NO: 634560 - RNA, 14 nt, Escherichia coli CFT073
aucccucuucggua

SEQ ID NO: 634561 - RNA, 17 nt, Escherichia coli CFT073
aucccucacgcuucuga

SEQ ID NO: 634562 - RNA, 20 nt, Escherichia coli CFT073
aucccgguauaacuugccag

SEQ ID NO: 634563 - RNA, 13 nt, Escherichia coli CFT073
aucccgugccugc

SEQ ID NO: 634564 - RNA, 14 nt, Escherichia coli CFT073
auccgccagccaau

SEQ ID NO: 634565 - RNA, 15 nt, Escherichia coli CFT073
auccgccagcgccuc

SEQ ID NO: 634566 - RNA, 14 nt, Escherichia coli CFT073
auccgccacuucuu

SEQ ID NO: 634567 - RNA, 12 nt, Escherichia coli CFT073
auccgccagcag

SEQ ID NO: 634568 - RNA, 17 nt, Escherichia coli CFT073
auccgcacaaucccuua

SEQ ID NO: 634569 - RNA, 13 nt, Escherichia coli CFT073
auccgcccucuuc

SEQ ID NO: 634570 - RNA, 18 nt, Escherichia coli CFT073
auccgaucauuagcugga

SEQ ID NO: 634571 - RNA, 15 nt, Escherichia coli CFT073
auccgauuguuccug

SEQ ID NO: 634572 - RNA, 22 nt, Escherichia coli CFT073
auccgacuugucaggcggauaa

SEQ ID NO: 634573 - RNA, 20 nt, Escherichia coli CFT073
auccgaccuacacucggcac

SEQ ID NO: 634574 - RNA, 21 nt, Escherichia coli CFT073
auccgacaaaaugaugucaac

SEQ ID NO: 634575 - RNA, 13 nt, Escherichia coli CFT073
auccccggcaacc

SEQ ID NO: 634576 - RNA, 15 nt, Escherichia coli CFT073
auccccggcaggaag

SEQ ID NO: 634577 - RNA, 18 nt, Escherichia coli CFT073
auccccggcaggaaguaa

SEQ ID NO: 634578 - RNA, 17 nt, Escherichia coli CFT073
auccccucuucagccgc

SEQ ID NO: 634579 - RNA, 14 nt, Escherichia coli CFT073
aucccgccagcacc

SEQ ID NO: 634580 - RNA, 21 nt, Escherichia coli CFT073
aucccgccgaccaacgcagaa

SEQ ID NO: 634581 - RNA, 14 nt, Escherichia coli CFT073
aucccggcaggaau

SEQ ID NO: 634582 - RNA, 15 nt, Escherichia coli CFT073
aucccggcucauccc

SEQ ID NO: 634583 - RNA, 15 nt, Escherichia coli CFT073
aucccgcgacggaag

SEQ ID NO: 634584 - RNA, 19 nt, Escherichia coli CFT073
aucccaguccucaucaucc

SEQ ID NO: 634585 - RNA, 19 nt, Escherichia coli CFT073
aucccagccaaugcaggca

SEQ ID NO: 634586 - RNA, 18 nt, Escherichia coli CFT073
aucccaucgcagaaacga

SEQ ID NO: 634587 - RNA, 12 nt, Escherichia coli CFT073
aucccccacuuu

SEQ ID NO: 634588 - RNA, 17 nt, Escherichia coli CFT073
auccccccaagcggggg

SEQ ID NO: 634589 - RNA, 13 nt, Escherichia coli CFT073
aucccccagcacu

SEQ ID NO: 634590 - RNA, 21 nt, Escherichia coli CFT073
aucccccgauaaaacauuacu

SEQ ID NO: 634591 - RNA, 16 nt, Escherichia coli CFT073
auccaggacauaucag

SEQ ID NO: 634592 - RNA, 22 nt, Escherichia coli CFT073
auccaggcacuggccuuuucac

SEQ ID NO: 634593 - RNA, 13 nt, Escherichia coli CFT073
auccaggccaaaa

SEQ ID NO: 634594 - RNA, 16 nt, Escherichia coli CFT073
auccagguuacgcaug

SEQ ID NO: 634595 - RNA, 16 nt, Escherichia coli CFT073
auccagguagcaaaca

SEQ ID NO: 634596 - RNA, 17 nt, Escherichia coli CFT073
auccagguagcaaacaa

SEQ ID NO: 634597 - RNA, 21 nt, Escherichia coli CFT073
auccaggguuuuauuauucca

SEQ ID NO: 634598 - RNA, 19 nt, Escherichia coli CFT073
auccagggaucaacauuca

SEQ ID NO: 634599 - RNA, 14 nt, Escherichia coli CFT073
auccauuaaaacug

SEQ ID NO: 634600 - RNA, 18 nt, Escherichia coli CFT073
auccauuaugauuaucag

SEQ ID NO: 634601 - RNA, 23 nt, Escherichia coli CFT073
auccauuacaucacgacgaccac

SEQ ID NO: 634602 - RNA, 21 nt, Escherichia coli CFT073
auccauucaucacgcacugca

SEQ ID NO: 634603 - RNA, 13 nt, Escherichia coli CFT073
auccacuggaauu

SEQ ID NO: 634604 - RNA, 19 nt, Escherichia coli CFT073
auccaccguuggcagauaa

SEQ ID NO: 634605 - RNA, 20 nt, Escherichia coli CFT073
auccaccguuggcagauaac

SEQ ID NO: 634606 - RNA, 22 nt, Escherichia coli CFT073
auccaccgcguuuagcaguuca

SEQ ID NO: 634607 - RNA, 14 nt, Escherichia coli CFT073
auccaccagugacu

SEQ ID NO: 634608 - RNA, 16 nt, Escherichia coli CFT073
auccacccgcagcaag

SEQ ID NO: 634609 - RNA, 14 nt, Escherichia coli CFT073
auccagccacggcu

SEQ ID NO: 634610 - RNA, 13 nt, Escherichia coli CFT073
auccagccaggcg

SEQ ID NO: 634611 - RNA, 19 nt, Escherichia coli CFT073
auccagccccaccagcaaa

SEQ ID NO: 634612 - RNA, 19 nt, Escherichia coli CFT073
auccagcgaaauaaaagug

SEQ ID NO: 634613 - RNA, 16 nt, Escherichia coli CFT073
auccagcgcaaaggga

SEQ ID NO: 634614 - RNA, 22 nt, Escherichia coli CFT073
auccagcgcacgggcaguuaau

SEQ ID NO: 634615 - RNA, 15 nt, Escherichia coli CFT073
auccagcauaccuuc

SEQ ID NO: 634616 - RNA, 11 nt, Escherichia coli CFT073
auccagccaaa

SEQ ID NO: 634617 - RNA, 19 nt, Escherichia coli CFT073
auccagcagcgacucacga

SEQ ID NO: 634618 - RNA, 17 nt, Escherichia coli CFT073
auccagcaguggaucga

SEQ ID NO: 634619 - RNA, 18 nt, Escherichia coli CFT073
auccaccacaaaagcaaa

SEQ ID NO: 634620 - RNA, 14 nt, Escherichia coli CFT073
aucauuugcaccag

SEQ ID NO: 634621 - RNA, 14 nt, Escherichia coli CFT073
auccaacuucguua

SEQ ID NO: 634622 - RNA, 11 nt, Escherichia coli CFT073
aaaagaaacug

SEQ ID NO: 634623 - RNA, 12 nt, Escherichia coli CFT073
aucauuaucacc

SEQ ID NO: 634624 - RNA, 22 nt, Escherichia coli CFT073
aaaacuucauuugucucaaaac

SEQ ID NO: 634625 - RNA, 23 nt, Escherichia coli CFT073
aucauuaacaccacgccagccgc

SEQ ID NO: 634626 - RNA, 23 nt, Escherichia coli CFT073
aucauuagcccuauaaucaccgu

SEQ ID NO: 634627 - RNA, 15 nt, Escherichia coli CFT073
aucauuagucacaaa

SEQ ID NO: 634628 - RNA, 16 nt, Escherichia coli CFT073
aucauuaccugagccu

SEQ ID NO: 634629 - RNA, 14 nt, Escherichia coli CFT073
aucuucagucuuga

SEQ ID NO: 634630 - RNA, 20 nt, Escherichia coli CFT073
aucuucauccgccccggcuu

SEQ ID NO: 634631 - RNA, 20 nt, Escherichia coli CFT073
aucuucauacggcccuucga

SEQ ID NO: 634632 - RNA, 23 nt, Escherichia coli CFT073
aucuucaucaucugcgccacgaa

SEQ ID NO: 634633 - RNA, 14 nt, Escherichia coli CFT073
aucuucacgauuau

SEQ ID NO: 634634 - RNA, 16 nt, Escherichia coli CFT073
aucuucacacacauca

SEQ ID NO: 634635 - RNA, 15 nt, Escherichia coli CFT073
aucuucacaucauca

SEQ ID NO: 634636 - RNA, 16 nt, Escherichia coli CFT073
aucuucacaucaucau

SEQ ID NO: 634637 - RNA, 15 nt, Escherichia coli CFT073
aucuuccccugcgau

SEQ ID NO: 634638 - RNA, 15 nt, Escherichia coli CFT073
aucuuccccuuuugc

SEQ ID NO: 634639 - RNA, 23 nt, Escherichia coli CFT073
aucuuccccuuuugccuucugag

SEQ ID NO: 634640 - RNA, 18 nt, Escherichia coli CFT073
aucuuccgggcaacaauc

SEQ ID NO: 634641 - RNA, 14 nt, Escherichia coli CFT073
aucuuccagaucac

SEQ ID NO: 634642 - RNA, 21 nt, Escherichia coli CFT073
aucuuccagaucaccgcagaa

SEQ ID NO: 634643 - RNA, 19 nt, Escherichia coli CFT073
aucuuccacaauaccaauc

SEQ ID NO: 634644 - RNA, 13 nt, Escherichia coli CFT073
aucuucauugugc

SEQ ID NO: 634645 - RNA, 18 nt, Escherichia coli CFT073
aucuuaauagcugccagc

SEQ ID NO: 634646 - RNA, 19 nt, Escherichia coli CFT073
aucuuacguuuaauauuac

SEQ ID NO: 634647 - RNA, 13 nt, Escherichia coli CFT073
aucuuacugcaac

SEQ ID NO: 634648 - RNA, 15 nt, Escherichia coli CFT073
aucuuacugcaacug

SEQ ID NO: 634649 - RNA, 15 nt, Escherichia coli CFT073
aucuuagacaucaaa

SEQ ID NO: 634650 - RNA, 18 nt, Escherichia coli CFT073
aucuuagacaucaaaauu

SEQ ID NO: 634651 - RNA, 16 nt, Escherichia coli CFT073
aucuuauucccacuuu

SEQ ID NO: 634652 - RNA, 18 nt, Escherichia coli CFT073
aucuuauugccauuuuca

SEQ ID NO: 634653 - RNA, 22 nt, Escherichia coli CFT073
aucuuaucccuucgagcggggg

SEQ ID NO: 634654 - RNA, 19 nt, Escherichia coli CFT073
aucuuaucuaacaaucuug

SEQ ID NO: 634655 - RNA, 17 nt, Escherichia coli CFT073
aucuguaucguuauuaa

SEQ ID NO: 634656 - RNA, 12 nt, Escherichia coli CFT073
aucuguauguca

SEQ ID NO: 634657 - RNA, 16 nt, Escherichia coli CFT073
aucugucagacuaucu

SEQ ID NO: 634658 - RNA, 12 nt, Escherichia coli CFT073
aucuguuuucaa

SEQ ID NO: 634659 - RNA, 23 nt, Escherichia coli CFT073
aucuggcuccuguuugcauuucu

SEQ ID NO: 634660 - RNA, 21 nt, Escherichia coli CFT073
aucuggcgucagcggcuggca

SEQ ID NO: 634661 - RNA, 15 nt, Escherichia coli CFT073
aucuggcgagaacac

SEQ ID NO: 634662 - RNA, 23 nt, Escherichia coli CFT073
aucuggcaccgguacacaaccgc

SEQ ID NO: 634663 - RNA, 23 nt, Escherichia coli CFT073
aucuggcaucggcgcacaaccgc

SEQ ID NO: 634664 - RNA, 17 nt, Escherichia coli CFT073
aucugccugauccugag

SEQ ID NO: 634665 - RNA, 20 nt, Escherichia coli CFT073
aucugccugauccugagcua

SEQ ID NO: 634666 - RNA, 21 nt, Escherichia coli CFT073
aucugcgcccaauauccugag

SEQ ID NO: 634667 - RNA, 19 nt, Escherichia coli CFT073
aucugcguaucgcccugcc

SEQ ID NO: 634668 - RNA, 23 nt, Escherichia coli CFT073
aucugcggccuccaacaacccug

SEQ ID NO: 634669 - RNA, 13 nt, Escherichia coli CFT073
aucugaaaaugaa

SEQ ID NO: 634670 - RNA, 14 nt, Escherichia coli CFT073
aucugaaaaugaaa

SEQ ID NO: 634671 - RNA, 22 nt, Escherichia coli CFT073
aucuccggcgguaaaugcucau

SEQ ID NO: 634672 - RNA, 11 nt, Escherichia coli CFT073
aucucaucaau

SEQ ID NO: 634673 - RNA, 16 nt, Escherichia coli CFT073
aucuccacccgcaaau

SEQ ID NO: 634674 - RNA, 15 nt, Escherichia coli CFT073
aucucgccauccuua

SEQ ID NO: 634675 - RNA, 12 nt, Escherichia coli CFT073
aucucuccuuuc

SEQ ID NO: 634676 - RNA, 20 nt, Escherichia coli CFT073
aucucgcgccaguaccgccg

SEQ ID NO: 634677 - RNA, 20 nt, Escherichia coli CFT073
aucucgcgcucuucuucacg

SEQ ID NO: 634678 - RNA, 21 nt, Escherichia coli CFT073
aucucuuucucgucugaaaga

SEQ ID NO: 634679 - RNA, 12 nt, Escherichia coli CFT073
aucucuuuaugg

SEQ ID NO: 634680 - RNA, 14 nt, Escherichia coli CFT073
aucucuuuccauuc

SEQ ID NO: 634681 - RNA, 16 nt, Escherichia coli CFT073
aucucuuuccauucuu

SEQ ID NO: 634682 - RNA, 18 nt, Escherichia coli CFT073
aucucuuuccauucuuuc

SEQ ID NO: 634683 - RNA, 20 nt, Escherichia coli CFT073
aucucuuuccauucuuuccc

SEQ ID NO: 634684 - RNA, 23 nt, Escherichia coli CFT073
aucugaaaaccaggcuuacacuu

SEQ ID NO: 634685 - RNA, 13 nt, Escherichia coli CFT073
aucucuggcggca

SEQ ID NO: 634686 - RNA, 20 nt, Escherichia coli CFT073
aucucuggcggcaaaccuuu

SEQ ID NO: 634687 - RNA, 23 nt, Escherichia coli CFT073
aucucuggcggcaaaccuuucgc

SEQ ID NO: 634688 - RNA, 22 nt, Escherichia coli CFT073
aucucugccuugaguuuuucau

SEQ ID NO: 634689 - RNA, 16 nt, Escherichia coli CFT073
aucucugcgcuaucca

SEQ ID NO: 634690 - RNA, 21 nt, Escherichia coli CFT073
aucguauuggugcauaacaca

SEQ ID NO: 634691 - RNA, 14 nt, Escherichia coli CFT073
aucguauuucagac

SEQ ID NO: 634692 - RNA, 16 nt, Escherichia coli CFT073
aucgucagacgcucug

SEQ ID NO: 634693 - RNA, 22 nt, Escherichia coli CFT073
aucgucaggaagaagcccauca

SEQ ID NO: 634694 - RNA, 22 nt, Escherichia coli CFT073
aucuagccugaugcgaugcugg

SEQ ID NO: 634695 - RNA, 14 nt, Escherichia coli CFT073
aucuauaaaauccu

SEQ ID NO: 634696 - RNA, 22 nt, Escherichia coli CFT073
aucuauccgaugcaaaaaauga

SEQ ID NO: 634697 - RNA, 16 nt, Escherichia coli CFT073
aucuaugccaucuucu

SEQ ID NO: 634698 - RNA, 23 nt, Escherichia coli CFT073
aucucacccauagauaccuucuu

SEQ ID NO: 634699 - RNA, 16 nt, Escherichia coli CFT073
aucucagucagauacc

SEQ ID NO: 634700 - RNA, 19 nt, Escherichia coli CFT073
augaguugaaauugauggg

SEQ ID NO: 634701 - RNA, 17 nt, Escherichia coli CFT073
augaguuggauaauugc

SEQ ID NO: 634702 - RNA, 13 nt, Escherichia coli CFT073
augagugccagau

SEQ ID NO: 634703 - RNA, 13 nt, Escherichia coli CFT073
augaguuaucacu

SEQ ID NO: 634704 - RNA, 16 nt, Escherichia coli CFT073
augauacuccacauca

SEQ ID NO: 634705 - RNA, 18 nt, Escherichia coli CFT073
augauacucgccgaacca

SEQ ID NO: 634706 - RNA, 14 nt, Escherichia coli CFT073
augauagccaggcg

SEQ ID NO: 634707 - RNA, 14 nt, Escherichia coli CFT073
augauaauaaaaac

SEQ ID NO: 634708 - RNA, 23 nt, Escherichia coli CFT073
augauaaucucgcccaugcgauu

SEQ ID NO: 634709 - RNA, 19 nt, Escherichia coli CFT073
augaucgaagcaaagaguu

SEQ ID NO: 634710 - RNA, 15 nt, Escherichia coli CFT073
augaucgacaggcuu

SEQ ID NO: 634711 - RNA, 14 nt, Escherichia coli CFT073
augaucccagaacc

SEQ ID NO: 634712 - RNA, 16 nt, Escherichia coli CFT073
augaucccagaaccag

SEQ ID NO: 634713 - RNA, 16 nt, Escherichia coli CFT073
augaucccuucacuuc

SEQ ID NO: 634714 - RNA, 13 nt, Escherichia coli CFT073
augaucagaacau

SEQ ID NO: 634715 - RNA, 23 nt, Escherichia coli CFT073
augaucaaaaaaaucuucacuga

SEQ ID NO: 634716 - RNA, 14 nt, Escherichia coli CFT073
augauagagaucac

SEQ ID NO: 634717 - RNA, 14 nt, Escherichia coli CFT073
augauaucccugcu

SEQ ID NO: 634718 - RNA, 17 nt, Escherichia coli CFT073
augacuuucaaagagag

SEQ ID NO: 634719 - RNA, 18 nt, Escherichia coli CFT073
augagcguauagagcagc

SEQ ID NO: 634720 - RNA, 15 nt, Escherichia coli CFT073
augaguaauuuuucu

SEQ ID NO: 634721 - RNA, 17 nt, Escherichia coli CFT073
augaguaaacuucaacg

SEQ ID NO: 634722 - RNA, 20 nt, Escherichia coli CFT073
augaguaaacuucaacgcug

SEQ ID NO: 634723 - RNA, 15 nt, Escherichia coli CFT073
augagggaugggcga

SEQ ID NO: 634724 - RNA, 17 nt, Escherichia coli CFT073
augagguucagccgagc

SEQ ID NO: 634725 - RNA, 20 nt, Escherichia coli CFT073
augacagcgugguuuucuca

SEQ ID NO: 634726 - RNA, 22 nt, Escherichia coli CFT073
augacauucacgcugucggcac

SEQ ID NO: 634727 - RNA, 16 nt, Escherichia coli CFT073
augacaguaucaccaa

SEQ ID NO: 634728 - RNA, 22 nt, Escherichia coli CFT073
augacucgccgcaaaacccagg

SEQ ID NO: 634729 - RNA, 13 nt, Escherichia coli CFT073
augaauaaaaaaa

SEQ ID NO: 634730 - RNA, 16 nt, Escherichia coli CFT073
augaaguaguaacugu

SEQ ID NO: 634731 - RNA, 17 nt, Escherichia coli CFT073
augaagucgcagaccaa

SEQ ID NO: 634732 - RNA, 15 nt, Escherichia coli CFT073
augaaugauacagaa

SEQ ID NO: 634733 - RNA, 15 nt, Escherichia coli CFT073
augaaugaaaacgaa

SEQ ID NO: 634734 - RNA, 15 nt, Escherichia coli CFT073
augaauuuugaagga

SEQ ID NO: 634735 - RNA, 23 nt, Escherichia coli CFT073
augaauuuccgguuguuuugguu

SEQ ID NO: 634736 - RNA, 18 nt, Escherichia coli CFT073
augacaaaaaagccaauu

SEQ ID NO: 634737 - RNA, 18 nt, Escherichia coli CFT073
augacaaacgcaaaacug

SEQ ID NO: 634738 - RNA, 20 nt, Escherichia coli CFT073
augaacggugcgcaggcuuu

SEQ ID NO: 634739 - RNA, 16 nt, Escherichia coli CFT073
aucuuuauucauaauc

SEQ ID NO: 634740 - RNA, 23 nt, Escherichia coli CFT073
aucuuucacaaagacgccaucaa

SEQ ID NO: 634741 - RNA, 13 nt, Escherichia coli CFT073
aucuuucacgccc

SEQ ID NO: 634742 - RNA, 14 nt, Escherichia coli CFT073
aucuuucacgccca

SEQ ID NO: 634743 - RNA, 21 nt, Escherichia coli CFT073
aucuuucagaguuguaccacc

SEQ ID NO: 634744 - RNA, 16 nt, Escherichia coli CFT073
aucuuuccagccucug

SEQ ID NO: 634745 - RNA, 13 nt, Escherichia coli CFT073
aucuuucgaguaa

SEQ ID NO: 634746 - RNA, 17 nt, Escherichia coli CFT073
aucuucgccaucccggc

SEQ ID NO: 634747 - RNA, 19 nt, Escherichia coli CFT073
aucuucgccaucccggcaa

SEQ ID NO: 634748 - RNA, 19 nt, Escherichia coli CFT073
aucuucggcgaaaaucauu

SEQ ID NO: 634749 - RNA, 23 nt, Escherichia coli CFT073
aucuucggcaauacuucaacaua

SEQ ID NO: 634750 - RNA, 20 nt, Escherichia coli CFT073
aucuucgucaaagauauuau

SEQ ID NO: 634751 - RNA, 14 nt, Escherichia coli CFT073
augaaaugcaggca

SEQ ID NO: 634752 - RNA, 20 nt, Escherichia coli CFT073
augaaauacuaaauaugaaa

SEQ ID NO: 634753 - RNA, 17 nt, Escherichia coli CFT073
augaaaaguuagccaca

SEQ ID NO: 634754 - RNA, 15 nt, Escherichia coli CFT073
auuaaauuuaugugc

SEQ ID NO: 634755 - RNA, 22 nt, Escherichia coli CFT073
auuaaauucaaugaauuaaaaa

SEQ ID NO: 634756 - RNA, 14 nt, Escherichia coli CFT073
auuaaauucagcaa

SEQ ID NO: 634757 - RNA, 12 nt, Escherichia coli CFT073
auuaaauauuau

SEQ ID NO: 634758 - RNA, 14 nt, Escherichia coli CFT073
auuaaauauuauau

SEQ ID NO: 634759 - RNA, 15 nt, Escherichia coli CFT073
auuaaagguauuauu

SEQ ID NO: 634760 - RNA, 18 nt, Escherichia coli CFT073
auguuuuugaauuaacuc

SEQ ID NO: 634761 - RNA, 20 nt, Escherichia coli CFT073
auguuugacaacucauuacu

SEQ ID NO: 634762 - RNA, 22 nt, Escherichia coli CFT073
auguuuugcacgcggugaguuu

SEQ ID NO: 634763 - RNA, 22 nt, Escherichia coli CFT073
auuaaaauguguacuucucugu

SEQ ID NO: 634764 - RNA, 20 nt, Escherichia coli CFT073
auuaaacaacgccaguccag

SEQ ID NO: 634765 - RNA, 13 nt, Escherichia coli CFT073
auuaaacagcccu

SEQ ID NO: 634766 - RNA, 20 nt, Escherichia coli CFT073
auuaaacagcccuuugauuu

SEQ ID NO: 634767 - RNA, 14 nt, Escherichia coli CFT073
auguuuccagcauc

SEQ ID NO: 634768 - RNA, 17 nt, Escherichia coli CFT073
auguuguuucucuuucu

SEQ ID NO: 634769 - RNA, 21 nt, Escherichia coli CFT073
auguuguuuucaacuucccaa

SEQ ID NO: 634770 - RNA, 22 nt, Escherichia coli CFT073
auguuguuuuccguugugcgau

SEQ ID NO: 634771 - RNA, 19 nt, Escherichia coli CFT073
auguugcgcgguuagaaaa

SEQ ID NO: 634772 - RNA, 12 nt, Escherichia coli CFT073
auguugcagggc

SEQ ID NO: 634773 - RNA, 20 nt, Escherichia coli CFT073
auguugcagggcauuccauc

SEQ ID NO: 634774 - RNA, 17 nt, Escherichia coli CFT073
auguugcaguacucgca

SEQ ID NO: 634775 - RNA, 15 nt, Escherichia coli CFT073
auguugucgccagua

SEQ ID NO: 634776 - RNA, 17 nt, Escherichia coli CFT073
auguuggagauaacaac

SEQ ID NO: 634777 - RNA, 17 nt, Escherichia coli CFT073
auguucaauaaaagcau

SEQ ID NO: 634778 - RNA, 21 nt, Escherichia coli CFT073
auguucagucacuucaaauuu

SEQ ID NO: 634779 - RNA, 13 nt, Escherichia coli CFT073
auguucaguuugc

SEQ ID NO: 634780 - RNA, 18 nt, Escherichia coli CFT073
auguucauaucaaaaccu

SEQ ID NO: 634781 - RNA, 17 nt, Escherichia coli CFT073
auguugauuugcuggaa

SEQ ID NO: 634782 - RNA, 18 nt, Escherichia coli CFT073
auguccgagcuuaaugaa

SEQ ID NO: 634783 - RNA, 18 nt, Escherichia coli CFT073
auuaauuccccugccaga

SEQ ID NO: 634784 - RNA, 22 nt, Escherichia coli CFT073
auuaauuuucaauugauaauaa

SEQ ID NO: 634785 - RNA, 14 nt, Escherichia coli CFT073
auuaaugccuucaa

SEQ ID NO: 634786 - RNA, 18 nt, Escherichia coli CFT073
auuaaugggaagcaaguu

SEQ ID NO: 634787 - RNA, 23 nt, Escherichia coli CFT073
auuaauggugauggucgucaauc

SEQ ID NO: 634788 - RNA, 14 nt, Escherichia coli CFT073
auuaccacaacaaa

SEQ ID NO: 634789 - RNA, 14 nt, Escherichia coli CFT073
auuaccaaucugcu

SEQ ID NO: 634790 - RNA, 16 nt, Escherichia coli CFT073
auuaccaaucugcucu

SEQ ID NO: 634791 - RNA, 14 nt, Escherichia coli CFT073
auuaccaccaccuu

SEQ ID NO: 634792 - RNA, 12 nt, Escherichia coli CFT073
auuaccaccagc

SEQ ID NO: 634793 - RNA, 14 nt, Escherichia coli CFT073
auuacacacaacac

SEQ ID NO: 634794 - RNA, 18 nt, Escherichia coli CFT073
auuacacacaacacaucg

SEQ ID NO: 634795 - RNA, 15 nt, Escherichia coli CFT073
auuacacugaaaaaa

SEQ ID NO: 634796 - RNA, 20 nt, Escherichia coli CFT073
auuaauuuuuuaauaaaaag

SEQ ID NO: 634797 - RNA, 21 nt, Escherichia coli CFT073
auuaauuuuuuaauaaaaagg

SEQ ID NO: 634798 - RNA, 13 nt, Escherichia coli CFT073
auuacaaaauaca

SEQ ID NO: 634799 - RNA, 15 nt, Escherichia coli CFT073
auuacaaaaugacau

SEQ ID NO: 634800 - RNA, 10 nt, Escherichia coli CFT073
auuaauccag

SEQ ID NO: 634801 - RNA, 19 nt, Escherichia coli CFT073
auuaauccagggaucaaca

SEQ ID NO: 634802 - RNA, 21 nt, Escherichia coli CFT073
auuaaucccugcuucggucag

SEQ ID NO: 634803 - RNA, 11 nt, Escherichia coli CFT073
auuaaugacau

SEQ ID NO: 634804 - RNA, 15 nt, Escherichia coli CFT073
auuaauauuaaacca

SEQ ID NO: 634805 - RNA, 15 nt, Escherichia coli CFT073
auuaacaucccuuca

SEQ ID NO: 634806 - RNA, 12 nt, Escherichia coli CFT073
auuaacagguau

SEQ ID NO: 634807 - RNA, 16 nt, Escherichia coli CFT073
auuaacagucagucac

SEQ ID NO: 634808 - RNA, 21 nt, Escherichia coli CFT073
auuaacaccuuaaccucagga

SEQ ID NO: 634809 - RNA, 22 nt, Escherichia coli CFT073
auuaacaccacgccagccgcca

SEQ ID NO: 634810 - RNA, 12 nt, Escherichia coli CFT073
aaaagcaccgua

SEQ ID NO: 634811 - RNA, 16 nt, Escherichia coli CFT073
aaaagcacgccagaca

SEQ ID NO: 634812 - RNA, 15 nt, Escherichia coli CFT073
aaaagcacagaaucu

SEQ ID NO: 634813 - RNA, 15 nt, Escherichia coli CFT073
auuaaguaacaauau

SEQ ID NO: 634814 - RNA, 21 nt, Escherichia coli CFT073
auuaaccagccacugcgccau

SEQ ID NO: 634815 - RNA, 15 nt, Escherichia coli CFT073
auucaaucucuucac

SEQ ID NO: 634816 - RNA, 19 nt, Escherichia coli CFT073
auucaacauauccagcgcc

SEQ ID NO: 634817 - RNA, 16 nt, Escherichia coli CFT073
auucaacaucucuauu

SEQ ID NO: 634818 - RNA, 13 nt, Escherichia coli CFT073
auuauugagcgca

SEQ ID NO: 634819 - RNA, 18 nt, Escherichia coli CFT073
auucacauccacacacag

SEQ ID NO: 634820 - RNA, 16 nt, Escherichia coli CFT073
auucacauccugccag

SEQ ID NO: 634821 - RNA, 23 nt, Escherichia coli CFT073
auucacaucucgauuucaauauc

SEQ ID NO: 634822 - RNA, 14 nt, Escherichia coli CFT073
auucaccagcaaau

SEQ ID NO: 634823 - RNA, 17 nt, Escherichia coli CFT073
auucaccagcaaaucca

SEQ ID NO: 634824 - RNA, 13 nt, Escherichia coli CFT073
auucaccagccca

SEQ ID NO: 634825 - RNA, 20 nt, Escherichia coli CFT073
aaaaggccuaaugucguggu

SEQ ID NO: 634826 - RNA, 19 nt, Escherichia coli CFT073
auucaguucaucuacuacu

SEQ ID NO: 634827 - RNA, 20 nt, Escherichia coli CFT073
auucaguucgucacaguuaa

SEQ ID NO: 634828 - RNA, 16 nt, Escherichia coli CFT073
auucaguuuuugaaac

SEQ ID NO: 634829 - RNA, 15 nt, Escherichia coli CFT073
auucaguaccagcac

SEQ ID NO: 634830 - RNA, 17 nt, Escherichia coli CFT073
auucaguaccagcaccu

SEQ ID NO: 634831 - RNA, 20 nt, Escherichia coli CFT073
auucaguccacaucucaauc

SEQ ID NO: 634832 - RNA, 14 nt, Escherichia coli CFT073
auucagucuuaaaa

SEQ ID NO: 634833 - RNA, 15 nt, Escherichia coli CFT073
auucagucuuaaaaa

SEQ ID NO: 634834 - RNA, 19 nt, Escherichia coli CFT073
auucagucuuaaaaagcag

SEQ ID NO: 634835 - RNA, 13 nt, Escherichia coli CFT073
auucagucccugu

SEQ ID NO: 634836 - RNA, 22 nt, Escherichia coli CFT073
auucagcgucgccagcagcuca

SEQ ID NO: 634837 - RNA, 21 nt, Escherichia coli CFT073
auucagcgucucacuaucgcc

SEQ ID NO: 634838 - RNA, 21 nt, Escherichia coli CFT073
auucagcguaacgcccacgcu

SEQ ID NO: 634839 - RNA, 19 nt, Escherichia coli CFT073
auucagaugccauuuugca

SEQ ID NO: 634840 - RNA, 13 nt, Escherichia coli CFT073
auucagauucaaa

SEQ ID NO: 634841 - RNA, 14 nt, Escherichia coli CFT073
auucagauucaaau

SEQ ID NO: 634842 - RNA, 11 nt, Escherichia coli CFT073
auucagcagca

SEQ ID NO: 634843 - RNA, 18 nt, Escherichia coli CFT073
auucagcagcagacagcc

SEQ ID NO: 634844 - RNA, 20 nt, Escherichia coli CFT073
auucagacguccacgagacu

SEQ ID NO: 634845 - RNA, 14 nt, Escherichia coli CFT073
auucagacaggcga

SEQ ID NO: 634846 - RNA, 17 nt, Escherichia coli CFT073
auucagaucgguuuuuu

SEQ ID NO: 634847 - RNA, 23 nt, Escherichia coli CFT073
auucagagggcaaagucuucacg

SEQ ID NO: 634848 - RNA, 20 nt, Escherichia coli CFT073
auucagaaccgcguaacuuu

SEQ ID NO: 634849 - RNA, 15 nt, Escherichia coli CFT073
auucagaaaaacuac

SEQ ID NO: 634850 - RNA, 12 nt, Escherichia coli CFT073
auucacuucaua

SEQ ID NO: 634851 - RNA, 13 nt, Escherichia coli CFT073
auucacgccccag

SEQ ID NO: 634852 - RNA, 17 nt, Escherichia coli CFT073
auucaccgccugcugau

SEQ ID NO: 634853 - RNA, 22 nt, Escherichia coli CFT073
auucaccguucaauuccgcaac

SEQ ID NO: 634854 - RNA, 11 nt, Escherichia coli CFT073
auucaccucug

SEQ ID NO: 634855 - RNA, 23 nt, Escherichia coli CFT073
auucacgagagcgggaaaacaua

SEQ ID NO: 634856 - RNA, 22 nt, Escherichia coli CFT073
auuaucaacguagaauaaaagc

SEQ ID NO: 634857 - RNA, 23 nt, Escherichia coli CFT073
auuaucagacaccgauugccccu

SEQ ID NO: 634858 - RNA, 19 nt, Escherichia coli CFT073
auuaucccccgauaaaaca

SEQ ID NO: 634859 - RNA, 16 nt, Escherichia coli CFT073
auuaucgaaaccaacc

SEQ ID NO: 634860 - RNA, 20 nt, Escherichia coli CFT073
auuaucuggcaagccugaaa

SEQ ID NO: 634861 - RNA, 21 nt, Escherichia coli CFT073
auuaucuggcaagccugaaaa

SEQ ID NO: 634862 - RNA, 16 nt, Escherichia coli CFT073
auuaucuggucaguua

SEQ ID NO: 634863 - RNA, 23 nt, Escherichia coli CFT073
auuauuacguccaccagaacgac

SEQ ID NO: 634864 - RNA, 16 nt, Escherichia coli CFT073
auuauuaccgucagaa

SEQ ID NO: 634865 - RNA, 21 nt, Escherichia coli CFT073
auuauuccugcguuauacauu

SEQ ID NO: 634866 - RNA, 17 nt, Escherichia coli CFT073
auuauuccauccugcuc

SEQ ID NO: 634867 - RNA, 22 nt, Escherichia coli CFT073
auuauucccgcgcuaccacuuc

SEQ ID NO: 634868 - RNA, 15 nt, Escherichia coli CFT073
auuauucagaguaua

SEQ ID NO: 634869 - RNA, 17 nt, Escherichia coli CFT073
auuauucauaaugccca

SEQ ID NO: 634870 - RNA, 14 nt, Escherichia coli CFT073
auuauuauuuuugu

SEQ ID NO: 634871 - RNA, 17 nt, Escherichia coli CFT073
auuauucaaaaacagau

SEQ ID NO: 634872 - RNA, 16 nt, Escherichia coli CFT073
auuaugcagccuucau

SEQ ID NO: 634873 - RNA, 21 nt, Escherichia coli CFT073
auuaugaaauucagugaacug

SEQ ID NO: 634874 - RNA, 20 nt, Escherichia coli CFT073
auuaucuguucuuuuauauu

SEQ ID NO: 634875 - RNA, 16 nt, Escherichia coli CFT073
auuaugaaacaagaag

SEQ ID NO: 634876 - RNA, 21 nt, Escherichia coli CFT073
auuauaaguucaaguaaaaca

SEQ ID NO: 634877 - RNA, 17 nt, Escherichia coli CFT073
auuauacugcgcuuuua

SEQ ID NO: 634878 - RNA, 17 nt, Escherichia coli CFT073
auuacgcgcuucguuga

SEQ ID NO: 634879 - RNA, 18 nt, Escherichia coli CFT073
auuacgcucgcugcaaaa

SEQ ID NO: 634880 - RNA, 21 nt, Escherichia coli CFT073
auuacgacggugaucaucaaa

SEQ ID NO: 634881 - RNA, 21 nt, Escherichia coli CFT073
auuacgacccgaccgagcugg

SEQ ID NO: 634882 - RNA, 16 nt, Escherichia coli CFT073
auuacgaaaucggcac

SEQ ID NO: 634883 - RNA, 22 nt, Escherichia coli CFT073
auuacgaaguuuaauucuuuga

SEQ ID NO: 634884 - RNA, 16 nt, Escherichia coli CFT073
auuaccccauccauug

SEQ ID NO: 634885 - RNA, 19 nt, Escherichia coli CFT073
auuaccagagaaaagauaa

SEQ ID NO: 634886 - RNA, 22 nt, Escherichia coli CFT073
auuaccccguggugggguuccc

SEQ ID NO: 634887 - RNA, 22 nt, Escherichia coli CFT073
aaaagccgacucacuugcaguc

SEQ ID NO: 634888 - RNA, 21 nt, Escherichia coli CFT073
auuagcuuaucaaucucugca

SEQ ID NO: 634889 - RNA, 20 nt, Escherichia coli CFT073
auuagccgguaaaucaccau

SEQ ID NO: 634890 - RNA, 18 nt, Escherichia coli CFT073
auuagcgaugaaaucaug

SEQ ID NO: 634891 - RNA, 13 nt, Escherichia coli CFT073
auguauaucggcc

SEQ ID NO: 634892 - RNA, 20 nt, Escherichia coli CFT073
auguaucugaaguaaagaaa

SEQ ID NO: 634893 - RNA, 23 nt, Escherichia coli CFT073
aaaagcaaacugugcaaugaaaa

SEQ ID NO: 634894 - RNA, 13 nt, Escherichia coli CFT073
augucauagcaau

SEQ ID NO: 634895 - RNA, 17 nt, Escherichia coli CFT073
augucauaaaaaugagg

SEQ ID NO: 634896 - RNA, 14 nt, Escherichia coli CFT073
augucagugguggc

SEQ ID NO: 634897 - RNA, 18 nt, Escherichia coli CFT073
augucaguugcauaccau

SEQ ID NO: 634898 - RNA, 17 nt, Escherichia coli CFT073
augucaucgcguuaauc

SEQ ID NO: 634899 - RNA, 16 nt, Escherichia coli CFT073
augucagaaagaaauu

SEQ ID NO: 634900 - RNA, 18 nt, Escherichia coli CFT073
augucaccagccggucau

SEQ ID NO: 634901 - RNA, 23 nt, Escherichia coli CFT073
auguagcgugauuuuguaggucg

SEQ ID NO: 634902 - RNA, 17 nt, Escherichia coli CFT073
auguaacugccuuuccc

SEQ ID NO: 634903 - RNA, 21 nt, Escherichia coli CFT073
auguaagcgcauaaucaaucg

SEQ ID NO: 634904 - RNA, 16 nt, Escherichia coli CFT073
auguaaugcauggccu

SEQ ID NO: 634905 - RNA, 14 nt, Escherichia coli CFT073
auguacucgcuguu

SEQ ID NO: 634906 - RNA, 14 nt, Escherichia coli CFT073
augguuggcgaguu

SEQ ID NO: 634907 - RNA, 16 nt, Escherichia coli CFT073
augguuuucaauuauc

SEQ ID NO: 634908 - RNA, 16 nt, Escherichia coli CFT073
augguuucgcccaccu

SEQ ID NO: 634909 - RNA, 17 nt, Escherichia coli CFT073
augguuucgcuuugccc

SEQ ID NO: 634910 - RNA, 16 nt, Escherichia coli CFT073
auguaaccguuuguuu

SEQ ID NO: 634911 - RNA, 23 nt, Escherichia coli CFT073
auguaaccguuuguuuuuuaagg

SEQ ID NO: 634912 - RNA, 15 nt, Escherichia coli CFT073
auggugaaagcaaaa

SEQ ID NO: 634913 - RNA, 17 nt, Escherichia coli CFT073
auggugaaagcaaaaaa

SEQ ID NO: 634914 - RNA, 19 nt, Escherichia coli CFT073
auggucuguaccaccagaa

SEQ ID NO: 634915 - RNA, 22 nt, Escherichia coli CFT073
auggucugcgccgcauucaggg

SEQ ID NO: 634916 - RNA, 17 nt, Escherichia coli CFT073
auggucauuccagucug

SEQ ID NO: 634917 - RNA, 11 nt, Escherichia coli CFT073
auggcggcugg

SEQ ID NO: 634918 - RNA, 16 nt, Escherichia coli CFT073
auggcuucuggcugcu

SEQ ID NO: 634919 - RNA, 23 nt, Escherichia coli CFT073
auggcuugaagcaauagcauuac

SEQ ID NO: 634920 - RNA, 14 nt, Escherichia coli CFT073
auggcuuugcccuu

SEQ ID NO: 634921 - RNA, 16 nt, Escherichia coli CFT073
auggcuuuccaccugc

SEQ ID NO: 634922 - RNA, 11 nt, Escherichia coli CFT073
augggagcaga

SEQ ID NO: 634923 - RNA, 18 nt, Escherichia coli CFT073
augggaaaugacauucac

SEQ ID NO: 634924 - RNA, 21 nt, Escherichia coli CFT073
auggggcgucaacgcugccau

SEQ ID NO: 634925 - RNA, 19 nt, Escherichia coli CFT073
augggcauuucuuuuaugg

SEQ ID NO: 634926 - RNA, 19 nt, Escherichia coli CFT073
augggcaauuguauccaug

SEQ ID NO: 634927 - RNA, 18 nt, Escherichia coli CFT073
augggcaauuucuuucgc

SEQ ID NO: 634928 - RNA, 12 nt, Escherichia coli CFT073
auggucaccaca

SEQ ID NO: 634929 - RNA, 15 nt, Escherichia coli CFT073
auggucaccacaaau

SEQ ID NO: 634930 - RNA, 16 nt, Escherichia coli CFT073
auggucaccacaaaug

SEQ ID NO: 634931 - RNA, 16 nt, Escherichia coli CFT073
augguauuguccugca

SEQ ID NO: 634932 - RNA, 11 nt, Escherichia coli CFT073
augggguggaa

SEQ ID NO: 634933 - RNA, 15 nt, Escherichia coli CFT073
auggcauuaauaugc

SEQ ID NO: 634934 - RNA, 18 nt, Escherichia coli CFT073
auggccagacauuacaaa

SEQ ID NO: 634935 - RNA, 21 nt, Escherichia coli CFT073
auggccagacauuacaaaaua

SEQ ID NO: 634936 - RNA, 14 nt, Escherichia coli CFT073
auggcgcgccaccu

SEQ ID NO: 634937 - RNA, 21 nt, Escherichia coli CFT073
auggccuuuaacacgcaacac

SEQ ID NO: 634938 - RNA, 13 nt, Escherichia coli CFT073
auggauucaagca

SEQ ID NO: 634939 - RNA, 14 nt, Escherichia coli CFT073
auggauucaagcau

SEQ ID NO: 634940 - RNA, 13 nt, Escherichia coli CFT073
auggcaacagcag

SEQ ID NO: 634941 - RNA, 20 nt, Escherichia coli CFT073
auggcacaccauagaccaug

SEQ ID NO: 634942 - RNA, 16 nt, Escherichia coli CFT073
augcugauucaucuau

SEQ ID NO: 634943 - RNA, 15 nt, Escherichia coli CFT073
augcugcuuucugcg

SEQ ID NO: 634944 - RNA, 14 nt, Escherichia coli CFT073
augcugcuuuuacg

SEQ ID NO: 634945 - RNA, 18 nt, Escherichia coli CFT073
augcugacgugugauaau

SEQ ID NO: 634946 - RNA, 18 nt, Escherichia coli CFT073
augcugggcgaucggcag

SEQ ID NO: 634947 - RNA, 18 nt, Escherichia coli CFT073
augcugguuuugaaaaga

SEQ ID NO: 634948 - RNA, 23 nt, Escherichia coli CFT073
augcuggcgcauuaacucacugg

SEQ ID NO: 634949 - RNA, 23 nt, Escherichia coli CFT073
aaaagacuauauuaaagauguuu

SEQ ID NO: 634950 - RNA, 19 nt, Escherichia coli CFT073
augcguuuggagccgcugg

SEQ ID NO: 634951 - RNA, 20 nt, Escherichia coli CFT073
augcguuguagcuuuuuccu

SEQ ID NO: 634952 - RNA, 13 nt, Escherichia coli CFT073
augcuaauaauca

SEQ ID NO: 634953 - RNA, 20 nt, Escherichia coli CFT073
augcugaaauuacgcggugc

SEQ ID NO: 634954 - RNA, 13 nt, Escherichia coli CFT073
augcucuuuacgc

SEQ ID NO: 634955 - RNA, 13 nt, Escherichia coli CFT073
augcuauaaaaau

SEQ ID NO: 634956 - RNA, 18 nt, Escherichia coli CFT073
augcucaacaauaaacug

SEQ ID NO: 634957 - RNA, 13 nt, Escherichia coli CFT073
augcgggcgaggg

SEQ ID NO: 634958 - RNA, 16 nt, Escherichia coli CFT073
augcggcgugaacacc

SEQ ID NO: 634959 - RNA, 16 nt, Escherichia coli CFT073
augcggcgugauaaaa

SEQ ID NO: 634960 - RNA, 21 nt, Escherichia coli CFT073
augcggcgugauaaaagucag

SEQ ID NO: 634961 - RNA, 17 nt, Escherichia coli CFT073
augcgugcuucauucac

SEQ ID NO: 634962 - RNA, 16 nt, Escherichia coli CFT073
augcgucuuccgugcc

SEQ ID NO: 634963 - RNA, 18 nt, Escherichia coli CFT073
augcgucuugccaucaua

SEQ ID NO: 634964 - RNA, 20 nt, Escherichia coli CFT073
augcguagcugggcaacaaa

SEQ ID NO: 634965 - RNA, 18 nt, Escherichia coli CFT073
augcguaccauuucuucu

SEQ ID NO: 634966 - RNA, 14 nt, Escherichia coli CFT073
augcggucgcugcc

SEQ ID NO: 634967 - RNA, 13 nt, Escherichia coli CFT073
augcgcagcauaa

SEQ ID NO: 634968 - RNA, 21 nt, Escherichia coli CFT073
augcgcucuguugguaaaugc

SEQ ID NO: 634969 - RNA, 18 nt, Escherichia coli CFT073
augcgcuggcgcaacugc

SEQ ID NO: 634970 - RNA, 22 nt, Escherichia coli CFT073
augcgcugucauucauucagau

SEQ ID NO: 634971 - RNA, 16 nt, Escherichia coli CFT073
augcgcaccuuuacca

SEQ ID NO: 634972 - RNA, 22 nt, Escherichia coli CFT073
augcgcaacaccguaagaaagg

SEQ ID NO: 634973 - RNA, 18 nt, Escherichia coli CFT073
augcgcaaccguaaacga

SEQ ID NO: 634974 - RNA, 17 nt, Escherichia coli CFT073
augccuaaagugcuggg

SEQ ID NO: 634975 - RNA, 15 nt, Escherichia coli CFT073
augcgagugucauuc

SEQ ID NO: 634976 - RNA, 16 nt, Escherichia coli CFT073
augcgauaaccaggca

SEQ ID NO: 634977 - RNA, 14 nt, Escherichia coli CFT073
augcccgcaccacc

SEQ ID NO: 634978 - RNA, 21 nt, Escherichia coli CFT073
augccccuguaucaugcagua

SEQ ID NO: 634979 - RNA, 18 nt, Escherichia coli CFT073
augcccucagccuucugu

SEQ ID NO: 634980 - RNA, 21 nt, Escherichia coli CFT073
augccggguaauuucauuaaa

SEQ ID NO: 634981 - RNA, 19 nt, Escherichia coli CFT073
augccggauccagcgguug

SEQ ID NO: 634982 - RNA, 22 nt, Escherichia coli CFT073
augccggguuuaagcccggcau

SEQ ID NO: 634983 - RNA, 16 nt, Escherichia coli CFT073
augccggguuugccau

SEQ ID NO: 634984 - RNA, 17 nt, Escherichia coli CFT073
augccguagaacagcau

SEQ ID NO: 634985 - RNA, 21 nt, Escherichia coli CFT073
augccgucaccagcaucaaca

SEQ ID NO: 634986 - RNA, 22 nt, Escherichia coli CFT073
augccagugaugggcagaauaa

SEQ ID NO: 634987 - RNA, 12 nt, Escherichia coli CFT073
augcccaaaaaa

SEQ ID NO: 634988 - RNA, 15 nt, Escherichia coli CFT073
augccagccugcaac

SEQ ID NO: 634989 - RNA, 15 nt, Escherichia coli CFT073
augcccaguguugua

SEQ ID NO: 634990 - RNA, 21 nt, Escherichia coli CFT073
augcccacugcacaguguuug

SEQ ID NO: 634991 - RNA, 19 nt, Escherichia coli CFT073
augcauuuuuguccucacc

SEQ ID NO: 634992 - RNA, 20 nt, Escherichia coli CFT073
augccaaagaaggaaggcau

SEQ ID NO: 634993 - RNA, 17 nt, Escherichia coli CFT073
augccaaagaaugcagu

SEQ ID NO: 634994 - RNA, 16 nt, Escherichia coli CFT073
augccaaauauuucuu

SEQ ID NO: 634995 - RNA, 22 nt, Escherichia coli CFT073
augccaaauauuucuuuaucac

SEQ ID NO: 634996 - RNA, 19 nt, Escherichia coli CFT073
augccaaauguauccauca

SEQ ID NO: 634997 - RNA, 21 nt, Escherichia coli CFT073
augccaaccgcgacaauauca

SEQ ID NO: 634998 - RNA, 18 nt, Escherichia coli CFT073
augccaacuaccuucugg

SEQ ID NO: 634999 - RNA, 16 nt, Escherichia coli CFT073
augccagaaaaggagu

SEQ ID NO: 635000 - RNA, 18 nt, Escherichia coli CFT073
augccagacuuuguugaa

SEQ ID NO: 635001 - RNA, 14 nt, Escherichia coli CFT073
augccagcaacugg

SEQ ID NO: 635002 - RNA, 19 nt, Escherichia coli CFT073
augccagcacagaucgcac

SEQ ID NO: 635003 - RNA, 15 nt, Escherichia coli CFT073
augccagcagcaccc

SEQ ID NO: 635004 - RNA, 22 nt, Escherichia coli CFT073
augccagccacgacgucgggcg

SEQ ID NO: 635005 - RNA, 13 nt, Escherichia coli CFT073
augcagcugcucg

SEQ ID NO: 635006 - RNA, 22 nt, Escherichia coli CFT073
augcaggcaucggugaugcucu

SEQ ID NO: 635007 - RNA, 17 nt, Escherichia coli CFT073
augcaggcaugcaauau

SEQ ID NO: 635008 - RNA, 15 nt, Escherichia coli CFT073
augcaggcagcacug

SEQ ID NO: 635009 - RNA, 15 nt, Escherichia coli CFT073
augcagggcaaacuc

SEQ ID NO: 635010 - RNA, 18 nt, Escherichia coli CFT073
augaucggcguacccagc

SEQ ID NO: 635011 - RNA, 20 nt, Escherichia coli CFT073
augaucgucauaucaucauc

SEQ ID NO: 635012 - RNA, 16 nt, Escherichia coli CFT073
augaucuaaaagcaaa

SEQ ID NO: 635013 - RNA, 20 nt, Escherichia coli CFT073
augcacgcaaaaacgcauac

SEQ ID NO: 635014 - RNA, 22 nt, Escherichia coli CFT073
augcaccuuuaccagacgggca

SEQ ID NO: 635015 - RNA, 13 nt, Escherichia coli CFT073
augcaucagcugg

SEQ ID NO: 635016 - RNA, 15 nt, Escherichia coli CFT073
augcaucaacaucau

SEQ ID NO: 635017 - RNA, 18 nt, Escherichia coli CFT073
augcaucaacaucauuaa

SEQ ID NO: 635018 - RNA, 15 nt, Escherichia coli CFT073
augcaucuucauuaa

SEQ ID NO: 635019 - RNA, 20 nt, Escherichia coli CFT073
augcauccggcacauuucau

SEQ ID NO: 635020 - RNA, 23 nt, Escherichia coli CFT073
augcauccggcacauuucauuca

SEQ ID NO: 635021 - RNA, 15 nt, Escherichia coli CFT073
augcagucacgccag

SEQ ID NO: 635022 - RNA, 21 nt, Escherichia coli CFT073
augcagucacgccaguaacuc

SEQ ID NO: 635023 - RNA, 22 nt, Escherichia coli CFT073
augcagguccacgaccagcgca

SEQ ID NO: 635024 - RNA, 15 nt, Escherichia coli CFT073
augcagguacucacc

SEQ ID NO: 635025 - RNA, 23 nt, Escherichia coli CFT073
auucuccagcaucgaaaaugcca

SEQ ID NO: 635026 - RNA, 20 nt, Escherichia coli CFT073
auucuguuucauuaacccgc

SEQ ID NO: 635027 - RNA, 12 nt, Escherichia coli CFT073
auucuucaacaa

SEQ ID NO: 635028 - RNA, 18 nt, Escherichia coli CFT073
auugaaagaucacaaugu

SEQ ID NO: 635029 - RNA, 14 nt, Escherichia coli CFT073
auugaaagcaaaaa

SEQ ID NO: 635030 - RNA, 14 nt, Escherichia coli CFT073
auucuuugaucgcc

SEQ ID NO: 635031 - RNA, 15 nt, Escherichia coli CFT073
auugaauuaaaaugu

SEQ ID NO: 635032 - RNA, 21 nt, Escherichia coli CFT073
auugacaagguaguagaaauc

SEQ ID NO: 635033 - RNA, 18 nt, Escherichia coli CFT073
auugaccauauuaacgca

SEQ ID NO: 635034 - RNA, 21 nt, Escherichia coli CFT073
auugaccauauuaacgcagca

SEQ ID NO: 635035 - RNA, 19 nt, Escherichia coli CFT073
auugaaucggcgcagcaau

SEQ ID NO: 635036 - RNA, 18 nt, Escherichia coli CFT073
auugaagacaacauugau

SEQ ID NO: 635037 - RNA, 17 nt, Escherichia coli CFT073
auugaagcagcgcugga

SEQ ID NO: 635038 - RNA, 23 nt, Escherichia coli CFT073
auugaacggcaccgguacaggca

SEQ ID NO: 635039 - RNA, 13 nt, Escherichia coli CFT073
auugagacaacuc

SEQ ID NO: 635040 - RNA, 17 nt, Escherichia coli CFT073
auugagauccauuauga

SEQ ID NO: 635041 - RNA, 15 nt, Escherichia coli CFT073
auugagcaggaugac

SEQ ID NO: 635042 - RNA, 14 nt, Escherichia coli CFT073
auugacuacaaaaa

SEQ ID NO: 635043 - RNA, 19 nt, Escherichia coli CFT073
auugaguagccucugcguu

SEQ ID NO: 635044 - RNA, 16 nt, Escherichia coli CFT073
auugagguuagugaca

SEQ ID NO: 635045 - RNA, 23 nt, Escherichia coli CFT073
auugagguaaacaggaauucggc

SEQ ID NO: 635046 - RNA, 17 nt, Escherichia coli CFT073
auugaggauauuacuga

SEQ ID NO: 635047 - RNA, 15 nt, Escherichia coli CFT073
auugaggccuuuaga

SEQ ID NO: 635048 - RNA, 19 nt, Escherichia coli CFT073
auuccuggggucaucagca

SEQ ID NO: 635049 - RNA, 19 nt, Escherichia coli CFT073
auucgacacauucagaauu

SEQ ID NO: 635050 - RNA, 17 nt, Escherichia coli CFT073
auucgacuuucucuggc

SEQ ID NO: 635051 - RNA, 20 nt, Escherichia coli CFT073
auucgagagaauuaaccaga

SEQ ID NO: 635052 - RNA, 21 nt, Escherichia coli CFT073
auucgagagaauuaaccagaa

SEQ ID NO: 635053 - RNA, 16 nt, Escherichia coli CFT073
auucgccacugccagc

SEQ ID NO: 635054 - RNA, 22 nt, Escherichia coli CFT073
auucgccacugccagcaaaaaa

SEQ ID NO: 635055 - RNA, 18 nt, Escherichia coli CFT073
auucgcaauacauaagca

SEQ ID NO: 635056 - RNA, 13 nt, Escherichia coli CFT073
auucgcagcugca

SEQ ID NO: 635057 - RNA, 14 nt, Escherichia coli CFT073
auucgcagcugcag

SEQ ID NO: 635058 - RNA, 18 nt, Escherichia coli CFT073
auucgccgaauuaaacaa

SEQ ID NO: 635059 - RNA, 19 nt, Escherichia coli CFT073
auucgccguuaccagcacc

SEQ ID NO: 635060 - RNA, 19 nt, Escherichia coli CFT073
auucgccugacgcaauaac

SEQ ID NO: 635061 - RNA, 15 nt, Escherichia coli CFT073
auucggauccagcac

SEQ ID NO: 635062 - RNA, 14 nt, Escherichia coli CFT073
auucggcuccagau

SEQ ID NO: 635063 - RNA, 18 nt, Escherichia coli CFT073
auucccagcaacagcaaa

SEQ ID NO: 635064 - RNA, 19 nt, Escherichia coli CFT073
auucccagcaccgcagaga

SEQ ID NO: 635065 - RNA, 18 nt, Escherichia coli CFT073
auucccaguaccuguugu

SEQ ID NO: 635066 - RNA, 13 nt, Escherichia coli CFT073
auuccccacccca

SEQ ID NO: 635067 - RNA, 22 nt, Escherichia coli CFT073
auucccagucgcgcaauugcca

SEQ ID NO: 635068 - RNA, 17 nt, Escherichia coli CFT073
auuccaguaaguuaugu

SEQ ID NO: 635069 - RNA, 20 nt, Escherichia coli CFT073
auuccagucaaucauugaua

SEQ ID NO: 635070 - RNA, 21 nt, Escherichia coli CFT073
auuccaguucaaucucuucac

SEQ ID NO: 635071 - RNA, 23 nt, Escherichia coli CFT073
auuccagacgggucauaaucaga

SEQ ID NO: 635072 - RNA, 22 nt, Escherichia coli CFT073
auuccagaugaacggcuuuuuc

SEQ ID NO: 635073 - RNA, 16 nt, Escherichia coli CFT073
auucauaaugcccagc

SEQ ID NO: 635074 - RNA, 18 nt, Escherichia coli CFT073
auucccuugucgcagcau

SEQ ID NO: 635075 - RNA, 20 nt, Escherichia coli CFT073
auuccgaauuucauccugua

SEQ ID NO: 635076 - RNA, 21 nt, Escherichia coli CFT073
auuccccggagcccuacaaac

SEQ ID NO: 635077 - RNA, 18 nt, Escherichia coli CFT073
auuccccugccagaagca

SEQ ID NO: 635078 - RNA, 20 nt, Escherichia coli CFT073
auuccccugccagaagcaga

SEQ ID NO: 635079 - RNA, 19 nt, Escherichia coli CFT073
auucccuucuuucucuuuc

SEQ ID NO: 635080 - RNA, 15 nt, Escherichia coli CFT073
auucccuugcucugg

SEQ ID NO: 635081 - RNA, 21 nt, Escherichia coli CFT073
auuccgcaccaacgcaaaaaa

SEQ ID NO: 635082 - RNA, 20 nt, Escherichia coli CFT073
auuccugaaucagccaguaa

SEQ ID NO: 635083 - RNA, 17 nt, Escherichia coli CFT073
auuccugacccagcacc

SEQ ID NO: 635084 - RNA, 20 nt, Escherichia coli CFT073
auuccugacccagcaccagu

SEQ ID NO: 635085 - RNA, 19 nt, Escherichia coli CFT073
auuccguagcguuuuuuca

SEQ ID NO: 635086 - RNA, 23 nt, Escherichia coli CFT073
auuccguagcguuuuuucauuuc

SEQ ID NO: 635087 - RNA, 17 nt, Escherichia coli CFT073
auuccgggccaccaugc

SEQ ID NO: 635088 - RNA, 18 nt, Escherichia coli CFT073
auuccgggccaccaugcc

SEQ ID NO: 635089 - RNA, 21 nt, Escherichia coli CFT073
auuccgggccaccaugcccag

SEQ ID NO: 635090 - RNA, 23 nt, Escherichia coli CFT073
auuccgggaaacgagccauaaaa

SEQ ID NO: 635091 - RNA, 19 nt, Escherichia coli CFT073
auuccgggaauucgaagcu

SEQ ID NO: 635092 - RNA, 16 nt, Escherichia coli CFT073
auuccggcaaauaaca

SEQ ID NO: 635093 - RNA, 12 nt, Escherichia coli CFT073
auugauuuuucc

SEQ ID NO: 635094 - RNA, 13 nt, Escherichia coli CFT073
auugcgcaacaga

SEQ ID NO: 635095 - RNA, 22 nt, Escherichia coli CFT073
auugcgcaacagagccaaagaa

SEQ ID NO: 635096 - RNA, 17 nt, Escherichia coli CFT073
auugcgcaacuuuuucu

SEQ ID NO: 635097 - RNA, 16 nt, Escherichia coli CFT073
auugcgcaccagcuug

SEQ ID NO: 635098 - RNA, 21 nt, Escherichia coli CFT073
auugcgcaccagcuugcgaca

SEQ ID NO: 635099 - RNA, 15 nt, Escherichia coli CFT073
auugauuguuuuaaa

SEQ ID NO: 635100 - RNA, 16 nt, Escherichia coli CFT073
auugauuguuuuaaau

SEQ ID NO: 635101 - RNA, 23 nt, Escherichia coli CFT073
auugauuucuuauucauaucuuc

SEQ ID NO: 635102 - RNA, 17 nt, Escherichia coli CFT073
auugauucacauccugc

SEQ ID NO: 635103 - RNA, 21 nt, Escherichia coli CFT073
auugauucaucucuucuuccg

SEQ ID NO: 635104 - RNA, 17 nt, Escherichia coli CFT073
auugauagauuucucua

SEQ ID NO: 635105 - RNA, 20 nt, Escherichia coli CFT073
auugaucccggcuuccugca

SEQ ID NO: 635106 - RNA, 15 nt, Escherichia coli CFT073
auugcucuuucacuu

SEQ ID NO: 635107 - RNA, 19 nt, Escherichia coli CFT073
auugcucuuucacuuuacc

SEQ ID NO: 635108 - RNA, 18 nt, Escherichia coli CFT073
auugcugacauggcaaua

SEQ ID NO: 635109 - RNA, 21 nt, Escherichia coli CFT073
auugcuuccaguaacacuucc

SEQ ID NO: 635110 - RNA, 22 nt, Escherichia coli CFT073
auugcuuugaucaagcaccgcc

SEQ ID NO: 635111 - RNA, 17 nt, Escherichia coli CFT073
auugcuuuuguuaucaa

SEQ ID NO: 635112 - RNA, 22 nt, Escherichia coli CFT073
auugcuuugcugugaagcaccu

SEQ ID NO: 635113 - RNA, 21 nt, Escherichia coli CFT073
auugcuuugguaaauggcuga

SEQ ID NO: 635114 - RNA, 13 nt, Escherichia coli CFT073
auugcgcauucua

SEQ ID NO: 635115 - RNA, 14 nt, Escherichia coli CFT073
auugcuaucaacaa

SEQ ID NO: 635116 - RNA, 17 nt, Escherichia coli CFT073
auugcuauuucccccuc

SEQ ID NO: 635117 - RNA, 15 nt, Escherichia coli CFT073
auuggcaaaaccaaa

SEQ ID NO: 635118 - RNA, 18 nt, Escherichia coli CFT073
auuggcaaaaccaaacca

SEQ ID NO: 635119 - RNA, 23 nt, Escherichia coli CFT073
auuggcacugcgaccagugaaaa

SEQ ID NO: 635120 - RNA, 20 nt, Escherichia coli CFT073
auuggcaaagccgccagaga

SEQ ID NO: 635121 - RNA, 20 nt, Escherichia coli CFT073
auuggcaauacgauccugag

SEQ ID NO: 635122 - RNA, 20 nt, Escherichia coli CFT073
auuggcacaucuagccugau

SEQ ID NO: 635123 - RNA, 12 nt, Escherichia coli CFT073
auuggaauacga

SEQ ID NO: 635124 - RNA, 20 nt, Escherichia coli CFT073
auuggcagugguaucaauau

SEQ ID NO: 635125 - RNA, 21 nt, Escherichia coli CFT073
auuggccgcgcaauugcugaa

SEQ ID NO: 635126 - RNA, 15 nt, Escherichia coli CFT073
auugggguuacgacc

SEQ ID NO: 635127 - RNA, 14 nt, Escherichia coli CFT073
auuggguucaucug

SEQ ID NO: 635128 - RNA, 12 nt, Escherichia coli CFT073
auuguauaccaa

SEQ ID NO: 635129 - RNA, 23 nt, Escherichia coli CFT073
auuguauuagcccguucuucgcc

SEQ ID NO: 635130 - RNA, 18 nt, Escherichia coli CFT073
auuguauugagauccugc

SEQ ID NO: 635131 - RNA, 22 nt, Escherichia coli CFT073
auugguaauacccagacuuuuc

SEQ ID NO: 635132 - RNA, 23 nt, Escherichia coli CFT073
auugguaauacccagacuuuuca

SEQ ID NO: 635133 - RNA, 15 nt, Escherichia coli CFT073
auugguagacgcacc

SEQ ID NO: 635134 - RNA, 22 nt, Escherichia coli CFT073
auuuaauugguuuugcaggccg

SEQ ID NO: 635135 - RNA, 19 nt, Escherichia coli CFT073
auuuaagccacuuccagca

SEQ ID NO: 635136 - RNA, 18 nt, Escherichia coli CFT073
auuuaagguuaugcaagu

SEQ ID NO: 635137 - RNA, 16 nt, Escherichia coli CFT073
auuuaaacccuuucug

SEQ ID NO: 635138 - RNA, 19 nt, Escherichia coli CFT073
auuguuuuuaucccggcaa

SEQ ID NO: 635139 - RNA, 14 nt, Escherichia coli CFT073
auuuaaaaaugcca

SEQ ID NO: 635140 - RNA, 21 nt, Escherichia coli CFT073
auugugauuaccgcaaaucac

SEQ ID NO: 635141 - RNA, 15 nt, Escherichia coli CFT073
auugugauaaaaauc

SEQ ID NO: 635142 - RNA, 16 nt, Escherichia coli CFT073
auugugaaguauuuaa

SEQ ID NO: 635143 - RNA, 18 nt, Escherichia coli CFT073
auugugaaguauuuaaaa

SEQ ID NO: 635144 - RNA, 14 nt, Escherichia coli CFT073
auugugacaaacug

SEQ ID NO: 635145 - RNA, 19 nt, Escherichia coli CFT073
auuuaccucgguuaacagc

SEQ ID NO: 635146 - RNA, 19 nt, Escherichia coli CFT073
auuuacgauggcagggcag

SEQ ID NO: 635147 - RNA, 19 nt, Escherichia coli CFT073
auuuacgcgucaguuuuuc

SEQ ID NO: 635148 - RNA, 23 nt, Escherichia coli CFT073
auuuacgcugucuuuugaucaaa

SEQ ID NO: 635149 - RNA, 20 nt, Escherichia coli CFT073
auuuacgccgcauccggcaa

SEQ ID NO: 635150 - RNA, 16 nt, Escherichia coli CFT073
auuuacgguauaaccc

SEQ ID NO: 635151 - RNA, 15 nt, Escherichia coli CFT073
auuuacguucuuaca

SEQ ID NO: 635152 - RNA, 21 nt, Escherichia coli CFT073
auuuacuauucaccacuaccg

SEQ ID NO: 635153 - RNA, 17 nt, Escherichia coli CFT073
auuuaccagcacaucuu

SEQ ID NO: 635154 - RNA, 15 nt, Escherichia coli CFT073
auuuacccacagaca

SEQ ID NO: 635155 - RNA, 22 nt, Escherichia coli CFT073
auuuaccgaccucaacaaaaua

SEQ ID NO: 635156 - RNA, 21 nt, Escherichia coli CFT073
auuuacaaucacuucauuccg

SEQ ID NO: 635157 - RNA, 16 nt, Escherichia coli CFT073
auuuagaacugaucaa

SEQ ID NO: 635158 - RNA, 16 nt, Escherichia coli CFT073
auuuacuuucuugcca

SEQ ID NO: 635159 - RNA, 16 nt, Escherichia coli CFT073
auuuagcgacccuggu

SEQ ID NO: 635160 - RNA, 22 nt, Escherichia coli CFT073
auuuagcguuaaaauuucacau

SEQ ID NO: 635161 - RNA, 15 nt, Escherichia coli CFT073
auuuagccagcagcu

SEQ ID NO: 635162 - RNA, 19 nt, Escherichia coli CFT073
auuuagccccggccaguac

SEQ ID NO: 635163 - RNA, 17 nt, Escherichia coli CFT073
auuuugaaggaaaaauc

SEQ ID NO: 635164 - RNA, 18 nt, Escherichia coli CFT073
auuuugcagcuguugcgc

SEQ ID NO: 635165 - RNA, 15 nt, Escherichia coli CFT073
auuuugcaggccuga

SEQ ID NO: 635166 - RNA, 18 nt, Escherichia coli CFT073
auuuugcaggccugauaa

SEQ ID NO: 635167 - RNA, 22 nt, Escherichia coli CFT073
auuuugcagcauucaucacaaa

SEQ ID NO: 635168 - RNA, 22 nt, Escherichia coli CFT073
auuuugacuuuuaauuucaucc

SEQ ID NO: 635169 - RNA, 23 nt, Escherichia coli CFT073
auuuugaguggucgacaaccagc

SEQ ID NO: 635170 - RNA, 12 nt, Escherichia coli CFT073
auuuuguaugcg

SEQ ID NO: 635171 - RNA, 22 nt, Escherichia coli CFT073
auuuugguaauucgccagccaa

SEQ ID NO: 635172 - RNA, 23 nt, Escherichia coli CFT073
auuuugcgagcagcauuccggca

SEQ ID NO: 635173 - RNA, 22 nt, Escherichia coli CFT073
auuuugcgccagugccugacga

SEQ ID NO: 635174 - RNA, 13 nt, Escherichia coli CFT073
auuuugcgcuucu

SEQ ID NO: 635175 - RNA, 16 nt, Escherichia coli CFT073
auuuuuacgaaacaga

SEQ ID NO: 635176 - RNA, 23 nt, Escherichia coli CFT073
auuuuuacaguugguauggcugu

SEQ ID NO: 635177 - RNA, 17 nt, Escherichia coli CFT073
auuuucccuucccgcaa

SEQ ID NO: 635178 - RNA, 21 nt, Escherichia coli CFT073
auuuucccuucccgcaaugca

SEQ ID NO: 635179 - RNA, 22 nt, Escherichia coli CFT073
auuuucccuuccgccaucaauc

SEQ ID NO: 635180 - RNA, 16 nt, Escherichia coli CFT073
auuuucaggucguuca

SEQ ID NO: 635181 - RNA, 13 nt, Escherichia coli CFT073
auuuucagcgugc

SEQ ID NO: 635182 - RNA, 21 nt, Escherichia coli CFT073
auuuucagcgugcccacguuc

SEQ ID NO: 635183 - RNA, 19 nt, Escherichia coli CFT073
auuuucugcgcauuuccca

SEQ ID NO: 635184 - RNA, 13 nt, Escherichia coli CFT073
auuuucugacaag

SEQ ID NO: 635185 - RNA, 23 nt, Escherichia coli CFT073
auuuuccuguugcuguuguucca

SEQ ID NO: 635186 - RNA, 15 nt, Escherichia coli CFT073
auuuucucacuggcg

SEQ ID NO: 635187 - RNA, 21 nt, Escherichia coli CFT073
auuuucucgugccgccaguac

SEQ ID NO: 635188 - RNA, 15 nt, Escherichia coli CFT073
auuuuaaaauuguag

SEQ ID NO: 635189 - RNA, 22 nt, Escherichia coli CFT073
auuuuaaacggcauaaauuuca

SEQ ID NO: 635190 - RNA, 22 nt, Escherichia coli CFT073
auuuucagaaggauaauuaauc

SEQ ID NO: 635191 - RNA, 20 nt, Escherichia coli CFT073
auuuuauugcguaaucuuuu

SEQ ID NO: 635192 - RNA, 22 nt, Escherichia coli CFT073
auuuuauugcguaaucuuuuca

SEQ ID NO: 635193 - RNA, 16 nt, Escherichia coli CFT073
auuuucaccaucgcca

SEQ ID NO: 635194 - RNA, 17 nt, Escherichia coli CFT073
auuuuauggcagaauac

SEQ ID NO: 635195 - RNA, 14 nt, Escherichia coli CFT073
caaaaaaauuucau

SEQ ID NO: 635196 - RNA, 21 nt, Escherichia coli CFT073
caaaaaacaaaccccguacag

SEQ ID NO: 635197 - RNA, 14 nt, Escherichia coli CFT073
caaaaaacggaaag

SEQ ID NO: 635198 - RNA, 13 nt, Escherichia coli CFT073
caaaaaaccaucc

SEQ ID NO: 635199 - RNA, 17 nt, Escherichia coli CFT073
caaaaaagaaggaaaau

SEQ ID NO: 635200 - RNA, 19 nt, Escherichia coli CFT073
caaaaaagaaggaaaauac

SEQ ID NO: 635201 - RNA, 13 nt, Escherichia coli CFT073
caaaaaagcccag

SEQ ID NO: 635202 - RNA, 18 nt, Escherichia coli CFT073
caaaaaagccggagcgac

SEQ ID NO: 635203 - RNA, 21 nt, Escherichia coli CFT073
auuuuuaucguugugguuaaa

SEQ ID NO: 635204 - RNA, 20 nt, Escherichia coli CFT073
auuuuuauauagccagccuc

SEQ ID NO: 635205 - RNA, 19 nt, Escherichia coli CFT073
auuuuuauuaaauauuaua

SEQ ID NO: 635206 - RNA, 22 nt, Escherichia coli CFT073
auuuuuauuaaauauuauaugu

SEQ ID NO: 635207 - RNA, 18 nt, Escherichia coli CFT073
auuuuuguuucacacuga

SEQ ID NO: 635208 - RNA, 16 nt, Escherichia coli CFT073
auuuuugugaagaaua

SEQ ID NO: 635209 - RNA, 12 nt, Escherichia coli CFT073
auuuuuugcaaa

SEQ ID NO: 635210 - RNA, 13 nt, Escherichia coli CFT073
auuuuuugaaaaa

SEQ ID NO: 635211 - RNA, 14 nt, Escherichia coli CFT073
caaaaacaccgcug

SEQ ID NO: 635212 - RNA, 23 nt, Escherichia coli CFT073
caaaaaagccaauuacaaaaagu

SEQ ID NO: 635213 - RNA, 15 nt, Escherichia coli CFT073
caaaaacccugccgu

SEQ ID NO: 635214 - RNA, 15 nt, Escherichia coli CFT073
caaaaaggggaaaaa

SEQ ID NO: 635215 - RNA, 19 nt, Escherichia coli CFT073
caaaaaggggaaaaauuca

SEQ ID NO: 635216 - RNA, 14 nt, Escherichia coli CFT073
caaaaaucaauggc

SEQ ID NO: 635217 - RNA, 19 nt, Escherichia coli CFT073
caaaaaucaauggcccauu

SEQ ID NO: 635218 - RNA, 21 nt, Escherichia coli CFT073
caaaaaguaguuccagcauga

SEQ ID NO: 635219 - RNA, 15 nt, Escherichia coli CFT073
caaaaauaaucaucu

SEQ ID NO: 635220 - RNA, 15 nt, Escherichia coli CFT073
caaaacagccugcgu

SEQ ID NO: 635221 - RNA, 19 nt, Escherichia coli CFT073
caaaacagcgacaccagcc

SEQ ID NO: 635222 - RNA, 20 nt, Escherichia coli CFT073
caaaacauacccaguuucau

SEQ ID NO: 635223 - RNA, 20 nt, Escherichia coli CFT073
caaaacauaucccaccagcg

SEQ ID NO: 635224 - RNA, 19 nt, Escherichia coli CFT073
caaaacauguggauuaaau

SEQ ID NO: 635225 - RNA, 14 nt, Escherichia coli CFT073
caaaaccaaaccag

SEQ ID NO: 635226 - RNA, 15 nt, Escherichia coli CFT073
caaaaccaaaccagc

SEQ ID NO: 635227 - RNA, 17 nt, Escherichia coli CFT073
caaaacagaaacccauu

SEQ ID NO: 635228 - RNA, 12 nt, Escherichia coli CFT073
caaaaaucgaca

SEQ ID NO: 635229 - RNA, 18 nt, Escherichia coli CFT073
auuugcggugaagccacc

SEQ ID NO: 635230 - RNA, 20 nt, Escherichia coli CFT073
auuugcggugaagccaccag

SEQ ID NO: 635231 - RNA, 15 nt, Escherichia coli CFT073
auuugcguaaaaccu

SEQ ID NO: 635232 - RNA, 14 nt, Escherichia coli CFT073
auuugcgaguccgc

SEQ ID NO: 635233 - RNA, 23 nt, Escherichia coli CFT073
auuugcgacaaagcucaccugag

SEQ ID NO: 635234 - RNA, 12 nt, Escherichia coli CFT073
auuugccaggcu

SEQ ID NO: 635235 - RNA, 18 nt, Escherichia coli CFT073
auuugcaggcuaaaaacg

SEQ ID NO: 635236 - RNA, 15 nt, Escherichia coli CFT073
auuugcaucaucaag

SEQ ID NO: 635237 - RNA, 13 nt, Escherichia coli CFT073
auuucuuuuaugg

SEQ ID NO: 635238 - RNA, 15 nt, Escherichia coli CFT073
auuucuuuguuuccc

SEQ ID NO: 635239 - RNA, 17 nt, Escherichia coli CFT073
auuucuuuacugacagg

SEQ ID NO: 635240 - RNA, 20 nt, Escherichia coli CFT073
auuucuuuaugggcauuucu

SEQ ID NO: 635241 - RNA, 18 nt, Escherichia coli CFT073
auuugacauuuuuucauc

SEQ ID NO: 635242 - RNA, 15 nt, Escherichia coli CFT073
auuugaauuucaaau

SEQ ID NO: 635243 - RNA, 21 nt, Escherichia coli CFT073
auuugcuuguuucauuacucg

SEQ ID NO: 635244 - RNA, 15 nt, Escherichia coli CFT073
auuugcugcuggcau

SEQ ID NO: 635245 - RNA, 21 nt, Escherichia coli CFT073
auuugcugcuggcaucaccaa

SEQ ID NO: 635246 - RNA, 22 nt, Escherichia coli CFT073
auuugcugcuggcaucaccaaa

SEQ ID NO: 635247 - RNA, 21 nt, Escherichia coli CFT073
auuugcugguggcauuuuuau

SEQ ID NO: 635248 - RNA, 21 nt, Escherichia coli CFT073
auuugcuguagaugacacuca

SEQ ID NO: 635249 - RNA, 15 nt, Escherichia coli CFT073
auuugguagaauuug

SEQ ID NO: 635250 - RNA, 14 nt, Escherichia coli CFT073
auuuggcugccgag

SEQ ID NO: 635251 - RNA, 15 nt, Escherichia coli CFT073
auuuguccacgccgc

SEQ ID NO: 635252 - RNA, 19 nt, Escherichia coli CFT073
auuugucgauuuccaucuc

SEQ ID NO: 635253 - RNA, 13 nt, Escherichia coli CFT073
auuuguucuggug

SEQ ID NO: 635254 - RNA, 17 nt, Escherichia coli CFT073
auuuguugagcuggaag

SEQ ID NO: 635255 - RNA, 16 nt, Escherichia coli CFT073
auuuguucagcaaaug

SEQ ID NO: 635256 - RNA, 12 nt, Escherichia coli CFT073
auuugugucaga

SEQ ID NO: 635257 - RNA, 15 nt, Escherichia coli CFT073
auuugugauuuguca

SEQ ID NO: 635258 - RNA, 16 nt, Escherichia coli CFT073
auuuaguauuuuaugg

SEQ ID NO: 635259 - RNA, 22 nt, Escherichia coli CFT073
auuuaguucauauaauuauuuu

SEQ ID NO: 635260 - RNA, 11 nt, Escherichia coli CFT073
auuucagaaaa

SEQ ID NO: 635261 - RNA, 19 nt, Escherichia coli CFT073
auuucacuucaaccacauu

SEQ ID NO: 635262 - RNA, 18 nt, Escherichia coli CFT073
auuucagaccuguugccc

SEQ ID NO: 635263 - RNA, 22 nt, Escherichia coli CFT073
auuucauuaagaacuccugaaa

SEQ ID NO: 635264 - RNA, 23 nt, Escherichia coli CFT073
auuucauucaggcccgucacgca

SEQ ID NO: 635265 - RNA, 17 nt, Escherichia coli CFT073
auuucaugcucaccaau

SEQ ID NO: 635266 - RNA, 18 nt, Escherichia coli CFT073
auuucaugcucaccaauc

SEQ ID NO: 635267 - RNA, 23 nt, Escherichia coli CFT073
auuucauggcggaaaucagagau

SEQ ID NO: 635268 - RNA, 18 nt, Escherichia coli CFT073
auuucauccuguaugaca

SEQ ID NO: 635269 - RNA, 14 nt, Escherichia coli CFT073
auuucaucaccagc

SEQ ID NO: 635270 - RNA, 17 nt, Escherichia coli CFT073
auuucuacacccagccc

SEQ ID NO: 635271 - RNA, 14 nt, Escherichia coli CFT073
auuucgauauguuc

SEQ ID NO: 635272 - RNA, 14 nt, Escherichia coli CFT073
auuucgaucauagu

SEQ ID NO: 635273 - RNA, 12 nt, Escherichia coli CFT073
auuucgccgcac

SEQ ID NO: 635274 - RNA, 22 nt, Escherichia coli CFT073
auuucgauuuguucugguguua

SEQ ID NO: 635275 - RNA, 19 nt, Escherichia coli CFT073
auuucgccaucaagaacac

SEQ ID NO: 635276 - RNA, 23 nt, Escherichia coli CFT073
auuuccuucgcuuccuguauauc

SEQ ID NO: 635277 - RNA, 20 nt, Escherichia coli CFT073
auuuccugcgcuuucugcuu

SEQ ID NO: 635278 - RNA, 23 nt, Escherichia coli CFT073
auuuccucgagccuuauccgacu

SEQ ID NO: 635279 - RNA, 17 nt, Escherichia coli CFT073
auuuccagaccuaaaaa

SEQ ID NO: 635280 - RNA, 14 nt, Escherichia coli CFT073
auuuccucaacauc

SEQ ID NO: 635281 - RNA, 22 nt, Escherichia coli CFT073
auuuccucaacaucuucaccaa

SEQ ID NO: 635282 - RNA, 15 nt, Escherichia coli CFT073
auuuccagaaaguga

SEQ ID NO: 635283 - RNA, 14 nt, Escherichia coli CFT073
auuuccagcucaaa

SEQ ID NO: 635284 - RNA, 22 nt, Escherichia coli CFT073
auuuccagggccucuccuuuac

SEQ ID NO: 635285 - RNA, 15 nt, Escherichia coli CFT073
auuuccaagauuaaa

SEQ ID NO: 635286 - RNA, 20 nt, Escherichia coli CFT073
cacguaucaacaucacacca

SEQ ID NO: 635287 - RNA, 23 nt, Escherichia coli CFT073
cacgucauauucgccaucagcca

SEQ ID NO: 635288 - RNA, 18 nt, Escherichia coli CFT073
cacguccaguggcauccg

SEQ ID NO: 635289 - RNA, 20 nt, Escherichia coli CFT073
cacguccaguggcauccgcu

SEQ ID NO: 635290 - RNA, 19 nt, Escherichia coli CFT073
cacguaggcgaucccagcg

SEQ ID NO: 635291 - RNA, 18 nt, Escherichia coli CFT073
cacguaauaaaaucuauu

SEQ ID NO: 635292 - RNA, 22 nt, Escherichia coli CFT073
cacgguuuuuugcagcaaccag

SEQ ID NO: 635293 - RNA, 22 nt, Escherichia coli CFT073
cacgguuaauggccggaagcua

SEQ ID NO: 635294 - RNA, 23 nt, Escherichia coli CFT073
cacgguucgcuggcaaguucguc

SEQ ID NO: 635295 - RNA, 14 nt, Escherichia coli CFT073
cacggucauaugca

SEQ ID NO: 635296 - RNA, 22 nt, Escherichia coli CFT073
cacggucggccaguauuugucu

SEQ ID NO: 635297 - RNA, 15 nt, Escherichia coli CFT073
cacggugcuccagug

SEQ ID NO: 635298 - RNA, 19 nt, Escherichia coli CFT073
cacggugcuccagugcgcu

SEQ ID NO: 635299 - RNA, 19 nt, Escherichia coli CFT073
cacggaauauuucaccggu

SEQ ID NO: 635300 - RNA, 21 nt, Escherichia coli CFT073
cacgcuuuuaacacguugcaa

SEQ ID NO: 635301 - RNA, 17 nt, Escherichia coli CFT073
cacggaaagcagcauac

SEQ ID NO: 635302 - RNA, 17 nt, Escherichia coli CFT073
cacggacgcuuguuauc

SEQ ID NO: 635303 - RNA, 14 nt, Escherichia coli CFT073
cacggcaugaaagc

SEQ ID NO: 635304 - RNA, 18 nt, Escherichia coli CFT073
cacggcauaagccguccc

SEQ ID NO: 635305 - RNA, 22 nt, Escherichia coli CFT073
cacggcguuuauucuggagugu

SEQ ID NO: 635306 - RNA, 14 nt, Escherichia coli CFT073
cacggcucaaccuu

SEQ ID NO: 635307 - RNA, 19 nt, Escherichia coli CFT073
cacggcucaaccuucuucg

SEQ ID NO: 635308 - RNA, 20 nt, Escherichia coli CFT073
cacgcucuguucugcgccug

SEQ ID NO: 635309 - RNA, 14 nt, Escherichia coli CFT073
cacgcuguucaucc

SEQ ID NO: 635310 - RNA, 15 nt, Escherichia coli CFT073
cacgcuguaaugcua

SEQ ID NO: 635311 - RNA, 17 nt, Escherichia coli CFT073
cacgcugucggcacuga

SEQ ID NO: 635312 - RNA, 12 nt, Escherichia coli CFT073
cacgcugccugg

SEQ ID NO: 635313 - RNA, 17 nt, Escherichia coli CFT073
cacgcugcgcugcacca

SEQ ID NO: 635314 - RNA, 14 nt, Escherichia coli CFT073
cacgccaccagcgu

SEQ ID NO: 635315 - RNA, 22 nt, Escherichia coli CFT073
cacgccaacguguugcugcaug

SEQ ID NO: 635316 - RNA, 19 nt, Escherichia coli CFT073
cacgccaagaaacuggcug

SEQ ID NO: 635317 - RNA, 15 nt, Escherichia coli CFT073
cacgccagagauaac

SEQ ID NO: 635318 - RNA, 16 nt, Escherichia coli CFT073
cacgccagccgccagc

SEQ ID NO: 635319 - RNA, 19 nt, Escherichia coli CFT073
cacgccagcguugaugcuc

SEQ ID NO: 635320 - RNA, 20 nt, Escherichia coli CFT073
cacgccgcugucuaccagca

SEQ ID NO: 635321 - RNA, 14 nt, Escherichia coli CFT073
cacgcccgcgaagc

SEQ ID NO: 635322 - RNA, 13 nt, Escherichia coli CFT073
cacgcccaguccg

SEQ ID NO: 635323 - RNA, 17 nt, Escherichia coli CFT073
cacgcccauacauacca

SEQ ID NO: 635324 - RNA, 14 nt, Escherichia coli CFT073
cacgcccagcacau

SEQ ID NO: 635325 - RNA, 12 nt, Escherichia coli CFT073
cacgauaucaau

SEQ ID NO: 635326 - RNA, 16 nt, Escherichia coli CFT073
cacgaucaagagaucc

SEQ ID NO: 635327 - RNA, 16 nt, Escherichia coli CFT073
cacgcaauugcugccc

SEQ ID NO: 635328 - RNA, 14 nt, Escherichia coli CFT073
cacgcaccaccagc

SEQ ID NO: 635329 - RNA, 15 nt, Escherichia coli CFT073
cacgcaccaccagcg

SEQ ID NO: 635330 - RNA, 20 nt, Escherichia coli CFT073
cacgcauuugcagcaaauag

SEQ ID NO: 635331 - RNA, 13 nt, Escherichia coli CFT073
cacgcauuaauaa

SEQ ID NO: 635332 - RNA, 14 nt, Escherichia coli CFT073
cacgcauuaauaag

SEQ ID NO: 635333 - RNA, 21 nt, Escherichia coli CFT073
cacgcauacaguaucgccugu

SEQ ID NO: 635334 - RNA, 18 nt, Escherichia coli CFT073
cacgcagcggcggcacug

SEQ ID NO: 635335 - RNA, 21 nt, Escherichia coli CFT073
cacgcagcugcgcguuaucua

SEQ ID NO: 635336 - RNA, 15 nt, Escherichia coli CFT073
cacgcagaccaaccg

SEQ ID NO: 635337 - RNA, 15 nt, Escherichia coli CFT073
cacgcagcaagccgu

SEQ ID NO: 635338 - RNA, 16 nt, Escherichia coli CFT073
cacgaauaccaagcag

SEQ ID NO: 635339 - RNA, 15 nt, Escherichia coli CFT073
aaaauacucagcacc

SEQ ID NO: 635340 - RNA, 18 nt, Escherichia coli CFT073
cacgauacaccagauggu

SEQ ID NO: 635341 - RNA, 16 nt, Escherichia coli CFT073
cacgaccuugccaagg

SEQ ID NO: 635342 - RNA, 12 nt, Escherichia coli CFT073
cacgacgccagc

SEQ ID NO: 635343 - RNA, 17 nt, Escherichia coli CFT073
cacgacgcgccagcagc

SEQ ID NO: 635344 - RNA, 13 nt, Escherichia coli CFT073
caccuucuccggc

SEQ ID NO: 635345 - RNA, 22 nt, Escherichia coli CFT073
caccugcgcggccagugccagu

SEQ ID NO: 635346 - RNA, 15 nt, Escherichia coli CFT073
caccugccagcaucu

SEQ ID NO: 635347 - RNA, 16 nt, Escherichia coli CFT073
caccugccagcaucuc

SEQ ID NO: 635348 - RNA, 18 nt, Escherichia coli CFT073
caccugccagcaucucca

SEQ ID NO: 635349 - RNA, 15 nt, Escherichia coli CFT073
caccugccaguuuac

SEQ ID NO: 635350 - RNA, 19 nt, Escherichia coli CFT073
caccuuuccccggcagcau

SEQ ID NO: 635351 - RNA, 13 nt, Escherichia coli CFT073
caccuuuuuaauc

SEQ ID NO: 635352 - RNA, 17 nt, Escherichia coli CFT073
aaaauaacgaucaucac

SEQ ID NO: 635353 - RNA, 16 nt, Escherichia coli CFT073
caccggcaaucugcug

SEQ ID NO: 635354 - RNA, 13 nt, Escherichia coli CFT073
caccggcaccacu

SEQ ID NO: 635355 - RNA, 14 nt, Escherichia coli CFT073
caccggcaccacuu

SEQ ID NO: 635356 - RNA, 19 nt, Escherichia coli CFT073
caccggauaacgccggcuu

SEQ ID NO: 635357 - RNA, 21 nt, Escherichia coli CFT073
caccgguguaggcauacacau

SEQ ID NO: 635358 - RNA, 15 nt, Escherichia coli CFT073
caccgguacaaacau

SEQ ID NO: 635359 - RNA, 24 nt, Escherichia coli CFT073
caccggugaccaucagcaugacaa

SEQ ID NO: 635360 - RNA, 15 nt, Escherichia coli CFT073
caccgggccgaugcg

SEQ ID NO: 635361 - RNA, 20 nt, Escherichia coli CFT073
caccgggggguugccgccac

SEQ ID NO: 635362 - RNA, 13 nt, Escherichia coli CFT073
caccucuucaccg

SEQ ID NO: 635363 - RNA, 19 nt, Escherichia coli CFT073
caccucugucgaugcgcuc

SEQ ID NO: 635364 - RNA, 23 nt, Escherichia coli CFT073
caccucuuuuucgacuuccacca

SEQ ID NO: 635365 - RNA, 19 nt, Escherichia coli CFT073
caccugaaauggucgcccc

SEQ ID NO: 635366 - RNA, 16 nt, Escherichia coli CFT073
caccugaucaauuucu

SEQ ID NO: 635367 - RNA, 18 nt, Escherichia coli CFT073
caccugaucaauuucugc

SEQ ID NO: 635368 - RNA, 20 nt, Escherichia coli CFT073
caccugaucaauuucugcgc

SEQ ID NO: 635369 - RNA, 21 nt, Escherichia coli CFT073
caccugauccagcucuuccuc

SEQ ID NO: 635370 - RNA, 13 nt, Escherichia coli CFT073
caccugauuaccu

SEQ ID NO: 635371 - RNA, 20 nt, Escherichia coli CFT073
caccugcacaccaaccgcuu

SEQ ID NO: 635372 - RNA, 20 nt, Escherichia coli CFT073
caccugcacaggcauucaga

SEQ ID NO: 635373 - RNA, 23 nt, Escherichia coli CFT073
caccugauugaccgccagcgcca

SEQ ID NO: 635374 - RNA, 18 nt, Escherichia coli CFT073
caccguaccaucauaagc

SEQ ID NO: 635375 - RNA, 15 nt, Escherichia coli CFT073
caccguacuccugug

SEQ ID NO: 635376 - RNA, 13 nt, Escherichia coli CFT073
caccguagaaggc

SEQ ID NO: 635377 - RNA, 23 nt, Escherichia coli CFT073
caccgugaaagagaucaaaguga

SEQ ID NO: 635378 - RNA, 19 nt, Escherichia coli CFT073
caccgugccgcuguucuga

SEQ ID NO: 635379 - RNA, 15 nt, Escherichia coli CFT073
caccguguucaugac

SEQ ID NO: 635380 - RNA, 21 nt, Escherichia coli CFT073
caccucggcacugacgcgcuu

SEQ ID NO: 635381 - RNA, 20 nt, Escherichia coli CFT073
cacccgcguuacgccaucug

SEQ ID NO: 635382 - RNA, 18 nt, Escherichia coli CFT073
cacccguugaucuucucu

SEQ ID NO: 635383 - RNA, 22 nt, Escherichia coli CFT073
cacccguugaucuucucuuaua

SEQ ID NO: 635384 - RNA, 19 nt, Escherichia coli CFT073
cacccuaacccucucccca

SEQ ID NO: 635385 - RNA, 12 nt, Escherichia coli CFT073
caccauuuuuau

SEQ ID NO: 635386 - RNA, 15 nt, Escherichia coli CFT073
caccauuuccggaga

SEQ ID NO: 635387 - RNA, 20 nt, Escherichia coli CFT073
caccauuuccggagacagcu

SEQ ID NO: 635388 - RNA, 18 nt, Escherichia coli CFT073
caccauugccggaugcgg

SEQ ID NO: 635389 - RNA, 17 nt, Escherichia coli CFT073
cacccgagagaacugcu

SEQ ID NO: 635390 - RNA, 14 nt, Escherichia coli CFT073
cacccacaccaccg

SEQ ID NO: 635391 - RNA, 15 nt, Escherichia coli CFT073
cacccaccagcgccg

SEQ ID NO: 635392 - RNA, 13 nt, Escherichia coli CFT073
caccgcgcccaca

SEQ ID NO: 635393 - RNA, 16 nt, Escherichia coli CFT073
caccgcgcccacauaa

SEQ ID NO: 635394 - RNA, 23 nt, Escherichia coli CFT073
caccgcgcccacauaaccaauca

SEQ ID NO: 635395 - RNA, 22 nt, Escherichia coli CFT073
caccgccguuaccuucggcccc

SEQ ID NO: 635396 - RNA, 15 nt, Escherichia coli CFT073
caccgccgccgccac

SEQ ID NO: 635397 - RNA, 15 nt, Escherichia coli CFT073
caccgccgaggccga

SEQ ID NO: 635398 - RNA, 13 nt, Escherichia coli CFT073
caccgccgccacu

SEQ ID NO: 635399 - RNA, 14 nt, Escherichia coli CFT073
caccgcccagagaa

SEQ ID NO: 635400 - RNA, 20 nt, Escherichia coli CFT073
caccgccaggcacuucccag

SEQ ID NO: 635401 - RNA, 19 nt, Escherichia coli CFT073
caccgaaguucguacaccc

SEQ ID NO: 635402 - RNA, 20 nt, Escherichia coli CFT073
caccgacaaccggugcugcg

SEQ ID NO: 635403 - RNA, 15 nt, Escherichia coli CFT073
caccgauugcaggaa

SEQ ID NO: 635404 - RNA, 21 nt, Escherichia coli CFT073
caccgauuuugccuucauacu

SEQ ID NO: 635405 - RNA, 14 nt, Escherichia coli CFT073
caccgcaaacugcu

SEQ ID NO: 635406 - RNA, 17 nt, Escherichia coli CFT073
caccgcaaacugcuguu

SEQ ID NO: 635407 - RNA, 22 nt, Escherichia coli CFT073
caccgcaaagaaacgcgcggca

SEQ ID NO: 635408 - RNA, 19 nt, Escherichia coli CFT073
caccgcaaccgccaacagc

SEQ ID NO: 635409 - RNA, 16 nt, Escherichia coli CFT073
caccgccagcaggaac

SEQ ID NO: 635410 - RNA, 14 nt, Escherichia coli CFT073
caccgccaccagcg

SEQ ID NO: 635411 - RNA, 23 nt, Escherichia coli CFT073
caccagugguuaccgaauccagc

SEQ ID NO: 635412 - RNA, 16 nt, Escherichia coli CFT073
caccaguucgccuuca

SEQ ID NO: 635413 - RNA, 23 nt, Escherichia coli CFT073
caccaguugguagguccagccgc

SEQ ID NO: 635414 - RNA, 14 nt, Escherichia coli CFT073
caccauauccagcg

SEQ ID NO: 635415 - RNA, 16 nt, Escherichia coli CFT073
caccauauucagcagc

SEQ ID NO: 635416 - RNA, 16 nt, Escherichia coli CFT073
caccaucaaacagccc

SEQ ID NO: 635417 - RNA, 17 nt, Escherichia coli CFT073
caccaucaaacagcccc

SEQ ID NO: 635418 - RNA, 18 nt, Escherichia coli CFT073
caccaucaaacagccccu

SEQ ID NO: 635419 - RNA, 19 nt, Escherichia coli CFT073
caccaucaaacagccccug

SEQ ID NO: 635420 - RNA, 13 nt, Escherichia coli CFT073
caccaucaacaaa

SEQ ID NO: 635421 - RNA, 16 nt, Escherichia coli CFT073
caccauaauauaagga

SEQ ID NO: 635422 - RNA, 15 nt, Escherichia coli CFT073
caccauaaugaccaa

SEQ ID NO: 635423 - RNA, 21 nt, Escherichia coli CFT073
caccauaaaucagaucgacgc

SEQ ID NO: 635424 - RNA, 13 nt, Escherichia coli CFT073
caccauccccuuu

SEQ ID NO: 635425 - RNA, 17 nt, Escherichia coli CFT073
caccauccgcccacacc

SEQ ID NO: 635426 - RNA, 20 nt, Escherichia coli CFT073
caccaucgauuuacugccaa

SEQ ID NO: 635427 - RNA, 18 nt, Escherichia coli CFT073
caccaucgcuucaugccc

SEQ ID NO: 635428 - RNA, 17 nt, Escherichia coli CFT073
caccaucggacggaaga

SEQ ID NO: 635429 - RNA, 15 nt, Escherichia coli CFT073
caccaugccgauggc

SEQ ID NO: 635430 - RNA, 21 nt, Escherichia coli CFT073
caccaucguugcuaacggcca

SEQ ID NO: 635431 - RNA, 20 nt, Escherichia coli CFT073
caccaucucaagcauuaccu

SEQ ID NO: 635432 - RNA, 19 nt, Escherichia coli CFT073
caccagccccagaacucac

SEQ ID NO: 635433 - RNA, 20 nt, Escherichia coli CFT073
caccagcgacagccagccca

SEQ ID NO: 635434 - RNA, 21 nt, Escherichia coli CFT073
caccagaaacagaguauaaaa

SEQ ID NO: 635435 - RNA, 23 nt, Escherichia coli CFT073
caccagaacgacgaccgccgcuc

SEQ ID NO: 635436 - RNA, 18 nt, Escherichia coli CFT073
caccagaacucccuguuc

SEQ ID NO: 635437 - RNA, 14 nt, Escherichia coli CFT073
caccagaaucgcca

SEQ ID NO: 635438 - RNA, 15 nt, Escherichia coli CFT073
caccagaaucgccag

SEQ ID NO: 635439 - RNA, 19 nt, Escherichia coli CFT073
caccagaaucgccagcauc

SEQ ID NO: 635440 - RNA, 14 nt, Escherichia coli CFT073
aaaaguuauuaaaa

SEQ ID NO: 635441 - RNA, 21 nt, Escherichia coli CFT073
aaaaguuuccuguuucucauu

SEQ ID NO: 635442 - RNA, 20 nt, Escherichia coli CFT073
aaaaguuugaucggagaaca

SEQ ID NO: 635443 - RNA, 24 nt, Escherichia coli CFT073
aaaaguuugaucggagaacaggaa

SEQ ID NO: 635444 - RNA, 15 nt, Escherichia coli CFT073
caccaggccgcgcag

SEQ ID NO: 635445 - RNA, 13 nt, Escherichia coli CFT073
caccaggaagccu

SEQ ID NO: 635446 - RNA, 17 nt, Escherichia coli CFT073
caccaggaagccuuccg

SEQ ID NO: 635447 - RNA, 20 nt, Escherichia coli CFT073
caccagcgcaauauguuucc

SEQ ID NO: 635448 - RNA, 16 nt, Escherichia coli CFT073
cacaguuuuacugcag

SEQ ID NO: 635449 - RNA, 13 nt, Escherichia coli CFT073
cacauaaauaaca

SEQ ID NO: 635450 - RNA, 23 nt, Escherichia coli CFT073
cacaguuuugagugauuccguuc

SEQ ID NO: 635451 - RNA, 20 nt, Escherichia coli CFT073
cacaucgguuugcgcagcuu

SEQ ID NO: 635452 - RNA, 23 nt, Escherichia coli CFT073
cacauaaugaugccgucuuuauc

SEQ ID NO: 635453 - RNA, 17 nt, Escherichia coli CFT073
cacauaauugagcagca

SEQ ID NO: 635454 - RNA, 21 nt, Escherichia coli CFT073
cacauaaccagguaaagacca

SEQ ID NO: 635455 - RNA, 20 nt, Escherichia coli CFT073
cacauaaccguacaaccguu

SEQ ID NO: 635456 - RNA, 14 nt, Escherichia coli CFT073
cacauaagcugaau

SEQ ID NO: 635457 - RNA, 14 nt, Escherichia coli CFT073
cacaucucaaaucu

SEQ ID NO: 635458 - RNA, 14 nt, Escherichia coli CFT073
cacaugcccuucac

SEQ ID NO: 635459 - RNA, 15 nt, Escherichia coli CFT073
cacaugaugauggcu

SEQ ID NO: 635460 - RNA, 20 nt, Escherichia coli CFT073
cacaugaucauucaccagcc

SEQ ID NO: 635461 - RNA, 22 nt, Escherichia coli CFT073
cacaugaucauucaccagccca

SEQ ID NO: 635462 - RNA, 18 nt, Escherichia coli CFT073
cacaugcacauccacgcc

SEQ ID NO: 635463 - RNA, 16 nt, Escherichia coli CFT073
cacauuucucugucag

SEQ ID NO: 635464 - RNA, 17 nt, Escherichia coli CFT073
caccaaguucuucacug

SEQ ID NO: 635465 - RNA, 21 nt, Escherichia coli CFT073
caccaauaaccggcacuucaa

SEQ ID NO: 635466 - RNA, 16 nt, Escherichia coli CFT073
caccaauaaugucgcu

SEQ ID NO: 635467 - RNA, 17 nt, Escherichia coli CFT073
cacauuguuaaagcccu

SEQ ID NO: 635468 - RNA, 20 nt, Escherichia coli CFT073
cacaugucaguugcauacca

SEQ ID NO: 635469 - RNA, 10 nt, Escherichia coli CFT073
cacauguugc

SEQ ID NO: 635470 - RNA, 21 nt, Escherichia coli CFT073
cacauucuccgccgaagacaa

SEQ ID NO: 635471 - RNA, 23 nt, Escherichia coli CFT073
cacauucugcauugcgcugaaca

SEQ ID NO: 635472 - RNA, 22 nt, Escherichia coli CFT073
cacaugguuuacggcggucugg

SEQ ID NO: 635473 - RNA, 14 nt, Escherichia coli CFT073
cacauggagcuuua

SEQ ID NO: 635474 - RNA, 19 nt, Escherichia coli CFT073
cacaugcugacuacuuuca

SEQ ID NO: 635475 - RNA, 18 nt, Escherichia coli CFT073
cacaugcuggaaccacag

SEQ ID NO: 635476 - RNA, 15 nt, Escherichia coli CFT073
cacaugcggcgugcc

SEQ ID NO: 635477 - RNA, 23 nt, Escherichia coli CFT073
caccaaugccaauguagccacgg

SEQ ID NO: 635478 - RNA, 17 nt, Escherichia coli CFT073
caccaauguggaaagcc

SEQ ID NO: 635479 - RNA, 20 nt, Escherichia coli CFT073
caccaauugugguacgcuuu

SEQ ID NO: 635480 - RNA, 19 nt, Escherichia coli CFT073
caccaauuuuaaaaccacc

SEQ ID NO: 635481 - RNA, 19 nt, Escherichia coli CFT073
caccaaugauaaguuucac

SEQ ID NO: 635482 - RNA, 15 nt, Escherichia coli CFT073
caccaaugacagccc

SEQ ID NO: 635483 - RNA, 15 nt, Escherichia coli CFT073
caccaaucagcccug

SEQ ID NO: 635484 - RNA, 18 nt, Escherichia coli CFT073
caccaaucgucaaugccg

SEQ ID NO: 635485 - RNA, 12 nt, Escherichia coli CFT073
caccaauaccag

SEQ ID NO: 635486 - RNA, 22 nt, Escherichia coli CFT073
caccaauacuugcgaaucauua

SEQ ID NO: 635487 - RNA, 20 nt, Escherichia coli CFT073
caccaauaucaaucuucucu

SEQ ID NO: 635488 - RNA, 19 nt, Escherichia coli CFT073
caccaccgcccguuccacc

SEQ ID NO: 635489 - RNA, 16 nt, Escherichia coli CFT073
caccaccgauaaaaua

SEQ ID NO: 635490 - RNA, 19 nt, Escherichia coli CFT073
caccaccgacgggccugca

SEQ ID NO: 635491 - RNA, 20 nt, Escherichia coli CFT073
caccaccgcuaacugcugcg

SEQ ID NO: 635492 - RNA, 24 nt, Escherichia coli CFT073
caccacgguuuuuugcagcaacca

SEQ ID NO: 635493 - RNA, 21 nt, Escherichia coli CFT073
caccacggcuauaccccaccc

SEQ ID NO: 635494 - RNA, 14 nt, Escherichia coli CFT073
caccaccucuucca

SEQ ID NO: 635495 - RNA, 17 nt, Escherichia coli CFT073
caccaccucuuccagcg

SEQ ID NO: 635496 - RNA, 19 nt, Escherichia coli CFT073
cacaccccgcgccgcugag

SEQ ID NO: 635497 - RNA, 15 nt, Escherichia coli CFT073
cacaccggcaccacg

SEQ ID NO: 635498 - RNA, 15 nt, Escherichia coli CFT073
cacaccgcggaacgc

SEQ ID NO: 635499 - RNA, 22 nt, Escherichia coli CFT073
cacacugguucccagagcuuuu

SEQ ID NO: 635500 - RNA, 15 nt, Escherichia coli CFT073
cacagaauggcauua

SEQ ID NO: 635501 - RNA, 21 nt, Escherichia coli CFT073
cacacugacuuuaccugccug

SEQ ID NO: 635502 - RNA, 18 nt, Escherichia coli CFT073
cacacugaugacaggcua

SEQ ID NO: 635503 - RNA, 23 nt, Escherichia coli CFT073
cacacugaugacaggcuacugcc

SEQ ID NO: 635504 - RNA, 17 nt, Escherichia coli CFT073
cacacugcggccagcau

SEQ ID NO: 635505 - RNA, 13 nt, Escherichia coli CFT073
cacacugaauaaa

SEQ ID NO: 635506 - RNA, 13 nt, Escherichia coli CFT073
cacaccugcucag

SEQ ID NO: 635507 - RNA, 22 nt, Escherichia coli CFT073
cacaccugcucagcacgccacu

SEQ ID NO: 635508 - RNA, 14 nt, Escherichia coli CFT073
cacaccuucaagaa

SEQ ID NO: 635509 - RNA, 16 nt, Escherichia coli CFT073
cacaccugacgaugcg

SEQ ID NO: 635510 - RNA, 20 nt, Escherichia coli CFT073
cacacuccagucccaguuca

SEQ ID NO: 635511 - RNA, 16 nt, Escherichia coli CFT073
cacaauugcaguauga

SEQ ID NO: 635512 - RNA, 14 nt, Escherichia coli CFT073
cacaauuaccuucc

SEQ ID NO: 635513 - RNA, 12 nt, Escherichia coli CFT073
cacaccaccaug

SEQ ID NO: 635514 - RNA, 23 nt, Escherichia coli CFT073
cacaccacgcgccugcagcggcc

SEQ ID NO: 635515 - RNA, 14 nt, Escherichia coli CFT073
cacaccaguaaagc

SEQ ID NO: 635516 - RNA, 13 nt, Escherichia coli CFT073
cacaccacuucau

SEQ ID NO: 635517 - RNA, 19 nt, Escherichia coli CFT073
cacaccagaccagacaauc

SEQ ID NO: 635518 - RNA, 17 nt, Escherichia coli CFT073
cacaccauaaugaccaa

SEQ ID NO: 635519 - RNA, 13 nt, Escherichia coli CFT073
cacaccaucaaca

SEQ ID NO: 635520 - RNA, 14 nt, Escherichia coli CFT073
cacaccauccagca

SEQ ID NO: 635521 - RNA, 16 nt, Escherichia coli CFT073
cacaaaguaaacaaua

SEQ ID NO: 635522 - RNA, 12 nt, Escherichia coli CFT073
cacaacaauacc

SEQ ID NO: 635523 - RNA, 17 nt, Escherichia coli CFT073
cacaaugccguaaccag

SEQ ID NO: 635524 - RNA, 22 nt, Escherichia coli CFT073
cacaaugccugaugcgaugcug

SEQ ID NO: 635525 - RNA, 19 nt, Escherichia coli CFT073
cacaaugccugaugcgcuu

SEQ ID NO: 635526 - RNA, 15 nt, Escherichia coli CFT073
cacaaugccugaugc

SEQ ID NO: 635527 - RNA, 23 nt, Escherichia coli CFT073
cacaauggcauauuccgccaccu

SEQ ID NO: 635528 - RNA, 17 nt, Escherichia coli CFT073
cacaaugggcaagcgac

SEQ ID NO: 635529 - RNA, 12 nt, Escherichia coli CFT073
cacaauggucaa

SEQ ID NO: 635530 - RNA, 13 nt, Escherichia coli CFT073
cacagucugcucc

SEQ ID NO: 635531 - RNA, 20 nt, Escherichia coli CFT073
cacagucuggagaugggugu

SEQ ID NO: 635532 - RNA, 22 nt, Escherichia coli CFT073
cacagugacccgcagccagcac

SEQ ID NO: 635533 - RNA, 18 nt, Escherichia coli CFT073
cacaggucgcaaacggcg

SEQ ID NO: 635534 - RNA, 22 nt, Escherichia coli CFT073
cacaggucgcccccggcaguga

SEQ ID NO: 635535 - RNA, 12 nt, Escherichia coli CFT073
cacagacaaaca

SEQ ID NO: 635536 - RNA, 23 nt, Escherichia coli CFT073
cacagagggcgaacgagauaaug

SEQ ID NO: 635537 - RNA, 16 nt, Escherichia coli CFT073
cacagaggucuuuucu

SEQ ID NO: 635538 - RNA, 18 nt, Escherichia coli CFT073
cacagaggucuuuucucg

SEQ ID NO: 635539 - RNA, 20 nt, Escherichia coli CFT073
cacagagcuaugaauagucg

SEQ ID NO: 635540 - RNA, 14 nt, Escherichia coli CFT073
cacagcgacaagcu

SEQ ID NO: 635541 - RNA, 13 nt, Escherichia coli CFT073
cacagcgcaccaa

SEQ ID NO: 635542 - RNA, 18 nt, Escherichia coli CFT073
caauuacgccgagcgcca

SEQ ID NO: 635543 - RNA, 15 nt, Escherichia coli CFT073
caauuacaaaaagua

SEQ ID NO: 635544 - RNA, 15 nt, Escherichia coli CFT073
caauuacacacaaca

SEQ ID NO: 635545 - RNA, 12 nt, Escherichia coli CFT073
caauuaccuucc

SEQ ID NO: 635546 - RNA, 12 nt, Escherichia coli CFT073
caauuaauacaa

SEQ ID NO: 635547 - RNA, 18 nt, Escherichia coli CFT073
caauuaauccuuucgaaa

SEQ ID NO: 635548 - RNA, 18 nt, Escherichia coli CFT073
caauuaaugccuucaaau

SEQ ID NO: 635549 - RNA, 12 nt, Escherichia coli CFT073
caaugcgccggc

SEQ ID NO: 635550 - RNA, 13 nt, Escherichia coli CFT073
caauguuuuucuc

SEQ ID NO: 635551 - RNA, 22 nt, Escherichia coli CFT073
caaugcguagcugggcaacaaa

SEQ ID NO: 635552 - RNA, 21 nt, Escherichia coli CFT073
caauucacacucugccagcga

SEQ ID NO: 635553 - RNA, 17 nt, Escherichia coli CFT073
caauuaucuguucuuuu

SEQ ID NO: 635554 - RNA, 12 nt, Escherichia coli CFT073
caauucuuuuuc

SEQ ID NO: 635555 - RNA, 13 nt, Escherichia coli CFT073
caauucuuuuucu

SEQ ID NO: 635556 - RNA, 14 nt, Escherichia coli CFT073
caauugauaauaaa

SEQ ID NO: 635557 - RNA, 16 nt, Escherichia coli CFT073
caauugauaauaaaaa

SEQ ID NO: 635558 - RNA, 19 nt, Escherichia coli CFT073
caauugaugcuuuuugccc

SEQ ID NO: 635559 - RNA, 21 nt, Escherichia coli CFT073
caauugaccugauaagacagc

SEQ ID NO: 635560 - RNA, 15 nt, Escherichia coli CFT073
caauugaagaauauc

SEQ ID NO: 635561 - RNA, 20 nt, Escherichia coli CFT073
caauugaagaauaucuucug

SEQ ID NO: 635562 - RNA, 20 nt, Escherichia coli CFT073
caauuauaauacgcuugauu

SEQ ID NO: 635563 - RNA, 11 nt, Escherichia coli CFT073
caauuaucugg

SEQ ID NO: 635564 - RNA, 16 nt, Escherichia coli CFT073
caauuaugcccucagc

SEQ ID NO: 635565 - RNA, 14 nt, Escherichia coli CFT073
caauuuuucaggau

SEQ ID NO: 635566 - RNA, 18 nt, Escherichia coli CFT073
cacaaaaccgucguugcu

SEQ ID NO: 635567 - RNA, 15 nt, Escherichia coli CFT073
cacaaaaacaccgcu

SEQ ID NO: 635568 - RNA, 16 nt, Escherichia coli CFT073
cacaaaaacaccgcug

SEQ ID NO: 635569 - RNA, 13 nt, Escherichia coli CFT073
cacaaaaacagua

SEQ ID NO: 635570 - RNA, 15 nt, Escherichia coli CFT073
cacaaaaacccgcuc

SEQ ID NO: 635571 - RNA, 19 nt, Escherichia coli CFT073
cacaaacgauccuggucag

SEQ ID NO: 635572 - RNA, 15 nt, Escherichia coli CFT073
cacaaacgcaaucca

SEQ ID NO: 635573 - RNA, 15 nt, Escherichia coli CFT073
cacaaacgccgugca

SEQ ID NO: 635574 - RNA, 18 nt, Escherichia coli CFT073
cacaaaauagaaauuuag

SEQ ID NO: 635575 - RNA, 21 nt, Escherichia coli CFT073
cacaaacaauuugcuuaagcc

SEQ ID NO: 635576 - RNA, 14 nt, Escherichia coli CFT073
cacaaacagaaugg

SEQ ID NO: 635577 - RNA, 12 nt, Escherichia coli CFT073
cacaaacaucau

SEQ ID NO: 635578 - RNA, 14 nt, Escherichia coli CFT073
cacaaacaucccug

SEQ ID NO: 635579 - RNA, 16 nt, Escherichia coli CFT073
cacaaacaucccugaa

SEQ ID NO: 635580 - RNA, 12 nt, Escherichia coli CFT073
cacaaaccaccg

SEQ ID NO: 635581 - RNA, 12 nt, Escherichia coli CFT073
cacaaaccagcc

SEQ ID NO: 635582 - RNA, 21 nt, Escherichia coli CFT073
caauuuguucacaccaucauc

SEQ ID NO: 635583 - RNA, 13 nt, Escherichia coli CFT073
caauuuugcagca

SEQ ID NO: 635584 - RNA, 14 nt, Escherichia coli CFT073
caauuuugcagcau

SEQ ID NO: 635585 - RNA, 16 nt, Escherichia coli CFT073
caauuuugcccagccg

SEQ ID NO: 635586 - RNA, 19 nt, Escherichia coli CFT073
caauuguuagccacaucca

SEQ ID NO: 635587 - RNA, 21 nt, Escherichia coli CFT073
caauuuaccgaccucaacaaa

SEQ ID NO: 635588 - RNA, 17 nt, Escherichia coli CFT073
caauaaucguuccuuua

SEQ ID NO: 635589 - RNA, 23 nt, Escherichia coli CFT073
caauaaucucuuuacccagcgga

SEQ ID NO: 635590 - RNA, 21 nt, Escherichia coli CFT073
caauaauauuaaucccugcuu

SEQ ID NO: 635591 - RNA, 15 nt, Escherichia coli CFT073
caauaauauugcuaa

SEQ ID NO: 635592 - RNA, 22 nt, Escherichia coli CFT073
caauaaucaaucuuuacacaca

SEQ ID NO: 635593 - RNA, 19 nt, Escherichia coli CFT073
caauaacuccccuucuggc

SEQ ID NO: 635594 - RNA, 22 nt, Escherichia coli CFT073
caauaaucugcccggcauuaau

SEQ ID NO: 635595 - RNA, 12 nt, Escherichia coli CFT073
caauaaugauga

SEQ ID NO: 635596 - RNA, 22 nt, Escherichia coli CFT073
caauaaugcccgcaccaccgag

SEQ ID NO: 635597 - RNA, 23 nt, Escherichia coli CFT073
caauaauucuuccuucacaucca

SEQ ID NO: 635598 - RNA, 13 nt, Escherichia coli CFT073
caauacauagaag

SEQ ID NO: 635599 - RNA, 22 nt, Escherichia coli CFT073
caauacauagaagcucauaugc

SEQ ID NO: 635600 - RNA, 22 nt, Escherichia coli CFT073
caauaacccguuguaaaugcug

SEQ ID NO: 635601 - RNA, 17 nt, Escherichia coli CFT073
caaguucuuuuguuuug

SEQ ID NO: 635602 - RNA, 21 nt, Escherichia coli CFT073
caaguaaucaaucaccucuuu

SEQ ID NO: 635603 - RNA, 19 nt, Escherichia coli CFT073
caaguuguaauuccugaag

SEQ ID NO: 635604 - RNA, 12 nt, Escherichia coli CFT073
caauaaaguuuu

SEQ ID NO: 635605 - RNA, 16 nt, Escherichia coli CFT073
caauacuuaaccccag

SEQ ID NO: 635606 - RNA, 21 nt, Escherichia coli CFT073
caauaccgccugcaaauaaau

SEQ ID NO: 635607 - RNA, 18 nt, Escherichia coli CFT073
caauaccagcaucaggau

SEQ ID NO: 635608 - RNA, 13 nt, Escherichia coli CFT073
caauacccugacc

SEQ ID NO: 635609 - RNA, 16 nt, Escherichia coli CFT073
caauacuuuccagcau

SEQ ID NO: 635610 - RNA, 18 nt, Escherichia coli CFT073
caauacuugugccgcacu

SEQ ID NO: 635611 - RNA, 18 nt, Escherichia coli CFT073
caauagccugauguagcg

SEQ ID NO: 635612 - RNA, 14 nt, Escherichia coli CFT073
caauauaaacagcc

SEQ ID NO: 635613 - RNA, 16 nt, Escherichia coli CFT073
caauagucaguauuuu

SEQ ID NO: 635614 - RNA, 18 nt, Escherichia coli CFT073
caauagucaguauuuucc

SEQ ID NO: 635615 - RNA, 19 nt, Escherichia coli CFT073
caauagucaguauuuuccc

SEQ ID NO: 635616 - RNA, 14 nt, Escherichia coli CFT073
caauagucauuaaa

SEQ ID NO: 635617 - RNA, 14 nt, Escherichia coli CFT073
caauauuaaauauc

SEQ ID NO: 635618 - RNA, 15 nt, Escherichia coli CFT073
caaugcacacaaaau

SEQ ID NO: 635619 - RNA, 15 nt, Escherichia coli CFT073
caaugcagguaccug

SEQ ID NO: 635620 - RNA, 18 nt, Escherichia coli CFT073
caaugccauauaacgggc

SEQ ID NO: 635621 - RNA, 15 nt, Escherichia coli CFT073
caaugccaucaccaa

SEQ ID NO: 635622 - RNA, 15 nt, Escherichia coli CFT073
caaugccauccagcu

SEQ ID NO: 635623 - RNA, 22 nt, Escherichia coli CFT073
caaugccauucacaaaaacagu

SEQ ID NO: 635624 - RNA, 15 nt, Escherichia coli CFT073
caaugccccagaaua

SEQ ID NO: 635625 - RNA, 16 nt, Escherichia coli CFT073
caaugccccagaauaa

SEQ ID NO: 635626 - RNA, 16 nt, Escherichia coli CFT073
caaugcgcaagcugcu

SEQ ID NO: 635627 - RNA, 16 nt, Escherichia coli CFT073
caaugcccgguguucc

SEQ ID NO: 635628 - RNA, 17 nt, Escherichia coli CFT073
caaugccguaauccugc

SEQ ID NO: 635629 - RNA, 19 nt, Escherichia coli CFT073
caaugccgucaccagcauc

SEQ ID NO: 635630 - RNA, 19 nt, Escherichia coli CFT073
caaugccugagacagacag

SEQ ID NO: 635631 - RNA, 23 nt, Escherichia coli CFT073
caaugccugaugcgcuucgcuua

SEQ ID NO: 635632 - RNA, 20 nt, Escherichia coli CFT073
caaugaaacgcaaauacuga

SEQ ID NO: 635633 - RNA, 19 nt, Escherichia coli CFT073
caaugaagaaccgcaccag

SEQ ID NO: 635634 - RNA, 23 nt, Escherichia coli CFT073
caaugagacgguuaaaaacagcc

SEQ ID NO: 635635 - RNA, 13 nt, Escherichia coli CFT073
caaucuuuccugc

SEQ ID NO: 635636 - RNA, 23 nt, Escherichia coli CFT073
caaucuuguucucagcacauuga

SEQ ID NO: 635637 - RNA, 11 nt, Escherichia coli CFT073
caaugauaaag

SEQ ID NO: 635638 - RNA, 19 nt, Escherichia coli CFT073
caaugauaaguccgaugcc

SEQ ID NO: 635639 - RNA, 18 nt, Escherichia coli CFT073
caaugagcugaacgucgc

SEQ ID NO: 635640 - RNA, 16 nt, Escherichia coli CFT073
caauauuggguuguug

SEQ ID NO: 635641 - RNA, 18 nt, Escherichia coli CFT073
caauauuccagucagcac

SEQ ID NO: 635642 - RNA, 19 nt, Escherichia coli CFT073
caauauuccagucagcacc

SEQ ID NO: 635643 - RNA, 21 nt, Escherichia coli CFT073
caauauucuuuugcagcagcg

SEQ ID NO: 635644 - RNA, 12 nt, Escherichia coli CFT073
caaucaucaucg

SEQ ID NO: 635645 - RNA, 18 nt, Escherichia coli CFT073
caaucaucgccuuaugcu

SEQ ID NO: 635646 - RNA, 20 nt, Escherichia coli CFT073
caaucccguugaaaaugcug

SEQ ID NO: 635647 - RNA, 17 nt, Escherichia coli CFT073
caaucccguugccacuc

SEQ ID NO: 635648 - RNA, 23 nt, Escherichia coli CFT073
caaucccguugccacucaggcaa

SEQ ID NO: 635649 - RNA, 19 nt, Escherichia coli CFT073
caaucauuugcaccaggcc

SEQ ID NO: 635650 - RNA, 16 nt, Escherichia coli CFT073
caauccgccaggacau

SEQ ID NO: 635651 - RNA, 22 nt, Escherichia coli CFT073
caauccgccaggacaucagcgc

SEQ ID NO: 635652 - RNA, 20 nt, Escherichia coli CFT073
caauccgcgagcgucuggcu

SEQ ID NO: 635653 - RNA, 22 nt, Escherichia coli CFT073
caaucuccuucggugcucccug

SEQ ID NO: 635654 - RNA, 14 nt, Escherichia coli CFT073
caaucucuucacag

SEQ ID NO: 635655 - RNA, 15 nt, Escherichia coli CFT073
caaucucuucaccug

SEQ ID NO: 635656 - RNA, 17 nt, Escherichia coli CFT073
caaucucuucaccugcc

SEQ ID NO: 635657 - RNA, 12 nt, Escherichia coli CFT073
caaucucagcga

SEQ ID NO: 635658 - RNA, 23 nt, Escherichia coli CFT073
caaucgccgccaguuccaggcaa

SEQ ID NO: 635659 - RNA, 14 nt, Escherichia coli CFT073
caaucaugcgcaua

SEQ ID NO: 635660 - RNA, 15 nt, Escherichia coli CFT073
caauccggaaaccaa

SEQ ID NO: 635661 - RNA, 19 nt, Escherichia coli CFT073
caaucgccuccagcgcugg

SEQ ID NO: 635662 - RNA, 13 nt, Escherichia coli CFT073
caaucgcucccag

SEQ ID NO: 635663 - RNA, 16 nt, Escherichia coli CFT073
caaucgcucccagccc

SEQ ID NO: 635664 - RNA, 14 nt, Escherichia coli CFT073
caaucgcugcuaau

SEQ ID NO: 635665 - RNA, 14 nt, Escherichia coli CFT073
caaucgcuuucugu

SEQ ID NO: 635666 - RNA, 19 nt, Escherichia coli CFT073
caaucggaaaacaaccgcc

SEQ ID NO: 635667 - RNA, 22 nt, Escherichia coli CFT073
caaucggaaaacaaccgccaug

SEQ ID NO: 635668 - RNA, 21 nt, Escherichia coli CFT073
caagggaaauaagaaaagcga

SEQ ID NO: 635669 - RNA, 16 nt, Escherichia coli CFT073
caagggguuuucagga

SEQ ID NO: 635670 - RNA, 15 nt, Escherichia coli CFT073
caagguaguagaaau

SEQ ID NO: 635671 - RNA, 17 nt, Escherichia coli CFT073
caagguaguagaaauca

SEQ ID NO: 635672 - RNA, 14 nt, Escherichia coli CFT073
caagguauugcacg

SEQ ID NO: 635673 - RNA, 13 nt, Escherichia coli CFT073
caagguggucaga

SEQ ID NO: 635674 - RNA, 15 nt, Escherichia coli CFT073
caaggcuacgccaca

SEQ ID NO: 635675 - RNA, 16 nt, Escherichia coli CFT073
caaggcuauucagcag

SEQ ID NO: 635676 - RNA, 15 nt, Escherichia coli CFT073
caaggaacugugcau

SEQ ID NO: 635677 - RNA, 13 nt, Escherichia coli CFT073
caaggagagccag

SEQ ID NO: 635678 - RNA, 14 nt, Escherichia coli CFT073
caaggagagccagu

SEQ ID NO: 635679 - RNA, 20 nt, Escherichia coli CFT073
caaggagagccaguacagcc

SEQ ID NO: 635680 - RNA, 13 nt, Escherichia coli CFT073
caagcagcugcca

SEQ ID NO: 635681 - RNA, 17 nt, Escherichia coli CFT073
caagcagcuugagaaaa

SEQ ID NO: 635682 - RNA, 12 nt, Escherichia coli CFT073
caagcagagaga

SEQ ID NO: 635683 - RNA, 17 nt, Escherichia coli CFT073
caagcccgccagaccag

SEQ ID NO: 635684 - RNA, 14 nt, Escherichia coli CFT073
caagcggcgcaugc

SEQ ID NO: 635685 - RNA, 15 nt, Escherichia coli CFT073
caagcgggaauagcu

SEQ ID NO: 635686 - RNA, 17 nt, Escherichia coli CFT073
caagcgggaauagcuca

SEQ ID NO: 635687 - RNA, 18 nt, Escherichia coli CFT073
caagcggggggaucagac

SEQ ID NO: 635688 - RNA, 19 nt, Escherichia coli CFT073
caagcgucgcaucaggcau

SEQ ID NO: 635689 - RNA, 19 nt, Escherichia coli CFT073
caagcggcccggagacgcc

SEQ ID NO: 635690 - RNA, 19 nt, Escherichia coli CFT073
caagcgcugugaaacaccu

SEQ ID NO: 635691 - RNA, 15 nt, Escherichia coli CFT073
caagcaaauuaauua

SEQ ID NO: 635692 - RNA, 15 nt, Escherichia coli CFT073
caagcaaggccaggu

SEQ ID NO: 635693 - RNA, 11 nt, Escherichia coli CFT073
caagcacuugc

SEQ ID NO: 635694 - RNA, 16 nt, Escherichia coli CFT073
caagcaccuaaaucca

SEQ ID NO: 635695 - RNA, 14 nt, Escherichia coli CFT073
caagauuggccuga

SEQ ID NO: 635696 - RNA, 19 nt, Escherichia coli CFT073
caagacuauuaauauauau

SEQ ID NO: 635697 - RNA, 21 nt, Escherichia coli CFT073
caagacuauuaauauauauua

SEQ ID NO: 635698 - RNA, 22 nt, Escherichia coli CFT073
caagacgcauaauccaggcauc

SEQ ID NO: 635699 - RNA, 17 nt, Escherichia coli CFT073
caagacgaaaaaugaau

SEQ ID NO: 635700 - RNA, 14 nt, Escherichia coli CFT073
caagaaccccagcc

SEQ ID NO: 635701 - RNA, 18 nt, Escherichia coli CFT073
caagaaccccagccaggu

SEQ ID NO: 635702 - RNA, 14 nt, Escherichia coli CFT073
caagaaaugcaugu

SEQ ID NO: 635703 - RNA, 14 nt, Escherichia coli CFT073
caagaaauaugaau

SEQ ID NO: 635704 - RNA, 19 nt, Escherichia coli CFT073
caagaaaaauacugcugca

SEQ ID NO: 635705 - RNA, 16 nt, Escherichia coli CFT073
caagaaaacuauuacu

SEQ ID NO: 635706 - RNA, 22 nt, Escherichia coli CFT073
caagaaaacugguuauaugaau

SEQ ID NO: 635707 - RNA, 14 nt, Escherichia coli CFT073
caacuuucacgcgc

SEQ ID NO: 635708 - RNA, 18 nt, Escherichia coli CFT073
caacuuuugcaggaagcu

SEQ ID NO: 635709 - RNA, 21 nt, Escherichia coli CFT073
caacuuuguauucaguucauc

SEQ ID NO: 635710 - RNA, 16 nt, Escherichia coli CFT073
caacuugcucaagcca

SEQ ID NO: 635711 - RNA, 16 nt, Escherichia coli CFT073
caacuuuacuaaaaag

SEQ ID NO: 635712 - RNA, 17 nt, Escherichia coli CFT073
caacuuuacuaaaaagu

SEQ ID NO: 635713 - RNA, 19 nt, Escherichia coli CFT073
caacuucugucacgcuggc

SEQ ID NO: 635714 - RNA, 22 nt, Escherichia coli CFT073
caacuucuuuaguugagcuuuu

SEQ ID NO: 635715 - RNA, 16 nt, Escherichia coli CFT073
caacuugaaguaugac

SEQ ID NO: 635716 - RNA, 20 nt, Escherichia coli CFT073
caacuccagcuuaacauccc

SEQ ID NO: 635717 - RNA, 15 nt, Escherichia coli CFT073
caacuccuguugcaa

SEQ ID NO: 635718 - RNA, 17 nt, Escherichia coli CFT073
caacuccgucgcggugu

SEQ ID NO: 635719 - RNA, 23 nt, Escherichia coli CFT073
caacgccagcgaagccagcuccc

SEQ ID NO: 635720 - RNA, 17 nt, Escherichia coli CFT073
caacgcccauacucauc

SEQ ID NO: 635721 - RNA, 20 nt, Escherichia coli CFT073
caacgcccauacucaucuuc

SEQ ID NO: 635722 - RNA, 16 nt, Escherichia coli CFT073
caacgccccuucugcc

SEQ ID NO: 635723 - RNA, 22 nt, Escherichia coli CFT073
caacugacggucgguaaacccg

SEQ ID NO: 635724 - RNA, 15 nt, Escherichia coli CFT073
caacugauauuuaaa

SEQ ID NO: 635725 - RNA, 21 nt, Escherichia coli CFT073
caacuucuaauuuuuccagca

SEQ ID NO: 635726 - RNA, 18 nt, Escherichia coli CFT073
caacuuaagucuccauuu

SEQ ID NO: 635727 - RNA, 22 nt, Escherichia coli CFT073
caacugugaauccugcauacca

SEQ ID NO: 635728 - RNA, 19 nt, Escherichia coli CFT073
caacuggcggucaugacga

SEQ ID NO: 635729 - RNA, 22 nt, Escherichia coli CFT073
caacuguaacgcagaagguuau

SEQ ID NO: 635730 - RNA, 22 nt, Escherichia coli CFT073
caacuguacgccgacgcccugc

SEQ ID NO: 635731 - RNA, 22 nt, Escherichia coli CFT073
caacuguggaauaugcgccacu

SEQ ID NO: 635732 - RNA, 17 nt, Escherichia coli CFT073
caaccgccaguuccccc

SEQ ID NO: 635733 - RNA, 11 nt, Escherichia coli CFT073
caaccgccauc

SEQ ID NO: 635734 - RNA, 16 nt, Escherichia coli CFT073
caaccgccauccaggu

SEQ ID NO: 635735 - RNA, 16 nt, Escherichia coli CFT073
caaccgcgacauacuu

SEQ ID NO: 635736 - RNA, 20 nt, Escherichia coli CFT073
caaccugcacguuaucagac

SEQ ID NO: 635737 - RNA, 12 nt, Escherichia coli CFT073
caaccugccaga

SEQ ID NO: 635738 - RNA, 16 nt, Escherichia coli CFT073
caacgaaccaaucacc

SEQ ID NO: 635739 - RNA, 14 nt, Escherichia coli CFT073
caaccuucuucgcg

SEQ ID NO: 635740 - RNA, 16 nt, Escherichia coli CFT073
caaccugcgcuuuguu

SEQ ID NO: 635741 - RNA, 24 nt, Escherichia coli CFT073
caacgccagauaaauucgaccauu

SEQ ID NO: 635742 - RNA, 13 nt, Escherichia coli CFT073
caacgcaacucca

SEQ ID NO: 635743 - RNA, 19 nt, Escherichia coli CFT073
caacgcaccaaaguuaauc

SEQ ID NO: 635744 - RNA, 15 nt, Escherichia coli CFT073
caacgcacuggcgcg

SEQ ID NO: 635745 - RNA, 18 nt, Escherichia coli CFT073
caacgcacuggcgcgccu

SEQ ID NO: 635746 - RNA, 14 nt, Escherichia coli CFT073
caacgcagccccag

SEQ ID NO: 635747 - RNA, 20 nt, Escherichia coli CFT073
caacauauaaguggagcccu

SEQ ID NO: 635748 - RNA, 19 nt, Escherichia coli CFT073
caacauagcuaaaaauaau

SEQ ID NO: 635749 - RNA, 14 nt, Escherichia coli CFT073
caacaucaacagac

SEQ ID NO: 635750 - RNA, 20 nt, Escherichia coli CFT073
caacauauuccgcaccugcc

SEQ ID NO: 635751 - RNA, 23 nt, Escherichia coli CFT073
caacauauuccgcaccugccagc

SEQ ID NO: 635752 - RNA, 17 nt, Escherichia coli CFT073
caacauauugcuccaua

SEQ ID NO: 635753 - RNA, 19 nt, Escherichia coli CFT073
caacauauuucucgccuga

SEQ ID NO: 635754 - RNA, 19 nt, Escherichia coli CFT073
caacauaaucggcgcggcg

SEQ ID NO: 635755 - RNA, 17 nt, Escherichia coli CFT073
caacauaaucaaccauu

SEQ ID NO: 635756 - RNA, 17 nt, Escherichia coli CFT073
caacaggaacauguauu

SEQ ID NO: 635757 - RNA, 11 nt, Escherichia coli CFT073
caacaggaaca

SEQ ID NO: 635758 - RNA, 22 nt, Escherichia coli CFT073
caacaggcgcugaucgucagca

SEQ ID NO: 635759 - RNA, 19 nt, Escherichia coli CFT073
caacccagcggaugaccca

SEQ ID NO: 635760 - RNA, 14 nt, Escherichia coli CFT073
caaccacacccaca

SEQ ID NO: 635761 - RNA, 12 nt, Escherichia coli CFT073
caaccaaucgcg

SEQ ID NO: 635762 - RNA, 16 nt, Escherichia coli CFT073
caaccacaacgcacug

SEQ ID NO: 635763 - RNA, 14 nt, Escherichia coli CFT073
caaccaccacaccu

SEQ ID NO: 635764 - RNA, 17 nt, Escherichia coli CFT073
caaccaccggcaccacu

SEQ ID NO: 635765 - RNA, 19 nt, Escherichia coli CFT073
caaccaccucaguacccgc

SEQ ID NO: 635766 - RNA, 17 nt, Escherichia coli CFT073
caaccacggcaacgccg

SEQ ID NO: 635767 - RNA, 17 nt, Escherichia coli CFT073
caaccacuucggcaucu

SEQ ID NO: 635768 - RNA, 21 nt, Escherichia coli CFT073
caaccacuucggcaucuuuua

SEQ ID NO: 635769 - RNA, 22 nt, Escherichia coli CFT073
caaccacuucggcaucuuuuau

SEQ ID NO: 635770 - RNA, 18 nt, Escherichia coli CFT073
caaccacuuuacgcaaaa

SEQ ID NO: 635771 - RNA, 13 nt, Escherichia coli CFT073
caaccagaaaguc

SEQ ID NO: 635772 - RNA, 20 nt, Escherichia coli CFT073
caaccagagccggugccauu

SEQ ID NO: 635773 - RNA, 13 nt, Escherichia coli CFT073
caaccagcaaugc

SEQ ID NO: 635774 - RNA, 23 nt, Escherichia coli CFT073
caacaaugucuucacaaccgcca

SEQ ID NO: 635775 - RNA, 14 nt, Escherichia coli CFT073
caacaauucccagc

SEQ ID NO: 635776 - RNA, 22 nt, Escherichia coli CFT073
caacaauugaagaauaucuucu

SEQ ID NO: 635777 - RNA, 17 nt, Escherichia coli CFT073
caacaauuucacgcgcu

SEQ ID NO: 635778 - RNA, 22 nt, Escherichia coli CFT073
caacaauuucacgcgcuguaau

SEQ ID NO: 635779 - RNA, 13 nt, Escherichia coli CFT073
caacaauuuccgc

SEQ ID NO: 635780 - RNA, 17 nt, Escherichia coli CFT073
caacaaggguaugcugu

SEQ ID NO: 635781 - RNA, 20 nt, Escherichia coli CFT073
caacaauaaaaggugcguua

SEQ ID NO: 635782 - RNA, 15 nt, Escherichia coli CFT073
caacaacgcaacucc

SEQ ID NO: 635783 - RNA, 12 nt, Escherichia coli CFT073
caacaacugcgc

SEQ ID NO: 635784 - RNA, 14 nt, Escherichia coli CFT073
caacagaaacgcca

SEQ ID NO: 635785 - RNA, 17 nt, Escherichia coli CFT073
caacacucucugcagua

SEQ ID NO: 635786 - RNA, 13 nt, Escherichia coli CFT073
caacacuucuuug

SEQ ID NO: 635787 - RNA, 19 nt, Escherichia coli CFT073
caacacuuuaucugccauu

SEQ ID NO: 635788 - RNA, 17 nt, Escherichia coli CFT073
caacacuuucacuacaa

SEQ ID NO: 635789 - RNA, 13 nt, Escherichia coli CFT073
caacagauaaaug

SEQ ID NO: 635790 - RNA, 13 nt, Escherichia coli CFT073
caacacauuacuu

SEQ ID NO: 635791 - RNA, 13 nt, Escherichia coli CFT073
caacacauaaccg

SEQ ID NO: 635792 - RNA, 19 nt, Escherichia coli CFT073
caacacauaaccguacaac

SEQ ID NO: 635793 - RNA, 14 nt, Escherichia coli CFT073
caacacaugcacau

SEQ ID NO: 635794 - RNA, 12 nt, Escherichia coli CFT073
caacacauuacu

SEQ ID NO: 635795 - RNA, 17 nt, Escherichia coli CFT073
caaauuugugcucuggc

SEQ ID NO: 635796 - RNA, 18 nt, Escherichia coli CFT073
caaauuuugaacagaacu

SEQ ID NO: 635797 - RNA, 11 nt, Escherichia coli CFT073
caacaacgcaa

SEQ ID NO: 635798 - RNA, 11 nt, Escherichia coli CFT073
caaauuuuuaa

SEQ ID NO: 635799 - RNA, 14 nt, Escherichia coli CFT073
caacaaaaaauuga

SEQ ID NO: 635800 - RNA, 15 nt, Escherichia coli CFT073
caaaugcugcggguc

SEQ ID NO: 635801 - RNA, 17 nt, Escherichia coli CFT073
caaauggaccaucuccg

SEQ ID NO: 635802 - RNA, 19 nt, Escherichia coli CFT073
caaauggaccaucuccgaa

SEQ ID NO: 635803 - RNA, 20 nt, Escherichia coli CFT073
caaauuaucccccagcacuu

SEQ ID NO: 635804 - RNA, 16 nt, Escherichia coli CFT073
caaauuauuaauuaaa

SEQ ID NO: 635805 - RNA, 23 nt, Escherichia coli CFT073
caaauuauuaauuaaacaaauaa

SEQ ID NO: 635806 - RNA, 15 nt, Escherichia coli CFT073
caaauagaucgccag

SEQ ID NO: 635807 - RNA, 14 nt, Escherichia coli CFT073
caaaugcgccgcca

SEQ ID NO: 635808 - RNA, 15 nt, Escherichia coli CFT073
caaaugcgccgccaa

SEQ ID NO: 635809 - RNA, 19 nt, Escherichia coli CFT073
caaaugcgccuauaaggcu

SEQ ID NO: 635810 - RNA, 17 nt, Escherichia coli CFT073
caaacgcccagaucacu

SEQ ID NO: 635811 - RNA, 23 nt, Escherichia coli CFT073
caaacgcacuuuuaacgccucgu

SEQ ID NO: 635812 - RNA, 13 nt, Escherichia coli CFT073
caaacgcaaaacu

SEQ ID NO: 635813 - RNA, 21 nt, Escherichia coli CFT073
caaacgaccgcgggacaaaua

SEQ ID NO: 635814 - RNA, 22 nt, Escherichia coli CFT073
caaacgaccgcgggacaaauaa

SEQ ID NO: 635815 - RNA, 15 nt, Escherichia coli CFT073
caaacgauaaaagug

SEQ ID NO: 635816 - RNA, 15 nt, Escherichia coli CFT073
caaaccgacugccug

SEQ ID NO: 635817 - RNA, 22 nt, Escherichia coli CFT073
caaacgacacugcucgcagaaa

SEQ ID NO: 635818 - RNA, 16 nt, Escherichia coli CFT073
caaacauugcugccag

SEQ ID NO: 635819 - RNA, 16 nt, Escherichia coli CFT073
caaacagcagaacgac

SEQ ID NO: 635820 - RNA, 18 nt, Escherichia coli CFT073
caaacagaauuaucauuu

SEQ ID NO: 635821 - RNA, 12 nt, Escherichia coli CFT073
caaacaccagcu

SEQ ID NO: 635822 - RNA, 22 nt, Escherichia coli CFT073
caaacaccgaaccgaaauggcu

SEQ ID NO: 635823 - RNA, 15 nt, Escherichia coli CFT073
caaacacgcaauccc

SEQ ID NO: 635824 - RNA, 22 nt, Escherichia coli CFT073
caaacagugaccaucuuccagc

SEQ ID NO: 635825 - RNA, 19 nt, Escherichia coli CFT073
caaacagucgcccgaccau

SEQ ID NO: 635826 - RNA, 22 nt, Escherichia coli CFT073
caaacagcgccagauagccgac

SEQ ID NO: 635827 - RNA, 14 nt, Escherichia coli CFT073
caaacagcgccugu

SEQ ID NO: 635828 - RNA, 17 nt, Escherichia coli CFT073
caaacagcgcgccagcu

SEQ ID NO: 635829 - RNA, 19 nt, Escherichia coli CFT073
caaacagguuauugaccga

SEQ ID NO: 635830 - RNA, 15 nt, Escherichia coli CFT073
caaacaguaacccag

SEQ ID NO: 635831 - RNA, 18 nt, Escherichia coli CFT073
caaacaguucugcagcgu

SEQ ID NO: 635832 - RNA, 14 nt, Escherichia coli CFT073
caaaauuuaacauu

SEQ ID NO: 635833 - RNA, 15 nt, Escherichia coli CFT073
caaaauuuaacauua

SEQ ID NO: 635834 - RNA, 14 nt, Escherichia coli CFT073
caaaauuuauccag

SEQ ID NO: 635835 - RNA, 12 nt, Escherichia coli CFT073
caaaauugacua

SEQ ID NO: 635836 - RNA, 16 nt, Escherichia coli CFT073
caaaauugccugaugc

SEQ ID NO: 635837 - RNA, 18 nt, Escherichia coli CFT073
caaaaugaugucaaccau

SEQ ID NO: 635838 - RNA, 20 nt, Escherichia coli CFT073
caaaaugccguacagcagaa

SEQ ID NO: 635839 - RNA, 11 nt, Escherichia coli CFT073
caaaaucauca

SEQ ID NO: 635840 - RNA, 14 nt, Escherichia coli CFT073
caaaaccggcucua

SEQ ID NO: 635841 - RNA, 21 nt, Escherichia coli CFT073
caaaaccgaggagcaacaaca

SEQ ID NO: 635842 - RNA, 19 nt, Escherichia coli CFT073
caaaaucaccgaugacaga

SEQ ID NO: 635843 - RNA, 21 nt, Escherichia coli CFT073
caaaaucaauauaaacagccc

SEQ ID NO: 635844 - RNA, 13 nt, Escherichia coli CFT073
caaaaucaaugcc

SEQ ID NO: 635845 - RNA, 19 nt, Escherichia coli CFT073
caaaauaugcccuuguggc

SEQ ID NO: 635846 - RNA, 12 nt, Escherichia coli CFT073
caaauaaaacau

SEQ ID NO: 635847 - RNA, 18 nt, Escherichia coli CFT073
caaaguuugugaucuuuu

SEQ ID NO: 635848 - RNA, 20 nt, Escherichia coli CFT073
caaaguuugugaucuuuuuc

SEQ ID NO: 635849 - RNA, 13 nt, Escherichia coli CFT073
caaaguuuaugua

SEQ ID NO: 635850 - RNA, 19 nt, Escherichia coli CFT073
caaaguuccgggauauaaa

SEQ ID NO: 635851 - RNA, 23 nt, Escherichia coli CFT073
caaagugggcgacaaaguugaag

SEQ ID NO: 635852 - RNA, 22 nt, Escherichia coli CFT073
caaaguguaaaaaaucccagcg

SEQ ID NO: 635853 - RNA, 21 nt, Escherichia coli CFT073
caaaggugacguccagaaccg

SEQ ID NO: 635854 - RNA, 15 nt, Escherichia coli CFT073
caaagguugcagcuc

SEQ ID NO: 635855 - RNA, 19 nt, Escherichia coli CFT073
caaagguugcagcucccca

SEQ ID NO: 635856 - RNA, 13 nt, Escherichia coli CFT073
caaaggucuuuug

SEQ ID NO: 635857 - RNA, 21 nt, Escherichia coli CFT073
caaauaaucgacgaggaaaau

SEQ ID NO: 635858 - RNA, 16 nt, Escherichia coli CFT073
caaauaaggaaaacug

SEQ ID NO: 635859 - RNA, 13 nt, Escherichia coli CFT073
caaauaaauaauc

SEQ ID NO: 635860 - RNA, 20 nt, Escherichia coli CFT073
caaauaaauaaucucuuccg

SEQ ID NO: 635861 - RNA, 22 nt, Escherichia coli CFT073
caaauaaauaccguucauuaac

SEQ ID NO: 635862 - RNA, 15 nt, Escherichia coli CFT073
caaauaagaaaaagg

SEQ ID NO: 635863 - RNA, 18 nt, Escherichia coli CFT073
caaauaacguaaaaaccc

SEQ ID NO: 635864 - RNA, 16 nt, Escherichia coli CFT073
caaauaacccgccaug

SEQ ID NO: 635865 - RNA, 18 nt, Escherichia coli CFT073
caaauaauuacuucgccg

SEQ ID NO: 635866 - RNA, 17 nt, Escherichia coli CFT073
caaauaauuucuuauuu

SEQ ID NO: 635867 - RNA, 13 nt, Escherichia coli CFT073
caaauacccaaaa

SEQ ID NO: 635868 - RNA, 18 nt, Escherichia coli CFT073
caaauaccuggagcagua

SEQ ID NO: 635869 - RNA, 13 nt, Escherichia coli CFT073
caaagauauuauu

SEQ ID NO: 635870 - RNA, 21 nt, Escherichia coli CFT073
caaagauauuauuaaaugcug

SEQ ID NO: 635871 - RNA, 14 nt, Escherichia coli CFT073
caaagcccgaugcg

SEQ ID NO: 635872 - RNA, 15 nt, Escherichia coli CFT073
caaagccaacagcag

SEQ ID NO: 635873 - RNA, 15 nt, Escherichia coli CFT073
caaagcaguauuucu

SEQ ID NO: 635874 - RNA, 16 nt, Escherichia coli CFT073
caaagcugucaccaau

SEQ ID NO: 635875 - RNA, 18 nt, Escherichia coli CFT073
caaagggggcgacauuua

SEQ ID NO: 635876 - RNA, 15 nt, Escherichia coli CFT073
caaagagagaagcca

SEQ ID NO: 635877 - RNA, 23 nt, Escherichia coli CFT073
caaagagagauccagcuucgcca

SEQ ID NO: 635878 - RNA, 20 nt, Escherichia coli CFT073
caaacuggggcauuuuuucc

SEQ ID NO: 635879 - RNA, 21 nt, Escherichia coli CFT073
caaacuggggcauuuuuucca

SEQ ID NO: 635880 - RNA, 19 nt, Escherichia coli CFT073
caaacugguauugagcgac

SEQ ID NO: 635881 - RNA, 22 nt, Escherichia coli CFT073
caaacugguauugagcgaccgc

SEQ ID NO: 635882 - RNA, 21 nt, Escherichia coli CFT073
caaacugcucguucagcacuu

SEQ ID NO: 635883 - RNA, 19 nt, Escherichia coli CFT073
caaacugaaaaaggcgccg

SEQ ID NO: 635884 - RNA, 19 nt, Escherichia coli CFT073
caaacuccccgcaaaccag

SEQ ID NO: 635885 - RNA, 15 nt, Escherichia coli CFT073
caaacuccgcgacca

SEQ ID NO: 635886 - RNA, 17 nt, Escherichia coli CFT073
caaacuccgcgaccaca

SEQ ID NO: 635887 - RNA, 16 nt, Escherichia coli CFT073
caaacucauaaaccag

SEQ ID NO: 635888 - RNA, 22 nt, Escherichia coli CFT073
aaaaucuuucagaguuguacca

SEQ ID NO: 635889 - RNA, 16 nt, Escherichia coli CFT073
aaaaucuuugaaauaa

SEQ ID NO: 635890 - RNA, 19 nt, Escherichia coli CFT073
aaaaucuuugaaauaauau

SEQ ID NO: 635891 - RNA, 21 nt, Escherichia coli CFT073
cagauuuugcaggccugauaa

SEQ ID NO: 635892 - RNA, 13 nt, Escherichia coli CFT073
cagcaaaacaccc

SEQ ID NO: 635893 - RNA, 15 nt, Escherichia coli CFT073
cagcaaaacaccccg

SEQ ID NO: 635894 - RNA, 18 nt, Escherichia coli CFT073
cagauuacguaccagaua

SEQ ID NO: 635895 - RNA, 15 nt, Escherichia coli CFT073
cagauuagcuggccu

SEQ ID NO: 635896 - RNA, 13 nt, Escherichia coli CFT073
cagauuguugaua

SEQ ID NO: 635897 - RNA, 14 nt, Escherichia coli CFT073
cagauucaacauaa

SEQ ID NO: 635898 - RNA, 13 nt, Escherichia coli CFT073
cagauucaauacu

SEQ ID NO: 635899 - RNA, 17 nt, Escherichia coli CFT073
cagauuauucaaaaaca

SEQ ID NO: 635900 - RNA, 20 nt, Escherichia coli CFT073
cagauuauucaaaaacagau

SEQ ID NO: 635901 - RNA, 19 nt, Escherichia coli CFT073
cagauucaaauccagucuu

SEQ ID NO: 635902 - RNA, 20 nt, Escherichia coli CFT073
cagauucaaauccagucuuu

SEQ ID NO: 635903 - RNA, 15 nt, Escherichia coli CFT073
cagauggcuuuccac

SEQ ID NO: 635904 - RNA, 14 nt, Escherichia coli CFT073
cagauggaugagca

SEQ ID NO: 635905 - RNA, 20 nt, Escherichia coli CFT073
cagaugcugggcgaucggca

SEQ ID NO: 635906 - RNA, 16 nt, Escherichia coli CFT073
cagaugcugugcaauc

SEQ ID NO: 635907 - RNA, 18 nt, Escherichia coli CFT073
cagaugcgucuucugcag

SEQ ID NO: 635908 - RNA, 17 nt, Escherichia coli CFT073
cagaugcucuucaaaac

SEQ ID NO: 635909 - RNA, 22 nt, Escherichia coli CFT073
aaaaucugcgggaacauaugca

SEQ ID NO: 635910 - RNA, 20 nt, Escherichia coli CFT073
aaaaucucgacuucuucauu

SEQ ID NO: 635911 - RNA, 21 nt, Escherichia coli CFT073
cagaugaucaacgaccagaaa

SEQ ID NO: 635912 - RNA, 18 nt, Escherichia coli CFT073
cagaugaucuaccaguuc

SEQ ID NO: 635913 - RNA, 22 nt, Escherichia coli CFT073
cagaugacucgccgcaaaaccc

SEQ ID NO: 635914 - RNA, 23 nt, Escherichia coli CFT073
cagaugcgacguuacaaccacau

SEQ ID NO: 635915 - RNA, 20 nt, Escherichia coli CFT073
cagaugccacaaucucgccc

SEQ ID NO: 635916 - RNA, 15 nt, Escherichia coli CFT073
cagaugccauuuugc

SEQ ID NO: 635917 - RNA, 14 nt, Escherichia coli CFT073
cagaucuucaggag

SEQ ID NO: 635918 - RNA, 15 nt, Escherichia coli CFT073
cagaucuuucugcag

SEQ ID NO: 635919 - RNA, 18 nt, Escherichia coli CFT073
cagaugaaauaccacuca

SEQ ID NO: 635920 - RNA, 20 nt, Escherichia coli CFT073
cagaugaacggcuuuuucug

SEQ ID NO: 635921 - RNA, 18 nt, Escherichia coli CFT073
cagaugaagauuuaaaca

SEQ ID NO: 635922 - RNA, 21 nt, Escherichia coli CFT073
cagaucugacgauuauuuucc

SEQ ID NO: 635923 - RNA, 23 nt, Escherichia coli CFT073
cagaucguguuuugcaaucaucg

SEQ ID NO: 635924 - RNA, 14 nt, Escherichia coli CFT073
cagauaaucaaccc

SEQ ID NO: 635925 - RNA, 18 nt, Escherichia coli CFT073
cagauaaggcguuuacgc

SEQ ID NO: 635926 - RNA, 22 nt, Escherichia coli CFT073
cagauaaguuugccguuaaucu

SEQ ID NO: 635927 - RNA, 17 nt, Escherichia coli CFT073
cagauaauaauguguuc

SEQ ID NO: 635928 - RNA, 22 nt, Escherichia coli CFT073
cagauaauaauguguucaacuu

SEQ ID NO: 635929 - RNA, 16 nt, Escherichia coli CFT073
cagauaauauuuaucu

SEQ ID NO: 635930 - RNA, 18 nt, Escherichia coli CFT073
cagauaauauuuaucuuc

SEQ ID NO: 635931 - RNA, 10 nt, Escherichia coli CFT073
cagauaagac

SEQ ID NO: 635932 - RNA, 12 nt, Escherichia coli CFT073
cagauaagacca

SEQ ID NO: 635933 - RNA, 14 nt, Escherichia coli CFT073
cagauaagaccaau

SEQ ID NO: 635934 - RNA, 16 nt, Escherichia coli CFT073
cagaguugaaaaucuc

SEQ ID NO: 635935 - RNA, 20 nt, Escherichia coli CFT073
cagaguugagcaguccccac

SEQ ID NO: 635936 - RNA, 21 nt, Escherichia coli CFT073
cagaucggacuucaugcgcag

SEQ ID NO: 635937 - RNA, 21 nt, Escherichia coli CFT073
cagaucgguaauugaucucac

SEQ ID NO: 635938 - RNA, 16 nt, Escherichia coli CFT073
cagaucgguugccaua

SEQ ID NO: 635939 - RNA, 23 nt, Escherichia coli CFT073
cagaucgccagagucagcacgag

SEQ ID NO: 635940 - RNA, 22 nt, Escherichia coli CFT073
cagcaauuuaugaggaugcaga

SEQ ID NO: 635941 - RNA, 20 nt, Escherichia coli CFT073
cagcacaaacgcaauccagu

SEQ ID NO: 635942 - RNA, 22 nt, Escherichia coli CFT073
cagcacaaacgcaauccagugg

SEQ ID NO: 635943 - RNA, 14 nt, Escherichia coli CFT073
cagcaauggacacc

SEQ ID NO: 635944 - RNA, 17 nt, Escherichia coli CFT073
cagcaaguauucacucu

SEQ ID NO: 635945 - RNA, 13 nt, Escherichia coli CFT073
cagcaauccccag

SEQ ID NO: 635946 - RNA, 13 nt, Escherichia coli CFT073
cagcaaucgacca

SEQ ID NO: 635947 - RNA, 23 nt, Escherichia coli CFT073
cagcaaucgaccaggccaucagc

SEQ ID NO: 635948 - RNA, 18 nt, Escherichia coli CFT073
cagcaaucucuucaagcu

SEQ ID NO: 635949 - RNA, 16 nt, Escherichia coli CFT073
aaaaugcugcaauugc

SEQ ID NO: 635950 - RNA, 18 nt, Escherichia coli CFT073
cagcaacgaacuaaccgc

SEQ ID NO: 635951 - RNA, 21 nt, Escherichia coli CFT073
cagcaacgaacuaaccgcacu

SEQ ID NO: 635952 - RNA, 10 nt, Escherichia coli CFT073
cagcaaccac

SEQ ID NO: 635953 - RNA, 21 nt, Escherichia coli CFT073
cagcaaccgcuuccggucugc

SEQ ID NO: 635954 - RNA, 13 nt, Escherichia coli CFT073
aaaauggagagaa

SEQ ID NO: 635955 - RNA, 20 nt, Escherichia coli CFT073
cagcaacgcugauuucucug

SEQ ID NO: 635956 - RNA, 15 nt, Escherichia coli CFT073
cagcaacgcuucaac

SEQ ID NO: 635957 - RNA, 22 nt, Escherichia coli CFT073
cagcacuugagauaaaaacuca

SEQ ID NO: 635958 - RNA, 22 nt, Escherichia coli CFT073
cagcacuucgcugguguacugc

SEQ ID NO: 635959 - RNA, 14 nt, Escherichia coli CFT073
cagcagaacaucag

SEQ ID NO: 635960 - RNA, 17 nt, Escherichia coli CFT073
cagcacuggcggcagca

SEQ ID NO: 635961 - RNA, 22 nt, Escherichia coli CFT073
cagcacuuaucucuuccgcauu

SEQ ID NO: 635962 - RNA, 15 nt, Escherichia coli CFT073
cagcacgcaggcauc

SEQ ID NO: 635963 - RNA, 18 nt, Escherichia coli CFT073
cagcacgcaggcaucuuu

SEQ ID NO: 635964 - RNA, 21 nt, Escherichia coli CFT073
cagcacgcaggcaucuuuuuc

SEQ ID NO: 635965 - RNA, 18 nt, Escherichia coli CFT073
cagcacgagugaguuaau

SEQ ID NO: 635966 - RNA, 22 nt, Escherichia coli CFT073
cagcaccgucgcaccgguaucu

SEQ ID NO: 635967 - RNA, 15 nt, Escherichia coli CFT073
cagcacaugcaacuu

SEQ ID NO: 635968 - RNA, 22 nt, Escherichia coli CFT073
cagcacauuacaggcaucuucc

SEQ ID NO: 635969 - RNA, 12 nt, Escherichia coli CFT073
cagcacagccag

SEQ ID NO: 635970 - RNA, 13 nt, Escherichia coli CFT073
cagcacagccaga

SEQ ID NO: 635971 - RNA, 16 nt, Escherichia coli CFT073
cagcacagccagaauc

SEQ ID NO: 635972 - RNA, 15 nt, Escherichia coli CFT073
cagcacagccagccu

SEQ ID NO: 635973 - RNA, 19 nt, Escherichia coli CFT073
cagcacauaacucauacug

SEQ ID NO: 635974 - RNA, 16 nt, Escherichia coli CFT073
cagcacauagccgaaa

SEQ ID NO: 635975 - RNA, 21 nt, Escherichia coli CFT073
cagcacacgauuccaacgaaa

SEQ ID NO: 635976 - RNA, 22 nt, Escherichia coli CFT073
cagcacacgauuccaacgaaaa

SEQ ID NO: 635977 - RNA, 22 nt, Escherichia coli CFT073
cagcacaccacaucgccgaccg

SEQ ID NO: 635978 - RNA, 15 nt, Escherichia coli CFT073
cagcacacuguaagc

SEQ ID NO: 635979 - RNA, 19 nt, Escherichia coli CFT073
cagcacagagauaaaaggc

SEQ ID NO: 635980 - RNA, 13 nt, Escherichia coli CFT073
cagcacccggcgu

SEQ ID NO: 635981 - RNA, 18 nt, Escherichia coli CFT073
cagcaccccgacagcaug

SEQ ID NO: 635982 - RNA, 17 nt, Escherichia coli CFT073
cagcacccgcggcugca

SEQ ID NO: 635983 - RNA, 13 nt, Escherichia coli CFT073
cagacgugcaccg

SEQ ID NO: 635984 - RNA, 23 nt, Escherichia coli CFT073
cagacguguugucagcucaucca

SEQ ID NO: 635985 - RNA, 14 nt, Escherichia coli CFT073
cagacguucuuccu

SEQ ID NO: 635986 - RNA, 17 nt, Escherichia coli CFT073
cagacguuucacggucg

SEQ ID NO: 635987 - RNA, 18 nt, Escherichia coli CFT073
cagacguuucgccagccu

SEQ ID NO: 635988 - RNA, 13 nt, Escherichia coli CFT073
cagacguuuuuuc

SEQ ID NO: 635989 - RNA, 18 nt, Escherichia coli CFT073
cagacuaaaccgcacugg

SEQ ID NO: 635990 - RNA, 17 nt, Escherichia coli CFT073
cagacgcgcugagucac

SEQ ID NO: 635991 - RNA, 14 nt, Escherichia coli CFT073
cagacgcaucgccc

SEQ ID NO: 635992 - RNA, 15 nt, Escherichia coli CFT073
cagacgcaucgccca

SEQ ID NO: 635993 - RNA, 20 nt, Escherichia coli CFT073
cagacgcaucgcccagccau

SEQ ID NO: 635994 - RNA, 22 nt, Escherichia coli CFT073
cagacgcaucgcccagccaucg

SEQ ID NO: 635995 - RNA, 16 nt, Escherichia coli CFT073
cagacgcaggcgcgcu

SEQ ID NO: 635996 - RNA, 19 nt, Escherichia coli CFT073
cagaccaucgucaguaaug

SEQ ID NO: 635997 - RNA, 21 nt, Escherichia coli CFT073
cagaccaucgucaguaaugau

SEQ ID NO: 635998 - RNA, 20 nt, Escherichia coli CFT073
cagaccagcuaccacgccga

SEQ ID NO: 635999 - RNA, 22 nt, Escherichia coli CFT073
cagaccaauuuuucccucuuca

SEQ ID NO: 636000 - RNA, 15 nt, Escherichia coli CFT073
cagaccacagguaau

SEQ ID NO: 636001 - RNA, 20 nt, Escherichia coli CFT073
cagaccacucauuuuuucgg

SEQ ID NO: 636002 - RNA, 17 nt, Escherichia coli CFT073
cagaccagcaauaaaaa

SEQ ID NO: 636003 - RNA, 18 nt, Escherichia coli CFT073
cagaccagcaauaaaaaa

SEQ ID NO: 636004 - RNA, 21 nt, Escherichia coli CFT073
cagagaaucaugucagagcug

SEQ ID NO: 636005 - RNA, 13 nt, Escherichia coli CFT073
aaaaucaaaaacu

SEQ ID NO: 636006 - RNA, 15 nt, Escherichia coli CFT073
aaaaucaaaaacucu

SEQ ID NO: 636007 - RNA, 18 nt, Escherichia coli CFT073
cagagaaacgccagcagc

SEQ ID NO: 636008 - RNA, 15 nt, Escherichia coli CFT073
aaaaucaaaguuagu

SEQ ID NO: 636009 - RNA, 19 nt, Escherichia coli CFT073
aaaaucaaaguuaguaaaa

SEQ ID NO: 636010 - RNA, 13 nt, Escherichia coli CFT073
cagagaaagcaaa

SEQ ID NO: 636011 - RNA, 19 nt, Escherichia coli CFT073
cagagaaagcaaaaauaaa

SEQ ID NO: 636012 - RNA, 12 nt, Escherichia coli CFT073
cagacuuuucag

SEQ ID NO: 636013 - RNA, 16 nt, Escherichia coli CFT073
cagacucaucuucggc

SEQ ID NO: 636014 - RNA, 21 nt, Escherichia coli CFT073
cagacucauuuuuaacagugu

SEQ ID NO: 636015 - RNA, 14 nt, Escherichia coli CFT073
cagacuacugacga

SEQ ID NO: 636016 - RNA, 21 nt, Escherichia coli CFT073
cagacucagcaacagguaacc

SEQ ID NO: 636017 - RNA, 23 nt, Escherichia coli CFT073
cagacuaagcugcgggaaauaac

SEQ ID NO: 636018 - RNA, 16 nt, Escherichia coli CFT073
cagagauacaggccac

SEQ ID NO: 636019 - RNA, 23 nt, Escherichia coli CFT073
cagagcacuaacaugacaccaag

SEQ ID NO: 636020 - RNA, 18 nt, Escherichia coli CFT073
cagagagacauuggcaaa

SEQ ID NO: 636021 - RNA, 13 nt, Escherichia coli CFT073
cagagacaacccg

SEQ ID NO: 636022 - RNA, 16 nt, Escherichia coli CFT073
cagagacagaccaaaa

SEQ ID NO: 636023 - RNA, 20 nt, Escherichia coli CFT073
aaaaucagccauacggucug

SEQ ID NO: 636024 - RNA, 23 nt, Escherichia coli CFT073
cagagacucggugaccauccauu

SEQ ID NO: 636025 - RNA, 17 nt, Escherichia coli CFT073
aaaaucauauucuuuuu

SEQ ID NO: 636026 - RNA, 21 nt, Escherichia coli CFT073
aaaaucaucacgcgguuacgc

SEQ ID NO: 636027 - RNA, 22 nt, Escherichia coli CFT073
aaaaucaucugccgguuccagc

SEQ ID NO: 636028 - RNA, 16 nt, Escherichia coli CFT073
cagaggaggagagcag

SEQ ID NO: 636029 - RNA, 22 nt, Escherichia coli CFT073
cagaggauauucugcggcuuca

SEQ ID NO: 636030 - RNA, 15 nt, Escherichia coli CFT073
cagagugaccaccaa

SEQ ID NO: 636031 - RNA, 12 nt, Escherichia coli CFT073
cagagugcccac

SEQ ID NO: 636032 - RNA, 19 nt, Escherichia coli CFT073
cagagucuuugcuugcgaa

SEQ ID NO: 636033 - RNA, 18 nt, Escherichia coli CFT073
cagaguguauucaugccc

SEQ ID NO: 636034 - RNA, 22 nt, Escherichia coli CFT073
cagagcuuuguugcgcugaaau

SEQ ID NO: 636035 - RNA, 15 nt, Escherichia coli CFT073
cagagcugaauauca

SEQ ID NO: 636036 - RNA, 13 nt, Escherichia coli CFT073
cagagcagcaaca

SEQ ID NO: 636037 - RNA, 17 nt, Escherichia coli CFT073
cagagcagcaacaagcc

SEQ ID NO: 636038 - RNA, 17 nt, Escherichia coli CFT073
cagagccaaagaauugg

SEQ ID NO: 636039 - RNA, 17 nt, Escherichia coli CFT073
cagacaaucauuuccag

SEQ ID NO: 636040 - RNA, 15 nt, Escherichia coli CFT073
cagacaccagaauag

SEQ ID NO: 636041 - RNA, 23 nt, Escherichia coli CFT073
cagacaccagaauaguguuaacc

SEQ ID NO: 636042 - RNA, 15 nt, Escherichia coli CFT073
cagaauucgggaagu

SEQ ID NO: 636043 - RNA, 21 nt, Escherichia coli CFT073
cagaauuccgugccagcacca

SEQ ID NO: 636044 - RNA, 12 nt, Escherichia coli CFT073
cagacaucaagu

SEQ ID NO: 636045 - RNA, 12 nt, Escherichia coli CFT073
cagacagugucu

SEQ ID NO: 636046 - RNA, 20 nt, Escherichia coli CFT073
cagacagcguaauagccuga

SEQ ID NO: 636047 - RNA, 13 nt, Escherichia coli CFT073
cagacagaacgau

SEQ ID NO: 636048 - RNA, 16 nt, Escherichia coli CFT073
cagacacgccgccaga

SEQ ID NO: 636049 - RNA, 17 nt, Escherichia coli CFT073
cagacaccgauugcccc

SEQ ID NO: 636050 - RNA, 21 nt, Escherichia coli CFT073
cagacaccggcgcacaaccgc

SEQ ID NO: 636051 - RNA, 18 nt, Escherichia coli CFT073
cagacaccguuuccauau

SEQ ID NO: 636052 - RNA, 13 nt, Escherichia coli CFT073
cagaacacgccgu

SEQ ID NO: 636053 - RNA, 14 nt, Escherichia coli CFT073
cagaagaucaugcc

SEQ ID NO: 636054 - RNA, 18 nt, Escherichia coli CFT073
cagaagaucaugccgaca

SEQ ID NO: 636055 - RNA, 22 nt, Escherichia coli CFT073
cagaagagagauaauucagcag

SEQ ID NO: 636056 - RNA, 14 nt, Escherichia coli CFT073
cagaagaggagagu

SEQ ID NO: 636057 - RNA, 21 nt, Escherichia coli CFT073
cagaacacuucuucuguuucu

SEQ ID NO: 636058 - RNA, 18 nt, Escherichia coli CFT073
cagaaauucguaauccau

SEQ ID NO: 636059 - RNA, 12 nt, Escherichia coli CFT073
cagaaauuaaac

SEQ ID NO: 636060 - RNA, 20 nt, Escherichia coli CFT073
cagaagauucgaaaucuguu

SEQ ID NO: 636061 - RNA, 17 nt, Escherichia coli CFT073
cagaagcaucggugugu

SEQ ID NO: 636062 - RNA, 16 nt, Escherichia coli CFT073
cagaagcccaguuuuc

SEQ ID NO: 636063 - RNA, 17 nt, Escherichia coli CFT073
cagaaugguuuugucag

SEQ ID NO: 636064 - RNA, 15 nt, Escherichia coli CFT073
cagaauuaacgcuga

SEQ ID NO: 636065 - RNA, 16 nt, Escherichia coli CFT073
cagaauggcaucugau

SEQ ID NO: 636066 - RNA, 17 nt, Escherichia coli CFT073
cacuuucccuggcauga

SEQ ID NO: 636067 - RNA, 15 nt, Escherichia coli CFT073
cacuuuccaguuccg

SEQ ID NO: 636068 - RNA, 12 nt, Escherichia coli CFT073
cacuuucugcgc

SEQ ID NO: 636069 - RNA, 14 nt, Escherichia coli CFT073
cacgucguucgggc

SEQ ID NO: 636070 - RNA, 16 nt, Escherichia coli CFT073
cagaaaucggccuucc

SEQ ID NO: 636071 - RNA, 14 nt, Escherichia coli CFT073
cagaaaucagaguu

SEQ ID NO: 636072 - RNA, 17 nt, Escherichia coli CFT073
cagaaaucagcagcuuu

SEQ ID NO: 636073 - RNA, 17 nt, Escherichia coli CFT073
cagaaauagaaagugac

SEQ ID NO: 636074 - RNA, 22 nt, Escherichia coli CFT073
cagaaauagaccggagaaaaga

SEQ ID NO: 636075 - RNA, 18 nt, Escherichia coli CFT073
cagaaauagagaaagagu

SEQ ID NO: 636076 - RNA, 16 nt, Escherichia coli CFT073
cagaaacgccaccauu

SEQ ID NO: 636077 - RNA, 19 nt, Escherichia coli CFT073
cagaaacgccaucucuuua

SEQ ID NO: 636078 - RNA, 16 nt, Escherichia coli CFT073
cagaaacgcucauaaa

SEQ ID NO: 636079 - RNA, 23 nt, Escherichia coli CFT073
cagaaacaauaaguacgauacaa

SEQ ID NO: 636080 - RNA, 18 nt, Escherichia coli CFT073
cagaaaccaggucaaugc

SEQ ID NO: 636081 - RNA, 16 nt, Escherichia coli CFT073
cagaaacaguuguaaa

SEQ ID NO: 636082 - RNA, 20 nt, Escherichia coli CFT073
cagaaaccagccacggcgca

SEQ ID NO: 636083 - RNA, 17 nt, Escherichia coli CFT073
cagaaaaaacaaacggc

SEQ ID NO: 636084 - RNA, 19 nt, Escherichia coli CFT073
cagaaaaaaaacagcgccc

SEQ ID NO: 636085 - RNA, 13 nt, Escherichia coli CFT073
cagcgcacgggca

SEQ ID NO: 636086 - RNA, 23 nt, Escherichia coli CFT073
cagcgcaccgagugguucaucaa

SEQ ID NO: 636087 - RNA, 23 nt, Escherichia coli CFT073
cagcgcaccugugguagcggcuc

SEQ ID NO: 636088 - RNA, 14 nt, Escherichia coli CFT073
cagcgcaccagaaa

SEQ ID NO: 636089 - RNA, 20 nt, Escherichia coli CFT073
cagcgcaccacacaucggca

SEQ ID NO: 636090 - RNA, 22 nt, Escherichia coli CFT073
cagcgccaacggugaaaaacca

SEQ ID NO: 636091 - RNA, 13 nt, Escherichia coli CFT073
cagcgccaaucgc

SEQ ID NO: 636092 - RNA, 13 nt, Escherichia coli CFT073
cagcgagaagucg

SEQ ID NO: 636093 - RNA, 20 nt, Escherichia coli CFT073
cagcgagaaauacgcccuga

SEQ ID NO: 636094 - RNA, 22 nt, Escherichia coli CFT073
cagcgcaauaccgauaucgcca

SEQ ID NO: 636095 - RNA, 16 nt, Escherichia coli CFT073
cagcgcaauagccuga

SEQ ID NO: 636096 - RNA, 15 nt, Escherichia coli CFT073
cagcgcaaucaccgg

SEQ ID NO: 636097 - RNA, 14 nt, Escherichia coli CFT073
cagcgccaucgcca

SEQ ID NO: 636098 - RNA, 14 nt, Escherichia coli CFT073
cagcgcccaacacu

SEQ ID NO: 636099 - RNA, 21 nt, Escherichia coli CFT073
cagcgccacggaaacauucaa

SEQ ID NO: 636100 - RNA, 13 nt, Escherichia coli CFT073
cagcgccgcccac

SEQ ID NO: 636101 - RNA, 14 nt, Escherichia coli CFT073
cagcgcgcgaauau

SEQ ID NO: 636102 - RNA, 14 nt, Escherichia coli CFT073
cagcgcgcccggcg

SEQ ID NO: 636103 - RNA, 12 nt, Escherichia coli CFT073
cagcgcgauacg

SEQ ID NO: 636104 - RNA, 21 nt, Escherichia coli CFT073
cagcgcgacacaacagaccag

SEQ ID NO: 636105 - RNA, 22 nt, Escherichia coli CFT073
cagcgccugacggaucggcuca

SEQ ID NO: 636106 - RNA, 15 nt, Escherichia coli CFT073
cagccgccaucgcug

SEQ ID NO: 636107 - RNA, 13 nt, Escherichia coli CFT073
cagccgcccagcg

SEQ ID NO: 636108 - RNA, 16 nt, Escherichia coli CFT073
cagccaucgacaccag

SEQ ID NO: 636109 - RNA, 14 nt, Escherichia coli CFT073
cagccaucgccacc

SEQ ID NO: 636110 - RNA, 13 nt, Escherichia coli CFT073
cagccaugaugaa

SEQ ID NO: 636111 - RNA, 17 nt, Escherichia coli CFT073
cagccaugaugaauaac

SEQ ID NO: 636112 - RNA, 13 nt, Escherichia coli CFT073
cagccaugccacg

SEQ ID NO: 636113 - RNA, 17 nt, Escherichia coli CFT073
cagccaugcggcaucuu

SEQ ID NO: 636114 - RNA, 17 nt, Escherichia coli CFT073
cagccauuccugcaccu

SEQ ID NO: 636115 - RNA, 14 nt, Escherichia coli CFT073
cagccauucaaucu

SEQ ID NO: 636116 - RNA, 14 nt, Escherichia coli CFT073
cagcccuaucaucg

SEQ ID NO: 636117 - RNA, 17 nt, Escherichia coli CFT073
cagcccuucccggugcg

SEQ ID NO: 636118 - RNA, 19 nt, Escherichia coli CFT073
cagcccuucuuucacuuca

SEQ ID NO: 636119 - RNA, 15 nt, Escherichia coli CFT073
cagccuuuuucucug

SEQ ID NO: 636120 - RNA, 13 nt, Escherichia coli CFT073
cagccuuuuucuc

SEQ ID NO: 636121 - RNA, 14 nt, Escherichia coli CFT073
cagcgaaaccugaa

SEQ ID NO: 636122 - RNA, 16 nt, Escherichia coli CFT073
cagcgaaacucgcuga

SEQ ID NO: 636123 - RNA, 21 nt, Escherichia coli CFT073
cagccuuuucauccuccccca

SEQ ID NO: 636124 - RNA, 12 nt, Escherichia coli CFT073
cagccuuuuucu

SEQ ID NO: 636125 - RNA, 20 nt, Escherichia coli CFT073
cagcgaagcccacaccgccc

SEQ ID NO: 636126 - RNA, 21 nt, Escherichia coli CFT073
cagcgaagcccacaccgccca

SEQ ID NO: 636127 - RNA, 22 nt, Escherichia coli CFT073
cagcgaagcccacaccgcccag

SEQ ID NO: 636128 - RNA, 13 nt, Escherichia coli CFT073
cagcgaagucaca

SEQ ID NO: 636129 - RNA, 15 nt, Escherichia coli CFT073
cagcgaacaccagca

SEQ ID NO: 636130 - RNA, 19 nt, Escherichia coli CFT073
cagcgaacgacauccgcca

SEQ ID NO: 636131 - RNA, 24 nt, Escherichia coli CFT073
cagcgaagcauucagacacgccgc

SEQ ID NO: 636132 - RNA, 14 nt, Escherichia coli CFT073
cagcgacaccagcc

SEQ ID NO: 636133 - RNA, 17 nt, Escherichia coli CFT073
cagcgacaccagccauc

SEQ ID NO: 636134 - RNA, 16 nt, Escherichia coli CFT073
cagcgaauggguugua

SEQ ID NO: 636135 - RNA, 21 nt, Escherichia coli CFT073
cagcgaauaauucagcccaaa

SEQ ID NO: 636136 - RNA, 13 nt, Escherichia coli CFT073
cagccggcaaagu

SEQ ID NO: 636137 - RNA, 15 nt, Escherichia coli CFT073
cagccugauccacuu

SEQ ID NO: 636138 - RNA, 21 nt, Escherichia coli CFT073
cagccugauccacuuuagaca

SEQ ID NO: 636139 - RNA, 18 nt, Escherichia coli CFT073
cagccucuuccagagagg

SEQ ID NO: 636140 - RNA, 23 nt, Escherichia coli CFT073
  misc_feature (6)..(6): n is a, c, g or u
cagcanuaucgucuggcgcguga

SEQ ID NO: 636141 - RNA, 16 nt, Escherichia coli CFT073
cagcauaaauuucucg

SEQ ID NO: 636142 - RNA, 18 nt, Escherichia coli CFT073
cagcauaccuucacaaaa

SEQ ID NO: 636143 - RNA, 15 nt, Escherichia coli CFT073
cagcauaccuuccag

SEQ ID NO: 636144 - RNA, 20 nt, Escherichia coli CFT073
cagcauaaucaccaguaccg

SEQ ID NO: 636145 - RNA, 20 nt, Escherichia coli CFT073
cagcagugacaaucuccuuc

SEQ ID NO: 636146 - RNA, 19 nt, Escherichia coli CFT073
cagcagugccaucccaggg

SEQ ID NO: 636147 - RNA, 15 nt, Escherichia coli CFT073
cagcaguucagucag

SEQ ID NO: 636148 - RNA, 20 nt, Escherichia coli CFT073
cagcaguugcugacuuuccg

SEQ ID NO: 636149 - RNA, 21 nt, Escherichia coli CFT073
cagcaguuuuaccgaugcgcu

SEQ ID NO: 636150 - RNA, 17 nt, Escherichia coli CFT073
cagcagguguaguucac

SEQ ID NO: 636151 - RNA, 14 nt, Escherichia coli CFT073
cagcaguaaaccgc

SEQ ID NO: 636152 - RNA, 22 nt, Escherichia coli CFT073
cagcaguaaaccacccaccagc

SEQ ID NO: 636153 - RNA, 21 nt, Escherichia coli CFT073
cagcaguacgccgagaauaaa

SEQ ID NO: 636154 - RNA, 17 nt, Escherichia coli CFT073
cagcagguccaucacuu

SEQ ID NO: 636155 - RNA, 19 nt, Escherichia coli CFT073
cagcagggcaaucgcgcca

SEQ ID NO: 636156 - RNA, 22 nt, Escherichia coli CFT073
cagcaggaauaaucagcaguga

SEQ ID NO: 636157 - RNA, 18 nt, Escherichia coli CFT073
cagcagcuugcgccgccc

SEQ ID NO: 636158 - RNA, 23 nt, Escherichia coli CFT073
cagcaggauuugcgguagcgggc

SEQ ID NO: 636159 - RNA, 12 nt, Escherichia coli CFT073
cagcagacacau

SEQ ID NO: 636160 - RNA, 11 nt, Escherichia coli CFT073
cagcagaccag

SEQ ID NO: 636161 - RNA, 11 nt, Escherichia coli CFT073
cagcagcgcca

SEQ ID NO: 636162 - RNA, 23 nt, Escherichia coli CFT073
cagcagauaucccgccagcacca

SEQ ID NO: 636163 - RNA, 17 nt, Escherichia coli CFT073
cagcagacgcugcaccu

SEQ ID NO: 636164 - RNA, 15 nt, Escherichia coli CFT073
cagcagagcaaaaau

SEQ ID NO: 636165 - RNA, 16 nt, Escherichia coli CFT073
cagcagagcaugguua

SEQ ID NO: 636166 - RNA, 13 nt, Escherichia coli CFT073
cagcagcgccgcg

SEQ ID NO: 636167 - RNA, 16 nt, Escherichia coli CFT073
cagcagcgccaggcac

SEQ ID NO: 636168 - RNA, 17 nt, Escherichia coli CFT073
cagcaucagaguaugua

SEQ ID NO: 636169 - RNA, 21 nt, Escherichia coli CFT073
cagcaucagcaaauagauaaa

SEQ ID NO: 636170 - RNA, 19 nt, Escherichia coli CFT073
cagcauaugcacacgcagc

SEQ ID NO: 636171 - RNA, 13 nt, Escherichia coli CFT073
cagcaucccaccu

SEQ ID NO: 636172 - RNA, 23 nt, Escherichia coli CFT073
cagcaucgcauccggcaauaacu

SEQ ID NO: 636173 - RNA, 15 nt, Escherichia coli CFT073
cagcaucgccaucaa

SEQ ID NO: 636174 - RNA, 16 nt, Escherichia coli CFT073
cagcaucggccugcaa

SEQ ID NO: 636175 - RNA, 18 nt, Escherichia coli CFT073
cagcaucggcgcauucga

SEQ ID NO: 636176 - RNA, 22 nt, Escherichia coli CFT073
cagcaucggugaggaucaccag

SEQ ID NO: 636177 - RNA, 16 nt, Escherichia coli CFT073
cagcaucucugcaugu

SEQ ID NO: 636178 - RNA, 20 nt, Escherichia coli CFT073
cagcaucuccugcaacaggu

SEQ ID NO: 636179 - RNA, 15 nt, Escherichia coli CFT073
cagcaucgucaucag

SEQ ID NO: 636180 - RNA, 13 nt, Escherichia coli CFT073
cagcaugauacaa

SEQ ID NO: 636181 - RNA, 16 nt, Escherichia coli CFT073
cagcauucaucacaaa

SEQ ID NO: 636182 - RNA, 22 nt, Escherichia coli CFT073
cagcauucaucacaaaauagaa

SEQ ID NO: 636183 - RNA, 13 nt, Escherichia coli CFT073
cagcauucagcuu

SEQ ID NO: 636184 - RNA, 20 nt, Escherichia coli CFT073
cagcauggguaaagcccauc

SEQ ID NO: 636185 - RNA, 22 nt, Escherichia coli CFT073
cagcauggucgcagcggcuucc

SEQ ID NO: 636186 - RNA, 13 nt, Escherichia coli CFT073
cagcaugccgcca

SEQ ID NO: 636187 - RNA, 21 nt, Escherichia coli CFT073
cagcauugucaggaucaccaa

SEQ ID NO: 636188 - RNA, 17 nt, Escherichia coli CFT073
cagcauucccgccacca

SEQ ID NO: 636189 - RNA, 19 nt, Escherichia coli CFT073
cagcauucccgccaccauu

SEQ ID NO: 636190 - RNA, 19 nt, Escherichia coli CFT073
cagcauuuguugguacacc

SEQ ID NO: 636191 - RNA, 24 nt, Escherichia coli CFT073
cagcauuuguugguacaccugcug

SEQ ID NO: 636192 - RNA, 16 nt, Escherichia coli CFT073
cagccacaccaaucaa

SEQ ID NO: 636193 - RNA, 14 nt, Escherichia coli CFT073
cagccaaaaaugac

SEQ ID NO: 636194 - RNA, 20 nt, Escherichia coli CFT073
cagccacaggccggucaucc

SEQ ID NO: 636195 - RNA, 15 nt, Escherichia coli CFT073
cagccacaccuucuu

SEQ ID NO: 636196 - RNA, 21 nt, Escherichia coli CFT073
cagccacgacguuugguggaa

SEQ ID NO: 636197 - RNA, 16 nt, Escherichia coli CFT073
cagccacggcgcauga

SEQ ID NO: 636198 - RNA, 12 nt, Escherichia coli CFT073
cagccacggcag

SEQ ID NO: 636199 - RNA, 16 nt, Escherichia coli CFT073
cagccacggcuccagc

SEQ ID NO: 636200 - RNA, 17 nt, Escherichia coli CFT073
cagccacggcuccagca

SEQ ID NO: 636201 - RNA, 14 nt, Escherichia coli CFT073
cagccagcgccgcg

SEQ ID NO: 636202 - RNA, 22 nt, Escherichia coli CFT073
cagccagcgcuuugauggcacu

SEQ ID NO: 636203 - RNA, 17 nt, Escherichia coli CFT073
cagccagcgcaccagcg

SEQ ID NO: 636204 - RNA, 13 nt, Escherichia coli CFT073
cagccagcgcagg

SEQ ID NO: 636205 - RNA, 21 nt, Escherichia coli CFT073
cagccagccgcuaacuuccug

SEQ ID NO: 636206 - RNA, 23 nt, Escherichia coli CFT073
cagccaggguucccggccaaagc

SEQ ID NO: 636207 - RNA, 14 nt, Escherichia coli CFT073
cagccaggccgcca

SEQ ID NO: 636208 - RNA, 17 nt, Escherichia coli CFT073
cagccagcguuacccag

SEQ ID NO: 636209 - RNA, 19 nt, Escherichia coli CFT073
cagccagcguuacccagac

SEQ ID NO: 636210 - RNA, 19 nt, Escherichia coli CFT073
cagccaggaauccagcacg

SEQ ID NO: 636211 - RNA, 14 nt, Escherichia coli CFT073
caguaguugcucaa

SEQ ID NO: 636212 - RNA, 16 nt, Escherichia coli CFT073
caguaguugcucaagc

SEQ ID NO: 636213 - RNA, 21 nt, Escherichia coli CFT073
caguagcguaaaggcugccag

SEQ ID NO: 636214 - RNA, 20 nt, Escherichia coli CFT073
caguagcuauaaaccugcug

SEQ ID NO: 636215 - RNA, 17 nt, Escherichia coli CFT073
caguagcaccucuccac

SEQ ID NO: 636216 - RNA, 20 nt, Escherichia coli CFT073
caguagcaccucuccacgca

SEQ ID NO: 636217 - RNA, 19 nt, Escherichia coli CFT073
caguagcauccccggcaac

SEQ ID NO: 636218 - RNA, 19 nt, Escherichia coli CFT073
caguacguguuguuccagu

SEQ ID NO: 636219 - RNA, 17 nt, Escherichia coli CFT073
caguacucgcacuuuuc

SEQ ID NO: 636220 - RNA, 21 nt, Escherichia coli CFT073
caguacggucgugcgguuuca

SEQ ID NO: 636221 - RNA, 21 nt, Escherichia coli CFT073
caguacggcagcaaucgacca

SEQ ID NO: 636222 - RNA, 12 nt, Escherichia coli CFT073
caguacggcagc

SEQ ID NO: 636223 - RNA, 17 nt, Escherichia coli CFT073
caguacggcuauauaca

SEQ ID NO: 636224 - RNA, 19 nt, Escherichia coli CFT073
caguacggcuauauacagc

SEQ ID NO: 636225 - RNA, 19 nt, Escherichia coli CFT073
caguagauccuugcggauc

SEQ ID NO: 636226 - RNA, 15 nt, Escherichia coli CFT073
caguagaauaaugau

SEQ ID NO: 636227 - RNA, 16 nt, Escherichia coli CFT073
caguacugacuaucca

SEQ ID NO: 636228 - RNA, 16 nt, Escherichia coli CFT073
caguacuguacaacac

SEQ ID NO: 636229 - RNA, 17 nt, Escherichia coli CFT073
caguaccugcaaaccgu

SEQ ID NO: 636230 - RNA, 20 nt, Escherichia coli CFT073
caguaccuucguccauccca

SEQ ID NO: 636231 - RNA, 21 nt, Escherichia coli CFT073
caguaccuucguccaucccac

SEQ ID NO: 636232 - RNA, 19 nt, Escherichia coli CFT073
caguacgccauucgcugug

SEQ ID NO: 636233 - RNA, 21 nt, Escherichia coli CFT073
caguacgcggacacuuuccug

SEQ ID NO: 636234 - RNA, 17 nt, Escherichia coli CFT073
caguacgcgggguuuua

SEQ ID NO: 636235 - RNA, 22 nt, Escherichia coli CFT073
cagucauacuuauugaaagcaa

SEQ ID NO: 636236 - RNA, 20 nt, Escherichia coli CFT073
cagucaucacuuucagaccg

SEQ ID NO: 636237 - RNA, 15 nt, Escherichia coli CFT073
cagucagcaccagac

SEQ ID NO: 636238 - RNA, 23 nt, Escherichia coli CFT073
cagucaggcgauuguuuagaucc

SEQ ID NO: 636239 - RNA, 13 nt, Escherichia coli CFT073
caguccaaucagg

SEQ ID NO: 636240 - RNA, 22 nt, Escherichia coli CFT073
caguccacacugagcaccacac

SEQ ID NO: 636241 - RNA, 12 nt, Escherichia coli CFT073
caguccacggcu

SEQ ID NO: 636242 - RNA, 13 nt, Escherichia coli CFT073
caguccagcgccu

SEQ ID NO: 636243 - RNA, 15 nt, Escherichia coli CFT073
caguccagcgccuga

SEQ ID NO: 636244 - RNA, 17 nt, Escherichia coli CFT073
cagucccauaacauauu

SEQ ID NO: 636245 - RNA, 22 nt, Escherichia coli CFT073
cagucccauaacauauucaccc

SEQ ID NO: 636246 - RNA, 16 nt, Escherichia coli CFT073
caguccccacaucaca

SEQ ID NO: 636247 - RNA, 21 nt, Escherichia coli CFT073
caguccaguauagaaggugac

SEQ ID NO: 636248 - RNA, 19 nt, Escherichia coli CFT073
caguccauggcagaugauc

SEQ ID NO: 636249 - RNA, 20 nt, Escherichia coli CFT073
caguccauggcagaugauca

SEQ ID NO: 636250 - RNA, 12 nt, Escherichia coli CFT073
caguccaucggc

SEQ ID NO: 636251 - RNA, 13 nt, Escherichia coli CFT073
cagucacugccac

SEQ ID NO: 636252 - RNA, 18 nt, Escherichia coli CFT073
cagucacugccaccaucc

SEQ ID NO: 636253 - RNA, 15 nt, Escherichia coli CFT073
cagucacgguuaauc

SEQ ID NO: 636254 - RNA, 14 nt, Escherichia coli CFT073
cagucacugugacg

SEQ ID NO: 636255 - RNA, 14 nt, Escherichia coli CFT073
cagucacuucaaau

SEQ ID NO: 636256 - RNA, 14 nt, Escherichia coli CFT073
cagucacccgcugc

SEQ ID NO: 636257 - RNA, 18 nt, Escherichia coli CFT073
cagucacccugcccggca

SEQ ID NO: 636258 - RNA, 16 nt, Escherichia coli CFT073
cagucaccagcaucag

SEQ ID NO: 636259 - RNA, 16 nt, Escherichia coli CFT073
cagucacgacaaagac

SEQ ID NO: 636260 - RNA, 14 nt, Escherichia coli CFT073
cagucacgcaacau

SEQ ID NO: 636261 - RNA, 13 nt, Escherichia coli CFT073
cagucacagggga

SEQ ID NO: 636262 - RNA, 20 nt, Escherichia coli CFT073
cagucaaaacuuuucaccag

SEQ ID NO: 636263 - RNA, 15 nt, Escherichia coli CFT073
caguaugcaacaacu

SEQ ID NO: 636264 - RNA, 19 nt, Escherichia coli CFT073
caguaugcaacaacucuaa

SEQ ID NO: 636265 - RNA, 16 nt, Escherichia coli CFT073
caguauuaccagaccu

SEQ ID NO: 636266 - RNA, 19 nt, Escherichia coli CFT073
caguauucagaucagcggc

SEQ ID NO: 636267 - RNA, 13 nt, Escherichia coli CFT073
caguauuucuuug

SEQ ID NO: 636268 - RNA, 14 nt, Escherichia coli CFT073
cagucucaaaccgg

SEQ ID NO: 636269 - RNA, 15 nt, Escherichia coli CFT073
cagucgucaucccag

SEQ ID NO: 636270 - RNA, 15 nt, Escherichia coli CFT073
cagucgggugcugcc

SEQ ID NO: 636271 - RNA, 21 nt, Escherichia coli CFT073
cagucguaaugaaucagcaga

SEQ ID NO: 636272 - RNA, 19 nt, Escherichia coli CFT073
cagucgcgcuucguuuucc

SEQ ID NO: 636273 - RNA, 21 nt, Escherichia coli CFT073
cagucggccaugugcuuuucc

SEQ ID NO: 636274 - RNA, 12 nt, Escherichia coli CFT073
caguccugcagg

SEQ ID NO: 636275 - RNA, 15 nt, Escherichia coli CFT073
caguccuguucaaac

SEQ ID NO: 636276 - RNA, 14 nt, Escherichia coli CFT073
caguccucaucauc

SEQ ID NO: 636277 - RNA, 19 nt, Escherichia coli CFT073
caguccucaucauccucuu

SEQ ID NO: 636278 - RNA, 18 nt, Escherichia coli CFT073
cagucgcaaaucagcggc

SEQ ID NO: 636279 - RNA, 16 nt, Escherichia coli CFT073
caguccgcgguugguu

SEQ ID NO: 636280 - RNA, 23 nt, Escherichia coli CFT073
caguccgguggagagcauauaaa

SEQ ID NO: 636281 - RNA, 18 nt, Escherichia coli CFT073
caguccccucgccccucc

SEQ ID NO: 636282 - RNA, 21 nt, Escherichia coli CFT073
cagucccugaaucgccacgcc

SEQ ID NO: 636283 - RNA, 16 nt, Escherichia coli CFT073
cagugacugcuuuuuc

SEQ ID NO: 636284 - RNA, 17 nt, Escherichia coli CFT073
cagugacugcuuuuuca

SEQ ID NO: 636285 - RNA, 18 nt, Escherichia coli CFT073
cagugacugcuuuuucaa

SEQ ID NO: 636286 - RNA, 23 nt, Escherichia coli CFT073
cagugacgucacuuaaugucaca

SEQ ID NO: 636287 - RNA, 21 nt, Escherichia coli CFT073
cagugaccaucuuccagcauc

SEQ ID NO: 636288 - RNA, 20 nt, Escherichia coli CFT073
cagugaccgaaccuguuuuc

SEQ ID NO: 636289 - RNA, 23 nt, Escherichia coli CFT073
cagugaucuggcuggcaacccag

SEQ ID NO: 636290 - RNA, 14 nt, Escherichia coli CFT073
cagugauucauagu

SEQ ID NO: 636291 - RNA, 17 nt, Escherichia coli CFT073
cagugauuuuugcugaa

SEQ ID NO: 636292 - RNA, 23 nt, Escherichia coli CFT073
cagugauuuuugcugaacgccac

SEQ ID NO: 636293 - RNA, 19 nt, Escherichia coli CFT073
cagugcaaagacaucgcug

SEQ ID NO: 636294 - RNA, 15 nt, Escherichia coli CFT073
cagugcaacuuuacu

SEQ ID NO: 636295 - RNA, 16 nt, Escherichia coli CFT073
cagugcagaugcacaa

SEQ ID NO: 636296 - RNA, 23 nt, Escherichia coli CFT073
cagugcagcaucgcuguuuuucg

SEQ ID NO: 636297 - RNA, 17 nt, Escherichia coli CFT073
cagugcaggcaccagcc

SEQ ID NO: 636298 - RNA, 18 nt, Escherichia coli CFT073
cagugcaggcaccagccc

SEQ ID NO: 636299 - RNA, 12 nt, Escherichia coli CFT073
cagucuuaaaaa

SEQ ID NO: 636300 - RNA, 16 nt, Escherichia coli CFT073
cagucuuaaaaagcag

SEQ ID NO: 636301 - RNA, 19 nt, Escherichia coli CFT073
cagucuggcguuuucuuuu

SEQ ID NO: 636302 - RNA, 20 nt, Escherichia coli CFT073
cagugaaaacgcauaccagu

SEQ ID NO: 636303 - RNA, 13 nt, Escherichia coli CFT073
cagucuuccugcg

SEQ ID NO: 636304 - RNA, 15 nt, Escherichia coli CFT073
cagucuuaagcggcu

SEQ ID NO: 636305 - RNA, 16 nt, Escherichia coli CFT073
cagugacauucaccuc

SEQ ID NO: 636306 - RNA, 14 nt, Escherichia coli CFT073
cagugacagcccca

SEQ ID NO: 636307 - RNA, 20 nt, Escherichia coli CFT073
cagugaauaagcgcccagcu

SEQ ID NO: 636308 - RNA, 16 nt, Escherichia coli CFT073
cagugaaucucaggca

SEQ ID NO: 636309 - RNA, 17 nt, Escherichia coli CFT073
cagugaauuaaaaacag

SEQ ID NO: 636310 - RNA, 13 nt, Escherichia coli CFT073
caguaauuuccug

SEQ ID NO: 636311 - RNA, 18 nt, Escherichia coli CFT073
caguaauuuccugccagc

SEQ ID NO: 636312 - RNA, 20 nt, Escherichia coli CFT073
caguaaggccugguucaucg

SEQ ID NO: 636313 - RNA, 19 nt, Escherichia coli CFT073
caguaagggaucacgcggu

SEQ ID NO: 636314 - RNA, 13 nt, Escherichia coli CFT073
caguaagguuugu

SEQ ID NO: 636315 - RNA, 10 nt, Escherichia coli CFT073
caguaaucag

SEQ ID NO: 636316 - RNA, 13 nt, Escherichia coli CFT073
caguaccagcagu

SEQ ID NO: 636317 - RNA, 14 nt, Escherichia coli CFT073
caguaccagcaccu

SEQ ID NO: 636318 - RNA, 16 nt, Escherichia coli CFT073
caguaccagcaccuga

SEQ ID NO: 636319 - RNA, 16 nt, Escherichia coli CFT073
caguacaguaccgaac

SEQ ID NO: 636320 - RNA, 13 nt, Escherichia coli CFT073
caguaccaccgcg

SEQ ID NO: 636321 - RNA, 12 nt, Escherichia coli CFT073
caguacaaacau

SEQ ID NO: 636322 - RNA, 13 nt, Escherichia coli CFT073
caguacaccaauu

SEQ ID NO: 636323 - RNA, 12 nt, Escherichia coli CFT073
caguacacgcug

SEQ ID NO: 636324 - RNA, 18 nt, Escherichia coli CFT073
caguacacgcugaagauc

SEQ ID NO: 636325 - RNA, 12 nt, Escherichia coli CFT073
caguaacccagc

SEQ ID NO: 636326 - RNA, 14 nt, Escherichia coli CFT073
caguaacugcugua

SEQ ID NO: 636327 - RNA, 16 nt, Escherichia coli CFT073
caguaagcaguccagc

SEQ ID NO: 636328 - RNA, 18 nt, Escherichia coli CFT073
caguaagcaguccagcgc

SEQ ID NO: 636329 - RNA, 21 nt, Escherichia coli CFT073
caguaagcaguccagcgccug

SEQ ID NO: 636330 - RNA, 22 nt, Escherichia coli CFT073
caguaaaacgggcgcgaugaca

SEQ ID NO: 636331 - RNA, 13 nt, Escherichia coli CFT073
caguaaaaccggu

SEQ ID NO: 636332 - RNA, 20 nt, Escherichia coli CFT073
caguaaaaucgacaucugca

SEQ ID NO: 636333 - RNA, 19 nt, Escherichia coli CFT073
caguaaacacaccacagca

SEQ ID NO: 636334 - RNA, 15 nt, Escherichia coli CFT073
caguaaaccacauca

SEQ ID NO: 636335 - RNA, 21 nt, Escherichia coli CFT073
caguaaaccacccaccagcgc

SEQ ID NO: 636336 - RNA, 17 nt, Escherichia coli CFT073
caguaaccagaaaccgu

SEQ ID NO: 636337 - RNA, 18 nt, Escherichia coli CFT073
caguaaccagaaaccgug

SEQ ID NO: 636338 - RNA, 14 nt, Escherichia coli CFT073
caguaaccagccgu

SEQ ID NO: 636339 - RNA, 13 nt, Escherichia coli CFT073
caguaaacuguca

SEQ ID NO: 636340 - RNA, 20 nt, Escherichia coli CFT073
caguaaacugucaacaccag

SEQ ID NO: 636341 - RNA, 17 nt, Escherichia coli CFT073
caguaaagcgcaaaaua

SEQ ID NO: 636342 - RNA, 23 nt, Escherichia coli CFT073
caguaaagcgcaaaauaccagca

SEQ ID NO: 636343 - RNA, 22 nt, Escherichia coli CFT073
caguaaaguaucaaacagaaaa

SEQ ID NO: 636344 - RNA, 13 nt, Escherichia coli CFT073
caguaaauaaaaa

SEQ ID NO: 636345 - RNA, 15 nt, Escherichia coli CFT073
caguaaauaaaaaau

SEQ ID NO: 636346 - RNA, 19 nt, Escherichia coli CFT073
cagguucugaccagccagc

SEQ ID NO: 636347 - RNA, 19 nt, Escherichia coli CFT073
cagguugaggugcugaagg

SEQ ID NO: 636348 - RNA, 21 nt, Escherichia coli CFT073
cagguugaugaguuggcuacu

SEQ ID NO: 636349 - RNA, 14 nt, Escherichia coli CFT073
cagguuuaccagca

SEQ ID NO: 636350 - RNA, 16 nt, Escherichia coli CFT073
cagguuuaccagcagc

SEQ ID NO: 636351 - RNA, 20 nt, Escherichia coli CFT073
cagguuggcuuuuuuauaca

SEQ ID NO: 636352 - RNA, 15 nt, Escherichia coli CFT073
cagguuggcaucacc

SEQ ID NO: 636353 - RNA, 12 nt, Escherichia coli CFT073
cagguuggaaag

SEQ ID NO: 636354 - RNA, 22 nt, Escherichia coli CFT073
cagguuggaucaacaggcacua

SEQ ID NO: 636355 - RNA, 15 nt, Escherichia coli CFT073
cagguuuaucaugcu

SEQ ID NO: 636356 - RNA, 14 nt, Escherichia coli CFT073
aaacaaaucacuau

SEQ ID NO: 636357 - RNA, 13 nt, Escherichia coli CFT073
aaacaaccccauc

SEQ ID NO: 636358 - RNA, 23 nt, Escherichia coli CFT073
aaacaaauuuugaacagaacugg

SEQ ID NO: 636359 - RNA, 18 nt, Escherichia coli CFT073
cagguuuguacaacguaa

SEQ ID NO: 636360 - RNA, 15 nt, Escherichia coli CFT073
aaacaacgcuucaaa

SEQ ID NO: 636361 - RNA, 20 nt, Escherichia coli CFT073
cagguuuuucagcugcccac

SEQ ID NO: 636362 - RNA, 22 nt, Escherichia coli CFT073
cagguuuuuacccaacucuuua

SEQ ID NO: 636363 - RNA, 17 nt, Escherichia coli CFT073
cagguuuuucagcugcc

SEQ ID NO: 636364 - RNA, 12 nt, Escherichia coli CFT073
cagguucaacag

SEQ ID NO: 636365 - RNA, 15 nt, Escherichia coli CFT073
cagguuaggcugaga

SEQ ID NO: 636366 - RNA, 17 nt, Escherichia coli CFT073
cagguuacgcccuuccc

SEQ ID NO: 636367 - RNA, 14 nt, Escherichia coli CFT073
cagguuauaccuuu

SEQ ID NO: 636368 - RNA, 22 nt, Escherichia coli CFT073
cagguuaacccacagcgcacca

SEQ ID NO: 636369 - RNA, 13 nt, Escherichia coli CFT073
cagguuaacgcag

SEQ ID NO: 636370 - RNA, 18 nt, Escherichia coli CFT073
cagguguuacgccgcacc

SEQ ID NO: 636371 - RNA, 19 nt, Escherichia coli CFT073
cagguggcguuugccaccu

SEQ ID NO: 636372 - RNA, 20 nt, Escherichia coli CFT073
cagguggucacagucugcuc

SEQ ID NO: 636373 - RNA, 15 nt, Escherichia coli CFT073
cagguguaauaaagu

SEQ ID NO: 636374 - RNA, 15 nt, Escherichia coli CFT073
cagguguaguucacc

SEQ ID NO: 636375 - RNA, 16 nt, Escherichia coli CFT073
cagguggcauguuacc

SEQ ID NO: 636376 - RNA, 16 nt, Escherichia coli CFT073
caggugcuuuuguuau

SEQ ID NO: 636377 - RNA, 20 nt, Escherichia coli CFT073
caggugauuagucuuuaucu

SEQ ID NO: 636378 - RNA, 18 nt, Escherichia coli CFT073
caggucuuucugaaaugg

SEQ ID NO: 636379 - RNA, 14 nt, Escherichia coli CFT073
caggugaaauccgg

SEQ ID NO: 636380 - RNA, 16 nt, Escherichia coli CFT073
caggugacaccaccgc

SEQ ID NO: 636381 - RNA, 16 nt, Escherichia coli CFT073
caggugaaaaauaaaa

SEQ ID NO: 636382 - RNA, 17 nt, Escherichia coli CFT073
caggugaaaaauaaaag

SEQ ID NO: 636383 - RNA, 22 nt, Escherichia coli CFT073
caggugcgugcgcccaucauug

SEQ ID NO: 636384 - RNA, 11 nt, Escherichia coli CFT073
caggugcagcc

SEQ ID NO: 636385 - RNA, 15 nt, Escherichia coli CFT073
caggucggauaagac

SEQ ID NO: 636386 - RNA, 16 nt, Escherichia coli CFT073
caggucggauaagacg

SEQ ID NO: 636387 - RNA, 17 nt, Escherichia coli CFT073
caggucggauaagacgc

SEQ ID NO: 636388 - RNA, 23 nt, Escherichia coli CFT073
caggucgcgcauuaccucaauaa

SEQ ID NO: 636389 - RNA, 15 nt, Escherichia coli CFT073
caggucgaaaauaau

SEQ ID NO: 636390 - RNA, 17 nt, Escherichia coli CFT073
cagguccaucacuugcu

SEQ ID NO: 636391 - RNA, 23 nt, Escherichia coli CFT073
cagguccaucacuugcugcaccu

SEQ ID NO: 636392 - RNA, 14 nt, Escherichia coli CFT073
caggucaaucccag

SEQ ID NO: 636393 - RNA, 19 nt, Escherichia coli CFT073
caggucaaucccaggaagc

SEQ ID NO: 636394 - RNA, 18 nt, Escherichia coli CFT073
cagguauuuugucagccc

SEQ ID NO: 636395 - RNA, 21 nt, Escherichia coli CFT073
cagguauuguguugccgggcg

SEQ ID NO: 636396 - RNA, 15 nt, Escherichia coli CFT073
cagggaacacaugug

SEQ ID NO: 636397 - RNA, 14 nt, Escherichia coli CFT073
caggcuucauacac

SEQ ID NO: 636398 - RNA, 14 nt, Escherichia coli CFT073
caggcuggcugacc

SEQ ID NO: 636399 - RNA, 20 nt, Escherichia coli CFT073
caggcuuacgaaguuccugc

SEQ ID NO: 636400 - RNA, 13 nt, Escherichia coli CFT073
caggcuucaacac

SEQ ID NO: 636401 - RNA, 20 nt, Escherichia coli CFT073
caggcugggcacucuuggca

SEQ ID NO: 636402 - RNA, 20 nt, Escherichia coli CFT073
caggcuggagcguugcgcca

SEQ ID NO: 636403 - RNA, 16 nt, Escherichia coli CFT073
caggcuccagauaaca

SEQ ID NO: 636404 - RNA, 14 nt, Escherichia coli CFT073
caggcuaucggcca

SEQ ID NO: 636405 - RNA, 21 nt, Escherichia coli CFT073
caggcuaucuucgauaaacuc

SEQ ID NO: 636406 - RNA, 20 nt, Escherichia coli CFT073
caggcgucgcaucaggcauu

SEQ ID NO: 636407 - RNA, 14 nt, Escherichia coli CFT073
caggcgguggaaca

SEQ ID NO: 636408 - RNA, 22 nt, Escherichia coli CFT073
caggcguaacgacaugaagauc

SEQ ID NO: 636409 - RNA, 13 nt, Escherichia coli CFT073
caggcgcaccagc

SEQ ID NO: 636410 - RNA, 21 nt, Escherichia coli CFT073
caggcgauuuaaucccgugcc

SEQ ID NO: 636411 - RNA, 23 nt, Escherichia coli CFT073
caggcgauuucaaauugcucgaa

SEQ ID NO: 636412 - RNA, 17 nt, Escherichia coli CFT073
cagggaaguagauaccc

SEQ ID NO: 636413 - RNA, 19 nt, Escherichia coli CFT073
cagggcaauacgcuccgcc

SEQ ID NO: 636414 - RNA, 20 nt, Escherichia coli CFT073
cagggcaauguaacaccugu

SEQ ID NO: 636415 - RNA, 16 nt, Escherichia coli CFT073
cagggcagcauggggc

SEQ ID NO: 636416 - RNA, 14 nt, Escherichia coli CFT073
cagggcgucaccgg

SEQ ID NO: 636417 - RNA, 23 nt, Escherichia coli CFT073
cagggcgcuguugcuaucggcga

SEQ ID NO: 636418 - RNA, 22 nt, Escherichia coli CFT073
aaaauuuuuucagauaaaagcu

SEQ ID NO: 636419 - RNA, 18 nt, Escherichia coli CFT073
cagggcggcuaucccaaa

SEQ ID NO: 636420 - RNA, 16 nt, Escherichia coli CFT073
cagggccuccugcagc

SEQ ID NO: 636421 - RNA, 16 nt, Escherichia coli CFT073
caggaucugcgcggca

SEQ ID NO: 636422 - RNA, 18 nt, Escherichia coli CFT073
caggauauauuucaucaa

SEQ ID NO: 636423 - RNA, 13 nt, Escherichia coli CFT073
caggauaucugaa

SEQ ID NO: 636424 - RNA, 16 nt, Escherichia coli CFT073
caggauauuuauauuu

SEQ ID NO: 636425 - RNA, 23 nt, Escherichia coli CFT073
caggaucaccaauaccagcauca

SEQ ID NO: 636426 - RNA, 21 nt, Escherichia coli CFT073
caggaugagaaaagagaugaa

SEQ ID NO: 636427 - RNA, 18 nt, Escherichia coli CFT073
caggcaucgugcaccaau

SEQ ID NO: 636428 - RNA, 18 nt, Escherichia coli CFT073
caggcaugauacgccaau

SEQ ID NO: 636429 - RNA, 12 nt, Escherichia coli CFT073
caggcaugcaau

SEQ ID NO: 636430 - RNA, 16 nt, Escherichia coli CFT073
caggccaucagcagcg

SEQ ID NO: 636431 - RNA, 22 nt, Escherichia coli CFT073
caggccaccucgcaacaauguc

SEQ ID NO: 636432 - RNA, 20 nt, Escherichia coli CFT073
caggccacgaaucagcaccg

SEQ ID NO: 636433 - RNA, 19 nt, Escherichia coli CFT073
caggccccgucagcaaaau

SEQ ID NO: 636434 - RNA, 19 nt, Escherichia coli CFT073
caggcgauugaguauuaaa

SEQ ID NO: 636435 - RNA, 19 nt, Escherichia coli CFT073
caggccgaugccugcuuau

SEQ ID NO: 636436 - RNA, 22 nt, Escherichia coli CFT073
caggccgccagcaccgauugcc

SEQ ID NO: 636437 - RNA, 20 nt, Escherichia coli CFT073
caggccgauagacacugccg

SEQ ID NO: 636438 - RNA, 17 nt, Escherichia coli CFT073
aaaauuuggauuuuugc

SEQ ID NO: 636439 - RNA, 13 nt, Escherichia coli CFT073
aaaauuuggauuu

SEQ ID NO: 636440 - RNA, 12 nt, Escherichia coli CFT073
caggaauauacc

SEQ ID NO: 636441 - RNA, 23 nt, Escherichia coli CFT073
aaaauuucucuuucacuccauug

SEQ ID NO: 636442 - RNA, 14 nt, Escherichia coli CFT073
caggaauaagacag

SEQ ID NO: 636443 - RNA, 16 nt, Escherichia coli CFT073
aaaauuucuaucauca

SEQ ID NO: 636444 - RNA, 14 nt, Escherichia coli CFT073
caggaaggcugacc

SEQ ID NO: 636445 - RNA, 20 nt, Escherichia coli CFT073
caggaaccgaucagauugag

SEQ ID NO: 636446 - RNA, 13 nt, Escherichia coli CFT073
caggaacagccac

SEQ ID NO: 636447 - RNA, 12 nt, Escherichia coli CFT073
caggaacgccau

SEQ ID NO: 636448 - RNA, 19 nt, Escherichia coli CFT073
caggaaccugugacagcag

SEQ ID NO: 636449 - RNA, 21 nt, Escherichia coli CFT073
caggaaccugugacagcagcg

SEQ ID NO: 636450 - RNA, 18 nt, Escherichia coli CFT073
caggaacgcgccaagaua

SEQ ID NO: 636451 - RNA, 15 nt, Escherichia coli CFT073
caggauaacggcaga

SEQ ID NO: 636452 - RNA, 14 nt, Escherichia coli CFT073
caggagacaccagc

SEQ ID NO: 636453 - RNA, 22 nt, Escherichia coli CFT073
aaaauuuuauccgcaaagauuu

SEQ ID NO: 636454 - RNA, 23 nt, Escherichia coli CFT073
aaaauuuuauccgcaaagauuug

SEQ ID NO: 636455 - RNA, 14 nt, Escherichia coli CFT073
caggacgaauacaa

SEQ ID NO: 636456 - RNA, 14 nt, Escherichia coli CFT073
caggacgcaauguc

SEQ ID NO: 636457 - RNA, 17 nt, Escherichia coli CFT073
cagcuuauccagcaacg

SEQ ID NO: 636458 - RNA, 16 nt, Escherichia coli CFT073
cagcuuacgcgccaga

SEQ ID NO: 636459 - RNA, 18 nt, Escherichia coli CFT073
cagcuuauuaacagucag

SEQ ID NO: 636460 - RNA, 19 nt, Escherichia coli CFT073
cagcuuauuaacagucagu

SEQ ID NO: 636461 - RNA, 15 nt, Escherichia coli CFT073
cagcuguuucaucuc

SEQ ID NO: 636462 - RNA, 12 nt, Escherichia coli CFT073
cagcuucaucau

SEQ ID NO: 636463 - RNA, 13 nt, Escherichia coli CFT073
cagcuucacggaa

SEQ ID NO: 636464 - RNA, 19 nt, Escherichia coli CFT073
cagcuguccgauuuguucu

SEQ ID NO: 636465 - RNA, 18 nt, Escherichia coli CFT073
cagcugucguacccaguc

SEQ ID NO: 636466 - RNA, 23 nt, Escherichia coli CFT073
cagcucugcgcccugcaucacug

SEQ ID NO: 636467 - RNA, 15 nt, Escherichia coli CFT073
caggaacaacgacag

SEQ ID NO: 636468 - RNA, 22 nt, Escherichia coli CFT073
caggaaauuauggaucaccauc

SEQ ID NO: 636469 - RNA, 14 nt, Escherichia coli CFT073
caggaacagauacu

SEQ ID NO: 636470 - RNA, 15 nt, Escherichia coli CFT073
cagcuuuuuccugcg

SEQ ID NO: 636471 - RNA, 23 nt, Escherichia coli CFT073
cagcuuuugcaaacaacgcuuca

SEQ ID NO: 636472 - RNA, 22 nt, Escherichia coli CFT073
cagcuuuuacaaaaucuucguu

SEQ ID NO: 636473 - RNA, 21 nt, Escherichia coli CFT073
cagcuuuuccauaucaagcau

SEQ ID NO: 636474 - RNA, 20 nt, Escherichia coli CFT073
cagcuuugcccgaucaucaa

SEQ ID NO: 636475 - RNA, 18 nt, Escherichia coli CFT073
cagcuuucggguggccag

SEQ ID NO: 636476 - RNA, 19 nt, Escherichia coli CFT073
cagcuuucggguggccagc

SEQ ID NO: 636477 - RNA, 16 nt, Escherichia coli CFT073
cagcuugcgauccugc

SEQ ID NO: 636478 - RNA, 12 nt, Escherichia coli CFT073
cagcuugagaaa

SEQ ID NO: 636479 - RNA, 13 nt, Escherichia coli CFT073
cagcucacgcagc

SEQ ID NO: 636480 - RNA, 17 nt, Escherichia coli CFT073
cagcuacaccgaucacc

SEQ ID NO: 636481 - RNA, 19 nt, Escherichia coli CFT073
cagcuacgaaggugcauug

SEQ ID NO: 636482 - RNA, 18 nt, Escherichia coli CFT073
cagcuacgcaucaugccg

SEQ ID NO: 636483 - RNA, 23 nt, Escherichia coli CFT073
cagcuacgcaucaugccgcccag

SEQ ID NO: 636484 - RNA, 20 nt, Escherichia coli CFT073
cagcucacggccagucauuu

SEQ ID NO: 636485 - RNA, 16 nt, Escherichia coli CFT073
cagcucacugauaaua

SEQ ID NO: 636486 - RNA, 21 nt, Escherichia coli CFT073
cagcucacgcgccagcuucac

SEQ ID NO: 636487 - RNA, 18 nt, Escherichia coli CFT073
cagcucacuucgauccag

SEQ ID NO: 636488 - RNA, 20 nt, Escherichia coli CFT073
aaaauugucuuuuucaaagu

SEQ ID NO: 636489 - RNA, 16 nt, Escherichia coli CFT073
cagcgcuggagagcgc

SEQ ID NO: 636490 - RNA, 16 nt, Escherichia coli CFT073
cagcgcugcccaccac

SEQ ID NO: 636491 - RNA, 18 nt, Escherichia coli CFT073
cagcgcgguaacgcacag

SEQ ID NO: 636492 - RNA, 16 nt, Escherichia coli CFT073
aaaauuuaacauuacu

SEQ ID NO: 636493 - RNA, 17 nt, Escherichia coli CFT073
aaaauuuauccagcgca

SEQ ID NO: 636494 - RNA, 16 nt, Escherichia coli CFT073
cagcuccagaauuccg

SEQ ID NO: 636495 - RNA, 22 nt, Escherichia coli CFT073
cagcuccagaguaacuucacca

SEQ ID NO: 636496 - RNA, 16 nt, Escherichia coli CFT073
cagcuccagcgcuucu

SEQ ID NO: 636497 - RNA, 11 nt, Escherichia coli CFT073
cagcuccagcc

SEQ ID NO: 636498 - RNA, 19 nt, Escherichia coli CFT073
cagcuccagcccgcgucgu

SEQ ID NO: 636499 - RNA, 18 nt, Escherichia coli CFT073
cagcuccccacaccacca

SEQ ID NO: 636500 - RNA, 17 nt, Escherichia coli CFT073
cagcuccggcacuuccc

SEQ ID NO: 636501 - RNA, 20 nt, Escherichia coli CFT073
cagcuccgggcuaacacccg

SEQ ID NO: 636502 - RNA, 15 nt, Escherichia coli CFT073
ccagccccucagcgg

SEQ ID NO: 636503 - RNA, 12 nt, Escherichia coli CFT073
ccagcccgccga

SEQ ID NO: 636504 - RNA, 13 nt, Escherichia coli CFT073
ccagcccacaugc

SEQ ID NO: 636505 - RNA, 14 nt, Escherichia coli CFT073
ccagccccaccagc

SEQ ID NO: 636506 - RNA, 10 nt, Escherichia coli CFT073
ccagccacac

SEQ ID NO: 636507 - RNA, 12 nt, Escherichia coli CFT073
ccagccacacca

SEQ ID NO: 636508 - RNA, 14 nt, Escherichia coli CFT073
ccagccacaggccg

SEQ ID NO: 636509 - RNA, 18 nt, Escherichia coli CFT073
ccagccaacaaucgcugc

SEQ ID NO: 636510 - RNA, 22 nt, Escherichia coli CFT073
ccagccaacgccuuuaccacca

SEQ ID NO: 636511 - RNA, 16 nt, Escherichia coli CFT073
ccagccagacucagca

SEQ ID NO: 636512 - RNA, 14 nt, Escherichia coli CFT073
ccagccacggcagc

SEQ ID NO: 636513 - RNA, 14 nt, Escherichia coli CFT073
ccagccacugcgcg

SEQ ID NO: 636514 - RNA, 18 nt, Escherichia coli CFT073
ccagccauuaaccagcca

SEQ ID NO: 636515 - RNA, 23 nt, Escherichia coli CFT073
ccagccaguauugccaugcacgc

SEQ ID NO: 636516 - RNA, 14 nt, Escherichia coli CFT073
ccagccagguguug

SEQ ID NO: 636517 - RNA, 14 nt, Escherichia coli CFT073
ccagcagucgacca

SEQ ID NO: 636518 - RNA, 17 nt, Escherichia coli CFT073
ccagcauaacguggcgc

SEQ ID NO: 636519 - RNA, 20 nt, Escherichia coli CFT073
ccagcauaacuaauuccgcu

SEQ ID NO: 636520 - RNA, 16 nt, Escherichia coli CFT073
ccagcaguugcugacu

SEQ ID NO: 636521 - RNA, 15 nt, Escherichia coli CFT073
ccagcauaccuucca

SEQ ID NO: 636522 - RNA, 16 nt, Escherichia coli CFT073
ccagcaguaaaccacc

SEQ ID NO: 636523 - RNA, 18 nt, Escherichia coli CFT073
ccagcaguaaaccaccca

SEQ ID NO: 636524 - RNA, 23 nt, Escherichia coli CFT073
ccagcaguaaaccacccaccagc

SEQ ID NO: 636525 - RNA, 20 nt, Escherichia coli CFT073
ccagcaguaauuuugcucac

SEQ ID NO: 636526 - RNA, 13 nt, Escherichia coli CFT073
ccagcagggcaau

SEQ ID NO: 636527 - RNA, 18 nt, Escherichia coli CFT073
ccagcaggaucaauacca

SEQ ID NO: 636528 - RNA, 19 nt, Escherichia coli CFT073
ccagcaucuccugcaacag

SEQ ID NO: 636529 - RNA, 17 nt, Escherichia coli CFT073
ccagcaucggcaacgcc

SEQ ID NO: 636530 - RNA, 19 nt, Escherichia coli CFT073
ccagcaucggcaacgccag

SEQ ID NO: 636531 - RNA, 22 nt, Escherichia coli CFT073
ccagcaucgaaaaugccacugc

SEQ ID NO: 636532 - RNA, 23 nt, Escherichia coli CFT073
ccagcaucgaaaaugccacugcg

SEQ ID NO: 636533 - RNA, 17 nt, Escherichia coli CFT073
ccagcaucgaccaggau

SEQ ID NO: 636534 - RNA, 14 nt, Escherichia coli CFT073
ccagcaucauaaau

SEQ ID NO: 636535 - RNA, 15 nt, Escherichia coli CFT073
ccagcaucagaccca

SEQ ID NO: 636536 - RNA, 11 nt, Escherichia coli CFT073
ccagcauuucu

SEQ ID NO: 636537 - RNA, 14 nt, Escherichia coli CFT073
ccagcauuucuucc

SEQ ID NO: 636538 - RNA, 15 nt, Escherichia coli CFT073
ccagcaugccugugg

SEQ ID NO: 636539 - RNA, 14 nt, Escherichia coli CFT073
ccagcaaaaucacc

SEQ ID NO: 636540 - RNA, 18 nt, Escherichia coli CFT073
ccagauuuuucaguauuu

SEQ ID NO: 636541 - RNA, 20 nt, Escherichia coli CFT073
ccagauuguuauccagcugu

SEQ ID NO: 636542 - RNA, 17 nt, Escherichia coli CFT073
ccagauuguacuuucca

SEQ ID NO: 636543 - RNA, 22 nt, Escherichia coli CFT073
ccagauuguacuuuccagccac

SEQ ID NO: 636544 - RNA, 17 nt, Escherichia coli CFT073
ccagcaacaacagcgcg

SEQ ID NO: 636545 - RNA, 15 nt, Escherichia coli CFT073
ccagcaaaaucacca

SEQ ID NO: 636546 - RNA, 18 nt, Escherichia coli CFT073
ccagcaacuguaacgcag

SEQ ID NO: 636547 - RNA, 13 nt, Escherichia coli CFT073
ccagcaagaacca

SEQ ID NO: 636548 - RNA, 16 nt, Escherichia coli CFT073
ccagcaagagcaaaua

SEQ ID NO: 636549 - RNA, 19 nt, Escherichia coli CFT073
ccagcaacugauacaccuu

SEQ ID NO: 636550 - RNA, 23 nt, Escherichia coli CFT073
ccagcaaccaacgcuagcagcag

SEQ ID NO: 636551 - RNA, 17 nt, Escherichia coli CFT073
ccagcaaccaaugccgc

SEQ ID NO: 636552 - RNA, 20 nt, Escherichia coli CFT073
ccagcaaccaaugccgccag

SEQ ID NO: 636553 - RNA, 20 nt, Escherichia coli CFT073
ccagcaacauuggcucauca

SEQ ID NO: 636554 - RNA, 23 nt, Escherichia coli CFT073
ccagcaauuuacguuuuucuucc

SEQ ID NO: 636555 - RNA, 16 nt, Escherichia coli CFT073
ccagcaauuugcgcuc

SEQ ID NO: 636556 - RNA, 21 nt, Escherichia coli CFT073
ccagcaauuugcgcucaauaa

SEQ ID NO: 636557 - RNA, 14 nt, Escherichia coli CFT073
ccagcaauaacuaa

SEQ ID NO: 636558 - RNA, 17 nt, Escherichia coli CFT073
ccagcaauccccagaca

SEQ ID NO: 636559 - RNA, 20 nt, Escherichia coli CFT073
ccagcaauccccagacaaaa

SEQ ID NO: 636560 - RNA, 12 nt, Escherichia coli CFT073
ccagcaauacaa

SEQ ID NO: 636561 - RNA, 14 nt, Escherichia coli CFT073
ccagcaauacaaau

SEQ ID NO: 636562 - RNA, 16 nt, Escherichia coli CFT073
ccagcaauacaaauga

SEQ ID NO: 636563 - RNA, 14 nt, Escherichia coli CFT073
ccagcaauccccag

SEQ ID NO: 636564 - RNA, 21 nt, Escherichia coli CFT073
ccagcaagcugugcgauagca

SEQ ID NO: 636565 - RNA, 12 nt, Escherichia coli CFT073
ccagcaccagcu

SEQ ID NO: 636566 - RNA, 13 nt, Escherichia coli CFT073
ccagcaccaguac

SEQ ID NO: 636567 - RNA, 15 nt, Escherichia coli CFT073
ccagcaccagcaaca

SEQ ID NO: 636568 - RNA, 20 nt, Escherichia coli CFT073
ccagcacaucaucaaagcca

SEQ ID NO: 636569 - RNA, 9 nt, Escherichia coli CFT073
ccagcacau

SEQ ID NO: 636570 - RNA, 20 nt, Escherichia coli CFT073
ccagcacauaacucauacug

SEQ ID NO: 636571 - RNA, 16 nt, Escherichia coli CFT073
ccagcacagccagccu

SEQ ID NO: 636572 - RNA, 13 nt, Escherichia coli CFT073
ccagcaccugaau

SEQ ID NO: 636573 - RNA, 23 nt, Escherichia coli CFT073
ccagcaccgcagagaucgccccg

SEQ ID NO: 636574 - RNA, 18 nt, Escherichia coli CFT073
ccagcaccgccagcagca

SEQ ID NO: 636575 - RNA, 18 nt, Escherichia coli CFT073
ccagcaccgcuggcucac

SEQ ID NO: 636576 - RNA, 13 nt, Escherichia coli CFT073
ccagcagagauac

SEQ ID NO: 636577 - RNA, 18 nt, Escherichia coli CFT073
ccagcagagaucuuucac

SEQ ID NO: 636578 - RNA, 16 nt, Escherichia coli CFT073
ccagcacuuccugaau

SEQ ID NO: 636579 - RNA, 16 nt, Escherichia coli CFT073
ccagcacugccagcca

SEQ ID NO: 636580 - RNA, 15 nt, Escherichia coli CFT073
ccagcacuaccgccc

SEQ ID NO: 636581 - RNA, 23 nt, Escherichia coli CFT073
ccagcacuuuucgcacugcaggc

SEQ ID NO: 636582 - RNA, 17 nt, Escherichia coli CFT073
ccagcacguugugcccu

SEQ ID NO: 636583 - RNA, 20 nt, Escherichia coli CFT073
ccagcacguugugcccuucc

SEQ ID NO: 636584 - RNA, 20 nt, Escherichia coli CFT073
ccagcacgcaggcaucuuuu

SEQ ID NO: 636585 - RNA, 13 nt, Escherichia coli CFT073
ccagcagcugcuc

SEQ ID NO: 636586 - RNA, 14 nt, Escherichia coli CFT073
ccagcagcugcucc

SEQ ID NO: 636587 - RNA, 16 nt, Escherichia coli CFT073
ccagcagcugcuccca

SEQ ID NO: 636588 - RNA, 18 nt, Escherichia coli CFT073
ccagcagcugcucccagc

SEQ ID NO: 636589 - RNA, 21 nt, Escherichia coli CFT073
ccagcagcugcucccagcgca

SEQ ID NO: 636590 - RNA, 14 nt, Escherichia coli CFT073
ccagcagcggcaga

SEQ ID NO: 636591 - RNA, 22 nt, Escherichia coli CFT073
ccagcagcgcaaagcccgccgc

SEQ ID NO: 636592 - RNA, 13 nt, Escherichia coli CFT073
ccagcagcagcgg

SEQ ID NO: 636593 - RNA, 19 nt, Escherichia coli CFT073
ccagcagcagcgaauaauu

SEQ ID NO: 636594 - RNA, 22 nt, Escherichia coli CFT073
ccagcagcagcgaauaauucag

SEQ ID NO: 636595 - RNA, 12 nt, Escherichia coli CFT073
ccagcagauggc

SEQ ID NO: 636596 - RNA, 13 nt, Escherichia coli CFT073
ccagcagcaacca

SEQ ID NO: 636597 - RNA, 23 nt, Escherichia coli CFT073
ccagacgaaugaagcagaagccg

SEQ ID NO: 636598 - RNA, 15 nt, Escherichia coli CFT073
ccagacgacggcugc

SEQ ID NO: 636599 - RNA, 20 nt, Escherichia coli CFT073
ccagaccugaauuugcucca

SEQ ID NO: 636600 - RNA, 17 nt, Escherichia coli CFT073
ccagacgccccaguaaa

SEQ ID NO: 636601 - RNA, 20 nt, Escherichia coli CFT073
ccagacgccccaguaaacac

SEQ ID NO: 636602 - RNA, 22 nt, Escherichia coli CFT073
ccagacgcccgcgcccaggcca

SEQ ID NO: 636603 - RNA, 14 nt, Escherichia coli CFT073
ccagacgauuuucc

SEQ ID NO: 636604 - RNA, 13 nt, Escherichia coli CFT073
ccagacgauggcu

SEQ ID NO: 636605 - RNA, 18 nt, Escherichia coli CFT073
ccagacgcaaccugaugu

SEQ ID NO: 636606 - RNA, 15 nt, Escherichia coli CFT073
ccagaccgccuuuga

SEQ ID NO: 636607 - RNA, 19 nt, Escherichia coli CFT073
ccagaccgcgcuugccgcc

SEQ ID NO: 636608 - RNA, 15 nt, Escherichia coli CFT073
ccagaccacagguaa

SEQ ID NO: 636609 - RNA, 17 nt, Escherichia coli CFT073
ccagacagccucaagca

SEQ ID NO: 636610 - RNA, 21 nt, Escherichia coli CFT073
ccagacauuacaaaauacaaa

SEQ ID NO: 636611 - RNA, 19 nt, Escherichia coli CFT073
ccagacaucaccaguaccg

SEQ ID NO: 636612 - RNA, 23 nt, Escherichia coli CFT073
ccagacaucaccaguaccgccac

SEQ ID NO: 636613 - RNA, 19 nt, Escherichia coli CFT073
ccagacguccggcgcugca

SEQ ID NO: 636614 - RNA, 17 nt, Escherichia coli CFT073
ccagacugcgcauuaaa

SEQ ID NO: 636615 - RNA, 23 nt, Escherichia coli CFT073
ccagacugaugugcuccaucagg

SEQ ID NO: 636616 - RNA, 19 nt, Escherichia coli CFT073
ccagagagcggagcaauga

SEQ ID NO: 636617 - RNA, 16 nt, Escherichia coli CFT073
ccagacuuuguugaau

SEQ ID NO: 636618 - RNA, 22 nt, Escherichia coli CFT073
ccagacuuggucgguauuuccg

SEQ ID NO: 636619 - RNA, 22 nt, Escherichia coli CFT073
ccagagaacugaacaccgccuu

SEQ ID NO: 636620 - RNA, 11 nt, Escherichia coli CFT073
ccagagucagc

SEQ ID NO: 636621 - RNA, 17 nt, Escherichia coli CFT073
ccagagucagcaaugcc

SEQ ID NO: 636622 - RNA, 18 nt, Escherichia coli CFT073
ccagagucagcaaugcca

SEQ ID NO: 636623 - RNA, 13 nt, Escherichia coli CFT073
ccagaggggcgag

SEQ ID NO: 636624 - RNA, 13 nt, Escherichia coli CFT073
ccagagcuaaaau

SEQ ID NO: 636625 - RNA, 15 nt, Escherichia coli CFT073
ccagagcccguuacc

SEQ ID NO: 636626 - RNA, 13 nt, Escherichia coli CFT073
ccagagccgcgcc

SEQ ID NO: 636627 - RNA, 21 nt, Escherichia coli CFT073
ccagauaaauucgaccauugc

SEQ ID NO: 636628 - RNA, 13 nt, Escherichia coli CFT073
ccagauaacccag

SEQ ID NO: 636629 - RNA, 17 nt, Escherichia coli CFT073
ccagauaaggcguucac

SEQ ID NO: 636630 - RNA, 18 nt, Escherichia coli CFT073
ccagauaagacacugacg

SEQ ID NO: 636631 - RNA, 21 nt, Escherichia coli CFT073
ccagaguggauuaucuucacc

SEQ ID NO: 636632 - RNA, 21 nt, Escherichia coli CFT073
ccagauacccgacagauaaau

SEQ ID NO: 636633 - RNA, 18 nt, Escherichia coli CFT073
ccagaucacgcagcaagc

SEQ ID NO: 636634 - RNA, 16 nt, Escherichia coli CFT073
ccagaucaaacaaccg

SEQ ID NO: 636635 - RNA, 19 nt, Escherichia coli CFT073
ccagaucagacccagaacc

SEQ ID NO: 636636 - RNA, 15 nt, Escherichia coli CFT073
ccagauagccagguu

SEQ ID NO: 636637 - RNA, 15 nt, Escherichia coli CFT073
ccagauccagcaagg

SEQ ID NO: 636638 - RNA, 21 nt, Escherichia coli CFT073
ccagaugcggcgugaacgccu

SEQ ID NO: 636639 - RNA, 14 nt, Escherichia coli CFT073
ccagaucuucauca

SEQ ID NO: 636640 - RNA, 14 nt, Escherichia coli CFT073
ccagaucuuccagc

SEQ ID NO: 636641 - RNA, 14 nt, Escherichia coli CFT073
ccagaucugcuuca

SEQ ID NO: 636642 - RNA, 23 nt, Escherichia coli CFT073
ccagaucguguuuugcaaucauc

SEQ ID NO: 636643 - RNA, 16 nt, Escherichia coli CFT073
ccagaucgguaauuga

SEQ ID NO: 636644 - RNA, 13 nt, Escherichia coli CFT073
ccagauugaacuc

SEQ ID NO: 636645 - RNA, 21 nt, Escherichia coli CFT073
ccagauggcuuuccaccauca

SEQ ID NO: 636646 - RNA, 18 nt, Escherichia coli CFT073
ccagauguggugccagug

SEQ ID NO: 636647 - RNA, 16 nt, Escherichia coli CFT073
ccagaaaauacucagc

SEQ ID NO: 636648 - RNA, 15 nt, Escherichia coli CFT073
ccagaaacaauaagu

SEQ ID NO: 636649 - RNA, 20 nt, Escherichia coli CFT073
ccagaaacagaguauaaaaa

SEQ ID NO: 636650 - RNA, 21 nt, Escherichia coli CFT073
ccagaaacagaguauaaaaaa

SEQ ID NO: 636651 - RNA, 13 nt, Escherichia coli CFT073
ccagaaaaccugg

SEQ ID NO: 636652 - RNA, 18 nt, Escherichia coli CFT073
ccagaaaaccuggcgcag

SEQ ID NO: 636653 - RNA, 15 nt, Escherichia coli CFT073
ccagaaacaucccca

SEQ ID NO: 636654 - RNA, 22 nt, Escherichia coli CFT073
ccagaaaccaguuuuugcgccc

SEQ ID NO: 636655 - RNA, 13 nt, Escherichia coli CFT073
ccagaaaccgugu

SEQ ID NO: 636656 - RNA, 13 nt, Escherichia coli CFT073
ccacuuuggugaa

SEQ ID NO: 636657 - RNA, 22 nt, Escherichia coli CFT073
ccacuuuuuauuuacucuccug

SEQ ID NO: 636658 - RNA, 18 nt, Escherichia coli CFT073
ccagaaaucggccuucca

SEQ ID NO: 636659 - RNA, 15 nt, Escherichia coli CFT073
ccagaaaguuuuuca

SEQ ID NO: 636660 - RNA, 20 nt, Escherichia coli CFT073
ccagaaauagaccggagaaa

SEQ ID NO: 636661 - RNA, 13 nt, Escherichia coli CFT073
ccagaaaucacca

SEQ ID NO: 636662 - RNA, 11 nt, Escherichia coli CFT073
ccagaaaucag

SEQ ID NO: 636663 - RNA, 16 nt, Escherichia coli CFT073
ccagaaaucagcagcu

SEQ ID NO: 636664 - RNA, 20 nt, Escherichia coli CFT073
ccagaacacgcucccagcag

SEQ ID NO: 636665 - RNA, 12 nt, Escherichia coli CFT073
ccagaaccagca

SEQ ID NO: 636666 - RNA, 18 nt, Escherichia coli CFT073
ccagaaccagcaaccacu

SEQ ID NO: 636667 - RNA, 21 nt, Escherichia coli CFT073
ccagaaccugaggcaauaaau

SEQ ID NO: 636668 - RNA, 18 nt, Escherichia coli CFT073
ccagaacgcugccuugcu

SEQ ID NO: 636669 - RNA, 16 nt, Escherichia coli CFT073
ccagaauauguucgcu

SEQ ID NO: 636670 - RNA, 23 nt, Escherichia coli CFT073
ccagaauauugccgaagaccaga

SEQ ID NO: 636671 - RNA, 12 nt, Escherichia coli CFT073
ccagaauaccuu

SEQ ID NO: 636672 - RNA, 20 nt, Escherichia coli CFT073
ccagaauaacgcggcaggag

SEQ ID NO: 636673 - RNA, 22 nt, Escherichia coli CFT073
ccagaacucaucuucuuuuucc

SEQ ID NO: 636674 - RNA, 21 nt, Escherichia coli CFT073
ccagaacugcugcgccagcgg

SEQ ID NO: 636675 - RNA, 17 nt, Escherichia coli CFT073
ccagaauccccacaaac

SEQ ID NO: 636676 - RNA, 15 nt, Escherichia coli CFT073
ccagaaucaucauau

SEQ ID NO: 636677 - RNA, 21 nt, Escherichia coli CFT073
ccagaauuccgugccagcacc

SEQ ID NO: 636678 - RNA, 21 nt, Escherichia coli CFT073
ccagaaugcggaugagauaca

SEQ ID NO: 636679 - RNA, 16 nt, Escherichia coli CFT073
ccagacaauccagcga

SEQ ID NO: 636680 - RNA, 14 nt, Escherichia coli CFT073
ccagacacaacaau

SEQ ID NO: 636681 - RNA, 22 nt, Escherichia coli CFT073
ccagacacaguucuucaaaaau

SEQ ID NO: 636682 - RNA, 15 nt, Escherichia coli CFT073
ccagacacaguucuu

SEQ ID NO: 636683 - RNA, 15 nt, Escherichia coli CFT073
ccagacaccgcugcu

SEQ ID NO: 636684 - RNA, 13 nt, Escherichia coli CFT073
ccacuucauacuc

SEQ ID NO: 636685 - RNA, 16 nt, Escherichia coli CFT073
ccacuucaucgucaua

SEQ ID NO: 636686 - RNA, 13 nt, Escherichia coli CFT073
ccacuucaugccc

SEQ ID NO: 636687 - RNA, 21 nt, Escherichia coli CFT073
ccacuuccaccacuuccugcu

SEQ ID NO: 636688 - RNA, 21 nt, Escherichia coli CFT073
ccacugugaguggcuccaugu

SEQ ID NO: 636689 - RNA, 12 nt, Escherichia coli CFT073
ccacuguuucaa

SEQ ID NO: 636690 - RNA, 19 nt, Escherichia coli CFT073
ccacuguuugaucugcugc

SEQ ID NO: 636691 - RNA, 20 nt, Escherichia coli CFT073
ccacuuaacguuaccuuuaa

SEQ ID NO: 636692 - RNA, 18 nt, Escherichia coli CFT073
ccacuucacgaugcagcg

SEQ ID NO: 636693 - RNA, 13 nt, Escherichia coli CFT073
ccacuugcagcuc

SEQ ID NO: 636694 - RNA, 15 nt, Escherichia coli CFT073
ccacuugcagcucau

SEQ ID NO: 636695 - RNA, 18 nt, Escherichia coli CFT073
ccacuuuacgcaaaauau

SEQ ID NO: 636696 - RNA, 15 nt, Escherichia coli CFT073
ccacuuuacgggcaa

SEQ ID NO: 636697 - RNA, 22 nt, Escherichia coli CFT073
ccacuuuacgggcaaucuccug

SEQ ID NO: 636698 - RNA, 16 nt, Escherichia coli CFT073
ccacuuucacgccgcc

SEQ ID NO: 636699 - RNA, 17 nt, Escherichia coli CFT073
ccacuuucacgccgcca

SEQ ID NO: 636700 - RNA, 22 nt, Escherichia coli CFT073
ccacuucuguuuguagaugccc

SEQ ID NO: 636701 - RNA, 19 nt, Escherichia coli CFT073
ccacuucuuucacgcccgc

SEQ ID NO: 636702 - RNA, 16 nt, Escherichia coli CFT073
ccacuggauguugcau

SEQ ID NO: 636703 - RNA, 21 nt, Escherichia coli CFT073
ccacuggcaauaauaucccaa

SEQ ID NO: 636704 - RNA, 19 nt, Escherichia coli CFT073
ccacugcgacaccagcaug

SEQ ID NO: 636705 - RNA, 22 nt, Escherichia coli CFT073
ccacugcgccaacgucugccug

SEQ ID NO: 636706 - RNA, 14 nt, Escherichia coli CFT073
ccacugcgccgcuc

SEQ ID NO: 636707 - RNA, 19 nt, Escherichia coli CFT073
ccacugcauggcggcgucu

SEQ ID NO: 636708 - RNA, 13 nt, Escherichia coli CFT073
ccacgccaagaaa

SEQ ID NO: 636709 - RNA, 14 nt, Escherichia coli CFT073
ccacgccaaaaagc

SEQ ID NO: 636710 - RNA, 18 nt, Escherichia coli CFT073
ccacgccaauguguuuau

SEQ ID NO: 636711 - RNA, 15 nt, Escherichia coli CFT073
ccacgccacgcugcc

SEQ ID NO: 636712 - RNA, 16 nt, Escherichia coli CFT073
ccaccuggcggcgugu

SEQ ID NO: 636713 - RNA, 13 nt, Escherichia coli CFT073
ccaccugcccggc

SEQ ID NO: 636714 - RNA, 22 nt, Escherichia coli CFT073
ccaccggaauggucaccacaaa

SEQ ID NO: 636715 - RNA, 19 nt, Escherichia coli CFT073
ccaccggcaagaaugauac

SEQ ID NO: 636716 - RNA, 21 nt, Escherichia coli CFT073
ccaccgucgggcugacguuaa

SEQ ID NO: 636717 - RNA, 22 nt, Escherichia coli CFT073
ccaccguuuaccucgucaccac

SEQ ID NO: 636718 - RNA, 13 nt, Escherichia coli CFT073
ccaccgucaucac

SEQ ID NO: 636719 - RNA, 21 nt, Escherichia coli CFT073
ccaccaauacuugcgaaucau

SEQ ID NO: 636720 - RNA, 16 nt, Escherichia coli CFT073
ccaccaaacugcgccc

SEQ ID NO: 636721 - RNA, 14 nt, Escherichia coli CFT073
ccaccaccaccugc

SEQ ID NO: 636722 - RNA, 12 nt, Escherichia coli CFT073
ccaccacaaaag

SEQ ID NO: 636723 - RNA, 12 nt, Escherichia coli CFT073
ccaccaccagac

SEQ ID NO: 636724 - RNA, 18 nt, Escherichia coli CFT073
ccacccaccgcagcccag

SEQ ID NO: 636725 - RNA, 13 nt, Escherichia coli CFT073
ccaccagcgacag

SEQ ID NO: 636726 - RNA, 14 nt, Escherichia coli CFT073
ccaccgcagcccag

SEQ ID NO: 636727 - RNA, 20 nt, Escherichia coli CFT073
ccaccgcaaucgcggcagcg

SEQ ID NO: 636728 - RNA, 22 nt, Escherichia coli CFT073
ccaccgaguaauaacaguaaug

SEQ ID NO: 636729 - RNA, 17 nt, Escherichia coli CFT073
ccacccgcagcaagcgu

SEQ ID NO: 636730 - RNA, 14 nt, Escherichia coli CFT073
ccacccgauacccu

SEQ ID NO: 636731 - RNA, 21 nt, Escherichia coli CFT073
ccacccccauaauccaugcca

SEQ ID NO: 636732 - RNA, 18 nt, Escherichia coli CFT073
ccacacucucgcgcagcg

SEQ ID NO: 636733 - RNA, 18 nt, Escherichia coli CFT073
ccacacugagcaccacac

SEQ ID NO: 636734 - RNA, 17 nt, Escherichia coli CFT073
ccacacgcgcccagccu

SEQ ID NO: 636735 - RNA, 14 nt, Escherichia coli CFT073
ccacaccgcccagc

SEQ ID NO: 636736 - RNA, 21 nt, Escherichia coli CFT073
ccacaaucucgcccgcuucau

SEQ ID NO: 636737 - RNA, 16 nt, Escherichia coli CFT073
ccacaccugccgggaa

SEQ ID NO: 636738 - RNA, 15 nt, Escherichia coli CFT073
ccacaucaaucccuu

SEQ ID NO: 636739 - RNA, 21 nt, Escherichia coli CFT073
ccacauauguuuaaccggcag

SEQ ID NO: 636740 - RNA, 18 nt, Escherichia coli CFT073
ccacaguugaucagccag

SEQ ID NO: 636741 - RNA, 18 nt, Escherichia coli CFT073
ccacaguuuuacugcagc

SEQ ID NO: 636742 - RNA, 19 nt, Escherichia coli CFT073
ccacaguuuuacugcagcc

SEQ ID NO: 636743 - RNA, 18 nt, Escherichia coli CFT073
ccacaguuuuucaccguu

SEQ ID NO: 636744 - RNA, 16 nt, Escherichia coli CFT073
ccacauugcugcacau

SEQ ID NO: 636745 - RNA, 21 nt, Escherichia coli CFT073
ccacauugugggauuccagcg

SEQ ID NO: 636746 - RNA, 23 nt, Escherichia coli CFT073
ccacauuagucauuacucaucca

SEQ ID NO: 636747 - RNA, 17 nt, Escherichia coli CFT073
ccacaugccugcauaaa

SEQ ID NO: 636748 - RNA, 23 nt, Escherichia coli CFT073
ccacaugaucauucaccagccca

SEQ ID NO: 636749 - RNA, 18 nt, Escherichia coli CFT073
ccacauggagcuuuaaac

SEQ ID NO: 636750 - RNA, 14 nt, Escherichia coli CFT073
ccacauggcgugca

SEQ ID NO: 636751 - RNA, 14 nt, Escherichia coli CFT073
ccacaucgccauau

SEQ ID NO: 636752 - RNA, 21 nt, Escherichia coli CFT073
ccacaucgguuugcgcagcuu

SEQ ID NO: 636753 - RNA, 23 nt, Escherichia coli CFT073
ccacaucgguuugcgcagcuuug

SEQ ID NO: 636754 - RNA, 19 nt, Escherichia coli CFT073
ccacaucggcaucaggcca

SEQ ID NO: 636755 - RNA, 21 nt, Escherichia coli CFT073
ccacauccggcauauuaacca

SEQ ID NO: 636756 - RNA, 12 nt, Escherichia coli CFT073
ccacauccagcg

SEQ ID NO: 636757 - RNA, 17 nt, Escherichia coli CFT073
ccacauccagcggcaga

SEQ ID NO: 636758 - RNA, 14 nt, Escherichia coli CFT073
ccacauccaugcuu

SEQ ID NO: 636759 - RNA, 13 nt, Escherichia coli CFT073
ccacaucacacca

SEQ ID NO: 636760 - RNA, 23 nt, Escherichia coli CFT073
ccacaucacaccauccagcaaca

SEQ ID NO: 636761 - RNA, 13 nt, Escherichia coli CFT073
ccaauguuuuucu

SEQ ID NO: 636762 - RNA, 14 nt, Escherichia coli CFT073
ccaauguuuuucuc

SEQ ID NO: 636763 - RNA, 16 nt, Escherichia coli CFT073
ccaauguuuuucuccu

SEQ ID NO: 636764 - RNA, 19 nt, Escherichia coli CFT073
ccaauuaauugugcuccuu

SEQ ID NO: 636765 - RNA, 20 nt, Escherichia coli CFT073
ccaauuacacacaacacauc

SEQ ID NO: 636766 - RNA, 12 nt, Escherichia coli CFT073
ccaaugccaaug

SEQ ID NO: 636767 - RNA, 15 nt, Escherichia coli CFT073
ccaaugaccacuccg

SEQ ID NO: 636768 - RNA, 13 nt, Escherichia coli CFT073
ccaaugauuuuga

SEQ ID NO: 636769 - RNA, 18 nt, Escherichia coli CFT073
ccaauaaaaaucagauau

SEQ ID NO: 636770 - RNA, 18 nt, Escherichia coli CFT073
ccaauaauccccaauacg

SEQ ID NO: 636771 - RNA, 19 nt, Escherichia coli CFT073
ccacaagcccgccagacca

SEQ ID NO: 636772 - RNA, 21 nt, Escherichia coli CFT073
ccacaagcccgccagaccagc

SEQ ID NO: 636773 - RNA, 20 nt, Escherichia coli CFT073
ccacaacgugggccaggcgu

SEQ ID NO: 636774 - RNA, 19 nt, Escherichia coli CFT073
ccacaacguacggcuucag

SEQ ID NO: 636775 - RNA, 13 nt, Escherichia coli CFT073
ccacaacuucaac

SEQ ID NO: 636776 - RNA, 19 nt, Escherichia coli CFT073
ccacaauaccaaucgcagg

SEQ ID NO: 636777 - RNA, 12 nt, Escherichia coli CFT073
ccacaagcacag

SEQ ID NO: 636778 - RNA, 19 nt, Escherichia coli CFT073
ccacaaauaccccaccgcc

SEQ ID NO: 636779 - RNA, 19 nt, Escherichia coli CFT073
ccacaacccagacaaauaa

SEQ ID NO: 636780 - RNA, 23 nt, Escherichia coli CFT073
ccacaacaaaucguaaucggcuu

SEQ ID NO: 636781 - RNA, 17 nt, Escherichia coli CFT073
ccacaaccucagcaguu

SEQ ID NO: 636782 - RNA, 14 nt, Escherichia coli CFT073
ccacaaacagaaug

SEQ ID NO: 636783 - RNA, 16 nt, Escherichia coli CFT073
ccacaaaauaaccgcc

SEQ ID NO: 636784 - RNA, 20 nt, Escherichia coli CFT073
ccacaaagcagacaacccac

SEQ ID NO: 636785 - RNA, 15 nt, Escherichia coli CFT073
ccaaaugcagcaacc

SEQ ID NO: 636786 - RNA, 18 nt, Escherichia coli CFT073
ccaaaguuugcaaaccca

SEQ ID NO: 636787 - RNA, 23 nt, Escherichia coli CFT073
ccaaagaagcguugauccagcgc

SEQ ID NO: 636788 - RNA, 15 nt, Escherichia coli CFT073
ccaaagaaguucucc

SEQ ID NO: 636789 - RNA, 16 nt, Escherichia coli CFT073
ccaaagccucaaugcu

SEQ ID NO: 636790 - RNA, 21 nt, Escherichia coli CFT073
ccaaaguguaaaaaaucccag

SEQ ID NO: 636791 - RNA, 15 nt, Escherichia coli CFT073
ccaaaguuaaucagc

SEQ ID NO: 636792 - RNA, 15 nt, Escherichia coli CFT073
ccaaagcaccacucc

SEQ ID NO: 636793 - RNA, 20 nt, Escherichia coli CFT073
ccaaccaucaggcagaacac

SEQ ID NO: 636794 - RNA, 13 nt, Escherichia coli CFT073
ccaaccaucaucc

SEQ ID NO: 636795 - RNA, 12 nt, Escherichia coli CFT073
ccaaccagcagg

SEQ ID NO: 636796 - RNA, 13 nt, Escherichia coli CFT073
ccaaccagcaggu

SEQ ID NO: 636797 - RNA, 22 nt, Escherichia coli CFT073
ccaaccacuuuacgcaaaauau

SEQ ID NO: 636798 - RNA, 22 nt, Escherichia coli CFT073
ccaaccaugccgcccagcagca

SEQ ID NO: 636799 - RNA, 20 nt, Escherichia coli CFT073
ccaaccacaugaucauucac

SEQ ID NO: 636800 - RNA, 10 nt, Escherichia coli CFT073
ccaacaccca

SEQ ID NO: 636801 - RNA, 15 nt, Escherichia coli CFT073
ccaagcgggaauagc

SEQ ID NO: 636802 - RNA, 18 nt, Escherichia coli CFT073
ccaaggucuccgcccagc

SEQ ID NO: 636803 - RNA, 19 nt, Escherichia coli CFT073
ccaacuuuguuguuuacca

SEQ ID NO: 636804 - RNA, 15 nt, Escherichia coli CFT073
ccaagaaacaccaga

SEQ ID NO: 636805 - RNA, 19 nt, Escherichia coli CFT073
ccaacuccucuuugcugcc

SEQ ID NO: 636806 - RNA, 21 nt, Escherichia coli CFT073
ccaacguuucuggaaguaauc

SEQ ID NO: 636807 - RNA, 19 nt, Escherichia coli CFT073
ccaacuaaacguagcggaa

SEQ ID NO: 636808 - RNA, 21 nt, Escherichia coli CFT073
ccaacuaucaaccucuuuuuc

SEQ ID NO: 636809 - RNA, 23 nt, Escherichia coli CFT073
ccaacucaacgccugcuuuuacc

SEQ ID NO: 636810 - RNA, 14 nt, Escherichia coli CFT073
ccaacuucauguau

SEQ ID NO: 636811 - RNA, 22 nt, Escherichia coli CFT073
ccaacccuaacccaacauucga

SEQ ID NO: 636812 - RNA, 16 nt, Escherichia coli CFT073
ccaaccgcugauugcu

SEQ ID NO: 636813 - RNA, 19 nt, Escherichia coli CFT073
ccaaccgcuucccaaagac

SEQ ID NO: 636814 - RNA, 22 nt, Escherichia coli CFT073
ccaacgugguuuaccaccagcg

SEQ ID NO: 636815 - RNA, 23 nt, Escherichia coli CFT073
ccaacgugguuuaccaccagcgg

SEQ ID NO: 636816 - RNA, 22 nt, Escherichia coli CFT073
ccaacgucugccugguuucucu

SEQ ID NO: 636817 - RNA, 16 nt, Escherichia coli CFT073
ccaaaccgacugccug

SEQ ID NO: 636818 - RNA, 17 nt, Escherichia coli CFT073
ccaaaccgacugccugc

SEQ ID NO: 636819 - RNA, 15 nt, Escherichia coli CFT073
ccaaacgcucccagc

SEQ ID NO: 636820 - RNA, 19 nt, Escherichia coli CFT073
ccaaacuggaacugaaagg

SEQ ID NO: 636821 - RNA, 16 nt, Escherichia coli CFT073
ccaaacauacgacuuu

SEQ ID NO: 636822 - RNA, 14 nt, Escherichia coli CFT073
ccaaacagcagaac

SEQ ID NO: 636823 - RNA, 15 nt, Escherichia coli CFT073
ccaaacagcgugccg

SEQ ID NO: 636824 - RNA, 14 nt, Escherichia coli CFT073
ccaaaccaucacaa

SEQ ID NO: 636825 - RNA, 15 nt, Escherichia coli CFT073
ccaaacauuucacgu

SEQ ID NO: 636826 - RNA, 22 nt, Escherichia coli CFT073
ccaaaaaggggaaaaauucagg

SEQ ID NO: 636827 - RNA, 20 nt, Escherichia coli CFT073
ccaaaaagaaccugaacgcc

SEQ ID NO: 636828 - RNA, 20 nt, Escherichia coli CFT073
ccaaaaagcgucccuaauac

SEQ ID NO: 636829 - RNA, 13 nt, Escherichia coli CFT073
ccaaaaauaaggc

SEQ ID NO: 636830 - RNA, 12 nt, Escherichia coli CFT073
ccaaaaaucgac

SEQ ID NO: 636831 - RNA, 14 nt, Escherichia coli CFT073
ccaaaacagcgaca

SEQ ID NO: 636832 - RNA, 16 nt, Escherichia coli CFT073
ccaaaacagcgacacc

SEQ ID NO: 636833 - RNA, 20 nt, Escherichia coli CFT073
ccaaaacagcgacaccagcc

SEQ ID NO: 636834 - RNA, 16 nt, Escherichia coli CFT073
ccaaaagcgauuauuu

SEQ ID NO: 636835 - RNA, 20 nt, Escherichia coli CFT073
ccaaaagcgauuauuuauuc

SEQ ID NO: 636836 - RNA, 22 nt, Escherichia coli CFT073
ccaaaacucgcuggcggcuggc

SEQ ID NO: 636837 - RNA, 18 nt, Escherichia coli CFT073
cauuuuuuugccugcuau

SEQ ID NO: 636838 - RNA, 21 nt, Escherichia coli CFT073
cauuuuuuuaaccuaaaugcu

SEQ ID NO: 636839 - RNA, 22 nt, Escherichia coli CFT073
cauuuuuuugcauuacugcuau

SEQ ID NO: 636840 - RNA, 14 nt, Escherichia coli CFT073
cauuuuuuccccuu

SEQ ID NO: 636841 - RNA, 20 nt, Escherichia coli CFT073
cauuuuuuacucucguucca

SEQ ID NO: 636842 - RNA, 16 nt, Escherichia coli CFT073
cauuuuucgcuaccag

SEQ ID NO: 636843 - RNA, 20 nt, Escherichia coli CFT073
cauuuuucggcgucagaacu

SEQ ID NO: 636844 - RNA, 19 nt, Escherichia coli CFT073
cauuuuuaauaacuuuuag

SEQ ID NO: 636845 - RNA, 18 nt, Escherichia coli CFT073
cauuuuuaguuuugugaa

SEQ ID NO: 636846 - RNA, 15 nt, Escherichia coli CFT073
cauuuuucacugcgg

SEQ ID NO: 636847 - RNA, 19 nt, Escherichia coli CFT073
cauuuuucagcguucccca

SEQ ID NO: 636848 - RNA, 20 nt, Escherichia coli CFT073
cauuuuucagcguuccccag

SEQ ID NO: 636849 - RNA, 23 nt, Escherichia coli CFT073
cauuuucuaugcugccacacugc

SEQ ID NO: 636850 - RNA, 16 nt, Escherichia coli CFT073
cauuuugcacauucca

SEQ ID NO: 636851 - RNA, 20 nt, Escherichia coli CFT073
cauuuugcuguuuaguggua

SEQ ID NO: 636852 - RNA, 14 nt, Escherichia coli CFT073
cauuuuguaggccu

SEQ ID NO: 636853 - RNA, 20 nt, Escherichia coli CFT073
cauuuuguaugcggcgaagg

SEQ ID NO: 636854 - RNA, 20 nt, Escherichia coli CFT073
cauuuugggacagugcagga

SEQ ID NO: 636855 - RNA, 22 nt, Escherichia coli CFT073
cauugaauuuaauugguuuugc

SEQ ID NO: 636856 - RNA, 15 nt, Escherichia coli CFT073
cauugaaguuaucgc

SEQ ID NO: 636857 - RNA, 22 nt, Escherichia coli CFT073
cauugacgguuuccacuuccac

SEQ ID NO: 636858 - RNA, 14 nt, Escherichia coli CFT073
cauugacgcuggcu

SEQ ID NO: 636859 - RNA, 17 nt, Escherichia coli CFT073
cauugacgccuuuaucu

SEQ ID NO: 636860 - RNA, 18 nt, Escherichia coli CFT073
cauugaaaucaaaaucac

SEQ ID NO: 636861 - RNA, 16 nt, Escherichia coli CFT073
cauucuuucccagcag

SEQ ID NO: 636862 - RNA, 20 nt, Escherichia coli CFT073
cauucuugcgcggauggccu

SEQ ID NO: 636863 - RNA, 17 nt, Escherichia coli CFT073
cauuccccggagcccua

SEQ ID NO: 636864 - RNA, 22 nt, Escherichia coli CFT073
cauuccccggagcccuacaaac

SEQ ID NO: 636865 - RNA, 23 nt, Escherichia coli CFT073
cauucccgcucacgguuagcaua

SEQ ID NO: 636866 - RNA, 22 nt, Escherichia coli CFT073
cauucccggucaguagaauaau

SEQ ID NO: 636867 - RNA, 13 nt, Escherichia coli CFT073
cauucccugcagu

SEQ ID NO: 636868 - RNA, 23 nt, Escherichia coli CFT073
cauucccugcagucaccugcccu

SEQ ID NO: 636869 - RNA, 17 nt, Escherichia coli CFT073
cauucucaccuacagcc

SEQ ID NO: 636870 - RNA, 18 nt, Escherichia coli CFT073
cauucucgucuugcguuu

SEQ ID NO: 636871 - RNA, 22 nt, Escherichia coli CFT073
cauucugcgcugacucuacuga

SEQ ID NO: 636872 - RNA, 15 nt, Escherichia coli CFT073
cauucugcgcugacu

SEQ ID NO: 636873 - RNA, 22 nt, Escherichia coli CFT073
cauucucgcuacccaugaagaa

SEQ ID NO: 636874 - RNA, 15 nt, Escherichia coli CFT073
cauuaauuucaggcu

SEQ ID NO: 636875 - RNA, 16 nt, Escherichia coli CFT073
cauuacaaaauacaaa

SEQ ID NO: 636876 - RNA, 23 nt, Escherichia coli CFT073
cauuaucacaucagcgcauuuac

SEQ ID NO: 636877 - RNA, 19 nt, Escherichia coli CFT073
cauuacaccaauaccgccc

SEQ ID NO: 636878 - RNA, 18 nt, Escherichia coli CFT073
cauuacaagaaucaugcc

SEQ ID NO: 636879 - RNA, 14 nt, Escherichia coli CFT073
cauuacaggcaucu

SEQ ID NO: 636880 - RNA, 16 nt, Escherichia coli CFT073
cauuauccuuuaucug

SEQ ID NO: 636881 - RNA, 17 nt, Escherichia coli CFT073
cauuauccuuuaucugc

SEQ ID NO: 636882 - RNA, 16 nt, Escherichia coli CFT073
cauuaucuucuuucuc

SEQ ID NO: 636883 - RNA, 13 nt, Escherichia coli CFT073
cauuaucaccaaa

SEQ ID NO: 636884 - RNA, 23 nt, Escherichia coli CFT073
cauuaugcuggaaucaauaauua

SEQ ID NO: 636885 - RNA, 17 nt, Escherichia coli CFT073
cauuauggugaagaagc

SEQ ID NO: 636886 - RNA, 17 nt, Escherichia coli CFT073
cauuaugucauugaaug

SEQ ID NO: 636887 - RNA, 19 nt, Escherichia coli CFT073
cauucaugcgaauacagcc

SEQ ID NO: 636888 - RNA, 17 nt, Escherichia coli CFT073
cauucagauugauguua

SEQ ID NO: 636889 - RNA, 13 nt, Escherichia coli CFT073
cauucagaauaau

SEQ ID NO: 636890 - RNA, 23 nt, Escherichia coli CFT073
cauucagacacgccgccagacca

SEQ ID NO: 636891 - RNA, 14 nt, Escherichia coli CFT073
cauucagacaggcg

SEQ ID NO: 636892 - RNA, 19 nt, Escherichia coli CFT073
cauuccagccagaaaucac

SEQ ID NO: 636893 - RNA, 13 nt, Escherichia coli CFT073
cauuccagccaug

SEQ ID NO: 636894 - RNA, 15 nt, Escherichia coli CFT073
cauucauucagauuc

SEQ ID NO: 636895 - RNA, 14 nt, Escherichia coli CFT073
cauucacauccaca

SEQ ID NO: 636896 - RNA, 20 nt, Escherichia coli CFT073
cauucacgcugucggcacug

SEQ ID NO: 636897 - RNA, 19 nt, Escherichia coli CFT073
cauucaccagcccacaugc

SEQ ID NO: 636898 - RNA, 22 nt, Escherichia coli CFT073
cauuauucauuguucucccaua

SEQ ID NO: 636899 - RNA, 19 nt, Escherichia coli CFT073
cauuauucauuuuucgcua

SEQ ID NO: 636900 - RNA, 21 nt, Escherichia coli CFT073
cauuauucccccggcuucaau

SEQ ID NO: 636901 - RNA, 13 nt, Escherichia coli CFT073
cauuauucaaucg

SEQ ID NO: 636902 - RNA, 15 nt, Escherichia coli CFT073
cauuaaagcuuuacu

SEQ ID NO: 636903 - RNA, 17 nt, Escherichia coli CFT073
cauuaaacguacuggcg

SEQ ID NO: 636904 - RNA, 11 nt, Escherichia coli CFT073
cauuaaaauga

SEQ ID NO: 636905 - RNA, 22 nt, Escherichia coli CFT073
cauuaaaaugaauaacuuccug

SEQ ID NO: 636906 - RNA, 14 nt, Escherichia coli CFT073
cauuaacgauaauu

SEQ ID NO: 636907 - RNA, 15 nt, Escherichia coli CFT073
cauuaacgcagaauc

SEQ ID NO: 636908 - RNA, 17 nt, Escherichia coli CFT073
cauuaacgccccaauca

SEQ ID NO: 636909 - RNA, 16 nt, Escherichia coli CFT073
cauuaacucaguugcc

SEQ ID NO: 636910 - RNA, 16 nt, Escherichia coli CFT073
cauuaacuccccuuua

SEQ ID NO: 636911 - RNA, 23 nt, Escherichia coli CFT073
cauuaacaccacgccagccgcca

SEQ ID NO: 636912 - RNA, 22 nt, Escherichia coli CFT073
cauuaacagcggugcaccugcc

SEQ ID NO: 636913 - RNA, 15 nt, Escherichia coli CFT073
cauuaaccaaccacc

SEQ ID NO: 636914 - RNA, 15 nt, Escherichia coli CFT073
cauuaaccagccacu

SEQ ID NO: 636915 - RNA, 16 nt, Escherichia coli CFT073
cauguucagucacuuc

SEQ ID NO: 636916 - RNA, 14 nt, Escherichia coli CFT073
cauguauauuaucc

SEQ ID NO: 636917 - RNA, 16 nt, Escherichia coli CFT073
cauguuuuccuuuucg

SEQ ID NO: 636918 - RNA, 15 nt, Escherichia coli CFT073
cauguuguuuacagc

SEQ ID NO: 636919 - RNA, 13 nt, Escherichia coli CFT073
cauguugccuggg

SEQ ID NO: 636920 - RNA, 16 nt, Escherichia coli CFT073
cauguugcgcagaguu

SEQ ID NO: 636921 - RNA, 17 nt, Escherichia coli CFT073
cauguugacuucaaucu

SEQ ID NO: 636922 - RNA, 15 nt, Escherichia coli CFT073
cauguugaucccugc

SEQ ID NO: 636923 - RNA, 23 nt, Escherichia coli CFT073
cauguugaucccugcaccaauga

SEQ ID NO: 636924 - RNA, 15 nt, Escherichia coli CFT073
cauggggagacccca

SEQ ID NO: 636925 - RNA, 17 nt, Escherichia coli CFT073
cauggggagaccccaca

SEQ ID NO: 636926 - RNA, 17 nt, Escherichia coli CFT073
cauggcggcagcgugcc

SEQ ID NO: 636927 - RNA, 18 nt, Escherichia coli CFT073
cauguagccgcuuuuucu

SEQ ID NO: 636928 - RNA, 21 nt, Escherichia coli CFT073
caugguuuggaucuguugcug

SEQ ID NO: 636929 - RNA, 19 nt, Escherichia coli CFT073
caugguuaaaaucucccgc

SEQ ID NO: 636930 - RNA, 19 nt, Escherichia coli CFT073
caugguggaacucuucaca

SEQ ID NO: 636931 - RNA, 17 nt, Escherichia coli CFT073
caugcggcgugccuuca

SEQ ID NO: 636932 - RNA, 21 nt, Escherichia coli CFT073
caugcgccagguaacgaagau

SEQ ID NO: 636933 - RNA, 16 nt, Escherichia coli CFT073
cauggcgaauggcacg

SEQ ID NO: 636934 - RNA, 21 nt, Escherichia coli CFT073
cauggccgggguuuugcugau

SEQ ID NO: 636935 - RNA, 13 nt, Escherichia coli CFT073
caugcuaaaaauc

SEQ ID NO: 636936 - RNA, 18 nt, Escherichia coli CFT073
caugcccauuccccagcc

SEQ ID NO: 636937 - RNA, 16 nt, Escherichia coli CFT073
caugcccggagagauc

SEQ ID NO: 636938 - RNA, 18 nt, Escherichia coli CFT073
caugcccugcccgcugcc

SEQ ID NO: 636939 - RNA, 22 nt, Escherichia coli CFT073
caugcccugcgcauuucgcucu

SEQ ID NO: 636940 - RNA, 14 nt, Escherichia coli CFT073
caugccgaacaggu

SEQ ID NO: 636941 - RNA, 13 nt, Escherichia coli CFT073
caugccgaaugcc

SEQ ID NO: 636942 - RNA, 16 nt, Escherichia coli CFT073
caugccgacaaacagc

SEQ ID NO: 636943 - RNA, 15 nt, Escherichia coli CFT073
caugccaaaucaaug

SEQ ID NO: 636944 - RNA, 22 nt, Escherichia coli CFT073
caugccaacgcggaugaggcgu

SEQ ID NO: 636945 - RNA, 15 nt, Escherichia coli CFT073
caugccauccgcauc

SEQ ID NO: 636946 - RNA, 18 nt, Escherichia coli CFT073
caugccagugaugggcag

SEQ ID NO: 636947 - RNA, 17 nt, Escherichia coli CFT073
caugccugcauaaagga

SEQ ID NO: 636948 - RNA, 17 nt, Escherichia coli CFT073
caugccuaaagugcugg

SEQ ID NO: 636949 - RNA, 16 nt, Escherichia coli CFT073
caugcgaauacagccc

SEQ ID NO: 636950 - RNA, 13 nt, Escherichia coli CFT073
caugcgaucccau

SEQ ID NO: 636951 - RNA, 23 nt, Escherichia coli CFT073
caugccgggcaaaagucaccagu

SEQ ID NO: 636952 - RNA, 13 nt, Escherichia coli CFT073
caugaucugcaaa

SEQ ID NO: 636953 - RNA, 22 nt, Escherichia coli CFT073
caugaucugcaaauucaauaaa

SEQ ID NO: 636954 - RNA, 22 nt, Escherichia coli CFT073
caugaucugugugguuuuguag

SEQ ID NO: 636955 - RNA, 15 nt, Escherichia coli CFT073
caugaucgaagcaaa

SEQ ID NO: 636956 - RNA, 14 nt, Escherichia coli CFT073
caugaugacaacau

SEQ ID NO: 636957 - RNA, 20 nt, Escherichia coli CFT073
caugauacuccacaucauug

SEQ ID NO: 636958 - RNA, 13 nt, Escherichia coli CFT073
caugauguccugc

SEQ ID NO: 636959 - RNA, 14 nt, Escherichia coli CFT073
caugauuuucaucu

SEQ ID NO: 636960 - RNA, 16 nt, Escherichia coli CFT073
caugauuuucaucuuu

SEQ ID NO: 636961 - RNA, 20 nt, Escherichia coli CFT073
caugauuuucaucuuuugcg

SEQ ID NO: 636962 - RNA, 16 nt, Escherichia coli CFT073
caugcaaauucaauau

SEQ ID NO: 636963 - RNA, 15 nt, Escherichia coli CFT073
caugcaacacaagcc

SEQ ID NO: 636964 - RNA, 12 nt, Escherichia coli CFT073
caugauuucugc

SEQ ID NO: 636965 - RNA, 18 nt, Escherichia coli CFT073
caugauuguauggaaugc

SEQ ID NO: 636966 - RNA, 17 nt, Escherichia coli CFT073
caugauuucaguuggca

SEQ ID NO: 636967 - RNA, 16 nt, Escherichia coli CFT073
caugcaacuugaagua

SEQ ID NO: 636968 - RNA, 14 nt, Escherichia coli CFT073
caugcaggcuggcc

SEQ ID NO: 636969 - RNA, 16 nt, Escherichia coli CFT073
caugcaguaccagaua

SEQ ID NO: 636970 - RNA, 20 nt, Escherichia coli CFT073
caugcacggacgcuuguuau

SEQ ID NO: 636971 - RNA, 17 nt, Escherichia coli CFT073
caugcagcaacucugcu

SEQ ID NO: 636972 - RNA, 22 nt, Escherichia coli CFT073
caugcagcauggguaaagccca

SEQ ID NO: 636973 - RNA, 16 nt, Escherichia coli CFT073
caugcagccccauaug

SEQ ID NO: 636974 - RNA, 20 nt, Escherichia coli CFT073
caugcaggcaugcaauauuc

SEQ ID NO: 636975 - RNA, 12 nt, Escherichia coli CFT073
caucuucuccac

SEQ ID NO: 636976 - RNA, 19 nt, Escherichia coli CFT073
caucgugcucgcuuuccau

SEQ ID NO: 636977 - RNA, 18 nt, Escherichia coli CFT073
caucguugaauacauuca

SEQ ID NO: 636978 - RNA, 14 nt, Escherichia coli CFT073
caucuucugaauca

SEQ ID NO: 636979 - RNA, 18 nt, Escherichia coli CFT073
caucuucuucaauuuccg

SEQ ID NO: 636980 - RNA, 17 nt, Escherichia coli CFT073
caucuucuuugcgccag

SEQ ID NO: 636981 - RNA, 20 nt, Escherichia coli CFT073
caucuuucaucuguuuucaa

SEQ ID NO: 636982 - RNA, 15 nt, Escherichia coli CFT073
caucuuucagaauca

SEQ ID NO: 636983 - RNA, 17 nt, Escherichia coli CFT073
caugaaagcgaugcuga

SEQ ID NO: 636984 - RNA, 19 nt, Escherichia coli CFT073
caugaaagcgaugcugaug

SEQ ID NO: 636985 - RNA, 22 nt, Escherichia coli CFT073
caugaacaaaacauacuuucuc

SEQ ID NO: 636986 - RNA, 15 nt, Escherichia coli CFT073
caugaacgccugauu

SEQ ID NO: 636987 - RNA, 16 nt, Escherichia coli CFT073
caucuuuuuuuaccug

SEQ ID NO: 636988 - RNA, 19 nt, Escherichia coli CFT073
caugaaaaauagacacaaa

SEQ ID NO: 636989 - RNA, 15 nt, Escherichia coli CFT073
caucuuuuucaaucc

SEQ ID NO: 636990 - RNA, 17 nt, Escherichia coli CFT073
caucuuugagucaacau

SEQ ID NO: 636991 - RNA, 15 nt, Escherichia coli CFT073
caugacauucauaaa

SEQ ID NO: 636992 - RNA, 22 nt, Escherichia coli CFT073
caugacagcgcccgacaagauc

SEQ ID NO: 636993 - RNA, 18 nt, Escherichia coli CFT073
caugacacacucugaccu

SEQ ID NO: 636994 - RNA, 17 nt, Escherichia coli CFT073
caugaccguuugccccg

SEQ ID NO: 636995 - RNA, 22 nt, Escherichia coli CFT073
caugaccgcuccgccaucuucu

SEQ ID NO: 636996 - RNA, 23 nt, Escherichia coli CFT073
caugaccgugaucguggccauga

SEQ ID NO: 636997 - RNA, 16 nt, Escherichia coli CFT073
caugaccgaucaaggc

SEQ ID NO: 636998 - RNA, 16 nt, Escherichia coli CFT073
caugaccgcuccgcca

SEQ ID NO: 636999 - RNA, 14 nt, Escherichia coli CFT073
caugaauaaaaaaa

SEQ ID NO: 637000 - RNA, 22 nt, Escherichia coli CFT073
caugaagcugacaggcgcugau

SEQ ID NO: 637001 - RNA, 13 nt, Escherichia coli CFT073
caugaaugucaua

SEQ ID NO: 637002 - RNA, 21 nt, Escherichia coli CFT073
caugaauuuugaaggaaaaau

SEQ ID NO: 637003 - RNA, 20 nt, Escherichia coli CFT073
caugacaaacucaccuggcu

SEQ ID NO: 637004 - RNA, 20 nt, Escherichia coli CFT073
caugaguaacagucaguuau

SEQ ID NO: 637005 - RNA, 12 nt, Escherichia coli CFT073
caugaguaauuu

SEQ ID NO: 637006 - RNA, 23 nt, Escherichia coli CFT073
caugacgcaacaacacaccacca

SEQ ID NO: 637007 - RNA, 19 nt, Escherichia coli CFT073
caugacgcacuuucgcuuu

SEQ ID NO: 637008 - RNA, 18 nt, Escherichia coli CFT073
caugaccuuccagcgcug

SEQ ID NO: 637009 - RNA, 11 nt, Escherichia coli CFT073
caugaccuuuc

SEQ ID NO: 637010 - RNA, 18 nt, Escherichia coli CFT073
caugacgaugcagaaaua

SEQ ID NO: 637011 - RNA, 20 nt, Escherichia coli CFT073
caucggcagcgccaaucgcu

SEQ ID NO: 637012 - RNA, 15 nt, Escherichia coli CFT073
caucggcaacgccag

SEQ ID NO: 637013 - RNA, 15 nt, Escherichia coli CFT073
caucggaaugcacag

SEQ ID NO: 637014 - RNA, 15 nt, Escherichia coli CFT073
caucgcuggaggcau

SEQ ID NO: 637015 - RNA, 16 nt, Escherichia coli CFT073
caucgcccugauggcg

SEQ ID NO: 637016 - RNA, 13 nt, Escherichia coli CFT073
caucgcccgcaac

SEQ ID NO: 637017 - RNA, 14 nt, Escherichia coli CFT073
caucgguuaacccg

SEQ ID NO: 637018 - RNA, 12 nt, Escherichia coli CFT073
caucgugcacca

SEQ ID NO: 637019 - RNA, 16 nt, Escherichia coli CFT073
caucgguacacauucg

SEQ ID NO: 637020 - RNA, 15 nt, Escherichia coli CFT073
caucgguagcaccag

SEQ ID NO: 637021 - RNA, 19 nt, Escherichia coli CFT073
caucgguauaaccaaauga

SEQ ID NO: 637022 - RNA, 21 nt, Escherichia coli CFT073
caucgguaucaucccagccaa

SEQ ID NO: 637023 - RNA, 20 nt, Escherichia coli CFT073
caucgguaucgaauaaagau

SEQ ID NO: 637024 - RNA, 23 nt, Escherichia coli CFT073
caucggcuugaggaagcgcgccg

SEQ ID NO: 637025 - RNA, 20 nt, Escherichia coli CFT073
caucggggcugaugaaguug

SEQ ID NO: 637026 - RNA, 15 nt, Escherichia coli CFT073
caucgggcaucgcaa

SEQ ID NO: 637027 - RNA, 15 nt, Escherichia coli CFT073
caucggcgucgguuu

SEQ ID NO: 637028 - RNA, 22 nt, Escherichia coli CFT073
caucgcaucgccuaaauggaaa

SEQ ID NO: 637029 - RNA, 20 nt, Escherichia coli CFT073
caucgcaugccagcgccccu

SEQ ID NO: 637030 - RNA, 14 nt, Escherichia coli CFT073
caucgccaaacagg

SEQ ID NO: 637031 - RNA, 17 nt, Escherichia coli CFT073
caucgccacggcaugaa

SEQ ID NO: 637032 - RNA, 16 nt, Escherichia coli CFT073
caucgccagcagccau

SEQ ID NO: 637033 - RNA, 15 nt, Escherichia coli CFT073
caucgccauuuucug

SEQ ID NO: 637034 - RNA, 20 nt, Escherichia coli CFT073
caucgccaugaugagcgcca

SEQ ID NO: 637035 - RNA, 14 nt, Escherichia coli CFT073
caucgcccagccau

SEQ ID NO: 637036 - RNA, 18 nt, Escherichia coli CFT073
caucgccauaaacaccag

SEQ ID NO: 637037 - RNA, 18 nt, Escherichia coli CFT073
caucgaaccaucggcuuu

SEQ ID NO: 637038 - RNA, 14 nt, Escherichia coli CFT073
caucgaaaauacac

SEQ ID NO: 637039 - RNA, 20 nt, Escherichia coli CFT073
caucgaaaauacacgcugca

SEQ ID NO: 637040 - RNA, 14 nt, Escherichia coli CFT073
caucgaaaaugcca

SEQ ID NO: 637041 - RNA, 20 nt, Escherichia coli CFT073
caucgaaaaugccacugcgc

SEQ ID NO: 637042 - RNA, 16 nt, Escherichia coli CFT073
cauccuuugcuggcaa

SEQ ID NO: 637043 - RNA, 15 nt, Escherichia coli CFT073
cauccuugcuaacca

SEQ ID NO: 637044 - RNA, 18 nt, Escherichia coli CFT073
cauccggcgacaggaacc

SEQ ID NO: 637045 - RNA, 15 nt, Escherichia coli CFT073
cauccggcuuaaauc

SEQ ID NO: 637046 - RNA, 15 nt, Escherichia coli CFT073
cauccggcaucaacc

SEQ ID NO: 637047 - RNA, 18 nt, Escherichia coli CFT073
cauccggcauuugagcag

SEQ ID NO: 637048 - RNA, 13 nt, Escherichia coli CFT073
cauccggcacgcu

SEQ ID NO: 637049 - RNA, 21 nt, Escherichia coli CFT073
cauccggcacuuucggauuac

SEQ ID NO: 637050 - RNA, 15 nt, Escherichia coli CFT073
cauccggcagcgcau

SEQ ID NO: 637051 - RNA, 21 nt, Escherichia coli CFT073
cauccggcagcgcauaagcca

SEQ ID NO: 637052 - RNA, 15 nt, Escherichia coli CFT073
cauccggcauaaaca

SEQ ID NO: 637053 - RNA, 21 nt, Escherichia coli CFT073
cauccggcauaaacacaggca

SEQ ID NO: 637054 - RNA, 16 nt, Escherichia coli CFT073
cauccggcauauuaac

SEQ ID NO: 637055 - RNA, 13 nt, Escherichia coli CFT073
cauccggcauuau

SEQ ID NO: 637056 - RNA, 16 nt, Escherichia coli CFT073
caucccaccugaaaug

SEQ ID NO: 637057 - RNA, 23 nt, Escherichia coli CFT073
cauccauaucgccauugcuggug

SEQ ID NO: 637058 - RNA, 17 nt, Escherichia coli CFT073
cauccauaaucacgcug

SEQ ID NO: 637059 - RNA, 20 nt, Escherichia coli CFT073
cauccauguggcauugguau

SEQ ID NO: 637060 - RNA, 16 nt, Escherichia coli CFT073
cauccaugcaaguagu

SEQ ID NO: 637061 - RNA, 16 nt, Escherichia coli CFT073
cauccaguuccacacc

SEQ ID NO: 637062 - RNA, 15 nt, Escherichia coli CFT073
cauccaguuccaguu

SEQ ID NO: 637063 - RNA, 15 nt, Escherichia coli CFT073
cauccaguugcgccg

SEQ ID NO: 637064 - RNA, 15 nt, Escherichia coli CFT073
cauccaggguuuuau

SEQ ID NO: 637065 - RNA, 17 nt, Escherichia coli CFT073
cauccaguaccugaucc

SEQ ID NO: 637066 - RNA, 19 nt, Escherichia coli CFT073
cauccaguacgccuucacg

SEQ ID NO: 637067 - RNA, 21 nt, Escherichia coli CFT073
cauccaggcaaaguacacauu

SEQ ID NO: 637068 - RNA, 12 nt, Escherichia coli CFT073
cauccaggccaa

SEQ ID NO: 637069 - RNA, 18 nt, Escherichia coli CFT073
cauccaggccaaaagcua

SEQ ID NO: 637070 - RNA, 16 nt, Escherichia coli CFT073
cauccagcugccaggc

SEQ ID NO: 637071 - RNA, 13 nt, Escherichia coli CFT073
cauccccuccccg

SEQ ID NO: 637072 - RNA, 15 nt, Escherichia coli CFT073
cauccccuccccggc

SEQ ID NO: 637073 - RNA, 21 nt, Escherichia coli CFT073
cauccccggcaaccacaccca

SEQ ID NO: 637074 - RNA, 13 nt, Escherichia coli CFT073
cauccccugacug

SEQ ID NO: 637075 - RNA, 21 nt, Escherichia coli CFT073
cauccccugccccaucugccc

SEQ ID NO: 637076 - RNA, 16 nt, Escherichia coli CFT073
caucccgaccagugca

SEQ ID NO: 637077 - RNA, 21 nt, Escherichia coli CFT073
caucccgcacacuaccaaaac

SEQ ID NO: 637078 - RNA, 16 nt, Escherichia coli CFT073
cauccgauuguuccug

SEQ ID NO: 637079 - RNA, 19 nt, Escherichia coli CFT073
cauccgacuuugaaggaua

SEQ ID NO: 637080 - RNA, 16 nt, Escherichia coli CFT073
caucccggcagagaaa

SEQ ID NO: 637081 - RNA, 12 nt, Escherichia coli CFT073
cauccccacacc

SEQ ID NO: 637082 - RNA, 13 nt, Escherichia coli CFT073
caucccaguccuc

SEQ ID NO: 637083 - RNA, 15 nt, Escherichia coli CFT073
caucccagcagagau

SEQ ID NO: 637084 - RNA, 19 nt, Escherichia coli CFT073
caucccccaguggcagcaa

SEQ ID NO: 637085 - RNA, 20 nt, Escherichia coli CFT073
caucccccaguggcagcaau

SEQ ID NO: 637086 - RNA, 14 nt, Escherichia coli CFT073
cauccccggcaacc

SEQ ID NO: 637087 - RNA, 20 nt, Escherichia coli CFT073
cauccccggcaaccacaccc

SEQ ID NO: 637088 - RNA, 20 nt, Escherichia coli CFT073
caucauuuugcuauucaccu

SEQ ID NO: 637089 - RNA, 14 nt, Escherichia coli CFT073
caucauuaacugcu

SEQ ID NO: 637090 - RNA, 23 nt, Escherichia coli CFT073
caucagcaguuuuuccccugcca

SEQ ID NO: 637091 - RNA, 16 nt, Escherichia coli CFT073
caucagcaucccaccu

SEQ ID NO: 637092 - RNA, 15 nt, Escherichia coli CFT073
caucagcaugacaaa

SEQ ID NO: 637093 - RNA, 18 nt, Escherichia coli CFT073
caucagcaugacaaaaaa

SEQ ID NO: 637094 - RNA, 22 nt, Escherichia coli CFT073
caucagcaugacaaaaaagcca

SEQ ID NO: 637095 - RNA, 22 nt, Escherichia coli CFT073
caucauggcgaugagaaucagu

SEQ ID NO: 637096 - RNA, 20 nt, Escherichia coli CFT073
caucaugguuugcauccaca

SEQ ID NO: 637097 - RNA, 14 nt, Escherichia coli CFT073
caucaugcuuaaau

SEQ ID NO: 637098 - RNA, 13 nt, Escherichia coli CFT073
cauccagaugucu

SEQ ID NO: 637099 - RNA, 18 nt, Escherichia coli CFT073
cauccagauucucauaua

SEQ ID NO: 637100 - RNA, 16 nt, Escherichia coli CFT073
cauccagcaacaacag

SEQ ID NO: 637101 - RNA, 20 nt, Escherichia coli CFT073
cauccagcguuaccggcuuc

SEQ ID NO: 637102 - RNA, 14 nt, Escherichia coli CFT073
cauccagcucaagu

SEQ ID NO: 637103 - RNA, 21 nt, Escherichia coli CFT073
cauccagcggcagaguaauug

SEQ ID NO: 637104 - RNA, 22 nt, Escherichia coli CFT073
cauccagcggcgagcuuuucug

SEQ ID NO: 637105 - RNA, 20 nt, Escherichia coli CFT073
cauccagcagacgcuccauu

SEQ ID NO: 637106 - RNA, 11 nt, Escherichia coli CFT073
cauccagcagc

SEQ ID NO: 637107 - RNA, 15 nt, Escherichia coli CFT073
cauccagcagcgacu

SEQ ID NO: 637108 - RNA, 16 nt, Escherichia coli CFT073
cauccaccguaagauc

SEQ ID NO: 637109 - RNA, 10 nt, Escherichia coli CFT073
cauccaccug

SEQ ID NO: 637110 - RNA, 16 nt, Escherichia coli CFT073
cauccaccuggccccg

SEQ ID NO: 637111 - RNA, 18 nt, Escherichia coli CFT073
cauccacaccaaaauaac

SEQ ID NO: 637112 - RNA, 21 nt, Escherichia coli CFT073
cauccaccacaaaagcaaagu

SEQ ID NO: 637113 - RNA, 15 nt, Escherichia coli CFT073
cauccaccagcccca

SEQ ID NO: 637114 - RNA, 22 nt, Escherichia coli CFT073
caucaaguugauuuuucguuuu

SEQ ID NO: 637115 - RNA, 17 nt, Escherichia coli CFT073
caucaauaacaaaggga

SEQ ID NO: 637116 - RNA, 15 nt, Escherichia coli CFT073
caucacaacuucgca

SEQ ID NO: 637117 - RNA, 20 nt, Escherichia coli CFT073
caucacaacuucgcaaacac

SEQ ID NO: 637118 - RNA, 19 nt, Escherichia coli CFT073
caucacaaaauuuauccag

SEQ ID NO: 637119 - RNA, 13 nt, Escherichia coli CFT073
caucaauuaacug

SEQ ID NO: 637120 - RNA, 17 nt, Escherichia coli CFT073
caucaauuaacugaacu

SEQ ID NO: 637121 - RNA, 16 nt, Escherichia coli CFT073
caucaauuacaccauc

SEQ ID NO: 637122 - RNA, 12 nt, Escherichia coli CFT073
caucaccaggcc

SEQ ID NO: 637123 - RNA, 13 nt, Escherichia coli CFT073
caucaccaacacc

SEQ ID NO: 637124 - RNA, 20 nt, Escherichia coli CFT073
caucaccacgccgagagaag

SEQ ID NO: 637125 - RNA, 19 nt, Escherichia coli CFT073
caucaccacguuagcaaau

SEQ ID NO: 637126 - RNA, 17 nt, Escherichia coli CFT073
caucaccaguaccgcca

SEQ ID NO: 637127 - RNA, 13 nt, Escherichia coli CFT073
caucacagaccaa

SEQ ID NO: 637128 - RNA, 13 nt, Escherichia coli CFT073
caucacauccagc

SEQ ID NO: 637129 - RNA, 23 nt, Escherichia coli CFT073
caucaccaaugacagccccacca

SEQ ID NO: 637130 - RNA, 21 nt, Escherichia coli CFT073
caucacugacaucacgccacu

SEQ ID NO: 637131 - RNA, 23 nt, Escherichia coli CFT073
caucacugcaaauacccaaaaaa

SEQ ID NO: 637132 - RNA, 16 nt, Escherichia coli CFT073
caucagcagauaccaa

SEQ ID NO: 637133 - RNA, 12 nt, Escherichia coli CFT073
caucagcagcaa

SEQ ID NO: 637134 - RNA, 23 nt, Escherichia coli CFT073
caucaccgacggauuauucacua

SEQ ID NO: 637135 - RNA, 20 nt, Escherichia coli CFT073
caucaccgaugcccucaaua

SEQ ID NO: 637136 - RNA, 17 nt, Escherichia coli CFT073
cauauauuuucgccauu

SEQ ID NO: 637137 - RNA, 17 nt, Escherichia coli CFT073
cauaucaaaaagcugua

SEQ ID NO: 637138 - RNA, 18 nt, Escherichia coli CFT073
cauauuccgcaccugcca

SEQ ID NO: 637139 - RNA, 19 nt, Escherichia coli CFT073
cauauuccgcaccugccag

SEQ ID NO: 637140 - RNA, 16 nt, Escherichia coli CFT073
cauaucgcuggcugca

SEQ ID NO: 637141 - RNA, 18 nt, Escherichia coli CFT073
cauaucgcgugcacuaca

SEQ ID NO: 637142 - RNA, 19 nt, Escherichia coli CFT073
cauaucgcgugcacuacaa

SEQ ID NO: 637143 - RNA, 18 nt, Escherichia coli CFT073
cauaucguagccccaguc

SEQ ID NO: 637144 - RNA, 16 nt, Escherichia coli CFT073
cauauucauuacuuau

SEQ ID NO: 637145 - RNA, 15 nt, Escherichia coli CFT073
cauauuccaccacuu

SEQ ID NO: 637146 - RNA, 22 nt, Escherichia coli CFT073
caucaaguagcagguaaucugc

SEQ ID NO: 637147 - RNA, 15 nt, Escherichia coli CFT073
caucaagucagaugc

SEQ ID NO: 637148 - RNA, 22 nt, Escherichia coli CFT073
caucaagcugugccugaauaua

SEQ ID NO: 637149 - RNA, 18 nt, Escherichia coli CFT073
caucaaaucacagcaccu

SEQ ID NO: 637150 - RNA, 20 nt, Escherichia coli CFT073
caucaaaugcgccugcauaa

SEQ ID NO: 637151 - RNA, 20 nt, Escherichia coli CFT073
caucaaauggcauccuugcu

SEQ ID NO: 637152 - RNA, 14 nt, Escherichia coli CFT073
caucaaauccccac

SEQ ID NO: 637153 - RNA, 18 nt, Escherichia coli CFT073
cauauuuuuugaaaaaug

SEQ ID NO: 637154 - RNA, 14 nt, Escherichia coli CFT073
caucaaagaacagc

SEQ ID NO: 637155 - RNA, 19 nt, Escherichia coli CFT073
caucaaaggcuucaacgac

SEQ ID NO: 637156 - RNA, 14 nt, Escherichia coli CFT073
cauauuugguauca

SEQ ID NO: 637157 - RNA, 13 nt, Escherichia coli CFT073
cauagccuccggc

SEQ ID NO: 637158 - RNA, 17 nt, Escherichia coli CFT073
cauagccacucaccgcc

SEQ ID NO: 637159 - RNA, 13 nt, Escherichia coli CFT073
cauagccaucccu

SEQ ID NO: 637160 - RNA, 21 nt, Escherichia coli CFT073
cauagcguaacuuaucaauug

SEQ ID NO: 637161 - RNA, 14 nt, Escherichia coli CFT073
cauagcguucuucc

SEQ ID NO: 637162 - RNA, 16 nt, Escherichia coli CFT073
cauagcuaaaaauaau

SEQ ID NO: 637163 - RNA, 13 nt, Escherichia coli CFT073
cauaguaagcaga

SEQ ID NO: 637164 - RNA, 23 nt, Escherichia coli CFT073
cauaguaaguguuguauuauaua

SEQ ID NO: 637165 - RNA, 15 nt, Escherichia coli CFT073
cauaggucaggaaua

SEQ ID NO: 637166 - RNA, 22 nt, Escherichia coli CFT073
cauaggugcccgcauagcccag

SEQ ID NO: 637167 - RNA, 15 nt, Escherichia coli CFT073
cauauaacguccagu

SEQ ID NO: 637168 - RNA, 14 nt, Escherichia coli CFT073
cauauauaaaauca

SEQ ID NO: 637169 - RNA, 20 nt, Escherichia coli CFT073
cauauaucagcgccacauca

SEQ ID NO: 637170 - RNA, 23 nt, Escherichia coli CFT073
cauauaucagcgccacaucagca

SEQ ID NO: 637171 - RNA, 20 nt, Escherichia coli CFT073
cauauaugaauauugcugaa

SEQ ID NO: 637172 - RNA, 18 nt, Escherichia coli CFT073
cauauaaacauaucacuu

SEQ ID NO: 637173 - RNA, 15 nt, Escherichia coli CFT073
cauagauaccuucuu

SEQ ID NO: 637174 - RNA, 18 nt, Escherichia coli CFT073
cauagagagauguugcug

SEQ ID NO: 637175 - RNA, 16 nt, Escherichia coli CFT073
cauagagauaacuggc

SEQ ID NO: 637176 - RNA, 13 nt, Escherichia coli CFT073
cauagacuuaugc

SEQ ID NO: 637177 - RNA, 18 nt, Escherichia coli CFT073
cauagacaauguaucuuu

SEQ ID NO: 637178 - RNA, 13 nt, Escherichia coli CFT073
cauagacagccac

SEQ ID NO: 637179 - RNA, 14 nt, Escherichia coli CFT073
cauagaccauugca

SEQ ID NO: 637180 - RNA, 21 nt, Escherichia coli CFT073
cauagaagcucauaugcagca

SEQ ID NO: 637181 - RNA, 22 nt, Escherichia coli CFT073
cauacuuauugaaagcaaaaaa

SEQ ID NO: 637182 - RNA, 17 nt, Escherichia coli CFT073
cauacugcaucagcgcc

SEQ ID NO: 637183 - RNA, 19 nt, Escherichia coli CFT073
cauacugccgaccaucugu

SEQ ID NO: 637184 - RNA, 17 nt, Escherichia coli CFT073
cauacuggacacugaau

SEQ ID NO: 637185 - RNA, 23 nt, Escherichia coli CFT073
cauacuggcuucgauaccgucca

SEQ ID NO: 637186 - RNA, 16 nt, Escherichia coli CFT073
cauacuuaaugccagu

SEQ ID NO: 637187 - RNA, 19 nt, Escherichia coli CFT073
cauacuuaaugccaguuca

SEQ ID NO: 637188 - RNA, 19 nt, Escherichia coli CFT073
cauacucuuucccggcaau

SEQ ID NO: 637189 - RNA, 15 nt, Escherichia coli CFT073
cauacugauuaccca

SEQ ID NO: 637190 - RNA, 18 nt, Escherichia coli CFT073
cauacugauuacccaguu

SEQ ID NO: 637191 - RNA, 14 nt, Escherichia coli CFT073
cauacucuccucca

SEQ ID NO: 637192 - RNA, 19 nt, Escherichia coli CFT073
cauacucgaggcauuggca

SEQ ID NO: 637193 - RNA, 17 nt, Escherichia coli CFT073
cagugcaugggcaaauu

SEQ ID NO: 637194 - RNA, 22 nt, Escherichia coli CFT073
cagugcaggccggaguuaaucu

SEQ ID NO: 637195 - RNA, 22 nt, Escherichia coli CFT073
cagugcaggcaccagccccugg

SEQ ID NO: 637196 - RNA, 12 nt, Escherichia coli CFT073
cagugcauaagu

SEQ ID NO: 637197 - RNA, 14 nt, Escherichia coli CFT073
cgacaaggaacgcc

SEQ ID NO: 637198 - RNA, 16 nt, Escherichia coli CFT073
cgacaagaauauugcu

SEQ ID NO: 637199 - RNA, 16 nt, Escherichia coli CFT073
cgacaagauccugaua

SEQ ID NO: 637200 - RNA, 15 nt, Escherichia coli CFT073
cgacaccagccaucu

SEQ ID NO: 637201 - RNA, 18 nt, Escherichia coli CFT073
cgaauugacuagcuuuuc

SEQ ID NO: 637202 - RNA, 17 nt, Escherichia coli CFT073
cgaauuccgccuccgcu

SEQ ID NO: 637203 - RNA, 13 nt, Escherichia coli CFT073
cgaauuccugacu

SEQ ID NO: 637204 - RNA, 19 nt, Escherichia coli CFT073
cgaauuccugacuuacuuc

SEQ ID NO: 637205 - RNA, 14 nt, Escherichia coli CFT073
cgacaaaaacccug

SEQ ID NO: 637206 - RNA, 23 nt, Escherichia coli CFT073
cgacaaacgcuguaauuaccagc

SEQ ID NO: 637207 - RNA, 22 nt, Escherichia coli CFT073
cgacaaagaccugaacacgcaa

SEQ ID NO: 637208 - RNA, 21 nt, Escherichia coli CFT073
cgacaaagccucuauggaagu

SEQ ID NO: 637209 - RNA, 15 nt, Escherichia coli CFT073
cgacaaacaccgaac

SEQ ID NO: 637210 - RNA, 23 nt, Escherichia coli CFT073
cgacaaccugaccuuuuuucagc

SEQ ID NO: 637211 - RNA, 17 nt, Escherichia coli CFT073
cgacaguugccgcuuuu

SEQ ID NO: 637212 - RNA, 20 nt, Escherichia coli CFT073
cgacaguaccagcaguacag

SEQ ID NO: 637213 - RNA, 14 nt, Escherichia coli CFT073
cgacaguagccccg

SEQ ID NO: 637214 - RNA, 14 nt, Escherichia coli CFT073
cgacaguagcccuu

SEQ ID NO: 637215 - RNA, 19 nt, Escherichia coli CFT073
cgacaggaaccaaaugccg

SEQ ID NO: 637216 - RNA, 23 nt, Escherichia coli CFT073
cgacauacucagcgccugcugca

SEQ ID NO: 637217 - RNA, 21 nt, Escherichia coli CFT073
cgacauacaggggaucgacgc

SEQ ID NO: 637218 - RNA, 21 nt, Escherichia coli CFT073
cgacauauguuuaauguugag

SEQ ID NO: 637219 - RNA, 20 nt, Escherichia coli CFT073
cgacaucgacguggugaaau

SEQ ID NO: 637220 - RNA, 14 nt, Escherichia coli CFT073
cgacagaagaggag

SEQ ID NO: 637221 - RNA, 16 nt, Escherichia coli CFT073
cgacagacgccagcgc

SEQ ID NO: 637222 - RNA, 23 nt, Escherichia coli CFT073
cgacacggcucgccuuuucgccc

SEQ ID NO: 637223 - RNA, 14 nt, Escherichia coli CFT073
cgacagccucuucc

SEQ ID NO: 637224 - RNA, 14 nt, Escherichia coli CFT073
cgacagccagccca

SEQ ID NO: 637225 - RNA, 13 nt, Escherichia coli CFT073
cgaaugacaugcc

SEQ ID NO: 637226 - RNA, 19 nt, Escherichia coli CFT073
cgaauuaacaccaccagcg

SEQ ID NO: 637227 - RNA, 19 nt, Escherichia coli CFT073
cgaauuaagaauuucucag

SEQ ID NO: 637228 - RNA, 20 nt, Escherichia coli CFT073
cgaauuauucagaguauaua

SEQ ID NO: 637229 - RNA, 16 nt, Escherichia coli CFT073
cgaaucuucauagucu

SEQ ID NO: 637230 - RNA, 16 nt, Escherichia coli CFT073
cgaauccuuauauaaa

SEQ ID NO: 637231 - RNA, 13 nt, Escherichia coli CFT073
cgaauccuucccc

SEQ ID NO: 637232 - RNA, 21 nt, Escherichia coli CFT073
cgaauccuucccccaccacca

SEQ ID NO: 637233 - RNA, 18 nt, Escherichia coli CFT073
cgaaucaggcggcucacc

SEQ ID NO: 637234 - RNA, 20 nt, Escherichia coli CFT073
cgaaucaggcggcucaccug

SEQ ID NO: 637235 - RNA, 14 nt, Escherichia coli CFT073
cgaaucaaacaugg

SEQ ID NO: 637236 - RNA, 23 nt, Escherichia coli CFT073
cgaaucacagcuauaccgccagg

SEQ ID NO: 637237 - RNA, 14 nt, Escherichia coli CFT073
cgaaucauuaccug

SEQ ID NO: 637238 - RNA, 16 nt, Escherichia coli CFT073
cgaaggccagcaccac

SEQ ID NO: 637239 - RNA, 21 nt, Escherichia coli CFT073
cgaaguggacgaacagcucaa

SEQ ID NO: 637240 - RNA, 17 nt, Escherichia coli CFT073
cgaagugguuccacgcc

SEQ ID NO: 637241 - RNA, 19 nt, Escherichia coli CFT073
cgaaguucuuccggcagcc

SEQ ID NO: 637242 - RNA, 21 nt, Escherichia coli CFT073
cgaauaaacgauauccccgga

SEQ ID NO: 637243 - RNA, 17 nt, Escherichia coli CFT073
cgaagccagcucccaca

SEQ ID NO: 637244 - RNA, 15 nt, Escherichia coli CFT073
cgaagcccacaccgc

SEQ ID NO: 637245 - RNA, 20 nt, Escherichia coli CFT073
cgaagcccacaccgcccagc

SEQ ID NO: 637246 - RNA, 18 nt, Escherichia coli CFT073
cgaagaauacgccccaga

SEQ ID NO: 637247 - RNA, 14 nt, Escherichia coli CFT073
cgaagcacacauac

SEQ ID NO: 637248 - RNA, 13 nt, Escherichia coli CFT073
cgaagauguaguc

SEQ ID NO: 637249 - RNA, 17 nt, Escherichia coli CFT073
cgaacugucgauuugua

SEQ ID NO: 637250 - RNA, 16 nt, Escherichia coli CFT073
cgaacugguaaggaac

SEQ ID NO: 637251 - RNA, 16 nt, Escherichia coli CFT073
cgaacuuuaucugcac

SEQ ID NO: 637252 - RNA, 16 nt, Escherichia coli CFT073
ccuuuugccuucugag

SEQ ID NO: 637253 - RNA, 19 nt, Escherichia coli CFT073
ccuuuuuaggucgcccugu

SEQ ID NO: 637254 - RNA, 19 nt, Escherichia coli CFT073
ccuuuuucaguuugcugac

SEQ ID NO: 637255 - RNA, 20 nt, Escherichia coli CFT073
ccuuuuucacaucauugaca

SEQ ID NO: 637256 - RNA, 18 nt, Escherichia coli CFT073
ccuuuuuauuuagauaaa

SEQ ID NO: 637257 - RNA, 23 nt, Escherichia coli CFT073
cgaaccguucauuucacgcagcg

SEQ ID NO: 637258 - RNA, 16 nt, Escherichia coli CFT073
cgaaccucggaaugcc

SEQ ID NO: 637259 - RNA, 17 nt, Escherichia coli CFT073
cgaacuccgaucccugc

SEQ ID NO: 637260 - RNA, 16 nt, Escherichia coli CFT073
cgaacucaccaugacc

SEQ ID NO: 637261 - RNA, 15 nt, Escherichia coli CFT073
cgaacuccaguagcg

SEQ ID NO: 637262 - RNA, 15 nt, Escherichia coli CFT073
cgaacguaggccuca

SEQ ID NO: 637263 - RNA, 21 nt, Escherichia coli CFT073
cgaacgcagugauaacucaaa

SEQ ID NO: 637264 - RNA, 11 nt, Escherichia coli CFT073
cgacgggcgac

SEQ ID NO: 637265 - RNA, 13 nt, Escherichia coli CFT073
cgacguaauuuag

SEQ ID NO: 637266 - RNA, 13 nt, Escherichia coli CFT073
cgacgguugaauc

SEQ ID NO: 637267 - RNA, 17 nt, Escherichia coli CFT073
cgacgguuuccaggcag

SEQ ID NO: 637268 - RNA, 14 nt, Escherichia coli CFT073
cgacggcuggcaaa

SEQ ID NO: 637269 - RNA, 18 nt, Escherichia coli CFT073
cgacggcgcacaggcaau

SEQ ID NO: 637270 - RNA, 15 nt, Escherichia coli CFT073
cgacggcaucgccau

SEQ ID NO: 637271 - RNA, 15 nt, Escherichia coli CFT073
cgacgcgcgcggguc

SEQ ID NO: 637272 - RNA, 13 nt, Escherichia coli CFT073
cgacgcggcagcg

SEQ ID NO: 637273 - RNA, 18 nt, Escherichia coli CFT073
cgacgcuugccgcgucuu

SEQ ID NO: 637274 - RNA, 21 nt, Escherichia coli CFT073
cgacgcugaagucagcacauc

SEQ ID NO: 637275 - RNA, 14 nt, Escherichia coli CFT073
cgaccuuuuuugca

SEQ ID NO: 637276 - RNA, 14 nt, Escherichia coli CFT073
cgacgaauagguaa

SEQ ID NO: 637277 - RNA, 22 nt, Escherichia coli CFT073
cgacgaauuucaucgcuacacc

SEQ ID NO: 637278 - RNA, 14 nt, Escherichia coli CFT073
cgacgacaggcaag

SEQ ID NO: 637279 - RNA, 18 nt, Escherichia coli CFT073
cgacgacuggcgcggcag

SEQ ID NO: 637280 - RNA, 20 nt, Escherichia coli CFT073
cgacgaccgccgcucaccug

SEQ ID NO: 637281 - RNA, 12 nt, Escherichia coli CFT073
cgacgaggaaaa

SEQ ID NO: 637282 - RNA, 22 nt, Escherichia coli CFT073
cgacgauauuccgacggcgagc

SEQ ID NO: 637283 - RNA, 17 nt, Escherichia coli CFT073
cgacgcaguucaccugg

SEQ ID NO: 637284 - RNA, 16 nt, Escherichia coli CFT073
cgacgcauacgauccu

SEQ ID NO: 637285 - RNA, 21 nt, Escherichia coli CFT073
cgacgaucgggaacagccaca

SEQ ID NO: 637286 - RNA, 14 nt, Escherichia coli CFT073
cgaccuacacaccu

SEQ ID NO: 637287 - RNA, 23 nt, Escherichia coli CFT073
cgaccguuugccagaacugcugc

SEQ ID NO: 637288 - RNA, 19 nt, Escherichia coli CFT073
cgaccuacaaaaucaugca

SEQ ID NO: 637289 - RNA, 23 nt, Escherichia coli CFT073
cgaccuacaaaaucaugcaaauu

SEQ ID NO: 637290 - RNA, 23 nt, Escherichia coli CFT073
cgaccgucuuuauccagcaccac

SEQ ID NO: 637291 - RNA, 18 nt, Escherichia coli CFT073
cgaccgugcgccagcaaa

SEQ ID NO: 637292 - RNA, 23 nt, Escherichia coli CFT073
cgaccguaaauucucccgccccc

SEQ ID NO: 637293 - RNA, 19 nt, Escherichia coli CFT073
cgaccggcguaacggccac

SEQ ID NO: 637294 - RNA, 17 nt, Escherichia coli CFT073
cgaccggauuagucugg

SEQ ID NO: 637295 - RNA, 17 nt, Escherichia coli CFT073
cgacccguuuacggcua

SEQ ID NO: 637296 - RNA, 20 nt, Escherichia coli CFT073
cgacccugaugaauauucuc

SEQ ID NO: 637297 - RNA, 22 nt, Escherichia coli CFT073
cgacccggcguuuucagaucca

SEQ ID NO: 637298 - RNA, 13 nt, Escherichia coli CFT073
cgaccgagcuggu

SEQ ID NO: 637299 - RNA, 15 nt, Escherichia coli CFT073
cgacccacgccccug

SEQ ID NO: 637300 - RNA, 23 nt, Escherichia coli CFT073
cgaccaaagaauccgcccucuuc

SEQ ID NO: 637301 - RNA, 13 nt, Escherichia coli CFT073
cgacauuuccccc

SEQ ID NO: 637302 - RNA, 16 nt, Escherichia coli CFT073
cgacauuucugcugcc

SEQ ID NO: 637303 - RNA, 20 nt, Escherichia coli CFT073
cgacauuaagacgcagauuu

SEQ ID NO: 637304 - RNA, 23 nt, Escherichia coli CFT073
cgacaucuuucugcgcaucuucc

SEQ ID NO: 637305 - RNA, 23 nt, Escherichia coli CFT073
cgaccacaaauaccccaccgccg

SEQ ID NO: 637306 - RNA, 17 nt, Escherichia coli CFT073
cgaccacccaccgcagc

SEQ ID NO: 637307 - RNA, 17 nt, Escherichia coli CFT073
cgaccacggccaguccg

SEQ ID NO: 637308 - RNA, 18 nt, Escherichia coli CFT073
cgaccacugaccgcccgg

SEQ ID NO: 637309 - RNA, 17 nt, Escherichia coli CFT073
cgaccaccucggcacug

SEQ ID NO: 637310 - RNA, 12 nt, Escherichia coli CFT073
cgacccacgccc

SEQ ID NO: 637311 - RNA, 14 nt, Escherichia coli CFT073
cgacccacgccccu

SEQ ID NO: 637312 - RNA, 19 nt, Escherichia coli CFT073
cgaccaucggaucggccau

SEQ ID NO: 637313 - RNA, 17 nt, Escherichia coli CFT073
cgaccaucguuaccuuu

SEQ ID NO: 637314 - RNA, 21 nt, Escherichia coli CFT073
cgaccaucguuaccuuugcag

SEQ ID NO: 637315 - RNA, 17 nt, Escherichia coli CFT073
cgaccaggcaaaccagu

SEQ ID NO: 637316 - RNA, 19 nt, Escherichia coli CFT073
cgaccaggccaucagcagc

SEQ ID NO: 637317 - RNA, 17 nt, Escherichia coli CFT073
cgaccagugaaaauggc

SEQ ID NO: 637318 - RNA, 21 nt, Escherichia coli CFT073
cgaccagugcaacagagagca

SEQ ID NO: 637319 - RNA, 22 nt, Escherichia coli CFT073
cgaccagcgucguauccagcgu

SEQ ID NO: 637320 - RNA, 14 nt, Escherichia coli CFT073
cgaccaggaacgcc

SEQ ID NO: 637321 - RNA, 17 nt, Escherichia coli CFT073
cgaccagaccggcaauc

SEQ ID NO: 637322 - RNA, 21 nt, Escherichia coli CFT073
cgaccagauaagaacugacuu

SEQ ID NO: 637323 - RNA, 12 nt, Escherichia coli CFT073
cgaccagaaaug

SEQ ID NO: 637324 - RNA, 14 nt, Escherichia coli CFT073
cgaccagaaaugca

SEQ ID NO: 637325 - RNA, 21 nt, Escherichia coli CFT073
ccuuuccccggcagcaucagu

SEQ ID NO: 637326 - RNA, 16 nt, Escherichia coli CFT073
ccuuucagauauccca

SEQ ID NO: 637327 - RNA, 18 nt, Escherichia coli CFT073
ccuuucagccccagcgca

SEQ ID NO: 637328 - RNA, 13 nt, Escherichia coli CFT073
ccuuucagcguua

SEQ ID NO: 637329 - RNA, 16 nt, Escherichia coli CFT073
ccuuugauuuucaggu

SEQ ID NO: 637330 - RNA, 13 nt, Escherichia coli CFT073
ccuuucggccaug

SEQ ID NO: 637331 - RNA, 18 nt, Escherichia coli CFT073
ccuuugcggugcagcagc

SEQ ID NO: 637332 - RNA, 13 nt, Escherichia coli CFT073
ccuuuugacuccu

SEQ ID NO: 637333 - RNA, 19 nt, Escherichia coli CFT073
ccuuuugcauaugcugcuu

SEQ ID NO: 637334 - RNA, 13 nt, Escherichia coli CFT073
ccuuuaugacuau

SEQ ID NO: 637335 - RNA, 18 nt, Escherichia coli CFT073
ccuuuaucacgcagcaga

SEQ ID NO: 637336 - RNA, 23 nt, Escherichia coli CFT073
ccuuucacaucagaacagcccca

SEQ ID NO: 637337 - RNA, 16 nt, Escherichia coli CFT073
ccuuucaccucaguga

SEQ ID NO: 637338 - RNA, 23 nt, Escherichia coli CFT073
ccuuucacgccgggaaauuuuuc

SEQ ID NO: 637339 - RNA, 21 nt, Escherichia coli CFT073
ccuuucaauaccgccugcaaa

SEQ ID NO: 637340 - RNA, 22 nt, Escherichia coli CFT073
ccuuuauuuugggggcguuucc

SEQ ID NO: 637341 - RNA, 20 nt, Escherichia coli CFT073
ccuuuaccgccacagcagcc

SEQ ID NO: 637342 - RNA, 18 nt, Escherichia coli CFT073
ccuuuacugacuguccca

SEQ ID NO: 637343 - RNA, 18 nt, Escherichia coli CFT073
ccuuuacaugaaaaauag

SEQ ID NO: 637344 - RNA, 20 nt, Escherichia coli CFT073
ccuuuaaucuuagacaucaa

SEQ ID NO: 637345 - RNA, 21 nt, Escherichia coli CFT073
ccuuguuggaucaugcucuua

SEQ ID NO: 637346 - RNA, 20 nt, Escherichia coli CFT073
ccuugugggccugaaagcuc

SEQ ID NO: 637347 - RNA, 21 nt, Escherichia coli CFT073
ccuugcguacaccaacaucac

SEQ ID NO: 637348 - RNA, 20 nt, Escherichia coli CFT073
ccuugcgugacgccugcucc

SEQ ID NO: 637349 - RNA, 11 nt, Escherichia coli CFT073
ccuucuucauc

SEQ ID NO: 637350 - RNA, 19 nt, Escherichia coli CFT073
ccuucgcggcaaaacagcc

SEQ ID NO: 637351 - RNA, 17 nt, Escherichia coli CFT073
ccuucgcuaucaaacug

SEQ ID NO: 637352 - RNA, 16 nt, Escherichia coli CFT073
ccuucgcugaauaucu

SEQ ID NO: 637353 - RNA, 13 nt, Escherichia coli CFT073
ccuucuugcuguc

SEQ ID NO: 637354 - RNA, 12 nt, Escherichia coli CFT073
ccuucuucuuuc

SEQ ID NO: 637355 - RNA, 16 nt, Escherichia coli CFT073
ccuuccgccaucaauc

SEQ ID NO: 637356 - RNA, 16 nt, Escherichia coli CFT073
ccuucagguuuuucag

SEQ ID NO: 637357 - RNA, 22 nt, Escherichia coli CFT073
ccuucagucauauuucuguuug

SEQ ID NO: 637358 - RNA, 17 nt, Escherichia coli CFT073
ccuucaguuuccagcaa

SEQ ID NO: 637359 - RNA, 18 nt, Escherichia coli CFT073
ccuucaguuuccagcaaa

SEQ ID NO: 637360 - RNA, 23 nt, Escherichia coli CFT073
ccuucagcgaagcccacaccgcc

SEQ ID NO: 637361 - RNA, 20 nt, Escherichia coli CFT073
ccuucagccccagacguuuc

SEQ ID NO: 637362 - RNA, 19 nt, Escherichia coli CFT073
ccuucagaagaucggaaga

SEQ ID NO: 637363 - RNA, 21 nt, Escherichia coli CFT073
ccuucagcaagaguuuuaaaa

SEQ ID NO: 637364 - RNA, 15 nt, Escherichia coli CFT073
ccuucagcaauuugu

SEQ ID NO: 637365 - RNA, 19 nt, Escherichia coli CFT073
ccuucgaaugccgcagcac

SEQ ID NO: 637366 - RNA, 18 nt, Escherichia coli CFT073
ccuuccugauaacacagc

SEQ ID NO: 637367 - RNA, 23 nt, Escherichia coli CFT073
ccuucgccagaauauugccauua

SEQ ID NO: 637368 - RNA, 23 nt, Escherichia coli CFT073
ccuucacgggcaaccacagugag

SEQ ID NO: 637369 - RNA, 18 nt, Escherichia coli CFT073
ccuucacggguugcgccu

SEQ ID NO: 637370 - RNA, 22 nt, Escherichia coli CFT073
ccuucacggguugcgccugugu

SEQ ID NO: 637371 - RNA, 23 nt, Escherichia coli CFT073
ccuucacgguuauuggagccugc

SEQ ID NO: 637372 - RNA, 22 nt, Escherichia coli CFT073
ccuucacauuucccggaauaau

SEQ ID NO: 637373 - RNA, 13 nt, Escherichia coli CFT073
ccuucaauaucau

SEQ ID NO: 637374 - RNA, 22 nt, Escherichia coli CFT073
ccuucaaugaucgucauaucau

SEQ ID NO: 637375 - RNA, 15 nt, Escherichia coli CFT073
ccuucaagcguccau

SEQ ID NO: 637376 - RNA, 20 nt, Escherichia coli CFT073
ccuuauugaccccguaauua

SEQ ID NO: 637377 - RNA, 17 nt, Escherichia coli CFT073
ccuuauugucuuuaaau

SEQ ID NO: 637378 - RNA, 18 nt, Escherichia coli CFT073
ccuuauuuuuauaacuau

SEQ ID NO: 637379 - RNA, 14 nt, Escherichia coli CFT073
ccuuaauuaucugg

SEQ ID NO: 637380 - RNA, 14 nt, Escherichia coli CFT073
ccuuaaucuucacu

SEQ ID NO: 637381 - RNA, 18 nt, Escherichia coli CFT073
ccuuaauaccggcaucca

SEQ ID NO: 637382 - RNA, 19 nt, Escherichia coli CFT073
ccuguagauauucuuccag

SEQ ID NO: 637383 - RNA, 20 nt, Escherichia coli CFT073
ccuguacgucgagaauaucg

SEQ ID NO: 637384 - RNA, 21 nt, Escherichia coli CFT073
ccuguaaugucaucucuggca

SEQ ID NO: 637385 - RNA, 19 nt, Escherichia coli CFT073
ccuuauccgacauuucugc

SEQ ID NO: 637386 - RNA, 18 nt, Escherichia coli CFT073
ccuuaugcagcggaauaa

SEQ ID NO: 637387 - RNA, 21 nt, Escherichia coli CFT073
ccuuaugcagcggaauaaucu

SEQ ID NO: 637388 - RNA, 14 nt, Escherichia coli CFT073
ccuuauucacgcca

SEQ ID NO: 637389 - RNA, 21 nt, Escherichia coli CFT073
ccuguaagcgguauugagcuu

SEQ ID NO: 637390 - RNA, 19 nt, Escherichia coli CFT073
ccuguaagaccugucucuu

SEQ ID NO: 637391 - RNA, 13 nt, Escherichia coli CFT073
ccuggugcaggcg

SEQ ID NO: 637392 - RNA, 17 nt, Escherichia coli CFT073
ccugggcuucauccagc

SEQ ID NO: 637393 - RNA, 16 nt, Escherichia coli CFT073
ccugggcaagcaccua

SEQ ID NO: 637394 - RNA, 13 nt, Escherichia coli CFT073
ccugggcaauggu

SEQ ID NO: 637395 - RNA, 16 nt, Escherichia coli CFT073
ccugggcaauggugaa

SEQ ID NO: 637396 - RNA, 15 nt, Escherichia coli CFT073
ccugggcgagguggg

SEQ ID NO: 637397 - RNA, 20 nt, Escherichia coli CFT073
ccuggcuggcgcuacugaag

SEQ ID NO: 637398 - RNA, 16 nt, Escherichia coli CFT073
ccuggcuugccagcca

SEQ ID NO: 637399 - RNA, 15 nt, Escherichia coli CFT073
ccuggcgcugcucag

SEQ ID NO: 637400 - RNA, 20 nt, Escherichia coli CFT073
ccuggcgggaauaaaagcca

SEQ ID NO: 637401 - RNA, 17 nt, Escherichia coli CFT073
ccugcuuugacacuuca

SEQ ID NO: 637402 - RNA, 15 nt, Escherichia coli CFT073
ccugcuuuuaccauc

SEQ ID NO: 637403 - RNA, 20 nt, Escherichia coli CFT073
ccuggagguggcaguuacug

SEQ ID NO: 637404 - RNA, 12 nt, Escherichia coli CFT073
ccuggagagugu

SEQ ID NO: 637405 - RNA, 22 nt, Escherichia coli CFT073
ccuggauaaggccaccagcggc

SEQ ID NO: 637406 - RNA, 13 nt, Escherichia coli CFT073
ccuggcaccauca

SEQ ID NO: 637407 - RNA, 19 nt, Escherichia coli CFT073
ccuggccauaccaugacga

SEQ ID NO: 637408 - RNA, 21 nt, Escherichia coli CFT073
ccuggccauaccaugacgaug

SEQ ID NO: 637409 - RNA, 23 nt, Escherichia coli CFT073
ccugcuccagcagcucaaucgcc

SEQ ID NO: 637410 - RNA, 15 nt, Escherichia coli CFT073
ccugcugugucucuu

SEQ ID NO: 637411 - RNA, 17 nt, Escherichia coli CFT073
ccugcugugucucuucu

SEQ ID NO: 637412 - RNA, 20 nt, Escherichia coli CFT073
ccugcuguguaauuugcguu

SEQ ID NO: 637413 - RNA, 14 nt, Escherichia coli CFT073
ccugccugacagac

SEQ ID NO: 637414 - RNA, 14 nt, Escherichia coli CFT073
ccugccugacgaug

SEQ ID NO: 637415 - RNA, 17 nt, Escherichia coli CFT073
ccugccugcagcugcuc

SEQ ID NO: 637416 - RNA, 18 nt, Escherichia coli CFT073
ccugccgucugggcaaaa

SEQ ID NO: 637417 - RNA, 23 nt, Escherichia coli CFT073
ccugccgucugggcaaaaucauc

SEQ ID NO: 637418 - RNA, 19 nt, Escherichia coli CFT073
ccugcggcguaccaauacg

SEQ ID NO: 637419 - RNA, 18 nt, Escherichia coli CFT073
ccugcgggagcgcuuuuu

SEQ ID NO: 637420 - RNA, 13 nt, Escherichia coli CFT073
ccugcucaucagc

SEQ ID NO: 637421 - RNA, 14 nt, Escherichia coli CFT073
ccugcucaaccgcc

SEQ ID NO: 637422 - RNA, 14 nt, Escherichia coli CFT073
ccugcucaaucgca

SEQ ID NO: 637423 - RNA, 19 nt, Escherichia coli CFT073
ccugcggggagaaugccag

SEQ ID NO: 637424 - RNA, 23 nt, Escherichia coli CFT073
ccugcggggaugaauauguaggc

SEQ ID NO: 637425 - RNA, 18 nt, Escherichia coli CFT073
ccugcaccucaaaaccaa

SEQ ID NO: 637426 - RNA, 18 nt, Escherichia coli CFT073
ccugcacugguggcaccu

SEQ ID NO: 637427 - RNA, 16 nt, Escherichia coli CFT073
ccugcacgaccggguu

SEQ ID NO: 637428 - RNA, 15 nt, Escherichia coli CFT073
ccugcagggauggcu

SEQ ID NO: 637429 - RNA, 16 nt, Escherichia coli CFT073
ccugcacugcaggccg

SEQ ID NO: 637430 - RNA, 15 nt, Escherichia coli CFT073
ccugcacuucaaauu

SEQ ID NO: 637431 - RNA, 14 nt, Escherichia coli CFT073
ccugcacaaugccu

SEQ ID NO: 637432 - RNA, 13 nt, Escherichia coli CFT073
ccugcacaccaac

SEQ ID NO: 637433 - RNA, 14 nt, Escherichia coli CFT073
ccugccccaucugc

SEQ ID NO: 637434 - RNA, 12 nt, Escherichia coli CFT073
ccugccccagag

SEQ ID NO: 637435 - RNA, 14 nt, Escherichia coli CFT073
ccugcccgcuccag

SEQ ID NO: 637436 - RNA, 18 nt, Escherichia coli CFT073
ccugcccgcgauccagcg

SEQ ID NO: 637437 - RNA, 14 nt, Escherichia coli CFT073
ccugcagucaccug

SEQ ID NO: 637438 - RNA, 18 nt, Escherichia coli CFT073
ccugcagucaccugcccu

SEQ ID NO: 637439 - RNA, 20 nt, Escherichia coli CFT073
ccugcauaaaggcaaaacag

SEQ ID NO: 637440 - RNA, 18 nt, Escherichia coli CFT073
ccugcauaccaagcccga

SEQ ID NO: 637441 - RNA, 21 nt, Escherichia coli CFT073
ccugcagugcaggccggaguu

SEQ ID NO: 637442 - RNA, 22 nt, Escherichia coli CFT073
ccugccagcuugcgauccugca

SEQ ID NO: 637443 - RNA, 15 nt, Escherichia coli CFT073
ccugccagcaguuug

SEQ ID NO: 637444 - RNA, 22 nt, Escherichia coli CFT073
ccggcgucguucgccagucucc

SEQ ID NO: 637445 - RNA, 15 nt, Escherichia coli CFT073
ccggcguccaccugc

SEQ ID NO: 637446 - RNA, 17 nt, Escherichia coli CFT073
aaaccguccccaaaaaa

SEQ ID NO: 637447 - RNA, 22 nt, Escherichia coli CFT073
ccggcgcaaaaaacuaucccau

SEQ ID NO: 637448 - RNA, 20 nt, Escherichia coli CFT073
ccgggcagccuuucacauca

SEQ ID NO: 637449 - RNA, 13 nt, Escherichia coli CFT073
ccggcucccgcag

SEQ ID NO: 637450 - RNA, 16 nt, Escherichia coli CFT073
ccggcucccgcagcca

SEQ ID NO: 637451 - RNA, 16 nt, Escherichia coli CFT073
ccggcucauaucuucu

SEQ ID NO: 637452 - RNA, 18 nt, Escherichia coli CFT073
aaaccguggcaaaaucca

SEQ ID NO: 637453 - RNA, 17 nt, Escherichia coli CFT073
ccgggcaaaugcucccc

SEQ ID NO: 637454 - RNA, 19 nt, Escherichia coli CFT073
ccgggcaaaugcuccccug

SEQ ID NO: 637455 - RNA, 14 nt, Escherichia coli CFT073
ccgggcaaaaguca

SEQ ID NO: 637456 - RNA, 16 nt, Escherichia coli CFT073
ccgguaaucaccagca

SEQ ID NO: 637457 - RNA, 19 nt, Escherichia coli CFT073
ccgguaaucaccagcaaca

SEQ ID NO: 637458 - RNA, 14 nt, Escherichia coli CFT073
ccgguaaucaggca

SEQ ID NO: 637459 - RNA, 15 nt, Escherichia coli CFT073
ccgguaacggaccgc

SEQ ID NO: 637460 - RNA, 17 nt, Escherichia coli CFT073
ccgguacacaaccgccg

SEQ ID NO: 637461 - RNA, 19 nt, Escherichia coli CFT073
ccggguuuucaaugauaaa

SEQ ID NO: 637462 - RNA, 14 nt, Escherichia coli CFT073
ccgguaaacaaaaa

SEQ ID NO: 637463 - RNA, 14 nt, Escherichia coli CFT073
ccgggugaacugcc

SEQ ID NO: 637464 - RNA, 15 nt, Escherichia coli CFT073
ccgggucagcgggau

SEQ ID NO: 637465 - RNA, 19 nt, Escherichia coli CFT073
ccgggcuccauagggcagg

SEQ ID NO: 637466 - RNA, 19 nt, Escherichia coli CFT073
ccgggcgaugcagcgcaug

SEQ ID NO: 637467 - RNA, 23 nt, Escherichia coli CFT073
ccgguagucaggaagccccagcu

SEQ ID NO: 637468 - RNA, 16 nt, Escherichia coli CFT073
ccgguacgccagaccu

SEQ ID NO: 637469 - RNA, 17 nt, Escherichia coli CFT073
ccggucacgccggggau

SEQ ID NO: 637470 - RNA, 18 nt, Escherichia coli CFT073
ccggucagcagcaccacc

SEQ ID NO: 637471 - RNA, 11 nt, Escherichia coli CFT073
ccggugcauuc

SEQ ID NO: 637472 - RNA, 14 nt, Escherichia coli CFT073
ccggugauugcugc

SEQ ID NO: 637473 - RNA, 17 nt, Escherichia coli CFT073
ccggugcguauucggca

SEQ ID NO: 637474 - RNA, 17 nt, Escherichia coli CFT073
ccggugcgggaguugau

SEQ ID NO: 637475 - RNA, 17 nt, Escherichia coli CFT073
ccggcaauugcaccgcg

SEQ ID NO: 637476 - RNA, 17 nt, Escherichia coli CFT073
ccggcaaucaacagaua

SEQ ID NO: 637477 - RNA, 16 nt, Escherichia coli CFT073
ccggcaauaaaacagg

SEQ ID NO: 637478 - RNA, 14 nt, Escherichia coli CFT073
ccggcaauaaacag

SEQ ID NO: 637479 - RNA, 15 nt, Escherichia coli CFT073
ccggcaccauuggaa

SEQ ID NO: 637480 - RNA, 14 nt, Escherichia coli CFT073
ccggcaccagcacc

SEQ ID NO: 637481 - RNA, 16 nt, Escherichia coli CFT073
ccggcaaugagcgccg

SEQ ID NO: 637482 - RNA, 20 nt, Escherichia coli CFT073
ccggcaccaauguaggccug

SEQ ID NO: 637483 - RNA, 20 nt, Escherichia coli CFT073
ccggcacguuuuggcaggca

SEQ ID NO: 637484 - RNA, 16 nt, Escherichia coli CFT073
ccggcaccugucagac

SEQ ID NO: 637485 - RNA, 15 nt, Escherichia coli CFT073
ccggcacuuuuucau

SEQ ID NO: 637486 - RNA, 13 nt, Escherichia coli CFT073
ccggcagaaacca

SEQ ID NO: 637487 - RNA, 20 nt, Escherichia coli CFT073
ccggcagaagcagucguccc

SEQ ID NO: 637488 - RNA, 16 nt, Escherichia coli CFT073
ccggcagaccaucguc

SEQ ID NO: 637489 - RNA, 11 nt, Escherichia coli CFT073
ccggcagagaa

SEQ ID NO: 637490 - RNA, 14 nt, Escherichia coli CFT073
ccggcacuucaacu

SEQ ID NO: 637491 - RNA, 22 nt, Escherichia coli CFT073
ccggcagcaaauucaccgccug

SEQ ID NO: 637492 - RNA, 13 nt, Escherichia coli CFT073
ccggcagcuucac

SEQ ID NO: 637493 - RNA, 15 nt, Escherichia coli CFT073
ccggcauacuuugau

SEQ ID NO: 637494 - RNA, 23 nt, Escherichia coli CFT073
ccggcagguuuaaccaucaggca

SEQ ID NO: 637495 - RNA, 12 nt, Escherichia coli CFT073
ccggcagugauc

SEQ ID NO: 637496 - RNA, 22 nt, Escherichia coli CFT073
ccggcaucauuauucccccggc

SEQ ID NO: 637497 - RNA, 12 nt, Escherichia coli CFT073
ccggcauccaga

SEQ ID NO: 637498 - RNA, 19 nt, Escherichia coli CFT073
ccggcauccagccaaacau

SEQ ID NO: 637499 - RNA, 13 nt, Escherichia coli CFT073
ccggcaucgccag

SEQ ID NO: 637500 - RNA, 15 nt, Escherichia coli CFT073
ccggcaucuuguuca

SEQ ID NO: 637501 - RNA, 17 nt, Escherichia coli CFT073
ccggcauuguuggaccg

SEQ ID NO: 637502 - RNA, 21 nt, Escherichia coli CFT073
ccggcauugacgaugccgucg

SEQ ID NO: 637503 - RNA, 23 nt, Escherichia coli CFT073
ccggcauuugagcauagugccug

SEQ ID NO: 637504 - RNA, 15 nt, Escherichia coli CFT073
ccggccaguccccuc

SEQ ID NO: 637505 - RNA, 22 nt, Escherichia coli CFT073
ccggccauacccgccagugccg

SEQ ID NO: 637506 - RNA, 13 nt, Escherichia coli CFT073
ccggauccagcgg

SEQ ID NO: 637507 - RNA, 16 nt, Escherichia coli CFT073
ccggaucugccauauc

SEQ ID NO: 637508 - RNA, 23 nt, Escherichia coli CFT073
ccggaugaguaaacuucaacgcu

SEQ ID NO: 637509 - RNA, 17 nt, Escherichia coli CFT073
ccggaugcggcaggcgu

SEQ ID NO: 637510 - RNA, 22 nt, Escherichia coli CFT073
ccggaugcggcauaaacgccuu

SEQ ID NO: 637511 - RNA, 22 nt, Escherichia coli CFT073
ccggaugcggcgcaccagcauc

SEQ ID NO: 637512 - RNA, 22 nt, Escherichia coli CFT073
ccggaugcgacgcuggccgcgu

SEQ ID NO: 637513 - RNA, 15 nt, Escherichia coli CFT073
ccggaugccucuccu

SEQ ID NO: 637514 - RNA, 19 nt, Escherichia coli CFT073
ccggaugcgacauagaucu

SEQ ID NO: 637515 - RNA, 19 nt, Escherichia coli CFT073
ccggaugauucacaucauc

SEQ ID NO: 637516 - RNA, 15 nt, Escherichia coli CFT073
ccggaugcaaacgau

SEQ ID NO: 637517 - RNA, 17 nt, Escherichia coli CFT073
ccggauuuucaccaucg

SEQ ID NO: 637518 - RNA, 14 nt, Escherichia coli CFT073
ccggcaaacucuac

SEQ ID NO: 637519 - RNA, 14 nt, Escherichia coli CFT073
ccggcaaauaacag

SEQ ID NO: 637520 - RNA, 20 nt, Escherichia coli CFT073
ccggcaaauuggcguggcgg

SEQ ID NO: 637521 - RNA, 14 nt, Escherichia coli CFT073
ccggcaaccacacc

SEQ ID NO: 637522 - RNA, 22 nt, Escherichia coli CFT073
ccggcaaccggaucgucaauaa

SEQ ID NO: 637523 - RNA, 17 nt, Escherichia coli CFT073
ccggauuguauugagau

SEQ ID NO: 637524 - RNA, 22 nt, Escherichia coli CFT073
ccggaugcggcguuaacgccuu

SEQ ID NO: 637525 - RNA, 22 nt, Escherichia coli CFT073
ccggauggauccccgcagcaaa

SEQ ID NO: 637526 - RNA, 21 nt, Escherichia coli CFT073
ccggauggcacgcauccggca

SEQ ID NO: 637527 - RNA, 16 nt, Escherichia coli CFT073
ccgcuguugccagcag

SEQ ID NO: 637528 - RNA, 18 nt, Escherichia coli CFT073
ccgcuguugccagcagca

SEQ ID NO: 637529 - RNA, 22 nt, Escherichia coli CFT073
ccgcuuaagcugccugcuaaca

SEQ ID NO: 637530 - RNA, 16 nt, Escherichia coli CFT073
ccgcuucaaaguucug

SEQ ID NO: 637531 - RNA, 21 nt, Escherichia coli CFT073
ccgcuucaaaguucugcgucu

SEQ ID NO: 637532 - RNA, 19 nt, Escherichia coli CFT073
ccgcuucaaucuucgauuu

SEQ ID NO: 637533 - RNA, 14 nt, Escherichia coli CFT073
ccgcuucacucccu

SEQ ID NO: 637534 - RNA, 16 nt, Escherichia coli CFT073
ccgcuucgcccgccag

SEQ ID NO: 637535 - RNA, 13 nt, Escherichia coli CFT073
ccgcuuccagaaa

SEQ ID NO: 637536 - RNA, 19 nt, Escherichia coli CFT073
ccgcugugguucauaugau

SEQ ID NO: 637537 - RNA, 17 nt, Escherichia coli CFT073
ccgcuguucugauuuug

SEQ ID NO: 637538 - RNA, 17 nt, Escherichia coli CFT073
ccgcugucuaccagcac

SEQ ID NO: 637539 - RNA, 22 nt, Escherichia coli CFT073
ccggaccaucuuccagcugcac

SEQ ID NO: 637540 - RNA, 13 nt, Escherichia coli CFT073
ccgcuuuaucuga

SEQ ID NO: 637541 - RNA, 21 nt, Escherichia coli CFT073
ccgcuuuaugugcuucuagca

SEQ ID NO: 637542 - RNA, 13 nt, Escherichia coli CFT073
ccgcuuuuaaccc

SEQ ID NO: 637543 - RNA, 21 nt, Escherichia coli CFT073
ccgcuuuugguuuuucaacca

SEQ ID NO: 637544 - RNA, 17 nt, Escherichia coli CFT073
ccgcuuuuuucaucucu

SEQ ID NO: 637545 - RNA, 18 nt, Escherichia coli CFT073
ccggaaaaaucaaaaacu

SEQ ID NO: 637546 - RNA, 18 nt, Escherichia coli CFT073
ccucgcugcucacaccau

SEQ ID NO: 637547 - RNA, 20 nt, Escherichia coli CFT073
ccucgccgagcagcuguuuc

SEQ ID NO: 637548 - RNA, 17 nt, Escherichia coli CFT073
ccucgaccaucuccuua

SEQ ID NO: 637549 - RNA, 19 nt, Escherichia coli CFT073
ccucaucauccucuucagc

SEQ ID NO: 637550 - RNA, 14 nt, Escherichia coli CFT073
ccucagccugauag

SEQ ID NO: 637551 - RNA, 16 nt, Escherichia coli CFT073
ccucagcggucaccgg

SEQ ID NO: 637552 - RNA, 12 nt, Escherichia coli CFT073
ccucaucuccag

SEQ ID NO: 637553 - RNA, 14 nt, Escherichia coli CFT073
aaacgcaaaacugc

SEQ ID NO: 637554 - RNA, 13 nt, Escherichia coli CFT073
ccuccaacaaccc

SEQ ID NO: 637555 - RNA, 22 nt, Escherichia coli CFT073
ccuccaacaacccugcaucaga

SEQ ID NO: 637556 - RNA, 12 nt, Escherichia coli CFT073
ccuccaacccac

SEQ ID NO: 637557 - RNA, 13 nt, Escherichia coli CFT073
ccuccugcggcuu

SEQ ID NO: 637558 - RNA, 14 nt, Escherichia coli CFT073
ccuccugcggcuuc

SEQ ID NO: 637559 - RNA, 22 nt, Escherichia coli CFT073
ccuccugucuaaccgccugccu

SEQ ID NO: 637560 - RNA, 23 nt, Escherichia coli CFT073
ccuccugucuaaccgccugccuu

SEQ ID NO: 637561 - RNA, 17 nt, Escherichia coli CFT073
ccuauuucauucaggcc

SEQ ID NO: 637562 - RNA, 13 nt, Escherichia coli CFT073
ccucaaaaagaaa

SEQ ID NO: 637563 - RNA, 13 nt, Escherichia coli CFT073
ccucaauaaucau

SEQ ID NO: 637564 - RNA, 15 nt, Escherichia coli CFT073
ccucaauaaucauuc

SEQ ID NO: 637565 - RNA, 17 nt, Escherichia coli CFT073
ccucacagcuaaucauc

SEQ ID NO: 637566 - RNA, 22 nt, Escherichia coli CFT073
ccucacccuaacccucuccccg

SEQ ID NO: 637567 - RNA, 17 nt, Escherichia coli CFT073
ccucacuuugauuuaua

SEQ ID NO: 637568 - RNA, 13 nt, Escherichia coli CFT073
ccucagaaaucag

SEQ ID NO: 637569 - RNA, 20 nt, Escherichia coli CFT073
ccucagcauaugcuucuucc

SEQ ID NO: 637570 - RNA, 14 nt, Escherichia coli CFT073
ccucagccacacuu

SEQ ID NO: 637571 - RNA, 13 nt, Escherichia coli CFT073
ccucagccagcgg

SEQ ID NO: 637572 - RNA, 21 nt, Escherichia coli CFT073
ccuauugcucuacgcuucucu

SEQ ID NO: 637573 - RNA, 12 nt, Escherichia coli CFT073
ccuauauauuua

SEQ ID NO: 637574 - RNA, 17 nt, Escherichia coli CFT073
ccuauaucaacgcccau

SEQ ID NO: 637575 - RNA, 19 nt, Escherichia coli CFT073
ccuauaccuaacacgauca

SEQ ID NO: 637576 - RNA, 15 nt, Escherichia coli CFT073
ccuauaaggcucucu

SEQ ID NO: 637577 - RNA, 23 nt, Escherichia coli CFT073
ccuacaccccagccggucagcag

SEQ ID NO: 637578 - RNA, 18 nt, Escherichia coli CFT073
ccuacagaacgcugcaau

SEQ ID NO: 637579 - RNA, 13 nt, Escherichia coli CFT073
ccuacagccacac

SEQ ID NO: 637580 - RNA, 16 nt, Escherichia coli CFT073
ccuacaaaccaucuga

SEQ ID NO: 637581 - RNA, 13 nt, Escherichia coli CFT073
ccuacacaccuuc

SEQ ID NO: 637582 - RNA, 13 nt, Escherichia coli CFT073
ccuaauuuuuuga

SEQ ID NO: 637583 - RNA, 16 nt, Escherichia coli CFT073
ccuaauggagaaacga

SEQ ID NO: 637584 - RNA, 15 nt, Escherichia coli CFT073
ccuaaugaauccagc

SEQ ID NO: 637585 - RNA, 16 nt, Escherichia coli CFT073
ccuagcaaacuaucug

SEQ ID NO: 637586 - RNA, 23 nt, Escherichia coli CFT073
ccuacgauucggcauuaauuagu

SEQ ID NO: 637587 - RNA, 17 nt, Escherichia coli CFT073
ccuacggauucaaugca

SEQ ID NO: 637588 - RNA, 18 nt, Escherichia coli CFT073
ccuacgggaacagugcuu

SEQ ID NO: 637589 - RNA, 15 nt, Escherichia coli CFT073
ccgguuccugcaucg

SEQ ID NO: 637590 - RNA, 18 nt, Escherichia coli CFT073
ccgguguggcauggcgaa

SEQ ID NO: 637591 - RNA, 15 nt, Escherichia coli CFT073
ccgguucccagaccu

SEQ ID NO: 637592 - RNA, 22 nt, Escherichia coli CFT073
ccgguuuaaucgauuuagaacu

SEQ ID NO: 637593 - RNA, 15 nt, Escherichia coli CFT073
ccgguuuagaaaaga

SEQ ID NO: 637594 - RNA, 17 nt, Escherichia coli CFT073
ccgguuucaauccaggu

SEQ ID NO: 637595 - RNA, 22 nt, Escherichia coli CFT073
ccgguugugugcuggccaucac

SEQ ID NO: 637596 - RNA, 23 nt, Escherichia coli CFT073
ccgguuguuuugguuauuaacug

SEQ ID NO: 637597 - RNA, 12 nt, Escherichia coli CFT073
ccgucgaccagc

SEQ ID NO: 637598 - RNA, 14 nt, Escherichia coli CFT073
ccgucgcguagcac

SEQ ID NO: 637599 - RNA, 17 nt, Escherichia coli CFT073
ccgucgccuucaacgua

SEQ ID NO: 637600 - RNA, 21 nt, Escherichia coli CFT073
aaacgaccgcgggacaaauaa

SEQ ID NO: 637601 - RNA, 16 nt, Escherichia coli CFT073
aaacgauauccugcug

SEQ ID NO: 637602 - RNA, 18 nt, Escherichia coli CFT073
aaacgagccauaaaauca

SEQ ID NO: 637603 - RNA, 21 nt, Escherichia coli CFT073
aaacgagcgauccaacuaaau

SEQ ID NO: 637604 - RNA, 14 nt, Escherichia coli CFT073
aaacgauaauacgu

SEQ ID NO: 637605 - RNA, 17 nt, Escherichia coli CFT073
ccguggccugcaucgcu

SEQ ID NO: 637606 - RNA, 19 nt, Escherichia coli CFT073
ccguggcaaauugcccaag

SEQ ID NO: 637607 - RNA, 21 nt, Escherichia coli CFT073
ccgugucgggagggagaaccc

SEQ ID NO: 637608 - RNA, 19 nt, Escherichia coli CFT073
ccguguaauucgccgucgu

SEQ ID NO: 637609 - RNA, 17 nt, Escherichia coli CFT073
ccgugcauuuuucgcuu

SEQ ID NO: 637610 - RNA, 23 nt, Escherichia coli CFT073
ccgugcagcgcaaucgccuccag

SEQ ID NO: 637611 - RNA, 13 nt, Escherichia coli CFT073
ccgugcacaccga

SEQ ID NO: 637612 - RNA, 20 nt, Escherichia coli CFT073
ccgucugaagggaugcugug

SEQ ID NO: 637613 - RNA, 17 nt, Escherichia coli CFT073
ccgucugccacuucuuc

SEQ ID NO: 637614 - RNA, 13 nt, Escherichia coli CFT073
ccgucugcgccug

SEQ ID NO: 637615 - RNA, 15 nt, Escherichia coli CFT073
ccgucuaugccgguc

SEQ ID NO: 637616 - RNA, 14 nt, Escherichia coli CFT073
ccgucgugaaugcc

SEQ ID NO: 637617 - RNA, 15 nt, Escherichia coli CFT073
ccgucguuaaucugc

SEQ ID NO: 637618 - RNA, 21 nt, Escherichia coli CFT073
ccguuauacaucgcuuuccag

SEQ ID NO: 637619 - RNA, 21 nt, Escherichia coli CFT073
ccguuaaggccaaacaccagg

SEQ ID NO: 637620 - RNA, 11 nt, Escherichia coli CFT073
ccguucaauuc

SEQ ID NO: 637621 - RNA, 17 nt, Escherichia coli CFT073
ccguuuaauugccucuu

SEQ ID NO: 637622 - RNA, 15 nt, Escherichia coli CFT073
ccguuuacggcuaaa

SEQ ID NO: 637623 - RNA, 19 nt, Escherichia coli CFT073
ccguugugcgauccacgcc

SEQ ID NO: 637624 - RNA, 16 nt, Escherichia coli CFT073
ccguugcuucuagugc

SEQ ID NO: 637625 - RNA, 17 nt, Escherichia coli CFT073
ccguugguuauccuggu

SEQ ID NO: 637626 - RNA, 20 nt, Escherichia coli CFT073
ccguuguaaaugcugcucca

SEQ ID NO: 637627 - RNA, 22 nt, Escherichia coli CFT073
ccguuggcauuucgaccauggu

SEQ ID NO: 637628 - RNA, 20 nt, Escherichia coli CFT073
ccguugccgguuaucccgcu

SEQ ID NO: 637629 - RNA, 16 nt, Escherichia coli CFT073
ccguugcgcgucaacu

SEQ ID NO: 637630 - RNA, 17 nt, Escherichia coli CFT073
ccguucucaccaacugg

SEQ ID NO: 637631 - RNA, 13 nt, Escherichia coli CFT073
ccguucuuccuca

SEQ ID NO: 637632 - RNA, 19 nt, Escherichia coli CFT073
ccguucuuccucaugcggc

SEQ ID NO: 637633 - RNA, 20 nt, Escherichia coli CFT073
ccguucuggacuuccccugc

SEQ ID NO: 637634 - RNA, 22 nt, Escherichia coli CFT073
ccguucuggacuuccccugcca

SEQ ID NO: 637635 - RNA, 17 nt, Escherichia coli CFT073
ccguucuucgccauaac

SEQ ID NO: 637636 - RNA, 20 nt, Escherichia coli CFT073
ccguugacgaugucgacagg

SEQ ID NO: 637637 - RNA, 18 nt, Escherichia coli CFT073
ccguugccgcauugcgca

SEQ ID NO: 637638 - RNA, 12 nt, Escherichia coli CFT073
ccguuuucucca

SEQ ID NO: 637639 - RNA, 14 nt, Escherichia coli CFT073
ccguuuucaccuua

SEQ ID NO: 637640 - RNA, 20 nt, Escherichia coli CFT073
ccuaaagagaaaccccggca

SEQ ID NO: 637641 - RNA, 17 nt, Escherichia coli CFT073
ccguuuuuugaaacagg

SEQ ID NO: 637642 - RNA, 18 nt, Escherichia coli CFT073
ccuaaaaacaguaccaga

SEQ ID NO: 637643 - RNA, 19 nt, Escherichia coli CFT073
ccuaauaccguuccaacgc

SEQ ID NO: 637644 - RNA, 13 nt, Escherichia coli CFT073
ccuaauacucugg

SEQ ID NO: 637645 - RNA, 15 nt, Escherichia coli CFT073
ccuaacucuuccugc

SEQ ID NO: 637646 - RNA, 15 nt, Escherichia coli CFT073
ccuaagaaccagaau

SEQ ID NO: 637647 - RNA, 12 nt, Escherichia coli CFT073
ccuaacacagca

SEQ ID NO: 637648 - RNA, 15 nt, Escherichia coli CFT073
ccuaacacaugcaag

SEQ ID NO: 637649 - RNA, 21 nt, Escherichia coli CFT073
ccuaacacaugcaagucgaac

SEQ ID NO: 637650 - RNA, 18 nt, Escherichia coli CFT073
ccuaacccucuccccgga

SEQ ID NO: 637651 - RNA, 13 nt, Escherichia coli CFT073
ccgauuuguucuc

SEQ ID NO: 637652 - RNA, 17 nt, Escherichia coli CFT073
ccgauuucgcugauuug

SEQ ID NO: 637653 - RNA, 21 nt, Escherichia coli CFT073
ccgauuaaucuuccagaucac

SEQ ID NO: 637654 - RNA, 16 nt, Escherichia coli CFT073
ccgaugucuuugcguu

SEQ ID NO: 637655 - RNA, 12 nt, Escherichia coli CFT073
ccgauugccaug

SEQ ID NO: 637656 - RNA, 20 nt, Escherichia coli CFT073
ccgagcguucaaaacggcug

SEQ ID NO: 637657 - RNA, 18 nt, Escherichia coli CFT073
ccgcacucugaccgggaa

SEQ ID NO: 637658 - RNA, 13 nt, Escherichia coli CFT073
ccgcaaugugcuc

SEQ ID NO: 637659 - RNA, 18 nt, Escherichia coli CFT073
ccgcacaaauagccagca

SEQ ID NO: 637660 - RNA, 22 nt, Escherichia coli CFT073
ccgcacaaauagccagcagagc

SEQ ID NO: 637661 - RNA, 12 nt, Escherichia coli CFT073
ccgcaaaccaga

SEQ ID NO: 637662 - RNA, 17 nt, Escherichia coli CFT073
ccgcaaaacgcggcagg

SEQ ID NO: 637663 - RNA, 20 nt, Escherichia coli CFT073
ccgcagguagcagcagcgcc

SEQ ID NO: 637664 - RNA, 16 nt, Escherichia coli CFT073
ccgcaggugacgcugg

SEQ ID NO: 637665 - RNA, 22 nt, Escherichia coli CFT073
ccgcaggucggauaagacgcgc

SEQ ID NO: 637666 - RNA, 19 nt, Escherichia coli CFT073
ccgcagucauggcucuucc

SEQ ID NO: 637667 - RNA, 16 nt, Escherichia coli CFT073
ccgcaggaugagcgcg

SEQ ID NO: 637668 - RNA, 14 nt, Escherichia coli CFT073
ccgcagcuccagcc

SEQ ID NO: 637669 - RNA, 17 nt, Escherichia coli CFT073
ccgcacugguggcagug

SEQ ID NO: 637670 - RNA, 13 nt, Escherichia coli CFT073
ccgcaucauacug

SEQ ID NO: 637671 - RNA, 19 nt, Escherichia coli CFT073
ccgcauccggcauaaacaa

SEQ ID NO: 637672 - RNA, 20 nt, Escherichia coli CFT073
ccgcauccggcgacaggaac

SEQ ID NO: 637673 - RNA, 21 nt, Escherichia coli CFT073
ccgcauccggcgauuuucauc

SEQ ID NO: 637674 - RNA, 20 nt, Escherichia coli CFT073
ccgcaucgccgguuuugcca

SEQ ID NO: 637675 - RNA, 19 nt, Escherichia coli CFT073
ccgcaucguggccugcuca

SEQ ID NO: 637676 - RNA, 11 nt, Escherichia coli CFT073
ccgcauuggac

SEQ ID NO: 637677 - RNA, 14 nt, Escherichia coli CFT073
ccgcauugcccaau

SEQ ID NO: 637678 - RNA, 15 nt, Escherichia coli CFT073
ccgccaacagugccg

SEQ ID NO: 637679 - RNA, 20 nt, Escherichia coli CFT073
ccgccaaacugugcaccgcc

SEQ ID NO: 637680 - RNA, 20 nt, Escherichia coli CFT073
ccgccaccagaaccgccgcu

SEQ ID NO: 637681 - RNA, 11 nt, Escherichia coli CFT073
ccgccaccagg

SEQ ID NO: 637682 - RNA, 13 nt, Escherichia coli CFT073
ccgccaccuccgc

SEQ ID NO: 637683 - RNA, 14 nt, Escherichia coli CFT073
ccgccaccuccgcu

SEQ ID NO: 637684 - RNA, 16 nt, Escherichia coli CFT073
ccgccagaugcggcgu

SEQ ID NO: 637685 - RNA, 15 nt, Escherichia coli CFT073
ccgccagaccacugc

SEQ ID NO: 637686 - RNA, 13 nt, Escherichia coli CFT073
ccgccagauaguu

SEQ ID NO: 637687 - RNA, 23 nt, Escherichia coli CFT073
ccgccagaaaggguguccacgcu

SEQ ID NO: 637688 - RNA, 17 nt, Escherichia coli CFT073
ccgccagaaucaccgga

SEQ ID NO: 637689 - RNA, 22 nt, Escherichia coli CFT073
ccgccagaauccccggcaggaa

SEQ ID NO: 637690 - RNA, 22 nt, Escherichia coli CFT073
ccgccagaauccggugauugcu

SEQ ID NO: 637691 - RNA, 13 nt, Escherichia coli CFT073
ccgccagcacagc

SEQ ID NO: 637692 - RNA, 23 nt, Escherichia coli CFT073
ccgccagcacagccagccuccaa

SEQ ID NO: 637693 - RNA, 13 nt, Escherichia coli CFT073
ccgccagccacag

SEQ ID NO: 637694 - RNA, 13 nt, Escherichia coli CFT073
ccgccagcaggaa

SEQ ID NO: 637695 - RNA, 17 nt, Escherichia coli CFT073
aaaccaucacuccccuc

SEQ ID NO: 637696 - RNA, 23 nt, Escherichia coli CFT073
aaaccauaauauuuaaugacgaa

SEQ ID NO: 637697 - RNA, 13 nt, Escherichia coli CFT073
aaaccauauuaaa

SEQ ID NO: 637698 - RNA, 13 nt, Escherichia coli CFT073
aaaccaguacuga

SEQ ID NO: 637699 - RNA, 13 nt, Escherichia coli CFT073
aaaccaggaacag

SEQ ID NO: 637700 - RNA, 22 nt, Escherichia coli CFT073
aaaccagguaucguuacgccag

SEQ ID NO: 637701 - RNA, 15 nt, Escherichia coli CFT073
aaaccagaaagggaa

SEQ ID NO: 637702 - RNA, 17 nt, Escherichia coli CFT073
aaaccagaaagggaaga

SEQ ID NO: 637703 - RNA, 19 nt, Escherichia coli CFT073
aaaccagaaagggaagaac

SEQ ID NO: 637704 - RNA, 12 nt, Escherichia coli CFT073
aaaccagaccua

SEQ ID NO: 637705 - RNA, 11 nt, Escherichia coli CFT073
aaaccagcagc

SEQ ID NO: 637706 - RNA, 12 nt, Escherichia coli CFT073
aaaccagcgcau

SEQ ID NO: 637707 - RNA, 12 nt, Escherichia coli CFT073
ccgccagcgccu

SEQ ID NO: 637708 - RNA, 13 nt, Escherichia coli CFT073
ccgccagcgccuc

SEQ ID NO: 637709 - RNA, 15 nt, Escherichia coli CFT073
ccgccauagaaagga

SEQ ID NO: 637710 - RNA, 13 nt, Escherichia coli CFT073
ccgccauaaacag

SEQ ID NO: 637711 - RNA, 11 nt, Escherichia coli CFT073
ccgccaucauc

SEQ ID NO: 637712 - RNA, 14 nt, Escherichia coli CFT073
ccgccauccaggua

SEQ ID NO: 637713 - RNA, 15 nt, Escherichia coli CFT073
ccgccaucgcccgca

SEQ ID NO: 637714 - RNA, 18 nt, Escherichia coli CFT073
ccgccagucacugccacc

SEQ ID NO: 637715 - RNA, 19 nt, Escherichia coli CFT073
ccgccaguucccccugcca

SEQ ID NO: 637716 - RNA, 22 nt, Escherichia coli CFT073
ccgccaguucccccugccagac

SEQ ID NO: 637717 - RNA, 15 nt, Escherichia coli CFT073
ccgccucacgccagc

SEQ ID NO: 637718 - RNA, 17 nt, Escherichia coli CFT073
ccgccguacgucagcgc

SEQ ID NO: 637719 - RNA, 16 nt, Escherichia coli CFT073
ccgccgguugccccgc

SEQ ID NO: 637720 - RNA, 14 nt, Escherichia coli CFT073
ccgccgccaaucgc

SEQ ID NO: 637721 - RNA, 11 nt, Escherichia coli CFT073
ccgccgcccgg

SEQ ID NO: 637722 - RNA, 20 nt, Escherichia coli CFT073
ccgccgccauuugggcggcu

SEQ ID NO: 637723 - RNA, 13 nt, Escherichia coli CFT073
ccgccgccagggu

SEQ ID NO: 637724 - RNA, 13 nt, Escherichia coli CFT073
ccgccgccgccac

SEQ ID NO: 637725 - RNA, 23 nt, Escherichia coli CFT073
ccgccggaaagcaguaccgcagc

SEQ ID NO: 637726 - RNA, 16 nt, Escherichia coli CFT073
ccgccgcuggcgcagc

SEQ ID NO: 637727 - RNA, 14 nt, Escherichia coli CFT073
ccgccgcuccucau

SEQ ID NO: 637728 - RNA, 14 nt, Escherichia coli CFT073
aaaccauuuugcug

SEQ ID NO: 637729 - RNA, 13 nt, Escherichia coli CFT073
ccgccgaggccga

SEQ ID NO: 637730 - RNA, 22 nt, Escherichia coli CFT073
ccgcccgucaaacguaccgcca

SEQ ID NO: 637731 - RNA, 13 nt, Escherichia coli CFT073
ccgcccugcugua

SEQ ID NO: 637732 - RNA, 21 nt, Escherichia coli CFT073
ccgccccgcguuucaccacca

SEQ ID NO: 637733 - RNA, 22 nt, Escherichia coli CFT073
ccgcccagucccguacccagca

SEQ ID NO: 637734 - RNA, 15 nt, Escherichia coli CFT073
ccgccauuuccagcg

SEQ ID NO: 637735 - RNA, 18 nt, Escherichia coli CFT073
ccgccauuaaacgcagua

SEQ ID NO: 637736 - RNA, 18 nt, Escherichia coli CFT073
ccgccauuccagccagaa

SEQ ID NO: 637737 - RNA, 12 nt, Escherichia coli CFT073
ccgcccagugcc

SEQ ID NO: 637738 - RNA, 16 nt, Escherichia coli CFT073
ccgcccagcagcgccg

SEQ ID NO: 637739 - RNA, 21 nt, Escherichia coli CFT073
ccgacuuugaaggauaagacg

SEQ ID NO: 637740 - RNA, 15 nt, Escherichia coli CFT073
ccgagcaaugagcua

SEQ ID NO: 637741 - RNA, 23 nt, Escherichia coli CFT073
ccgacgagaaaugucggcccgca

SEQ ID NO: 637742 - RNA, 17 nt, Escherichia coli CFT073
ccgacgaucaacagaau

SEQ ID NO: 637743 - RNA, 18 nt, Escherichia coli CFT073
ccgacgauaccgccgcac

SEQ ID NO: 637744 - RNA, 23 nt, Escherichia coli CFT073
ccgacauuaucaccgacaaacag

SEQ ID NO: 637745 - RNA, 15 nt, Escherichia coli CFT073
ccgacaucaacgccu

SEQ ID NO: 637746 - RNA, 13 nt, Escherichia coli CFT073
ccgaccaacgcag

SEQ ID NO: 637747 - RNA, 14 nt, Escherichia coli CFT073
aaaccacugacaca

SEQ ID NO: 637748 - RNA, 19 nt, Escherichia coli CFT073
aaaccacugauaagcugag

SEQ ID NO: 637749 - RNA, 21 nt, Escherichia coli CFT073
aaacauuucacguucacguaa

SEQ ID NO: 637750 - RNA, 22 nt, Escherichia coli CFT073
aaacauuauugagaaacagaaa

SEQ ID NO: 637751 - RNA, 13 nt, Escherichia coli CFT073
aaacauugcugcc

SEQ ID NO: 637752 - RNA, 15 nt, Escherichia coli CFT073
aaacauugcugccag

SEQ ID NO: 637753 - RNA, 22 nt, Escherichia coli CFT073
aaacauugguccgauuguacuu

SEQ ID NO: 637754 - RNA, 16 nt, Escherichia coli CFT073
ccgacagauaaaucau

SEQ ID NO: 637755 - RNA, 21 nt, Escherichia coli CFT073
ccgacacuauaucucaaucaa

SEQ ID NO: 637756 - RNA, 15 nt, Escherichia coli CFT073
ccgacacuggcagug

SEQ ID NO: 637757 - RNA, 12 nt, Escherichia coli CFT073
ccgaagcgccuu

SEQ ID NO: 637758 - RNA, 14 nt, Escherichia coli CFT073
ccgaagcgccuuua

SEQ ID NO: 637759 - RNA, 16 nt, Escherichia coli CFT073
ccgaagcgccaauacc

SEQ ID NO: 637760 - RNA, 14 nt, Escherichia coli CFT073
ccgaagacaaacau

SEQ ID NO: 637761 - RNA, 18 nt, Escherichia coli CFT073
aaacaucgccauaaacac

SEQ ID NO: 637762 - RNA, 18 nt, Escherichia coli CFT073
aaacauguggauuaaauu

SEQ ID NO: 637763 - RNA, 21 nt, Escherichia coli CFT073
aaacaucaccaaugacagccc

SEQ ID NO: 637764 - RNA, 14 nt, Escherichia coli CFT073
aaacaucaaaaggu

SEQ ID NO: 637765 - RNA, 14 nt, Escherichia coli CFT073
aaacaucaccaaug

SEQ ID NO: 637766 - RNA, 16 nt, Escherichia coli CFT073
ccgaaccaaacgaggu

SEQ ID NO: 637767 - RNA, 23 nt, Escherichia coli CFT073
aaacauccccagcgucagcagca

SEQ ID NO: 637768 - RNA, 19 nt, Escherichia coli CFT073
ccgaacucgaccugcaacu

SEQ ID NO: 637769 - RNA, 14 nt, Escherichia coli CFT073
aaacauacuuucuc

SEQ ID NO: 637770 - RNA, 16 nt, Escherichia coli CFT073
aaacauacuuucucau

SEQ ID NO: 637771 - RNA, 19 nt, Escherichia coli CFT073
aaacauacccacgaaaucu

SEQ ID NO: 637772 - RNA, 16 nt, Escherichia coli CFT073
ccgaaacuugguuacg

SEQ ID NO: 637773 - RNA, 19 nt, Escherichia coli CFT073
cccuggucgguuucagcca

SEQ ID NO: 637774 - RNA, 12 nt, Escherichia coli CFT073
cccugguggcca

SEQ ID NO: 637775 - RNA, 22 nt, Escherichia coli CFT073
cccuggugggguucccgagcgg

SEQ ID NO: 637776 - RNA, 20 nt, Escherichia coli CFT073
cccuggucauaggcugccga

SEQ ID NO: 637777 - RNA, 20 nt, Escherichia coli CFT073
cccugguaccccauaacgac

SEQ ID NO: 637778 - RNA, 15 nt, Escherichia coli CFT073
cccugggcuucaucc

SEQ ID NO: 637779 - RNA, 14 nt, Escherichia coli CFT073
cccuuacccuuacu

SEQ ID NO: 637780 - RNA, 13 nt, Escherichia coli CFT073
aaacagcaggcag

SEQ ID NO: 637781 - RNA, 16 nt, Escherichia coli CFT073
aaacagaguauaaaaa

SEQ ID NO: 637782 - RNA, 17 nt, Escherichia coli CFT073
aaacagaguauaaaaaa

SEQ ID NO: 637783 - RNA, 18 nt, Escherichia coli CFT073
cccuucacucugcugcca

SEQ ID NO: 637784 - RNA, 12 nt, Escherichia coli CFT073
cccuucacuuca

SEQ ID NO: 637785 - RNA, 18 nt, Escherichia coli CFT073
aaacagcgacaccagcca

SEQ ID NO: 637786 - RNA, 19 nt, Escherichia coli CFT073
aaacagcgagaacaccgaa

SEQ ID NO: 637787 - RNA, 13 nt, Escherichia coli CFT073
aaacagcgccaga

SEQ ID NO: 637788 - RNA, 16 nt, Escherichia coli CFT073
aaacagccaaucauaa

SEQ ID NO: 637789 - RNA, 23 nt, Escherichia coli CFT073
aaacagccagcagcgaaucagcc

SEQ ID NO: 637790 - RNA, 22 nt, Escherichia coli CFT073
aaacagcgcgccagcuaccaga

SEQ ID NO: 637791 - RNA, 21 nt, Escherichia coli CFT073
aaacaggcggcgcguccgguu

SEQ ID NO: 637792 - RNA, 15 nt, Escherichia coli CFT073
aaacaggcggucugc

SEQ ID NO: 637793 - RNA, 23 nt, Escherichia coli CFT073
aaacaggcuguuguucagugcau

SEQ ID NO: 637794 - RNA, 15 nt, Escherichia coli CFT073
cccuuuuucacauca

SEQ ID NO: 637795 - RNA, 23 nt, Escherichia coli CFT073
cccgguggcggcgucagcggcug

SEQ ID NO: 637796 - RNA, 21 nt, Escherichia coli CFT073
cccgguaccuuugaacugcug

SEQ ID NO: 637797 - RNA, 14 nt, Escherichia coli CFT073
cccgguaaacaaaa

SEQ ID NO: 637798 - RNA, 18 nt, Escherichia coli CFT073
cccgguaaagcgcaugau

SEQ ID NO: 637799 - RNA, 19 nt, Escherichia coli CFT073
cccggcguuuucagaucca

SEQ ID NO: 637800 - RNA, 15 nt, Escherichia coli CFT073
cccgccgccauccug

SEQ ID NO: 637801 - RNA, 19 nt, Escherichia coli CFT073
cccguucauccgcuucagg

SEQ ID NO: 637802 - RNA, 16 nt, Escherichia coli CFT073
cccguuaaccacuuca

SEQ ID NO: 637803 - RNA, 20 nt, Escherichia coli CFT073
cccgugcugcuuuuaaugcu

SEQ ID NO: 637804 - RNA, 16 nt, Escherichia coli CFT073
cccgugaagacuuugc

SEQ ID NO: 637805 - RNA, 20 nt, Escherichia coli CFT073
cccgugaugcggucgcugcc

SEQ ID NO: 637806 - RNA, 17 nt, Escherichia coli CFT073
cccgugagucuccuuua

SEQ ID NO: 637807 - RNA, 13 nt, Escherichia coli CFT073
cccgucugcugcu

SEQ ID NO: 637808 - RNA, 15 nt, Escherichia coli CFT073
cccgucugcugcugc

SEQ ID NO: 637809 - RNA, 14 nt, Escherichia coli CFT073
cccgucagcaaaau

SEQ ID NO: 637810 - RNA, 20 nt, Escherichia coli CFT073
cccuaacuggcgggcggcuu

SEQ ID NO: 637811 - RNA, 14 nt, Escherichia coli CFT073
cccguuuucaccuu

SEQ ID NO: 637812 - RNA, 21 nt, Escherichia coli CFT073
cccguuuucuccagcgccgcc

SEQ ID NO: 637813 - RNA, 16 nt, Escherichia coli CFT073
cccguugaucuucucu

SEQ ID NO: 637814 - RNA, 20 nt, Escherichia coli CFT073
cccguugaucuucucuuaua

SEQ ID NO: 637815 - RNA, 16 nt, Escherichia coli CFT073
cccguuguuugaaauu

SEQ ID NO: 637816 - RNA, 17 nt, Escherichia coli CFT073
cccuacgccuaccacca

SEQ ID NO: 637817 - RNA, 21 nt, Escherichia coli CFT073
cccuacgcgauaaaaaacccc

SEQ ID NO: 637818 - RNA, 13 nt, Escherichia coli CFT073
cccugaaauauug

SEQ ID NO: 637819 - RNA, 15 nt, Escherichia coli CFT073
cccugaaauauugcu

SEQ ID NO: 637820 - RNA, 19 nt, Escherichia coli CFT073
cccugaauaacgccgacag

SEQ ID NO: 637821 - RNA, 15 nt, Escherichia coli CFT073
cccugaauucucaaa

SEQ ID NO: 637822 - RNA, 22 nt, Escherichia coli CFT073
cccucuuccggaaccaccagau

SEQ ID NO: 637823 - RNA, 18 nt, Escherichia coli CFT073
cccugacuugcgaacuca

SEQ ID NO: 637824 - RNA, 19 nt, Escherichia coli CFT073
cccugaccgucaaacaugc

SEQ ID NO: 637825 - RNA, 14 nt, Escherichia coli CFT073
cccugauaaaucac

SEQ ID NO: 637826 - RNA, 16 nt, Escherichia coli CFT073
cccugaucggccauga

SEQ ID NO: 637827 - RNA, 23 nt, Escherichia coli CFT073
cccugaugcgugcgccagagccc

SEQ ID NO: 637828 - RNA, 21 nt, Escherichia coli CFT073
cccugcucuuucagcaccgcg

SEQ ID NO: 637829 - RNA, 22 nt, Escherichia coli CFT073
cccuggcuggucagcaauuuua

SEQ ID NO: 637830 - RNA, 23 nt, Escherichia coli CFT073
cccugcccggagccaucccugca

SEQ ID NO: 637831 - RNA, 12 nt, Escherichia coli CFT073
cccugccgccau

SEQ ID NO: 637832 - RNA, 19 nt, Escherichia coli CFT073
cccugcggcgaugaccgcc

SEQ ID NO: 637833 - RNA, 21 nt, Escherichia coli CFT073
cccugccagcgauacucucgc

SEQ ID NO: 637834 - RNA, 17 nt, Escherichia coli CFT073
cccugcaacaucaccgg

SEQ ID NO: 637835 - RNA, 18 nt, Escherichia coli CFT073
cccugccagaagcagaau

SEQ ID NO: 637836 - RNA, 23 nt, Escherichia coli CFT073
cccucguuuugccgccaucaucg

SEQ ID NO: 637837 - RNA, 21 nt, Escherichia coli CFT073
cccucuaaacgcucaaacagc

SEQ ID NO: 637838 - RNA, 14 nt, Escherichia coli CFT073
cccucgccccuccg

SEQ ID NO: 637839 - RNA, 16 nt, Escherichia coli CFT073
cccucgaccaucuccu

SEQ ID NO: 637840 - RNA, 16 nt, Escherichia coli CFT073
cccuccccggcggcuu

SEQ ID NO: 637841 - RNA, 17 nt, Escherichia coli CFT073
cccaucguugaaaaaau

SEQ ID NO: 637842 - RNA, 22 nt, Escherichia coli CFT073
cccaugaugcgcggcuccagaa

SEQ ID NO: 637843 - RNA, 12 nt, Escherichia coli CFT073
ccccaaaugucg

SEQ ID NO: 637844 - RNA, 15 nt, Escherichia coli CFT073
cccauuuucagccgg

SEQ ID NO: 637845 - RNA, 21 nt, Escherichia coli CFT073
cccauuuucagccggcaggau

SEQ ID NO: 637846 - RNA, 15 nt, Escherichia coli CFT073
ccccacauguugcag

SEQ ID NO: 637847 - RNA, 15 nt, Escherichia coli CFT073
ccccacaucacacca

SEQ ID NO: 637848 - RNA, 23 nt, Escherichia coli CFT073
ccccaccugaacuucuucgccag

SEQ ID NO: 637849 - RNA, 16 nt, Escherichia coli CFT073
ccccagauugccgaua

SEQ ID NO: 637850 - RNA, 22 nt, Escherichia coli CFT073
ccccagccagaugccuugccag

SEQ ID NO: 637851 - RNA, 14 nt, Escherichia coli CFT073
ccccagccaggugg

SEQ ID NO: 637852 - RNA, 21 nt, Escherichia coli CFT073
ccccaucagcaucccaccuga

SEQ ID NO: 637853 - RNA, 21 nt, Escherichia coli CFT073
ccccaucagcgccaucgccag

SEQ ID NO: 637854 - RNA, 13 nt, Escherichia coli CFT073
ccccauccacgca

SEQ ID NO: 637855 - RNA, 14 nt, Escherichia coli CFT073
ccccauaaucaaug

SEQ ID NO: 637856 - RNA, 19 nt, Escherichia coli CFT073
ccccauaaucaaugccagg

SEQ ID NO: 637857 - RNA, 13 nt, Escherichia coli CFT073
ccccauaugcagc

SEQ ID NO: 637858 - RNA, 23 nt, Escherichia coli CFT073
ccccaucgcguuugcguuccggc

SEQ ID NO: 637859 - RNA, 15 nt, Escherichia coli CFT073
cccccaccgccgccg

SEQ ID NO: 637860 - RNA, 14 nt, Escherichia coli CFT073
cccccacugccgcc

SEQ ID NO: 637861 - RNA, 13 nt, Escherichia coli CFT073
cccccuuccugcu

SEQ ID NO: 637862 - RNA, 22 nt, Escherichia coli CFT073
ccccgcgaacggggcugccagc

SEQ ID NO: 637863 - RNA, 22 nt, Escherichia coli CFT073
ccccgcgcucacaccacaacag

SEQ ID NO: 637864 - RNA, 19 nt, Escherichia coli CFT073
cccgaaagcguauccauca

SEQ ID NO: 637865 - RNA, 21 nt, Escherichia coli CFT073
ccccuuucuuauuuuucugca

SEQ ID NO: 637866 - RNA, 22 nt, Escherichia coli CFT073
cccgagcgugcgggcacaggcg

SEQ ID NO: 637867 - RNA, 11 nt, Escherichia coli CFT073
cccgagcgcca

SEQ ID NO: 637868 - RNA, 23 nt, Escherichia coli CFT073
cccgagcgaauaaaccacaccgc

SEQ ID NO: 637869 - RNA, 19 nt, Escherichia coli CFT073
cccgacgauaccgccgcac

SEQ ID NO: 637870 - RNA, 17 nt, Escherichia coli CFT073
cccgaccacuucaugcc

SEQ ID NO: 637871 - RNA, 19 nt, Escherichia coli CFT073
cccgaccaucgccagcuca

SEQ ID NO: 637872 - RNA, 17 nt, Escherichia coli CFT073
ccccucuuccggaacca

SEQ ID NO: 637873 - RNA, 18 nt, Escherichia coli CFT073
ccccugagcauacauugc

SEQ ID NO: 637874 - RNA, 19 nt, Escherichia coli CFT073
ccccugaagcggcagagga

SEQ ID NO: 637875 - RNA, 15 nt, Escherichia coli CFT073
ccccugccccaucug

SEQ ID NO: 637876 - RNA, 11 nt, Escherichia coli CFT073
ccccuucgcca

SEQ ID NO: 637877 - RNA, 19 nt, Escherichia coli CFT073
ccccgugaugaacugcggu

SEQ ID NO: 637878 - RNA, 13 nt, Escherichia coli CFT073
ccccgcucacgca

SEQ ID NO: 637879 - RNA, 22 nt, Escherichia coli CFT073
ccccgcucacgcagcggcggca

SEQ ID NO: 637880 - RNA, 12 nt, Escherichia coli CFT073
ccccgcuccggc

SEQ ID NO: 637881 - RNA, 16 nt, Escherichia coli CFT073
cccgccagcgcgcgcg

SEQ ID NO: 637882 - RNA, 15 nt, Escherichia coli CFT073
cccgccagcaccagc

SEQ ID NO: 637883 - RNA, 14 nt, Escherichia coli CFT073
cccgccagcagaau

SEQ ID NO: 637884 - RNA, 12 nt, Escherichia coli CFT073
cccgccagacca

SEQ ID NO: 637885 - RNA, 16 nt, Escherichia coli CFT073
cccgccaucgcccauc

SEQ ID NO: 637886 - RNA, 18 nt, Escherichia coli CFT073
cccgccaucaucccuaca

SEQ ID NO: 637887 - RNA, 13 nt, Escherichia coli CFT073
cccgccgaccauc

SEQ ID NO: 637888 - RNA, 14 nt, Escherichia coli CFT073
cccgcaaaccagac

SEQ ID NO: 637889 - RNA, 20 nt, Escherichia coli CFT073
cccgcaaagagcagcaaccg

SEQ ID NO: 637890 - RNA, 20 nt, Escherichia coli CFT073
cccgagguguauuucacugu

SEQ ID NO: 637891 - RNA, 23 nt, Escherichia coli CFT073
cccgcaaggaucggugcugccag

SEQ ID NO: 637892 - RNA, 19 nt, Escherichia coli CFT073
cccgcaacgcccugcaacu

SEQ ID NO: 637893 - RNA, 16 nt, Escherichia coli CFT073
cccgccaaugccgcgc

SEQ ID NO: 637894 - RNA, 18 nt, Escherichia coli CFT073
cccagggaaacagccacc

SEQ ID NO: 637895 - RNA, 16 nt, Escherichia coli CFT073
cccaggcugugcgcca

SEQ ID NO: 637896 - RNA, 20 nt, Escherichia coli CFT073
cccagguuugacgccugcag

SEQ ID NO: 637897 - RNA, 17 nt, Escherichia coli CFT073
cccaguaaacacaccac

SEQ ID NO: 637898 - RNA, 16 nt, Escherichia coli CFT073
cccaguccgcucgccg

SEQ ID NO: 637899 - RNA, 19 nt, Escherichia coli CFT073
cccaguagugcgcagaaca

SEQ ID NO: 637900 - RNA, 15 nt, Escherichia coli CFT073
cccaguggcagcaau

SEQ ID NO: 637901 - RNA, 20 nt, Escherichia coli CFT073
cccagucgucaucccagucc

SEQ ID NO: 637902 - RNA, 13 nt, Escherichia coli CFT073
cccagucguccag

SEQ ID NO: 637903 - RNA, 14 nt, Escherichia coli CFT073
cccagucuuuccau

SEQ ID NO: 637904 - RNA, 16 nt, Escherichia coli CFT073
cccagugccagcacca

SEQ ID NO: 637905 - RNA, 22 nt, Escherichia coli CFT073
cccauaacauauucacccgcgc

SEQ ID NO: 637906 - RNA, 16 nt, Escherichia coli CFT073
cccauaacccacacca

SEQ ID NO: 637907 - RNA, 22 nt, Escherichia coli CFT073
cccaguuuucguaguuaauaau

SEQ ID NO: 637908 - RNA, 15 nt, Escherichia coli CFT073
cccaguuuuucagga

SEQ ID NO: 637909 - RNA, 18 nt, Escherichia coli CFT073
cccaguugugcugccagc

SEQ ID NO: 637910 - RNA, 11 nt, Escherichia coli CFT073
cccaguuucau

SEQ ID NO: 637911 - RNA, 18 nt, Escherichia coli CFT073
aaacaccagaaugcccca

SEQ ID NO: 637912 - RNA, 23 nt, Escherichia coli CFT073
cccauagagagauguugcugcuc

SEQ ID NO: 637913 - RNA, 22 nt, Escherichia coli CFT073
cccauagauaccuucuugacau

SEQ ID NO: 637914 - RNA, 17 nt, Escherichia coli CFT073
cccauacucaucuucca

SEQ ID NO: 637915 - RNA, 18 nt, Escherichia coli CFT073
cccauaugcagccacugc

SEQ ID NO: 637916 - RNA, 21 nt, Escherichia coli CFT073
cccauaugcagccacugcugc

SEQ ID NO: 637917 - RNA, 20 nt, Escherichia coli CFT073
cccauauguucccgcgccuc

SEQ ID NO: 637918 - RNA, 17 nt, Escherichia coli CFT073
cccaucgcgacggcaga

SEQ ID NO: 637919 - RNA, 19 nt, Escherichia coli CFT073
cccaucgcgcccgccgcca

SEQ ID NO: 637920 - RNA, 16 nt, Escherichia coli CFT073
cccauccagcagagau

SEQ ID NO: 637921 - RNA, 13 nt, Escherichia coli CFT073
cccaucaguagca

SEQ ID NO: 637922 - RNA, 11 nt, Escherichia coli CFT073
cccauccacgc

SEQ ID NO: 637923 - RNA, 17 nt, Escherichia coli CFT073
cccagcaauccugcaug

SEQ ID NO: 637924 - RNA, 20 nt, Escherichia coli CFT073
cccagcaaugccaggcucca

SEQ ID NO: 637925 - RNA, 16 nt, Escherichia coli CFT073
cccagcaccaguacca

SEQ ID NO: 637926 - RNA, 17 nt, Escherichia coli CFT073
cccacuuucugcgcaau

SEQ ID NO: 637927 - RNA, 16 nt, Escherichia coli CFT073
cccagaagcuuuccau

SEQ ID NO: 637928 - RNA, 14 nt, Escherichia coli CFT073
cccagaaucgccaa

SEQ ID NO: 637929 - RNA, 19 nt, Escherichia coli CFT073
cccagaaucgccaacgccu

SEQ ID NO: 637930 - RNA, 22 nt, Escherichia coli CFT073
cccagaaucucuuuuguuuccc

SEQ ID NO: 637931 - RNA, 14 nt, Escherichia coli CFT073
cccagaauccccac

SEQ ID NO: 637932 - RNA, 15 nt, Escherichia coli CFT073
cccagaacacgccgu

SEQ ID NO: 637933 - RNA, 12 nt, Escherichia coli CFT073
cccagaaaauac

SEQ ID NO: 637934 - RNA, 18 nt, Escherichia coli CFT073
cccagaaacaggcggcgc

SEQ ID NO: 637935 - RNA, 15 nt, Escherichia coli CFT073
cccagccuuuccagc

SEQ ID NO: 637936 - RNA, 17 nt, Escherichia coli CFT073
cccagcgaagcaaacca

SEQ ID NO: 637937 - RNA, 16 nt, Escherichia coli CFT073
cccagccuaagccauu

SEQ ID NO: 637938 - RNA, 21 nt, Escherichia coli CFT073
cccagccugaaugccgcgccc

SEQ ID NO: 637939 - RNA, 17 nt, Escherichia coli CFT073
cccagcaggaucaauac

SEQ ID NO: 637940 - RNA, 18 nt, Escherichia coli CFT073
cccagcaggaucaauacc

SEQ ID NO: 637941 - RNA, 16 nt, Escherichia coli CFT073
cccagcccagcggaaa

SEQ ID NO: 637942 - RNA, 18 nt, Escherichia coli CFT073
cccagcagcgccgcgccu

SEQ ID NO: 637943 - RNA, 13 nt, Escherichia coli CFT073
cccagcacuucgc

SEQ ID NO: 637944 - RNA, 21 nt, Escherichia coli CFT073
cccagcacuuuucgcacugca

SEQ ID NO: 637945 - RNA, 12 nt, Escherichia coli CFT073
cccagcagagau

SEQ ID NO: 637946 - RNA, 23 nt, Escherichia coli CFT073
cccagcagagaucuuucacgccc

SEQ ID NO: 637947 - RNA, 21 nt, Escherichia coli CFT073
cccagcuggcgccaggcuuca

SEQ ID NO: 637948 - RNA, 18 nt, Escherichia coli CFT073
cccaggccaucgccaccg

SEQ ID NO: 637949 - RNA, 16 nt, Escherichia coli CFT073
cccaggcauccaguug

SEQ ID NO: 637950 - RNA, 17 nt, Escherichia coli CFT073
cccagcucaucagcauu

SEQ ID NO: 637951 - RNA, 19 nt, Escherichia coli CFT073
cccagcgucggaaucccuu

SEQ ID NO: 637952 - RNA, 18 nt, Escherichia coli CFT073
cccagcgcgaucgcgcca

SEQ ID NO: 637953 - RNA, 12 nt, Escherichia coli CFT073
cccagcgccugg

SEQ ID NO: 637954 - RNA, 18 nt, Escherichia coli CFT073
cccagcgccuggcagcau

SEQ ID NO: 637955 - RNA, 14 nt, Escherichia coli CFT073
cccagcggaaaaua

SEQ ID NO: 637956 - RNA, 21 nt, Escherichia coli CFT073
cccagcggaaaauaucaccaa

SEQ ID NO: 637957 - RNA, 16 nt, Escherichia coli CFT073
ccaugucgccaccugu

SEQ ID NO: 637958 - RNA, 21 nt, Escherichia coli CFT073
ccaugucgccaccuguccaua

SEQ ID NO: 637959 - RNA, 19 nt, Escherichia coli CFT073
ccaugucagacaacaugcc

SEQ ID NO: 637960 - RNA, 16 nt, Escherichia coli CFT073
ccauguugaucccugc

SEQ ID NO: 637961 - RNA, 15 nt, Escherichia coli CFT073
ccaugugcgacgggc

SEQ ID NO: 637962 - RNA, 15 nt, Escherichia coli CFT073
ccauguugacuucaa

SEQ ID NO: 637963 - RNA, 23 nt, Escherichia coli CFT073
ccauguugacuucaaucugagcg

SEQ ID NO: 637964 - RNA, 15 nt, Escherichia coli CFT073
ccaugugagucagau

SEQ ID NO: 637965 - RNA, 21 nt, Escherichia coli CFT073
ccauggcuggcaccuggcgca

SEQ ID NO: 637966 - RNA, 14 nt, Escherichia coli CFT073
ccaugggaaauggc

SEQ ID NO: 637967 - RNA, 22 nt, Escherichia coli CFT073
ccaugggaaauggcuggucagg

SEQ ID NO: 637968 - RNA, 12 nt, Escherichia coli CFT073
ccauguaauucg

SEQ ID NO: 637969 - RNA, 14 nt, Escherichia coli CFT073
ccauuacacugaaa

SEQ ID NO: 637970 - RNA, 19 nt, Escherichia coli CFT073
ccauuacacugaaaaaaag

SEQ ID NO: 637971 - RNA, 21 nt, Escherichia coli CFT073
ccauuacccggugccgccguc

SEQ ID NO: 637972 - RNA, 14 nt, Escherichia coli CFT073
ccauuaccgccauc

SEQ ID NO: 637973 - RNA, 12 nt, Escherichia coli CFT073
ccauguuuuccu

SEQ ID NO: 637974 - RNA, 19 nt, Escherichia coli CFT073
ccauuaaaucagccuuaau

SEQ ID NO: 637975 - RNA, 16 nt, Escherichia coli CFT073
ccauuaaccagccacu

SEQ ID NO: 637976 - RNA, 13 nt, Escherichia coli CFT073
ccauuaacccauu

SEQ ID NO: 637977 - RNA, 14 nt, Escherichia coli CFT073
ccauuccccagccg

SEQ ID NO: 637978 - RNA, 13 nt, Escherichia coli CFT073
ccauuagucacau

SEQ ID NO: 637979 - RNA, 22 nt, Escherichia coli CFT073
ccauuagucuggauugcagaga

SEQ ID NO: 637980 - RNA, 21 nt, Escherichia coli CFT073
ccauucccuggcacuguucau

SEQ ID NO: 637981 - RNA, 21 nt, Escherichia coli CFT073
ccauugcugaugcaccuucaa

SEQ ID NO: 637982 - RNA, 16 nt, Escherichia coli CFT073
ccauugcuaucaacaa

SEQ ID NO: 637983 - RNA, 17 nt, Escherichia coli CFT073
ccauugcucuuucacuu

SEQ ID NO: 637984 - RNA, 19 nt, Escherichia coli CFT073
ccauugcucuuucacuuua

SEQ ID NO: 637985 - RNA, 15 nt, Escherichia coli CFT073
ccauugccugcaacg

SEQ ID NO: 637986 - RNA, 16 nt, Escherichia coli CFT073
ccauugcgaauaagaa

SEQ ID NO: 637987 - RNA, 15 nt, Escherichia coli CFT073
ccauugcgucauaau

SEQ ID NO: 637988 - RNA, 17 nt, Escherichia coli CFT073
ccauugcgucgcugaac

SEQ ID NO: 637989 - RNA, 13 nt, Escherichia coli CFT073
ccauucuccgcuc

SEQ ID NO: 637990 - RNA, 18 nt, Escherichia coli CFT073
ccauugccgccucugccg

SEQ ID NO: 637991 - RNA, 13 nt, Escherichia coli CFT073
ccauuuucauuua

SEQ ID NO: 637992 - RNA, 17 nt, Escherichia coli CFT073
ccauuuuuuuacccagc

SEQ ID NO: 637993 - RNA, 11 nt, Escherichia coli CFT073
ccauuuugcug

SEQ ID NO: 637994 - RNA, 17 nt, Escherichia coli CFT073
cccaacgcaaaaccaag

SEQ ID NO: 637995 - RNA, 23 nt, Escherichia coli CFT073
cccaacgcaaagagagaagccag

SEQ ID NO: 637996 - RNA, 21 nt, Escherichia coli CFT073
cccaagaucaauacaaccuac

SEQ ID NO: 637997 - RNA, 21 nt, Escherichia coli CFT073
cccaagaugccagaaucccca

SEQ ID NO: 637998 - RNA, 22 nt, Escherichia coli CFT073
cccaagaugccagaauccccac

SEQ ID NO: 637999 - RNA, 12 nt, Escherichia coli CFT073
cccaagcggggg

SEQ ID NO: 638000 - RNA, 18 nt, Escherichia coli CFT073
cccaacgugaccaguacc

SEQ ID NO: 638001 - RNA, 14 nt, Escherichia coli CFT073
cccaacugaucugc

SEQ ID NO: 638002 - RNA, 22 nt, Escherichia coli CFT073
cccaacugaucugccagcagac

SEQ ID NO: 638003 - RNA, 15 nt, Escherichia coli CFT073
ccaucauacagccag

SEQ ID NO: 638004 - RNA, 15 nt, Escherichia coli CFT073
ccaucaggcagucug

SEQ ID NO: 638005 - RNA, 22 nt, Escherichia coli CFT073
ccaucaguauuaucaaaucacc

SEQ ID NO: 638006 - RNA, 14 nt, Escherichia coli CFT073
ccauauucgaaccc

SEQ ID NO: 638007 - RNA, 17 nt, Escherichia coli CFT073
ccauauggcccaucauc

SEQ ID NO: 638008 - RNA, 18 nt, Escherichia coli CFT073
ccauauggcccaucaucu

SEQ ID NO: 638009 - RNA, 19 nt, Escherichia coli CFT073
ccauauucugaucgugcuc

SEQ ID NO: 638010 - RNA, 19 nt, Escherichia coli CFT073
ccauauuguuucaacacag

SEQ ID NO: 638011 - RNA, 20 nt, Escherichia coli CFT073
ccauauuucgucgcaucaca

SEQ ID NO: 638012 - RNA, 18 nt, Escherichia coli CFT073
ccaucgccauuuaacgca

SEQ ID NO: 638013 - RNA, 16 nt, Escherichia coli CFT073
ccaucgccaggaacaa

SEQ ID NO: 638014 - RNA, 16 nt, Escherichia coli CFT073
ccaucgcgacggcaga

SEQ ID NO: 638015 - RNA, 20 nt, Escherichia coli CFT073
ccaucgccguaccuuuguaa

SEQ ID NO: 638016 - RNA, 15 nt, Escherichia coli CFT073
ccauccuccgcagcc

SEQ ID NO: 638017 - RNA, 16 nt, Escherichia coli CFT073
ccauccuccgcagcca

SEQ ID NO: 638018 - RNA, 16 nt, Escherichia coli CFT073
ccaucgccaccgcuuc

SEQ ID NO: 638019 - RNA, 13 nt, Escherichia coli CFT073
ccauccggcagca

SEQ ID NO: 638020 - RNA, 20 nt, Escherichia coli CFT073
ccauccgggaucacaucaua

SEQ ID NO: 638021 - RNA, 13 nt, Escherichia coli CFT073
ccauccagcaaca

SEQ ID NO: 638022 - RNA, 12 nt, Escherichia coli CFT073
ccauccagcaga

SEQ ID NO: 638023 - RNA, 21 nt, Escherichia coli CFT073
ccauccaggagauauugcugc

SEQ ID NO: 638024 - RNA, 10 nt, Escherichia coli CFT073
ccauccauac

SEQ ID NO: 638025 - RNA, 15 nt, Escherichia coli CFT073
ccauccaucaacgcc

SEQ ID NO: 638026 - RNA, 16 nt, Escherichia coli CFT073
ccauccaucaacgcca

SEQ ID NO: 638027 - RNA, 21 nt, Escherichia coli CFT073
ccauccaucaacgccagcggg

SEQ ID NO: 638028 - RNA, 14 nt, Escherichia coli CFT073
ccauggaacucuuu

SEQ ID NO: 638029 - RNA, 19 nt, Escherichia coli CFT073
ccauggacaugcgcaccuu

SEQ ID NO: 638030 - RNA, 11 nt, Escherichia coli CFT073
ccaugcauauc

SEQ ID NO: 638031 - RNA, 17 nt, Escherichia coli CFT073
ccaugccgccaccacca

SEQ ID NO: 638032 - RNA, 22 nt, Escherichia coli CFT073
ccaugccaucugccagcaagcg

SEQ ID NO: 638033 - RNA, 17 nt, Escherichia coli CFT073
ccaugcaccaacccuaa

SEQ ID NO: 638034 - RNA, 18 nt, Escherichia coli CFT073
ccaugcacuuuuacugac

SEQ ID NO: 638035 - RNA, 22 nt, Escherichia coli CFT073
ccaugaccgcuccgccaucuuc

SEQ ID NO: 638036 - RNA, 20 nt, Escherichia coli CFT073
ccaugacgcaccuuguucau

SEQ ID NO: 638037 - RNA, 21 nt, Escherichia coli CFT073
ccaucuucuugcagcuuaauc

SEQ ID NO: 638038 - RNA, 14 nt, Escherichia coli CFT073
ccaucuucuucaau

SEQ ID NO: 638039 - RNA, 16 nt, Escherichia coli CFT073
ccaugaaaaaguuacc

SEQ ID NO: 638040 - RNA, 14 nt, Escherichia coli CFT073
ccaugacaaacuca

SEQ ID NO: 638041 - RNA, 21 nt, Escherichia coli CFT073
ccaugacaaacucaccuggcu

SEQ ID NO: 638042 - RNA, 15 nt, Escherichia coli CFT073
ccaucggcuuuggca

SEQ ID NO: 638043 - RNA, 15 nt, Escherichia coli CFT073
ccaucggcagcgcca

SEQ ID NO: 638044 - RNA, 22 nt, Escherichia coli CFT073
ccaguauugccaugcacgcaaa

SEQ ID NO: 638045 - RNA, 17 nt, Escherichia coli CFT073
ccaguauuucauagauu

SEQ ID NO: 638046 - RNA, 18 nt, Escherichia coli CFT073
ccagucacugccaccauc

SEQ ID NO: 638047 - RNA, 17 nt, Escherichia coli CFT073
ccagucagaaagugcca

SEQ ID NO: 638048 - RNA, 14 nt, Escherichia coli CFT073
ccagucagcuccac

SEQ ID NO: 638049 - RNA, 23 nt, Escherichia coli CFT073
ccagucaggcaugaucagcgucc

SEQ ID NO: 638050 - RNA, 14 nt, Escherichia coli CFT073
ccagucaggcauga

SEQ ID NO: 638051 - RNA, 14 nt, Escherichia coli CFT073
ccaguccacacuga

SEQ ID NO: 638052 - RNA, 19 nt, Escherichia coli CFT073
ccaguagcaccucuccacg

SEQ ID NO: 638053 - RNA, 23 nt, Escherichia coli CFT073
ccaguagcaccucuccacgcauc

SEQ ID NO: 638054 - RNA, 15 nt, Escherichia coli CFT073
ccaguagaacaauua

SEQ ID NO: 638055 - RNA, 23 nt, Escherichia coli CFT073
ccaguacggcuucgaucaggaac

SEQ ID NO: 638056 - RNA, 19 nt, Escherichia coli CFT073
ccaguacgcgcaaccccgc

SEQ ID NO: 638057 - RNA, 22 nt, Escherichia coli CFT073
ccaguacgcggacacuuuccug

SEQ ID NO: 638058 - RNA, 23 nt, Escherichia coli CFT073
ccaguacugacuauccacuggaa

SEQ ID NO: 638059 - RNA, 19 nt, Escherichia coli CFT073
ccaguagcuugaaaucacc

SEQ ID NO: 638060 - RNA, 21 nt, Escherichia coli CFT073
ccaguagugaaaaaagcaaga

SEQ ID NO: 638061 - RNA, 15 nt, Escherichia coli CFT073
ccaguaguugcucaa

SEQ ID NO: 638062 - RNA, 20 nt, Escherichia coli CFT073
ccaguaguugcucaagcuga

SEQ ID NO: 638063 - RNA, 12 nt, Escherichia coli CFT073
ccaguaaugcgc

SEQ ID NO: 638064 - RNA, 18 nt, Escherichia coli CFT073
ccaguacacgcugaagau

SEQ ID NO: 638065 - RNA, 13 nt, Escherichia coli CFT073
ccaguaauaaaga

SEQ ID NO: 638066 - RNA, 14 nt, Escherichia coli CFT073
ccaguaauaaagac

SEQ ID NO: 638067 - RNA, 23 nt, Escherichia coli CFT073
ccaguaaucgggcaacugcugcg

SEQ ID NO: 638068 - RNA, 17 nt, Escherichia coli CFT073
ccaguaauuccacacca

SEQ ID NO: 638069 - RNA, 18 nt, Escherichia coli CFT073
ccaguaauuccacaccaa

SEQ ID NO: 638070 - RNA, 11 nt, Escherichia coli CFT073
ccaguaccgau

SEQ ID NO: 638071 - RNA, 17 nt, Escherichia coli CFT073
ccaguaccgccaccacc

SEQ ID NO: 638072 - RNA, 24 nt, Escherichia coli CFT073
ccaguaccgccaccaccagacgca

SEQ ID NO: 638073 - RNA, 18 nt, Escherichia coli CFT073
ccaguaccgccagugcag

SEQ ID NO: 638074 - RNA, 13 nt, Escherichia coli CFT073
ccaguaccgccag

SEQ ID NO: 638075 - RNA, 15 nt, Escherichia coli CFT073
ccaguaccgccgcag

SEQ ID NO: 638076 - RNA, 15 nt, Escherichia coli CFT073
ccaguacgccuucac

SEQ ID NO: 638077 - RNA, 13 nt, Escherichia coli CFT073
ccaguaaggcugc

SEQ ID NO: 638078 - RNA, 22 nt, Escherichia coli CFT073
ccaguaacuuccccuuucacau

SEQ ID NO: 638079 - RNA, 20 nt, Escherichia coli CFT073
ccagguuuucuuucaccucu

SEQ ID NO: 638080 - RNA, 22 nt, Escherichia coli CFT073
ccaguaaacacaccacagcacc

SEQ ID NO: 638081 - RNA, 18 nt, Escherichia coli CFT073
ccaguaaacugacccgcu

SEQ ID NO: 638082 - RNA, 23 nt, Escherichia coli CFT073
ccaguaaauuguugccggagaaa

SEQ ID NO: 638083 - RNA, 17 nt, Escherichia coli CFT073
ccagguuuaccagcagc

SEQ ID NO: 638084 - RNA, 17 nt, Escherichia coli CFT073
ccagguuugaccccggc

SEQ ID NO: 638085 - RNA, 22 nt, Escherichia coli CFT073
ccagguuuuguagcuaaacuga

SEQ ID NO: 638086 - RNA, 18 nt, Escherichia coli CFT073
ccagggucaguuucaccu

SEQ ID NO: 638087 - RNA, 15 nt, Escherichia coli CFT073
ccagguaacgaagau

SEQ ID NO: 638088 - RNA, 17 nt, Escherichia coli CFT073
ccaggguuuuauuauuc

SEQ ID NO: 638089 - RNA, 14 nt, Escherichia coli CFT073
ccagguaaacaccu

SEQ ID NO: 638090 - RNA, 22 nt, Escherichia coli CFT073
ccagggguuguuauuuccggca

SEQ ID NO: 638091 - RNA, 16 nt, Escherichia coli CFT073
ccagccgcgucugaau

SEQ ID NO: 638092 - RNA, 13 nt, Escherichia coli CFT073
ccagguggcagac

SEQ ID NO: 638093 - RNA, 12 nt, Escherichia coli CFT073
ccaggugcuuuu

SEQ ID NO: 638094 - RNA, 16 nt, Escherichia coli CFT073
ccagguuaugguugaa

SEQ ID NO: 638095 - RNA, 18 nt, Escherichia coli CFT073
ccagguagcguuucaccu

SEQ ID NO: 638096 - RNA, 19 nt, Escherichia coli CFT073
ccagguagcaaacaaaaag

SEQ ID NO: 638097 - RNA, 15 nt, Escherichia coli CFT073
ccagucgucauccca

SEQ ID NO: 638098 - RNA, 15 nt, Escherichia coli CFT073
ccagucgcugcugac

SEQ ID NO: 638099 - RNA, 16 nt, Escherichia coli CFT073
ccagucuuccugcggc

SEQ ID NO: 638100 - RNA, 13 nt, Escherichia coli CFT073
ccagugaauacug

SEQ ID NO: 638101 - RNA, 19 nt, Escherichia coli CFT073
ccagugaauuaaaaacagu

SEQ ID NO: 638102 - RNA, 13 nt, Escherichia coli CFT073
ccagucccuuuca

SEQ ID NO: 638103 - RNA, 21 nt, Escherichia coli CFT073
ccagucccguacccagcaaga

SEQ ID NO: 638104 - RNA, 21 nt, Escherichia coli CFT073
ccagucccugaaugucuccau

SEQ ID NO: 638105 - RNA, 12 nt, Escherichia coli CFT073
ccaguucacacc

SEQ ID NO: 638106 - RNA, 16 nt, Escherichia coli CFT073
ccaguucacgaauauu

SEQ ID NO: 638107 - RNA, 15 nt, Escherichia coli CFT073
ccaguuaacgccgcg

SEQ ID NO: 638108 - RNA, 16 nt, Escherichia coli CFT073
ccaguuaacgccgcgc

SEQ ID NO: 638109 - RNA, 17 nt, Escherichia coli CFT073
ccaguuccacuucugca

SEQ ID NO: 638110 - RNA, 15 nt, Escherichia coli CFT073
ccaguuccacuuugc

SEQ ID NO: 638111 - RNA, 23 nt, Escherichia coli CFT073
ccaguuccacuuugcuuucagau

SEQ ID NO: 638112 - RNA, 21 nt, Escherichia coli CFT073
ccaguucauguucgacaugcu

SEQ ID NO: 638113 - RNA, 12 nt, Escherichia coli CFT073
ccaguucccccu

SEQ ID NO: 638114 - RNA, 19 nt, Escherichia coli CFT073
ccaguuccccgcgauugau

SEQ ID NO: 638115 - RNA, 19 nt, Escherichia coli CFT073
ccaguugagcuccagugcg

SEQ ID NO: 638116 - RNA, 15 nt, Escherichia coli CFT073
ccaguucagcggcug

SEQ ID NO: 638117 - RNA, 13 nt, Escherichia coli CFT073
ccagugauuccag

SEQ ID NO: 638118 - RNA, 15 nt, Escherichia coli CFT073
ccagugcaaaaaauc

SEQ ID NO: 638119 - RNA, 15 nt, Escherichia coli CFT073
ccagugcagauacca

SEQ ID NO: 638120 - RNA, 15 nt, Escherichia coli CFT073
ccagugcagcgaagu

SEQ ID NO: 638121 - RNA, 13 nt, Escherichia coli CFT073
ccagugcagcgca

SEQ ID NO: 638122 - RNA, 15 nt, Escherichia coli CFT073
ccagugccagcacca

SEQ ID NO: 638123 - RNA, 21 nt, Escherichia coli CFT073
ccagugcccgaccacuucaug

SEQ ID NO: 638124 - RNA, 22 nt, Escherichia coli CFT073
ccauacgucggugcagcaugau

SEQ ID NO: 638125 - RNA, 18 nt, Escherichia coli CFT073
ccauacggcucagcucug

SEQ ID NO: 638126 - RNA, 20 nt, Escherichia coli CFT073
ccauaggaugagguuucccg

SEQ ID NO: 638127 - RNA, 16 nt, Escherichia coli CFT073
ccauagggcagggugc

SEQ ID NO: 638128 - RNA, 21 nt, Escherichia coli CFT073
ccauacccaccaauuaauccc

SEQ ID NO: 638129 - RNA, 18 nt, Escherichia coli CFT073
ccauaccggacuccagac

SEQ ID NO: 638130 - RNA, 17 nt, Escherichia coli CFT073
ccauaccggcugcaaac

SEQ ID NO: 638131 - RNA, 19 nt, Escherichia coli CFT073
ccauacauugcggaccagc

SEQ ID NO: 638132 - RNA, 21 nt, Escherichia coli CFT073
ccauacauugcggaccagcgg

SEQ ID NO: 638133 - RNA, 20 nt, Escherichia coli CFT073
ccauaccacuuccagcagac

SEQ ID NO: 638134 - RNA, 20 nt, Escherichia coli CFT073
ccauaaugccccagcgcacu

SEQ ID NO: 638135 - RNA, 15 nt, Escherichia coli CFT073
ccauaaucgacuccc

SEQ ID NO: 638136 - RNA, 14 nt, Escherichia coli CFT073
ccauaaacaccagc

SEQ ID NO: 638137 - RNA, 20 nt, Escherichia coli CFT073
ccauaaacaucgucaggaag

SEQ ID NO: 638138 - RNA, 24 nt, Escherichia coli CFT073
ccauaaaacucgauggcguuuucc

SEQ ID NO: 638139 - RNA, 11 nt, Escherichia coli CFT073
ccauaaaaacg

SEQ ID NO: 638140 - RNA, 19 nt, Escherichia coli CFT073
ccauaaaaaaacccgccga

SEQ ID NO: 638141 - RNA, 24 nt, Escherichia coli CFT073
ccaguuuuuucgcuugaucuuccu

SEQ ID NO: 638142 - RNA, 18 nt, Escherichia coli CFT073
ccaguuuuucuuuuucaa

SEQ ID NO: 638143 - RNA, 23 nt, Escherichia coli CFT073
ccaguugugaugauuuugcgcca

SEQ ID NO: 638144 - RNA, 20 nt, Escherichia coli CFT073
ccaguugugucagugcgcga

SEQ ID NO: 638145 - RNA, 22 nt, Escherichia coli CFT073
ccaguuuucagaaugagguuca

SEQ ID NO: 638146 - RNA, 17 nt, Escherichia coli CFT073
ccaguugcauaauuucu

SEQ ID NO: 638147 - RNA, 18 nt, Escherichia coli CFT073
ccaguugcauacauaaau

SEQ ID NO: 638148 - RNA, 16 nt, Escherichia coli CFT073
ccaguugccgacgcuc

SEQ ID NO: 638149 - RNA, 15 nt, Escherichia coli CFT073
cgcagccaguuaacc

SEQ ID NO: 638150 - RNA, 16 nt, Escherichia coli CFT073
cgcagccagcgcaccu

SEQ ID NO: 638151 - RNA, 15 nt, Escherichia coli CFT073
cgcagccagcacugc

SEQ ID NO: 638152 - RNA, 20 nt, Escherichia coli CFT073
cgcagcauuuccucaacauc

SEQ ID NO: 638153 - RNA, 20 nt, Escherichia coli CFT073
cgcagcagauaaaagaccac

SEQ ID NO: 638154 - RNA, 20 nt, Escherichia coli CFT073
cgcagcacccugaguuuuca

SEQ ID NO: 638155 - RNA, 18 nt, Escherichia coli CFT073
cgcagccgccacaauaaa

SEQ ID NO: 638156 - RNA, 21 nt, Escherichia coli CFT073
cgcagcgcguuacgcccaagc

SEQ ID NO: 638157 - RNA, 21 nt, Escherichia coli CFT073
cgcagcggaggcgauaaugac

SEQ ID NO: 638158 - RNA, 15 nt, Escherichia coli CFT073
cgcagcgcagcgcca

SEQ ID NO: 638159 - RNA, 20 nt, Escherichia coli CFT073
cgcagugucagcaccagaga

SEQ ID NO: 638160 - RNA, 19 nt, Escherichia coli CFT073
cgcagugagaagccaccgc

SEQ ID NO: 638161 - RNA, 22 nt, Escherichia coli CFT073
cgcaguuucuuaccuaccugcu

SEQ ID NO: 638162 - RNA, 16 nt, Escherichia coli CFT073
cgcaguuuuuccuuuu

SEQ ID NO: 638163 - RNA, 21 nt, Escherichia coli CFT073
cgcauaaaacggcgcauugcc

SEQ ID NO: 638164 - RNA, 23 nt, Escherichia coli CFT073
cgcaguaagcuguacacuuccca

SEQ ID NO: 638165 - RNA, 16 nt, Escherichia coli CFT073
cgcaguaccagcaacg

SEQ ID NO: 638166 - RNA, 19 nt, Escherichia coli CFT073
cgcaguaaauccgccacuu

SEQ ID NO: 638167 - RNA, 14 nt, Escherichia coli CFT073
cgcagucgcugacc

SEQ ID NO: 638168 - RNA, 21 nt, Escherichia coli CFT073
cgcagcuuccggccagcaugc

SEQ ID NO: 638169 - RNA, 19 nt, Escherichia coli CFT073
cgcagcugcgcguuaucua

SEQ ID NO: 638170 - RNA, 21 nt, Escherichia coli CFT073
cgcaggugacgcuggcagcag

SEQ ID NO: 638171 - RNA, 19 nt, Escherichia coli CFT073
aaacggugagacgccagaa

SEQ ID NO: 638172 - RNA, 21 nt, Escherichia coli CFT073
aaacgguggccacagcaagca

SEQ ID NO: 638173 - RNA, 19 nt, Escherichia coli CFT073
cgcaccgguaucugccagc

SEQ ID NO: 638174 - RNA, 12 nt, Escherichia coli CFT073
cgcaccggcaag

SEQ ID NO: 638175 - RNA, 22 nt, Escherichia coli CFT073
cgcaccggaaauugcugccgcu

SEQ ID NO: 638176 - RNA, 13 nt, Escherichia coli CFT073
cgcagacaaggcg

SEQ ID NO: 638177 - RNA, 12 nt, Escherichia coli CFT073
cgcacuuacagc

SEQ ID NO: 638178 - RNA, 15 nt, Escherichia coli CFT073
cgcacuuacagcaac

SEQ ID NO: 638179 - RNA, 15 nt, Escherichia coli CFT073
cgcacuggcgcgccu

SEQ ID NO: 638180 - RNA, 16 nt, Escherichia coli CFT073
cgcacuggcgcgccug

SEQ ID NO: 638181 - RNA, 12 nt, Escherichia coli CFT073
cgcagaccaaac

SEQ ID NO: 638182 - RNA, 16 nt, Escherichia coli CFT073
cgcagaccuucugcca

SEQ ID NO: 638183 - RNA, 17 nt, Escherichia coli CFT073
cgcagcaacaucacgcu

SEQ ID NO: 638184 - RNA, 21 nt, Escherichia coli CFT073
cgcagcaaaagcaggcaccgc

SEQ ID NO: 638185 - RNA, 12 nt, Escherichia coli CFT073
cgcaaggcauug

SEQ ID NO: 638186 - RNA, 14 nt, Escherichia coli CFT073
cgcaagccacgggc

SEQ ID NO: 638187 - RNA, 14 nt, Escherichia coli CFT073
cgcaaucagcaccg

SEQ ID NO: 638188 - RNA, 22 nt, Escherichia coli CFT073
cgcaauauuuuauauuacgccu

SEQ ID NO: 638189 - RNA, 16 nt, Escherichia coli CFT073
cgcaaucaaauuugcc

SEQ ID NO: 638190 - RNA, 23 nt, Escherichia coli CFT073
cgcaccaggcgaaaacgcugacc

SEQ ID NO: 638191 - RNA, 13 nt, Escherichia coli CFT073
cgcaccagcuuuc

SEQ ID NO: 638192 - RNA, 17 nt, Escherichia coli CFT073
cgcaccaggcaguuuau

SEQ ID NO: 638193 - RNA, 15 nt, Escherichia coli CFT073
cgcaaucauuuuuuc

SEQ ID NO: 638194 - RNA, 17 nt, Escherichia coli CFT073
cgcaaucauuuuuuccc

SEQ ID NO: 638195 - RNA, 14 nt, Escherichia coli CFT073
cgcaaucugcuucu

SEQ ID NO: 638196 - RNA, 23 nt, Escherichia coli CFT073
cgcaaucugcuucuuaccaccuu

SEQ ID NO: 638197 - RNA, 17 nt, Escherichia coli CFT073
cgcaaugacgucuucca

SEQ ID NO: 638198 - RNA, 22 nt, Escherichia coli CFT073
cgcaaugucuuuuaugguagaa

SEQ ID NO: 638199 - RNA, 12 nt, Escherichia coli CFT073
cgcaaugugcuc

SEQ ID NO: 638200 - RNA, 17 nt, Escherichia coli CFT073
cgauucacauaacggcc

SEQ ID NO: 638201 - RNA, 14 nt, Escherichia coli CFT073
cgauuguuccugcu

SEQ ID NO: 638202 - RNA, 14 nt, Escherichia coli CFT073
cgauuuaucgauuu

SEQ ID NO: 638203 - RNA, 11 nt, Escherichia coli CFT073
cgauuuagaac

SEQ ID NO: 638204 - RNA, 15 nt, Escherichia coli CFT073
cgauucggcaaucac

SEQ ID NO: 638205 - RNA, 20 nt, Escherichia coli CFT073
cgauuauccaugccacagua

SEQ ID NO: 638206 - RNA, 15 nt, Escherichia coli CFT073
cgauuauccgccagc

SEQ ID NO: 638207 - RNA, 16 nt, Escherichia coli CFT073
cgauguuuucugccuc

SEQ ID NO: 638208 - RNA, 21 nt, Escherichia coli CFT073
cgaugcauaauccgccgcugu

SEQ ID NO: 638209 - RNA, 14 nt, Escherichia coli CFT073
cgauguaauucagc

SEQ ID NO: 638210 - RNA, 20 nt, Escherichia coli CFT073
cgaugguugcugucaacuga

SEQ ID NO: 638211 - RNA, 23 nt, Escherichia coli CFT073
cgaugguucaagacgaauaccuu

SEQ ID NO: 638212 - RNA, 18 nt, Escherichia coli CFT073
cgauguagcgauuuacua

SEQ ID NO: 638213 - RNA, 21 nt, Escherichia coli CFT073
cgauggugcuaagccccugag

SEQ ID NO: 638214 - RNA, 13 nt, Escherichia coli CFT073
cgauggugcacga

SEQ ID NO: 638215 - RNA, 22 nt, Escherichia coli CFT073
cgaugcagaaauaaaagccuga

SEQ ID NO: 638216 - RNA, 15 nt, Escherichia coli CFT073
cgaugcagcgcauga

SEQ ID NO: 638217 - RNA, 19 nt, Escherichia coli CFT073
cgaugcacagcucugaaua

SEQ ID NO: 638218 - RNA, 21 nt, Escherichia coli CFT073
cgaugcagcgucugcuguucc

SEQ ID NO: 638219 - RNA, 21 nt, Escherichia coli CFT073
cgaugacuuucaaagagagca

SEQ ID NO: 638220 - RNA, 20 nt, Escherichia coli CFT073
cgaugacagaaucagcagcg

SEQ ID NO: 638221 - RNA, 15 nt, Escherichia coli CFT073
cgaucuuuugucgcu

SEQ ID NO: 638222 - RNA, 23 nt, Escherichia coli CFT073
cgaucuuccgaccgcccuuuuuc

SEQ ID NO: 638223 - RNA, 16 nt, Escherichia coli CFT073
cgaucgggaacaggcu

SEQ ID NO: 638224 - RNA, 17 nt, Escherichia coli CFT073
cgaucgucgcucacuuc

SEQ ID NO: 638225 - RNA, 23 nt, Escherichia coli CFT073
cgaucgugauacaacugccgcgc

SEQ ID NO: 638226 - RNA, 14 nt, Escherichia coli CFT073
cgaucggcaggaaa

SEQ ID NO: 638227 - RNA, 20 nt, Escherichia coli CFT073
cgaucggcguguuucaucuc

SEQ ID NO: 638228 - RNA, 23 nt, Escherichia coli CFT073
cgaucucccgcuuuggcaucuuc

SEQ ID NO: 638229 - RNA, 14 nt, Escherichia coli CFT073
cgaucaucaccugc

SEQ ID NO: 638230 - RNA, 17 nt, Escherichia coli CFT073
cgaucaugauaaauaau

SEQ ID NO: 638231 - RNA, 17 nt, Escherichia coli CFT073
cgauccaccaccgcaaa

SEQ ID NO: 638232 - RNA, 18 nt, Escherichia coli CFT073
cgaucgcccggcaccagc

SEQ ID NO: 638233 - RNA, 11 nt, Escherichia coli CFT073
cgauccgggua

SEQ ID NO: 638234 - RNA, 16 nt, Escherichia coli CFT073
cgauccgacaucccgc

SEQ ID NO: 638235 - RNA, 22 nt, Escherichia coli CFT073
cgaucccaacugaucugccagc

SEQ ID NO: 638236 - RNA, 15 nt, Escherichia coli CFT073
cgauacucugccauc

SEQ ID NO: 638237 - RNA, 23 nt, Escherichia coli CFT073
cgauacucuuuuggcguuguguc

SEQ ID NO: 638238 - RNA, 19 nt, Escherichia coli CFT073
cgauaggccuuaaccgccg

SEQ ID NO: 638239 - RNA, 21 nt, Escherichia coli CFT073
cgauaggggggauugccgcga

SEQ ID NO: 638240 - RNA, 22 nt, Escherichia coli CFT073
cgauaguacauuucuucuuuca

SEQ ID NO: 638241 - RNA, 15 nt, Escherichia coli CFT073
cgauauaaaaaauac

SEQ ID NO: 638242 - RNA, 15 nt, Escherichia coli CFT073
cgauauaaccauggc

SEQ ID NO: 638243 - RNA, 17 nt, Escherichia coli CFT073
cgauauaaauuccacgc

SEQ ID NO: 638244 - RNA, 22 nt, Escherichia coli CFT073
cgauaucaggcaaacagaauua

SEQ ID NO: 638245 - RNA, 22 nt, Escherichia coli CFT073
cgauauccaguucaugacguga

SEQ ID NO: 638246 - RNA, 19 nt, Escherichia coli CFT073
cgauauccugaaacgcggc

SEQ ID NO: 638247 - RNA, 22 nt, Escherichia coli CFT073
cgauaucgccauuaaacaaccc

SEQ ID NO: 638248 - RNA, 13 nt, Escherichia coli CFT073
cgaucaccacaau

SEQ ID NO: 638249 - RNA, 17 nt, Escherichia coli CFT073
cgaucacguaauaaaau

SEQ ID NO: 638250 - RNA, 21 nt, Escherichia coli CFT073
cgauaacggaucggaacgcga

SEQ ID NO: 638251 - RNA, 17 nt, Escherichia coli CFT073
cgauaccuaacgccagc

SEQ ID NO: 638252 - RNA, 22 nt, Escherichia coli CFT073
cgauacgccucgggaaggucag

SEQ ID NO: 638253 - RNA, 20 nt, Escherichia coli CFT073
cgauacuacgucucaauuua

SEQ ID NO: 638254 - RNA, 15 nt, Escherichia coli CFT073
cgauaaucagcgcca

SEQ ID NO: 638255 - RNA, 22 nt, Escherichia coli CFT073
cgauaagguaucgcgaaaaaaa

SEQ ID NO: 638256 - RNA, 23 nt, Escherichia coli CFT073
cgauaagguaucgcgaaaaaaaa

SEQ ID NO: 638257 - RNA, 12 nt, Escherichia coli CFT073
cgauaagggagc

SEQ ID NO: 638258 - RNA, 12 nt, Escherichia coli CFT073
cgccauuuccag

SEQ ID NO: 638259 - RNA, 16 nt, Escherichia coli CFT073
cgccauuggccugaau

SEQ ID NO: 638260 - RNA, 18 nt, Escherichia coli CFT073
cgccauugcagccgcgau

SEQ ID NO: 638261 - RNA, 17 nt, Escherichia coli CFT073
cgcccagaccugcguuc

SEQ ID NO: 638262 - RNA, 22 nt, Escherichia coli CFT073
cgcccacaacagcaucgguauc

SEQ ID NO: 638263 - RNA, 13 nt, Escherichia coli CFT073
cgcccaauauccu

SEQ ID NO: 638264 - RNA, 13 nt, Escherichia coli CFT073
cgcccaacacuuc

SEQ ID NO: 638265 - RNA, 16 nt, Escherichia coli CFT073
cgcccaaccagcaggu

SEQ ID NO: 638266 - RNA, 14 nt, Escherichia coli CFT073
cgccauccggcagc

SEQ ID NO: 638267 - RNA, 15 nt, Escherichia coli CFT073
cgccauccagccggg

SEQ ID NO: 638268 - RNA, 13 nt, Escherichia coli CFT073
cgccauccguaac

SEQ ID NO: 638269 - RNA, 16 nt, Escherichia coli CFT073
cgccauguugccuggg

SEQ ID NO: 638270 - RNA, 13 nt, Escherichia coli CFT073
cgccaucgcggcu

SEQ ID NO: 638271 - RNA, 16 nt, Escherichia coli CFT073
cgccauuaacaguccg

SEQ ID NO: 638272 - RNA, 13 nt, Escherichia coli CFT073
cgccauaucggca

SEQ ID NO: 638273 - RNA, 23 nt, Escherichia coli CFT073
cgccaucaccaguugugaugcca

SEQ ID NO: 638274 - RNA, 15 nt, Escherichia coli CFT073
cgccaucagggccaa

SEQ ID NO: 638275 - RNA, 13 nt, Escherichia coli CFT073
cgcccccgccagc

SEQ ID NO: 638276 - RNA, 15 nt, Escherichia coli CFT073
cgccccgugaugaac

SEQ ID NO: 638277 - RNA, 17 nt, Escherichia coli CFT073
cgccccuucugccgcaa

SEQ ID NO: 638278 - RNA, 15 nt, Escherichia coli CFT073
cgcccgcgcccaggc

SEQ ID NO: 638279 - RNA, 20 nt, Escherichia coli CFT073
cgccccagaauccccacaaa

SEQ ID NO: 638280 - RNA, 17 nt, Escherichia coli CFT073
cgcccauacucaucuuc

SEQ ID NO: 638281 - RNA, 18 nt, Escherichia coli CFT073
cgcccauacucaucuucc

SEQ ID NO: 638282 - RNA, 12 nt, Escherichia coli CFT073
cgcccaucauug

SEQ ID NO: 638283 - RNA, 19 nt, Escherichia coli CFT073
cgcccaucgcgcccgccgc

SEQ ID NO: 638284 - RNA, 18 nt, Escherichia coli CFT073
cgcccaggaaggcugacc

SEQ ID NO: 638285 - RNA, 12 nt, Escherichia coli CFT073
cgcccuuccccc

SEQ ID NO: 638286 - RNA, 23 nt, Escherichia coli CFT073
cgcccuucccccauugccgccuc

SEQ ID NO: 638287 - RNA, 13 nt, Escherichia coli CFT073
cgcccugcuccag

SEQ ID NO: 638288 - RNA, 22 nt, Escherichia coli CFT073
cgcccgucacguuuugcgccgu

SEQ ID NO: 638289 - RNA, 21 nt, Escherichia coli CFT073
cgcccgugacgggugacgcca

SEQ ID NO: 638290 - RNA, 21 nt, Escherichia coli CFT073
cgcccguuuucuccagcgccg

SEQ ID NO: 638291 - RNA, 14 nt, Escherichia coli CFT073
cgccgccacugcaa

SEQ ID NO: 638292 - RNA, 20 nt, Escherichia coli CFT073
cgccgccagaccacugcgcc

SEQ ID NO: 638293 - RNA, 16 nt, Escherichia coli CFT073
cgccgcacccgccaga

SEQ ID NO: 638294 - RNA, 20 nt, Escherichia coli CFT073
cgccgcaaccguaguggcca

SEQ ID NO: 638295 - RNA, 23 nt, Escherichia coli CFT073
cgccgcaacaauaacccccugcc

SEQ ID NO: 638296 - RNA, 19 nt, Escherichia coli CFT073
cgccgauuccaauauuaaa

SEQ ID NO: 638297 - RNA, 14 nt, Escherichia coli CFT073
cgccgauuaauauu

SEQ ID NO: 638298 - RNA, 14 nt, Escherichia coli CFT073
cgccgagagaagcg

SEQ ID NO: 638299 - RNA, 23 nt, Escherichia coli CFT073
cgccaggaaccugugacagcagc

SEQ ID NO: 638300 - RNA, 11 nt, Escherichia coli CFT073
cgccagcucca

SEQ ID NO: 638301 - RNA, 15 nt, Escherichia coli CFT073
cgccagcuccagcgc

SEQ ID NO: 638302 - RNA, 14 nt, Escherichia coli CFT073
cgccagcgugguca

SEQ ID NO: 638303 - RNA, 19 nt, Escherichia coli CFT073
cgccagcgguuguucaccc

SEQ ID NO: 638304 - RNA, 19 nt, Escherichia coli CFT073
cgccagcguuugcggcgcu

SEQ ID NO: 638305 - RNA, 19 nt, Escherichia coli CFT073
cgccagcguugaugcucag

SEQ ID NO: 638306 - RNA, 16 nt, Escherichia coli CFT073
cgccagcgucacuucc

SEQ ID NO: 638307 - RNA, 17 nt, Escherichia coli CFT073
cgccagcgucucuucaa

SEQ ID NO: 638308 - RNA, 20 nt, Escherichia coli CFT073
cgccagcgucucuucaaucc

SEQ ID NO: 638309 - RNA, 13 nt, Escherichia coli CFT073
cgccagcgucuga

SEQ ID NO: 638310 - RNA, 15 nt, Escherichia coli CFT073
cgccagcgucugagc

SEQ ID NO: 638311 - RNA, 11 nt, Escherichia coli CFT073
cgccagcgcca

SEQ ID NO: 638312 - RNA, 22 nt, Escherichia coli CFT073
cgccagcgaauuccaguugauu

SEQ ID NO: 638313 - RNA, 15 nt, Escherichia coli CFT073
cgccagcgcaccuga

SEQ ID NO: 638314 - RNA, 15 nt, Escherichia coli CFT073
cgccagccgccagca

SEQ ID NO: 638315 - RNA, 22 nt, Escherichia coli CFT073
cgccagccugcgcuaccagaaa

SEQ ID NO: 638316 - RNA, 21 nt, Escherichia coli CFT073
cgccagcggggcgaaaucuuc

SEQ ID NO: 638317 - RNA, 12 nt, Escherichia coli CFT073
cgccagcggggc

SEQ ID NO: 638318 - RNA, 23 nt, Escherichia coli CFT073
cgccagcggcguuugcuccugcu

SEQ ID NO: 638319 - RNA, 23 nt, Escherichia coli CFT073
cgccagcgcggcggcaaucauca

SEQ ID NO: 638320 - RNA, 14 nt, Escherichia coli CFT073
cgccagcggcagcu

SEQ ID NO: 638321 - RNA, 18 nt, Escherichia coli CFT073
cgccagcgcgaccgccau

SEQ ID NO: 638322 - RNA, 21 nt, Escherichia coli CFT073
cgccagucccuuucaggucag

SEQ ID NO: 638323 - RNA, 21 nt, Escherichia coli CFT073
cgccagugacgaccuuuucca

SEQ ID NO: 638324 - RNA, 20 nt, Escherichia coli CFT073
cgccagugcuuucagugccu

SEQ ID NO: 638325 - RNA, 18 nt, Escherichia coli CFT073
cgccaguuugcaggccaa

SEQ ID NO: 638326 - RNA, 22 nt, Escherichia coli CFT073
cgccaguuugcaggccaaacag

SEQ ID NO: 638327 - RNA, 15 nt, Escherichia coli CFT073
cgccaguucccccug

SEQ ID NO: 638328 - RNA, 19 nt, Escherichia coli CFT073
cgccauaaacagcaggcag

SEQ ID NO: 638329 - RNA, 23 nt, Escherichia coli CFT073
cgccauaaaccgcaucauguaaa

SEQ ID NO: 638330 - RNA, 16 nt, Escherichia coli CFT073
cgccaguuuguagccg

SEQ ID NO: 638331 - RNA, 15 nt, Escherichia coli CFT073
cgccauaacaaauau

SEQ ID NO: 638332 - RNA, 20 nt, Escherichia coli CFT073
cgccauaaacuucauucagc

SEQ ID NO: 638333 - RNA, 14 nt, Escherichia coli CFT073
cgccauaucaccac

SEQ ID NO: 638334 - RNA, 18 nt, Escherichia coli CFT073
cgccaggucagagagcca

SEQ ID NO: 638335 - RNA, 22 nt, Escherichia coli CFT073
cgccaggucagagagccagccc

SEQ ID NO: 638336 - RNA, 14 nt, Escherichia coli CFT073
cgccaggugcuuuu

SEQ ID NO: 638337 - RNA, 23 nt, Escherichia coli CFT073
cgccagguuuuagaucccacggc

SEQ ID NO: 638338 - RNA, 19 nt, Escherichia coli CFT073
cgccaguaaucagcgcgga

SEQ ID NO: 638339 - RNA, 16 nt, Escherichia coli CFT073
cgccaguaccagcagc

SEQ ID NO: 638340 - RNA, 14 nt, Escherichia coli CFT073
cgccaguaguugcu

SEQ ID NO: 638341 - RNA, 14 nt, Escherichia coli CFT073
cgccagucacugcc

SEQ ID NO: 638342 - RNA, 15 nt, Escherichia coli CFT073
cgccagucacugcca

SEQ ID NO: 638343 - RNA, 19 nt, Escherichia coli CFT073
cgccagguaacgaagaugg

SEQ ID NO: 638344 - RNA, 22 nt, Escherichia coli CFT073
cgccaggcuuuccgucagcggc

SEQ ID NO: 638345 - RNA, 15 nt, Escherichia coli CFT073
cgcauaauaucuuuc

SEQ ID NO: 638346 - RNA, 17 nt, Escherichia coli CFT073
cgcauaagccacaauau

SEQ ID NO: 638347 - RNA, 21 nt, Escherichia coli CFT073
cgcauaaccgguaccugccgg

SEQ ID NO: 638348 - RNA, 16 nt, Escherichia coli CFT073
cgcaguuuaugcagua

SEQ ID NO: 638349 - RNA, 16 nt, Escherichia coli CFT073
cgcauccgacacuggc

SEQ ID NO: 638350 - RNA, 15 nt, Escherichia coli CFT073
cgcauccgacauuug

SEQ ID NO: 638351 - RNA, 17 nt, Escherichia coli CFT073
cgcauaccccaucagcg

SEQ ID NO: 638352 - RNA, 17 nt, Escherichia coli CFT073
cgcauccccuacucucu

SEQ ID NO: 638353 - RNA, 13 nt, Escherichia coli CFT073
cgcauccggcaac

SEQ ID NO: 638354 - RNA, 13 nt, Escherichia coli CFT073
cgcauccggcaau

SEQ ID NO: 638355 - RNA, 18 nt, Escherichia coli CFT073
cgccaccagaaccgccgc

SEQ ID NO: 638356 - RNA, 17 nt, Escherichia coli CFT073
cgccaccacgcccagcg

SEQ ID NO: 638357 - RNA, 12 nt, Escherichia coli CFT073
cgcauccggcca

SEQ ID NO: 638358 - RNA, 19 nt, Escherichia coli CFT073
cgccacuuuaugauccagc

SEQ ID NO: 638359 - RNA, 18 nt, Escherichia coli CFT073
cgccacuggcggaugcgg

SEQ ID NO: 638360 - RNA, 11 nt, Escherichia coli CFT073
cgccacuggca

SEQ ID NO: 638361 - RNA, 22 nt, Escherichia coli CFT073
cgccacuaucgccaucaggcag

SEQ ID NO: 638362 - RNA, 16 nt, Escherichia coli CFT073
cgccacgccaccagcg

SEQ ID NO: 638363 - RNA, 18 nt, Escherichia coli CFT073
cgccaccucuuucaccaa

SEQ ID NO: 638364 - RNA, 13 nt, Escherichia coli CFT073
cgccaccccacac

SEQ ID NO: 638365 - RNA, 18 nt, Escherichia coli CFT073
cgccaccauguugcgcag

SEQ ID NO: 638366 - RNA, 17 nt, Escherichia coli CFT073
cgccagcaaaucagcca

SEQ ID NO: 638367 - RNA, 20 nt, Escherichia coli CFT073
cgccagcacagccagccucc

SEQ ID NO: 638368 - RNA, 11 nt, Escherichia coli CFT073
cgccagcaaua

SEQ ID NO: 638369 - RNA, 20 nt, Escherichia coli CFT073
cgccagcaagagcaaauaaa

SEQ ID NO: 638370 - RNA, 14 nt, Escherichia coli CFT073
cgccagauguuccg

SEQ ID NO: 638371 - RNA, 12 nt, Escherichia coli CFT073
cgccagauccug

SEQ ID NO: 638372 - RNA, 14 nt, Escherichia coli CFT073
cgccagaucaggga

SEQ ID NO: 638373 - RNA, 17 nt, Escherichia coli CFT073
cgccagagagaacugug

SEQ ID NO: 638374 - RNA, 19 nt, Escherichia coli CFT073
cgccagagaucgcacaugu

SEQ ID NO: 638375 - RNA, 17 nt, Escherichia coli CFT073
cgccagacucgccaggc

SEQ ID NO: 638376 - RNA, 17 nt, Escherichia coli CFT073
cgccagaccaauagaaa

SEQ ID NO: 638377 - RNA, 20 nt, Escherichia coli CFT073
cgccagaaaaccuggcgcag

SEQ ID NO: 638378 - RNA, 19 nt, Escherichia coli CFT073
cgccacuuucacgccgcca

SEQ ID NO: 638379 - RNA, 15 nt, Escherichia coli CFT073
cgccagaaaaccugg

SEQ ID NO: 638380 - RNA, 21 nt, Escherichia coli CFT073
cgccagaaaggguguccacgc

SEQ ID NO: 638381 - RNA, 22 nt, Escherichia coli CFT073
cgccagaaaguuuuucaacacc

SEQ ID NO: 638382 - RNA, 13 nt, Escherichia coli CFT073
cgccagaaaucag

SEQ ID NO: 638383 - RNA, 17 nt, Escherichia coli CFT073
cgccagaacacgcuccc

SEQ ID NO: 638384 - RNA, 19 nt, Escherichia coli CFT073
cgccagaacacgcucccag

SEQ ID NO: 638385 - RNA, 11 nt, Escherichia coli CFT073
cgccagcacua

SEQ ID NO: 638386 - RNA, 20 nt, Escherichia coli CFT073
cgccagcagcagcgaauaau

SEQ ID NO: 638387 - RNA, 20 nt, Escherichia coli CFT073
cgccagcagcagcgccaacg

SEQ ID NO: 638388 - RNA, 17 nt, Escherichia coli CFT073
cgccagcagcucacgca

SEQ ID NO: 638389 - RNA, 19 nt, Escherichia coli CFT073
cgccagcaugccgccaagc

SEQ ID NO: 638390 - RNA, 16 nt, Escherichia coli CFT073
cgccagcaucggcaac

SEQ ID NO: 638391 - RNA, 17 nt, Escherichia coli CFT073
cgcuggcucaccacagc

SEQ ID NO: 638392 - RNA, 12 nt, Escherichia coli CFT073
cgcuggcggcug

SEQ ID NO: 638393 - RNA, 22 nt, Escherichia coli CFT073
cgcuggccaugauuaccagcau

SEQ ID NO: 638394 - RNA, 17 nt, Escherichia coli CFT073
cgcugucggugccauca

SEQ ID NO: 638395 - RNA, 19 nt, Escherichia coli CFT073
cgcuguggcagucacuucc

SEQ ID NO: 638396 - RNA, 15 nt, Escherichia coli CFT073
cgcugucauucauuc

SEQ ID NO: 638397 - RNA, 22 nt, Escherichia coli CFT073
cgcuguaauccaccgugccgcu

SEQ ID NO: 638398 - RNA, 17 nt, Escherichia coli CFT073
cgcuguaaugcuauaaa

SEQ ID NO: 638399 - RNA, 18 nt, Escherichia coli CFT073
cgcuguaauuaccagcgc

SEQ ID NO: 638400 - RNA, 18 nt, Escherichia coli CFT073
cgcuguacucaccaacgc

SEQ ID NO: 638401 - RNA, 18 nt, Escherichia coli CFT073
cgcuguaagccgccgcca

SEQ ID NO: 638402 - RNA, 19 nt, Escherichia coli CFT073
cgcuguaagccgccgccau

SEQ ID NO: 638403 - RNA, 15 nt, Escherichia coli CFT073
cgcugguugcgucuu

SEQ ID NO: 638404 - RNA, 15 nt, Escherichia coli CFT073
cgcugguaacaucaa

SEQ ID NO: 638405 - RNA, 20 nt, Escherichia coli CFT073
cgcuucgcuaacauuuuagu

SEQ ID NO: 638406 - RNA, 17 nt, Escherichia coli CFT073
cgcuuccuccaccacuu

SEQ ID NO: 638407 - RNA, 11 nt, Escherichia coli CFT073
cgcuuccaguu

SEQ ID NO: 638408 - RNA, 15 nt, Escherichia coli CFT073
cgcuucauuuacauc

SEQ ID NO: 638409 - RNA, 16 nt, Escherichia coli CFT073
cgcuucuucuuccagg

SEQ ID NO: 638410 - RNA, 16 nt, Escherichia coli CFT073
cgcuucuuucucaauc

SEQ ID NO: 638411 - RNA, 16 nt, Escherichia coli CFT073
cgcuucugucgcuuca

SEQ ID NO: 638412 - RNA, 12 nt, Escherichia coli CFT073
cgcuucuucagc

SEQ ID NO: 638413 - RNA, 17 nt, Escherichia coli CFT073
cgcuucggcggguuuuu

SEQ ID NO: 638414 - RNA, 15 nt, Escherichia coli CFT073
cgcuuccggcagcuu

SEQ ID NO: 638415 - RNA, 18 nt, Escherichia coli CFT073
cgcuucacgcaccauaau

SEQ ID NO: 638416 - RNA, 21 nt, Escherichia coli CFT073
cgcuucaauacgcaucaccuc

SEQ ID NO: 638417 - RNA, 14 nt, Escherichia coli CFT073
cgcuuaucaggccu

SEQ ID NO: 638418 - RNA, 23 nt, Escherichia coli CFT073
cgcuuagcaaagaacguaaucaa

SEQ ID NO: 638419 - RNA, 17 nt, Escherichia coli CFT073
cgcuguugcguaacuga

SEQ ID NO: 638420 - RNA, 23 nt, Escherichia coli CFT073
cgcuguuauugucggcagauacc

SEQ ID NO: 638421 - RNA, 15 nt, Escherichia coli CFT073
cgcuguuaugcacac

SEQ ID NO: 638422 - RNA, 18 nt, Escherichia coli CFT073
cgcuuaaauuuccaccgc

SEQ ID NO: 638423 - RNA, 18 nt, Escherichia coli CFT073
cgcuuaaggucagaaugc

SEQ ID NO: 638424 - RNA, 13 nt, Escherichia coli CFT073
cgcuuaauaagaa

SEQ ID NO: 638425 - RNA, 23 nt, Escherichia coli CFT073
cgcuuaaucaauugcaggaaggu

SEQ ID NO: 638426 - RNA, 22 nt, Escherichia coli CFT073
cgcugcacuuucucgacaucca

SEQ ID NO: 638427 - RNA, 20 nt, Escherichia coli CFT073
cgcugccagucacugugacg

SEQ ID NO: 638428 - RNA, 18 nt, Escherichia coli CFT073
cgcugccccugguuaucu

SEQ ID NO: 638429 - RNA, 13 nt, Escherichia coli CFT073
cgcugcccgccgc

SEQ ID NO: 638430 - RNA, 19 nt, Escherichia coli CFT073
cgcugcauggcaacuuuaa

SEQ ID NO: 638431 - RNA, 18 nt, Escherichia coli CFT073
cgcugccagaucaaacaa

SEQ ID NO: 638432 - RNA, 15 nt, Escherichia coli CFT073
cgcugacucuacuga

SEQ ID NO: 638433 - RNA, 19 nt, Escherichia coli CFT073
cgcugaccguugcucauua

SEQ ID NO: 638434 - RNA, 22 nt, Escherichia coli CFT073
cgcugacgaucauuccgcccag

SEQ ID NO: 638435 - RNA, 17 nt, Escherichia coli CFT073
cgcugauauacccuuca

SEQ ID NO: 638436 - RNA, 19 nt, Escherichia coli CFT073
cgcugauauugcuccagac

SEQ ID NO: 638437 - RNA, 15 nt, Escherichia coli CFT073
cgcugaucaccguag

SEQ ID NO: 638438 - RNA, 21 nt, Escherichia coli CFT073
cgcugaggaucgggcagugcu

SEQ ID NO: 638439 - RNA, 18 nt, Escherichia coli CFT073
cgcugagguuaugcaaac

SEQ ID NO: 638440 - RNA, 17 nt, Escherichia coli CFT073
cgcuggaggcaucugau

SEQ ID NO: 638441 - RNA, 22 nt, Escherichia coli CFT073
cgcuggagaauaaagcuuuaau

SEQ ID NO: 638442 - RNA, 19 nt, Escherichia coli CFT073
cgcugcuguagcaguucca

SEQ ID NO: 638443 - RNA, 11 nt, Escherichia coli CFT073
cgcugcucagg

SEQ ID NO: 638444 - RNA, 20 nt, Escherichia coli CFT073
cgcugcgucuuccacuucau

SEQ ID NO: 638445 - RNA, 21 nt, Escherichia coli CFT073
cgcugcggguugcucucgcca

SEQ ID NO: 638446 - RNA, 22 nt, Escherichia coli CFT073
cgcugcggguugcucucgccag

SEQ ID NO: 638447 - RNA, 23 nt, Escherichia coli CFT073
cgcugcggguugcucucgccagc

SEQ ID NO: 638448 - RNA, 22 nt, Escherichia coli CFT073
cgcugcgaaguuuuuccgccgc

SEQ ID NO: 638449 - RNA, 18 nt, Escherichia coli CFT073
cgcugcgcuugcugccag

SEQ ID NO: 638450 - RNA, 22 nt, Escherichia coli CFT073
cgcugcgcuuacacacccggcc

SEQ ID NO: 638451 - RNA, 16 nt, Escherichia coli CFT073
cgcugcgcuucucagg

SEQ ID NO: 638452 - RNA, 21 nt, Escherichia coli CFT073
cgcguugcauaaagcucagau

SEQ ID NO: 638453 - RNA, 17 nt, Escherichia coli CFT073
cgcguucugucagcacg

SEQ ID NO: 638454 - RNA, 15 nt, Escherichia coli CFT073
cgcguuggcgcagca

SEQ ID NO: 638455 - RNA, 18 nt, Escherichia coli CFT073
cgcguuguugcaggaaca

SEQ ID NO: 638456 - RNA, 23 nt, Escherichia coli CFT073
cgcguuucaccaccacuucuuuc

SEQ ID NO: 638457 - RNA, 19 nt, Escherichia coli CFT073
cgcgugcgccaccgcuucc

SEQ ID NO: 638458 - RNA, 17 nt, Escherichia coli CFT073
cgcgugaguggcgcgcg

SEQ ID NO: 638459 - RNA, 11 nt, Escherichia coli CFT073
cgcguggaaca

SEQ ID NO: 638460 - RNA, 20 nt, Escherichia coli CFT073
cgcgucaucggcgcgguagc

SEQ ID NO: 638461 - RNA, 14 nt, Escherichia coli CFT073
cgcgggcagaugcc

SEQ ID NO: 638462 - RNA, 19 nt, Escherichia coli CFT073
cgcucacaacaauaucaaa

SEQ ID NO: 638463 - RNA, 14 nt, Escherichia coli CFT073
cgcucacaccacaa

SEQ ID NO: 638464 - RNA, 13 nt, Escherichia coli CFT073
cgcucacccauca

SEQ ID NO: 638465 - RNA, 15 nt, Escherichia coli CFT073
cgcuaugugccauug

SEQ ID NO: 638466 - RNA, 21 nt, Escherichia coli CFT073
cgcucagcaacauggcgcggc

SEQ ID NO: 638467 - RNA, 22 nt, Escherichia coli CFT073
cgcuauagacaccuugcaacuc

SEQ ID NO: 638468 - RNA, 19 nt, Escherichia coli CFT073
cgcuaguucucgggcggca

SEQ ID NO: 638469 - RNA, 14 nt, Escherichia coli CFT073
cgcuaucaaacuga

SEQ ID NO: 638470 - RNA, 21 nt, Escherichia coli CFT073
cgcuauaucgcugauaucaaa

SEQ ID NO: 638471 - RNA, 15 nt, Escherichia coli CFT073
cgcuauccagcgcau

SEQ ID NO: 638472 - RNA, 13 nt, Escherichia coli CFT073
cgcuaucagcgcc

SEQ ID NO: 638473 - RNA, 14 nt, Escherichia coli CFT073
cgcuaucagcgcca

SEQ ID NO: 638474 - RNA, 13 nt, Escherichia coli CFT073
cgcuauccagcgc

SEQ ID NO: 638475 - RNA, 20 nt, Escherichia coli CFT073
cgcuaucgccugcgaaucua

SEQ ID NO: 638476 - RNA, 12 nt, Escherichia coli CFT073
cgcuaucggcau

SEQ ID NO: 638477 - RNA, 14 nt, Escherichia coli CFT073
cgcuagauagguca

SEQ ID NO: 638478 - RNA, 19 nt, Escherichia coli CFT073
cgcuacuggcaauccugcu

SEQ ID NO: 638479 - RNA, 19 nt, Escherichia coli CFT073
cgcuccauugcccgcccga

SEQ ID NO: 638480 - RNA, 22 nt, Escherichia coli CFT073
cgcuccaaggucuccgcccagc

SEQ ID NO: 638481 - RNA, 12 nt, Escherichia coli CFT073
cgcucaucaccg

SEQ ID NO: 638482 - RNA, 18 nt, Escherichia coli CFT073
cgcucauaauacaggcua

SEQ ID NO: 638483 - RNA, 14 nt, Escherichia coli CFT073
cgcuccucaucaau

SEQ ID NO: 638484 - RNA, 13 nt, Escherichia coli CFT073
cgcuccggcagca

SEQ ID NO: 638485 - RNA, 16 nt, Escherichia coli CFT073
cgcuccggcagcagca

SEQ ID NO: 638486 - RNA, 13 nt, Escherichia coli CFT073
cgcucccggcaua

SEQ ID NO: 638487 - RNA, 14 nt, Escherichia coli CFT073
cgcucccagcccgg

SEQ ID NO: 638488 - RNA, 16 nt, Escherichia coli CFT073
cgcucgagccgcaucc

SEQ ID NO: 638489 - RNA, 22 nt, Escherichia coli CFT073
cgcucgcuggcguuguccgcca

SEQ ID NO: 638490 - RNA, 23 nt, Escherichia coli CFT073
cgcucgcuggcguuguccgccag

SEQ ID NO: 638491 - RNA, 18 nt, Escherichia coli CFT073
cgcucugcaucccggcag

SEQ ID NO: 638492 - RNA, 16 nt, Escherichia coli CFT073
cgcucucuaucacgaa

SEQ ID NO: 638493 - RNA, 16 nt, Escherichia coli CFT073
cgcucuucaucuucca

SEQ ID NO: 638494 - RNA, 14 nt, Escherichia coli CFT073
cgcugaaaaacgaa

SEQ ID NO: 638495 - RNA, 17 nt, Escherichia coli CFT073
cgcugaacgcaccuucc

SEQ ID NO: 638496 - RNA, 18 nt, Escherichia coli CFT073
cgcugaauaauggugaau

SEQ ID NO: 638497 - RNA, 14 nt, Escherichia coli CFT073
cgcgaaugggugaa

SEQ ID NO: 638498 - RNA, 20 nt, Escherichia coli CFT073
cgcgacacaauccaugccaa

SEQ ID NO: 638499 - RNA, 15 nt, Escherichia coli CFT073
cgcgaccacacucaa

SEQ ID NO: 638500 - RNA, 18 nt, Escherichia coli CFT073
cgcgaccacuggguuaac

SEQ ID NO: 638501 - RNA, 14 nt, Escherichia coli CFT073
cgccuuccagcagc

SEQ ID NO: 638502 - RNA, 18 nt, Escherichia coli CFT073
cgccuucagguuuuucag

SEQ ID NO: 638503 - RNA, 16 nt, Escherichia coli CFT073
cgccuucacgguuauu

SEQ ID NO: 638504 - RNA, 16 nt, Escherichia coli CFT073
cgcgaaccagaccagc

SEQ ID NO: 638505 - RNA, 12 nt, Escherichia coli CFT073
cgcgaaccgccu

SEQ ID NO: 638506 - RNA, 21 nt, Escherichia coli CFT073
cgcgaaccgccuggcgcugcu

SEQ ID NO: 638507 - RNA, 21 nt, Escherichia coli CFT073
cgcgaacuaaacaacgccgcc

SEQ ID NO: 638508 - RNA, 21 nt, Escherichia coli CFT073
cgcgaauucauguucgguaaa

SEQ ID NO: 638509 - RNA, 22 nt, Escherichia coli CFT073
cgccucuaacagaucauccauc

SEQ ID NO: 638510 - RNA, 14 nt, Escherichia coli CFT073
cgccucuuccaggc

SEQ ID NO: 638511 - RNA, 16 nt, Escherichia coli CFT073
cgccugaacaccagaa

SEQ ID NO: 638512 - RNA, 15 nt, Escherichia coli CFT073
cgccugaucgcgcag

SEQ ID NO: 638513 - RNA, 14 nt, Escherichia coli CFT073
cgccugcaucucuu

SEQ ID NO: 638514 - RNA, 16 nt, Escherichia coli CFT073
cgccugcgccaccaca

SEQ ID NO: 638515 - RNA, 17 nt, Escherichia coli CFT073
cgccugggggggaaacc

SEQ ID NO: 638516 - RNA, 18 nt, Escherichia coli CFT073
cgccuggcgugcccccgu

SEQ ID NO: 638517 - RNA, 15 nt, Escherichia coli CFT073
cgccuggcgcugcuc

SEQ ID NO: 638518 - RNA, 21 nt, Escherichia coli CFT073
cgccgccgagauuugccagau

SEQ ID NO: 638519 - RNA, 17 nt, Escherichia coli CFT073
cgccgguuccugcaucg

SEQ ID NO: 638520 - RNA, 15 nt, Escherichia coli CFT073
cgccgucaucacgca

SEQ ID NO: 638521 - RNA, 13 nt, Escherichia coli CFT073
cgccuaccaccag

SEQ ID NO: 638522 - RNA, 20 nt, Escherichia coli CFT073
cgccucaacgccuaaugcca

SEQ ID NO: 638523 - RNA, 19 nt, Escherichia coli CFT073
cgccucaagaaucacuuca

SEQ ID NO: 638524 - RNA, 16 nt, Escherichia coli CFT073
cgccuaaacugaucga

SEQ ID NO: 638525 - RNA, 14 nt, Escherichia coli CFT073
cgccguucccagcg

SEQ ID NO: 638526 - RNA, 18 nt, Escherichia coli CFT073
cgccucaucaucgcgcgu

SEQ ID NO: 638527 - RNA, 13 nt, Escherichia coli CFT073
cgccucagccaga

SEQ ID NO: 638528 - RNA, 22 nt, Escherichia coli CFT073
cgccucaagcucgcagagauca

SEQ ID NO: 638529 - RNA, 15 nt, Escherichia coli CFT073
cgcgcucaccgcucu

SEQ ID NO: 638530 - RNA, 16 nt, Escherichia coli CFT073
cgcgcucaccgcucuu

SEQ ID NO: 638531 - RNA, 19 nt, Escherichia coli CFT073
cgcgcuaccaaccagauua

SEQ ID NO: 638532 - RNA, 18 nt, Escherichia coli CFT073
cgcgcgggucacugcggu

SEQ ID NO: 638533 - RNA, 13 nt, Escherichia coli CFT073
cgcgcgucacgau

SEQ ID NO: 638534 - RNA, 17 nt, Escherichia coli CFT073
cgcgcgugccggaacgc

SEQ ID NO: 638535 - RNA, 22 nt, Escherichia coli CFT073
cgcgcgugccggaacgccgcug

SEQ ID NO: 638536 - RNA, 22 nt, Escherichia coli CFT073
cgcgcugccagaaccgcuucuu

SEQ ID NO: 638537 - RNA, 24 nt, Escherichia coli CFT073
cgcgcucguagguuucugccagcg

SEQ ID NO: 638538 - RNA, 23 nt, Escherichia coli CFT073
cgcgcucuucuucacgauaaauc

SEQ ID NO: 638539 - RNA, 18 nt, Escherichia coli CFT073
cgcgcuuucuucgcagca

SEQ ID NO: 638540 - RNA, 18 nt, Escherichia coli CFT073
cgcggaauuggccgcgca

SEQ ID NO: 638541 - RNA, 12 nt, Escherichia coli CFT073
cgcgcuuuuucg

SEQ ID NO: 638542 - RNA, 21 nt, Escherichia coli CFT073
cgcggaacaagucggcgugca

SEQ ID NO: 638543 - RNA, 12 nt, Escherichia coli CFT073
cgcgcuggcauc

SEQ ID NO: 638544 - RNA, 17 nt, Escherichia coli CFT073
cgcggauuucggcggcu

SEQ ID NO: 638545 - RNA, 22 nt, Escherichia coli CFT073
cgcggcaaaacccugcgccagc

SEQ ID NO: 638546 - RNA, 23 nt, Escherichia coli CFT073
cgcggauggccucugccagcugc

SEQ ID NO: 638547 - RNA, 23 nt, Escherichia coli CFT073
cgcggcgauaauacccagcaacg

SEQ ID NO: 638548 - RNA, 20 nt, Escherichia coli CFT073
cgcggcguuaccggcaaugu

SEQ ID NO: 638549 - RNA, 20 nt, Escherichia coli CFT073
cgcggcucaggcgcacgcca

SEQ ID NO: 638550 - RNA, 16 nt, Escherichia coli CFT073
cgcgggcaaucgccag

SEQ ID NO: 638551 - RNA, 16 nt, Escherichia coli CFT073
cgcggcgcagcuccag

SEQ ID NO: 638552 - RNA, 18 nt, Escherichia coli CFT073
cgcgagcuuaacugccau

SEQ ID NO: 638553 - RNA, 21 nt, Escherichia coli CFT073
cgcgagcgccuuauccggccu

SEQ ID NO: 638554 - RNA, 14 nt, Escherichia coli CFT073
cgcgaggccagcgg

SEQ ID NO: 638555 - RNA, 22 nt, Escherichia coli CFT073
cgcgcaacgucgcgccugucac

SEQ ID NO: 638556 - RNA, 15 nt, Escherichia coli CFT073
cgcgagguuuuccuu

SEQ ID NO: 638557 - RNA, 19 nt, Escherichia coli CFT073
cgcgcaccaaugacggcca

SEQ ID NO: 638558 - RNA, 18 nt, Escherichia coli CFT073
cgcgcaaucagcaccgcg

SEQ ID NO: 638559 - RNA, 21 nt, Escherichia coli CFT073
cgcgcaaucagcaccgcgcgu

SEQ ID NO: 638560 - RNA, 21 nt, Escherichia coli CFT073
cgcgcaaucguaugaucaucc

SEQ ID NO: 638561 - RNA, 18 nt, Escherichia coli CFT073
cgcgcaguuucuuaccua

SEQ ID NO: 638562 - RNA, 13 nt, Escherichia coli CFT073
cgcgccagcagcg

SEQ ID NO: 638563 - RNA, 14 nt, Escherichia coli CFT073
cgcgccagagcugg

SEQ ID NO: 638564 - RNA, 15 nt, Escherichia coli CFT073
cgcgccagcuaccag

SEQ ID NO: 638565 - RNA, 20 nt, Escherichia coli CFT073
cgcgccagcuaccagaauug

SEQ ID NO: 638566 - RNA, 23 nt, Escherichia coli CFT073
cgcgccaguaaucagcgcggaac

SEQ ID NO: 638567 - RNA, 23 nt, Escherichia coli CFT073
cgcgccgaagcugaccagacagu

SEQ ID NO: 638568 - RNA, 23 nt, Escherichia coli CFT073
cgcgccgcagccggaaaaccauc

SEQ ID NO: 638569 - RNA, 23 nt, Escherichia coli CFT073
cgcgccuguugcgguuucucccg

SEQ ID NO: 638570 - RNA, 22 nt, Escherichia coli CFT073
cgcgccuguuuuuuuaaugcgc

SEQ ID NO: 638571 - RNA, 13 nt, Escherichia coli CFT073
cgcgccugccagg

SEQ ID NO: 638572 - RNA, 18 nt, Escherichia coli CFT073
cggcgaucuuuuaauaau

SEQ ID NO: 638573 - RNA, 15 nt, Escherichia coli CFT073
cggcgagugugugga

SEQ ID NO: 638574 - RNA, 17 nt, Escherichia coli CFT073
cggcgauaguacauuuc

SEQ ID NO: 638575 - RNA, 20 nt, Escherichia coli CFT073
cggcgaguauucuugcugau

SEQ ID NO: 638576 - RNA, 19 nt, Escherichia coli CFT073
cggcgcauagccuccggcc

SEQ ID NO: 638577 - RNA, 16 nt, Escherichia coli CFT073
cggcgcaugcaggcau

SEQ ID NO: 638578 - RNA, 18 nt, Escherichia coli CFT073
cggcgcgaguuugccgcu

SEQ ID NO: 638579 - RNA, 23 nt, Escherichia coli CFT073
cggcgcgauauccaguucaugac

SEQ ID NO: 638580 - RNA, 18 nt, Escherichia coli CFT073
cggccccaucgaaccauc

SEQ ID NO: 638581 - RNA, 15 nt, Escherichia coli CFT073
cggccauugaauauu

SEQ ID NO: 638582 - RNA, 17 nt, Escherichia coli CFT073
cggccauugcccgagga

SEQ ID NO: 638583 - RNA, 19 nt, Escherichia coli CFT073
cggcgaaaaucauuuaucu

SEQ ID NO: 638584 - RNA, 15 nt, Escherichia coli CFT073
cggcgaccaguucgc

SEQ ID NO: 638585 - RNA, 14 nt, Escherichia coli CFT073
cggcgacaggaacc

SEQ ID NO: 638586 - RNA, 15 nt, Escherichia coli CFT073
cggcgacaggaacca

SEQ ID NO: 638587 - RNA, 22 nt, Escherichia coli CFT073
cggcgagaucuucgccaucccg

SEQ ID NO: 638588 - RNA, 15 nt, Escherichia coli CFT073
cggcgagaacgccuu

SEQ ID NO: 638589 - RNA, 12 nt, Escherichia coli CFT073
cggcgacuuccu

SEQ ID NO: 638590 - RNA, 16 nt, Escherichia coli CFT073
cggcaugaaagcgaug

SEQ ID NO: 638591 - RNA, 18 nt, Escherichia coli CFT073
cggcaucuucuccacgcc

SEQ ID NO: 638592 - RNA, 22 nt, Escherichia coli CFT073
cggcaucuuaucuaacaaucuu

SEQ ID NO: 638593 - RNA, 21 nt, Escherichia coli CFT073
cggcaucgcgguugcugucgg

SEQ ID NO: 638594 - RNA, 22 nt, Escherichia coli CFT073
cggcaucgccagcgcggcggca

SEQ ID NO: 638595 - RNA, 13 nt, Escherichia coli CFT073
cggcaucaaccag

SEQ ID NO: 638596 - RNA, 22 nt, Escherichia coli CFT073
cggcauacuuugauuaaccguu

SEQ ID NO: 638597 - RNA, 23 nt, Escherichia coli CFT073
cggcauagccaccuggcugcguu

SEQ ID NO: 638598 - RNA, 23 nt, Escherichia coli CFT073
cggcaucccgguauaacuugcca

SEQ ID NO: 638599 - RNA, 20 nt, Escherichia coli CFT073
cggcaugguauaaggagcaa

SEQ ID NO: 638600 - RNA, 12 nt, Escherichia coli CFT073
cggccaucccag

SEQ ID NO: 638601 - RNA, 20 nt, Escherichia coli CFT073
cggccaugauaaacggcacu

SEQ ID NO: 638602 - RNA, 22 nt, Escherichia coli CFT073
cggccaguguuuaucaucucgg

SEQ ID NO: 638603 - RNA, 17 nt, Escherichia coli CFT073
cggccaguugcgcaacg

SEQ ID NO: 638604 - RNA, 14 nt, Escherichia coli CFT073
cggccagcgggcgu

SEQ ID NO: 638605 - RNA, 14 nt, Escherichia coli CFT073
cggcagaaaaucca

SEQ ID NO: 638606 - RNA, 13 nt, Escherichia coli CFT073
cggcagaacggug

SEQ ID NO: 638607 - RNA, 15 nt, Escherichia coli CFT073
cggcagaaugguaac

SEQ ID NO: 638608 - RNA, 18 nt, Escherichia coli CFT073
cggcacggaaagcagcau

SEQ ID NO: 638609 - RNA, 23 nt, Escherichia coli CFT073
cggcacggcguuuaguggguccc

SEQ ID NO: 638610 - RNA, 18 nt, Escherichia coli CFT073
cggcagagaaaccacauc

SEQ ID NO: 638611 - RNA, 20 nt, Escherichia coli CFT073
cggcagagaaaccacaucaa

SEQ ID NO: 638612 - RNA, 11 nt, Escherichia coli CFT073
cggcagaccau

SEQ ID NO: 638613 - RNA, 18 nt, Escherichia coli CFT073
cggcagccugcgucgcca

SEQ ID NO: 638614 - RNA, 20 nt, Escherichia coli CFT073
cggcagagaggacucugccg

SEQ ID NO: 638615 - RNA, 22 nt, Escherichia coli CFT073
cggcagccaggauuguaaguga

SEQ ID NO: 638616 - RNA, 15 nt, Escherichia coli CFT073
cggcagauccaccag

SEQ ID NO: 638617 - RNA, 14 nt, Escherichia coli CFT073
cgcuugccgcgucu

SEQ ID NO: 638618 - RNA, 19 nt, Escherichia coli CFT073
cgcuugccugugccacggc

SEQ ID NO: 638619 - RNA, 18 nt, Escherichia coli CFT073
cgcuugcguaucgggcgc

SEQ ID NO: 638620 - RNA, 19 nt, Escherichia coli CFT073
cggcacgcguugcgcauga

SEQ ID NO: 638621 - RNA, 18 nt, Escherichia coli CFT073
cggcagcuuuaccggcuu

SEQ ID NO: 638622 - RNA, 15 nt, Escherichia coli CFT073
cggcagcucuuucuc

SEQ ID NO: 638623 - RNA, 21 nt, Escherichia coli CFT073
cggcagcucuuucucgcucag

SEQ ID NO: 638624 - RNA, 21 nt, Escherichia coli CFT073
cggcagcgugccaggcgcgcu

SEQ ID NO: 638625 - RNA, 14 nt, Escherichia coli CFT073
cggcagcuccagca

SEQ ID NO: 638626 - RNA, 15 nt, Escherichia coli CFT073
cggcagcggcuucau

SEQ ID NO: 638627 - RNA, 13 nt, Escherichia coli CFT073
cggcagcgcgcuc

SEQ ID NO: 638628 - RNA, 18 nt, Escherichia coli CFT073
cggcaguauagcggcaug

SEQ ID NO: 638629 - RNA, 12 nt, Escherichia coli CFT073
cggcagugaaaa

SEQ ID NO: 638630 - RNA, 18 nt, Escherichia coli CFT073
cggcagugcuuucauuuc

SEQ ID NO: 638631 - RNA, 21 nt, Escherichia coli CFT073
cggcaguggcuaagcaggcug

SEQ ID NO: 638632 - RNA, 16 nt, Escherichia coli CFT073
cggcaguuugagauug

SEQ ID NO: 638633 - RNA, 15 nt, Escherichia coli CFT073
cggcauaaacaaagc

SEQ ID NO: 638634 - RNA, 18 nt, Escherichia coli CFT073
cggcauaaagcugcggau

SEQ ID NO: 638635 - RNA, 20 nt, Escherichia coli CFT073
cggcauaauaagcccggccu

SEQ ID NO: 638636 - RNA, 14 nt, Escherichia coli CFT073
cggcauacccauau

SEQ ID NO: 638637 - RNA, 21 nt, Escherichia coli CFT073
cggcggaauuaaccgcccacc

SEQ ID NO: 638638 - RNA, 22 nt, Escherichia coli CFT073
cggcggaauuaaccgcccaccg

SEQ ID NO: 638639 - RNA, 13 nt, Escherichia coli CFT073
cggcgcugaccac

SEQ ID NO: 638640 - RNA, 18 nt, Escherichia coli CFT073
cggcggcgcaaccaucag

SEQ ID NO: 638641 - RNA, 20 nt, Escherichia coli CFT073
cggcggcgaucgccugcugg

SEQ ID NO: 638642 - RNA, 18 nt, Escherichia coli CFT073
cggcggugacuagcagca

SEQ ID NO: 638643 - RNA, 21 nt, Escherichia coli CFT073
cggcggugagaagaccgccgc

SEQ ID NO: 638644 - RNA, 17 nt, Escherichia coli CFT073
cggcgguugacgccccu

SEQ ID NO: 638645 - RNA, 14 nt, Escherichia coli CFT073
cggcgguaaaaggg

SEQ ID NO: 638646 - RNA, 16 nt, Escherichia coli CFT073
cggcgguaaaaucauc

SEQ ID NO: 638647 - RNA, 13 nt, Escherichia coli CFT073
uuuuuuauuugau

SEQ ID NO: 638648 - RNA, 14 nt, Escherichia coli CFT073
uuuuuuauuuguuu

SEQ ID NO: 638649 - RNA, 23 nt, Escherichia coli CFT073
uuuuucgacuuccaccagcggcu

SEQ ID NO: 638650 - RNA, 14 nt, Escherichia coli CFT073
uuuuucgauaauca

SEQ ID NO: 638651 - RNA, 15 nt, Escherichia coli CFT073
uuuuuccgcacauac

SEQ ID NO: 638652 - RNA, 15 nt, Escherichia coli CFT073
uuuuucuccuacacc

SEQ ID NO: 638653 - RNA, 17 nt, Escherichia coli CFT073
uuuuuccacuccgcuua

SEQ ID NO: 638654 - RNA, 16 nt, Escherichia coli CFT073
uuuuucccucuucaau

SEQ ID NO: 638655 - RNA, 22 nt, Escherichia coli CFT073
uuuuugccccagaauuuucccu

SEQ ID NO: 638656 - RNA, 18 nt, Escherichia coli CFT073
uuuuugcgcccaugauga

SEQ ID NO: 638657 - RNA, 16 nt, Escherichia coli CFT073
uuuuugcgcgaagaaa

SEQ ID NO: 638658 - RNA, 14 nt, Escherichia coli CFT073
uuuuugcuccgaag

SEQ ID NO: 638659 - RNA, 18 nt, Escherichia coli CFT073
uuuuuggguuaauucggc

SEQ ID NO: 638660 - RNA, 12 nt, Escherichia coli CFT073
uuuuugaacaga

SEQ ID NO: 638661 - RNA, 12 nt, Escherichia coli CFT073
uuuuucuucagu

SEQ ID NO: 638662 - RNA, 14 nt, Escherichia coli CFT073
uuuuaggauaaauc

SEQ ID NO: 638663 - RNA, 23 nt, Escherichia coli CFT073
uuuuauacaagggaaauaagaaa

SEQ ID NO: 638664 - RNA, 24 nt, Escherichia coli CFT073
uuuuaucguugugguuaaacguga

SEQ ID NO: 638665 - RNA, 13 nt, Escherichia coli CFT073
uuuuaugcaccuu

SEQ ID NO: 638666 - RNA, 22 nt, Escherichia coli CFT073
uuuuaucacuuguaguuacauu

SEQ ID NO: 638667 - RNA, 18 nt, Escherichia coli CFT073
uuuuaucccggcaaaaaa

SEQ ID NO: 638668 - RNA, 18 nt, Escherichia coli CFT073
uuuuauccucuucaagcu

SEQ ID NO: 638669 - RNA, 12 nt, Escherichia coli CFT073
uuuuacaucauc

SEQ ID NO: 638670 - RNA, 12 nt, Escherichia coli CFT073
uuuuacccaacu

SEQ ID NO: 638671 - RNA, 19 nt, Escherichia coli CFT073
uuuuacccacuaacugauc

SEQ ID NO: 638672 - RNA, 23 nt, Escherichia coli CFT073
uuuuacccacuaacugaucacgu

SEQ ID NO: 638673 - RNA, 20 nt, Escherichia coli CFT073
uuuuacccagcagcagcggu

SEQ ID NO: 638674 - RNA, 17 nt, Escherichia coli CFT073
uuuuaccaccgcaaaac

SEQ ID NO: 638675 - RNA, 14 nt, Escherichia coli CFT073
uuuuaccauauaaa

SEQ ID NO: 638676 - RNA, 20 nt, Escherichia coli CFT073
uuuuaauacaaucuggauau

SEQ ID NO: 638677 - RNA, 15 nt, Escherichia coli CFT073
uuuuaauauuucauu

SEQ ID NO: 638678 - RNA, 19 nt, Escherichia coli CFT073
uuuuaaucuauauauguuu

SEQ ID NO: 638679 - RNA, 20 nt, Escherichia coli CFT073
uuuuacugguugauuuuaaa

SEQ ID NO: 638680 - RNA, 14 nt, Escherichia coli CFT073
uuuuagauuguuuu

SEQ ID NO: 638681 - RNA, 17 nt, Escherichia coli CFT073
uuuuagauuguuuucaa

SEQ ID NO: 638682 - RNA, 18 nt, Escherichia coli CFT073
uuuuaugcuucagccaga

SEQ ID NO: 638683 - RNA, 17 nt, Escherichia coli CFT073
uuuuauggagaaaacau

SEQ ID NO: 638684 - RNA, 23 nt, Escherichia coli CFT073
uuuuauggaucuuugacugaaau

SEQ ID NO: 638685 - RNA, 20 nt, Escherichia coli CFT073
uuuuauuuagauaaacggaa

SEQ ID NO: 638686 - RNA, 16 nt, Escherichia coli CFT073
uuuuauugcauuaaaa

SEQ ID NO: 638687 - RNA, 19 nt, Escherichia coli CFT073
uuuuauugcugcaccagca

SEQ ID NO: 638688 - RNA, 18 nt, Escherichia coli CFT073
uuuucacaguaauuuccu

SEQ ID NO: 638689 - RNA, 20 nt, Escherichia coli CFT073
uuuuccaggggcuggugccu

SEQ ID NO: 638690 - RNA, 18 nt, Escherichia coli CFT073
uuuuccaguucuagugcu

SEQ ID NO: 638691 - RNA, 22 nt, Escherichia coli CFT073
uuuuccagcgcgcuaugcaaca

SEQ ID NO: 638692 - RNA, 13 nt, Escherichia coli CFT073
uuuucaaugcaua

SEQ ID NO: 638693 - RNA, 16 nt, Escherichia coli CFT073
uuuucaaugcauauca

SEQ ID NO: 638694 - RNA, 13 nt, Escherichia coli CFT073
uuuucguuuuaau

SEQ ID NO: 638695 - RNA, 15 nt, Escherichia coli CFT073
uuuucccgauauaac

SEQ ID NO: 638696 - RNA, 23 nt, Escherichia coli CFT073
uuuuccgagaaucgacaccaguu

SEQ ID NO: 638697 - RNA, 21 nt, Escherichia coli CFT073
uuuugaaggaauuaaucccuu

SEQ ID NO: 638698 - RNA, 15 nt, Escherichia coli CFT073
uuuugaacuuuuucu

SEQ ID NO: 638699 - RNA, 16 nt, Escherichia coli CFT073
uuuugaaauaaaauca

SEQ ID NO: 638700 - RNA, 13 nt, Escherichia coli CFT073
uuuucuucaauga

SEQ ID NO: 638701 - RNA, 18 nt, Escherichia coli CFT073
uuuucuuccggcagcaaa

SEQ ID NO: 638702 - RNA, 23 nt, Escherichia coli CFT073
uuuguauucaguucaucuacuac

SEQ ID NO: 638703 - RNA, 16 nt, Escherichia coli CFT073
uuuguaugguuuugua

SEQ ID NO: 638704 - RNA, 23 nt, Escherichia coli CFT073
uuuguagcagaaaagaaccaaug

SEQ ID NO: 638705 - RNA, 15 nt, Escherichia coli CFT073
uuuguaggccugaua

SEQ ID NO: 638706 - RNA, 13 nt, Escherichia coli CFT073
uuuguaaucaaca

SEQ ID NO: 638707 - RNA, 16 nt, Escherichia coli CFT073
uuugggcggcuuuuug

SEQ ID NO: 638708 - RNA, 11 nt, Escherichia coli CFT073
uuuggcaucuu

SEQ ID NO: 638709 - RNA, 17 nt, Escherichia coli CFT073
uuuggcgaaauauagaa

SEQ ID NO: 638710 - RNA, 19 nt, Escherichia coli CFT073
uuuggcggccuucuuccag

SEQ ID NO: 638711 - RNA, 14 nt, Escherichia coli CFT073
uuugguuucacuaa

SEQ ID NO: 638712 - RNA, 22 nt, Escherichia coli CFT073
uuugguuauccagcaaccaggu

SEQ ID NO: 638713 - RNA, 23 nt, Escherichia coli CFT073
uuugguuaacugaauauuccagu

SEQ ID NO: 638714 - RNA, 12 nt, Escherichia coli CFT073
uuuggcaccuuc

SEQ ID NO: 638715 - RNA, 20 nt, Escherichia coli CFT073
uuuggcaggcaaccauauuu

SEQ ID NO: 638716 - RNA, 17 nt, Escherichia coli CFT073
uuuggauggaaaauuuu

SEQ ID NO: 638717 - RNA, 22 nt, Escherichia coli CFT073
uuuggauggaaaauuuuuucag

SEQ ID NO: 638718 - RNA, 21 nt, Escherichia coli CFT073
uuuggagagcggcguuuugua

SEQ ID NO: 638719 - RNA, 13 nt, Escherichia coli CFT073
uuuggacuguugu

SEQ ID NO: 638720 - RNA, 16 nt, Escherichia coli CFT073
uuugcuguuccagcau

SEQ ID NO: 638721 - RNA, 14 nt, Escherichia coli CFT073
uuugcuuauaacca

SEQ ID NO: 638722 - RNA, 20 nt, Escherichia coli CFT073
uuugcgcuccaucagauuca

SEQ ID NO: 638723 - RNA, 14 nt, Escherichia coli CFT073
uuugcgcucgcuga

SEQ ID NO: 638724 - RNA, 18 nt, Escherichia coli CFT073
uuugcggcgcuucuuuag

SEQ ID NO: 638725 - RNA, 22 nt, Escherichia coli CFT073
uuugcguagucugaccucuucu

SEQ ID NO: 638726 - RNA, 18 nt, Escherichia coli CFT073
uuugcucggcaaucucuu

SEQ ID NO: 638727 - RNA, 22 nt, Escherichia coli CFT073
uuugcucggcaaucucuuccag

SEQ ID NO: 638728 - RNA, 23 nt, Escherichia coli CFT073
uuugcugaauuggguucuuuccu

SEQ ID NO: 638729 - RNA, 20 nt, Escherichia coli CFT073
uuugcucgcgacguaauuua

SEQ ID NO: 638730 - RNA, 17 nt, Escherichia coli CFT073
uuugcuccgccagugac

SEQ ID NO: 638731 - RNA, 22 nt, Escherichia coli CFT073
uuugcuggcaaaguagagcgaa

SEQ ID NO: 638732 - RNA, 16 nt, Escherichia coli CFT073
uuugcugguggcauuu

SEQ ID NO: 638733 - RNA, 20 nt, Escherichia coli CFT073
uuugcugguggcauuuuuau

SEQ ID NO: 638734 - RNA, 15 nt, Escherichia coli CFT073
uuugcugucaauuga

SEQ ID NO: 638735 - RNA, 21 nt, Escherichia coli CFT073
uuuguuuuguccgauuucgcu

SEQ ID NO: 638736 - RNA, 20 nt, Escherichia coli CFT073
uuuguuucuuauucagaauc

SEQ ID NO: 638737 - RNA, 19 nt, Escherichia coli CFT073
uuuguugugggcaggaaaa

SEQ ID NO: 638738 - RNA, 23 nt, Escherichia coli CFT073
uuuguugugggcaggaaaaucag

SEQ ID NO: 638739 - RNA, 16 nt, Escherichia coli CFT073
uuuguuucacacugac

SEQ ID NO: 638740 - RNA, 20 nt, Escherichia coli CFT073
uuuguugagauaauuuauaa

SEQ ID NO: 638741 - RNA, 13 nt, Escherichia coli CFT073
uuuguucucuucu

SEQ ID NO: 638742 - RNA, 22 nt, Escherichia coli CFT073
uuuguuaacaauauuaacaaca

SEQ ID NO: 638743 - RNA, 21 nt, Escherichia coli CFT073
uuugugaagaauaaauuuggg

SEQ ID NO: 638744 - RNA, 12 nt, Escherichia coli CFT073
uuugugaugucu

SEQ ID NO: 638745 - RNA, 22 nt, Escherichia coli CFT073
uuuguggcccuugcgcaaugag

SEQ ID NO: 638746 - RNA, 20 nt, Escherichia coli CFT073
uuugugccagagcacugcau

SEQ ID NO: 638747 - RNA, 18 nt, Escherichia coli CFT073
uuugucauaugcaaugca

SEQ ID NO: 638748 - RNA, 19 nt, Escherichia coli CFT073
uuugucauaugcaaugcau

SEQ ID NO: 638749 - RNA, 21 nt, Escherichia coli CFT073
uuugucauuccuuaugcugcu

SEQ ID NO: 638750 - RNA, 19 nt, Escherichia coli CFT073
uuuguccagugcaacuuua

SEQ ID NO: 638751 - RNA, 23 nt, Escherichia coli CFT073
uuuguccagugcaacuuuacuaa

SEQ ID NO: 638752 - RNA, 21 nt, Escherichia coli CFT073
uuugucgaugggggaggucaa

SEQ ID NO: 638753 - RNA, 22 nt, Escherichia coli CFT073
uuuuaaaaacagaguagaaaua

SEQ ID NO: 638754 - RNA, 13 nt, Escherichia coli CFT073
uuuuaaauauugu

SEQ ID NO: 638755 - RNA, 13 nt, Escherichia coli CFT073
uuuuaaacaucag

SEQ ID NO: 638756 - RNA, 23 nt, Escherichia coli CFT073
uuuuaagauccaguugaccugcg

SEQ ID NO: 638757 - RNA, 16 nt, Escherichia coli CFT073
uucuacacccagcccc

SEQ ID NO: 638758 - RNA, 20 nt, Escherichia coli CFT073
uucuaauuuuuccagcauuu

SEQ ID NO: 638759 - RNA, 17 nt, Escherichia coli CFT073
uucuaccuuauccagca

SEQ ID NO: 638760 - RNA, 21 nt, Escherichia coli CFT073
uucuaccauccgcugaaaaac

SEQ ID NO: 638761 - RNA, 17 nt, Escherichia coli CFT073
uucuacgccaucaguuu

SEQ ID NO: 638762 - RNA, 20 nt, Escherichia coli CFT073
uucuacgccaucaguuucag

SEQ ID NO: 638763 - RNA, 21 nt, Escherichia coli CFT073
uucuauugcaggggcuuauau

SEQ ID NO: 638764 - RNA, 15 nt, Escherichia coli CFT073
uucguugaagucagg

SEQ ID NO: 638765 - RNA, 17 nt, Escherichia coli CFT073
uucguugauaauaaagc

SEQ ID NO: 638766 - RNA, 11 nt, Escherichia coli CFT073
uucguugauca

SEQ ID NO: 638767 - RNA, 14 nt, Escherichia coli CFT073
uucguagcguuuuu

SEQ ID NO: 638768 - RNA, 23 nt, Escherichia coli CFT073
uucggugauauacgccacuucau

SEQ ID NO: 638769 - RNA, 23 nt, Escherichia coli CFT073
uucgguccgacgugcucgaacau

SEQ ID NO: 638770 - RNA, 22 nt, Escherichia coli CFT073
uucgguauuaauuugccagcgu

SEQ ID NO: 638771 - RNA, 22 nt, Escherichia coli CFT073
uucgguauuuuuacgaaacaga

SEQ ID NO: 638772 - RNA, 21 nt, Escherichia coli CFT073
uucggcgucuuguugaacaga

SEQ ID NO: 638773 - RNA, 22 nt, Escherichia coli CFT073
uucgggaucaucucaacaaacg

SEQ ID NO: 638774 - RNA, 13 nt, Escherichia coli CFT073
uucggcuucuucc

SEQ ID NO: 638775 - RNA, 18 nt, Escherichia coli CFT073
uuaucaggccuacaaguc

SEQ ID NO: 638776 - RNA, 14 nt, Escherichia coli CFT073
uuaucaggccuaca

SEQ ID NO: 638777 - RNA, 22 nt, Escherichia coli CFT073
uucggcgaccagcgcagcuucc

SEQ ID NO: 638778 - RNA, 19 nt, Escherichia coli CFT073
uuaucacgguaaugauuaa

SEQ ID NO: 638779 - RNA, 21 nt, Escherichia coli CFT073
uuaucagacaccgauugcccc

SEQ ID NO: 638780 - RNA, 11 nt, Escherichia coli CFT073
uuaucaggccu

SEQ ID NO: 638781 - RNA, 14 nt, Escherichia coli CFT073
uuaucagauuuuca

SEQ ID NO: 638782 - RNA, 18 nt, Escherichia coli CFT073
uucugcacacacacgccc

SEQ ID NO: 638783 - RNA, 17 nt, Escherichia coli CFT073
uucugccaggcuggcag

SEQ ID NO: 638784 - RNA, 16 nt, Escherichia coli CFT073
uucugccaccagguuc

SEQ ID NO: 638785 - RNA, 18 nt, Escherichia coli CFT073
uucugccagacaaaacug

SEQ ID NO: 638786 - RNA, 12 nt, Escherichia coli CFT073
uucugcauugcg

SEQ ID NO: 638787 - RNA, 21 nt, Escherichia coli CFT073
uucugccaaacgcucccagcc

SEQ ID NO: 638788 - RNA, 17 nt, Escherichia coli CFT073
uucugccggaauaauca

SEQ ID NO: 638789 - RNA, 22 nt, Escherichia coli CFT073
uucugccggaauaaucagaugu

SEQ ID NO: 638790 - RNA, 20 nt, Escherichia coli CFT073
uucugccucgucccaaaagc

SEQ ID NO: 638791 - RNA, 16 nt, Escherichia coli CFT073
uucucuuuccagcaac

SEQ ID NO: 638792 - RNA, 16 nt, Escherichia coli CFT073
uucucuuucacuccau

SEQ ID NO: 638793 - RNA, 20 nt, Escherichia coli CFT073
uucucuuuguuaaacagugc

SEQ ID NO: 638794 - RNA, 22 nt, Escherichia coli CFT073
uucucuucauuaccuucaauac

SEQ ID NO: 638795 - RNA, 23 nt, Escherichia coli CFT073
uucucugucaggguuauagccuu

SEQ ID NO: 638796 - RNA, 17 nt, Escherichia coli CFT073
uucucugacgcucucaa

SEQ ID NO: 638797 - RNA, 19 nt, Escherichia coli CFT073
uucucucgcucaugccagg

SEQ ID NO: 638798 - RNA, 12 nt, Escherichia coli CFT073
uucucccggcac

SEQ ID NO: 638799 - RNA, 15 nt, Escherichia coli CFT073
uucucccucccgaca

SEQ ID NO: 638800 - RNA, 13 nt, Escherichia coli CFT073
uucucccgccugc

SEQ ID NO: 638801 - RNA, 17 nt, Escherichia coli CFT073
uucuccgcguucaauac

SEQ ID NO: 638802 - RNA, 21 nt, Escherichia coli CFT073
uucucaccaacuggcgcagca

SEQ ID NO: 638803 - RNA, 16 nt, Escherichia coli CFT073
uucucaccaucaaaca

SEQ ID NO: 638804 - RNA, 19 nt, Escherichia coli CFT073
uucucacggauccagaacu

SEQ ID NO: 638805 - RNA, 22 nt, Escherichia coli CFT073
uucucacuaauugcaaacagag

SEQ ID NO: 638806 - RNA, 21 nt, Escherichia coli CFT073
uucucacuggcgucacaggcc

SEQ ID NO: 638807 - RNA, 13 nt, Escherichia coli CFT073
uucuuauucauau

SEQ ID NO: 638808 - RNA, 20 nt, Escherichia coli CFT073
uucuuagucccaaacagcag

SEQ ID NO: 638809 - RNA, 15 nt, Escherichia coli CFT073
uucuucuaauugugc

SEQ ID NO: 638810 - RNA, 15 nt, Escherichia coli CFT073
uucuucugaauauca

SEQ ID NO: 638811 - RNA, 20 nt, Escherichia coli CFT073
uucuucgcugacaguaccca

SEQ ID NO: 638812 - RNA, 17 nt, Escherichia coli CFT073
uucugucgagcaucacu

SEQ ID NO: 638813 - RNA, 14 nt, Escherichia coli CFT073
uucuguagucccgg

SEQ ID NO: 638814 - RNA, 14 nt, Escherichia coli CFT073
uucugcugccuaca

SEQ ID NO: 638815 - RNA, 20 nt, Escherichia coli CFT073
uucugcgguugugcaaaaaa

SEQ ID NO: 638816 - RNA, 16 nt, Escherichia coli CFT073
uucuguugauaaaaca

SEQ ID NO: 638817 - RNA, 20 nt, Escherichia coli CFT073
uucuguuauauauuacccuu

SEQ ID NO: 638818 - RNA, 13 nt, Escherichia coli CFT073
uucugugcaauca

SEQ ID NO: 638819 - RNA, 17 nt, Escherichia coli CFT073
uucuuaaaaugaugcua

SEQ ID NO: 638820 - RNA, 14 nt, Escherichia coli CFT073
uucuguuucugucg

SEQ ID NO: 638821 - RNA, 14 nt, Escherichia coli CFT073
uugaucaagcucau

SEQ ID NO: 638822 - RNA, 23 nt, Escherichia coli CFT073
uugaucagccaggcgaugaaauu

SEQ ID NO: 638823 - RNA, 21 nt, Escherichia coli CFT073
uugaucagugcacugacgcua

SEQ ID NO: 638824 - RNA, 19 nt, Escherichia coli CFT073
uugaucccggcuuccugca

SEQ ID NO: 638825 - RNA, 21 nt, Escherichia coli CFT073
uugaucccugcaccaaugacu

SEQ ID NO: 638826 - RNA, 11 nt, Escherichia coli CFT073
uugauccagcg

SEQ ID NO: 638827 - RNA, 16 nt, Escherichia coli CFT073
uugauguccaguuccc

SEQ ID NO: 638828 - RNA, 13 nt, Escherichia coli CFT073
uugaugguaaaau

SEQ ID NO: 638829 - RNA, 20 nt, Escherichia coli CFT073
uugauggaaaauuguuccgu

SEQ ID NO: 638830 - RNA, 17 nt, Escherichia coli CFT073
uugauuacagcuggagu

SEQ ID NO: 638831 - RNA, 20 nt, Escherichia coli CFT073
uugauucaucucuucuuccg

SEQ ID NO: 638832 - RNA, 20 nt, Escherichia coli CFT073
uugcaaauauuccaucaaua

SEQ ID NO: 638833 - RNA, 22 nt, Escherichia coli CFT073
uugcaccacuaucaaccacggc

SEQ ID NO: 638834 - RNA, 20 nt, Escherichia coli CFT073
uugcaccagaucuuccagcg

SEQ ID NO: 638835 - RNA, 15 nt, Escherichia coli CFT073
uugauagauuucucu

SEQ ID NO: 638836 - RNA, 22 nt, Escherichia coli CFT073
uugauagcaaugccaucaccaa

SEQ ID NO: 638837 - RNA, 12 nt, Escherichia coli CFT073
uugauacguuau

SEQ ID NO: 638838 - RNA, 18 nt, Escherichia coli CFT073
uugaggaacucaaaccau

SEQ ID NO: 638839 - RNA, 14 nt, Escherichia coli CFT073
uugaggccuuuaga

SEQ ID NO: 638840 - RNA, 14 nt, Escherichia coli CFT073
uugaccgccagcgc

SEQ ID NO: 638841 - RNA, 16 nt, Escherichia coli CFT073
uugaccgccagcgcca

SEQ ID NO: 638842 - RNA, 11 nt, Escherichia coli CFT073
uugaccgccua

SEQ ID NO: 638843 - RNA, 13 nt, Escherichia coli CFT073
uugacugaaauuu

SEQ ID NO: 638844 - RNA, 14 nt, Escherichia coli CFT073
uugagcuuuuuccg

SEQ ID NO: 638845 - RNA, 18 nt, Escherichia coli CFT073
uugagauuguuggucaca

SEQ ID NO: 638846 - RNA, 20 nt, Escherichia coli CFT073
uugagcaaagacgcguucau

SEQ ID NO: 638847 - RNA, 18 nt, Escherichia coli CFT073
uugagauaacguaauguc

SEQ ID NO: 638848 - RNA, 12 nt, Escherichia coli CFT073
uugacauuuuuu

SEQ ID NO: 638849 - RNA, 16 nt, Escherichia coli CFT073
uugacauuuuuucauc

SEQ ID NO: 638850 - RNA, 12 nt, Escherichia coli CFT073
uugaccaagaac

SEQ ID NO: 638851 - RNA, 22 nt, Escherichia coli CFT073
uugacauauaaccggcaacaga

SEQ ID NO: 638852 - RNA, 21 nt, Escherichia coli CFT073
uugaauaaauuggcuggggua

SEQ ID NO: 638853 - RNA, 11 nt, Escherichia coli CFT073
uugaagucagg

SEQ ID NO: 638854 - RNA, 16 nt, Escherichia coli CFT073
uugaacagaccacauu

SEQ ID NO: 638855 - RNA, 20 nt, Escherichia coli CFT073
uugaaggaauuaaucccuua

SEQ ID NO: 638856 - RNA, 12 nt, Escherichia coli CFT073
uugaaaucaaaa

SEQ ID NO: 638857 - RNA, 13 nt, Escherichia coli CFT073
uugaaaacguagc

SEQ ID NO: 638858 - RNA, 14 nt, Escherichia coli CFT073
uucuuuugccuguu

SEQ ID NO: 638859 - RNA, 14 nt, Escherichia coli CFT073
uucuuuugcugccu

SEQ ID NO: 638860 - RNA, 11 nt, Escherichia coli CFT073
uucuuuuucaa

SEQ ID NO: 638861 - RNA, 12 nt, Escherichia coli CFT073
uucuuuucccug

SEQ ID NO: 638862 - RNA, 14 nt, Escherichia coli CFT073
uucuuucaccucuu

SEQ ID NO: 638863 - RNA, 12 nt, Escherichia coli CFT073
uucuuucagagu

SEQ ID NO: 638864 - RNA, 20 nt, Escherichia coli CFT073
uucuuucgcacugguuugca

SEQ ID NO: 638865 - RNA, 19 nt, Escherichia coli CFT073
uucuuucggugcaucguga

SEQ ID NO: 638866 - RNA, 20 nt, Escherichia coli CFT073
uucuuuaguugagcuuuuuc

SEQ ID NO: 638867 - RNA, 11 nt, Escherichia coli CFT073
uucuuuaaaac

SEQ ID NO: 638868 - RNA, 12 nt, Escherichia coli CFT073
uucuucuuucag

SEQ ID NO: 638869 - RNA, 16 nt, Escherichia coli CFT073
uucuucuucugacuca

SEQ ID NO: 638870 - RNA, 23 nt, Escherichia coli CFT073
uugucgggcaggagcugagugcg

SEQ ID NO: 638871 - RNA, 22 nt, Escherichia coli CFT073
uugugcgguccaugcgaagacc

SEQ ID NO: 638872 - RNA, 22 nt, Escherichia coli CFT073
uugugccagagcacugcauucg

SEQ ID NO: 638873 - RNA, 13 nt, Escherichia coli CFT073
uugugcccuucca

SEQ ID NO: 638874 - RNA, 16 nt, Escherichia coli CFT073
uugugcagcacacgau

SEQ ID NO: 638875 - RNA, 17 nt, Escherichia coli CFT073
uugugcaccagcuggcu

SEQ ID NO: 638876 - RNA, 16 nt, Escherichia coli CFT073
uugugauuuauuuucc

SEQ ID NO: 638877 - RNA, 14 nt, Escherichia coli CFT073
uugugcaaaaaaau

SEQ ID NO: 638878 - RNA, 18 nt, Escherichia coli CFT073
uugugcaaaaaaauuuca

SEQ ID NO: 638879 - RNA, 14 nt, Escherichia coli CFT073
uugugaugccacuu

SEQ ID NO: 638880 - RNA, 18 nt, Escherichia coli CFT073
uugugauuaccgcaaauc

SEQ ID NO: 638881 - RNA, 17 nt, Escherichia coli CFT073
uuguuaacucuggggaa

SEQ ID NO: 638882 - RNA, 15 nt, Escherichia coli CFT073
uuguuagcaugcuga

SEQ ID NO: 638883 - RNA, 16 nt, Escherichia coli CFT073
uuguuagccacaucca

SEQ ID NO: 638884 - RNA, 20 nt, Escherichia coli CFT073
uuguggaaauuccagcggca

SEQ ID NO: 638885 - RNA, 14 nt, Escherichia coli CFT073
uuguggcucgccau

SEQ ID NO: 638886 - RNA, 23 nt, Escherichia coli CFT073
uugguucaacaaagcgcguguug

SEQ ID NO: 638887 - RNA, 20 nt, Escherichia coli CFT073
uugguuaaauaauauuuccc

SEQ ID NO: 638888 - RNA, 14 nt, Escherichia coli CFT073
uugguuaacugaau

SEQ ID NO: 638889 - RNA, 14 nt, Escherichia coli CFT073
uugguuauuaacug

SEQ ID NO: 638890 - RNA, 16 nt, Escherichia coli CFT073
uuguauaacaugguga

SEQ ID NO: 638891 - RNA, 15 nt, Escherichia coli CFT073
uuguacugucuaaug

SEQ ID NO: 638892 - RNA, 20 nt, Escherichia coli CFT073
uuguacugucuaaugauuca

SEQ ID NO: 638893 - RNA, 14 nt, Escherichia coli CFT073
uuguacuuuaaaau

SEQ ID NO: 638894 - RNA, 14 nt, Escherichia coli CFT073
uuguacaaaccaua

SEQ ID NO: 638895 - RNA, 18 nt, Escherichia coli CFT073
uuguaucuagggacauag

SEQ ID NO: 638896 - RNA, 16 nt, Escherichia coli CFT073
uugucaccguaaccac

SEQ ID NO: 638897 - RNA, 14 nt, Escherichia coli CFT073
uuguaucaccacac

SEQ ID NO: 638898 - RNA, 15 nt, Escherichia coli CFT073
uugucaggaucacca

SEQ ID NO: 638899 - RNA, 15 nt, Escherichia coli CFT073
uugucagcaugucuu

SEQ ID NO: 638900 - RNA, 20 nt, Escherichia coli CFT073
uugucagcccuuuuggcaca

SEQ ID NO: 638901 - RNA, 23 nt, Escherichia coli CFT073
uugucauauaauguaucugaagu

SEQ ID NO: 638902 - RNA, 19 nt, Escherichia coli CFT073
uugucauagcgacuaccac

SEQ ID NO: 638903 - RNA, 19 nt, Escherichia coli CFT073
uugucauuguuauaauguu

SEQ ID NO: 638904 - RNA, 11 nt, Escherichia coli CFT073
uuguucugguc

SEQ ID NO: 638905 - RNA, 17 nt, Escherichia coli CFT073
uuguugguacaccugcu

SEQ ID NO: 638906 - RNA, 15 nt, Escherichia coli CFT073
uuguuggcauggugg

SEQ ID NO: 638907 - RNA, 21 nt, Escherichia coli CFT073
uuguugugggcaggaaaauca

SEQ ID NO: 638908 - RNA, 20 nt, Escherichia coli CFT073
uuguuuaaucaacuguggaa

SEQ ID NO: 638909 - RNA, 16 nt, Escherichia coli CFT073
uuguuuacgccggaug

SEQ ID NO: 638910 - RNA, 18 nt, Escherichia coli CFT073
uuguuuacuaaaaguuau

SEQ ID NO: 638911 - RNA, 21 nt, Escherichia coli CFT073
uuguuuacuaaaaguuauuaa

SEQ ID NO: 638912 - RNA, 22 nt, Escherichia coli CFT073
uuguuuacuaaaaguuauuaaa

SEQ ID NO: 638913 - RNA, 20 nt, Escherichia coli CFT073
uuguuuguuucuuauucaga

SEQ ID NO: 638914 - RNA, 11 nt, Escherichia coli CFT073
uuguuuuucag

SEQ ID NO: 638915 - RNA, 23 nt, Escherichia coli CFT073
uuuaaaaucgcuucgaugguugg

SEQ ID NO: 638916 - RNA, 23 nt, Escherichia coli CFT073
uuuaaaagcuuaugcuguacuuu

SEQ ID NO: 638917 - RNA, 15 nt, Escherichia coli CFT073
uuuaaaugcacagga

SEQ ID NO: 638918 - RNA, 22 nt, Escherichia coli CFT073
uuuaaaugcccgacaaaaauua

SEQ ID NO: 638919 - RNA, 17 nt, Escherichia coli CFT073
uuuaaaugccggaaugc

SEQ ID NO: 638920 - RNA, 15 nt, Escherichia coli CFT073
uuuaacaacucacca

SEQ ID NO: 638921 - RNA, 11 nt, Escherichia coli CFT073
uuuaacauuac

SEQ ID NO: 638922 - RNA, 12 nt, Escherichia coli CFT073
uuuaacaucauu

SEQ ID NO: 638923 - RNA, 11 nt, Escherichia coli CFT073
uuuaaccaaca

SEQ ID NO: 638924 - RNA, 11 nt, Escherichia coli CFT073
uuuaaccaccu

SEQ ID NO: 638925 - RNA, 14 nt, Escherichia coli CFT073
uuuaacaauucucc

SEQ ID NO: 638926 - RNA, 20 nt, Escherichia coli CFT073
uuuaacaauucuccaaacgu

SEQ ID NO: 638927 - RNA, 13 nt, Escherichia coli CFT073
uuuaauucaaaug

SEQ ID NO: 638928 - RNA, 12 nt, Escherichia coli CFT073
uuuaauaaaaag

SEQ ID NO: 638929 - RNA, 15 nt, Escherichia coli CFT073
uuuaaccugcauacc

SEQ ID NO: 638930 - RNA, 17 nt, Escherichia coli CFT073
uugguauuccaguucag

SEQ ID NO: 638931 - RNA, 13 nt, Escherichia coli CFT073
uuggggagacuaa

SEQ ID NO: 638932 - RNA, 18 nt, Escherichia coli CFT073
uugguaccguaaaaauag

SEQ ID NO: 638933 - RNA, 17 nt, Escherichia coli CFT073
uugggcgaauuccugac

SEQ ID NO: 638934 - RNA, 17 nt, Escherichia coli CFT073
uugggcgaucucccgcu

SEQ ID NO: 638935 - RNA, 14 nt, Escherichia coli CFT073
uuggcguucacugc

SEQ ID NO: 638936 - RNA, 21 nt, Escherichia coli CFT073
uuggcgucaaacgacuaaagc

SEQ ID NO: 638937 - RNA, 21 nt, Escherichia coli CFT073
uuggcguaccauuaaggucau

SEQ ID NO: 638938 - RNA, 15 nt, Escherichia coli CFT073
uuggcguaccauuaa

SEQ ID NO: 638939 - RNA, 21 nt, Escherichia coli CFT073
uuggcggcaacgaaucacugg

SEQ ID NO: 638940 - RNA, 16 nt, Escherichia coli CFT073
uuggcgauaccccaac

SEQ ID NO: 638941 - RNA, 21 nt, Escherichia coli CFT073
uuggcaucguauuucagaccu

SEQ ID NO: 638942 - RNA, 13 nt, Escherichia coli CFT073
uuggacaugugcg

SEQ ID NO: 638943 - RNA, 17 nt, Escherichia coli CFT073
uuggacucauuaaacca

SEQ ID NO: 638944 - RNA, 20 nt, Escherichia coli CFT073
uuggagagauccgcauauuu

SEQ ID NO: 638945 - RNA, 13 nt, Escherichia coli CFT073
uugcugccuucac

SEQ ID NO: 638946 - RNA, 15 nt, Escherichia coli CFT073
uugcugccguucuca

SEQ ID NO: 638947 - RNA, 19 nt, Escherichia coli CFT073
uugcugccguucucaaagg

SEQ ID NO: 638948 - RNA, 13 nt, Escherichia coli CFT073
uugcugcaccagc

SEQ ID NO: 638949 - RNA, 16 nt, Escherichia coli CFT073
uugcucauccauugcu

SEQ ID NO: 638950 - RNA, 23 nt, Escherichia coli CFT073
uugcuuaaauacgccucuucaua

SEQ ID NO: 638951 - RNA, 13 nt, Escherichia coli CFT073
uugcuuuccagcu

SEQ ID NO: 638952 - RNA, 16 nt, Escherichia coli CFT073
uugcuguuguuccagc

SEQ ID NO: 638953 - RNA, 17 nt, Escherichia coli CFT073
uugcuguuguuccagcu

SEQ ID NO: 638954 - RNA, 16 nt, Escherichia coli CFT073
uugcucaaauccauca

SEQ ID NO: 638955 - RNA, 19 nt, Escherichia coli CFT073
uugcucagauugcugacaa

SEQ ID NO: 638956 - RNA, 23 nt, Escherichia coli CFT073
uugcucaggaguaaacuuucccu

SEQ ID NO: 638957 - RNA, 14 nt, Escherichia coli CFT073
uugcuauugguuca

SEQ ID NO: 638958 - RNA, 21 nt, Escherichia coli CFT073
uugcuauuucccccucccccu

SEQ ID NO: 638959 - RNA, 13 nt, Escherichia coli CFT073
uugcgcuguuacu

SEQ ID NO: 638960 - RNA, 20 nt, Escherichia coli CFT073
uugcguacaccaacaucacg

SEQ ID NO: 638961 - RNA, 21 nt, Escherichia coli CFT073
uugcgucgaaaccacaguuca

SEQ ID NO: 638962 - RNA, 15 nt, Escherichia coli CFT073
uugcgugauauuaca

SEQ ID NO: 638963 - RNA, 24 nt, Escherichia coli CFT073
uugcgcggauggccucugccagcu

SEQ ID NO: 638964 - RNA, 16 nt, Escherichia coli CFT073
uugcgcucaauaauca

SEQ ID NO: 638965 - RNA, 15 nt, Escherichia coli CFT073
uugcgcguuggcaag

SEQ ID NO: 638966 - RNA, 21 nt, Escherichia coli CFT073
uugcgcuacguaucagggcua

SEQ ID NO: 638967 - RNA, 22 nt, Escherichia coli CFT073
uugccgccgcgugcaauaucaa

SEQ ID NO: 638968 - RNA, 22 nt, Escherichia coli CFT073
uugccggaagcgccaccagcgc

SEQ ID NO: 638969 - RNA, 16 nt, Escherichia coli CFT073
uugccggaucuuucag

SEQ ID NO: 638970 - RNA, 22 nt, Escherichia coli CFT073
uugccggaugcgacgcaaacgc

SEQ ID NO: 638971 - RNA, 18 nt, Escherichia coli CFT073
uugccgcgucuuaucagg

SEQ ID NO: 638972 - RNA, 16 nt, Escherichia coli CFT073
uugccgcucaguuccg

SEQ ID NO: 638973 - RNA, 18 nt, Escherichia coli CFT073
uugccgcuuuuaugugca

SEQ ID NO: 638974 - RNA, 14 nt, Escherichia coli CFT073
uugcgacugaacca

SEQ ID NO: 638975 - RNA, 13 nt, Escherichia coli CFT073
uugcgaaaaauaa

SEQ ID NO: 638976 - RNA, 22 nt, Escherichia coli CFT073
uugcgaauccgcggaugauucc

SEQ ID NO: 638977 - RNA, 14 nt, Escherichia coli CFT073
uugcgauaucccau

SEQ ID NO: 638978 - RNA, 15 nt, Escherichia coli CFT073
uugcgccucaagaau

SEQ ID NO: 638979 - RNA, 17 nt, Escherichia coli CFT073
uugccccucuaacucuu

SEQ ID NO: 638980 - RNA, 19 nt, Escherichia coli CFT073
uugccccagaauuuucccu

SEQ ID NO: 638981 - RNA, 23 nt, Escherichia coli CFT073
uugcccuucacagguggucacag

SEQ ID NO: 638982 - RNA, 17 nt, Escherichia coli CFT073
uugcccguuuuuuuauc

SEQ ID NO: 638983 - RNA, 16 nt, Escherichia coli CFT073
uugcccgucugcugcu

SEQ ID NO: 638984 - RNA, 20 nt, Escherichia coli CFT073
uugcccgcgcguuaacuccc

SEQ ID NO: 638985 - RNA, 16 nt, Escherichia coli CFT073
uugccgacgcuccuga

SEQ ID NO: 638986 - RNA, 18 nt, Escherichia coli CFT073
uugccgaugauucccagu

SEQ ID NO: 638987 - RNA, 16 nt, Escherichia coli CFT073
uugccgcagacaaaau

SEQ ID NO: 638988 - RNA, 15 nt, Escherichia coli CFT073
uugcauaucaauuag

SEQ ID NO: 638989 - RNA, 13 nt, Escherichia coli CFT073
uugcauccaacuu

SEQ ID NO: 638990 - RNA, 20 nt, Escherichia coli CFT073
uugcagaaguugugaaacga

SEQ ID NO: 638991 - RNA, 13 nt, Escherichia coli CFT073
uugcagauggaug

SEQ ID NO: 638992 - RNA, 16 nt, Escherichia coli CFT073
uugcagauaccacauc

SEQ ID NO: 638993 - RNA, 17 nt, Escherichia coli CFT073
uugcagacguagaaaau

SEQ ID NO: 638994 - RNA, 12 nt, Escherichia coli CFT073
uuuauuaaauau

SEQ ID NO: 638995 - RNA, 23 nt, Escherichia coli CFT073
uuuauuaauccagggaucaacau

SEQ ID NO: 638996 - RNA, 18 nt, Escherichia coli CFT073
uuuauuaaugacauucag

SEQ ID NO: 638997 - RNA, 24 nt, Escherichia coli CFT073
uuuauggcagaauacuucacauga

SEQ ID NO: 638998 - RNA, 18 nt, Escherichia coli CFT073
uuuauguuagccgccugc

SEQ ID NO: 638999 - RNA, 15 nt, Escherichia coli CFT073
uuuaugauccagcuu

SEQ ID NO: 639000 - RNA, 22 nt, Escherichia coli CFT073
uuuaugauuuccggucaaccca

SEQ ID NO: 639001 - RNA, 14 nt, Escherichia coli CFT073
uuuaugccggugag

SEQ ID NO: 639002 - RNA, 19 nt, Escherichia coli CFT073
uuuauccggccuacaauga

SEQ ID NO: 639003 - RNA, 23 nt, Escherichia coli CFT073
uuuaucgauaaauggcgcaucca

SEQ ID NO: 639004 - RNA, 12 nt, Escherichia coli CFT073
uuuauccagcac

SEQ ID NO: 639005 - RNA, 20 nt, Escherichia coli CFT073
uuuaucugugaacucaggcu

SEQ ID NO: 639006 - RNA, 22 nt, Escherichia coli CFT073
uuuaucgucacgcaucacgaca

SEQ ID NO: 639007 - RNA, 20 nt, Escherichia coli CFT073
uuuauagcugauaucaccug

SEQ ID NO: 639008 - RNA, 20 nt, Escherichia coli CFT073
uuuauacggcguuuccagcu

SEQ ID NO: 639009 - RNA, 22 nt, Escherichia coli CFT073
uuuauacucacgaaucauaggc

SEQ ID NO: 639010 - RNA, 16 nt, Escherichia coli CFT073
uuuauaaaauccaacu

SEQ ID NO: 639011 - RNA, 23 nt, Escherichia coli CFT073
uuuauaaauaucaaaaacaaauu

SEQ ID NO: 639012 - RNA, 15 nt, Escherichia coli CFT073
uuuauaacuauauga

SEQ ID NO: 639013 - RNA, 12 nt, Escherichia coli CFT073
uuuauauaauga

SEQ ID NO: 639014 - RNA, 13 nt, Escherichia coli CFT073
uuuaucacaucca

SEQ ID NO: 639015 - RNA, 14 nt, Escherichia coli CFT073
uuuaucaccaauga

SEQ ID NO: 639016 - RNA, 15 nt, Escherichia coli CFT073
uuuaucaccaaugau

SEQ ID NO: 639017 - RNA, 17 nt, Escherichia coli CFT073
uuuaucaaugacaucug

SEQ ID NO: 639018 - RNA, 23 nt, Escherichia coli CFT073
uuuacugccgcgauggguuguug

SEQ ID NO: 639019 - RNA, 18 nt, Escherichia coli CFT073
uuuacucucguuccacuc

SEQ ID NO: 639020 - RNA, 17 nt, Escherichia coli CFT073
uuuacucuucuuuaauu

SEQ ID NO: 639021 - RNA, 20 nt, Escherichia coli CFT073
uuuacucuucuuuaauuaau

SEQ ID NO: 639022 - RNA, 11 nt, Escherichia coli CFT073
uuuacuuaaua

SEQ ID NO: 639023 - RNA, 22 nt, Escherichia coli CFT073
uuuacugguugauuuuaaagga

SEQ ID NO: 639024 - RNA, 13 nt, Escherichia coli CFT073
uuuacuaaaaguu

SEQ ID NO: 639025 - RNA, 21 nt, Escherichia coli CFT073
uuuacuaauagcaaaauauaa

SEQ ID NO: 639026 - RNA, 12 nt, Escherichia coli CFT073
uuuacgccgcau

SEQ ID NO: 639027 - RNA, 19 nt, Escherichia coli CFT073
uuuacgccgcauccggcaa

SEQ ID NO: 639028 - RNA, 22 nt, Escherichia coli CFT073
uuuacgcgucaguuuuuccaga

SEQ ID NO: 639029 - RNA, 18 nt, Escherichia coli CFT073
uuuacgcucccacggaau

SEQ ID NO: 639030 - RNA, 20 nt, Escherichia coli CFT073
uuuacgcuguaagccgccgc

SEQ ID NO: 639031 - RNA, 23 nt, Escherichia coli CFT073
uuuacggaacacggacaauacac

SEQ ID NO: 639032 - RNA, 11 nt, Escherichia coli CFT073
uuuacauaaau

SEQ ID NO: 639033 - RNA, 19 nt, Escherichia coli CFT073
uuuacaucaucagaaaugc

SEQ ID NO: 639034 - RNA, 21 nt, Escherichia coli CFT073
uuuacaucaucagaaaugcca

SEQ ID NO: 639035 - RNA, 17 nt, Escherichia coli CFT073
uuuacagauuucccauu

SEQ ID NO: 639036 - RNA, 23 nt, Escherichia coli CFT073
uuuacagccagccgcuaacuucc

SEQ ID NO: 639037 - RNA, 22 nt, Escherichia coli CFT073
uuuagggggggcucuuuccauc

SEQ ID NO: 639038 - RNA, 17 nt, Escherichia coli CFT073
uuuagguacaaagccaa

SEQ ID NO: 639039 - RNA, 16 nt, Escherichia coli CFT073
uuuagucgccacaauc

SEQ ID NO: 639040 - RNA, 16 nt, Escherichia coli CFT073
uuuagcgaauaacaaa

SEQ ID NO: 639041 - RNA, 18 nt, Escherichia coli CFT073
uuuagccgcuucugcagc

SEQ ID NO: 639042 - RNA, 20 nt, Escherichia coli CFT073
uuuagcaugugcaaucuaca

SEQ ID NO: 639043 - RNA, 19 nt, Escherichia coli CFT073
uuucaucccgagucgcuga

SEQ ID NO: 639044 - RNA, 19 nt, Escherichia coli CFT073
uuucaucauuaaaggcaaa

SEQ ID NO: 639045 - RNA, 21 nt, Escherichia coli CFT073
uuucaucaacugacuauccug

SEQ ID NO: 639046 - RNA, 14 nt, Escherichia coli CFT073
uuucauccugccau

SEQ ID NO: 639047 - RNA, 15 nt, Escherichia coli CFT073
uuucauccuucauua

SEQ ID NO: 639048 - RNA, 19 nt, Escherichia coli CFT073
uuucauccuucauuacccu

SEQ ID NO: 639049 - RNA, 16 nt, Escherichia coli CFT073
uuucaucgauccccug

SEQ ID NO: 639050 - RNA, 20 nt, Escherichia coli CFT073
uuucaucgauccccugcccg

SEQ ID NO: 639051 - RNA, 22 nt, Escherichia coli CFT073
uuucaucgcccaggcaaguagc

SEQ ID NO: 639052 - RNA, 13 nt, Escherichia coli CFT073
uuucaucucauca

SEQ ID NO: 639053 - RNA, 16 nt, Escherichia coli CFT073
uuucaugcucaccaau

SEQ ID NO: 639054 - RNA, 24 nt, Escherichia coli CFT073
uuucaugcucaccaauccaggcaa

SEQ ID NO: 639055 - RNA, 12 nt, Escherichia coli CFT073
uuucaugaauaa

SEQ ID NO: 639056 - RNA, 18 nt, Escherichia coli CFT073
uuucaugcuauuccuuga

SEQ ID NO: 639057 - RNA, 16 nt, Escherichia coli CFT073
uuucauguaacgcugc

SEQ ID NO: 639058 - RNA, 14 nt, Escherichia coli CFT073
uuucauuauucauu

SEQ ID NO: 639059 - RNA, 17 nt, Escherichia coli CFT073
uuucauuacuauaaccc

SEQ ID NO: 639060 - RNA, 14 nt, Escherichia coli CFT073
uuucauucuccauu

SEQ ID NO: 639061 - RNA, 21 nt, Escherichia coli CFT073
uuucauuuggauggaaaauuu

SEQ ID NO: 639062 - RNA, 15 nt, Escherichia coli CFT073
uuucauuuaagccac

SEQ ID NO: 639063 - RNA, 15 nt, Escherichia coli CFT073
uuucagauaucccau

SEQ ID NO: 639064 - RNA, 16 nt, Escherichia coli CFT073
uuucagauccagugcu

SEQ ID NO: 639065 - RNA, 15 nt, Escherichia coli CFT073
uuucagacgggccau

SEQ ID NO: 639066 - RNA, 20 nt, Escherichia coli CFT073
uuucagagcggccuucuucu

SEQ ID NO: 639067 - RNA, 20 nt, Escherichia coli CFT073
uuucacuucaaccacauuca

SEQ ID NO: 639068 - RNA, 14 nt, Escherichia coli CFT073
uuucacuuuaccuu

SEQ ID NO: 639069 - RNA, 17 nt, Escherichia coli CFT073
uuucacuuucugaccau

SEQ ID NO: 639070 - RNA, 16 nt, Escherichia coli CFT073
uuucagcaauaaucag

SEQ ID NO: 639071 - RNA, 18 nt, Escherichia coli CFT073
uuucaggaaauaaauaau

SEQ ID NO: 639072 - RNA, 12 nt, Escherichia coli CFT073
uuucagcugccc

SEQ ID NO: 639073 - RNA, 23 nt, Escherichia coli CFT073
uuucagcgccgcgcuauuuuccu

SEQ ID NO: 639074 - RNA, 20 nt, Escherichia coli CFT073
uuucauagauuaauuuccca

SEQ ID NO: 639075 - RNA, 19 nt, Escherichia coli CFT073
uuucauagauuaauuuccc

SEQ ID NO: 639076 - RNA, 15 nt, Escherichia coli CFT073
uuucauagcaaauuc

SEQ ID NO: 639077 - RNA, 14 nt, Escherichia coli CFT073
uuucauaauccugu

SEQ ID NO: 639078 - RNA, 14 nt, Escherichia coli CFT073
uuucauacugccga

SEQ ID NO: 639079 - RNA, 13 nt, Escherichia coli CFT073
uuucaguuugccg

SEQ ID NO: 639080 - RNA, 13 nt, Escherichia coli CFT073
uuucaguuugcug

SEQ ID NO: 639081 - RNA, 20 nt, Escherichia coli CFT073
uuucaggcuuuuuuccagcu

SEQ ID NO: 639082 - RNA, 17 nt, Escherichia coli CFT073
uuucaggcaacaaaaaa

SEQ ID NO: 639083 - RNA, 20 nt, Escherichia coli CFT073
uuucaggcaacaaaaaaccc

SEQ ID NO: 639084 - RNA, 15 nt, Escherichia coli CFT073
uuucaggucaguuuu

SEQ ID NO: 639085 - RNA, 16 nt, Escherichia coli CFT073
uuucagguuacgcccu

SEQ ID NO: 639086 - RNA, 20 nt, Escherichia coli CFT073
uuucagguuacgcccuuccc

SEQ ID NO: 639087 - RNA, 17 nt, Escherichia coli CFT073
uuuauucugucucaacu

SEQ ID NO: 639088 - RNA, 16 nt, Escherichia coli CFT073
uuuauuagcccagcca

SEQ ID NO: 639089 - RNA, 22 nt, Escherichia coli CFT073
uuuauuagcccgggauuugguu

SEQ ID NO: 639090 - RNA, 11 nt, Escherichia coli CFT073
uuuauuauucc

SEQ ID NO: 639091 - RNA, 16 nt, Escherichia coli CFT073
uuuauuauuccgugac

SEQ ID NO: 639092 - RNA, 14 nt, Escherichia coli CFT073
uuucaaacaggcug

SEQ ID NO: 639093 - RNA, 20 nt, Escherichia coli CFT073
uuucaaaucaccaaacugcu

SEQ ID NO: 639094 - RNA, 22 nt, Escherichia coli CFT073
uuuauuuugcgagcagcauucc

SEQ ID NO: 639095 - RNA, 17 nt, Escherichia coli CFT073
uuucaacggaccaauaa

SEQ ID NO: 639096 - RNA, 13 nt, Escherichia coli CFT073
uuucaacuuccca

SEQ ID NO: 639097 - RNA, 13 nt, Escherichia coli CFT073
uuucaaugcuuuu

SEQ ID NO: 639098 - RNA, 21 nt, Escherichia coli CFT073
uuucaaugccuuucuuuguuc

SEQ ID NO: 639099 - RNA, 15 nt, Escherichia coli CFT073
uuucaauccguccca

SEQ ID NO: 639100 - RNA, 23 nt, Escherichia coli CFT073
uuucaaugauaaaggucaucaca

SEQ ID NO: 639101 - RNA, 18 nt, Escherichia coli CFT073
uuucacgcaaggcacaaa

SEQ ID NO: 639102 - RNA, 21 nt, Escherichia coli CFT073
uuucacccagcguuugcugcu

SEQ ID NO: 639103 - RNA, 11 nt, Escherichia coli CFT073
uuucaccucuu

SEQ ID NO: 639104 - RNA, 20 nt, Escherichia coli CFT073
uuucacuaagauguuguuca

SEQ ID NO: 639105 - RNA, 22 nt, Escherichia coli CFT073
uuucacgccgggaaauuuuucc

SEQ ID NO: 639106 - RNA, 16 nt, Escherichia coli CFT073
uuucacggcaccagcc

SEQ ID NO: 639107 - RNA, 23 nt, Escherichia coli CFT073
uuucaauggcgcugcaaagcuga

SEQ ID NO: 639108 - RNA, 18 nt, Escherichia coli CFT073
uuucaauuagcuuacgcc

SEQ ID NO: 639109 - RNA, 12 nt, Escherichia coli CFT073
uuucaauuauca

SEQ ID NO: 639110 - RNA, 16 nt, Escherichia coli CFT073
uuucacauauucauua

SEQ ID NO: 639111 - RNA, 12 nt, Escherichia coli CFT073
uuucacaucauu

SEQ ID NO: 639112 - RNA, 19 nt, Escherichia coli CFT073
uuucacagaagugaagcau

SEQ ID NO: 639113 - RNA, 20 nt, Escherichia coli CFT073
uuucacaguaauuuccugcc

SEQ ID NO: 639114 - RNA, 13 nt, Escherichia coli CFT073
uuugccagcagag

SEQ ID NO: 639115 - RNA, 19 nt, Escherichia coli CFT073
uuugccaggucgcuugccg

SEQ ID NO: 639116 - RNA, 23 nt, Escherichia coli CFT073
uuugcauuacugcuaucugucag

SEQ ID NO: 639117 - RNA, 23 nt, Escherichia coli CFT073
uuugcccgaucaucaaaaaacac

SEQ ID NO: 639118 - RNA, 22 nt, Escherichia coli CFT073
uuugcccugaugaucuaaaagc

SEQ ID NO: 639119 - RNA, 15 nt, Escherichia coli CFT073
uuugccgcauccuca

SEQ ID NO: 639120 - RNA, 23 nt, Escherichia coli CFT073
uuugcgcaggcaagccuugcagc

SEQ ID NO: 639121 - RNA, 12 nt, Escherichia coli CFT073
uuugcgccauca

SEQ ID NO: 639122 - RNA, 20 nt, Escherichia coli CFT073
uuugcgagucugcuccagaa

SEQ ID NO: 639123 - RNA, 14 nt, Escherichia coli CFT073
uuugccugccgccu

SEQ ID NO: 639124 - RNA, 12 nt, Escherichia coli CFT073
uuugccugcuau

SEQ ID NO: 639125 - RNA, 16 nt, Escherichia coli CFT073
uuugcaauuugcagcc

SEQ ID NO: 639126 - RNA, 20 nt, Escherichia coli CFT073
uuugcacgcucuucacggcg

SEQ ID NO: 639127 - RNA, 20 nt, Escherichia coli CFT073
uuugcacgcuuucugcguga

SEQ ID NO: 639128 - RNA, 18 nt, Escherichia coli CFT073
uuugcaacgcuuugcuga

SEQ ID NO: 639129 - RNA, 16 nt, Escherichia coli CFT073
uuugcauccacaaccc

SEQ ID NO: 639130 - RNA, 16 nt, Escherichia coli CFT073
uuugcauuacugcuau

SEQ ID NO: 639131 - RNA, 14 nt, Escherichia coli CFT073
uuugcaggaaaaac

SEQ ID NO: 639132 - RNA, 18 nt, Escherichia coli CFT073
uuugcaggaaaaacugcc

SEQ ID NO: 639133 - RNA, 15 nt, Escherichia coli CFT073
uuugcagguucugcu

SEQ ID NO: 639134 - RNA, 19 nt, Escherichia coli CFT073
uuugcagccguuuguucug

SEQ ID NO: 639135 - RNA, 14 nt, Escherichia coli CFT073
uuugaucaaucugc

SEQ ID NO: 639136 - RNA, 16 nt, Escherichia coli CFT073
uuugaucgcuuccauu

SEQ ID NO: 639137 - RNA, 21 nt, Escherichia coli CFT073
uuugaugguggucgcaucauc

SEQ ID NO: 639138 - RNA, 16 nt, Escherichia coli CFT073
uuugauuugcugcuca

SEQ ID NO: 639139 - RNA, 23 nt, Escherichia coli CFT073
uuugauuccaguaaguuauguau

SEQ ID NO: 639140 - RNA, 16 nt, Escherichia coli CFT073
uuugauugauuuuucc

SEQ ID NO: 639141 - RNA, 18 nt, Escherichia coli CFT073
uuugauugauuuuuccac

SEQ ID NO: 639142 - RNA, 16 nt, Escherichia coli CFT073
uuugaguggucgacaa

SEQ ID NO: 639143 - RNA, 22 nt, Escherichia coli CFT073
uuugauaaaccuccagcaucag

SEQ ID NO: 639144 - RNA, 19 nt, Escherichia coli CFT073
uuugauaaguacauuaaaa

SEQ ID NO: 639145 - RNA, 14 nt, Escherichia coli CFT073
uuugagaacauuca

SEQ ID NO: 639146 - RNA, 22 nt, Escherichia coli CFT073
uuugagcgucaaacuuuuaaau

SEQ ID NO: 639147 - RNA, 22 nt, Escherichia coli CFT073
uuugagcaucaaacuuuuaaau

SEQ ID NO: 639148 - RNA, 21 nt, Escherichia coli CFT073
uuucuugguagagauuuuucc

SEQ ID NO: 639149 - RNA, 16 nt, Escherichia coli CFT073
uuucuuucaccucuuc

SEQ ID NO: 639150 - RNA, 11 nt, Escherichia coli CFT073
uuucuuuaauu

SEQ ID NO: 639151 - RNA, 12 nt, Escherichia coli CFT073
uuucuucauucg

SEQ ID NO: 639152 - RNA, 13 nt, Escherichia coli CFT073
uuucuuccagguu

SEQ ID NO: 639153 - RNA, 15 nt, Escherichia coli CFT073
uuucuuccugcauca

SEQ ID NO: 639154 - RNA, 11 nt, Escherichia coli CFT073
uuucuucuucg

SEQ ID NO: 639155 - RNA, 12 nt, Escherichia coli CFT073
uuucuuauuaag

SEQ ID NO: 639156 - RNA, 12 nt, Escherichia coli CFT073
uuucuuauuuuu

SEQ ID NO: 639157 - RNA, 21 nt, Escherichia coli CFT073
uuucuggcgguaguuccacca

SEQ ID NO: 639158 - RNA, 13 nt, Escherichia coli CFT073
uuugaauuucaaa

SEQ ID NO: 639159 - RNA, 19 nt, Escherichia coli CFT073
uuugacccaucuugucauu

SEQ ID NO: 639160 - RNA, 22 nt, Escherichia coli CFT073
uuugacagccccugugccagcu

SEQ ID NO: 639161 - RNA, 18 nt, Escherichia coli CFT073
uuugacuccugacaggua

SEQ ID NO: 639162 - RNA, 17 nt, Escherichia coli CFT073
uuugaaggaauuaaucc

SEQ ID NO: 639163 - RNA, 14 nt, Escherichia coli CFT073
uuugaacuggaaaa

SEQ ID NO: 639164 - RNA, 15 nt, Escherichia coli CFT073
uuugaacuuuuucuu

SEQ ID NO: 639165 - RNA, 12 nt, Escherichia coli CFT073
uuugaacauauc

SEQ ID NO: 639166 - RNA, 18 nt, Escherichia coli CFT073
uuugaaauugugauaaaa

SEQ ID NO: 639167 - RNA, 18 nt, Escherichia coli CFT073
uuugaaauaaaaucagcu

SEQ ID NO: 639168 - RNA, 12 nt, Escherichia coli CFT073
uuugaaagaugc

SEQ ID NO: 639169 - RNA, 17 nt, Escherichia coli CFT073
uuucuuucgcacugguu

SEQ ID NO: 639170 - RNA, 15 nt, Escherichia coli CFT073
uuucuuuguucuucu

SEQ ID NO: 639171 - RNA, 13 nt, Escherichia coli CFT073
uuucuuuuaacaa

SEQ ID NO: 639172 - RNA, 15 nt, Escherichia coli CFT073
uuucuuuuaacaaac

SEQ ID NO: 639173 - RNA, 16 nt, Escherichia coli CFT073
uuugaaaagaguucau

SEQ ID NO: 639174 - RNA, 15 nt, Escherichia coli CFT073
uuucuuuuucagcaa

SEQ ID NO: 639175 - RNA, 12 nt, Escherichia coli CFT073
uuuccagaaagu

SEQ ID NO: 639176 - RNA, 12 nt, Escherichia coli CFT073
uuuccacuggau

SEQ ID NO: 639177 - RNA, 14 nt, Escherichia coli CFT073
uuuccacuuccacc

SEQ ID NO: 639178 - RNA, 17 nt, Escherichia coli CFT073
uuuccagaucggcuuca

SEQ ID NO: 639179 - RNA, 16 nt, Escherichia coli CFT073
uuuccagcgccuguug

SEQ ID NO: 639180 - RNA, 15 nt, Escherichia coli CFT073
uuuccaggcagccau

SEQ ID NO: 639181 - RNA, 21 nt, Escherichia coli CFT073
uuuccaggcuggcaggccuca

SEQ ID NO: 639182 - RNA, 20 nt, Escherichia coli CFT073
uuuccagcucggcgaucugu

SEQ ID NO: 639183 - RNA, 16 nt, Escherichia coli CFT073
uuuccaucuuuccuca

SEQ ID NO: 639184 - RNA, 16 nt, Escherichia coli CFT073
uuuccaguuugcguuc

SEQ ID NO: 639185 - RNA, 16 nt, Escherichia coli CFT073
uuuccaguugugagac

SEQ ID NO: 639186 - RNA, 14 nt, Escherichia coli CFT073
uuuccaguucuagu

SEQ ID NO: 639187 - RNA, 17 nt, Escherichia coli CFT073
uuuccaguguucauaua

SEQ ID NO: 639188 - RNA, 23 nt, Escherichia coli CFT073
uuuccagggccaguacacaaucc

SEQ ID NO: 639189 - RNA, 17 nt, Escherichia coli CFT073
uuucccgauaaccuucu

SEQ ID NO: 639190 - RNA, 17 nt, Escherichia coli CFT073
uuucccgacacacugcg

SEQ ID NO: 639191 - RNA, 18 nt, Escherichia coli CFT073
uuuccccuaacucuuuca

SEQ ID NO: 639192 - RNA, 21 nt, Escherichia coli CFT073
uuucccagcaagaaccaugca

SEQ ID NO: 639193 - RNA, 16 nt, Escherichia coli CFT073
uuucccagcaggauca

SEQ ID NO: 639194 - RNA, 14 nt, Escherichia coli CFT073
uuucccccacagcu

SEQ ID NO: 639195 - RNA, 18 nt, Escherichia coli CFT073
uuuccgacgguuugccuu

SEQ ID NO: 639196 - RNA, 18 nt, Escherichia coli CFT073
uuuccgcacguuuuucca

SEQ ID NO: 639197 - RNA, 15 nt, Escherichia coli CFT073
uuuccggaaaaauca

SEQ ID NO: 639198 - RNA, 18 nt, Escherichia coli CFT073
uuucccggguaaacacca

SEQ ID NO: 639199 - RNA, 14 nt, Escherichia coli CFT073
uuucccuguugccu

SEQ ID NO: 639200 - RNA, 16 nt, Escherichia coli CFT073
uuucccuguugcgcuc

SEQ ID NO: 639201 - RNA, 18 nt, Escherichia coli CFT073
uuucccuucccgcaaugc

SEQ ID NO: 639202 - RNA, 14 nt, Escherichia coli CFT073
uuucccuuucuuau

SEQ ID NO: 639203 - RNA, 11 nt, Escherichia coli CFT073
uuuccggugcc

SEQ ID NO: 639204 - RNA, 22 nt, Escherichia coli CFT073
uuuccgcuggccgguuugccau

SEQ ID NO: 639205 - RNA, 18 nt, Escherichia coli CFT073
uuuccggauuauccagcc

SEQ ID NO: 639206 - RNA, 20 nt, Escherichia coli CFT073
uuuccggcauuucuugugca

SEQ ID NO: 639207 - RNA, 16 nt, Escherichia coli CFT073
uuuccguaucugucag

SEQ ID NO: 639208 - RNA, 15 nt, Escherichia coli CFT073
uuuccgucagcggca

SEQ ID NO: 639209 - RNA, 19 nt, Escherichia coli CFT073
uuuccuggguuaguugaua

SEQ ID NO: 639210 - RNA, 19 nt, Escherichia coli CFT073
uuuccugcacaaugccuuu

SEQ ID NO: 639211 - RNA, 20 nt, Escherichia coli CFT073
uuuccugccagaccuuauca

SEQ ID NO: 639212 - RNA, 21 nt, Escherichia coli CFT073
uuuccucaguaccgugcagcg

SEQ ID NO: 639213 - RNA, 15 nt, Escherichia coli CFT073
uuucgauaaucauca

SEQ ID NO: 639214 - RNA, 23 nt, Escherichia coli CFT073
uuucgaugcguaccauuucuucu

SEQ ID NO: 639215 - RNA, 22 nt, Escherichia coli CFT073
uuucgaggauccaugacaucuc

SEQ ID NO: 639216 - RNA, 13 nt, Escherichia coli CFT073
uuucgauugcaca

SEQ ID NO: 639217 - RNA, 15 nt, Escherichia coli CFT073
uuucgauuuguucug

SEQ ID NO: 639218 - RNA, 17 nt, Escherichia coli CFT073
uuucgauuuuuuccagc

SEQ ID NO: 639219 - RNA, 12 nt, Escherichia coli CFT073
uuucgcaaacca

SEQ ID NO: 639220 - RNA, 15 nt, Escherichia coli CFT073
uuucgcaaaccaaac

SEQ ID NO: 639221 - RNA, 23 nt, Escherichia coli CFT073
uuuccuuccuccccgguagccau

SEQ ID NO: 639222 - RNA, 20 nt, Escherichia coli CFT073
uuuccuucgggaucaaccgc

SEQ ID NO: 639223 - RNA, 18 nt, Escherichia coli CFT073
uuucgacaauaaucaacg

SEQ ID NO: 639224 - RNA, 14 nt, Escherichia coli CFT073
uuucuacuuuuucu

SEQ ID NO: 639225 - RNA, 16 nt, Escherichia coli CFT073
uuucuacuucuuucac

SEQ ID NO: 639226 - RNA, 12 nt, Escherichia coli CFT073
uuucuacaagca

SEQ ID NO: 639227 - RNA, 22 nt, Escherichia coli CFT073
uuucuaaaaagaggccggugcu

SEQ ID NO: 639228 - RNA, 13 nt, Escherichia coli CFT073
uuucgcuucuuca

SEQ ID NO: 639229 - RNA, 16 nt, Escherichia coli CFT073
uuucgcugucgguacu

SEQ ID NO: 639230 - RNA, 14 nt, Escherichia coli CFT073
uuucgccugcaaau

SEQ ID NO: 639231 - RNA, 16 nt, Escherichia coli CFT073
uuucgcgucaaucaca

SEQ ID NO: 639232 - RNA, 21 nt, Escherichia coli CFT073
uuucgcgucaaucacacugac

SEQ ID NO: 639233 - RNA, 15 nt, Escherichia coli CFT073
uuucgucguacugac

SEQ ID NO: 639234 - RNA, 21 nt, Escherichia coli CFT073
uuucguuagcaaacgacacau

SEQ ID NO: 639235 - RNA, 14 nt, Escherichia coli CFT073
uuucuaucaucaua

SEQ ID NO: 639236 - RNA, 17 nt, Escherichia coli CFT073
uuucucaagucugggua

SEQ ID NO: 639237 - RNA, 13 nt, Escherichia coli CFT073
uuucucauuuuua

SEQ ID NO: 639238 - RNA, 15 nt, Escherichia coli CFT073
uuucuccaaccagcu

SEQ ID NO: 639239 - RNA, 13 nt, Escherichia coli CFT073
uuucucacuggcg

SEQ ID NO: 639240 - RNA, 22 nt, Escherichia coli CFT073
uuucucgccaccggcacaucca

SEQ ID NO: 639241 - RNA, 15 nt, Escherichia coli CFT073
uuucucgccugaguu

SEQ ID NO: 639242 - RNA, 20 nt, Escherichia coli CFT073
uuucucgccuggaugggaua

SEQ ID NO: 639243 - RNA, 15 nt, Escherichia coli CFT073
uuucuccgagcauuu

SEQ ID NO: 639244 - RNA, 14 nt, Escherichia coli CFT073
uuucuccugcgccu

SEQ ID NO: 639245 - RNA, 13 nt, Escherichia coli CFT073
uuucucuucaucu

SEQ ID NO: 639246 - RNA, 22 nt, Escherichia coli CFT073
uuucucugacgcucucaacgcc

SEQ ID NO: 639247 - RNA, 17 nt, Escherichia coli CFT073
uuucucuuuaaacagau

SEQ ID NO: 639248 - RNA, 15 nt, Escherichia coli CFT073
uuucucuuucuucag

SEQ ID NO: 639249 - RNA, 17 nt, Escherichia coli CFT073
uuucucguaaauucccc

SEQ ID NO: 639250 - RNA, 20 nt, Escherichia coli CFT073
uuucucgguauuacaaugcg

SEQ ID NO: 639251 - RNA, 22 nt, Escherichia coli CFT073
uuucugaccaugcauauaagau

SEQ ID NO: 639252 - RNA, 23 nt, Escherichia coli CFT073
uuucugacgaugguguuuauucc

SEQ ID NO: 639253 - RNA, 14 nt, Escherichia coli CFT073
uuucugacuucccu

SEQ ID NO: 639254 - RNA, 15 nt, Escherichia coli CFT073
uuucugagcaucaca

SEQ ID NO: 639255 - RNA, 15 nt, Escherichia coli CFT073
uuucugcaugaaaua

SEQ ID NO: 639256 - RNA, 22 nt, Escherichia coli CFT073
uuucugccucgucccaaaagcu

SEQ ID NO: 639257 - RNA, 22 nt, Escherichia coli CFT073
uuucugccugaucuuucugaua

SEQ ID NO: 639258 - RNA, 19 nt, Escherichia coli CFT073
uuucugcugcuuuaucagc

SEQ ID NO: 639259 - RNA, 18 nt, Escherichia coli CFT073
ucauuaccggcacuggaa

SEQ ID NO: 639260 - RNA, 20 nt, Escherichia coli CFT073
ucauuaccacaacaaaucgu

SEQ ID NO: 639261 - RNA, 21 nt, Escherichia coli CFT073
ucauuaccacaacaaaucgua

SEQ ID NO: 639262 - RNA, 12 nt, Escherichia coli CFT073
ucauuaccuuca

SEQ ID NO: 639263 - RNA, 13 nt, Escherichia coli CFT073
ucauuaccuucaa

SEQ ID NO: 639264 - RNA, 13 nt, Escherichia coli CFT073
ucauuacucaucc

SEQ ID NO: 639265 - RNA, 15 nt, Escherichia coli CFT073
ucauuaauaaccauu

SEQ ID NO: 639266 - RNA, 19 nt, Escherichia coli CFT073
ucauuaagaacuccugaaa

SEQ ID NO: 639267 - RNA, 16 nt, Escherichia coli CFT073
ucauuaaaugcguagg

SEQ ID NO: 639268 - RNA, 16 nt, Escherichia coli CFT073
ucauuaacgcagaauc

SEQ ID NO: 639269 - RNA, 17 nt, Escherichia coli CFT073
ucauguuuuucaccuug

SEQ ID NO: 639270 - RNA, 14 nt, Escherichia coli CFT073
ucauuaaaccacuu

SEQ ID NO: 639271 - RNA, 21 nt, Escherichia coli CFT073
ucaugucgcgcaaaguaaagc

SEQ ID NO: 639272 - RNA, 17 nt, Escherichia coli CFT073
ucaugucggcagugauu

SEQ ID NO: 639273 - RNA, 13 nt, Escherichia coli CFT073
ucaugucagagcu

SEQ ID NO: 639274 - RNA, 13 nt, Escherichia coli CFT073
ucauuauaucuua

SEQ ID NO: 639275 - RNA, 18 nt, Escherichia coli CFT073
ucauuagucacaaaucuc

SEQ ID NO: 639276 - RNA, 19 nt, Escherichia coli CFT073
ucauucagaucguuaauga

SEQ ID NO: 639277 - RNA, 19 nt, Escherichia coli CFT073
ucauucagauucaaaucca

SEQ ID NO: 639278 - RNA, 20 nt, Escherichia coli CFT073
ucauucaggccaaagccgcc

SEQ ID NO: 639279 - RNA, 13 nt, Escherichia coli CFT073
ucauuauuaauau

SEQ ID NO: 639280 - RNA, 16 nt, Escherichia coli CFT073
ucauuauuaauauuca

SEQ ID NO: 639281 - RNA, 13 nt, Escherichia coli CFT073
ucauuauuaauuu

SEQ ID NO: 639282 - RNA, 15 nt, Escherichia coli CFT073
ucauuauucauuuuu

SEQ ID NO: 639283 - RNA, 12 nt, Escherichia coli CFT073
ucauuauucccc

SEQ ID NO: 639284 - RNA, 22 nt, Escherichia coli CFT073
ucauucgcagcugcaguaccag

SEQ ID NO: 639285 - RNA, 16 nt, Escherichia coli CFT073
ucauucguccaggauu

SEQ ID NO: 639286 - RNA, 19 nt, Escherichia coli CFT073
ucauucguccaggauuuuc

SEQ ID NO: 639287 - RNA, 21 nt, Escherichia coli CFT073
ucauucccauaccuuucgcaa

SEQ ID NO: 639288 - RNA, 21 nt, Escherichia coli CFT073
ucauugaugcugccaucaucu

SEQ ID NO: 639289 - RNA, 12 nt, Escherichia coli CFT073
ucauugauuuuc

SEQ ID NO: 639290 - RNA, 17 nt, Escherichia coli CFT073
ucauugcaaucuccugu

SEQ ID NO: 639291 - RNA, 19 nt, Escherichia coli CFT073
ucauugccagcccuaaaaa

SEQ ID NO: 639292 - RNA, 18 nt, Escherichia coli CFT073
ucauuuuuagugaucacg

SEQ ID NO: 639293 - RNA, 22 nt, Escherichia coli CFT073
ucauuuuguaggccugauaaga

SEQ ID NO: 639294 - RNA, 22 nt, Escherichia coli CFT073
ucauuuugucgacaucaagaaa

SEQ ID NO: 639295 - RNA, 21 nt, Escherichia coli CFT073
ucauuuucuucagcaguucag

SEQ ID NO: 639296 - RNA, 23 nt, Escherichia coli CFT073
ucauuuggucggagauuugaaug

SEQ ID NO: 639297 - RNA, 20 nt, Escherichia coli CFT073
ucauuugcaccaggccgcgc

SEQ ID NO: 639298 - RNA, 16 nt, Escherichia coli CFT073
ucauuucauuuggaug

SEQ ID NO: 639299 - RNA, 21 nt, Escherichia coli CFT073
ucauuguugguuaaauaauau

SEQ ID NO: 639300 - RNA, 15 nt, Escherichia coli CFT073
ucauugcguuauagc

SEQ ID NO: 639301 - RNA, 15 nt, Escherichia coli CFT073
ucauugccugauguu

SEQ ID NO: 639302 - RNA, 23 nt, Escherichia coli CFT073
ucauugcuguuuuacagcugcuc

SEQ ID NO: 639303 - RNA, 15 nt, Escherichia coli CFT073
ucauuuuucucaacg

SEQ ID NO: 639304 - RNA, 15 nt, Escherichia coli CFT073
uccaacaauaaaaag

SEQ ID NO: 639305 - RNA, 18 nt, Escherichia coli CFT073
uccaacgaaucuuuaacc

SEQ ID NO: 639306 - RNA, 20 nt, Escherichia coli CFT073
uccaacauagcuaaaaauaa

SEQ ID NO: 639307 - RNA, 23 nt, Escherichia coli CFT073
uccaacauagcuaaaaauaauca

SEQ ID NO: 639308 - RNA, 19 nt, Escherichia coli CFT073
uccaacaguuccagcagcu

SEQ ID NO: 639309 - RNA, 14 nt, Escherichia coli CFT073
ucaugccaaaaaua

SEQ ID NO: 639310 - RNA, 18 nt, Escherichia coli CFT073
ucaugcaucgguuuugcg

SEQ ID NO: 639311 - RNA, 23 nt, Escherichia coli CFT073
ucaugcccugcccgcugccagga

SEQ ID NO: 639312 - RNA, 18 nt, Escherichia coli CFT073
ucaugccaaaaauaaucu

SEQ ID NO: 639313 - RNA, 20 nt, Escherichia coli CFT073
ucaugccgggcaaaagucac

SEQ ID NO: 639314 - RNA, 19 nt, Escherichia coli CFT073
ucaugcgggcgaggggaga

SEQ ID NO: 639315 - RNA, 20 nt, Escherichia coli CFT073
ucaugcgucaaaugcagggc

SEQ ID NO: 639316 - RNA, 15 nt, Escherichia coli CFT073
ucaugcgccagguaa

SEQ ID NO: 639317 - RNA, 22 nt, Escherichia coli CFT073
ucaugccggccagcgccaccac

SEQ ID NO: 639318 - RNA, 16 nt, Escherichia coli CFT073
ucaugcuauuccuuga

SEQ ID NO: 639319 - RNA, 20 nt, Escherichia coli CFT073
ucaugaagcaacucaccauu

SEQ ID NO: 639320 - RNA, 14 nt, Escherichia coli CFT073
ucaugaauaaaaaa

SEQ ID NO: 639321 - RNA, 15 nt, Escherichia coli CFT073
ucaugaacugggcua

SEQ ID NO: 639322 - RNA, 24 nt, Escherichia coli CFT073
ucaugaucguggcaauagagacaa

SEQ ID NO: 639323 - RNA, 16 nt, Escherichia coli CFT073
ucaugauggcgauacu

SEQ ID NO: 639324 - RNA, 16 nt, Escherichia coli CFT073
ucaugaugaugccaaa

SEQ ID NO: 639325 - RNA, 19 nt, Escherichia coli CFT073
ucaugaugaugccaaaaug

SEQ ID NO: 639326 - RNA, 13 nt, Escherichia coli CFT073
ucaugaccgugau

SEQ ID NO: 639327 - RNA, 14 nt, Escherichia coli CFT073
ucaucuguuuucaa

SEQ ID NO: 639328 - RNA, 23 nt, Escherichia coli CFT073
ucaucuguuuuccgucugucaaa

SEQ ID NO: 639329 - RNA, 15 nt, Escherichia coli CFT073
ucaucuucagucagg

SEQ ID NO: 639330 - RNA, 16 nt, Escherichia coli CFT073
ucaucuucauaacuuu

SEQ ID NO: 639331 - RNA, 15 nt, Escherichia coli CFT073
ucaucuucaucaucu

SEQ ID NO: 639332 - RNA, 11 nt, Escherichia coli CFT073
ucaucuuccag

SEQ ID NO: 639333 - RNA, 16 nt, Escherichia coli CFT073
ucaucuuccgggcaac

SEQ ID NO: 639334 - RNA, 13 nt, Escherichia coli CFT073
ucaucuucuucug

SEQ ID NO: 639335 - RNA, 15 nt, Escherichia coli CFT073
ucaucucugccuuga

SEQ ID NO: 639336 - RNA, 14 nt, Escherichia coli CFT073
ucaucucuucaaua

SEQ ID NO: 639337 - RNA, 15 nt, Escherichia coli CFT073
ucaucucuucaauau

SEQ ID NO: 639338 - RNA, 20 nt, Escherichia coli CFT073
ucaucugguuccuaaauaac

SEQ ID NO: 639339 - RNA, 16 nt, Escherichia coli CFT073
ucaucuguaagcaauu

SEQ ID NO: 639340 - RNA, 20 nt, Escherichia coli CFT073
ucaucugcgccacgaaaacc

SEQ ID NO: 639341 - RNA, 19 nt, Escherichia coli CFT073
ucaucggcaucuucuucug

SEQ ID NO: 639342 - RNA, 17 nt, Escherichia coli CFT073
ucaucggccacgcuuuc

SEQ ID NO: 639343 - RNA, 20 nt, Escherichia coli CFT073
ucaucgcuguggcagucacu

SEQ ID NO: 639344 - RNA, 16 nt, Escherichia coli CFT073
ucaucgggcguuuucu

SEQ ID NO: 639345 - RNA, 23 nt, Escherichia coli CFT073
ucaucggguugcugauuuuguug

SEQ ID NO: 639346 - RNA, 23 nt, Escherichia coli CFT073
ucaucggucagcgcagugacauu

SEQ ID NO: 639347 - RNA, 18 nt, Escherichia coli CFT073
ucaucggugguguaaccu

SEQ ID NO: 639348 - RNA, 14 nt, Escherichia coli CFT073
ucaucgguuaaccc

SEQ ID NO: 639349 - RNA, 21 nt, Escherichia coli CFT073
ucaucguaguaguucaucccc

SEQ ID NO: 639350 - RNA, 21 nt, Escherichia coli CFT073
ucaucgcaaugguucccggac

SEQ ID NO: 639351 - RNA, 13 nt, Escherichia coli CFT073
ucaucgcaaauga

SEQ ID NO: 639352 - RNA, 15 nt, Escherichia coli CFT073
ucaucgaugcugcuc

SEQ ID NO: 639353 - RNA, 18 nt, Escherichia coli CFT073
ucaucgccgucacgguaa

SEQ ID NO: 639354 - RNA, 15 nt, Escherichia coli CFT073
ucaucgccuucaucu

SEQ ID NO: 639355 - RNA, 17 nt, Escherichia coli CFT073
ucaucgcggcacacagc

SEQ ID NO: 639356 - RNA, 15 nt, Escherichia coli CFT073
ucaucgcuacaccaa

SEQ ID NO: 639357 - RNA, 19 nt, Escherichia coli CFT073
ucaucgcugacaugugauu

SEQ ID NO: 639358 - RNA, 16 nt, Escherichia coli CFT073
ucauccugacaggccc

SEQ ID NO: 639359 - RNA, 19 nt, Escherichia coli CFT073
ucauccugaugcuucagau

SEQ ID NO: 639360 - RNA, 12 nt, Escherichia coli CFT073
ucauccuucagu

SEQ ID NO: 639361 - RNA, 19 nt, Escherichia coli CFT073
ucaucgaacgggugauuuc

SEQ ID NO: 639362 - RNA, 14 nt, Escherichia coli CFT073
ucaucgagcagcau

SEQ ID NO: 639363 - RNA, 13 nt, Escherichia coli CFT073
ucaucgaauaaau

SEQ ID NO: 639364 - RNA, 14 nt, Escherichia coli CFT073
ucaucgaauaaauu

SEQ ID NO: 639365 - RNA, 19 nt, Escherichia coli CFT073
ucaucgaauaaauugagcu

SEQ ID NO: 639366 - RNA, 22 nt, Escherichia coli CFT073
ucaucgacauugaccagugcag

SEQ ID NO: 639367 - RNA, 13 nt, Escherichia coli CFT073
ucauccuguucau

SEQ ID NO: 639368 - RNA, 16 nt, Escherichia coli CFT073
ucauccagggugagga

SEQ ID NO: 639369 - RNA, 15 nt, Escherichia coli CFT073
ucauccagccuggaa

SEQ ID NO: 639370 - RNA, 13 nt, Escherichia coli CFT073
ucauccagcagcg

SEQ ID NO: 639371 - RNA, 22 nt, Escherichia coli CFT073
ucaucccaguccucaucauccu

SEQ ID NO: 639372 - RNA, 15 nt, Escherichia coli CFT073
ucauccccacaccug

SEQ ID NO: 639373 - RNA, 18 nt, Escherichia coli CFT073
ucauccauaccacagguc

SEQ ID NO: 639374 - RNA, 16 nt, Escherichia coli CFT073
ucaucccuacagguaa

SEQ ID NO: 639375 - RNA, 17 nt, Escherichia coli CFT073
ucaucccuuccugcccu

SEQ ID NO: 639376 - RNA, 15 nt, Escherichia coli CFT073
ucauccccucuucca

SEQ ID NO: 639377 - RNA, 16 nt, Escherichia coli CFT073
ucauccccucuuccau

SEQ ID NO: 639378 - RNA, 15 nt, Escherichia coli CFT073
ucauccgccaaaaca

SEQ ID NO: 639379 - RNA, 19 nt, Escherichia coli CFT073
ucauccggcacuuuuucau

SEQ ID NO: 639380 - RNA, 18 nt, Escherichia coli CFT073
ucauccggcuuucuucug

SEQ ID NO: 639381 - RNA, 21 nt, Escherichia coli CFT073
ucauccggcuuuuuuacauca

SEQ ID NO: 639382 - RNA, 18 nt, Escherichia coli CFT073
ucauccgguuauacguca

SEQ ID NO: 639383 - RNA, 18 nt, Escherichia coli CFT073
ucaucaugggcaagguau

SEQ ID NO: 639384 - RNA, 16 nt, Escherichia coli CFT073
ucaucaugcuuaaaua

SEQ ID NO: 639385 - RNA, 21 nt, Escherichia coli CFT073
ucaucagguugaggaacuucc

SEQ ID NO: 639386 - RNA, 23 nt, Escherichia coli CFT073
ucaucagguuggaucaacaggca

SEQ ID NO: 639387 - RNA, 19 nt, Escherichia coli CFT073
ucaucaguuccaguucauu

SEQ ID NO: 639388 - RNA, 20 nt, Escherichia coli CFT073
ucaucauacugauaauaaau

SEQ ID NO: 639389 - RNA, 14 nt, Escherichia coli CFT073
ucaucauauugucu

SEQ ID NO: 639390 - RNA, 14 nt, Escherichia coli CFT073
ucaucauccagcac

SEQ ID NO: 639391 - RNA, 13 nt, Escherichia coli CFT073
ucaucauccagca

SEQ ID NO: 639392 - RNA, 17 nt, Escherichia coli CFT073
ucaucaucacuuuuucc

SEQ ID NO: 639393 - RNA, 18 nt, Escherichia coli CFT073
ucaucaucacuuuuuccg

SEQ ID NO: 639394 - RNA, 17 nt, Escherichia coli CFT073
ucaucaucggcugcgcu

SEQ ID NO: 639395 - RNA, 23 nt, Escherichia coli CFT073
ucaucacuccccgcaacagugaa

SEQ ID NO: 639396 - RNA, 14 nt, Escherichia coli CFT073
ucaucacuugcucc

SEQ ID NO: 639397 - RNA, 17 nt, Escherichia coli CFT073
ucaucaggccugcauac

SEQ ID NO: 639398 - RNA, 16 nt, Escherichia coli CFT073
ucaucaauuaaugccu

SEQ ID NO: 639399 - RNA, 17 nt, Escherichia coli CFT073
ucaucaauuaaugccuu

SEQ ID NO: 639400 - RNA, 21 nt, Escherichia coli CFT073
ucaucaauugcgcaccagcuu

SEQ ID NO: 639401 - RNA, 16 nt, Escherichia coli CFT073
ucaucacaucccagca

SEQ ID NO: 639402 - RNA, 18 nt, Escherichia coli CFT073
ucaucacaucccagcaga

SEQ ID NO: 639403 - RNA, 21 nt, Escherichia coli CFT073
ucaucaccugcgcuggcaggc

SEQ ID NO: 639404 - RNA, 22 nt, Escherichia coli CFT073
ucaucacgcacugcaauauuau

SEQ ID NO: 639405 - RNA, 19 nt, Escherichia coli CFT073
ucaucacgcgguuacgcac

SEQ ID NO: 639406 - RNA, 12 nt, Escherichia coli CFT073
ucauauccagca

SEQ ID NO: 639407 - RNA, 15 nt, Escherichia coli CFT073
ucauaguuuuaccuu

SEQ ID NO: 639408 - RNA, 21 nt, Escherichia coli CFT073
ucauaugcaaugcaucuauag

SEQ ID NO: 639409 - RNA, 20 nt, Escherichia coli CFT073
ucauaugcuuuuuuaaaaac

SEQ ID NO: 639410 - RNA, 16 nt, Escherichia coli CFT073
ucauaucguagacaac

SEQ ID NO: 639411 - RNA, 23 nt, Escherichia coli CFT073
ucauaucuucaggccaauucacu

SEQ ID NO: 639412 - RNA, 13 nt, Escherichia coli CFT073
ucaucaaagccaa

SEQ ID NO: 639413 - RNA, 18 nt, Escherichia coli CFT073
ucaucaaaaucaucauug

SEQ ID NO: 639414 - RNA, 21 nt, Escherichia coli CFT073
ucaucaauacccgguccuuca

SEQ ID NO: 639415 - RNA, 21 nt, Escherichia coli CFT073
ucaucaaguuacgauaaucag

SEQ ID NO: 639416 - RNA, 20 nt, Escherichia coli CFT073
ucaucaauggauucaugaua

SEQ ID NO: 639417 - RNA, 18 nt, Escherichia coli CFT073
ucaucaagcugugccuga

SEQ ID NO: 639418 - RNA, 22 nt, Escherichia coli CFT073
ucaucaacugacuauccuggac

SEQ ID NO: 639419 - RNA, 17 nt, Escherichia coli CFT073
ucaucaaaaucaucauu

SEQ ID NO: 639420 - RNA, 13 nt, Escherichia coli CFT073
ucauauuuuuucc

SEQ ID NO: 639421 - RNA, 14 nt, Escherichia coli CFT073
ucauauuuuuuccc

SEQ ID NO: 639422 - RNA, 14 nt, Escherichia coli CFT073
ucauauuuaagccu

SEQ ID NO: 639423 - RNA, 16 nt, Escherichia coli CFT073
ucauacacgccgccua

SEQ ID NO: 639424 - RNA, 18 nt, Escherichia coli CFT073
ucauaauuauaauaaaua

SEQ ID NO: 639425 - RNA, 21 nt, Escherichia coli CFT073
ucauacagaugcugcucuuca

SEQ ID NO: 639426 - RNA, 20 nt, Escherichia coli CFT073
ucauacaggcggaaacguaa

SEQ ID NO: 639427 - RNA, 17 nt, Escherichia coli CFT073
ucauaauaugaccugac

SEQ ID NO: 639428 - RNA, 14 nt, Escherichia coli CFT073
ucauaagcgauacc

SEQ ID NO: 639429 - RNA, 16 nt, Escherichia coli CFT073
ucauaggcuuccacuu

SEQ ID NO: 639430 - RNA, 18 nt, Escherichia coli CFT073
ucauaggucauuggcgua

SEQ ID NO: 639431 - RNA, 19 nt, Escherichia coli CFT073
ucauagcaauaaaugccug

SEQ ID NO: 639432 - RNA, 15 nt, Escherichia coli CFT073
ucauagcacauccug

SEQ ID NO: 639433 - RNA, 16 nt, Escherichia coli CFT073
ucauagcacauccuga

SEQ ID NO: 639434 - RNA, 13 nt, Escherichia coli CFT073
ucauagaauaaag

SEQ ID NO: 639435 - RNA, 13 nt, Escherichia coli CFT073
ucauagaccauug

SEQ ID NO: 639436 - RNA, 19 nt, Escherichia coli CFT073
ucauacugagcaaggcaua

SEQ ID NO: 639437 - RNA, 17 nt, Escherichia coli CFT073
ucauacggcccuucgau

SEQ ID NO: 639438 - RNA, 15 nt, Escherichia coli CFT073
ucaguaccagcaccu

SEQ ID NO: 639439 - RNA, 16 nt, Escherichia coli CFT073
ucaguaccagcccgcc

SEQ ID NO: 639440 - RNA, 18 nt, Escherichia coli CFT073
ucaguacguuaucaccga

SEQ ID NO: 639441 - RNA, 19 nt, Escherichia coli CFT073
ucaguagcaguaauuuaua

SEQ ID NO: 639442 - RNA, 16 nt, Escherichia coli CFT073
ucaguagcaugaacau

SEQ ID NO: 639443 - RNA, 22 nt, Escherichia coli CFT073
ucaguagcgcaauaaccaccac

SEQ ID NO: 639444 - RNA, 13 nt, Escherichia coli CFT073
ucaguaugcaguc

SEQ ID NO: 639445 - RNA, 20 nt, Escherichia coli CFT073
ucaguauauugcagaaaucc

SEQ ID NO: 639446 - RNA, 20 nt, Escherichia coli CFT073
ucagguuuuucagcugccca

SEQ ID NO: 639447 - RNA, 21 nt, Escherichia coli CFT073
ucagguuuaaugguuugcccu

SEQ ID NO: 639448 - RNA, 20 nt, Escherichia coli CFT073
ucagguucugaccagccagc

SEQ ID NO: 639449 - RNA, 19 nt, Escherichia coli CFT073
ucaguaaugaucugaucaa

SEQ ID NO: 639450 - RNA, 19 nt, Escherichia coli CFT073
ucaguguccagaugcugua

SEQ ID NO: 639451 - RNA, 21 nt, Escherichia coli CFT073
ucagugaaucucaggcaaaua

SEQ ID NO: 639452 - RNA, 19 nt, Escherichia coli CFT073
ucagugacugcuuuuucaa

SEQ ID NO: 639453 - RNA, 16 nt, Escherichia coli CFT073
ucagucuuaagcggcu

SEQ ID NO: 639454 - RNA, 16 nt, Escherichia coli CFT073
ucagucgcaucuucac

SEQ ID NO: 639455 - RNA, 18 nt, Escherichia coli CFT073
ucagucgguucaaccauc

SEQ ID NO: 639456 - RNA, 12 nt, Escherichia coli CFT073
ucagucagcagu

SEQ ID NO: 639457 - RNA, 15 nt, Escherichia coli CFT073
ucaguauugagcaac

SEQ ID NO: 639458 - RNA, 13 nt, Escherichia coli CFT073
ucagucacagggg

SEQ ID NO: 639459 - RNA, 23 nt, Escherichia coli CFT073
ucaguuguaugucauaaaaauga

SEQ ID NO: 639460 - RNA, 12 nt, Escherichia coli CFT073
ucaguuguuccg

SEQ ID NO: 639461 - RNA, 13 nt, Escherichia coli CFT073
ucaguuuccagca

SEQ ID NO: 639462 - RNA, 17 nt, Escherichia coli CFT073
ucaguuucgaucagcaa

SEQ ID NO: 639463 - RNA, 22 nt, Escherichia coli CFT073
ucaguuucgcauccagagauuu

SEQ ID NO: 639464 - RNA, 15 nt, Escherichia coli CFT073
ucaguuuaucaaucu

SEQ ID NO: 639465 - RNA, 17 nt, Escherichia coli CFT073
ucaguugcaccugaucc

SEQ ID NO: 639466 - RNA, 19 nt, Escherichia coli CFT073
ucaguucgucacaguuaac

SEQ ID NO: 639467 - RNA, 20 nt, Escherichia coli CFT073
ucaguucgcuuaacaguucc

SEQ ID NO: 639468 - RNA, 15 nt, Escherichia coli CFT073
ucaguuacucugcaa

SEQ ID NO: 639469 - RNA, 21 nt, Escherichia coli CFT073
ucaguuccugaucgauaaauu

SEQ ID NO: 639470 - RNA, 18 nt, Escherichia coli CFT073
ucaguuccgggaucacca

SEQ ID NO: 639471 - RNA, 20 nt, Escherichia coli CFT073
ucaguucaucuacuacugga

SEQ ID NO: 639472 - RNA, 15 nt, Escherichia coli CFT073
ucauaaccaaugugg

SEQ ID NO: 639473 - RNA, 17 nt, Escherichia coli CFT073
ucauaaccuguuccuua

SEQ ID NO: 639474 - RNA, 23 nt, Escherichia coli CFT073
ucauaaauacagagcacgcaagg

SEQ ID NO: 639475 - RNA, 18 nt, Escherichia coli CFT073
ucauaaaaauauauuccu

SEQ ID NO: 639476 - RNA, 18 nt, Escherichia coli CFT073
ucauaaaaaucaaaugcu

SEQ ID NO: 639477 - RNA, 15 nt, Escherichia coli CFT073
ucaguuugcgggaca

SEQ ID NO: 639478 - RNA, 22 nt, Escherichia coli CFT073
ucaggcacuucuuccgccagca

SEQ ID NO: 639479 - RNA, 13 nt, Escherichia coli CFT073
ucaggcagaacac

SEQ ID NO: 639480 - RNA, 18 nt, Escherichia coli CFT073
ucaggcagaacaccggca

SEQ ID NO: 639481 - RNA, 22 nt, Escherichia coli CFT073
ucaggcagaacaccggcagcgg

SEQ ID NO: 639482 - RNA, 21 nt, Escherichia coli CFT073
ucaggcagaacgccaugccaa

SEQ ID NO: 639483 - RNA, 12 nt, Escherichia coli CFT073
ucaggcaacaaa

SEQ ID NO: 639484 - RNA, 17 nt, Escherichia coli CFT073
ucaggcaacaaaaaacc

SEQ ID NO: 639485 - RNA, 17 nt, Escherichia coli CFT073
ucaggcaacccagaaga

SEQ ID NO: 639486 - RNA, 21 nt, Escherichia coli CFT073
ucaggcaacccgcacaaggcu

SEQ ID NO: 639487 - RNA, 17 nt, Escherichia coli CFT073
ucaggcagucgugccca

SEQ ID NO: 639488 - RNA, 22 nt, Escherichia coli CFT073
ucaggcagauacaaccaaucgc

SEQ ID NO: 639489 - RNA, 20 nt, Escherichia coli CFT073
ucaggcaucgugcaccaauu

SEQ ID NO: 639490 - RNA, 18 nt, Escherichia coli CFT073
ucaggauaaacuccugca

SEQ ID NO: 639491 - RNA, 14 nt, Escherichia coli CFT073
ucaggaucaagcug

SEQ ID NO: 639492 - RNA, 21 nt, Escherichia coli CFT073
ucaggaucaccaauaccagca

SEQ ID NO: 639493 - RNA, 21 nt, Escherichia coli CFT073
ucaggaucaucauuguugguu

SEQ ID NO: 639494 - RNA, 20 nt, Escherichia coli CFT073
ucaggcauucucgaauuaau

SEQ ID NO: 639495 - RNA, 19 nt, Escherichia coli CFT073
ucaggccaaucaaacccac

SEQ ID NO: 639496 - RNA, 12 nt, Escherichia coli CFT073
ucaggccaccuc

SEQ ID NO: 639497 - RNA, 15 nt, Escherichia coli CFT073
ucaggcauugugucu

SEQ ID NO: 639498 - RNA, 21 nt, Escherichia coli CFT073
ucaggccaacauccaucagcg

SEQ ID NO: 639499 - RNA, 13 nt, Escherichia coli CFT073
ucaggccaaggcc

SEQ ID NO: 639500 - RNA, 20 nt, Escherichia coli CFT073
ucaggcccgcguagagaaaa

SEQ ID NO: 639501 - RNA, 20 nt, Escherichia coli CFT073
ucaggccaggcgugaaucac

SEQ ID NO: 639502 - RNA, 15 nt, Escherichia coli CFT073
ucaggccggaauaac

SEQ ID NO: 639503 - RNA, 23 nt, Escherichia coli CFT073
ucaggcgagucgagaucccuucc

SEQ ID NO: 639504 - RNA, 13 nt, Escherichia coli CFT073
ucaggccuacaua

SEQ ID NO: 639505 - RNA, 13 nt, Escherichia coli CFT073
ucaggccugcaua

SEQ ID NO: 639506 - RNA, 20 nt, Escherichia coli CFT073
ucagggagcggaauugcgca

SEQ ID NO: 639507 - RNA, 13 nt, Escherichia coli CFT073
ucagggccaucau

SEQ ID NO: 639508 - RNA, 16 nt, Escherichia coli CFT073
ucaggggcauuuucca

SEQ ID NO: 639509 - RNA, 18 nt, Escherichia coli CFT073
ucaggggcauuuuccagu

SEQ ID NO: 639510 - RNA, 19 nt, Escherichia coli CFT073
ucagggcgcacgcacggcg

SEQ ID NO: 639511 - RNA, 15 nt, Escherichia coli CFT073
ucagggcggcuaucc

SEQ ID NO: 639512 - RNA, 22 nt, Escherichia coli CFT073
ucagggcggcuaucccaaagcu

SEQ ID NO: 639513 - RNA, 16 nt, Escherichia coli CFT073
ucagggccugcgugug

SEQ ID NO: 639514 - RNA, 17 nt, Escherichia coli CFT073
ucagggagaacucaucu

SEQ ID NO: 639515 - RNA, 20 nt, Escherichia coli CFT073
ucaggcugaggcguuucaac

SEQ ID NO: 639516 - RNA, 20 nt, Escherichia coli CFT073
ucaggcguuucuucacccuu

SEQ ID NO: 639517 - RNA, 23 nt, Escherichia coli CFT073
ucaggucuuucugaaaugggcca

SEQ ID NO: 639518 - RNA, 19 nt, Escherichia coli CFT073
ucagguggccaaauucagu

SEQ ID NO: 639519 - RNA, 13 nt, Escherichia coli CFT073
ucagguggcggua

SEQ ID NO: 639520 - RNA, 21 nt, Escherichia coli CFT073
ucagguuacgcccuuccccca

SEQ ID NO: 639521 - RNA, 14 nt, Escherichia coli CFT073
ucagguguaauaaa

SEQ ID NO: 639522 - RNA, 13 nt, Escherichia coli CFT073
ucaggucaucacu

SEQ ID NO: 639523 - RNA, 14 nt, Escherichia coli CFT073
ucagguaacaggga

SEQ ID NO: 639524 - RNA, 15 nt, Escherichia coli CFT073
ucagguaacagggaa

SEQ ID NO: 639525 - RNA, 20 nt, Escherichia coli CFT073
ucagguaagcgauaaaaaua

SEQ ID NO: 639526 - RNA, 17 nt, Escherichia coli CFT073
ucagguaacagggaacu

SEQ ID NO: 639527 - RNA, 18 nt, Escherichia coli CFT073
ucaggggcuuccagcaaa

SEQ ID NO: 639528 - RNA, 15 nt, Escherichia coli CFT073
ucagcuuauccagca

SEQ ID NO: 639529 - RNA, 13 nt, Escherichia coli CFT073
ucagcugccaggg

SEQ ID NO: 639530 - RNA, 19 nt, Escherichia coli CFT073
ucagcuccacaagaaugcc

SEQ ID NO: 639531 - RNA, 15 nt, Escherichia coli CFT073
ucagcuccgguauac

SEQ ID NO: 639532 - RNA, 17 nt, Escherichia coli CFT073
ucagcuaacaaaaauau

SEQ ID NO: 639533 - RNA, 20 nt, Escherichia coli CFT073
ucagcucauaggccugcuga

SEQ ID NO: 639534 - RNA, 17 nt, Escherichia coli CFT073
ucaggaagaagcccauc

SEQ ID NO: 639535 - RNA, 20 nt, Escherichia coli CFT073
ucaggaagaagcccaucagu

SEQ ID NO: 639536 - RNA, 22 nt, Escherichia coli CFT073
ucaggaaccacaaccacuuugu

SEQ ID NO: 639537 - RNA, 14 nt, Escherichia coli CFT073
ucaggaauaagaca

SEQ ID NO: 639538 - RNA, 15 nt, Escherichia coli CFT073
ucaggaauaagacag

SEQ ID NO: 639539 - RNA, 12 nt, Escherichia coli CFT073
ucaggacccuca

SEQ ID NO: 639540 - RNA, 18 nt, Escherichia coli CFT073
ucaggacgaauacaagaa

SEQ ID NO: 639541 - RNA, 22 nt, Escherichia coli CFT073
ucagcuucggcgacuauuucaa

SEQ ID NO: 639542 - RNA, 18 nt, Escherichia coli CFT073
ucagcuuucgcaucagcu

SEQ ID NO: 639543 - RNA, 12 nt, Escherichia coli CFT073
ucaggaaauaaa

SEQ ID NO: 639544 - RNA, 20 nt, Escherichia coli CFT073
ucagcggcguaucuuccagg

SEQ ID NO: 639545 - RNA, 14 nt, Escherichia coli CFT073
ucagcguuccccag

SEQ ID NO: 639546 - RNA, 12 nt, Escherichia coli CFT073
ucagcguggcga

SEQ ID NO: 639547 - RNA, 16 nt, Escherichia coli CFT073
ucagcgugaggguuuc

SEQ ID NO: 639548 - RNA, 12 nt, Escherichia coli CFT073
ucagcgugccca

SEQ ID NO: 639549 - RNA, 17 nt, Escherichia coli CFT073
ucagcggucaccggaac

SEQ ID NO: 639550 - RNA, 19 nt, Escherichia coli CFT073
ucagcgguggugaaaagag

SEQ ID NO: 639551 - RNA, 14 nt, Escherichia coli CFT073
ucagcgguuuugcc

SEQ ID NO: 639552 - RNA, 21 nt, Escherichia coli CFT073
ucagcgucgccagcagcucac

SEQ ID NO: 639553 - RNA, 14 nt, Escherichia coli CFT073
uaucuucaaucaga

SEQ ID NO: 639554 - RNA, 10 nt, Escherichia coli CFT073
uaucuucaca

SEQ ID NO: 639555 - RNA, 18 nt, Escherichia coli CFT073
uaucuucaaucagaugug

SEQ ID NO: 639556 - RNA, 23 nt, Escherichia coli CFT073
uaucuucauccgccccggcuuca

SEQ ID NO: 639557 - RNA, 18 nt, Escherichia coli CFT073
uaucuuccagcauuucca

SEQ ID NO: 639558 - RNA, 15 nt, Escherichia coli CFT073
uaucuucccagccca

SEQ ID NO: 639559 - RNA, 14 nt, Escherichia coli CFT073
ucagcgcagcgcga

SEQ ID NO: 639560 - RNA, 13 nt, Escherichia coli CFT073
ucagcgcagcacc

SEQ ID NO: 639561 - RNA, 19 nt, Escherichia coli CFT073
uaucuuccguauuugucuc

SEQ ID NO: 639562 - RNA, 19 nt, Escherichia coli CFT073
uaucuucgauaaacucaau

SEQ ID NO: 639563 - RNA, 13 nt, Escherichia coli CFT073
ucagcgcaccaca

SEQ ID NO: 639564 - RNA, 17 nt, Escherichia coli CFT073
ucagcgcaccacacauc

SEQ ID NO: 639565 - RNA, 13 nt, Escherichia coli CFT073
ucagcgcaccaua

SEQ ID NO: 639566 - RNA, 13 nt, Escherichia coli CFT073
ucagcgcaugauu

SEQ ID NO: 639567 - RNA, 20 nt, Escherichia coli CFT073
ucagcgccacggaaacauuc

SEQ ID NO: 639568 - RNA, 15 nt, Escherichia coli CFT073
ucagcgccacaucag

SEQ ID NO: 639569 - RNA, 13 nt, Escherichia coli CFT073
ucagcgccaccac

SEQ ID NO: 639570 - RNA, 19 nt, Escherichia coli CFT073
ucagcgccaucgccaggaa

SEQ ID NO: 639571 - RNA, 18 nt, Escherichia coli CFT073
ucagcgccagcgcggaag

SEQ ID NO: 639572 - RNA, 15 nt, Escherichia coli CFT073
ucagcgccugcugca

SEQ ID NO: 639573 - RNA, 20 nt, Escherichia coli CFT073
ucagcgcggaacaagucggc

SEQ ID NO: 639574 - RNA, 18 nt, Escherichia coli CFT073
uccacaagaaugccugcc

SEQ ID NO: 639575 - RNA, 17 nt, Escherichia coli CFT073
uccacaauaccaaucgc

SEQ ID NO: 639576 - RNA, 20 nt, Escherichia coli CFT073
uccacaauaccaaucgcagg

SEQ ID NO: 639577 - RNA, 17 nt, Escherichia coli CFT073
uccacaacgugggccag

SEQ ID NO: 639578 - RNA, 20 nt, Escherichia coli CFT073
uccacaacccgugagucucc

SEQ ID NO: 639579 - RNA, 11 nt, Escherichia coli CFT073
uccacaaaccg

SEQ ID NO: 639580 - RNA, 11 nt, Escherichia coli CFT073
uccaaugguca

SEQ ID NO: 639581 - RNA, 13 nt, Escherichia coli CFT073
uccaauaaaaauc

SEQ ID NO: 639582 - RNA, 17 nt, Escherichia coli CFT073
uccaauaaaaaucagau

SEQ ID NO: 639583 - RNA, 16 nt, Escherichia coli CFT073
uccaauaaaucccaga

SEQ ID NO: 639584 - RNA, 23 nt, Escherichia coli CFT073
uccaagaugggccagcacguugu

SEQ ID NO: 639585 - RNA, 20 nt, Escherichia coli CFT073
uccaacuuuucccagcgcga

SEQ ID NO: 639586 - RNA, 16 nt, Escherichia coli CFT073
uccaacucuuuuacca

SEQ ID NO: 639587 - RNA, 17 nt, Escherichia coli CFT073
uccacaccaaaauaacg

SEQ ID NO: 639588 - RNA, 15 nt, Escherichia coli CFT073
uccacaccacuucau

SEQ ID NO: 639589 - RNA, 17 nt, Escherichia coli CFT073
uccacacgcgcccagcc

SEQ ID NO: 639590 - RNA, 19 nt, Escherichia coli CFT073
uccacaccuacgcccgcca

SEQ ID NO: 639591 - RNA, 19 nt, Escherichia coli CFT073
uccacagaguguauucaug

SEQ ID NO: 639592 - RNA, 18 nt, Escherichia coli CFT073
uccaccaccgcaaaauag

SEQ ID NO: 639593 - RNA, 12 nt, Escherichia coli CFT073
uccaccacuucc

SEQ ID NO: 639594 - RNA, 14 nt, Escherichia coli CFT073
uccaccagcggcug

SEQ ID NO: 639595 - RNA, 13 nt, Escherichia coli CFT073
uccaccagcggcu

SEQ ID NO: 639596 - RNA, 16 nt, Escherichia coli CFT073
uccaccagauggcuuu

SEQ ID NO: 639597 - RNA, 20 nt, Escherichia coli CFT073
uccaccagaccuuccgcagg

SEQ ID NO: 639598 - RNA, 10 nt, Escherichia coli CFT073
uccaccagug

SEQ ID NO: 639599 - RNA, 22 nt, Escherichia coli CFT073
uccaccgcuacguucgcgagga

SEQ ID NO: 639600 - RNA, 14 nt, Escherichia coli CFT073
uccaccguauccag

SEQ ID NO: 639601 - RNA, 20 nt, Escherichia coli CFT073
uccaccguaagaucgcgcca

SEQ ID NO: 639602 - RNA, 18 nt, Escherichia coli CFT073
uccaccguuggcagauaa

SEQ ID NO: 639603 - RNA, 18 nt, Escherichia coli CFT073
uccaccguugugaaaaua

SEQ ID NO: 639604 - RNA, 20 nt, Escherichia coli CFT073
uccaccgaaagcacuguucg

SEQ ID NO: 639605 - RNA, 23 nt, Escherichia coli CFT073
uccaccgagccaaacucauccac

SEQ ID NO: 639606 - RNA, 23 nt, Escherichia coli CFT073
uccacuuugcuuucagauucagu

SEQ ID NO: 639607 - RNA, 21 nt, Escherichia coli CFT073
uccacuucugcacgguuuuuc

SEQ ID NO: 639608 - RNA, 13 nt, Escherichia coli CFT073
uccacuggcaccc

SEQ ID NO: 639609 - RNA, 19 nt, Escherichia coli CFT073
uccacugguuaacgcgcca

SEQ ID NO: 639610 - RNA, 21 nt, Escherichia coli CFT073
uccacuuccaccacuuccugc

SEQ ID NO: 639611 - RNA, 21 nt, Escherichia coli CFT073
uccacuuccgcgucaaucugc

SEQ ID NO: 639612 - RNA, 21 nt, Escherichia coli CFT073
uccacuacgcuguagccgcca

SEQ ID NO: 639613 - RNA, 16 nt, Escherichia coli CFT073
uccacguuccagaucu

SEQ ID NO: 639614 - RNA, 14 nt, Escherichia coli CFT073
uccacguuccccag

SEQ ID NO: 639615 - RNA, 18 nt, Escherichia coli CFT073
uccacugcgcauaaucca

SEQ ID NO: 639616 - RNA, 17 nt, Escherichia coli CFT073
uccacugcucaccgcaa

SEQ ID NO: 639617 - RNA, 18 nt, Escherichia coli CFT073
uccacugaauagugccgc

SEQ ID NO: 639618 - RNA, 12 nt, Escherichia coli CFT073
uccacugcagaa

SEQ ID NO: 639619 - RNA, 13 nt, Escherichia coli CFT073
uccacucuuucag

SEQ ID NO: 639620 - RNA, 22 nt, Escherichia coli CFT073
uccacucacacagcuuucucaa

SEQ ID NO: 639621 - RNA, 21 nt, Escherichia coli CFT073
uccacuccagucuuuuaaccg

SEQ ID NO: 639622 - RNA, 13 nt, Escherichia coli CFT073
uccacggcaucuu

SEQ ID NO: 639623 - RNA, 20 nt, Escherichia coli CFT073
uccacggcugcggccaaaaa

SEQ ID NO: 639624 - RNA, 19 nt, Escherichia coli CFT073
uccacggggacuccacacc

SEQ ID NO: 639625 - RNA, 15 nt, Escherichia coli CFT073
uccacgguucuccac

SEQ ID NO: 639626 - RNA, 16 nt, Escherichia coli CFT073
uccacgguucuccacu

SEQ ID NO: 639627 - RNA, 22 nt, Escherichia coli CFT073
uccacgcuaugugcuucaucag

SEQ ID NO: 639628 - RNA, 23 nt, Escherichia coli CFT073
uccacgcuaugugcuucaucagg

SEQ ID NO: 639629 - RNA, 20 nt, Escherichia coli CFT073
uccacgcuauacagcagcca

SEQ ID NO: 639630 - RNA, 19 nt, Escherichia coli CFT073
uccacgcuauacagcagcc

SEQ ID NO: 639631 - RNA, 23 nt, Escherichia coli CFT073
uccacgcggguuuaccacggcuu

SEQ ID NO: 639632 - RNA, 21 nt, Escherichia coli CFT073
uccacgccgcugucuaccagc

SEQ ID NO: 639633 - RNA, 22 nt, Escherichia coli CFT073
uccacgccguuuuuacccagca

SEQ ID NO: 639634 - RNA, 20 nt, Escherichia coli CFT073
uccagauauucauagagaag

SEQ ID NO: 639635 - RNA, 23 nt, Escherichia coli CFT073
uccagauaaaacaucucuuccca

SEQ ID NO: 639636 - RNA, 20 nt, Escherichia coli CFT073
uccagacggagcugccaggc

SEQ ID NO: 639637 - RNA, 21 nt, Escherichia coli CFT073
uccagacgggucauaaucaga

SEQ ID NO: 639638 - RNA, 18 nt, Escherichia coli CFT073
uccagaagcgguuugccg

SEQ ID NO: 639639 - RNA, 19 nt, Escherichia coli CFT073
uccagaaugccucaaucag

SEQ ID NO: 639640 - RNA, 16 nt, Escherichia coli CFT073
uccagaauuccgugcc

SEQ ID NO: 639641 - RNA, 23 nt, Escherichia coli CFT073
uccagaauuccgugccagcacca

SEQ ID NO: 639642 - RNA, 19 nt, Escherichia coli CFT073
uccagcaacaacagcgcga

SEQ ID NO: 639643 - RNA, 14 nt, Escherichia coli CFT073
uccagcaacaacag

SEQ ID NO: 639644 - RNA, 22 nt, Escherichia coli CFT073
uccagcaacguuucgcuggaug

SEQ ID NO: 639645 - RNA, 17 nt, Escherichia coli CFT073
uccagcacacuguaagc

SEQ ID NO: 639646 - RNA, 22 nt, Escherichia coli CFT073
uccagauucaguuucaccgcgu

SEQ ID NO: 639647 - RNA, 19 nt, Escherichia coli CFT073
uccagcacgaagaggccgc

SEQ ID NO: 639648 - RNA, 14 nt, Escherichia coli CFT073
uccagcaccaguuc

SEQ ID NO: 639649 - RNA, 17 nt, Escherichia coli CFT073
uccagcagauucaacau

SEQ ID NO: 639650 - RNA, 17 nt, Escherichia coli CFT073
uccagcacggugaagaa

SEQ ID NO: 639651 - RNA, 17 nt, Escherichia coli CFT073
uccagcauaaugacucu

SEQ ID NO: 639652 - RNA, 21 nt, Escherichia coli CFT073
uccagcaucacaucaaauccc

SEQ ID NO: 639653 - RNA, 18 nt, Escherichia coli CFT073
uccagcauaguacgggca

SEQ ID NO: 639654 - RNA, 17 nt, Escherichia coli CFT073
uccagcaucgaccagga

SEQ ID NO: 639655 - RNA, 14 nt, Escherichia coli CFT073
uccagcaucgccac

SEQ ID NO: 639656 - RNA, 16 nt, Escherichia coli CFT073
uccagcaucuccugca

SEQ ID NO: 639657 - RNA, 16 nt, Escherichia coli CFT073
uccagcaucuguucuu

SEQ ID NO: 639658 - RNA, 13 nt, Escherichia coli CFT073
uccagcaggaagc

SEQ ID NO: 639659 - RNA, 16 nt, Escherichia coli CFT073
uccagccccaccagca

SEQ ID NO: 639660 - RNA, 17 nt, Escherichia coli CFT073
uccagcaugcucacuac

SEQ ID NO: 639661 - RNA, 12 nt, Escherichia coli CFT073
uccagccacugc

SEQ ID NO: 639662 - RNA, 19 nt, Escherichia coli CFT073
uccagccaucaaucccauc

SEQ ID NO: 639663 - RNA, 14 nt, Escherichia coli CFT073
uccagccucugucu

SEQ ID NO: 639664 - RNA, 12 nt, Escherichia coli CFT073
uccagccgguaa

SEQ ID NO: 639665 - RNA, 14 nt, Escherichia coli CFT073
uccagcgauaauga

SEQ ID NO: 639666 - RNA, 21 nt, Escherichia coli CFT073
uccagccuggaauuucuucgg

SEQ ID NO: 639667 - RNA, 16 nt, Escherichia coli CFT073
uccagcgacuccaguu

SEQ ID NO: 639668 - RNA, 16 nt, Escherichia coli CFT073
uccagcgcaucgaucu

SEQ ID NO: 639669 - RNA, 16 nt, Escherichia coli CFT073
uccagcgcguuuguca

SEQ ID NO: 639670 - RNA, 19 nt, Escherichia coli CFT073
uccagcgcguuugucagca

SEQ ID NO: 639671 - RNA, 17 nt, Escherichia coli CFT073
uccagcggccagacacc

SEQ ID NO: 639672 - RNA, 22 nt, Escherichia coli CFT073
uccagcggccagacaccggcuu

SEQ ID NO: 639673 - RNA, 23 nt, Escherichia coli CFT073
uccagcgccuggcgaaucgccug

SEQ ID NO: 639674 - RNA, 18 nt, Escherichia coli CFT073
uccagcgccaguaauucu

SEQ ID NO: 639675 - RNA, 23 nt, Escherichia coli CFT073
uccaggacuggcgauaucaauau

SEQ ID NO: 639676 - RNA, 17 nt, Escherichia coli CFT073
uccaggagggguuuuug

SEQ ID NO: 639677 - RNA, 19 nt, Escherichia coli CFT073
uccaggauuuucuacgcug

SEQ ID NO: 639678 - RNA, 22 nt, Escherichia coli CFT073
uccaggcuggucgcgcggaagu

SEQ ID NO: 639679 - RNA, 16 nt, Escherichia coli CFT073
uccagggccaguacac

SEQ ID NO: 639680 - RNA, 22 nt, Escherichia coli CFT073
uccagggccaguacacaauccu

SEQ ID NO: 639681 - RNA, 19 nt, Escherichia coli CFT073
uccagcuuaacauccccau

SEQ ID NO: 639682 - RNA, 20 nt, Escherichia coli CFT073
uccagcuuaauucuguccuc

SEQ ID NO: 639683 - RNA, 17 nt, Escherichia coli CFT073
uccagcuucagauuagc

SEQ ID NO: 639684 - RNA, 16 nt, Escherichia coli CFT073
uccagcuucagauuca

SEQ ID NO: 639685 - RNA, 13 nt, Escherichia coli CFT073
uccagcugccugc

SEQ ID NO: 639686 - RNA, 21 nt, Escherichia coli CFT073
uccagcuccagccgcuccccu

SEQ ID NO: 639687 - RNA, 17 nt, Escherichia coli CFT073
uccagcucacugauaau

SEQ ID NO: 639688 - RNA, 15 nt, Escherichia coli CFT073
uccagcuccguccag

SEQ ID NO: 639689 - RNA, 17 nt, Escherichia coli CFT073
uccagcuccguccagcc

SEQ ID NO: 639690 - RNA, 18 nt, Escherichia coli CFT073
uccagcuaaccauccaca

SEQ ID NO: 639691 - RNA, 21 nt, Escherichia coli CFT073
uccagcucaagugccagauca

SEQ ID NO: 639692 - RNA, 15 nt, Escherichia coli CFT073
uccagcgucuccaga

SEQ ID NO: 639693 - RNA, 21 nt, Escherichia coli CFT073
uccagcguuaauuuccucuuc

SEQ ID NO: 639694 - RNA, 16 nt, Escherichia coli CFT073
uccagcguuaccggcu

SEQ ID NO: 639695 - RNA, 17 nt, Escherichia coli CFT073
uccagcguucccuuccc

SEQ ID NO: 639696 - RNA, 19 nt, Escherichia coli CFT073
uccagcgguuguagccacg

SEQ ID NO: 639697 - RNA, 23 nt, Escherichia coli CFT073
uccagugaaacgcgacuuaaacc

SEQ ID NO: 639698 - RNA, 15 nt, Escherichia coli CFT073
uccagucgcugcuga

SEQ ID NO: 639699 - RNA, 23 nt, Escherichia coli CFT073
uccagugacauacucucuccauu

SEQ ID NO: 639700 - RNA, 17 nt, Escherichia coli CFT073
uccagugauuccagucg

SEQ ID NO: 639701 - RNA, 13 nt, Escherichia coli CFT073
uccagugauuguc

SEQ ID NO: 639702 - RNA, 15 nt, Escherichia coli CFT073
uccagugauuguccu

SEQ ID NO: 639703 - RNA, 21 nt, Escherichia coli CFT073
uccagugcaacuuuacuaaaa

SEQ ID NO: 639704 - RNA, 12 nt, Escherichia coli CFT073
uccagugcacca

SEQ ID NO: 639705 - RNA, 17 nt, Escherichia coli CFT073
uccaguuucgagaaauu

SEQ ID NO: 639706 - RNA, 15 nt, Escherichia coli CFT073
uccaguuuauaucuu

SEQ ID NO: 639707 - RNA, 17 nt, Escherichia coli CFT073
uccaguuuauggaacaa

SEQ ID NO: 639708 - RNA, 13 nt, Escherichia coli CFT073
uccaguuguuuuu

SEQ ID NO: 639709 - RNA, 15 nt, Escherichia coli CFT073
uccaguugaagcugg

SEQ ID NO: 639710 - RNA, 20 nt, Escherichia coli CFT073
uccaguugaagcuggcagaa

SEQ ID NO: 639711 - RNA, 14 nt, Escherichia coli CFT073
uccaguugauacag

SEQ ID NO: 639712 - RNA, 14 nt, Escherichia coli CFT073
uccaguugcauaca

SEQ ID NO: 639713 - RNA, 20 nt, Escherichia coli CFT073
uccaguucuagugcuaccca

SEQ ID NO: 639714 - RNA, 17 nt, Escherichia coli CFT073
uccaguuccuucaagcc

SEQ ID NO: 639715 - RNA, 16 nt, Escherichia coli CFT073
uccaguuccacuuugc

SEQ ID NO: 639716 - RNA, 16 nt, Escherichia coli CFT073
uccagguuaacccaca

SEQ ID NO: 639717 - RNA, 16 nt, Escherichia coli CFT073
uccagguagcaaacaa

SEQ ID NO: 639718 - RNA, 18 nt, Escherichia coli CFT073
uccaggucaaucccagga

SEQ ID NO: 639719 - RNA, 23 nt, Escherichia coli CFT073
uccaggguuuuauuauuccaucc

SEQ ID NO: 639720 - RNA, 15 nt, Escherichia coli CFT073
uccaggguaaacauc

SEQ ID NO: 639721 - RNA, 16 nt, Escherichia coli CFT073
uccaggggcuggugcc

SEQ ID NO: 639722 - RNA, 23 nt, Escherichia coli CFT073
uccagggcgaaaagcuucuuccu

SEQ ID NO: 639723 - RNA, 23 nt, Escherichia coli CFT073
uccagucauacuuauugaaagca

SEQ ID NO: 639724 - RNA, 14 nt, Escherichia coli CFT073
uccaguagaauaau

SEQ ID NO: 639725 - RNA, 17 nt, Escherichia coli CFT073
uccaguagaauaaugau

SEQ ID NO: 639726 - RNA, 22 nt, Escherichia coli CFT073
uccaguagaauaaugaucccuu

SEQ ID NO: 639727 - RNA, 17 nt, Escherichia coli CFT073
uccaguaccaggcaaua

SEQ ID NO: 639728 - RNA, 15 nt, Escherichia coli CFT073
uccaguaccugcaaa

SEQ ID NO: 639729 - RNA, 13 nt, Escherichia coli CFT073
uccaguacgccuu

SEQ ID NO: 639730 - RNA, 21 nt, Escherichia coli CFT073
uccaguaaugcgcccaugccg

SEQ ID NO: 639731 - RNA, 23 nt, Escherichia coli CFT073
uccauacucguugacgaccaguc

SEQ ID NO: 639732 - RNA, 16 nt, Escherichia coli CFT073
uccauacgggcaugug

SEQ ID NO: 639733 - RNA, 13 nt, Escherichia coli CFT073
uccauaccggacu

SEQ ID NO: 639734 - RNA, 20 nt, Escherichia coli CFT073
uccauagucacuaccuguuu

SEQ ID NO: 639735 - RNA, 15 nt, Escherichia coli CFT073
uccauaaccauaauu

SEQ ID NO: 639736 - RNA, 19 nt, Escherichia coli CFT073
uccauaaauuauagaugca

SEQ ID NO: 639737 - RNA, 15 nt, Escherichia coli CFT073
uccauaagauugcau

SEQ ID NO: 639738 - RNA, 22 nt, Escherichia coli CFT073
uccaguuuucuuugccacuccu

SEQ ID NO: 639739 - RNA, 16 nt, Escherichia coli CFT073
uccaguuuuuaucaua

SEQ ID NO: 639740 - RNA, 11 nt, Escherichia coli CFT073
uccauccauac

SEQ ID NO: 639741 - RNA, 18 nt, Escherichia coli CFT073
uccaucccgcucuguaag

SEQ ID NO: 639742 - RNA, 19 nt, Escherichia coli CFT073
uccauccgguacuuuccuu

SEQ ID NO: 639743 - RNA, 19 nt, Escherichia coli CFT073
uccaucagauucagcagcg

SEQ ID NO: 639744 - RNA, 16 nt, Escherichia coli CFT073
uccaucagauucagca

SEQ ID NO: 639745 - RNA, 13 nt, Escherichia coli CFT073
uccauauucagcg

SEQ ID NO: 639746 - RNA, 16 nt, Escherichia coli CFT073
uccauauucagcgcca

SEQ ID NO: 639747 - RNA, 16 nt, Escherichia coli CFT073
uccauauauaaaauca

SEQ ID NO: 639748 - RNA, 16 nt, Escherichia coli CFT073
uccauauguucccuua

SEQ ID NO: 639749 - RNA, 18 nt, Escherichia coli CFT073
uccauauuuuuugaaaaa

SEQ ID NO: 639750 - RNA, 21 nt, Escherichia coli CFT073
uccauauuuugaaucgguggc

SEQ ID NO: 639751 - RNA, 19 nt, Escherichia coli CFT073
ucccacaguuguccauuaa

SEQ ID NO: 639752 - RNA, 18 nt, Escherichia coli CFT073
ucccacauauguuuaacc

SEQ ID NO: 639753 - RNA, 16 nt, Escherichia coli CFT073
ucccaccugaaauggu

SEQ ID NO: 639754 - RNA, 19 nt, Escherichia coli CFT073
ucccacgagagaaccagcc

SEQ ID NO: 639755 - RNA, 16 nt, Escherichia coli CFT073
ucccacgguuugagag

SEQ ID NO: 639756 - RNA, 14 nt, Escherichia coli CFT073
ucccacucaucaag

SEQ ID NO: 639757 - RNA, 18 nt, Escherichia coli CFT073
ucccacguuccuugcugc

SEQ ID NO: 639758 - RNA, 23 nt, Escherichia coli CFT073
ucccacgguauagcucaacagua

SEQ ID NO: 639759 - RNA, 15 nt, Escherichia coli CFT073
ucccagagaaugaau

SEQ ID NO: 639760 - RNA, 16 nt, Escherichia coli CFT073
ucccagagaaugaauu

SEQ ID NO: 639761 - RNA, 14 nt, Escherichia coli CFT073
ucccagaccuucau

SEQ ID NO: 639762 - RNA, 15 nt, Escherichia coli CFT073
uccauuuacccacag

SEQ ID NO: 639763 - RNA, 15 nt, Escherichia coli CFT073
uccauuucauugagu

SEQ ID NO: 639764 - RNA, 22 nt, Escherichia coli CFT073
ucccaaaagcucggucauugcc

SEQ ID NO: 639765 - RNA, 20 nt, Escherichia coli CFT073
ucccaaaccgcccagcagcg

SEQ ID NO: 639766 - RNA, 13 nt, Escherichia coli CFT073
ucccaacaacagc

SEQ ID NO: 639767 - RNA, 21 nt, Escherichia coli CFT073
ucccaaauaugaaaucucuug

SEQ ID NO: 639768 - RNA, 17 nt, Escherichia coli CFT073
ucccaacaacagcgcgc

SEQ ID NO: 639769 - RNA, 18 nt, Escherichia coli CFT073
ucccaacaacagcgcgcu

SEQ ID NO: 639770 - RNA, 20 nt, Escherichia coli CFT073
ucccaacaguuuguugagau

SEQ ID NO: 639771 - RNA, 23 nt, Escherichia coli CFT073
uccauguagcucaucugacguuc

SEQ ID NO: 639772 - RNA, 22 nt, Escherichia coli CFT073
uccauuacccgagaauuuugcu

SEQ ID NO: 639773 - RNA, 16 nt, Escherichia coli CFT073
uccauucgcugcugcg

SEQ ID NO: 639774 - RNA, 18 nt, Escherichia coli CFT073
uccauucaaggacaaacc

SEQ ID NO: 639775 - RNA, 19 nt, Escherichia coli CFT073
uccauucccuggcacuguu

SEQ ID NO: 639776 - RNA, 18 nt, Escherichia coli CFT073
uccaugccuucauaauga

SEQ ID NO: 639777 - RNA, 20 nt, Escherichia coli CFT073
uccaugccuucauaaugaau

SEQ ID NO: 639778 - RNA, 17 nt, Escherichia coli CFT073
uccaucucgguuuucag

SEQ ID NO: 639779 - RNA, 18 nt, Escherichia coli CFT073
uccaucguugaauacauu

SEQ ID NO: 639780 - RNA, 15 nt, Escherichia coli CFT073
uccccacaaaccacc

SEQ ID NO: 639781 - RNA, 23 nt, Escherichia coli CFT073
uccccacaaucggcgggaaaaau

SEQ ID NO: 639782 - RNA, 14 nt, Escherichia coli CFT073
uccccacaccacca

SEQ ID NO: 639783 - RNA, 11 nt, Escherichia coli CFT073
uccccaauacg

SEQ ID NO: 639784 - RNA, 20 nt, Escherichia coli CFT073
ucccauuuuauccucuucaa

SEQ ID NO: 639785 - RNA, 18 nt, Escherichia coli CFT073
ucccauuuacuggcauca

SEQ ID NO: 639786 - RNA, 21 nt, Escherichia coli CFT073
ucccaguuacugccaucuucc

SEQ ID NO: 639787 - RNA, 14 nt, Escherichia coli CFT073
ucccagucuuucca

SEQ ID NO: 639788 - RNA, 18 nt, Escherichia coli CFT073
ucccagugaauuaaaaac

SEQ ID NO: 639789 - RNA, 20 nt, Escherichia coli CFT073
ucccaggcaaaucccaucgg

SEQ ID NO: 639790 - RNA, 21 nt, Escherichia coli CFT073
ucccagcuuauuaacagucag

SEQ ID NO: 639791 - RNA, 20 nt, Escherichia coli CFT073
ucccaguacuguacaacaca

SEQ ID NO: 639792 - RNA, 22 nt, Escherichia coli CFT073
ucccaguacuguacaacacagu

SEQ ID NO: 639793 - RNA, 14 nt, Escherichia coli CFT073
ucccaguagugcuu

SEQ ID NO: 639794 - RNA, 22 nt, Escherichia coli CFT073
ucccagcgucggaaucccuucc

SEQ ID NO: 639795 - RNA, 22 nt, Escherichia coli CFT073
ucccagcguuuaucaauaucca

SEQ ID NO: 639796 - RNA, 20 nt, Escherichia coli CFT073
ucccagccggguaagaaaag

SEQ ID NO: 639797 - RNA, 19 nt, Escherichia coli CFT073
ucccagcaacagcaaagag

SEQ ID NO: 639798 - RNA, 18 nt, Escherichia coli CFT073
ucccagcaccgcagagau

SEQ ID NO: 639799 - RNA, 20 nt, Escherichia coli CFT073
ucccagcagagaucuuucac

SEQ ID NO: 639800 - RNA, 12 nt, Escherichia coli CFT073
ucccagccaguc

SEQ ID NO: 639801 - RNA, 15 nt, Escherichia coli CFT073
ucccagcccagcgcu

SEQ ID NO: 639802 - RNA, 20 nt, Escherichia coli CFT073
ucccagcccccuguguugau

SEQ ID NO: 639803 - RNA, 23 nt, Escherichia coli CFT073
uccccaucagguuugccgacguu

SEQ ID NO: 639804 - RNA, 13 nt, Escherichia coli CFT073
uccccauaucccg

SEQ ID NO: 639805 - RNA, 14 nt, Escherichia coli CFT073
ucccccacagcucu

SEQ ID NO: 639806 - RNA, 15 nt, Escherichia coli CFT073
ucccccaccaccauc

SEQ ID NO: 639807 - RNA, 22 nt, Escherichia coli CFT073
ucccccaccaccaucucaagca

SEQ ID NO: 639808 - RNA, 12 nt, Escherichia coli CFT073
ucccccacagcu

SEQ ID NO: 639809 - RNA, 16 nt, Escherichia coli CFT073
ucccccaccgccgccg

SEQ ID NO: 639810 - RNA, 17 nt, Escherichia coli CFT073
uccccagcgucagcagc

SEQ ID NO: 639811 - RNA, 19 nt, Escherichia coli CFT073
uccccagcgucagcagcaa

SEQ ID NO: 639812 - RNA, 18 nt, Escherichia coli CFT073
uccccagcggaaaauauc

SEQ ID NO: 639813 - RNA, 13 nt, Escherichia coli CFT073
uccccagacaaaa

SEQ ID NO: 639814 - RNA, 12 nt, Escherichia coli CFT073
uccccagccacg

SEQ ID NO: 639815 - RNA, 18 nt, Escherichia coli CFT073
uccccagccgaucagcgg

SEQ ID NO: 639816 - RNA, 17 nt, Escherichia coli CFT073
uccccagcggaaaauau

SEQ ID NO: 639817 - RNA, 18 nt, Escherichia coli CFT073
uccccaccugaacuucuu

SEQ ID NO: 639818 - RNA, 18 nt, Escherichia coli CFT073
uccccaccuguccagacg

SEQ ID NO: 639819 - RNA, 20 nt, Escherichia coli CFT073
uccccacugcauggcggcgu

SEQ ID NO: 639820 - RNA, 15 nt, Escherichia coli CFT073
uccccacuucauccg

SEQ ID NO: 639821 - RNA, 16 nt, Escherichia coli CFT073
uccccacuucauccga

SEQ ID NO: 639822 - RNA, 17 nt, Escherichia coli CFT073
uccccacuucauccgac

SEQ ID NO: 639823 - RNA, 21 nt, Escherichia coli CFT073
uccccaccccaguucggcguu

SEQ ID NO: 639824 - RNA, 15 nt, Escherichia coli CFT073
uccccacaucacacc

SEQ ID NO: 639825 - RNA, 21 nt, Escherichia coli CFT073
uccccgaagcuuguucagccg

SEQ ID NO: 639826 - RNA, 20 nt, Escherichia coli CFT073
uccccgcagcaaacagagau

SEQ ID NO: 639827 - RNA, 23 nt, Escherichia coli CFT073
uccccgccagcguugccaguccg

SEQ ID NO: 639828 - RNA, 18 nt, Escherichia coli CFT073
uccccgcaggucggauaa

SEQ ID NO: 639829 - RNA, 22 nt, Escherichia coli CFT073
uccccgcaucagugaacccaua

SEQ ID NO: 639830 - RNA, 14 nt, Escherichia coli CFT073
uccccgcaaaccag

SEQ ID NO: 639831 - RNA, 14 nt, Escherichia coli CFT073
uccccggagcccua

SEQ ID NO: 639832 - RNA, 22 nt, Escherichia coli CFT073
uccccggagcccuacaaaccau

SEQ ID NO: 639833 - RNA, 17 nt, Escherichia coli CFT073
uccccggcagugcuuuc

SEQ ID NO: 639834 - RNA, 14 nt, Escherichia coli CFT073
ucccccauugccgc

SEQ ID NO: 639835 - RNA, 15 nt, Escherichia coli CFT073
ucccccgcacacucc

SEQ ID NO: 639836 - RNA, 13 nt, Escherichia coli CFT073
ucccccucuuccg

SEQ ID NO: 639837 - RNA, 13 nt, Escherichia coli CFT073
uccgaucccugca

SEQ ID NO: 639838 - RNA, 13 nt, Escherichia coli CFT073
uccgaucccugcg

SEQ ID NO: 639839 - RNA, 18 nt, Escherichia coli CFT073
uccgaguagcucaccagc

SEQ ID NO: 639840 - RNA, 13 nt, Escherichia coli CFT073
uccgauccucacu

SEQ ID NO: 639841 - RNA, 13 nt, Escherichia coli CFT073
uccgaugcaaaaa

SEQ ID NO: 639842 - RNA, 16 nt, Escherichia coli CFT073
uccgauuaccggcaac

SEQ ID NO: 639843 - RNA, 22 nt, Escherichia coli CFT073
uccgauuuguucucuucugcuu

SEQ ID NO: 639844 - RNA, 20 nt, Escherichia coli CFT073
uccgacaucaacgccugaug

SEQ ID NO: 639845 - RNA, 22 nt, Escherichia coli CFT073
uccgacauuuugggacagugca

SEQ ID NO: 639846 - RNA, 21 nt, Escherichia coli CFT073
uccgagaaucgacaccaguuc

SEQ ID NO: 639847 - RNA, 21 nt, Escherichia coli CFT073
uccgacuucaguggaaucauc

SEQ ID NO: 639848 - RNA, 17 nt, Escherichia coli CFT073
uccgacguuacgcgcca

SEQ ID NO: 639849 - RNA, 12 nt, Escherichia coli CFT073
uccgacaccagc

SEQ ID NO: 639850 - RNA, 16 nt, Escherichia coli CFT073
uccgaaguucauccau

SEQ ID NO: 639851 - RNA, 14 nt, Escherichia coli CFT073
ucccuuuguaagca

SEQ ID NO: 639852 - RNA, 18 nt, Escherichia coli CFT073
ucccuuucagauauccca

SEQ ID NO: 639853 - RNA, 14 nt, Escherichia coli CFT073
ucccuuucagcaaa

SEQ ID NO: 639854 - RNA, 14 nt, Escherichia coli CFT073
ucccuuucagguca

SEQ ID NO: 639855 - RNA, 13 nt, Escherichia coli CFT073
ucccuuucugcag

SEQ ID NO: 639856 - RNA, 20 nt, Escherichia coli CFT073
ucccuuucuuauuuuucucu

SEQ ID NO: 639857 - RNA, 22 nt, Escherichia coli CFT073
ucccuuucuuauuuuucucuac

SEQ ID NO: 639858 - RNA, 22 nt, Escherichia coli CFT073
ucccuugcaguugauccaugcc

SEQ ID NO: 639859 - RNA, 14 nt, Escherichia coli CFT073
ucccuucugccacc

SEQ ID NO: 639860 - RNA, 21 nt, Escherichia coli CFT073
ucccugugccagcggcaguaa

SEQ ID NO: 639861 - RNA, 15 nt, Escherichia coli CFT073
ucccuuacccuuacu

SEQ ID NO: 639862 - RNA, 13 nt, Escherichia coli CFT073
ucccuucccagcc

SEQ ID NO: 639863 - RNA, 15 nt, Escherichia coli CFT073
ucccuucccagccgg

SEQ ID NO: 639864 - RNA, 21 nt, Escherichia coli CFT073
ucccuuccgcaauacagccag

SEQ ID NO: 639865 - RNA, 22 nt, Escherichia coli CFT073
ucccuuccgccaucaaucgacc

SEQ ID NO: 639866 - RNA, 20 nt, Escherichia coli CFT073
ucccuuccugcccuuuuaau

SEQ ID NO: 639867 - RNA, 21 nt, Escherichia coli CFT073
ucccuuccugcccuuuuaaua

SEQ ID NO: 639868 - RNA, 15 nt, Escherichia coli CFT073
ucccuucgagcgggg

SEQ ID NO: 639869 - RNA, 18 nt, Escherichia coli CFT073
ucccuucgauauccagau

SEQ ID NO: 639870 - RNA, 21 nt, Escherichia coli CFT073
ucccugaguuaauuaaauccu

SEQ ID NO: 639871 - RNA, 19 nt, Escherichia coli CFT073
ucccugcagggcuuuuuaa

SEQ ID NO: 639872 - RNA, 23 nt, Escherichia coli CFT073
ucccugcagggcuuuuuaaugca

SEQ ID NO: 639873 - RNA, 16 nt, Escherichia coli CFT073
ucccugcauaaucagg

SEQ ID NO: 639874 - RNA, 11 nt, Escherichia coli CFT073
ucccugcauau

SEQ ID NO: 639875 - RNA, 13 nt, Escherichia coli CFT073
ucccuggcacugu

SEQ ID NO: 639876 - RNA, 15 nt, Escherichia coli CFT073
ucccugguacagcag

SEQ ID NO: 639877 - RNA, 15 nt, Escherichia coli CFT073
ucccugcucuuucag

SEQ ID NO: 639878 - RNA, 17 nt, Escherichia coli CFT073
ucccugcgcaaggcauu

SEQ ID NO: 639879 - RNA, 16 nt, Escherichia coli CFT073
ucccugcuguccugag

SEQ ID NO: 639880 - RNA, 15 nt, Escherichia coli CFT073
ucccgcuuuggcauc

SEQ ID NO: 639881 - RNA, 21 nt, Escherichia coli CFT073
ucccggcaaucaccgccagcg

SEQ ID NO: 639882 - RNA, 14 nt, Escherichia coli CFT073
ucccgcggcgcagc

SEQ ID NO: 639883 - RNA, 14 nt, Escherichia coli CFT073
ucccgcucuguaag

SEQ ID NO: 639884 - RNA, 12 nt, Escherichia coli CFT073
ucccggcaggaa

SEQ ID NO: 639885 - RNA, 14 nt, Escherichia coli CFT073
ucccggcagagaaa

SEQ ID NO: 639886 - RNA, 15 nt, Escherichia coli CFT073
ucccggcagagaaaa

SEQ ID NO: 639887 - RNA, 19 nt, Escherichia coli CFT073
ucccuauaaugcgccacca

SEQ ID NO: 639888 - RNA, 16 nt, Escherichia coli CFT073
ucccuacugcacucau

SEQ ID NO: 639889 - RNA, 17 nt, Escherichia coli CFT073
ucccuaauaccguucca

SEQ ID NO: 639890 - RNA, 19 nt, Escherichia coli CFT073
ucccuacucucgcaugggg

SEQ ID NO: 639891 - RNA, 17 nt, Escherichia coli CFT073
ucccguugaaaaugcug

SEQ ID NO: 639892 - RNA, 21 nt, Escherichia coli CFT073
ucccguugccacucaggcaaa

SEQ ID NO: 639893 - RNA, 23 nt, Escherichia coli CFT073
ucccguuuuuagauuguuuucaa

SEQ ID NO: 639894 - RNA, 21 nt, Escherichia coli CFT073
ucccgggucgcgacugccagc

SEQ ID NO: 639895 - RNA, 22 nt, Escherichia coli CFT073
ucccgguauaacuugccaggcc

SEQ ID NO: 639896 - RNA, 17 nt, Escherichia coli CFT073
ucccgguuucaggauga

SEQ ID NO: 639897 - RNA, 13 nt, Escherichia coli CFT073
ucccgccugcugc

SEQ ID NO: 639898 - RNA, 19 nt, Escherichia coli CFT073
ucccgcgauuuccugaccc

SEQ ID NO: 639899 - RNA, 16 nt, Escherichia coli CFT073
ucccgccgaccaacgc

SEQ ID NO: 639900 - RNA, 15 nt, Escherichia coli CFT073
ucccgccagcaccag

SEQ ID NO: 639901 - RNA, 19 nt, Escherichia coli CFT073
ucccgcaggagcgccgaau

SEQ ID NO: 639902 - RNA, 16 nt, Escherichia coli CFT073
ucccgauaaccgcaaa

SEQ ID NO: 639903 - RNA, 19 nt, Escherichia coli CFT073
ucccgauaaccuucuucau

SEQ ID NO: 639904 - RNA, 15 nt, Escherichia coli CFT073
uccccggucagcagc

SEQ ID NO: 639905 - RNA, 16 nt, Escherichia coli CFT073
uccccggucagcagca

SEQ ID NO: 639906 - RNA, 11 nt, Escherichia coli CFT073
uccccggugaa

SEQ ID NO: 639907 - RNA, 20 nt, Escherichia coli CFT073
uccccggcagugcuuucauu

SEQ ID NO: 639908 - RNA, 15 nt, Escherichia coli CFT073
uccccuaacucuuuc

SEQ ID NO: 639909 - RNA, 20 nt, Escherichia coli CFT073
uccccguugguuuugaggug

SEQ ID NO: 639910 - RNA, 21 nt, Escherichia coli CFT073
uccccuucucaaucccuuucu

SEQ ID NO: 639911 - RNA, 16 nt, Escherichia coli CFT073
uccccuuuaugguggc

SEQ ID NO: 639912 - RNA, 13 nt, Escherichia coli CFT073
uccccugaaauau

SEQ ID NO: 639913 - RNA, 12 nt, Escherichia coli CFT073
uccccugacugu

SEQ ID NO: 639914 - RNA, 17 nt, Escherichia coli CFT073
uccccugagcauacauu

SEQ ID NO: 639915 - RNA, 23 nt, Escherichia coli CFT073
uccccugagcauacauugccgca

SEQ ID NO: 639916 - RNA, 14 nt, Escherichia coli CFT073
uccguuuuucuguu

SEQ ID NO: 639917 - RNA, 13 nt, Escherichia coli CFT073
uccuacaccccag

SEQ ID NO: 639918 - RNA, 13 nt, Escherichia coli CFT073
uccguucagaucg

SEQ ID NO: 639919 - RNA, 16 nt, Escherichia coli CFT073
uccguucaguaaucaa

SEQ ID NO: 639920 - RNA, 20 nt, Escherichia coli CFT073
uccguggucgcguagccagg

SEQ ID NO: 639921 - RNA, 17 nt, Escherichia coli CFT073
uccguucuggacuuccc

SEQ ID NO: 639922 - RNA, 19 nt, Escherichia coli CFT073
uccguuauguuucauccag

SEQ ID NO: 639923 - RNA, 14 nt, Escherichia coli CFT073
uccguugccagaug

SEQ ID NO: 639924 - RNA, 15 nt, Escherichia coli CFT073
uccgugggcuaacac

SEQ ID NO: 639925 - RNA, 23 nt, Escherichia coli CFT073
uccguccgcaaacguaaaugcca

SEQ ID NO: 639926 - RNA, 16 nt, Escherichia coli CFT073
uccgucgcgccaggcg

SEQ ID NO: 639927 - RNA, 17 nt, Escherichia coli CFT073
uccgucgcgccaggcgc

SEQ ID NO: 639928 - RNA, 14 nt, Escherichia coli CFT073
uccgucucaauggu

SEQ ID NO: 639929 - RNA, 12 nt, Escherichia coli CFT073
uccucccgagcg

SEQ ID NO: 639930 - RNA, 13 nt, Escherichia coli CFT073
uccucccguuaug

SEQ ID NO: 639931 - RNA, 23 nt, Escherichia coli CFT073
uccuccggcauagccggagguuu

SEQ ID NO: 639932 - RNA, 20 nt, Escherichia coli CFT073
uccuccggcaucuuuaacgu

SEQ ID NO: 639933 - RNA, 13 nt, Escherichia coli CFT073
uccucaucauccu

SEQ ID NO: 639934 - RNA, 23 nt, Escherichia coli CFT073
uccucaaacgugcggcaggcaca

SEQ ID NO: 639935 - RNA, 17 nt, Escherichia coli CFT073
uccuauuggagaauaug

SEQ ID NO: 639936 - RNA, 19 nt, Escherichia coli CFT073
uccuggcgguugauaauga

SEQ ID NO: 639937 - RNA, 21 nt, Escherichia coli CFT073
uccuggcgggaauaaaagcca

SEQ ID NO: 639938 - RNA, 21 nt, Escherichia coli CFT073
uccuggcuggcgcuacugaag

SEQ ID NO: 639939 - RNA, 21 nt, Escherichia coli CFT073
uccuggcuguuacucaacuga

SEQ ID NO: 639940 - RNA, 13 nt, Escherichia coli CFT073
uccugcgccagcc

SEQ ID NO: 639941 - RNA, 16 nt, Escherichia coli CFT073
uccugcgcacaaccug

SEQ ID NO: 639942 - RNA, 13 nt, Escherichia coli CFT073
uccugccugauuc

SEQ ID NO: 639943 - RNA, 17 nt, Escherichia coli CFT073
uccugccugauucagca

SEQ ID NO: 639944 - RNA, 15 nt, Escherichia coli CFT073
uccugcgccagcguu

SEQ ID NO: 639945 - RNA, 15 nt, Escherichia coli CFT073
uccuggguauaaaac

SEQ ID NO: 639946 - RNA, 17 nt, Escherichia coli CFT073
uccuggucaggaaugga

SEQ ID NO: 639947 - RNA, 17 nt, Escherichia coli CFT073
uccugggccagcaccau

SEQ ID NO: 639948 - RNA, 22 nt, Escherichia coli CFT073
uccuggggauucaucaccacug

SEQ ID NO: 639949 - RNA, 18 nt, Escherichia coli CFT073
uccuggggucaucagcau

SEQ ID NO: 639950 - RNA, 22 nt, Escherichia coli CFT073
uccuguucaccgauuuugccuu

SEQ ID NO: 639951 - RNA, 21 nt, Escherichia coli CFT073
uccuguuccggcagaaaccag

SEQ ID NO: 639952 - RNA, 13 nt, Escherichia coli CFT073
uccuggugaaagu

SEQ ID NO: 639953 - RNA, 23 nt, Escherichia coli CFT073
uccugagucggaacuuugcugca

SEQ ID NO: 639954 - RNA, 22 nt, Escherichia coli CFT073
uccugaguuaaucgccgcauaa

SEQ ID NO: 639955 - RNA, 20 nt, Escherichia coli CFT073
uccugauaaccuuccagcuu

SEQ ID NO: 639956 - RNA, 13 nt, Escherichia coli CFT073
uccugagcagcaa

SEQ ID NO: 639957 - RNA, 18 nt, Escherichia coli CFT073
uccugacuuaccuccugu

SEQ ID NO: 639958 - RNA, 19 nt, Escherichia coli CFT073
uccugacuuacuuccuguc

SEQ ID NO: 639959 - RNA, 13 nt, Escherichia coli CFT073
uccugaugcuuca

SEQ ID NO: 639960 - RNA, 15 nt, Escherichia coli CFT073
uccugaugcuucaga

SEQ ID NO: 639961 - RNA, 13 nt, Escherichia coli CFT073
uccugaucaagcu

SEQ ID NO: 639962 - RNA, 14 nt, Escherichia coli CFT073
uccugaucaagcug

SEQ ID NO: 639963 - RNA, 16 nt, Escherichia coli CFT073
uccugcaaucuuuccu

SEQ ID NO: 639964 - RNA, 13 nt, Escherichia coli CFT073
uccugccagcguu

SEQ ID NO: 639965 - RNA, 17 nt, Escherichia coli CFT073
uccugccaguuuuuccg

SEQ ID NO: 639966 - RNA, 20 nt, Escherichia coli CFT073
uccugcacaaauuugccguc

SEQ ID NO: 639967 - RNA, 18 nt, Escherichia coli CFT073
uccucuguaaacuccuuu

SEQ ID NO: 639968 - RNA, 14 nt, Escherichia coli CFT073
uccugaacuuucuc

SEQ ID NO: 639969 - RNA, 15 nt, Escherichia coli CFT073
uccugaagaugcugc

SEQ ID NO: 639970 - RNA, 16 nt, Escherichia coli CFT073
uccugaagaugcugca

SEQ ID NO: 639971 - RNA, 22 nt, Escherichia coli CFT073
uccugaaacgcggcguaaccac

SEQ ID NO: 639972 - RNA, 17 nt, Escherichia coli CFT073
uccugaauggugaccug

SEQ ID NO: 639973 - RNA, 18 nt, Escherichia coli CFT073
uccugacccucucggcau

SEQ ID NO: 639974 - RNA, 21 nt, Escherichia coli CFT073
uccucguuucgcccugccuuu

SEQ ID NO: 639975 - RNA, 23 nt, Escherichia coli CFT073
uccucgauacagaccccggcauu

SEQ ID NO: 639976 - RNA, 15 nt, Escherichia coli CFT073
uccucgagccuuauc

SEQ ID NO: 639977 - RNA, 17 nt, Escherichia coli CFT073
uccgccguggaugcgau

SEQ ID NO: 639978 - RNA, 19 nt, Escherichia coli CFT073
uccgccgcuguggcaggua

SEQ ID NO: 639979 - RNA, 21 nt, Escherichia coli CFT073
uccgcccucgauaugccagac

SEQ ID NO: 639980 - RNA, 22 nt, Escherichia coli CFT073
uccgccgcauauuccaccacuu

SEQ ID NO: 639981 - RNA, 13 nt, Escherichia coli CFT073
uccgccagcagcu

SEQ ID NO: 639982 - RNA, 20 nt, Escherichia coli CFT073
uccgccagcgccucuucuaa

SEQ ID NO: 639983 - RNA, 16 nt, Escherichia coli CFT073
uccgccaggacaucag

SEQ ID NO: 639984 - RNA, 20 nt, Escherichia coli CFT073
uccgccauuuccagcgucug

SEQ ID NO: 639985 - RNA, 16 nt, Escherichia coli CFT073
uccgccaguuuguagc

SEQ ID NO: 639986 - RNA, 17 nt, Escherichia coli CFT073
uccgcaggggauggaug

SEQ ID NO: 639987 - RNA, 21 nt, Escherichia coli CFT073
uccgcauuuguaggcaggaua

SEQ ID NO: 639988 - RNA, 20 nt, Escherichia coli CFT073
uccgccaaccgcugauugcu

SEQ ID NO: 639989 - RNA, 13 nt, Escherichia coli CFT073
uccgccaccugcg

SEQ ID NO: 639990 - RNA, 17 nt, Escherichia coli CFT073
uccgccaauucccgaca

SEQ ID NO: 639991 - RNA, 15 nt, Escherichia coli CFT073
uccgccagaccaauc

SEQ ID NO: 639992 - RNA, 20 nt, Escherichia coli CFT073
uccgcaauacaucaaagcgu

SEQ ID NO: 639993 - RNA, 12 nt, Escherichia coli CFT073
uccgcaaucaaa

SEQ ID NO: 639994 - RNA, 23 nt, Escherichia coli CFT073
uccgcaaucaaaugacugguuuu

SEQ ID NO: 639995 - RNA, 14 nt, Escherichia coli CFT073
uccgcacagcaguu

SEQ ID NO: 639996 - RNA, 15 nt, Escherichia coli CFT073
uccgcaccgcgguac

SEQ ID NO: 639997 - RNA, 16 nt, Escherichia coli CFT073
uccgcacucaacuuau

SEQ ID NO: 639998 - RNA, 18 nt, Escherichia coli CFT073
uccgccucuaacagauca

SEQ ID NO: 639999 - RNA, 20 nt, Escherichia coli CFT073
uccgcgaauuaugcagccuu

SEQ ID NO: 640000 - RNA, 13 nt, Escherichia coli CFT073
uccgcgcgcaccg

SEQ ID NO: 640001 - RNA, 20 nt, Escherichia coli CFT073
uccgcgcgaacagucagcac

SEQ ID NO: 640002 - RNA, 16 nt, Escherichia coli CFT073
uccgcuuucacaucag

SEQ ID NO: 640003 - RNA, 17 nt, Escherichia coli CFT073
uccgcuuuuaacaucuu

SEQ ID NO: 640004 - RNA, 15 nt, Escherichia coli CFT073
uccggaaaagccugu

SEQ ID NO: 640005 - RNA, 15 nt, Escherichia coli CFT073
uccggaaacuggaug

SEQ ID NO: 640006 - RNA, 19 nt, Escherichia coli CFT073
uccggaacauauuccggug

SEQ ID NO: 640007 - RNA, 14 nt, Escherichia coli CFT073
uccgcuuaccuguu

SEQ ID NO: 640008 - RNA, 16 nt, Escherichia coli CFT073
uccgcugacagcgcgu

SEQ ID NO: 640009 - RNA, 15 nt, Escherichia coli CFT073
uccgcucugcccacg

SEQ ID NO: 640010 - RNA, 14 nt, Escherichia coli CFT073
uccgcucuguaacc

SEQ ID NO: 640011 - RNA, 13 nt, Escherichia coli CFT073
uccgcucuuucac

SEQ ID NO: 640012 - RNA, 18 nt, Escherichia coli CFT073
uccgcucgccgcagagau

SEQ ID NO: 640013 - RNA, 19 nt, Escherichia coli CFT073
uccgcuauugaccagcgcc

SEQ ID NO: 640014 - RNA, 16 nt, Escherichia coli CFT073
uccgcucaauauauuc

SEQ ID NO: 640015 - RNA, 18 nt, Escherichia coli CFT073
uccggaguaaugaaaccg

SEQ ID NO: 640016 - RNA, 18 nt, Escherichia coli CFT073
uccggauaaggcguucac

SEQ ID NO: 640017 - RNA, 21 nt, Escherichia coli CFT073
uccggcaaauuaagaagcggc

SEQ ID NO: 640018 - RNA, 22 nt, Escherichia coli CFT073
uccggcaaauuaagaagcggcu

SEQ ID NO: 640019 - RNA, 20 nt, Escherichia coli CFT073
uccggcaaccgcgccaagcc

SEQ ID NO: 640020 - RNA, 23 nt, Escherichia coli CFT073
uccggcaacaucaaaucacagca

SEQ ID NO: 640021 - RNA, 16 nt, Escherichia coli CFT073
uccggcaaucaacaga

SEQ ID NO: 640022 - RNA, 19 nt, Escherichia coli CFT073
uccggcaaucaacagauaa

SEQ ID NO: 640023 - RNA, 21 nt, Escherichia coli CFT073
uccggcaaucaacgccugaug

SEQ ID NO: 640024 - RNA, 13 nt, Escherichia coli CFT073
uccggcaugguga

SEQ ID NO: 640025 - RNA, 21 nt, Escherichia coli CFT073
uccggcauuugagcaggaugc

SEQ ID NO: 640026 - RNA, 20 nt, Escherichia coli CFT073
uccggcaguauuaccagacc

SEQ ID NO: 640027 - RNA, 16 nt, Escherichia coli CFT073
uccggcagcagaaagc

SEQ ID NO: 640028 - RNA, 14 nt, Escherichia coli CFT073
uccggcagcagcac

SEQ ID NO: 640029 - RNA, 19 nt, Escherichia coli CFT073
uccggcacgcauugccgcc

SEQ ID NO: 640030 - RNA, 21 nt, Escherichia coli CFT073
uccggcacuuaauaccacucg

SEQ ID NO: 640031 - RNA, 20 nt, Escherichia coli CFT073
uccggcacuuuuucaucagg

SEQ ID NO: 640032 - RNA, 22 nt, Escherichia coli CFT073
uccggcagagaggacucugccg

SEQ ID NO: 640033 - RNA, 21 nt, Escherichia coli CFT073
uccggcagcaaauucaccgcc

SEQ ID NO: 640034 - RNA, 15 nt, Escherichia coli CFT073
uccggcagcagaaag

SEQ ID NO: 640035 - RNA, 21 nt, Escherichia coli CFT073
uccggccaguguuuaucaucu

SEQ ID NO: 640036 - RNA, 22 nt, Escherichia coli CFT073
uccggccuaccgcaucuuaauc

SEQ ID NO: 640037 - RNA, 17 nt, Escherichia coli CFT073
uccggccuacgggaaca

SEQ ID NO: 640038 - RNA, 18 nt, Escherichia coli CFT073
uccggccuacgggaacag

SEQ ID NO: 640039 - RNA, 21 nt, Escherichia coli CFT073
uccggccuacgggaacagugc

SEQ ID NO: 640040 - RNA, 15 nt, Escherichia coli CFT073
uccggcgacaggaac

SEQ ID NO: 640041 - RNA, 20 nt, Escherichia coli CFT073
uccggcguuuugauuuucac

SEQ ID NO: 640042 - RNA, 23 nt, Escherichia coli CFT073
uccggcgguaaaugcucauacca

SEQ ID NO: 640043 - RNA, 19 nt, Escherichia coli CFT073
uccggcggcacagccagcg

SEQ ID NO: 640044 - RNA, 22 nt, Escherichia coli CFT073
uccggcggcacagccagcgcag

SEQ ID NO: 640045 - RNA, 22 nt, Escherichia coli CFT073
uccggguuuucuccaaccagcu

SEQ ID NO: 640046 - RNA, 21 nt, Escherichia coli CFT073
uccgguaaaucgacccugaug

SEQ ID NO: 640047 - RNA, 14 nt, Escherichia coli CFT073
uccgggucuguaaa

SEQ ID NO: 640048 - RNA, 16 nt, Escherichia coli CFT073
uccgggguucgaaucc

SEQ ID NO: 640049 - RNA, 23 nt, Escherichia coli CFT073
uccgggcugguuuucagcgaaac

SEQ ID NO: 640050 - RNA, 16 nt, Escherichia coli CFT073
uccgggcuaauacccu

SEQ ID NO: 640051 - RNA, 20 nt, Escherichia coli CFT073
uccgggcuauacacccuucu

SEQ ID NO: 640052 - RNA, 17 nt, Escherichia coli CFT073
uccgggccgcaaaccag

SEQ ID NO: 640053 - RNA, 17 nt, Escherichia coli CFT073
uccgggcuguuuuccag

SEQ ID NO: 640054 - RNA, 18 nt, Escherichia coli CFT073
uccgggcuguuuuccagc

SEQ ID NO: 640055 - RNA, 16 nt, Escherichia coli CFT073
uccggggcaauuucag

SEQ ID NO: 640056 - RNA, 20 nt, Escherichia coli CFT073
uccgggaaauccucaaccgg

SEQ ID NO: 640057 - RNA, 14 nt, Escherichia coli CFT073
uccggcuuucacuu

SEQ ID NO: 640058 - RNA, 21 nt, Escherichia coli CFT073
uccggcuucuuuugcugccuu

SEQ ID NO: 640059 - RNA, 17 nt, Escherichia coli CFT073
uccgggaucaccagacc

SEQ ID NO: 640060 - RNA, 19 nt, Escherichia coli CFT073
uccgucaucgacgucagca

SEQ ID NO: 640061 - RNA, 22 nt, Escherichia coli CFT073
uccgucaucgacgucagcagau

SEQ ID NO: 640062 - RNA, 12 nt, Escherichia coli CFT073
uccgucagcaaa

SEQ ID NO: 640063 - RNA, 18 nt, Escherichia coli CFT073
uccguagcguuuuuucau

SEQ ID NO: 640064 - RNA, 23 nt, Escherichia coli CFT073
uccguagcguuuuuucauuucuc

SEQ ID NO: 640065 - RNA, 17 nt, Escherichia coli CFT073
uccguacgcuuuuccac

SEQ ID NO: 640066 - RNA, 16 nt, Escherichia coli CFT073
uccguacucaaugcca

SEQ ID NO: 640067 - RNA, 22 nt, Escherichia coli CFT073
uccgguuuguaagauuacgcua

SEQ ID NO: 640068 - RNA, 21 nt, Escherichia coli CFT073
uccgguuuuuuauuauccgcu

SEQ ID NO: 640069 - RNA, 22 nt, Escherichia coli CFT073
uccguaacgcucaagaacggca

SEQ ID NO: 640070 - RNA, 22 nt, Escherichia coli CFT073
uccguaacucaggaugagaaaa

SEQ ID NO: 640071 - RNA, 16 nt, Escherichia coli CFT073
uccgguacucaucaga

SEQ ID NO: 640072 - RNA, 14 nt, Escherichia coli CFT073
uccgguggagagca

SEQ ID NO: 640073 - RNA, 18 nt, Escherichia coli CFT073
uccgguggagagcauaua

SEQ ID NO: 640074 - RNA, 22 nt, Escherichia coli CFT073
uccgguuauacgucauuaauac

SEQ ID NO: 640075 - RNA, 15 nt, Escherichia coli CFT073
uccgguucacuucac

SEQ ID NO: 640076 - RNA, 19 nt, Escherichia coli CFT073
uccgguuguaggccugauc

SEQ ID NO: 640077 - RNA, 19 nt, Escherichia coli CFT073
ucgagcgcagcaacaucac

SEQ ID NO: 640078 - RNA, 21 nt, Escherichia coli CFT073
ucgauacaaaaacccgcuuca

SEQ ID NO: 640079 - RNA, 18 nt, Escherichia coli CFT073
ucgauaaucaucagacug

SEQ ID NO: 640080 - RNA, 13 nt, Escherichia coli CFT073
ucgauaacugcuc

SEQ ID NO: 640081 - RNA, 17 nt, Escherichia coli CFT073
ucgauaccuucauccag

SEQ ID NO: 640082 - RNA, 19 nt, Escherichia coli CFT073
ucgauaccuucauccaggg

SEQ ID NO: 640083 - RNA, 22 nt, Escherichia coli CFT073
ucgauccccugcccgauaaaag

SEQ ID NO: 640084 - RNA, 16 nt, Escherichia coli CFT073
ucgaucaucaggcccg

SEQ ID NO: 640085 - RNA, 15 nt, Escherichia coli CFT073
ucgauccuuaccaga

SEQ ID NO: 640086 - RNA, 20 nt, Escherichia coli CFT073
ucgaugauuuccgccagcgg

SEQ ID NO: 640087 - RNA, 22 nt, Escherichia coli CFT073
ucgaugcguaccauuucuucug

SEQ ID NO: 640088 - RNA, 14 nt, Escherichia coli CFT073
ucgaugccgcuuau

SEQ ID NO: 640089 - RNA, 19 nt, Escherichia coli CFT073
ucgaugccuugugggccug

SEQ ID NO: 640090 - RNA, 23 nt, Escherichia coli CFT073
ucgauggcuucuggcugcuccag

SEQ ID NO: 640091 - RNA, 20 nt, Escherichia coli CFT073
ucgauggccgggugauuuuu

SEQ ID NO: 640092 - RNA, 17 nt, Escherichia coli CFT073
ucgauuaacuaaaugaa

SEQ ID NO: 640093 - RNA, 20 nt, Escherichia coli CFT073
ucgccacgucguuccccauc

SEQ ID NO: 640094 - RNA, 14 nt, Escherichia coli CFT073
ucgccagaaaccau

SEQ ID NO: 640095 - RNA, 17 nt, Escherichia coli CFT073
ucgccagaaaguaaauu

SEQ ID NO: 640096 - RNA, 19 nt, Escherichia coli CFT073
ucgccagaaaguggcacac

SEQ ID NO: 640097 - RNA, 19 nt, Escherichia coli CFT073
ucgccacgcgggaagucac

SEQ ID NO: 640098 - RNA, 16 nt, Escherichia coli CFT073
ucgccacauugcugca

SEQ ID NO: 640099 - RNA, 19 nt, Escherichia coli CFT073
ucgccacauugcugcacau

SEQ ID NO: 640100 - RNA, 15 nt, Escherichia coli CFT073
ucgccaccaacuuau

SEQ ID NO: 640101 - RNA, 20 nt, Escherichia coli CFT073
ucgcauuuugcagcuguugc

SEQ ID NO: 640102 - RNA, 14 nt, Escherichia coli CFT073
ucgccagcucugcg

SEQ ID NO: 640103 - RNA, 16 nt, Escherichia coli CFT073
ucgccagcuugcagcc

SEQ ID NO: 640104 - RNA, 12 nt, Escherichia coli CFT073
ucgccagcggca

SEQ ID NO: 640105 - RNA, 13 nt, Escherichia coli CFT073
ucgccagcagggc

SEQ ID NO: 640106 - RNA, 14 nt, Escherichia coli CFT073
ucgccagaauagcg

SEQ ID NO: 640107 - RNA, 19 nt, Escherichia coli CFT073
ucgccagaauauugccauu

SEQ ID NO: 640108 - RNA, 16 nt, Escherichia coli CFT073
ucgccagacucaccag

SEQ ID NO: 640109 - RNA, 21 nt, Escherichia coli CFT073
ucgccagcaaauucuaagcug

SEQ ID NO: 640110 - RNA, 16 nt, Escherichia coli CFT073
ucgccagcaauacaaa

SEQ ID NO: 640111 - RNA, 15 nt, Escherichia coli CFT073
ucgcauuauccuuua

SEQ ID NO: 640112 - RNA, 18 nt, Escherichia coli CFT073
ucgcauuuaaccgccgag

SEQ ID NO: 640113 - RNA, 23 nt, Escherichia coli CFT073
ucgcaucccgguaucaaagcgcc

SEQ ID NO: 640114 - RNA, 21 nt, Escherichia coli CFT073
ucgcaaaggacaucccggcag

SEQ ID NO: 640115 - RNA, 21 nt, Escherichia coli CFT073
ucgcaaaggccagccaggcac

SEQ ID NO: 640116 - RNA, 15 nt, Escherichia coli CFT073
ucgcaaacauaccca

SEQ ID NO: 640117 - RNA, 15 nt, Escherichia coli CFT073
ucgcaaaauaaaaac

SEQ ID NO: 640118 - RNA, 14 nt, Escherichia coli CFT073
ucgauuuuuuccag

SEQ ID NO: 640119 - RNA, 15 nt, Escherichia coli CFT073
ucgauuuuuuccagc

SEQ ID NO: 640120 - RNA, 16 nt, Escherichia coli CFT073
ucgcagcgaucugccc

SEQ ID NO: 640121 - RNA, 19 nt, Escherichia coli CFT073
ucgacuuccugcaaucuuu

SEQ ID NO: 640122 - RNA, 16 nt, Escherichia coli CFT073
ucgacuuccaccagcg

SEQ ID NO: 640123 - RNA, 18 nt, Escherichia coli CFT073
ucgacucgcaauuauaau

SEQ ID NO: 640124 - RNA, 16 nt, Escherichia coli CFT073
ucgacuagauacugac

SEQ ID NO: 640125 - RNA, 19 nt, Escherichia coli CFT073
ucgacuaucuuauaaaggc

SEQ ID NO: 640126 - RNA, 14 nt, Escherichia coli CFT073
ucgacguuuuucag

SEQ ID NO: 640127 - RNA, 18 nt, Escherichia coli CFT073
ucgagauauuucaccagc

SEQ ID NO: 640128 - RNA, 16 nt, Escherichia coli CFT073
ucgagaucgacaccgg

SEQ ID NO: 640129 - RNA, 23 nt, Escherichia coli CFT073
ucgacuuuuuucggguuauuggu

SEQ ID NO: 640130 - RNA, 19 nt, Escherichia coli CFT073
ucgagaaucaacacaccgc

SEQ ID NO: 640131 - RNA, 19 nt, Escherichia coli CFT073
ucgagcaauaaacacugcu

SEQ ID NO: 640132 - RNA, 16 nt, Escherichia coli CFT073
ucgagcauugccagca

SEQ ID NO: 640133 - RNA, 15 nt, Escherichia coli CFT073
ucgacaaaaacccug

SEQ ID NO: 640134 - RNA, 16 nt, Escherichia coli CFT073
ucgacaaaaucagaaa

SEQ ID NO: 640135 - RNA, 15 nt, Escherichia coli CFT073
ucgacaucaagaaau

SEQ ID NO: 640136 - RNA, 17 nt, Escherichia coli CFT073
ucgacauacuugacuaa

SEQ ID NO: 640137 - RNA, 20 nt, Escherichia coli CFT073
ucgacauucaacauauccag

SEQ ID NO: 640138 - RNA, 18 nt, Escherichia coli CFT073
ucgacauuucccccuucc

SEQ ID NO: 640139 - RNA, 20 nt, Escherichia coli CFT073
ucgaccauugcguguuacgu

SEQ ID NO: 640140 - RNA, 12 nt, Escherichia coli CFT073
ucgaccugcaac

SEQ ID NO: 640141 - RNA, 21 nt, Escherichia coli CFT073
ucgaccaggccaucagcagcg

SEQ ID NO: 640142 - RNA, 12 nt, Escherichia coli CFT073
ucgaagccccau

SEQ ID NO: 640143 - RNA, 21 nt, Escherichia coli CFT073
ucgaauguugcguucaucagu

SEQ ID NO: 640144 - RNA, 17 nt, Escherichia coli CFT073
uccuguuuauggcguua

SEQ ID NO: 640145 - RNA, 18 nt, Escherichia coli CFT073
uccuguuuuuaagugaug

SEQ ID NO: 640146 - RNA, 21 nt, Escherichia coli CFT073
ucgaagacaucaucgugacca

SEQ ID NO: 640147 - RNA, 13 nt, Escherichia coli CFT073
ucgaagcaaagag

SEQ ID NO: 640148 - RNA, 12 nt, Escherichia coli CFT073
ucgcgaaaaaaa

SEQ ID NO: 640149 - RNA, 12 nt, Escherichia coli CFT073
ucgcgaaugcuu

SEQ ID NO: 640150 - RNA, 12 nt, Escherichia coli CFT073
ucgcgacgcuga

SEQ ID NO: 640151 - RNA, 15 nt, Escherichia coli CFT073
ucgcgaguucgaguc

SEQ ID NO: 640152 - RNA, 21 nt, Escherichia coli CFT073
ucgcgauagccgcuuucuaac

SEQ ID NO: 640153 - RNA, 18 nt, Escherichia coli CFT073
ucgcgauagcgcaccaac

SEQ ID NO: 640154 - RNA, 16 nt, Escherichia coli CFT073
ucgcgauagcgcaccg

SEQ ID NO: 640155 - RNA, 15 nt, Escherichia coli CFT073
ucgcgauauugcugc

SEQ ID NO: 640156 - RNA, 15 nt, Escherichia coli CFT073
ucgccuugcugccag

SEQ ID NO: 640157 - RNA, 15 nt, Escherichia coli CFT073
ucgccugaugcgaca

SEQ ID NO: 640158 - RNA, 23 nt, Escherichia coli CFT073
ucgccggucaggauguugccacg

SEQ ID NO: 640159 - RNA, 22 nt, Escherichia coli CFT073
ucgccgggaguuucagcggcgu

SEQ ID NO: 640160 - RNA, 18 nt, Escherichia coli CFT073
ucgccgccgcaaacaucg

SEQ ID NO: 640161 - RNA, 14 nt, Escherichia coli CFT073
ucgccgccgcagac

SEQ ID NO: 640162 - RNA, 15 nt, Escherichia coli CFT073
ucgccaguucaguca

SEQ ID NO: 640163 - RNA, 17 nt, Escherichia coli CFT073
ucgccaguucagucagg

SEQ ID NO: 640164 - RNA, 20 nt, Escherichia coli CFT073
ucgccauauuggggaugacg

SEQ ID NO: 640165 - RNA, 22 nt, Escherichia coli CFT073
ucgccaguaccgucgucauguu

SEQ ID NO: 640166 - RNA, 15 nt, Escherichia coli CFT073
ucgccagucccuuuc

SEQ ID NO: 640167 - RNA, 16 nt, Escherichia coli CFT073
ucgccagucccuuuca

SEQ ID NO: 640168 - RNA, 22 nt, Escherichia coli CFT073
ucgccagugacgaccuuuucca

SEQ ID NO: 640169 - RNA, 18 nt, Escherichia coli CFT073
ucgccaguaccagcagcg

SEQ ID NO: 640170 - RNA, 21 nt, Escherichia coli CFT073
ucgccauaaacaccagcagca

SEQ ID NO: 640171 - RNA, 22 nt, Escherichia coli CFT073
ucgccauaaacaccagcagcag

SEQ ID NO: 640172 - RNA, 19 nt, Escherichia coli CFT073
ucgcgcuuaucgccagcgc

SEQ ID NO: 640173 - RNA, 16 nt, Escherichia coli CFT073
ucgcgcucuucuucac

SEQ ID NO: 640174 - RNA, 17 nt, Escherichia coli CFT073
ucgcgcgggaaauuaag

SEQ ID NO: 640175 - RNA, 19 nt, Escherichia coli CFT073
ucgcgcccaaccagcaggu

SEQ ID NO: 640176 - RNA, 21 nt, Escherichia coli CFT073
ucgcgcgaagugagggccagc

SEQ ID NO: 640177 - RNA, 22 nt, Escherichia coli CFT073
ucgcgcgaagugagggccagcg

SEQ ID NO: 640178 - RNA, 20 nt, Escherichia coli CFT073
ucgcgcagucgggugcugcc

SEQ ID NO: 640179 - RNA, 18 nt, Escherichia coli CFT073
ucgcgcaguuuaugcagu

SEQ ID NO: 640180 - RNA, 15 nt, Escherichia coli CFT073
ucgcgccaaccagga

SEQ ID NO: 640181 - RNA, 20 nt, Escherichia coli CFT073
ucgcgccaaucagcgcagca

SEQ ID NO: 640182 - RNA, 12 nt, Escherichia coli CFT073
ucgcuucauuua

SEQ ID NO: 640183 - RNA, 18 nt, Escherichia coli CFT073
ucgcuucccaacgcagca

SEQ ID NO: 640184 - RNA, 20 nt, Escherichia coli CFT073
ucgcuuccggugaaucaauc

SEQ ID NO: 640185 - RNA, 13 nt, Escherichia coli CFT073
ucgcuuccuccac

SEQ ID NO: 640186 - RNA, 18 nt, Escherichia coli CFT073
ucgcuucgauucccagcu

SEQ ID NO: 640187 - RNA, 20 nt, Escherichia coli CFT073
ucgcuucuacgccaucaguu

SEQ ID NO: 640188 - RNA, 14 nt, Escherichia coli CFT073
ucgcuugccgccag

SEQ ID NO: 640189 - RNA, 11 nt, Escherichia coli CFT073
ucgcuucaacc

SEQ ID NO: 640190 - RNA, 18 nt, Escherichia coli CFT073
ucgcuucaagcauugauu

SEQ ID NO: 640191 - RNA, 23 nt, Escherichia coli CFT073
ucgcuucaauacgcuccaguacc

SEQ ID NO: 640192 - RNA, 13 nt, Escherichia coli CFT073
ucgcuuaagccau

SEQ ID NO: 640193 - RNA, 22 nt, Escherichia coli CFT073
ucgcuuaagccaucaucaauau

SEQ ID NO: 640194 - RNA, 15 nt, Escherichia coli CFT073
ucggaaugcacagcc

SEQ ID NO: 640195 - RNA, 20 nt, Escherichia coli CFT073
ucggacaauaguuucaaugc

SEQ ID NO: 640196 - RNA, 20 nt, Escherichia coli CFT073
ucggacguuuucucguccag

SEQ ID NO: 640197 - RNA, 17 nt, Escherichia coli CFT073
ucggcaaggccaauacc

SEQ ID NO: 640198 - RNA, 18 nt, Escherichia coli CFT073
ucggcaauuucagugcug

SEQ ID NO: 640199 - RNA, 16 nt, Escherichia coli CFT073
ucggcaccgccgccaa

SEQ ID NO: 640200 - RNA, 20 nt, Escherichia coli CFT073
ucggcagaguugagcagucc

SEQ ID NO: 640201 - RNA, 16 nt, Escherichia coli CFT073
ucggcacgaccaggaa

SEQ ID NO: 640202 - RNA, 22 nt, Escherichia coli CFT073
ucggcacugaccaccaccaccu

SEQ ID NO: 640203 - RNA, 19 nt, Escherichia coli CFT073
ucgcucacuucacgcugcc

SEQ ID NO: 640204 - RNA, 22 nt, Escherichia coli CFT073
ucgcucaguugggccagaaagg

SEQ ID NO: 640205 - RNA, 13 nt, Escherichia coli CFT073
ucgcucacaucau

SEQ ID NO: 640206 - RNA, 20 nt, Escherichia coli CFT073
ucgcugaacgggccauccau

SEQ ID NO: 640207 - RNA, 21 nt, Escherichia coli CFT073
ucgcugaauaucuaauuauua

SEQ ID NO: 640208 - RNA, 22 nt, Escherichia coli CFT073
ucgcugaugaauuuaucuuuca

SEQ ID NO: 640209 - RNA, 18 nt, Escherichia coli CFT073
ucgcugcaaaacagguca

SEQ ID NO: 640210 - RNA, 19 nt, Escherichia coli CFT073
ucgcuaagcggcuccgguc

SEQ ID NO: 640211 - RNA, 14 nt, Escherichia coli CFT073
ucgcuaaggaaauc

SEQ ID NO: 640212 - RNA, 20 nt, Escherichia coli CFT073
ucgcuaaggguauagaaacc

SEQ ID NO: 640213 - RNA, 21 nt, Escherichia coli CFT073
ucgcuaccuaaugaauccagc

SEQ ID NO: 640214 - RNA, 21 nt, Escherichia coli CFT073
ucgcguaauguuuccagcauc

SEQ ID NO: 640215 - RNA, 21 nt, Escherichia coli CFT073
ucgcgucgccggucaggaugu

SEQ ID NO: 640216 - RNA, 18 nt, Escherichia coli CFT073
ucucacuuggguaacagc

SEQ ID NO: 640217 - RNA, 20 nt, Escherichia coli CFT073
ucucacuuggguaacagccc

SEQ ID NO: 640218 - RNA, 11 nt, Escherichia coli CFT073
ucucacuuuga

SEQ ID NO: 640219 - RNA, 17 nt, Escherichia coli CFT073
ucucagcacauugaugg

SEQ ID NO: 640220 - RNA, 20 nt, Escherichia coli CFT073
ucucacugauuacccuucgc

SEQ ID NO: 640221 - RNA, 15 nt, Escherichia coli CFT073
ucucacucuuucccu

SEQ ID NO: 640222 - RNA, 15 nt, Escherichia coli CFT073
ucucaccuacagcca

SEQ ID NO: 640223 - RNA, 18 nt, Escherichia coli CFT073
ucucaauuccuuugcugc

SEQ ID NO: 640224 - RNA, 16 nt, Escherichia coli CFT073
ucucacaaucaucgca

SEQ ID NO: 640225 - RNA, 14 nt, Escherichia coli CFT073
ucucaagagugaac

SEQ ID NO: 640226 - RNA, 13 nt, Escherichia coli CFT073
ucucaaucaccac

SEQ ID NO: 640227 - RNA, 12 nt, Escherichia coli CFT073
ucucaaucccuu

SEQ ID NO: 640228 - RNA, 19 nt, Escherichia coli CFT073
ucucaaucgcacccgccau

SEQ ID NO: 640229 - RNA, 22 nt, Escherichia coli CFT073
ucucaaccgcuucuuucucaau

SEQ ID NO: 640230 - RNA, 14 nt, Escherichia coli CFT073
ucucaaaacugaaa

SEQ ID NO: 640231 - RNA, 15 nt, Escherichia coli CFT073
ucucaaaucuucuca

SEQ ID NO: 640232 - RNA, 24 nt, Escherichia coli CFT073
ucuauucgaccacgcugcgcugca

SEQ ID NO: 640233 - RNA, 18 nt, Escherichia coli CFT073
ucucauccaauaacguga

SEQ ID NO: 640234 - RNA, 11 nt, Escherichia coli CFT073
ucucaggcaaa

SEQ ID NO: 640235 - RNA, 23 nt, Escherichia coli CFT073
ucuccgggggcgauuucagauca

SEQ ID NO: 640236 - RNA, 20 nt, Escherichia coli CFT073
ucucccauuuuauccucuuc

SEQ ID NO: 640237 - RNA, 16 nt, Escherichia coli CFT073
ucuccaccugcggcac

SEQ ID NO: 640238 - RNA, 17 nt, Escherichia coli CFT073
ucuccuuacugcccccg

SEQ ID NO: 640239 - RNA, 15 nt, Escherichia coli CFT073
ucuccuguuucacuu

SEQ ID NO: 640240 - RNA, 15 nt, Escherichia coli CFT073
ucuccguucaguuua

SEQ ID NO: 640241 - RNA, 21 nt, Escherichia coli CFT073
ucuacuucacggcugcuaaua

SEQ ID NO: 640242 - RNA, 17 nt, Escherichia coli CFT073
ucuacuucuuucaccau

SEQ ID NO: 640243 - RNA, 22 nt, Escherichia coli CFT073
ucuagaaacuguuaagcccauu

SEQ ID NO: 640244 - RNA, 18 nt, Escherichia coli CFT073
ucuauccacauuagucau

SEQ ID NO: 640245 - RNA, 20 nt, Escherichia coli CFT073
ucuaucgccgguugauuuuu

SEQ ID NO: 640246 - RNA, 14 nt, Escherichia coli CFT073
ucuaucacuauaaa

SEQ ID NO: 640247 - RNA, 14 nt, Escherichia coli CFT073
ucuauauuuauuca

SEQ ID NO: 640248 - RNA, 21 nt, Escherichia coli CFT073
ucuauauauguuuuuuuuauc

SEQ ID NO: 640249 - RNA, 20 nt, Escherichia coli CFT073
ucuaugagagccguuaaaac

SEQ ID NO: 640250 - RNA, 20 nt, Escherichia coli CFT073
ucuauuccgcgugaaaugcc

SEQ ID NO: 640251 - RNA, 18 nt, Escherichia coli CFT073
ucuaacgaugccagcgcu

SEQ ID NO: 640252 - RNA, 12 nt, Escherichia coli CFT073
ucuaaugcuccu

SEQ ID NO: 640253 - RNA, 12 nt, Escherichia coli CFT073
ucuaaugcuuuu

SEQ ID NO: 640254 - RNA, 23 nt, Escherichia coli CFT073
ucuaaugccauuaacaucccuuc

SEQ ID NO: 640255 - RNA, 19 nt, Escherichia coli CFT073
ucuaccgucuguaaccaga

SEQ ID NO: 640256 - RNA, 14 nt, Escherichia coli CFT073
ucuaccgcaccuuc

SEQ ID NO: 640257 - RNA, 17 nt, Escherichia coli CFT073
ucuaccuuauccagcag

SEQ ID NO: 640258 - RNA, 19 nt, Escherichia coli CFT073
ucuaccuuauccagcagau

SEQ ID NO: 640259 - RNA, 22 nt, Escherichia coli CFT073
ucuaccuuccuacaagagguca

SEQ ID NO: 640260 - RNA, 21 nt, Escherichia coli CFT073
ucguuuuaaugcgauccugag

SEQ ID NO: 640261 - RNA, 18 nt, Escherichia coli CFT073
ucguuugcauccaguucg

SEQ ID NO: 640262 - RNA, 22 nt, Escherichia coli CFT073
ucguugcugucgcgcagcacuu

SEQ ID NO: 640263 - RNA, 22 nt, Escherichia coli CFT073
ucguugcgccgggaugauggcu

SEQ ID NO: 640264 - RNA, 14 nt, Escherichia coli CFT073
ucguugaagucagg

SEQ ID NO: 640265 - RNA, 19 nt, Escherichia coli CFT073
ucguugauuucaccaucuu

SEQ ID NO: 640266 - RNA, 17 nt, Escherichia coli CFT073
ucguugacgaccagucc

SEQ ID NO: 640267 - RNA, 20 nt, Escherichia coli CFT073
ucguugaguuugauuccugc

SEQ ID NO: 640268 - RNA, 23 nt, Escherichia coli CFT073
ucguugcccgcagauccagugcu

SEQ ID NO: 640269 - RNA, 21 nt, Escherichia coli CFT073
ucuaacaaucuugccauucca

SEQ ID NO: 640270 - RNA, 20 nt, Escherichia coli CFT073
ucuaaagcaacuccaucaag

SEQ ID NO: 640271 - RNA, 16 nt, Escherichia coli CFT073
ucuaaaccccaaccac

SEQ ID NO: 640272 - RNA, 15 nt, Escherichia coli CFT073
ucgugcucuggcagg

SEQ ID NO: 640273 - RNA, 14 nt, Escherichia coli CFT073
ucguggcugaguga

SEQ ID NO: 640274 - RNA, 22 nt, Escherichia coli CFT073
ucguggguucaucgagcagcau

SEQ ID NO: 640275 - RNA, 13 nt, Escherichia coli CFT073
ucgugcaccgccu

SEQ ID NO: 640276 - RNA, 17 nt, Escherichia coli CFT073
ucgugcaccgccuguug

SEQ ID NO: 640277 - RNA, 20 nt, Escherichia coli CFT073
ucgugcuggauuugugucag

SEQ ID NO: 640278 - RNA, 21 nt, Escherichia coli CFT073
ucgugcuggauuugugucaga

SEQ ID NO: 640279 - RNA, 12 nt, Escherichia coli CFT073
ucgugcucgcuu

SEQ ID NO: 640280 - RNA, 16 nt, Escherichia coli CFT073
ucgugcgggaccagca

SEQ ID NO: 640281 - RNA, 18 nt, Escherichia coli CFT073
ucgugcggguaaccagcc

SEQ ID NO: 640282 - RNA, 15 nt, Escherichia coli CFT073
ucgucugguuuuccu

SEQ ID NO: 640283 - RNA, 23 nt, Escherichia coli CFT073
ucgucuggcuguaguuucagugc

SEQ ID NO: 640284 - RNA, 17 nt, Escherichia coli CFT073
ucgucuucgucccaguc

SEQ ID NO: 640285 - RNA, 13 nt, Escherichia coli CFT073
ucgugcaccaauu

SEQ ID NO: 640286 - RNA, 14 nt, Escherichia coli CFT073
ucggcaugaaucau

SEQ ID NO: 640287 - RNA, 18 nt, Escherichia coli CFT073
ucggcauacagcgacaga

SEQ ID NO: 640288 - RNA, 22 nt, Escherichia coli CFT073
ucggcaguaucggagauaacca

SEQ ID NO: 640289 - RNA, 19 nt, Escherichia coli CFT073
ucggcauacaccaccacau

SEQ ID NO: 640290 - RNA, 18 nt, Escherichia coli CFT073
ucgguuacuauccugaaa

SEQ ID NO: 640291 - RNA, 18 nt, Escherichia coli CFT073
ucgguuaccacaccggca

SEQ ID NO: 640292 - RNA, 12 nt, Escherichia coli CFT073
ucgguugccaua

SEQ ID NO: 640293 - RNA, 18 nt, Escherichia coli CFT073
ucgguuguuuuaauaucu

SEQ ID NO: 640294 - RNA, 14 nt, Escherichia coli CFT073
ucgguuguuuucag

SEQ ID NO: 640295 - RNA, 16 nt, Escherichia coli CFT073
ucguagccaccaucuu

SEQ ID NO: 640296 - RNA, 18 nt, Escherichia coli CFT073
ucguagccaccaucuuuu

SEQ ID NO: 640297 - RNA, 20 nt, Escherichia coli CFT073
ucgucaaagauauuauuaaa

SEQ ID NO: 640298 - RNA, 12 nt, Escherichia coli CFT073
ucguaggccuga

SEQ ID NO: 640299 - RNA, 22 nt, Escherichia coli CFT073
ucguagguuuugucgaacaggu

SEQ ID NO: 640300 - RNA, 21 nt, Escherichia coli CFT073
ucgucacgcgcgccaagcccg

SEQ ID NO: 640301 - RNA, 20 nt, Escherichia coli CFT073
ucgucacgucgucaggcaau

SEQ ID NO: 640302 - RNA, 15 nt, Escherichia coli CFT073
ucgucacucacgcug

SEQ ID NO: 640303 - RNA, 15 nt, Escherichia coli CFT073
ucgucaacuucuuua

SEQ ID NO: 640304 - RNA, 17 nt, Escherichia coli CFT073
ucgucaauaaucaugca

SEQ ID NO: 640305 - RNA, 14 nt, Escherichia coli CFT073
ucgucagaaauggu

SEQ ID NO: 640306 - RNA, 23 nt, Escherichia coli CFT073
ucgucaggaucagccauuuugca

SEQ ID NO: 640307 - RNA, 16 nt, Escherichia coli CFT073
ucgucaggauuaaacu

SEQ ID NO: 640308 - RNA, 21 nt, Escherichia coli CFT073
ucgucaggggcauuuuccagu

SEQ ID NO: 640309 - RNA, 14 nt, Escherichia coli CFT073
ucgucaguuuauac

SEQ ID NO: 640310 - RNA, 23 nt, Escherichia coli CFT073
ucgucaucaaacggcauaugcca

SEQ ID NO: 640311 - RNA, 15 nt, Escherichia coli CFT073
ucgucaucagcucca

SEQ ID NO: 640312 - RNA, 13 nt, Escherichia coli CFT073
ucgucaucccagu

SEQ ID NO: 640313 - RNA, 18 nt, Escherichia coli CFT073
ucugauucccugccugac

SEQ ID NO: 640314 - RNA, 13 nt, Escherichia coli CFT073
ucugauucuuccc

SEQ ID NO: 640315 - RNA, 21 nt, Escherichia coli CFT073
ucugcagggcaauagccagcg

SEQ ID NO: 640316 - RNA, 16 nt, Escherichia coli CFT073
ucugccauauccagcc

SEQ ID NO: 640317 - RNA, 19 nt, Escherichia coli CFT073
ucugccagccagucagucu

SEQ ID NO: 640318 - RNA, 14 nt, Escherichia coli CFT073
ucugccaguacugc

SEQ ID NO: 640319 - RNA, 15 nt, Escherichia coli CFT073
ucugccacggcagaa

SEQ ID NO: 640320 - RNA, 13 nt, Escherichia coli CFT073
ucugccacuucuu

SEQ ID NO: 640321 - RNA, 23 nt, Escherichia coli CFT073
ucugcauccugaauauccuguuc

SEQ ID NO: 640322 - RNA, 11 nt, Escherichia coli CFT073
ucugcauugcg

SEQ ID NO: 640323 - RNA, 20 nt, Escherichia coli CFT073
ucugccaaacgcucccagcc

SEQ ID NO: 640324 - RNA, 19 nt, Escherichia coli CFT073
ucugccgcuuaaauuggcg

SEQ ID NO: 640325 - RNA, 16 nt, Escherichia coli CFT073
ucugccggaagacaca

SEQ ID NO: 640326 - RNA, 15 nt, Escherichia coli CFT073
ucugccggaauaauc

SEQ ID NO: 640327 - RNA, 20 nt, Escherichia coli CFT073
ucugcccugccaucacuauu

SEQ ID NO: 640328 - RNA, 15 nt, Escherichia coli CFT073
ucugcccuuuaguau

SEQ ID NO: 640329 - RNA, 24 nt, Escherichia coli CFT073
ucugccgcauggaaccaguucacu

SEQ ID NO: 640330 - RNA, 21 nt, Escherichia coli CFT073
ucugcccguacccaacacucg

SEQ ID NO: 640331 - RNA, 13 nt, Escherichia coli CFT073
ucugccgguucca

SEQ ID NO: 640332 - RNA, 17 nt, Escherichia coli CFT073
ucugccgggaagcucuc

SEQ ID NO: 640333 - RNA, 23 nt, Escherichia coli CFT073
ucugccuugaguuuuucaucccu

SEQ ID NO: 640334 - RNA, 16 nt, Escherichia coli CFT073
ucugccugguuucucu

SEQ ID NO: 640335 - RNA, 16 nt, Escherichia coli CFT073
ucugaacguucugcug

SEQ ID NO: 640336 - RNA, 13 nt, Escherichia coli CFT073
ucugaaugccagu

SEQ ID NO: 640337 - RNA, 23 nt, Escherichia coli CFT073
ucugacauagccacucaccgccg

SEQ ID NO: 640338 - RNA, 22 nt, Escherichia coli CFT073
ucugacaccccgguaaagcgca

SEQ ID NO: 640339 - RNA, 21 nt, Escherichia coli CFT073
ucugaccaauagauauucauc

SEQ ID NO: 640340 - RNA, 20 nt, Escherichia coli CFT073
ucugaccacggccauaucca

SEQ ID NO: 640341 - RNA, 15 nt, Escherichia coli CFT073
ucugagcgaagcgca

SEQ ID NO: 640342 - RNA, 16 nt, Escherichia coli CFT073
ucugagcgaagcgcau

SEQ ID NO: 640343 - RNA, 17 nt, Escherichia coli CFT073
ucugauagaacauguca

SEQ ID NO: 640344 - RNA, 19 nt, Escherichia coli CFT073
ucugauguugaaugugacc

SEQ ID NO: 640345 - RNA, 19 nt, Escherichia coli CFT073
ucugauaaaugaagaaaaa

SEQ ID NO: 640346 - RNA, 17 nt, Escherichia coli CFT073
ucuccuuuaccacucuc

SEQ ID NO: 640347 - RNA, 24 nt, Escherichia coli CFT073
ucuccuuuauagugugcaaucacu

SEQ ID NO: 640348 - RNA, 14 nt, Escherichia coli CFT073
ucucgaaacgcuuu

SEQ ID NO: 640349 - RNA, 19 nt, Escherichia coli CFT073
ucucgcgcccaaccagcag

SEQ ID NO: 640350 - RNA, 17 nt, Escherichia coli CFT073
ucucgcccgucuuccag

SEQ ID NO: 640351 - RNA, 21 nt, Escherichia coli CFT073
ucucgcucgagagagaaaaua

SEQ ID NO: 640352 - RNA, 19 nt, Escherichia coli CFT073
ucuguugccgcuacaucac

SEQ ID NO: 640353 - RNA, 16 nt, Escherichia coli CFT073
ucuguucuggaaaaaa

SEQ ID NO: 640354 - RNA, 13 nt, Escherichia coli CFT073
ucuguucuuucaa

SEQ ID NO: 640355 - RNA, 15 nt, Escherichia coli CFT073
ucuguggcagggcag

SEQ ID NO: 640356 - RNA, 22 nt, Escherichia coli CFT073
ucugugggacacauaaccaggu

SEQ ID NO: 640357 - RNA, 16 nt, Escherichia coli CFT073
ucuggucuggcccacg

SEQ ID NO: 640358 - RNA, 16 nt, Escherichia coli CFT073
ucuggucaacaaccag

SEQ ID NO: 640359 - RNA, 16 nt, Escherichia coli CFT073
ucugguaggccugaua

SEQ ID NO: 640360 - RNA, 14 nt, Escherichia coli CFT073
ucuggugccagcgc

SEQ ID NO: 640361 - RNA, 17 nt, Escherichia coli CFT073
ucuggugccagcgccag

SEQ ID NO: 640362 - RNA, 22 nt, Escherichia coli CFT073
ucugugaagcaugaguaacccg

SEQ ID NO: 640363 - RNA, 24 nt, Escherichia coli CFT073
ucugugacguuguccagcuuaauu

SEQ ID NO: 640364 - RNA, 18 nt, Escherichia coli CFT073
ucugugcgucugcuuuua

SEQ ID NO: 640365 - RNA, 14 nt, Escherichia coli CFT073
ucuguaugucagua

SEQ ID NO: 640366 - RNA, 12 nt, Escherichia coli CFT073
ucuguauucauc

SEQ ID NO: 640367 - RNA, 15 nt, Escherichia coli CFT073
ucuguauuuggcugc

SEQ ID NO: 640368 - RNA, 21 nt, Escherichia coli CFT073
ucugcgacgguuucuggcgua

SEQ ID NO: 640369 - RNA, 14 nt, Escherichia coli CFT073
ucugcgccacgaaa

SEQ ID NO: 640370 - RNA, 20 nt, Escherichia coli CFT073
ucuggaugccaucgcaugac

SEQ ID NO: 640371 - RNA, 16 nt, Escherichia coli CFT073
ucuggauuuacugcau

SEQ ID NO: 640372 - RNA, 20 nt, Escherichia coli CFT073
ucugggcaaaaucaucacuc

SEQ ID NO: 640373 - RNA, 17 nt, Escherichia coli CFT073
ucugguaacccauccag

SEQ ID NO: 640374 - RNA, 19 nt, Escherichia coli CFT073
ucuggccccaccugcucga

SEQ ID NO: 640375 - RNA, 23 nt, Escherichia coli CFT073
ucuggcaauucgugaugcccuga

SEQ ID NO: 640376 - RNA, 17 nt, Escherichia coli CFT073
ucuggcagauccugaaa

SEQ ID NO: 640377 - RNA, 20 nt, Escherichia coli CFT073
ucuggcagauccugaaauuc

SEQ ID NO: 640378 - RNA, 20 nt, Escherichia coli CFT073
ucuggcauaaacaaagcgca

SEQ ID NO: 640379 - RNA, 21 nt, Escherichia coli CFT073
ucuggcaucggcgcacaaccg

SEQ ID NO: 640380 - RNA, 22 nt, Escherichia coli CFT073
ucuggcaugacaggcaaccggu

SEQ ID NO: 640381 - RNA, 21 nt, Escherichia coli CFT073
ucuggcauuaacgcgaaauaa

SEQ ID NO: 640382 - RNA, 21 nt, Escherichia coli CFT073
ucuugauuugcuuguuucauu

SEQ ID NO: 640383 - RNA, 15 nt, Escherichia coli CFT073
ucuugccacuggccu

SEQ ID NO: 640384 - RNA, 17 nt, Escherichia coli CFT073
ucuugccagauuuucuu

SEQ ID NO: 640385 - RNA, 15 nt, Escherichia coli CFT073
ucuugccucccugca

SEQ ID NO: 640386 - RNA, 22 nt, Escherichia coli CFT073
ucuugcgcggauggccucugcc

SEQ ID NO: 640387 - RNA, 21 nt, Escherichia coli CFT073
ucuugguuacgcaagccaggu

SEQ ID NO: 640388 - RNA, 23 nt, Escherichia coli CFT073
ucuuguaacgaguacaaaaauaa

SEQ ID NO: 640389 - RNA, 21 nt, Escherichia coli CFT073
ucuuuaguugagcuuuuuccg

SEQ ID NO: 640390 - RNA, 20 nt, Escherichia coli CFT073
ucuuuacucauuaugucauu

SEQ ID NO: 640391 - RNA, 21 nt, Escherichia coli CFT073
ucuuuaccgcugucgaucaga

SEQ ID NO: 640392 - RNA, 17 nt, Escherichia coli CFT073
ucuucuuuuuccgggcc

SEQ ID NO: 640393 - RNA, 23 nt, Escherichia coli CFT073
ucuugagacagaaacaaaugaaa

SEQ ID NO: 640394 - RNA, 12 nt, Escherichia coli CFT073
ucuugacuauca

SEQ ID NO: 640395 - RNA, 19 nt, Escherichia coli CFT073
ucuucuugcguuuuuugau

SEQ ID NO: 640396 - RNA, 14 nt, Escherichia coli CFT073
ucuucuuccgcuuc

SEQ ID NO: 640397 - RNA, 18 nt, Escherichia coli CFT073
ucuucuguuaaaucaucc

SEQ ID NO: 640398 - RNA, 18 nt, Escherichia coli CFT073
ucuucugcuucauguugc

SEQ ID NO: 640399 - RNA, 14 nt, Escherichia coli CFT073
ucuucguucuucuu

SEQ ID NO: 640400 - RNA, 19 nt, Escherichia coli CFT073
ucuucguuaauuucugcuu

SEQ ID NO: 640401 - RNA, 22 nt, Escherichia coli CFT073
ucuucguuaauuucugcuuuac

SEQ ID NO: 640402 - RNA, 15 nt, Escherichia coli CFT073
ucuucguuuucugcg

SEQ ID NO: 640403 - RNA, 23 nt, Escherichia coli CFT073
ucuucguuuucugcgcugaggau

SEQ ID NO: 640404 - RNA, 17 nt, Escherichia coli CFT073
ucuucgcuggaucgaac

SEQ ID NO: 640405 - RNA, 17 nt, Escherichia coli CFT073
ucuucggcgaaaaucau

SEQ ID NO: 640406 - RNA, 16 nt, Escherichia coli CFT073
ucuucggcuucuaccu

SEQ ID NO: 640407 - RNA, 21 nt, Escherichia coli CFT073
ucuucgguggucauuuuauug

SEQ ID NO: 640408 - RNA, 13 nt, Escherichia coli CFT073
ucuucguaccaaa

SEQ ID NO: 640409 - RNA, 15 nt, Escherichia coli CFT073
ucuucuccagcugcg

SEQ ID NO: 640410 - RNA, 14 nt, Escherichia coli CFT073
ucuucuaauugugc

SEQ ID NO: 640411 - RNA, 16 nt, Escherichia coli CFT073
ucuucgaguaaaaaga

SEQ ID NO: 640412 - RNA, 17 nt, Escherichia coli CFT073
ucuucgauauugacgau

SEQ ID NO: 640413 - RNA, 23 nt, Escherichia coli CFT073
ucuucgauuuaaccgcuuucacc

SEQ ID NO: 640414 - RNA, 13 nt, Escherichia coli CFT073
ucuucgaaaugcu

SEQ ID NO: 640415 - RNA, 14 nt, Escherichia coli CFT073
ucuucgaagaaaaa

SEQ ID NO: 640416 - RNA, 20 nt, Escherichia coli CFT073
ucuucgaccgucaccagucc

SEQ ID NO: 640417 - RNA, 13 nt, Escherichia coli CFT073
ucuucgcuuucaa

SEQ ID NO: 640418 - RNA, 20 nt, Escherichia coli CFT073
ucuucgcguuacggaucaga

SEQ ID NO: 640419 - RNA, 13 nt, Escherichia coli CFT073
ucuuaagauauaa

SEQ ID NO: 640420 - RNA, 18 nt, Escherichia coli CFT073
ucuuaagguuuuuuccuu

SEQ ID NO: 640421 - RNA, 13 nt, Escherichia coli CFT073
ucuuaauaaacgu

SEQ ID NO: 640422 - RNA, 21 nt, Escherichia coli CFT073
ucuucauacguggcagaaugg

SEQ ID NO: 640423 - RNA, 22 nt, Escherichia coli CFT073
ucuucauaacuuugaucgcguu

SEQ ID NO: 640424 - RNA, 12 nt, Escherichia coli CFT073
ucuucagcuuuc

SEQ ID NO: 640425 - RNA, 23 nt, Escherichia coli CFT073
ucuucaggaggagauauuuaaca

SEQ ID NO: 640426 - RNA, 20 nt, Escherichia coli CFT073
ucuuacagggcguauaacac

SEQ ID NO: 640427 - RNA, 22 nt, Escherichia coli CFT073
ucuucaggccaauucacuucac

SEQ ID NO: 640428 - RNA, 13 nt, Escherichia coli CFT073
ucuucauuaccuu

SEQ ID NO: 640429 - RNA, 21 nt, Escherichia coli CFT073
ucuucccggcucaguaaaauc

SEQ ID NO: 640430 - RNA, 15 nt, Escherichia coli CFT073
ucuuccggcuguagc

SEQ ID NO: 640431 - RNA, 17 nt, Escherichia coli CFT073
ucuuccgggaaaacauc

SEQ ID NO: 640432 - RNA, 17 nt, Escherichia coli CFT073
ucuuccgggcaacaauc

SEQ ID NO: 640433 - RNA, 15 nt, Escherichia coli CFT073
ucuuccgggcuauac

SEQ ID NO: 640434 - RNA, 22 nt, Escherichia coli CFT073
ucuuccgggcuauacacccuuc

SEQ ID NO: 640435 - RNA, 14 nt, Escherichia coli CFT073
ucuuccgccagcau

SEQ ID NO: 640436 - RNA, 19 nt, Escherichia coli CFT073
ucuuccggaaccaccagau

SEQ ID NO: 640437 - RNA, 23 nt, Escherichia coli CFT073
ucuuccggaguaaugaaaccgaa

SEQ ID NO: 640438 - RNA, 19 nt, Escherichia coli CFT073
ucuuccggcaccauuccac

SEQ ID NO: 640439 - RNA, 18 nt, Escherichia coli CFT073
ucuuccgucgccagaaag

SEQ ID NO: 640440 - RNA, 19 nt, Escherichia coli CFT073
uguaaaucgcuguuguucu

SEQ ID NO: 640441 - RNA, 16 nt, Escherichia coli CFT073
uguaacccaccaugcc

SEQ ID NO: 640442 - RNA, 17 nt, Escherichia coli CFT073
uguaaccuaauuuauua

SEQ ID NO: 640443 - RNA, 12 nt, Escherichia coli CFT073
uguaacgauggc

SEQ ID NO: 640444 - RNA, 17 nt, Escherichia coli CFT073
uguaacucgaauuauuc

SEQ ID NO: 640445 - RNA, 20 nt, Escherichia coli CFT073
uguaacucgaauuauucaga

SEQ ID NO: 640446 - RNA, 20 nt, Escherichia coli CFT073
uguaacucgucgucacucac

SEQ ID NO: 640447 - RNA, 21 nt, Escherichia coli CFT073
uguaagacauuuaacccuuca

SEQ ID NO: 640448 - RNA, 14 nt, Escherichia coli CFT073
uguaaagugaaaua

SEQ ID NO: 640449 - RNA, 16 nt, Escherichia coli CFT073
uguaaagugaaauauu

SEQ ID NO: 640450 - RNA, 15 nt, Escherichia coli CFT073
uguaaauaauugaau

SEQ ID NO: 640451 - RNA, 11 nt, Escherichia coli CFT073
uguaaauauug

SEQ ID NO: 640452 - RNA, 12 nt, Escherichia coli CFT073
uguaaacaacau

SEQ ID NO: 640453 - RNA, 13 nt, Escherichia coli CFT073
uguaaacccagcc

SEQ ID NO: 640454 - RNA, 14 nt, Escherichia coli CFT073
uguaaaacagccaa

SEQ ID NO: 640455 - RNA, 19 nt, Escherichia coli CFT073
ugguucaggcguuucuuca

SEQ ID NO: 640456 - RNA, 20 nt, Escherichia coli CFT073
ugguuauccagcaaccaggu

SEQ ID NO: 640457 - RNA, 19 nt, Escherichia coli CFT073
ugguuaucucgaauuguca

SEQ ID NO: 640458 - RNA, 23 nt, Escherichia coli CFT073
uguaauuucacaccaucaacaaa

SEQ ID NO: 640459 - RNA, 15 nt, Escherichia coli CFT073
uguaauacaaacuca

SEQ ID NO: 640460 - RNA, 23 nt, Escherichia coli CFT073
uguaauacaaacucacugccagc

SEQ ID NO: 640461 - RNA, 13 nt, Escherichia coli CFT073
uguacaacacagu

SEQ ID NO: 640462 - RNA, 14 nt, Escherichia coli CFT073
uguacaugcugcuu

SEQ ID NO: 640463 - RNA, 15 nt, Escherichia coli CFT073
uguacaugcugcuuu

SEQ ID NO: 640464 - RNA, 12 nt, Escherichia coli CFT073
uguaccacccug

SEQ ID NO: 640465 - RNA, 14 nt, Escherichia coli CFT073
uguaccagacugac

SEQ ID NO: 640466 - RNA, 14 nt, Escherichia coli CFT073
uguaccaaaaucau

SEQ ID NO: 640467 - RNA, 16 nt, Escherichia coli CFT073
uguaccugucgggaca

SEQ ID NO: 640468 - RNA, 21 nt, Escherichia coli CFT073
uguacuaaccaugcgcccauc

SEQ ID NO: 640469 - RNA, 20 nt, Escherichia coli CFT073
uguacuuaaaacucacccug

SEQ ID NO: 640470 - RNA, 15 nt, Escherichia coli CFT073
uguacuuuaaaauaa

SEQ ID NO: 640471 - RNA, 16 nt, Escherichia coli CFT073
uguacuuuaaaauaag

SEQ ID NO: 640472 - RNA, 19 nt, Escherichia coli CFT073
uguauuaauaccagaauaa

SEQ ID NO: 640473 - RNA, 22 nt, Escherichia coli CFT073
uguaugguauaucguuuuucau

SEQ ID NO: 640474 - RNA, 19 nt, Escherichia coli CFT073
ugucacaaucccuuccacc

SEQ ID NO: 640475 - RNA, 12 nt, Escherichia coli CFT073
uguaucccagcc

SEQ ID NO: 640476 - RNA, 22 nt, Escherichia coli CFT073
uguauccggcaugaacaaaaca

SEQ ID NO: 640477 - RNA, 17 nt, Escherichia coli CFT073
uguaucgcccuuaccau

SEQ ID NO: 640478 - RNA, 18 nt, Escherichia coli CFT073
uguauauuauccaucaaa

SEQ ID NO: 640479 - RNA, 15 nt, Escherichia coli CFT073
uguauaccgggcuuu

SEQ ID NO: 640480 - RNA, 19 nt, Escherichia coli CFT073
uguauacgggcuuuuuaau

SEQ ID NO: 640481 - RNA, 16 nt, Escherichia coli CFT073
uguauacaaaaucugu

SEQ ID NO: 640482 - RNA, 22 nt, Escherichia coli CFT073
uguauacaaaaucuguacagga

SEQ ID NO: 640483 - RNA, 15 nt, Escherichia coli CFT073
uguagauauucuucc

SEQ ID NO: 640484 - RNA, 18 nt, Escherichia coli CFT073
uguagcggaucgccgccg

SEQ ID NO: 640485 - RNA, 13 nt, Escherichia coli CFT073
uguagcucaucug

SEQ ID NO: 640486 - RNA, 15 nt, Escherichia coli CFT073
uguagucugaauuga

SEQ ID NO: 640487 - RNA, 18 nt, Escherichia coli CFT073
uguagucauuuuuugcaa

SEQ ID NO: 640488 - RNA, 12 nt, Escherichia coli CFT073
uguagguaaaac

SEQ ID NO: 640489 - RNA, 16 nt, Escherichia coli CFT073
uguaggguggcgucaa

SEQ ID NO: 640490 - RNA, 11 nt, Escherichia coli CFT073
uguaggccuga

SEQ ID NO: 640491 - RNA, 17 nt, Escherichia coli CFT073
uguaggcauacacauca

SEQ ID NO: 640492 - RNA, 21 nt, Escherichia coli CFT073
uguaggcauauuugguaucaa

SEQ ID NO: 640493 - RNA, 14 nt, Escherichia coli CFT073
uguaggccagauaa

SEQ ID NO: 640494 - RNA, 18 nt, Escherichia coli CFT073
uguaggcccgauaagcuu

SEQ ID NO: 640495 - RNA, 19 nt, Escherichia coli CFT073
ugguaaaaccgacuuaaaa

SEQ ID NO: 640496 - RNA, 15 nt, Escherichia coli CFT073
ugguaccaggaucag

SEQ ID NO: 640497 - RNA, 20 nt, Escherichia coli CFT073
ugguaaaaccgguuuugguu

SEQ ID NO: 640498 - RNA, 15 nt, Escherichia coli CFT073
uggguuucauccugc

SEQ ID NO: 640499 - RNA, 16 nt, Escherichia coli CFT073
uggguuucuaauuuuu

SEQ ID NO: 640500 - RNA, 20 nt, Escherichia coli CFT073
ugggugugcguggguuuucc

SEQ ID NO: 640501 - RNA, 16 nt, Escherichia coli CFT073
uggguucuuuccugcg

SEQ ID NO: 640502 - RNA, 14 nt, Escherichia coli CFT073
ugguauagaaugca

SEQ ID NO: 640503 - RNA, 21 nt, Escherichia coli CFT073
ugguauagaaugcagcagcaa

SEQ ID NO: 640504 - RNA, 15 nt, Escherichia coli CFT073
ugguauaaaggguau

SEQ ID NO: 640505 - RNA, 20 nt, Escherichia coli CFT073
ugguacuucaaucgccacca

SEQ ID NO: 640506 - RNA, 21 nt, Escherichia coli CFT073
ugguaguugauuuuaacuauc

SEQ ID NO: 640507 - RNA, 18 nt, Escherichia coli CFT073
ugguaugccauccggcuc

SEQ ID NO: 640508 - RNA, 12 nt, Escherichia coli CFT073
uggucagcaucg

SEQ ID NO: 640509 - RNA, 18 nt, Escherichia coli CFT073
uggucagaucagccacuu

SEQ ID NO: 640510 - RNA, 18 nt, Escherichia coli CFT073
ugguccggcgguguaaug

SEQ ID NO: 640511 - RNA, 13 nt, Escherichia coli CFT073
ugguccgauugua

SEQ ID NO: 640512 - RNA, 21 nt, Escherichia coli CFT073
ugguccgauuguacuuuaaaa

SEQ ID NO: 640513 - RNA, 21 nt, Escherichia coli CFT073
uggugaauuugucgauuucca

SEQ ID NO: 640514 - RNA, 13 nt, Escherichia coli CFT073
uggucgugguaau

SEQ ID NO: 640515 - RNA, 12 nt, Escherichia coli CFT073
ugguggcgucau

SEQ ID NO: 640516 - RNA, 18 nt, Escherichia coli CFT073
ugguggcaggcaaaaaug

SEQ ID NO: 640517 - RNA, 20 nt, Escherichia coli CFT073
ugggugccggauacaaaaaa

SEQ ID NO: 640518 - RNA, 17 nt, Escherichia coli CFT073
ugggugauuaaauucag

SEQ ID NO: 640519 - RNA, 21 nt, Escherichia coli CFT073
ugggucuaaaaacaauucuuc

SEQ ID NO: 640520 - RNA, 17 nt, Escherichia coli CFT073
uggggcgucaacgcugc

SEQ ID NO: 640521 - RNA, 23 nt, Escherichia coli CFT073
uggggcgucaacgcugccaugau

SEQ ID NO: 640522 - RNA, 14 nt, Escherichia coli CFT073
uggggcauuuuuuc

SEQ ID NO: 640523 - RNA, 16 nt, Escherichia coli CFT073
uggggcauuuuuucca

SEQ ID NO: 640524 - RNA, 16 nt, Escherichia coli CFT073
ugggcaugcuucacug

SEQ ID NO: 640525 - RNA, 21 nt, Escherichia coli CFT073
ugggcgacggcuugccaugcc

SEQ ID NO: 640526 - RNA, 16 nt, Escherichia coli CFT073
ugggcaaaaucaucac

SEQ ID NO: 640527 - RNA, 21 nt, Escherichia coli CFT073
ugggauuuauuuaccgcuacu

SEQ ID NO: 640528 - RNA, 17 nt, Escherichia coli CFT073
ugggauuuggcagcacc

SEQ ID NO: 640529 - RNA, 15 nt, Escherichia coli CFT073
ugggauguugauuaa

SEQ ID NO: 640530 - RNA, 20 nt, Escherichia coli CFT073
ugggauuaaggcuuccagcg

SEQ ID NO: 640531 - RNA, 20 nt, Escherichia coli CFT073
ugggcaggccaggguaaaaa

SEQ ID NO: 640532 - RNA, 21 nt, Escherichia coli CFT073
uggcuuugcccuuucugcauc

SEQ ID NO: 640533 - RNA, 14 nt, Escherichia coli CFT073
uggcuuuccgggag

SEQ ID NO: 640534 - RNA, 21 nt, Escherichia coli CFT073
uggcgcgaaaacaacuggcaa

SEQ ID NO: 640535 - RNA, 17 nt, Escherichia coli CFT073
uggcgccaguuauucau

SEQ ID NO: 640536 - RNA, 18 nt, Escherichia coli CFT073
uggcgauucagcaacauc

SEQ ID NO: 640537 - RNA, 19 nt, Escherichia coli CFT073
uggcgauguaauucagcca

SEQ ID NO: 640538 - RNA, 22 nt, Escherichia coli CFT073
uggcgauugaagcagcgcugga

SEQ ID NO: 640539 - RNA, 15 nt, Escherichia coli CFT073
uggcgaauucugcag

SEQ ID NO: 640540 - RNA, 17 nt, Escherichia coli CFT073
uggcgaauuuguucccc

SEQ ID NO: 640541 - RNA, 15 nt, Escherichia coli CFT073
uggcgacugccagcc

SEQ ID NO: 640542 - RNA, 12 nt, Escherichia coli CFT073
uggcgagagccg

SEQ ID NO: 640543 - RNA, 14 nt, Escherichia coli CFT073
uggcgaggaacgcc

SEQ ID NO: 640544 - RNA, 19 nt, Escherichia coli CFT073
uggcgaguauugcuuugcu

SEQ ID NO: 640545 - RNA, 22 nt, Escherichia coli CFT073
uggcgauaaucgaaccaaacag

SEQ ID NO: 640546 - RNA, 17 nt, Escherichia coli CFT073
uggccucguggaaaccg

SEQ ID NO: 640547 - RNA, 13 nt, Escherichia coli CFT073
uggccugaauaac

SEQ ID NO: 640548 - RNA, 21 nt, Escherichia coli CFT073
uggccugaugcgcuuaucaga

SEQ ID NO: 640549 - RNA, 14 nt, Escherichia coli CFT073
uggccuuugcgaug

SEQ ID NO: 640550 - RNA, 17 nt, Escherichia coli CFT073
uggccuuuaacacgcaa

SEQ ID NO: 640551 - RNA, 13 nt, Escherichia coli CFT073
uggccuucuucau

SEQ ID NO: 640552 - RNA, 14 nt, Escherichia coli CFT073
uggccuucuucauc

SEQ ID NO: 640553 - RNA, 17 nt, Escherichia coli CFT073
uggccgcgcaauugcug

SEQ ID NO: 640554 - RNA, 17 nt, Escherichia coli CFT073
uggccguacccagcggu

SEQ ID NO: 640555 - RNA, 17 nt, Escherichia coli CFT073
uggccgggcgaugcagc

SEQ ID NO: 640556 - RNA, 23 nt, Escherichia coli CFT073
uggcauccccugccccaucugcc

SEQ ID NO: 640557 - RNA, 15 nt, Escherichia coli CFT073
uggcauccuguuuuc

SEQ ID NO: 640558 - RNA, 19 nt, Escherichia coli CFT073
uggcaucaaugauaugugc

SEQ ID NO: 640559 - RNA, 20 nt, Escherichia coli CFT073
uggcaucaaugauaugugca

SEQ ID NO: 640560 - RNA, 16 nt, Escherichia coli CFT073
uggcaucaagaaaacu

SEQ ID NO: 640561 - RNA, 19 nt, Escherichia coli CFT073
uggcaucaccaucgggcca

SEQ ID NO: 640562 - RNA, 19 nt, Escherichia coli CFT073
uggcaucacgcaauugcug

SEQ ID NO: 640563 - RNA, 21 nt, Escherichia coli CFT073
uggcaucuguuaucucaacgu

SEQ ID NO: 640564 - RNA, 19 nt, Escherichia coli CFT073
uggcaucggcgcacaaccg

SEQ ID NO: 640565 - RNA, 24 nt, Escherichia coli CFT073
uggcauguuaccgauagauuuggu

SEQ ID NO: 640566 - RNA, 16 nt, Escherichia coli CFT073
uggcauguuaugaaua

SEQ ID NO: 640567 - RNA, 20 nt, Escherichia coli CFT073
uggcauuaaauucagcaaau

SEQ ID NO: 640568 - RNA, 17 nt, Escherichia coli CFT073
uggcauuaauaugcuca

SEQ ID NO: 640569 - RNA, 15 nt, Escherichia coli CFT073
uggcauuaccccgua

SEQ ID NO: 640570 - RNA, 22 nt, Escherichia coli CFT073
uggcauugggugcuugaggcug

SEQ ID NO: 640571 - RNA, 17 nt, Escherichia coli CFT073
uggcauugguauuccag

SEQ ID NO: 640572 - RNA, 20 nt, Escherichia coli CFT073
uggcauuccgucaauaggca

SEQ ID NO: 640573 - RNA, 16 nt, Escherichia coli CFT073
uggccaacgcuuucga

SEQ ID NO: 640574 - RNA, 20 nt, Escherichia coli CFT073
uggccaauaaagaaucacug

SEQ ID NO: 640575 - RNA, 14 nt, Escherichia coli CFT073
uggccagcaacagc

SEQ ID NO: 640576 - RNA, 18 nt, Escherichia coli CFT073
uggccagcaacagcgcgu

SEQ ID NO: 640577 - RNA, 21 nt, Escherichia coli CFT073
uggccagucgcaaaucagcgg

SEQ ID NO: 640578 - RNA, 15 nt, Escherichia coli CFT073
uggccaauuggcugg

SEQ ID NO: 640579 - RNA, 20 nt, Escherichia coli CFT073
uggccaauuggcuggcccuu

SEQ ID NO: 640580 - RNA, 22 nt, Escherichia coli CFT073
uggcccgcgcagcucuuuaucc

SEQ ID NO: 640581 - RNA, 16 nt, Escherichia coli CFT073
uggcccgccaagcauc

SEQ ID NO: 640582 - RNA, 18 nt, Escherichia coli CFT073
uggccaugauuaccagca

SEQ ID NO: 640583 - RNA, 21 nt, Escherichia coli CFT073
uggccaugauuaccagcauca

SEQ ID NO: 640584 - RNA, 13 nt, Escherichia coli CFT073
uggcccaucaucu

SEQ ID NO: 640585 - RNA, 18 nt, Escherichia coli CFT073
uggcccauugccagcgcu

SEQ ID NO: 640586 - RNA, 17 nt, Escherichia coli CFT073
uggcagugguaucaaua

SEQ ID NO: 640587 - RNA, 23 nt, Escherichia coli CFT073
uggcagugcgcgauaaucucauc

SEQ ID NO: 640588 - RNA, 21 nt, Escherichia coli CFT073
uggcaguugccagcuuuuguu

SEQ ID NO: 640589 - RNA, 15 nt, Escherichia coli CFT073
uggcagucacuuccu

SEQ ID NO: 640590 - RNA, 14 nt, Escherichia coli CFT073
uggcauauuccgcc

SEQ ID NO: 640591 - RNA, 19 nt, Escherichia coli CFT073
uggcauacaacgccaugaa

SEQ ID NO: 640592 - RNA, 15 nt, Escherichia coli CFT073
uggcagcuuuuucag

SEQ ID NO: 640593 - RNA, 18 nt, Escherichia coli CFT073
uggcaggccccgucagca

SEQ ID NO: 640594 - RNA, 18 nt, Escherichia coli CFT073
uggcagccauaaucacuc

SEQ ID NO: 640595 - RNA, 23 nt, Escherichia coli CFT073
uggcagccauaaucacucuuccc

SEQ ID NO: 640596 - RNA, 18 nt, Escherichia coli CFT073
uggcagcuaaugccaacg

SEQ ID NO: 640597 - RNA, 16 nt, Escherichia coli CFT073
uggcagcaugcugcca

SEQ ID NO: 640598 - RNA, 16 nt, Escherichia coli CFT073
uggcagcaccacgcag

SEQ ID NO: 640599 - RNA, 17 nt, Escherichia coli CFT073
uggcagauacauugcca

SEQ ID NO: 640600 - RNA, 17 nt, Escherichia coli CFT073
uggcagaccagagcuga

SEQ ID NO: 640601 - RNA, 18 nt, Escherichia coli CFT073
uggcagagcgacauacag

SEQ ID NO: 640602 - RNA, 23 nt, Escherichia coli CFT073
uggcagaauacuucacaugauaa

SEQ ID NO: 640603 - RNA, 18 nt, Escherichia coli CFT073
uggcacgcauccggcaau

SEQ ID NO: 640604 - RNA, 18 nt, Escherichia coli CFT073
uggcacuaauuaagacug

SEQ ID NO: 640605 - RNA, 20 nt, Escherichia coli CFT073
uggcacuaauuaagacugau

SEQ ID NO: 640606 - RNA, 15 nt, Escherichia coli CFT073
uggcacucuuccaga

SEQ ID NO: 640607 - RNA, 13 nt, Escherichia coli CFT073
uggcacaagacug

SEQ ID NO: 640608 - RNA, 15 nt, Escherichia coli CFT073
uggcacaagacugac

SEQ ID NO: 640609 - RNA, 13 nt, Escherichia coli CFT073
uggcaauuuugcu

SEQ ID NO: 640610 - RNA, 18 nt, Escherichia coli CFT073
uggcaauuuugcugugcu

SEQ ID NO: 640611 - RNA, 15 nt, Escherichia coli CFT073
uggcacacaccagau

SEQ ID NO: 640612 - RNA, 12 nt, Escherichia coli CFT073
uggcacaugacu

SEQ ID NO: 640613 - RNA, 19 nt, Escherichia coli CFT073
uggcacauaauugagcagc

SEQ ID NO: 640614 - RNA, 21 nt, Escherichia coli CFT073
uggcacauaauugagcagcaa

SEQ ID NO: 640615 - RNA, 19 nt, Escherichia coli CFT073
uggcaccgguacacaaccg

SEQ ID NO: 640616 - RNA, 17 nt, Escherichia coli CFT073
uggcaccaguaaaccaa

SEQ ID NO: 640617 - RNA, 14 nt, Escherichia coli CFT073
uggcacccagcgcu

SEQ ID NO: 640618 - RNA, 15 nt, Escherichia coli CFT073
uggcaccgacaucag

SEQ ID NO: 640619 - RNA, 19 nt, Escherichia coli CFT073
uggcaauugccauaaaaac

SEQ ID NO: 640620 - RNA, 20 nt, Escherichia coli CFT073
uggcaaugucaagugaauaa

SEQ ID NO: 640621 - RNA, 20 nt, Escherichia coli CFT073
uggcaaugaguaguuugguu

SEQ ID NO: 640622 - RNA, 22 nt, Escherichia coli CFT073
uggcaaugaguaguuugguuaa

SEQ ID NO: 640623 - RNA, 19 nt, Escherichia coli CFT073
uggcaaucagcggcaguuc

SEQ ID NO: 640624 - RNA, 13 nt, Escherichia coli CFT073
uggcaauccugcu

SEQ ID NO: 640625 - RNA, 14 nt, Escherichia coli CFT073
uggcaauccugcuu

SEQ ID NO: 640626 - RNA, 20 nt, Escherichia coli CFT073
uggcaauacgauccugagca

SEQ ID NO: 640627 - RNA, 21 nt, Escherichia coli CFT073
uggcaauagcuucuuccacau

SEQ ID NO: 640628 - RNA, 15 nt, Escherichia coli CFT073
uggcaauauauuugc

SEQ ID NO: 640629 - RNA, 16 nt, Escherichia coli CFT073
uggcaauauauuugcu

SEQ ID NO: 640630 - RNA, 19 nt, Escherichia coli CFT073
uggcaaaucgacgccacua

SEQ ID NO: 640631 - RNA, 17 nt, Escherichia coli CFT073
uggcaaauugcccaaga

SEQ ID NO: 640632 - RNA, 18 nt, Escherichia coli CFT073
uggcaacauaaucaacca

SEQ ID NO: 640633 - RNA, 22 nt, Escherichia coli CFT073
uggcaacccagcguugcagaga

SEQ ID NO: 640634 - RNA, 15 nt, Escherichia coli CFT073
uggcaacuuuguauu

SEQ ID NO: 640635 - RNA, 20 nt, Escherichia coli CFT073
uggcaagaaacgcuccacca

SEQ ID NO: 640636 - RNA, 12 nt, Escherichia coli CFT073
uggcaaaaacaa

SEQ ID NO: 640637 - RNA, 23 nt, Escherichia coli CFT073
uggauuuuuguuucacacugaca

SEQ ID NO: 640638 - RNA, 14 nt, Escherichia coli CFT073
uggcaaaauccaac

SEQ ID NO: 640639 - RNA, 19 nt, Escherichia coli CFT073
uggcaaaauccaacauagc

SEQ ID NO: 640640 - RNA, 20 nt, Escherichia coli CFT073
uggauugcuauuuaacaauu

SEQ ID NO: 640641 - RNA, 17 nt, Escherichia coli CFT073
uggauuguuccccuucc

SEQ ID NO: 640642 - RNA, 13 nt, Escherichia coli CFT073
uggauuaaauugc

SEQ ID NO: 640643 - RNA, 15 nt, Escherichia coli CFT073
uggauucaugauacu

SEQ ID NO: 640644 - RNA, 21 nt, Escherichia coli CFT073
uggaugcuuuugcaacaaggg

SEQ ID NO: 640645 - RNA, 11 nt, Escherichia coli CFT073
uggaugaaaug

SEQ ID NO: 640646 - RNA, 21 nt, Escherichia coli CFT073
uggaugcgccauaccaugcac

SEQ ID NO: 640647 - RNA, 13 nt, Escherichia coli CFT073
uggaucagaagag

SEQ ID NO: 640648 - RNA, 17 nt, Escherichia coli CFT073
uggaucagcguuucuuc

SEQ ID NO: 640649 - RNA, 23 nt, Escherichia coli CFT073
uggaucaaggauugcagcacuga

SEQ ID NO: 640650 - RNA, 18 nt, Escherichia coli CFT073
uggaucgagauugucggc

SEQ ID NO: 640651 - RNA, 23 nt, Escherichia coli CFT073
uggaucgcauaaugccugcaaca

SEQ ID NO: 640652 - RNA, 14 nt, Escherichia coli CFT073
uggaguggcccagg

SEQ ID NO: 640653 - RNA, 20 nt, Escherichia coli CFT073
uggagugguucgguccgcga

SEQ ID NO: 640654 - RNA, 18 nt, Escherichia coli CFT073
uggauaaggccaccagcg

SEQ ID NO: 640655 - RNA, 20 nt, Escherichia coli CFT073
uggauaauccaucccgcucu

SEQ ID NO: 640656 - RNA, 18 nt, Escherichia coli CFT073
uggauaugaucugcacag

SEQ ID NO: 640657 - RNA, 22 nt, Escherichia coli CFT073
uggaucaaggauugcagcacug

SEQ ID NO: 640658 - RNA, 22 nt, Escherichia coli CFT073
uggauauugccggaugugaugc

SEQ ID NO: 640659 - RNA, 23 nt, Escherichia coli CFT073
uggauaagaaagauacaaaacau

SEQ ID NO: 640660 - RNA, 24 nt, Escherichia coli CFT073
uggauacgcugacgugcugcaucu

SEQ ID NO: 640661 - RNA, 17 nt, Escherichia coli CFT073
uggaguaaaucagagga

SEQ ID NO: 640662 - RNA, 22 nt, Escherichia coli CFT073
uggagaguugcaccagcaauaa

SEQ ID NO: 640663 - RNA, 16 nt, Escherichia coli CFT073
uggagcaggugaauca

SEQ ID NO: 640664 - RNA, 16 nt, Escherichia coli CFT073
uggagccaucaccauc

SEQ ID NO: 640665 - RNA, 21 nt, Escherichia coli CFT073
uggagccgcuggcauacaguu

SEQ ID NO: 640666 - RNA, 18 nt, Escherichia coli CFT073
uggagcuaaacagagcug

SEQ ID NO: 640667 - RNA, 19 nt, Escherichia coli CFT073
uggagcuuuaaacacgauu

SEQ ID NO: 640668 - RNA, 16 nt, Escherichia coli CFT073
uggacgucgauaaaca

SEQ ID NO: 640669 - RNA, 22 nt, Escherichia coli CFT073
uggacgccguauucacuuucaa

SEQ ID NO: 640670 - RNA, 18 nt, Escherichia coli CFT073
uggagaaauauaaagaau

SEQ ID NO: 640671 - RNA, 16 nt, Escherichia coli CFT073
uggacuuccccugcca

SEQ ID NO: 640672 - RNA, 18 nt, Escherichia coli CFT073
uggagaguugcaccagca

SEQ ID NO: 640673 - RNA, 15 nt, Escherichia coli CFT073
uguuuuaccggcaac

SEQ ID NO: 640674 - RNA, 13 nt, Escherichia coli CFT073
uguuuuaaauauu

SEQ ID NO: 640675 - RNA, 22 nt, Escherichia coli CFT073
uguuuuccguugugcgauccac

SEQ ID NO: 640676 - RNA, 22 nt, Escherichia coli CFT073
uguuuucaauugauugauaaug

SEQ ID NO: 640677 - RNA, 12 nt, Escherichia coli CFT073
uguuucuguugc

SEQ ID NO: 640678 - RNA, 14 nt, Escherichia coli CFT073
uguuugcgacaaac

SEQ ID NO: 640679 - RNA, 22 nt, Escherichia coli CFT073
uguuuagccacgccgaggcauu

SEQ ID NO: 640680 - RNA, 19 nt, Escherichia coli CFT073
uguuuaccggugccagcaa

SEQ ID NO: 640681 - RNA, 13 nt, Escherichia coli CFT073
uguuucacacuga

SEQ ID NO: 640682 - RNA, 19 nt, Escherichia coli CFT073
uguuuauuaucaauuuuag

SEQ ID NO: 640683 - RNA, 21 nt, Escherichia coli CFT073
uguuuccgacgguuugccuuc

SEQ ID NO: 640684 - RNA, 13 nt, Escherichia coli CFT073
uguuucagcgcau

SEQ ID NO: 640685 - RNA, 16 nt, Escherichia coli CFT073
uguuucauaucaccgu

SEQ ID NO: 640686 - RNA, 18 nt, Escherichia coli CFT073
uguuucaucucaucaaug

SEQ ID NO: 640687 - RNA, 23 nt, Escherichia coli CFT073
uguuucaugaagcaacucaccau

SEQ ID NO: 640688 - RNA, 11 nt, Escherichia coli CFT073
uuaaacuggaa

SEQ ID NO: 640689 - RNA, 12 nt, Escherichia coli CFT073
uuaaacuggaaa

SEQ ID NO: 640690 - RNA, 21 nt, Escherichia coli CFT073
uuaaaguuaguaccgaacagc

SEQ ID NO: 640691 - RNA, 19 nt, Escherichia coli CFT073
uuaaagcguuccagcagcu

SEQ ID NO: 640692 - RNA, 17 nt, Escherichia coli CFT073
uuaaaauauaagguucu

SEQ ID NO: 640693 - RNA, 20 nt, Escherichia coli CFT073
uuaaaauaagcacaaagcaa

SEQ ID NO: 640694 - RNA, 16 nt, Escherichia coli CFT073
uuaaaauuucacauau

SEQ ID NO: 640695 - RNA, 19 nt, Escherichia coli CFT073
uuaaaauguguacuucucu

SEQ ID NO: 640696 - RNA, 18 nt, Escherichia coli CFT073
uuaaaacgcacgcugucg

SEQ ID NO: 640697 - RNA, 17 nt, Escherichia coli CFT073
uuaaaaacagccagcag

SEQ ID NO: 640698 - RNA, 15 nt, Escherichia coli CFT073
uguuuuuuuuaucac

SEQ ID NO: 640699 - RNA, 16 nt, Escherichia coli CFT073
uuaaaaaaagaacaac

SEQ ID NO: 640700 - RNA, 18 nt, Escherichia coli CFT073
uuaaaaaaagaacaacca

SEQ ID NO: 640701 - RNA, 13 nt, Escherichia coli CFT073
uguuuuuauuaaa

SEQ ID NO: 640702 - RNA, 14 nt, Escherichia coli CFT073
uguuuuucaggaaa

SEQ ID NO: 640703 - RNA, 17 nt, Escherichia coli CFT073
uguuuugcaucaacugc

SEQ ID NO: 640704 - RNA, 15 nt, Escherichia coli CFT073
uguugguuugugacu

SEQ ID NO: 640705 - RNA, 13 nt, Escherichia coli CFT073
uguuguacaguac

SEQ ID NO: 640706 - RNA, 21 nt, Escherichia coli CFT073
uguuggcuaucuauugcugaa

SEQ ID NO: 640707 - RNA, 13 nt, Escherichia coli CFT073
uguuguauucaga

SEQ ID NO: 640708 - RNA, 15 nt, Escherichia coli CFT073
uguuguggauaucug

SEQ ID NO: 640709 - RNA, 18 nt, Escherichia coli CFT073
uguugugaauauugccgc

SEQ ID NO: 640710 - RNA, 12 nt, Escherichia coli CFT073
uguuguuuucaa

SEQ ID NO: 640711 - RNA, 20 nt, Escherichia coli CFT073
uguuguugcgcgccagcuuu

SEQ ID NO: 640712 - RNA, 21 nt, Escherichia coli CFT073
uguugcagaugcucuucaaaa

SEQ ID NO: 640713 - RNA, 14 nt, Escherichia coli CFT073
uguugauucauuug

SEQ ID NO: 640714 - RNA, 23 nt, Escherichia coli CFT073
uguugauucugcggguuagucug

SEQ ID NO: 640715 - RNA, 19 nt, Escherichia coli CFT073
uguugccagcagcaaccau

SEQ ID NO: 640716 - RNA, 16 nt, Escherichia coli CFT073
uguugcaggaacagaa

SEQ ID NO: 640717 - RNA, 13 nt, Escherichia coli CFT073
uguuccgucagcc

SEQ ID NO: 640718 - RNA, 20 nt, Escherichia coli CFT073
uguuccggcagaaaccaggu

SEQ ID NO: 640719 - RNA, 12 nt, Escherichia coli CFT073
uguuccucugcc

SEQ ID NO: 640720 - RNA, 12 nt, Escherichia coli CFT073
uguuccucugcu

SEQ ID NO: 640721 - RNA, 20 nt, Escherichia coli CFT073
uguuccauugagaaaaucca

SEQ ID NO: 640722 - RNA, 18 nt, Escherichia coli CFT073
uguucccggcauuuugcu

SEQ ID NO: 640723 - RNA, 21 nt, Escherichia coli CFT073
uguucccuguaggucggauaa

SEQ ID NO: 640724 - RNA, 18 nt, Escherichia coli CFT073
uguuccaguugauacagg

SEQ ID NO: 640725 - RNA, 12 nt, Escherichia coli CFT073
uguuccagugcg

SEQ ID NO: 640726 - RNA, 16 nt, Escherichia coli CFT073
uguuaucagcaauaaa

SEQ ID NO: 640727 - RNA, 22 nt, Escherichia coli CFT073
uguuauccgacuuauucuucaa

SEQ ID NO: 640728 - RNA, 13 nt, Escherichia coli CFT073
uguuauucagaau

SEQ ID NO: 640729 - RNA, 18 nt, Escherichia coli CFT073
uguuauugaucagugcac

SEQ ID NO: 640730 - RNA, 17 nt, Escherichia coli CFT073
uguucagcgacagauua

SEQ ID NO: 640731 - RNA, 18 nt, Escherichia coli CFT073
uguucagcgggcagggca

SEQ ID NO: 640732 - RNA, 22 nt, Escherichia coli CFT073
uguucagcgggcagggcaucaa

SEQ ID NO: 640733 - RNA, 14 nt, Escherichia coli CFT073
uguucacucaucag

SEQ ID NO: 640734 - RNA, 17 nt, Escherichia coli CFT073
ugugugacacuucuucg

SEQ ID NO: 640735 - RNA, 12 nt, Escherichia coli CFT073
ugugugaaaguc

SEQ ID NO: 640736 - RNA, 19 nt, Escherichia coli CFT073
uguuaaaacgcacgcuguc

SEQ ID NO: 640737 - RNA, 15 nt, Escherichia coli CFT073
uguguuugaucacuu

SEQ ID NO: 640738 - RNA, 21 nt, Escherichia coli CFT073
uguuaacaauauuaacaacau

SEQ ID NO: 640739 - RNA, 23 nt, Escherichia coli CFT073
ugugcuacugcuucaaaguuuug

SEQ ID NO: 640740 - RNA, 15 nt, Escherichia coli CFT073
ugugcggcgcauuca

SEQ ID NO: 640741 - RNA, 20 nt, Escherichia coli CFT073
ugugcggcgcauucaccagc

SEQ ID NO: 640742 - RNA, 22 nt, Escherichia coli CFT073
ugugcgguccaugcgaagaccg

SEQ ID NO: 640743 - RNA, 13 nt, Escherichia coli CFT073
ugugcuccaucag

SEQ ID NO: 640744 - RNA, 21 nt, Escherichia coli CFT073
uguggcugggguacgaggauu

SEQ ID NO: 640745 - RNA, 15 nt, Escherichia coli CFT073
ugugaccccaucauu

SEQ ID NO: 640746 - RNA, 15 nt, Escherichia coli CFT073
ugucagcaccagaga

SEQ ID NO: 640747 - RNA, 19 nt, Escherichia coli CFT073
ugucagcaccagagaacug

SEQ ID NO: 640748 - RNA, 20 nt, Escherichia coli CFT073
ugucagcaccagagaacuga

SEQ ID NO: 640749 - RNA, 18 nt, Escherichia coli CFT073
ugucacgucucaucaggc

SEQ ID NO: 640750 - RNA, 20 nt, Escherichia coli CFT073
ugucacuacgguguaacccg

SEQ ID NO: 640751 - RNA, 16 nt, Escherichia coli CFT073
ugucagaagaaaaaau

SEQ ID NO: 640752 - RNA, 21 nt, Escherichia coli CFT073
ugucagacuaucuuuggcauu

SEQ ID NO: 640753 - RNA, 13 nt, Escherichia coli CFT073
ugucagaaagaaa

SEQ ID NO: 640754 - RNA, 14 nt, Escherichia coli CFT073
ugucagaaguugca

SEQ ID NO: 640755 - RNA, 17 nt, Escherichia coli CFT073
ugucaccgucacaucaa

SEQ ID NO: 640756 - RNA, 14 nt, Escherichia coli CFT073
ugucaccgccucca

SEQ ID NO: 640757 - RNA, 17 nt, Escherichia coli CFT073
ugucaccuaauuuaaaa

SEQ ID NO: 640758 - RNA, 16 nt, Escherichia coli CFT073
ugucaccacccugccc

SEQ ID NO: 640759 - RNA, 22 nt, Escherichia coli CFT073
ugucaccaaucugaaaccagcg

SEQ ID NO: 640760 - RNA, 19 nt, Escherichia coli CFT073
ugugccugaauauacgcca

SEQ ID NO: 640761 - RNA, 18 nt, Escherichia coli CFT073
ugugccggauagguaaua

SEQ ID NO: 640762 - RNA, 17 nt, Escherichia coli CFT073
ugugcgaucgagauuca

SEQ ID NO: 640763 - RNA, 23 nt, Escherichia coli CFT073
ugugcacagcauccgaacgcuga

SEQ ID NO: 640764 - RNA, 14 nt, Escherichia coli CFT073
ugugcaaugaaaaa

SEQ ID NO: 640765 - RNA, 12 nt, Escherichia coli CFT073
ugugcaccgccc

SEQ ID NO: 640766 - RNA, 23 nt, Escherichia coli CFT073
uuaaaucauccuguucauuuuua

SEQ ID NO: 640767 - RNA, 14 nt, Escherichia coli CFT073
uuaaauccugcaca

SEQ ID NO: 640768 - RNA, 22 nt, Escherichia coli CFT073
uuaacugggcgucaaagugaaa

SEQ ID NO: 640769 - RNA, 19 nt, Escherichia coli CFT073
uuaacugccauuucauaaa

SEQ ID NO: 640770 - RNA, 21 nt, Escherichia coli CFT073
uuaacugcccgaucaacggau

SEQ ID NO: 640771 - RNA, 16 nt, Escherichia coli CFT073
uuaaggccaaacacca

SEQ ID NO: 640772 - RNA, 17 nt, Escherichia coli CFT073
uuaaggcauauaugaau

SEQ ID NO: 640773 - RNA, 13 nt, Escherichia coli CFT073
uuaaggguaaaaa

SEQ ID NO: 640774 - RNA, 17 nt, Escherichia coli CFT073
uuaaggucguuuugccc

SEQ ID NO: 640775 - RNA, 12 nt, Escherichia coli CFT073
uuaagguuuuuu

SEQ ID NO: 640776 - RNA, 14 nt, Escherichia coli CFT073
uuaagguuuuuucc

SEQ ID NO: 640777 - RNA, 19 nt, Escherichia coli CFT073
uuaauauaaacgacagcgu

SEQ ID NO: 640778 - RNA, 18 nt, Escherichia coli CFT073
uuaauagugguaccagga

SEQ ID NO: 640779 - RNA, 16 nt, Escherichia coli CFT073
uuaaguguaaucagcc

SEQ ID NO: 640780 - RNA, 20 nt, Escherichia coli CFT073
uuaaguguccgccaauuuca

SEQ ID NO: 640781 - RNA, 14 nt, Escherichia coli CFT073
uuaauaauauaaau

SEQ ID NO: 640782 - RNA, 13 nt, Escherichia coli CFT073
uuaauauauauua

SEQ ID NO: 640783 - RNA, 20 nt, Escherichia coli CFT073
uuaauauuaaaccacccgcg

SEQ ID NO: 640784 - RNA, 14 nt, Escherichia coli CFT073
uuaauauguugacu

SEQ ID NO: 640785 - RNA, 13 nt, Escherichia coli CFT073
uuaaucaccagcg

SEQ ID NO: 640786 - RNA, 17 nt, Escherichia coli CFT073
uuaaucaucaugcuuaa

SEQ ID NO: 640787 - RNA, 19 nt, Escherichia coli CFT073
uuaaucaucaaugccagca

SEQ ID NO: 640788 - RNA, 19 nt, Escherichia coli CFT073
uuaaucaucgacuccagcg

SEQ ID NO: 640789 - RNA, 19 nt, Escherichia coli CFT073
uuaauccauaaccauaauu

SEQ ID NO: 640790 - RNA, 20 nt, Escherichia coli CFT073
uuaauccauaaccauaauuu

SEQ ID NO: 640791 - RNA, 18 nt, Escherichia coli CFT073
uuaauuucaugcucacca

SEQ ID NO: 640792 - RNA, 20 nt, Escherichia coli CFT073
uuaauuuccucuucccgcuc

SEQ ID NO: 640793 - RNA, 15 nt, Escherichia coli CFT073
uuaauucucccugcg

SEQ ID NO: 640794 - RNA, 21 nt, Escherichia coli CFT073
uuaauugcccaaagccaaucu

SEQ ID NO: 640795 - RNA, 23 nt, Escherichia coli CFT073
uuaauuuucguuccaggacuggc

SEQ ID NO: 640796 - RNA, 21 nt, Escherichia coli CFT073
uuacaaaaaguaguuccagca

SEQ ID NO: 640797 - RNA, 14 nt, Escherichia coli CFT073
uuaauuuuuuaaua

SEQ ID NO: 640798 - RNA, 15 nt, Escherichia coli CFT073
uuaauuuuuuaauaa

SEQ ID NO: 640799 - RNA, 15 nt, Escherichia coli CFT073
uuaaucgcuucaauc

SEQ ID NO: 640800 - RNA, 19 nt, Escherichia coli CFT073
uuaaucggaugaucaucca

SEQ ID NO: 640801 - RNA, 11 nt, Escherichia coli CFT073
uuaauccugau

SEQ ID NO: 640802 - RNA, 21 nt, Escherichia coli CFT073
uuaaucccuuuacaggcguga

SEQ ID NO: 640803 - RNA, 17 nt, Escherichia coli CFT073
uuaccagagaaaagaua

SEQ ID NO: 640804 - RNA, 19 nt, Escherichia coli CFT073
uuaccagagucuuugcuug

SEQ ID NO: 640805 - RNA, 17 nt, Escherichia coli CFT073
uuaccagacagaacgau

SEQ ID NO: 640806 - RNA, 21 nt, Escherichia coli CFT073
uuaccaaugcugcaccccaca

SEQ ID NO: 640807 - RNA, 19 nt, Escherichia coli CFT073
uuaccaccgucaauaaaaa

SEQ ID NO: 640808 - RNA, 21 nt, Escherichia coli CFT073
uuacaguagcuauaaaccugc

SEQ ID NO: 640809 - RNA, 23 nt, Escherichia coli CFT073
uuacaaucgucugguuuuccuua

SEQ ID NO: 640810 - RNA, 17 nt, Escherichia coli CFT073
uuacacagaguuugccg

SEQ ID NO: 640811 - RNA, 24 nt, Escherichia coli CFT073
uuacaggauuacuuaacuuccauc

SEQ ID NO: 640812 - RNA, 15 nt, Escherichia coli CFT073
uuaccguucuacuau

SEQ ID NO: 640813 - RNA, 16 nt, Escherichia coli CFT073
uuaccguaacagguga

SEQ ID NO: 640814 - RNA, 20 nt, Escherichia coli CFT073
uuaccguaacaggugauaau

SEQ ID NO: 640815 - RNA, 17 nt, Escherichia coli CFT073
uuaccggugccagcaac

SEQ ID NO: 640816 - RNA, 23 nt, Escherichia coli CFT073
uuaccgcuuggcgauaccccaac

SEQ ID NO: 640817 - RNA, 14 nt, Escherichia coli CFT073
uuacccuuacucac

SEQ ID NO: 640818 - RNA, 12 nt, Escherichia coli CFT073
uuacccggugcc

SEQ ID NO: 640819 - RNA, 15 nt, Escherichia coli CFT073
uuaccaucacuuugc

SEQ ID NO: 640820 - RNA, 16 nt, Escherichia coli CFT073
uuaccagcgcaggaac

SEQ ID NO: 640821 - RNA, 21 nt, Escherichia coli CFT073
uuaccgcccaugccaguaaua

SEQ ID NO: 640822 - RNA, 22 nt, Escherichia coli CFT073
uuagcagagcguuuaauaaaac

SEQ ID NO: 640823 - RNA, 19 nt, Escherichia coli CFT073
uuagcaaauuaucccccag

SEQ ID NO: 640824 - RNA, 17 nt, Escherichia coli CFT073
uuagcauggguauccug

SEQ ID NO: 640825 - RNA, 12 nt, Escherichia coli CFT073
uuagcaugugca

SEQ ID NO: 640826 - RNA, 21 nt, Escherichia coli CFT073
uuagcaugugcaaucuacaaa

SEQ ID NO: 640827 - RNA, 19 nt, Escherichia coli CFT073
uuagccauucuuucuuccc

SEQ ID NO: 640828 - RNA, 20 nt, Escherichia coli CFT073
uuagccaggcaccaaaaauc

SEQ ID NO: 640829 - RNA, 13 nt, Escherichia coli CFT073
uuagccaucauuu

SEQ ID NO: 640830 - RNA, 19 nt, Escherichia coli CFT073
uuagccuguaaugucaucu

SEQ ID NO: 640831 - RNA, 22 nt, Escherichia coli CFT073
uuagccgccggggucaaaccug

SEQ ID NO: 640832 - RNA, 14 nt, Escherichia coli CFT073
uuagcccuuuguag

SEQ ID NO: 640833 - RNA, 15 nt, Escherichia coli CFT073
uuaggcacaucaaca

SEQ ID NO: 640834 - RNA, 17 nt, Escherichia coli CFT073
uuaggaccgguuucaaa

SEQ ID NO: 640835 - RNA, 12 nt, Escherichia coli CFT073
uuagcuggccug

SEQ ID NO: 640836 - RNA, 14 nt, Escherichia coli CFT073
uuagcggcuucaaa

SEQ ID NO: 640837 - RNA, 17 nt, Escherichia coli CFT073
uuagcgcagcuacccga

SEQ ID NO: 640838 - RNA, 21 nt, Escherichia coli CFT073
uuagcgcauaaaagauaaacg

SEQ ID NO: 640839 - RNA, 17 nt, Escherichia coli CFT073
uuagccucuacaguauc

SEQ ID NO: 640840 - RNA, 17 nt, Escherichia coli CFT073
uuagauuguuuucaauu

SEQ ID NO: 640841 - RNA, 14 nt, Escherichia coli CFT073
uuagacaucaaaau

SEQ ID NO: 640842 - RNA, 13 nt, Escherichia coli CFT073
uuagaacugauca

SEQ ID NO: 640843 - RNA, 18 nt, Escherichia coli CFT073
uuaccuucagacucgaag

SEQ ID NO: 640844 - RNA, 19 nt, Escherichia coli CFT073
uuaccuuccugccagaucc

SEQ ID NO: 640845 - RNA, 14 nt, Escherichia coli CFT073
uuacgaagcagcau

SEQ ID NO: 640846 - RNA, 23 nt, Escherichia coli CFT073
uuauaaccagacgauuuucccug

SEQ ID NO: 640847 - RNA, 23 nt, Escherichia coli CFT073
uuauacugcgcuuuuaauucacu

SEQ ID NO: 640848 - RNA, 16 nt, Escherichia coli CFT073
uuauauuugaacaucg

SEQ ID NO: 640849 - RNA, 15 nt, Escherichia coli CFT073
uuauauuauuauucc

SEQ ID NO: 640850 - RNA, 20 nt, Escherichia coli CFT073
uuauauucaugaauaaaaaa

SEQ ID NO: 640851 - RNA, 14 nt, Escherichia coli CFT073
uuauaucucagaua

SEQ ID NO: 640852 - RNA, 21 nt, Escherichia coli CFT073
uuauaucuguacaguuaagcc

SEQ ID NO: 640853 - RNA, 19 nt, Escherichia coli CFT073
uuauaucuucacgauuauu

SEQ ID NO: 640854 - RNA, 14 nt, Escherichia coli CFT073
uuagugauuucgaa

SEQ ID NO: 640855 - RNA, 16 nt, Escherichia coli CFT073
uuagucauuacucauc

SEQ ID NO: 640856 - RNA, 15 nt, Escherichia coli CFT073
uuaguaggccugaua

SEQ ID NO: 640857 - RNA, 16 nt, Escherichia coli CFT073
uggaaucacucaucau

SEQ ID NO: 640858 - RNA, 15 nt, Escherichia coli CFT073
uggaaucaucaagca

SEQ ID NO: 640859 - RNA, 16 nt, Escherichia coli CFT073
uggaaucaucaagcac

SEQ ID NO: 640860 - RNA, 14 nt, Escherichia coli CFT073
uggaauaguaaaag

SEQ ID NO: 640861 - RNA, 19 nt, Escherichia coli CFT073
uggaauacguugcaaauau

SEQ ID NO: 640862 - RNA, 15 nt, Escherichia coli CFT073
uggaauggaaacagc

SEQ ID NO: 640863 - RNA, 17 nt, Escherichia coli CFT073
uggacauggguauuguu

SEQ ID NO: 640864 - RNA, 18 nt, Escherichia coli CFT073
uggacaucgucugcggug

SEQ ID NO: 640865 - RNA, 13 nt, Escherichia coli CFT073
uggacauguuuuu

SEQ ID NO: 640866 - RNA, 15 nt, Escherichia coli CFT073
uggacgaacagcuca

SEQ ID NO: 640867 - RNA, 17 nt, Escherichia coli CFT073
uggacgauuucacccag

SEQ ID NO: 640868 - RNA, 20 nt, Escherichia coli CFT073
uggacgacagcaacaucguu

SEQ ID NO: 640869 - RNA, 14 nt, Escherichia coli CFT073
uggaaacagcacca

SEQ ID NO: 640870 - RNA, 16 nt, Escherichia coli CFT073
uggaaaccgagauaaa

SEQ ID NO: 640871 - RNA, 12 nt, Escherichia coli CFT073
ugcuuuuucgcg

SEQ ID NO: 640872 - RNA, 22 nt, Escherichia coli CFT073
ugcuuuuugugggccugauaag

SEQ ID NO: 640873 - RNA, 17 nt, Escherichia coli CFT073
uggaaauagauuuucag

SEQ ID NO: 640874 - RNA, 20 nt, Escherichia coli CFT073
uggaaauugucguuauugau

SEQ ID NO: 640875 - RNA, 12 nt, Escherichia coli CFT073
uggaaaucaaau

SEQ ID NO: 640876 - RNA, 16 nt, Escherichia coli CFT073
uggaaaucaaauacau

SEQ ID NO: 640877 - RNA, 23 nt, Escherichia coli CFT073
uggaaaucacccagcgaagcaaa

SEQ ID NO: 640878 - RNA, 16 nt, Escherichia coli CFT073
uggaacauccuuuccu

SEQ ID NO: 640879 - RNA, 18 nt, Escherichia coli CFT073
uggaacauccuuuccuua

SEQ ID NO: 640880 - RNA, 22 nt, Escherichia coli CFT073
uggaaguacgcuucacgcacca

SEQ ID NO: 640881 - RNA, 21 nt, Escherichia coli CFT073
uggaagagcgacaaucccugc

SEQ ID NO: 640882 - RNA, 17 nt, Escherichia coli CFT073
ugcugucggcaaaucaa

SEQ ID NO: 640883 - RNA, 17 nt, Escherichia coli CFT073
ugcugucaccgaagcgg

SEQ ID NO: 640884 - RNA, 15 nt, Escherichia coli CFT073
ugcuggcgagugcau

SEQ ID NO: 640885 - RNA, 15 nt, Escherichia coli CFT073
ugcugguauuuugcg

SEQ ID NO: 640886 - RNA, 19 nt, Escherichia coli CFT073
ugcugaauuuccugcgcuu

SEQ ID NO: 640887 - RNA, 14 nt, Escherichia coli CFT073
ugcugaccaaaucu

SEQ ID NO: 640888 - RNA, 14 nt, Escherichia coli CFT073
ugcugaccaccagc

SEQ ID NO: 640889 - RNA, 15 nt, Escherichia coli CFT073
ugcugcgcacaaaca

SEQ ID NO: 640890 - RNA, 16 nt, Escherichia coli CFT073
ugcugcgauucagggu

SEQ ID NO: 640891 - RNA, 15 nt, Escherichia coli CFT073
ugcugaccaccagca

SEQ ID NO: 640892 - RNA, 14 nt, Escherichia coli CFT073
ugcuggauccccug

SEQ ID NO: 640893 - RNA, 22 nt, Escherichia coli CFT073
ugcuggauccccugcccggcaa

SEQ ID NO: 640894 - RNA, 14 nt, Escherichia coli CFT073
ugcuggcaccguga

SEQ ID NO: 640895 - RNA, 18 nt, Escherichia coli CFT073
ugcuggcaccgugaaaga

SEQ ID NO: 640896 - RNA, 12 nt, Escherichia coli CFT073
ugcuggcauuac

SEQ ID NO: 640897 - RNA, 15 nt, Escherichia coli CFT073
ugcugcuaaaucggg

SEQ ID NO: 640898 - RNA, 22 nt, Escherichia coli CFT073
ugcugcuaagagugagguauaa

SEQ ID NO: 640899 - RNA, 22 nt, Escherichia coli CFT073
ugcugcguuugcccuaaagcgc

SEQ ID NO: 640900 - RNA, 19 nt, Escherichia coli CFT073
ugcugcgcggugacaucaa

SEQ ID NO: 640901 - RNA, 19 nt, Escherichia coli CFT073
ugcugcgggcgaucauauc

SEQ ID NO: 640902 - RNA, 19 nt, Escherichia coli CFT073
ugcuuuccagcuguaccag

SEQ ID NO: 640903 - RNA, 18 nt, Escherichia coli CFT073
ugcuucuuacuauauaaa

SEQ ID NO: 640904 - RNA, 14 nt, Escherichia coli CFT073
ugcuuguaaaacag

SEQ ID NO: 640905 - RNA, 22 nt, Escherichia coli CFT073
ugcuugucaggccggaauaacu

SEQ ID NO: 640906 - RNA, 23 nt, Escherichia coli CFT073
ugcuuucaccaauguugucgcag

SEQ ID NO: 640907 - RNA, 17 nt, Escherichia coli CFT073
ugcuuucagcacuuauc

SEQ ID NO: 640908 - RNA, 16 nt, Escherichia coli CFT073
ugcuucuagugccugc

SEQ ID NO: 640909 - RNA, 20 nt, Escherichia coli CFT073
ugcuucuaucgcauuauccu

SEQ ID NO: 640910 - RNA, 22 nt, Escherichia coli CFT073
ugcuucucuucagccaacgcau

SEQ ID NO: 640911 - RNA, 22 nt, Escherichia coli CFT073
ugcuucggucagaauuucgacu

SEQ ID NO: 640912 - RNA, 13 nt, Escherichia coli CFT073
ugcuucgcucucu

SEQ ID NO: 640913 - RNA, 17 nt, Escherichia coli CFT073
ugcuuacgcaacugcca

SEQ ID NO: 640914 - RNA, 16 nt, Escherichia coli CFT073
ugcuuacgcagacaac

SEQ ID NO: 640915 - RNA, 20 nt, Escherichia coli CFT073
ugcuucauugcucucuucuc

SEQ ID NO: 640916 - RNA, 20 nt, Escherichia coli CFT073
ugcuucaucgugacaaucuc

SEQ ID NO: 640917 - RNA, 14 nt, Escherichia coli CFT073
ugcuuaaucauauu

SEQ ID NO: 640918 - RNA, 18 nt, Escherichia coli CFT073
ugcuuaaauuucuuacca

SEQ ID NO: 640919 - RNA, 22 nt, Escherichia coli CFT073
ugcuuaacauuggucagagcau

SEQ ID NO: 640920 - RNA, 13 nt, Escherichia coli CFT073
ugcgcuucaccag

SEQ ID NO: 640921 - RNA, 20 nt, Escherichia coli CFT073
ugcgcugucauucauucaga

SEQ ID NO: 640922 - RNA, 22 nt, Escherichia coli CFT073
ugcgcugggcgguaauguuuug

SEQ ID NO: 640923 - RNA, 23 nt, Escherichia coli CFT073
ugcgcuggcaagaagaucagcaa

SEQ ID NO: 640924 - RNA, 19 nt, Escherichia coli CFT073
ugcgcugcgcuuaucaggc

SEQ ID NO: 640925 - RNA, 17 nt, Escherichia coli CFT073
ugcgcucgaucaguuca

SEQ ID NO: 640926 - RNA, 22 nt, Escherichia coli CFT073
ugcgcauguuuagucgccacaa

SEQ ID NO: 640927 - RNA, 20 nt, Escherichia coli CFT073
ugcgcauuucccagcaagaa

SEQ ID NO: 640928 - RNA, 20 nt, Escherichia coli CFT073
ugcggcaauuagcggccagc

SEQ ID NO: 640929 - RNA, 16 nt, Escherichia coli CFT073
ugcgcuucuuccagca

SEQ ID NO: 640930 - RNA, 20 nt, Escherichia coli CFT073
ugcgcuugcugccaguuacc

SEQ ID NO: 640931 - RNA, 18 nt, Escherichia coli CFT073
ugcgcuuccggcagcuuc

SEQ ID NO: 640932 - RNA, 19 nt, Escherichia coli CFT073
ugcgcuuccggcagcuuca

SEQ ID NO: 640933 - RNA, 19 nt, Escherichia coli CFT073
ugcggcucucuuucuccag

SEQ ID NO: 640934 - RNA, 13 nt, Escherichia coli CFT073
ugcggcugcaucu

SEQ ID NO: 640935 - RNA, 14 nt, Escherichia coli CFT073
ugcggcuucaacug

SEQ ID NO: 640936 - RNA, 15 nt, Escherichia coli CFT073
ugcggcuucaacuga

SEQ ID NO: 640937 - RNA, 16 nt, Escherichia coli CFT073
ugcggcuucagcgaca

SEQ ID NO: 640938 - RNA, 14 nt, Escherichia coli CFT073
ugcggcguaccaau

SEQ ID NO: 640939 - RNA, 22 nt, Escherichia coli CFT073
ugcgguaacuccggcauaauaa

SEQ ID NO: 640940 - RNA, 17 nt, Escherichia coli CFT073
ugcgguagcgggcgcaa

SEQ ID NO: 640941 - RNA, 20 nt, Escherichia coli CFT073
ugcguagucugaccucuucu

SEQ ID NO: 640942 - RNA, 18 nt, Escherichia coli CFT073
ugcguagccgauccgcgu

SEQ ID NO: 640943 - RNA, 23 nt, Escherichia coli CFT073
ugcguaccggcguuucacauucu

SEQ ID NO: 640944 - RNA, 17 nt, Escherichia coli CFT073
ugcgggcauuacggaac

SEQ ID NO: 640945 - RNA, 15 nt, Escherichia coli CFT073
ugcgggaguggcgaa

SEQ ID NO: 640946 - RNA, 22 nt, Escherichia coli CFT073
ugcgggagcgcuuuuuccugcc

SEQ ID NO: 640947 - RNA, 21 nt, Escherichia coli CFT073
ugcgggaacauaugcacauga

SEQ ID NO: 640948 - RNA, 12 nt, Escherichia coli CFT073
ugcgucaacgcc

SEQ ID NO: 640949 - RNA, 23 nt, Escherichia coli CFT073
ugcgucaagcgguaaccauccau

SEQ ID NO: 640950 - RNA, 18 nt, Escherichia coli CFT073
ugcgucacguaggcuuca

SEQ ID NO: 640951 - RNA, 16 nt, Escherichia coli CFT073
ugcgucgcacucucaa

SEQ ID NO: 640952 - RNA, 21 nt, Escherichia coli CFT073
ugcgucgcggccuguuccaau

SEQ ID NO: 640953 - RNA, 14 nt, Escherichia coli CFT073
ugcgucaucggcag

SEQ ID NO: 640954 - RNA, 21 nt, Escherichia coli CFT073
ugcguuacacagaguuugccg

SEQ ID NO: 640955 - RNA, 19 nt, Escherichia coli CFT073
ugcguuacccacaguuuca

SEQ ID NO: 640956 - RNA, 11 nt, Escherichia coli CFT073
ugcguuauuuu

SEQ ID NO: 640957 - RNA, 19 nt, Escherichia coli CFT073
ugcguggcaucaaacaccg

SEQ ID NO: 640958 - RNA, 20 nt, Escherichia coli CFT073
ugcguuaagacuuuuuucau

SEQ ID NO: 640959 - RNA, 18 nt, Escherichia coli CFT073
ugcguuaauauugugugc

SEQ ID NO: 640960 - RNA, 18 nt, Escherichia coli CFT073
ugcguggaguaaagcccg

SEQ ID NO: 640961 - RNA, 16 nt, Escherichia coli CFT073
ugcucgccuugcugcc

SEQ ID NO: 640962 - RNA, 22 nt, Escherichia coli CFT073
ugcuccauuccgugcuggcugc

SEQ ID NO: 640963 - RNA, 22 nt, Escherichia coli CFT073
ugcuccauuaacccgagaucuu

SEQ ID NO: 640964 - RNA, 20 nt, Escherichia coli CFT073
ugcuccauaauugccagcuu

SEQ ID NO: 640965 - RNA, 17 nt, Escherichia coli CFT073
ugcuccccuuucuuauu

SEQ ID NO: 640966 - RNA, 18 nt, Escherichia coli CFT073
ugcucagaaucacgccaa

SEQ ID NO: 640967 - RNA, 14 nt, Escherichia coli CFT073
ugcucagccucggu

SEQ ID NO: 640968 - RNA, 19 nt, Escherichia coli CFT073
ugcucagcacgccacucac

SEQ ID NO: 640969 - RNA, 13 nt, Escherichia coli CFT073
ugcuccacugcuc

SEQ ID NO: 640970 - RNA, 17 nt, Escherichia coli CFT073
ugcuccagcagauggca

SEQ ID NO: 640971 - RNA, 17 nt, Escherichia coli CFT073
ugcuccagcagcucaau

SEQ ID NO: 640972 - RNA, 20 nt, Escherichia coli CFT073
ugcuccagcguaccugccgc

SEQ ID NO: 640973 - RNA, 18 nt, Escherichia coli CFT073
ugcuccagcguaccugcc

SEQ ID NO: 640974 - RNA, 15 nt, Escherichia coli CFT073
ugcucuggcagcacc

SEQ ID NO: 640975 - RNA, 16 nt, Escherichia coli CFT073
ugcucuggcagcacca

SEQ ID NO: 640976 - RNA, 14 nt, Escherichia coli CFT073
ugcucuggcaggcg

SEQ ID NO: 640977 - RNA, 12 nt, Escherichia coli CFT073
ugcucuggcaua

SEQ ID NO: 640978 - RNA, 16 nt, Escherichia coli CFT073
ugcucuugauccauua

SEQ ID NO: 640979 - RNA, 17 nt, Escherichia coli CFT073
ugcucuaaaaaguuccu

SEQ ID NO: 640980 - RNA, 22 nt, Escherichia coli CFT073
ugcucuaacccuuccagauuca

SEQ ID NO: 640981 - RNA, 21 nt, Escherichia coli CFT073
ugcucuacgcuucucucugua

SEQ ID NO: 640982 - RNA, 18 nt, Escherichia coli CFT073
ugcguuuuuaucuucaca

SEQ ID NO: 640983 - RNA, 13 nt, Escherichia coli CFT073
ugcguuuuuucac

SEQ ID NO: 640984 - RNA, 21 nt, Escherichia coli CFT073
ugcuaaaucggggaucauuaa

SEQ ID NO: 640985 - RNA, 14 nt, Escherichia coli CFT073
ugcuaaugguugca

SEQ ID NO: 640986 - RNA, 21 nt, Escherichia coli CFT073
ugcuacaggguaaaaagaggu

SEQ ID NO: 640987 - RNA, 14 nt, Escherichia coli CFT073
ugcuacccggcguu

SEQ ID NO: 640988 - RNA, 22 nt, Escherichia coli CFT073
ugcuacccggcguuuuuauugc

SEQ ID NO: 640989 - RNA, 21 nt, Escherichia coli CFT073
ugcuaccgggaucuccuccag

SEQ ID NO: 640990 - RNA, 14 nt, Escherichia coli CFT073
ugcucaacaauaaa

SEQ ID NO: 640991 - RNA, 15 nt, Escherichia coli CFT073
ugcuauuccuugaaa

SEQ ID NO: 640992 - RNA, 17 nt, Escherichia coli CFT073
ugcuaugcauacacaga

SEQ ID NO: 640993 - RNA, 22 nt, Escherichia coli CFT073
ugcuaucggcgauguagcgcug

SEQ ID NO: 640994 - RNA, 18 nt, Escherichia coli CFT073
ugcuacugcuucaaaguu

SEQ ID NO: 640995 - RNA, 14 nt, Escherichia coli CFT073
ugcuagauaagcaa

SEQ ID NO: 640996 - RNA, 17 nt, Escherichia coli CFT073
ugcuagauaagcaaggc

SEQ ID NO: 640997 - RNA, 23 nt, Escherichia coli CFT073
ugcgagcucaauauauuaaaaga

SEQ ID NO: 640998 - RNA, 21 nt, Escherichia coli CFT073
ugcgagacggcggaaagggcc

SEQ ID NO: 640999 - RNA, 21 nt, Escherichia coli CFT073
ugcgagaacgacguaccguca

SEQ ID NO: 641000 - RNA, 15 nt, Escherichia coli CFT073
ugcgagucaggccag

SEQ ID NO: 641001 - RNA, 15 nt, Escherichia coli CFT073
ugcgagugcauccag

SEQ ID NO: 641002 - RNA, 18 nt, Escherichia coli CFT073
ugcgacgcgggccgcguc

SEQ ID NO: 641003 - RNA, 16 nt, Escherichia coli CFT073
ugcgacgcuugccgcg

SEQ ID NO: 641004 - RNA, 22 nt, Escherichia coli CFT073
ugcgacggacgcccgccgacca

SEQ ID NO: 641005 - RNA, 20 nt, Escherichia coli CFT073
ugcgacauaaacguauuaug

SEQ ID NO: 641006 - RNA, 14 nt, Escherichia coli CFT073
ugcgaccagcagcg

SEQ ID NO: 641007 - RNA, 21 nt, Escherichia coli CFT073
ugcgaccagcagcguuuugua

SEQ ID NO: 641008 - RNA, 21 nt, Escherichia coli CFT073
ugcgaccagcgucguauccag

SEQ ID NO: 641009 - RNA, 15 nt, Escherichia coli CFT073
ugcgaauuuccugcc

SEQ ID NO: 641010 - RNA, 15 nt, Escherichia coli CFT073
ugcgacaaacuucca

SEQ ID NO: 641011 - RNA, 17 nt, Escherichia coli CFT073
ugcgacaaacuuccaga

SEQ ID NO: 641012 - RNA, 16 nt, Escherichia coli CFT073
ugcgacagauucgcgg

SEQ ID NO: 641013 - RNA, 14 nt, Escherichia coli CFT073
ugcgacaagcucau

SEQ ID NO: 641014 - RNA, 13 nt, Escherichia coli CFT073
ugcgacaccagca

SEQ ID NO: 641015 - RNA, 15 nt, Escherichia coli CFT073
ugcgaaguuuuuccg

SEQ ID NO: 641016 - RNA, 20 nt, Escherichia coli CFT073
ugcgaauaagaauaugaaca

SEQ ID NO: 641017 - RNA, 17 nt, Escherichia coli CFT073
ugcgaaacagaaauaga

SEQ ID NO: 641018 - RNA, 16 nt, Escherichia coli CFT073
ugcgaaagcgagcagu

SEQ ID NO: 641019 - RNA, 20 nt, Escherichia coli CFT073
ugcgauccacgccauccccu

SEQ ID NO: 641020 - RNA, 21 nt, Escherichia coli CFT073
ugcgaucccggcucauccccu

SEQ ID NO: 641021 - RNA, 21 nt, Escherichia coli CFT073
ugcgauuuuugacuuccagac

SEQ ID NO: 641022 - RNA, 18 nt, Escherichia coli CFT073
ugcgcaaccgcccggccu

SEQ ID NO: 641023 - RNA, 23 nt, Escherichia coli CFT073
ugcgcaguaaaucgucuguuugc

SEQ ID NO: 641024 - RNA, 21 nt, Escherichia coli CFT073
ugcgcauaagaccgugagcaa

SEQ ID NO: 641025 - RNA, 20 nt, Escherichia coli CFT073
ugcgcagcggugagccagga

SEQ ID NO: 641026 - RNA, 20 nt, Escherichia coli CFT073
ugcgcacgcguaauauccag

SEQ ID NO: 641027 - RNA, 18 nt, Escherichia coli CFT073
ugcgcagaguuuccaggc

SEQ ID NO: 641028 - RNA, 19 nt, Escherichia coli CFT073
ugcgcacaagcuaccagcc

SEQ ID NO: 641029 - RNA, 20 nt, Escherichia coli CFT073
ugcgcaauacguugcaaaau

SEQ ID NO: 641030 - RNA, 12 nt, Escherichia coli CFT073
ugccuuucuuug

SEQ ID NO: 641031 - RNA, 20 nt, Escherichia coli CFT073
ugccuuucuuuguucuucug

SEQ ID NO: 641032 - RNA, 14 nt, Escherichia coli CFT073
ugccuuugaaaucg

SEQ ID NO: 641033 - RNA, 11 nt, Escherichia coli CFT073
ugccuuucaug

SEQ ID NO: 641034 - RNA, 23 nt, Escherichia coli CFT073
ugccuuuaccgccacagcagccu

SEQ ID NO: 641035 - RNA, 17 nt, Escherichia coli CFT073
ugccuugugggcuauaa

SEQ ID NO: 641036 - RNA, 18 nt, Escherichia coli CFT073
ugccuugugggccugaaa

SEQ ID NO: 641037 - RNA, 22 nt, Escherichia coli CFT073
ugccuugaguuuuucaucccuc

SEQ ID NO: 641038 - RNA, 20 nt, Escherichia coli CFT073
ugccuuaaacuccauaccac

SEQ ID NO: 641039 - RNA, 15 nt, Escherichia coli CFT073
ugccugcggaucaag

SEQ ID NO: 641040 - RNA, 17 nt, Escherichia coli CFT073
ugccuguucaaccucaa

SEQ ID NO: 641041 - RNA, 18 nt, Escherichia coli CFT073
ugccuucacaggccgcca

SEQ ID NO: 641042 - RNA, 14 nt, Escherichia coli CFT073
ugccuucauacugc

SEQ ID NO: 641043 - RNA, 20 nt, Escherichia coli CFT073
ugccucacgcaaauucuucg

SEQ ID NO: 641044 - RNA, 22 nt, Escherichia coli CFT073
ugccucaugcgcugcgcuuauc

SEQ ID NO: 641045 - RNA, 12 nt, Escherichia coli CFT073
ugccugacagac

SEQ ID NO: 641046 - RNA, 16 nt, Escherichia coli CFT073
ugccugcacugguggc

SEQ ID NO: 641047 - RNA, 17 nt, Escherichia coli CFT073
ugccugaucaaagaccg

SEQ ID NO: 641048 - RNA, 14 nt, Escherichia coli CFT073
ugccugauccugag

SEQ ID NO: 641049 - RNA, 12 nt, Escherichia coli CFT073
ugccugauuacg

SEQ ID NO: 641050 - RNA, 23 nt, Escherichia coli CFT073
ugccugauuguuuguagccgcca

SEQ ID NO: 641051 - RNA, 14 nt, Escherichia coli CFT073
ugccgucugccacu

SEQ ID NO: 641052 - RNA, 17 nt, Escherichia coli CFT073
ugccgucugggcaaaau

SEQ ID NO: 641053 - RNA, 17 nt, Escherichia coli CFT073
ugccgucuaccaguaaa

SEQ ID NO: 641054 - RNA, 13 nt, Escherichia coli CFT073
ugccuauuuugua

SEQ ID NO: 641055 - RNA, 17 nt, Escherichia coli CFT073
ugccgccggaaacauaa

SEQ ID NO: 641056 - RNA, 19 nt, Escherichia coli CFT073
ugccggaccaucuuccagc

SEQ ID NO: 641057 - RNA, 21 nt, Escherichia coli CFT073
ugccggagauucaaagacuuc

SEQ ID NO: 641058 - RNA, 19 nt, Escherichia coli CFT073
ugccggauaagacgcggcu

SEQ ID NO: 641059 - RNA, 18 nt, Escherichia coli CFT073
ugccggauacgcuuuauc

SEQ ID NO: 641060 - RNA, 15 nt, Escherichia coli CFT073
ugccgccaucaccag

SEQ ID NO: 641061 - RNA, 16 nt, Escherichia coli CFT073
ugccguacucuucaau

SEQ ID NO: 641062 - RNA, 21 nt, Escherichia coli CFT073
ugccgucaauuuuaagcagau

SEQ ID NO: 641063 - RNA, 14 nt, Escherichia coli CFT073
ugccgucaccagca

SEQ ID NO: 641064 - RNA, 22 nt, Escherichia coli CFT073
ugccgggaagaaguuagagccg

SEQ ID NO: 641065 - RNA, 20 nt, Escherichia coli CFT073
ugccggaugguaugccaucc

SEQ ID NO: 641066 - RNA, 14 nt, Escherichia coli CFT073
ugcccgcagaucca

SEQ ID NO: 641067 - RNA, 13 nt, Escherichia coli CFT073
ugcccgcaucugc

SEQ ID NO: 641068 - RNA, 19 nt, Escherichia coli CFT073
ugcccgcaacggcugcuuc

SEQ ID NO: 641069 - RNA, 14 nt, Escherichia coli CFT073
ugcccgcaccaccg

SEQ ID NO: 641070 - RNA, 17 nt, Escherichia coli CFT073
ugcccgcccgacaaagc

SEQ ID NO: 641071 - RNA, 20 nt, Escherichia coli CFT073
ugcccgccagugcaucagcu

SEQ ID NO: 641072 - RNA, 15 nt, Escherichia coli CFT073
ugccccugaauaauc

SEQ ID NO: 641073 - RNA, 17 nt, Escherichia coli CFT073
ugccccgccaacagugc

SEQ ID NO: 641074 - RNA, 12 nt, Escherichia coli CFT073
ugcccaugcuuc

SEQ ID NO: 641075 - RNA, 22 nt, Escherichia coli CFT073
ugcccagcucaaucaacuccau

SEQ ID NO: 641076 - RNA, 20 nt, Escherichia coli CFT073
ugcccaguguuguauucaga

SEQ ID NO: 641077 - RNA, 18 nt, Escherichia coli CFT073
ugcccaggguaagaugaa

SEQ ID NO: 641078 - RNA, 15 nt, Escherichia coli CFT073
ugcccauacccggua

SEQ ID NO: 641079 - RNA, 19 nt, Escherichia coli CFT073
ugcccaucaggccaggcgu

SEQ ID NO: 641080 - RNA, 22 nt, Escherichia coli CFT073
ugccgacguugcguugccgcca

SEQ ID NO: 641081 - RNA, 14 nt, Escherichia coli CFT073
ugccgacaaccuga

SEQ ID NO: 641082 - RNA, 15 nt, Escherichia coli CFT073
ugccgacaucgccac

SEQ ID NO: 641083 - RNA, 17 nt, Escherichia coli CFT073
ugccgaccaucuguucu

SEQ ID NO: 641084 - RNA, 23 nt, Escherichia coli CFT073
ugccgaagaguuuuaaacgcagu

SEQ ID NO: 641085 - RNA, 23 nt, Escherichia coli CFT073
ugccgaauggcugcacuuucagu

SEQ ID NO: 641086 - RNA, 23 nt, Escherichia coli CFT073
ugccgaugauucccagucaggca

SEQ ID NO: 641087 - RNA, 21 nt, Escherichia coli CFT073
ugccgccaaucgucgccguca

SEQ ID NO: 641088 - RNA, 15 nt, Escherichia coli CFT073
ugccgccacagcguu

SEQ ID NO: 641089 - RNA, 17 nt, Escherichia coli CFT073
ugccgccaccaccagcg

SEQ ID NO: 641090 - RNA, 22 nt, Escherichia coli CFT073
ugcccuguuugucgaucaucag

SEQ ID NO: 641091 - RNA, 17 nt, Escherichia coli CFT073
ugcccggcccggaggau

SEQ ID NO: 641092 - RNA, 12 nt, Escherichia coli CFT073
ugcccuuucagu

SEQ ID NO: 641093 - RNA, 20 nt, Escherichia coli CFT073
ugcccuuuuaauacaaucug

SEQ ID NO: 641094 - RNA, 21 nt, Escherichia coli CFT073
ugccagucagcuccacaagaa

SEQ ID NO: 641095 - RNA, 11 nt, Escherichia coli CFT073
ugccagucagu

SEQ ID NO: 641096 - RNA, 17 nt, Escherichia coli CFT073
ugccagucaguuaagca

SEQ ID NO: 641097 - RNA, 20 nt, Escherichia coli CFT073
ugccaguuuacccagugaau

SEQ ID NO: 641098 - RNA, 15 nt, Escherichia coli CFT073
ugccaguuucuuuua

SEQ ID NO: 641099 - RNA, 17 nt, Escherichia coli CFT073
ugccagucaaugaaauu

SEQ ID NO: 641100 - RNA, 15 nt, Escherichia coli CFT073
ugccagucagcucca

SEQ ID NO: 641101 - RNA, 14 nt, Escherichia coli CFT073
ugccauaaaaguca

SEQ ID NO: 641102 - RNA, 18 nt, Escherichia coli CFT073
ugccauacgccggauggg

SEQ ID NO: 641103 - RNA, 13 nt, Escherichia coli CFT073
ugccaucacaccu

SEQ ID NO: 641104 - RNA, 12 nt, Escherichia coli CFT073
ugccauauccag

SEQ ID NO: 641105 - RNA, 23 nt, Escherichia coli CFT073
ugccauauuugcuuucagcgagu

SEQ ID NO: 641106 - RNA, 15 nt, Escherichia coli CFT073
ugccaucaauaauca

SEQ ID NO: 641107 - RNA, 16 nt, Escherichia coli CFT073
ugcccaccagccgcau

SEQ ID NO: 641108 - RNA, 13 nt, Escherichia coli CFT073
ugccagcacagau

SEQ ID NO: 641109 - RNA, 16 nt, Escherichia coli CFT073
ugccagcaccaaacug

SEQ ID NO: 641110 - RNA, 23 nt, Escherichia coli CFT073
ugccagcaccaaacuggaauagc

SEQ ID NO: 641111 - RNA, 14 nt, Escherichia coli CFT073
ugccagcagacgcc

SEQ ID NO: 641112 - RNA, 19 nt, Escherichia coli CFT073
ugccagcguaaauccugac

SEQ ID NO: 641113 - RNA, 20 nt, Escherichia coli CFT073
ugccagccauaccuggugca

SEQ ID NO: 641114 - RNA, 20 nt, Escherichia coli CFT073
ugccagcauaccgccgagga

SEQ ID NO: 641115 - RNA, 14 nt, Escherichia coli CFT073
ugccagcagcaccc

SEQ ID NO: 641116 - RNA, 13 nt, Escherichia coli CFT073
ugccagccacacc

SEQ ID NO: 641117 - RNA, 22 nt, Escherichia coli CFT073
ugccagccaggauaugcgccuu

SEQ ID NO: 641118 - RNA, 23 nt, Escherichia coli CFT073
ugccaggccgauagacacugccg

SEQ ID NO: 641119 - RNA, 18 nt, Escherichia coli CFT073
ugccagcuugcuuuccag

SEQ ID NO: 641120 - RNA, 13 nt, Escherichia coli CFT073
ugccagcugcuca

SEQ ID NO: 641121 - RNA, 18 nt, Escherichia coli CFT073
ugccagcuuucaccugcg

SEQ ID NO: 641122 - RNA, 21 nt, Escherichia coli CFT073
ugccagcuuuuguugucaccc

SEQ ID NO: 641123 - RNA, 14 nt, Escherichia coli CFT073
ugccaggaccauuc

SEQ ID NO: 641124 - RNA, 23 nt, Escherichia coli CFT073
ugccagcguaccaugauccugca

SEQ ID NO: 641125 - RNA, 22 nt, Escherichia coli CFT073
ugccagcucuuucgacagcgau

SEQ ID NO: 641126 - RNA, 13 nt, Escherichia coli CFT073
ugccacucaggca

SEQ ID NO: 641127 - RNA, 15 nt, Escherichia coli CFT073
ugccacucaggcaaa

SEQ ID NO: 641128 - RNA, 13 nt, Escherichia coli CFT073
ugccaccagugcc

SEQ ID NO: 641129 - RNA, 20 nt, Escherichia coli CFT073
ugccacuggauguugcauua

SEQ ID NO: 641130 - RNA, 18 nt, Escherichia coli CFT073
ugccacucuccugguugu

SEQ ID NO: 641131 - RNA, 20 nt, Escherichia coli CFT073
ugccacuucguaaccggccu

SEQ ID NO: 641132 - RNA, 15 nt, Escherichia coli CFT073
ugccacuucuuccag

SEQ ID NO: 641133 - RNA, 14 nt, Escherichia coli CFT073
ugccagaaaccagc

SEQ ID NO: 641134 - RNA, 13 nt, Escherichia coli CFT073
ugccagaacagaa

SEQ ID NO: 641135 - RNA, 20 nt, Escherichia coli CFT073
ugccaauaaauccuuuguac

SEQ ID NO: 641136 - RNA, 15 nt, Escherichia coli CFT073
ugccacauuucucug

SEQ ID NO: 641137 - RNA, 22 nt, Escherichia coli CFT073
ugccaccacaccagaccagaca

SEQ ID NO: 641138 - RNA, 22 nt, Escherichia coli CFT073
ugccaccaccagcguaccgaua

SEQ ID NO: 641139 - RNA, 16 nt, Escherichia coli CFT073
ugccaccagcacaccg

SEQ ID NO: 641140 - RNA, 23 nt, Escherichia coli CFT073
ugccaaccguaacgacggcuaua

SEQ ID NO: 641141 - RNA, 14 nt, Escherichia coli CFT073
ugccaacgcggccc

SEQ ID NO: 641142 - RNA, 20 nt, Escherichia coli CFT073
ugcaguaugaaacgccugau

SEQ ID NO: 641143 - RNA, 22 nt, Escherichia coli CFT073
ugcagucucaugcgucaugagc

SEQ ID NO: 641144 - RNA, 19 nt, Escherichia coli CFT073
ugcaguacgauaauggcuu

SEQ ID NO: 641145 - RNA, 12 nt, Escherichia coli CFT073
ugcaguaaaauu

SEQ ID NO: 641146 - RNA, 21 nt, Escherichia coli CFT073
ugcaggucguccugcaaagcu

SEQ ID NO: 641147 - RNA, 18 nt, Escherichia coli CFT073
ugcagguucuuuuaaacc

SEQ ID NO: 641148 - RNA, 16 nt, Escherichia coli CFT073
ugcagguugcaguugg

SEQ ID NO: 641149 - RNA, 14 nt, Escherichia coli CFT073
ugcaggucguccug

SEQ ID NO: 641150 - RNA, 17 nt, Escherichia coli CFT073
ugcagggugagggcaau

SEQ ID NO: 641151 - RNA, 20 nt, Escherichia coli CFT073
ugcagggugagggcaauaau

SEQ ID NO: 641152 - RNA, 13 nt, Escherichia coli CFT073
ugcagcugcucga

SEQ ID NO: 641153 - RNA, 17 nt, Escherichia coli CFT073
ugcagcuucuucuccag

SEQ ID NO: 641154 - RNA, 18 nt, Escherichia coli CFT073
ugcagcuucuucuccagc

SEQ ID NO: 641155 - RNA, 21 nt, Escherichia coli CFT073
ugcagcuucuucuccagcugc

SEQ ID NO: 641156 - RNA, 20 nt, Escherichia coli CFT073
ugcaggaaaucaaugccacc

SEQ ID NO: 641157 - RNA, 16 nt, Escherichia coli CFT073
ugcaggaauggcuggg

SEQ ID NO: 641158 - RNA, 15 nt, Escherichia coli CFT073
ugcagcucuguuuug

SEQ ID NO: 641159 - RNA, 18 nt, Escherichia coli CFT073
ugcagcuccccacaccac

SEQ ID NO: 641160 - RNA, 18 nt, Escherichia coli CFT073
ugcagcguuucgcgcgcg

SEQ ID NO: 641161 - RNA, 17 nt, Escherichia coli CFT073
ugcagcgcaugauuuuc

SEQ ID NO: 641162 - RNA, 20 nt, Escherichia coli CFT073
ugcagcgcggcgagagccuu

SEQ ID NO: 641163 - RNA, 21 nt, Escherichia coli CFT073
ugcagcggucacauguuccag

SEQ ID NO: 641164 - RNA, 17 nt, Escherichia coli CFT073
ugcagcggccaguagcu

SEQ ID NO: 641165 - RNA, 16 nt, Escherichia coli CFT073
ugcaggcuauuucugg

SEQ ID NO: 641166 - RNA, 15 nt, Escherichia coli CFT073
ugcaggcucaggcug

SEQ ID NO: 641167 - RNA, 14 nt, Escherichia coli CFT073
ugcagggauggcuc

SEQ ID NO: 641168 - RNA, 15 nt, Escherichia coli CFT073
ugcagggauggcucc

SEQ ID NO: 641169 - RNA, 22 nt, Escherichia coli CFT073
ugcagggcuuuuuaaugcaaua

SEQ ID NO: 641170 - RNA, 18 nt, Escherichia coli CFT073
ugcaggagaccaaaccau

SEQ ID NO: 641171 - RNA, 18 nt, Escherichia coli CFT073
ugcaggcaugcaauauuc

SEQ ID NO: 641172 - RNA, 14 nt, Escherichia coli CFT073
ugcaggccaaacag

SEQ ID NO: 641173 - RNA, 19 nt, Escherichia coli CFT073
ugcagagcauccagcagcc

SEQ ID NO: 641174 - RNA, 17 nt, Escherichia coli CFT073
ugcagauaccacaucaa

SEQ ID NO: 641175 - RNA, 18 nt, Escherichia coli CFT073
ugcagagagucacgcagc

SEQ ID NO: 641176 - RNA, 14 nt, Escherichia coli CFT073
ugcagaaucaaucu

SEQ ID NO: 641177 - RNA, 17 nt, Escherichia coli CFT073
ugcagaauuugcaccac

SEQ ID NO: 641178 - RNA, 17 nt, Escherichia coli CFT073
ugcagaucuuucugcag

SEQ ID NO: 641179 - RNA, 21 nt, Escherichia coli CFT073
ugcagaucuuucugcagggca

SEQ ID NO: 641180 - RNA, 23 nt, Escherichia coli CFT073
ugcagaucuuucugcagggcaau

SEQ ID NO: 641181 - RNA, 17 nt, Escherichia coli CFT073
ugcagauaccaccagcg

SEQ ID NO: 641182 - RNA, 15 nt, Escherichia coli CFT073
ugcagcacuugcagc

SEQ ID NO: 641183 - RNA, 20 nt, Escherichia coli CFT073
ugcagcacggagagacguug

SEQ ID NO: 641184 - RNA, 20 nt, Escherichia coli CFT073
ugcagcacucgauuccaaua

SEQ ID NO: 641185 - RNA, 17 nt, Escherichia coli CFT073
ugcagcacggagagacg

SEQ ID NO: 641186 - RNA, 16 nt, Escherichia coli CFT073
ugcagcaucgauggug

SEQ ID NO: 641187 - RNA, 18 nt, Escherichia coli CFT073
ugcagcaucgcuguuuuu

SEQ ID NO: 641188 - RNA, 14 nt, Escherichia coli CFT073
ugcagccuucauuc

SEQ ID NO: 641189 - RNA, 18 nt, Escherichia coli CFT073
ugcagccagcguuaccca

SEQ ID NO: 641190 - RNA, 14 nt, Escherichia coli CFT073
ugcagccacugcug

SEQ ID NO: 641191 - RNA, 16 nt, Escherichia coli CFT073
ugcagccacugcugcg

SEQ ID NO: 641192 - RNA, 22 nt, Escherichia coli CFT073
ugcacgaugccucaucacaaaa

SEQ ID NO: 641193 - RNA, 18 nt, Escherichia coli CFT073
ugcacgguuuuuccagcu

SEQ ID NO: 641194 - RNA, 22 nt, Escherichia coli CFT073
ugcacguuaucagacaccagcc

SEQ ID NO: 641195 - RNA, 17 nt, Escherichia coli CFT073
ugcacguuaucagacac

SEQ ID NO: 641196 - RNA, 15 nt, Escherichia coli CFT073
ugcacuuugugucag

SEQ ID NO: 641197 - RNA, 21 nt, Escherichia coli CFT073
ugcagaacguccgguuaaauc

SEQ ID NO: 641198 - RNA, 20 nt, Escherichia coli CFT073
ugcacuuucaguacguuuuu

SEQ ID NO: 641199 - RNA, 21 nt, Escherichia coli CFT073
ugcacgugcuuauaacugccc

SEQ ID NO: 641200 - RNA, 23 nt, Escherichia coli CFT073
ugcacuucuucacaucaauauuc

SEQ ID NO: 641201 - RNA, 18 nt, Escherichia coli CFT073
ugcacagcucugaauaaa

SEQ ID NO: 641202 - RNA, 19 nt, Escherichia coli CFT073
ugcacaggagacaccagcg

SEQ ID NO: 641203 - RNA, 17 nt, Escherichia coli CFT073
ugcacaggcauucagau

SEQ ID NO: 641204 - RNA, 23 nt, Escherichia coli CFT073
ugcacagaaaagcagagugugaa

SEQ ID NO: 641205 - RNA, 22 nt, Escherichia coli CFT073
ugcacagcauucagcuuccaga

SEQ ID NO: 641206 - RNA, 21 nt, Escherichia coli CFT073
ugcaccuuguuucagcacgau

SEQ ID NO: 641207 - RNA, 14 nt, Escherichia coli CFT073
ugcacauuccagau

SEQ ID NO: 641208 - RNA, 15 nt, Escherichia coli CFT073
ugcaaucgauuugaa

SEQ ID NO: 641209 - RNA, 19 nt, Escherichia coli CFT073
ugcaauccacaagcacagg

SEQ ID NO: 641210 - RNA, 15 nt, Escherichia coli CFT073
ugcaaucuacaaaag

SEQ ID NO: 641211 - RNA, 16 nt, Escherichia coli CFT073
ugcaaucgucugcuga

SEQ ID NO: 641212 - RNA, 20 nt, Escherichia coli CFT073
ugcaaucucugacauaaaaa

SEQ ID NO: 641213 - RNA, 23 nt, Escherichia coli CFT073
ugcaaugccguuugcugcaugau

SEQ ID NO: 641214 - RNA, 19 nt, Escherichia coli CFT073
ugcaaugccguuugcugca

SEQ ID NO: 641215 - RNA, 15 nt, Escherichia coli CFT073
ugcacaaugccuuuu

SEQ ID NO: 641216 - RNA, 20 nt, Escherichia coli CFT073
ugcacacggaucugaugagu

SEQ ID NO: 641217 - RNA, 17 nt, Escherichia coli CFT073
ugcaaacgauaaaagug

SEQ ID NO: 641218 - RNA, 14 nt, Escherichia coli CFT073
ugcaaagagaacug

SEQ ID NO: 641219 - RNA, 16 nt, Escherichia coli CFT073
ugcaaaggccaauggu

SEQ ID NO: 641220 - RNA, 15 nt, Escherichia coli CFT073
ugcaagucuugcugc

SEQ ID NO: 641221 - RNA, 17 nt, Escherichia coli CFT073
ugcaagucuugcugcgc

SEQ ID NO: 641222 - RNA, 15 nt, Escherichia coli CFT073
ugauucacauccugc

SEQ ID NO: 641223 - RNA, 17 nt, Escherichia coli CFT073
ugauucacauccugcca

SEQ ID NO: 641224 - RNA, 19 nt, Escherichia coli CFT073
ugauucacauccugccagu

SEQ ID NO: 641225 - RNA, 22 nt, Escherichia coli CFT073
ugauuccgggccaccaugccca

SEQ ID NO: 641226 - RNA, 21 nt, Escherichia coli CFT073
ugauuccguucaguaaucaac

SEQ ID NO: 641227 - RNA, 15 nt, Escherichia coli CFT073
ugauuauccucugua

SEQ ID NO: 641228 - RNA, 13 nt, Escherichia coli CFT073
ugauguccugcgg

SEQ ID NO: 641229 - RNA, 15 nt, Escherichia coli CFT073
ugauguccuuuauaa

SEQ ID NO: 641230 - RNA, 22 nt, Escherichia coli CFT073
ugauguccuuuauaacugucuu

SEQ ID NO: 641231 - RNA, 16 nt, Escherichia coli CFT073
ugaugugcuucagcuu

SEQ ID NO: 641232 - RNA, 15 nt, Escherichia coli CFT073
ugauguauauuucug

SEQ ID NO: 641233 - RNA, 13 nt, Escherichia coli CFT073
ugauguaacaguu

SEQ ID NO: 641234 - RNA, 22 nt, Escherichia coli CFT073
ugauggccagauaacccagggg

SEQ ID NO: 641235 - RNA, 20 nt, Escherichia coli CFT073
ugauggcauaacguugcagc

SEQ ID NO: 641236 - RNA, 21 nt, Escherichia coli CFT073
ugauggcgauacugccgccca

SEQ ID NO: 641237 - RNA, 19 nt, Escherichia coli CFT073
ugauuuuucguuuuaaugc

SEQ ID NO: 641238 - RNA, 23 nt, Escherichia coli CFT073
ugauuuuucguuuuaaugcgauc

SEQ ID NO: 641239 - RNA, 16 nt, Escherichia coli CFT073
ugauuuuuccacuccg

SEQ ID NO: 641240 - RNA, 15 nt, Escherichia coli CFT073
ugauuugauguacuc

SEQ ID NO: 641241 - RNA, 16 nt, Escherichia coli CFT073
ugauuugauguacuca

SEQ ID NO: 641242 - RNA, 19 nt, Escherichia coli CFT073
ugauuuaacagcaaaacac

SEQ ID NO: 641243 - RNA, 22 nt, Escherichia coli CFT073
ugauuuccccuaacucuuucaa

SEQ ID NO: 641244 - RNA, 12 nt, Escherichia coli CFT073
ugauuucuuauu

SEQ ID NO: 641245 - RNA, 18 nt, Escherichia coli CFT073
ugauuucucuggagaaau

SEQ ID NO: 641246 - RNA, 15 nt, Escherichia coli CFT073
ugauuguuuuaaaua

SEQ ID NO: 641247 - RNA, 18 nt, Escherichia coli CFT073
ugauuguuuuaaauauug

SEQ ID NO: 641248 - RNA, 14 nt, Escherichia coli CFT073
ugaucggagaacag

SEQ ID NO: 641249 - RNA, 21 nt, Escherichia coli CFT073
ugaucggagaacaggaauaaa

SEQ ID NO: 641250 - RNA, 14 nt, Escherichia coli CFT073
ugaugacuugccuc

SEQ ID NO: 641251 - RNA, 15 nt, Escherichia coli CFT073
ugaugacgcagaucc

SEQ ID NO: 641252 - RNA, 14 nt, Escherichia coli CFT073
ugaucgaaaaugcg

SEQ ID NO: 641253 - RNA, 22 nt, Escherichia coli CFT073
ugaucgcgcaguaaauccgcca

SEQ ID NO: 641254 - RNA, 16 nt, Escherichia coli CFT073
ugaugcucuugaaaug

SEQ ID NO: 641255 - RNA, 22 nt, Escherichia coli CFT073
ugauggaaauccgggcuaucau

SEQ ID NO: 641256 - RNA, 14 nt, Escherichia coli CFT073
ugaugcggcaucug

SEQ ID NO: 641257 - RNA, 15 nt, Escherichia coli CFT073
ugaugcguucuucaa

SEQ ID NO: 641258 - RNA, 23 nt, Escherichia coli CFT073
ugaugcgcuucgcuuaccaugcc

SEQ ID NO: 641259 - RNA, 16 nt, Escherichia coli CFT073
ugaugcgcggcuccag

SEQ ID NO: 641260 - RNA, 14 nt, Escherichia coli CFT073
ugaugcgcuaugcu

SEQ ID NO: 641261 - RNA, 19 nt, Escherichia coli CFT073
ugaugcgcuaugcuuauca

SEQ ID NO: 641262 - RNA, 20 nt, Escherichia coli CFT073
ugaugccagcacucugugcg

SEQ ID NO: 641263 - RNA, 11 nt, Escherichia coli CFT073
ugaugccaucg

SEQ ID NO: 641264 - RNA, 23 nt, Escherichia coli CFT073
ugaugcauacggcgauaaggcgu

SEQ ID NO: 641265 - RNA, 13 nt, Escherichia coli CFT073
ugaugauuuugcg

SEQ ID NO: 641266 - RNA, 15 nt, Escherichia coli CFT073
ugauauugauaauaa

SEQ ID NO: 641267 - RNA, 16 nt, Escherichia coli CFT073
ugauauugauaauaaa

SEQ ID NO: 641268 - RNA, 13 nt, Escherichia coli CFT073
ugauaucccugcu

SEQ ID NO: 641269 - RNA, 17 nt, Escherichia coli CFT073
ugauaucgcucugguug

SEQ ID NO: 641270 - RNA, 13 nt, Escherichia coli CFT073
ugauauccauaaa

SEQ ID NO: 641271 - RNA, 23 nt, Escherichia coli CFT073
ugauaucagccugcaaacgcuuu

SEQ ID NO: 641272 - RNA, 13 nt, Escherichia coli CFT073
ugaguggcuccau

SEQ ID NO: 641273 - RNA, 21 nt, Escherichia coli CFT073
ugagugauuccguucaguaau

SEQ ID NO: 641274 - RNA, 16 nt, Escherichia coli CFT073
ugauauaccguagauu

SEQ ID NO: 641275 - RNA, 23 nt, Escherichia coli CFT073
ugauauuuguuuuuguuaauugc

SEQ ID NO: 641276 - RNA, 12 nt, Escherichia coli CFT073
ugaucaaaaaaa

SEQ ID NO: 641277 - RNA, 13 nt, Escherichia coli CFT073
ugaucaccguaga

SEQ ID NO: 641278 - RNA, 16 nt, Escherichia coli CFT073
ugaucacgacuuguac

SEQ ID NO: 641279 - RNA, 15 nt, Escherichia coli CFT073
ugauccacaccggcg

SEQ ID NO: 641280 - RNA, 13 nt, Escherichia coli CFT073
ugauccacugcag

SEQ ID NO: 641281 - RNA, 16 nt, Escherichia coli CFT073
ugaucccagaaccagu

SEQ ID NO: 641282 - RNA, 15 nt, Escherichia coli CFT073
ugaucccggcuuccu

SEQ ID NO: 641283 - RNA, 13 nt, Escherichia coli CFT073
ugaguauuaaaug

SEQ ID NO: 641284 - RNA, 16 nt, Escherichia coli CFT073
ugaguaucgaaaacau

SEQ ID NO: 641285 - RNA, 18 nt, Escherichia coli CFT073
ugaguaucuuauugaaag

SEQ ID NO: 641286 - RNA, 15 nt, Escherichia coli CFT073
ugaguagccucugcg

SEQ ID NO: 641287 - RNA, 23 nt, Escherichia coli CFT073
ugagguauuucgucuaagcggcc

SEQ ID NO: 641288 - RNA, 13 nt, Escherichia coli CFT073
ugaggugcaggaa

SEQ ID NO: 641289 - RNA, 20 nt, Escherichia coli CFT073
ugagguggccgagaggcuga

SEQ ID NO: 641290 - RNA, 12 nt, Escherichia coli CFT073
ugagguuaugca

SEQ ID NO: 641291 - RNA, 14 nt, Escherichia coli CFT073
ugagguuucccgcc

SEQ ID NO: 641292 - RNA, 23 nt, Escherichia coli CFT073
ugaggguguuggaacccgcagcc

SEQ ID NO: 641293 - RNA, 18 nt, Escherichia coli CFT073
ugagguaacucucaugcu

SEQ ID NO: 641294 - RNA, 13 nt, Escherichia coli CFT073
ugagguaaucacu

SEQ ID NO: 641295 - RNA, 23 nt, Escherichia coli CFT073
ugagcgugagguuaucgcccugc

SEQ ID NO: 641296 - RNA, 16 nt, Escherichia coli CFT073
ugagcgguacaccaaa

SEQ ID NO: 641297 - RNA, 13 nt, Escherichia coli CFT073
ugagcgauaaaca

SEQ ID NO: 641298 - RNA, 16 nt, Escherichia coli CFT073
ugagcgauaaacaagu

SEQ ID NO: 641299 - RNA, 21 nt, Escherichia coli CFT073
ugagcuucucuggcugcuuca

SEQ ID NO: 641300 - RNA, 16 nt, Escherichia coli CFT073
ugagcuuucuuccagg

SEQ ID NO: 641301 - RNA, 14 nt, Escherichia coli CFT073
ugaggaucaccagu

SEQ ID NO: 641302 - RNA, 22 nt, Escherichia coli CFT073
ugaggaucgggcagugcucgua

SEQ ID NO: 641303 - RNA, 14 nt, Escherichia coli CFT073
ugaggaugcgaguc

SEQ ID NO: 641304 - RNA, 14 nt, Escherichia coli CFT073
ugaggaagcgcgcc

SEQ ID NO: 641305 - RNA, 14 nt, Escherichia coli CFT073
ugagcuuuggcggc

SEQ ID NO: 641306 - RNA, 21 nt, Escherichia coli CFT073
ugagaauuccggcagagaaag

SEQ ID NO: 641307 - RNA, 14 nt, Escherichia coli CFT073
ugagauaauuuaua

SEQ ID NO: 641308 - RNA, 14 nt, Escherichia coli CFT073
ugagauacauuggu

SEQ ID NO: 641309 - RNA, 19 nt, Escherichia coli CFT073
ugagaagccaccgcaccac

SEQ ID NO: 641310 - RNA, 18 nt, Escherichia coli CFT073
ugagauucaacaucucua

SEQ ID NO: 641311 - RNA, 20 nt, Escherichia coli CFT073
ugagauucaacaucucuauu

SEQ ID NO: 641312 - RNA, 12 nt, Escherichia coli CFT073
ugagaucuuuaa

SEQ ID NO: 641313 - RNA, 14 nt, Escherichia coli CFT073
ugagauccgcuuca

SEQ ID NO: 641314 - RNA, 16 nt, Escherichia coli CFT073
ugagauccugccaggc

SEQ ID NO: 641315 - RNA, 19 nt, Escherichia coli CFT073
ugagaucguuaagcacagc

SEQ ID NO: 641316 - RNA, 22 nt, Escherichia coli CFT073
ugagaucguuaugcaaaugaga

SEQ ID NO: 641317 - RNA, 21 nt, Escherichia coli CFT073
ugagccggaguugcagauuug

SEQ ID NO: 641318 - RNA, 18 nt, Escherichia coli CFT073
ugagccgccaccagaacc

SEQ ID NO: 641319 - RNA, 14 nt, Escherichia coli CFT073
ugagccagugagcg

SEQ ID NO: 641320 - RNA, 21 nt, Escherichia coli CFT073
ugagcaaacaguucugcagcg

SEQ ID NO: 641321 - RNA, 19 nt, Escherichia coli CFT073
ugagcaaacaguucugcag

SEQ ID NO: 641322 - RNA, 13 nt, Escherichia coli CFT073
ugagaacuguucc

SEQ ID NO: 641323 - RNA, 19 nt, Escherichia coli CFT073
ugagaacuucggcagagaa

SEQ ID NO: 641324 - RNA, 10 nt, Escherichia coli CFT073
ugagaaaaag

SEQ ID NO: 641325 - RNA, 23 nt, Escherichia coli CFT073
ugagaaaacuaucugaaaaugaa

SEQ ID NO: 641326 - RNA, 16 nt, Escherichia coli CFT073
ugacuuuugcccggca

SEQ ID NO: 641327 - RNA, 17 nt, Escherichia coli CFT073
ugacuuuaccugccuga

SEQ ID NO: 641328 - RNA, 20 nt, Escherichia coli CFT073
ugacuuucuuuucccugugg

SEQ ID NO: 641329 - RNA, 14 nt, Escherichia coli CFT073
ugacuugccagcca

SEQ ID NO: 641330 - RNA, 17 nt, Escherichia coli CFT073
ugacuugcgaacucacc

SEQ ID NO: 641331 - RNA, 17 nt, Escherichia coli CFT073
ugacuugcucaaucugg

SEQ ID NO: 641332 - RNA, 21 nt, Escherichia coli CFT073
ugacuguccacgacagaaccc

SEQ ID NO: 641333 - RNA, 16 nt, Escherichia coli CFT073
ugacugucgcuauuca

SEQ ID NO: 641334 - RNA, 19 nt, Escherichia coli CFT073
ugacuuggcuuucucuucc

SEQ ID NO: 641335 - RNA, 19 nt, Escherichia coli CFT073
ugacggaaauggacgucaa

SEQ ID NO: 641336 - RNA, 20 nt, Escherichia coli CFT073
ugacucaaagaugaaauaaa

SEQ ID NO: 641337 - RNA, 19 nt, Escherichia coli CFT073
ugacucagaccauauuccc

SEQ ID NO: 641338 - RNA, 14 nt, Escherichia coli CFT073
ugacucauaaaaau

SEQ ID NO: 641339 - RNA, 21 nt, Escherichia coli CFT073
ugacucguuauuguuugucgc

SEQ ID NO: 641340 - RNA, 13 nt, Escherichia coli CFT073
ugacugcuuuuuc

SEQ ID NO: 641341 - RNA, 16 nt, Escherichia coli CFT073
ugacugcuuuuucaau

SEQ ID NO: 641342 - RNA, 21 nt, Escherichia coli CFT073
ugacuggcagaaugaaguaaa

SEQ ID NO: 641343 - RNA, 15 nt, Escherichia coli CFT073
ugaccgggaauauaa

SEQ ID NO: 641344 - RNA, 19 nt, Escherichia coli CFT073
ugaccgcuaauagcgcagc

SEQ ID NO: 641345 - RNA, 20 nt, Escherichia coli CFT073
ugaccgcuguuaugcacacg

SEQ ID NO: 641346 - RNA, 21 nt, Escherichia coli CFT073
ugacccacgccuuuuucuccg

SEQ ID NO: 641347 - RNA, 18 nt, Escherichia coli CFT073
ugacccagaagacgagcc

SEQ ID NO: 641348 - RNA, 15 nt, Escherichia coli CFT073
ugaccaucagcagcg

SEQ ID NO: 641349 - RNA, 18 nt, Escherichia coli CFT073
ugaccaugagccaguucu

SEQ ID NO: 641350 - RNA, 15 nt, Escherichia coli CFT073
ugaccuauuucauuc

SEQ ID NO: 641351 - RNA, 15 nt, Escherichia coli CFT073
ugaccguuacugaua

SEQ ID NO: 641352 - RNA, 23 nt, Escherichia coli CFT073
ugaccguuagcauauugcaggcu

SEQ ID NO: 641353 - RNA, 17 nt, Escherichia coli CFT073
ugaccguuuuccccaac

SEQ ID NO: 641354 - RNA, 15 nt, Escherichia coli CFT073
ugaccugacauuaag

SEQ ID NO: 641355 - RNA, 21 nt, Escherichia coli CFT073
ugacgaucaacccaguugauc

SEQ ID NO: 641356 - RNA, 19 nt, Escherichia coli CFT073
ugacgaucauuccgcccag

SEQ ID NO: 641357 - RNA, 15 nt, Escherichia coli CFT073
ugacgaguccuuccu

SEQ ID NO: 641358 - RNA, 12 nt, Escherichia coli CFT073
ugacgauaaaag

SEQ ID NO: 641359 - RNA, 22 nt, Escherichia coli CFT073
ugacgcugaauaauccccacau

SEQ ID NO: 641360 - RNA, 22 nt, Escherichia coli CFT073
ugacgaugcgucacguaggcuu

SEQ ID NO: 641361 - RNA, 20 nt, Escherichia coli CFT073
ugacaccgcuguugcuucca

SEQ ID NO: 641362 - RNA, 22 nt, Escherichia coli CFT073
ugacacggaacaacggcaaaca

SEQ ID NO: 641363 - RNA, 16 nt, Escherichia coli CFT073
ugacacuauucgccag

SEQ ID NO: 641364 - RNA, 14 nt, Escherichia coli CFT073
ugacagaaucagca

SEQ ID NO: 641365 - RNA, 17 nt, Escherichia coli CFT073
ugacagaaucagcagcg

SEQ ID NO: 641366 - RNA, 18 nt, Escherichia coli CFT073
ugacagaaucagcagcgu

SEQ ID NO: 641367 - RNA, 23 nt, Escherichia coli CFT073
ugacagaaucagcagcguuccca

SEQ ID NO: 641368 - RNA, 15 nt, Escherichia coli CFT073
ugacaggccccccuc

SEQ ID NO: 641369 - RNA, 17 nt, Escherichia coli CFT073
ugacaggcgggaagaac

SEQ ID NO: 641370 - RNA, 14 nt, Escherichia coli CFT073
ugacagcuccuccg

SEQ ID NO: 641371 - RNA, 19 nt, Escherichia coli CFT073
ugacagcuccuccgggagc

SEQ ID NO: 641372 - RNA, 16 nt, Escherichia coli CFT073
ugacagcgugguuuuc

SEQ ID NO: 641373 - RNA, 15 nt, Escherichia coli CFT073
ugacagcucacgcgc

SEQ ID NO: 641374 - RNA, 17 nt, Escherichia coli CFT073
ugacagccccaguuccu

SEQ ID NO: 641375 - RNA, 23 nt, Escherichia coli CFT073
ugacagccccugugccagcucgu

SEQ ID NO: 641376 - RNA, 21 nt, Escherichia coli CFT073
ugacagaccgccaguaucuuc

SEQ ID NO: 641377 - RNA, 12 nt, Escherichia coli CFT073
ugacacuucuuc

SEQ ID NO: 641378 - RNA, 21 nt, Escherichia coli CFT073
ugacauauaaccggcaacaga

SEQ ID NO: 641379 - RNA, 17 nt, Escherichia coli CFT073
ugacaguaucaccaacu

SEQ ID NO: 641380 - RNA, 21 nt, Escherichia coli CFT073
ugaccauaaguaguuguucag

SEQ ID NO: 641381 - RNA, 14 nt, Escherichia coli CFT073
ugaccauaaaaggc

SEQ ID NO: 641382 - RNA, 18 nt, Escherichia coli CFT073
ugaccacuuugcgcuccu

SEQ ID NO: 641383 - RNA, 14 nt, Escherichia coli CFT073
ugaccaccagcacg

SEQ ID NO: 641384 - RNA, 20 nt, Escherichia coli CFT073
ugaaucggaucaauccccag

SEQ ID NO: 641385 - RNA, 23 nt, Escherichia coli CFT073
ugaaucggcgcagcaauuauucc

SEQ ID NO: 641386 - RNA, 13 nt, Escherichia coli CFT073
ugaauaucaucac

SEQ ID NO: 641387 - RNA, 16 nt, Escherichia coli CFT073
ugaauaucuaauuauu

SEQ ID NO: 641388 - RNA, 14 nt, Escherichia coli CFT073
ugaauaucuuucuc

SEQ ID NO: 641389 - RNA, 18 nt, Escherichia coli CFT073
ugaauauccuguucagac

SEQ ID NO: 641390 - RNA, 22 nt, Escherichia coli CFT073
ugaauauccuguucagacauua

SEQ ID NO: 641391 - RNA, 14 nt, Escherichia coli CFT073
ugaaucuggcuuca

SEQ ID NO: 641392 - RNA, 19 nt, Escherichia coli CFT073
ugaaucuuacuucuucuua

SEQ ID NO: 641393 - RNA, 13 nt, Escherichia coli CFT073
ugaaugaaaacga

SEQ ID NO: 641394 - RNA, 13 nt, Escherichia coli CFT073
ugaaucucaggca

SEQ ID NO: 641395 - RNA, 15 nt, Escherichia coli CFT073
ugaaucucaggcaaa

SEQ ID NO: 641396 - RNA, 19 nt, Escherichia coli CFT073
ugaaucucaggcaaauaug

SEQ ID NO: 641397 - RNA, 13 nt, Escherichia coli CFT073
ugaaucugagcau

SEQ ID NO: 641398 - RNA, 14 nt, Escherichia coli CFT073
ugaaucguuugucc

SEQ ID NO: 641399 - RNA, 19 nt, Escherichia coli CFT073
ucuuucaacacaugcacau

SEQ ID NO: 641400 - RNA, 14 nt, Escherichia coli CFT073
ucuuuauucauaau

SEQ ID NO: 641401 - RNA, 17 nt, Escherichia coli CFT073
ucuuuaguuaauuucgc

SEQ ID NO: 641402 - RNA, 14 nt, Escherichia coli CFT073
ucuuuauaaaguaa

SEQ ID NO: 641403 - RNA, 16 nt, Escherichia coli CFT073
ugaauaccaagucuca

SEQ ID NO: 641404 - RNA, 14 nt, Escherichia coli CFT073
ugaauacccgccag

SEQ ID NO: 641405 - RNA, 13 nt, Escherichia coli CFT073
ugaauacgcagcg

SEQ ID NO: 641406 - RNA, 16 nt, Escherichia coli CFT073
ugaauaaucugaaaac

SEQ ID NO: 641407 - RNA, 13 nt, Escherichia coli CFT073
ucuuucacaaaga

SEQ ID NO: 641408 - RNA, 15 nt, Escherichia coli CFT073
ugaaugcaacugccc

SEQ ID NO: 641409 - RNA, 18 nt, Escherichia coli CFT073
ugaaugcaacugcccagg

SEQ ID NO: 641410 - RNA, 22 nt, Escherichia coli CFT073
ugaaugccaaauccggcaaaua

SEQ ID NO: 641411 - RNA, 21 nt, Escherichia coli CFT073
ugaauuaucuauauuuauuca

SEQ ID NO: 641412 - RNA, 22 nt, Escherichia coli CFT073
ugaauuucaaaucaccaaacug

SEQ ID NO: 641413 - RNA, 21 nt, Escherichia coli CFT073
ugaauuuccugcgcuuucugc

SEQ ID NO: 641414 - RNA, 22 nt, Escherichia coli CFT073
ugaauuuccugcgcuuucugcu

SEQ ID NO: 641415 - RNA, 22 nt, Escherichia coli CFT073
ugaauuguuuugacgaguuagc

SEQ ID NO: 641416 - RNA, 19 nt, Escherichia coli CFT073
ugacaaaaaagccaauuac

SEQ ID NO: 641417 - RNA, 22 nt, Escherichia coli CFT073
ugacaaaaucaauauaaacagc

SEQ ID NO: 641418 - RNA, 15 nt, Escherichia coli CFT073
ugacaaacacagcag

SEQ ID NO: 641419 - RNA, 13 nt, Escherichia coli CFT073
ugacaaacucacc

SEQ ID NO: 641420 - RNA, 12 nt, Escherichia coli CFT073
ugacaacaacau

SEQ ID NO: 641421 - RNA, 16 nt, Escherichia coli CFT073
ugacaacguccucguc

SEQ ID NO: 641422 - RNA, 21 nt, Escherichia coli CFT073
ugacaauaauugucaacggca

SEQ ID NO: 641423 - RNA, 11 nt, Escherichia coli CFT073
ugacaccagca

SEQ ID NO: 641424 - RNA, 16 nt, Escherichia coli CFT073
ugacaccagcauaaua

SEQ ID NO: 641425 - RNA, 13 nt, Escherichia coli CFT073
ugacacccaaugu

SEQ ID NO: 641426 - RNA, 14 nt, Escherichia coli CFT073
gacaggucaucgca

SEQ ID NO: 641427 - RNA, 23 nt, Escherichia coli CFT073
gacaguaagcccaccacaaacca

SEQ ID NO: 641428 - RNA, 16 nt, Escherichia coli CFT073
gacaguacccagauuc

SEQ ID NO: 641429 - RNA, 15 nt, Escherichia coli CFT073
gacaguaucaccaac

SEQ ID NO: 641430 - RNA, 16 nt, Escherichia coli CFT073
gacaguaucaccaacu

SEQ ID NO: 641431 - RNA, 21 nt, Escherichia coli CFT073
gacaggcuuacguuacccagc

SEQ ID NO: 641432 - RNA, 20 nt, Escherichia coli CFT073
gacagggugagcagggcgcu

SEQ ID NO: 641433 - RNA, 16 nt, Escherichia coli CFT073
gacaggccgugcaguu

SEQ ID NO: 641434 - RNA, 16 nt, Escherichia coli CFT073
gacaggcagacgauga

SEQ ID NO: 641435 - RNA, 22 nt, Escherichia coli CFT073
gacaguugcugcgugaccgcca

SEQ ID NO: 641436 - RNA, 16 nt, Escherichia coli CFT073
gacaguucaaucuccg

SEQ ID NO: 641437 - RNA, 17 nt, Escherichia coli CFT073
gacagugcgcgguaguu

SEQ ID NO: 641438 - RNA, 17 nt, Escherichia coli CFT073
gacaguuaucaaauuca

SEQ ID NO: 641439 - RNA, 21 nt, Escherichia coli CFT073
gacauaaccgagaauuuccag

SEQ ID NO: 641440 - RNA, 12 nt, Escherichia coli CFT073
gacauauuuuug

SEQ ID NO: 641441 - RNA, 21 nt, Escherichia coli CFT073
gacaucaaaauuaccuuuaca

SEQ ID NO: 641442 - RNA, 16 nt, Escherichia coli CFT073
gacaucaaacaggcug

SEQ ID NO: 641443 - RNA, 13 nt, Escherichia coli CFT073
gacaucaaagaaa

SEQ ID NO: 641444 - RNA, 14 nt, Escherichia coli CFT073
gacaucaacagaag

SEQ ID NO: 641445 - RNA, 17 nt, Escherichia coli CFT073
gacaucaacgaugccuu

SEQ ID NO: 641446 - RNA, 13 nt, Escherichia coli CFT073
gacaucaagaaau

SEQ ID NO: 641447 - RNA, 16 nt, Escherichia coli CFT073
gacaucaagaaaugca

SEQ ID NO: 641448 - RNA, 16 nt, Escherichia coli CFT073
gacauauaaccggcaa

SEQ ID NO: 641449 - RNA, 13 nt, Escherichia coli CFT073
gacauacuuaaau

SEQ ID NO: 641450 - RNA, 23 nt, Escherichia coli CFT073
gacauaguacuggaagaaaacau

SEQ ID NO: 641451 - RNA, 16 nt, Escherichia coli CFT073
gacauacagcaccgcc

SEQ ID NO: 641452 - RNA, 22 nt, Escherichia coli CFT073
gacauuaucaccgacaaacagc

SEQ ID NO: 641453 - RNA, 14 nt, Escherichia coli CFT073
gacaugugcgacag

SEQ ID NO: 641454 - RNA, 14 nt, Escherichia coli CFT073
gacauguugcuuaa

SEQ ID NO: 641455 - RNA, 18 nt, Escherichia coli CFT073
gacauguuuuuauuaaag

SEQ ID NO: 641456 - RNA, 15 nt, Escherichia coli CFT073
gacauugaugaaaag

SEQ ID NO: 641457 - RNA, 16 nt, Escherichia coli CFT073
gacauuggcaaaacca

SEQ ID NO: 641458 - RNA, 19 nt, Escherichia coli CFT073
gacauucaacauauccagc

SEQ ID NO: 641459 - RNA, 19 nt, Escherichia coli CFT073
gacauucgcgcacggugca

SEQ ID NO: 641460 - RNA, 23 nt, Escherichia coli CFT073
gacaucgccacggcaugaaagcg

SEQ ID NO: 641461 - RNA, 16 nt, Escherichia coli CFT073
gacauccgccagcgcc

SEQ ID NO: 641462 - RNA, 15 nt, Escherichia coli CFT073
gacaucgacguggug

SEQ ID NO: 641463 - RNA, 14 nt, Escherichia coli CFT073
gacauccaugcacu

SEQ ID NO: 641464 - RNA, 18 nt, Escherichia coli CFT073
gacaucacucacgacaca

SEQ ID NO: 641465 - RNA, 12 nt, Escherichia coli CFT073
gacaucaucgcc

SEQ ID NO: 641466 - RNA, 21 nt, Escherichia coli CFT073
gacaucaucgugaccaaagca

SEQ ID NO: 641467 - RNA, 17 nt, Escherichia coli CFT073
gacaucgucaggggcau

SEQ ID NO: 641468 - RNA, 13 nt, Escherichia coli CFT073
gacaucucuucuu

SEQ ID NO: 641469 - RNA, 22 nt, Escherichia coli CFT073
gacaucuuucugcgcaucuucc

SEQ ID NO: 641470 - RNA, 20 nt, Escherichia coli CFT073
gacaugaccacaaagcagac

SEQ ID NO: 641471 - RNA, 22 nt, Escherichia coli CFT073
gaccaagaugcgcguaguacuu

SEQ ID NO: 641472 - RNA, 18 nt, Escherichia coli CFT073
gaccaacacccacagcca

SEQ ID NO: 641473 - RNA, 21 nt, Escherichia coli CFT073
gaccaaccgucagauccgcca

SEQ ID NO: 641474 - RNA, 22 nt, Escherichia coli CFT073
gacauuuuuaugaugcacuuca

SEQ ID NO: 641475 - RNA, 16 nt, Escherichia coli CFT073
gaccaaagaaugacac

SEQ ID NO: 641476 - RNA, 18 nt, Escherichia coli CFT073
gaccaaacuuauccgcca

SEQ ID NO: 641477 - RNA, 13 nt, Escherichia coli CFT073
gaccaccagcacg

SEQ ID NO: 641478 - RNA, 17 nt, Escherichia coli CFT073
gaccaccacccuguggg

SEQ ID NO: 641479 - RNA, 21 nt, Escherichia coli CFT073
gaccacaaauaccccaccgcc

SEQ ID NO: 641480 - RNA, 20 nt, Escherichia coli CFT073
gaccacaaucaacgccacca

SEQ ID NO: 641481 - RNA, 16 nt, Escherichia coli CFT073
gaccacacaaagugcg

SEQ ID NO: 641482 - RNA, 13 nt, Escherichia coli CFT073
gaccaauccgcca

SEQ ID NO: 641483 - RNA, 14 nt, Escherichia coli CFT073
gaccaaugcccaaa

SEQ ID NO: 641484 - RNA, 21 nt, Escherichia coli CFT073
gaccacccaccgcagcccaga

SEQ ID NO: 641485 - RNA, 13 nt, Escherichia coli CFT073
gaccaccgcgcua

SEQ ID NO: 641486 - RNA, 20 nt, Escherichia coli CFT073
gaccacgcugcgcugcacca

SEQ ID NO: 641487 - RNA, 22 nt, Escherichia coli CFT073
gaccacgcugcgcugcaccagu

SEQ ID NO: 641488 - RNA, 14 nt, Escherichia coli CFT073
gaccacuaacacuu

SEQ ID NO: 641489 - RNA, 15 nt, Escherichia coli CFT073
gaccacuucaugccc

SEQ ID NO: 641490 - RNA, 17 nt, Escherichia coli CFT073
gaccagaaacgccacca

SEQ ID NO: 641491 - RNA, 13 nt, Escherichia coli CFT073
gaccagaccggca

SEQ ID NO: 641492 - RNA, 22 nt, Escherichia coli CFT073
gaccagaccggcaaucgcgcca

SEQ ID NO: 641493 - RNA, 18 nt, Escherichia coli CFT073
gaccaguggcgggacaga

SEQ ID NO: 641494 - RNA, 23 nt, Escherichia coli CFT073
gaccaguggcgggacagaaagug

SEQ ID NO: 641495 - RNA, 13 nt, Escherichia coli CFT073
gaccaguaccacc

SEQ ID NO: 641496 - RNA, 17 nt, Escherichia coli CFT073
gaccagugcagauacca

SEQ ID NO: 641497 - RNA, 16 nt, Escherichia coli CFT073
gaccagggauaaagcu

SEQ ID NO: 641498 - RNA, 20 nt, Escherichia coli CFT073
gaccaggccaucagcagcgg

SEQ ID NO: 641499 - RNA, 15 nt, Escherichia coli CFT073
gaccaggccaucagc

SEQ ID NO: 641500 - RNA, 16 nt, Escherichia coli CFT073
gaccaggccaucagca

SEQ ID NO: 641501 - RNA, 19 nt, Escherichia coli CFT073
gaccaggccaucagcagcg

SEQ ID NO: 641502 - RNA, 16 nt, Escherichia coli CFT073
gaccaggaaacccaac

SEQ ID NO: 641503 - RNA, 19 nt, Escherichia coli CFT073
gaccagcacgguggcuggc

SEQ ID NO: 641504 - RNA, 23 nt, Escherichia coli CFT073
gaccagcaauaacuaagauaauc

SEQ ID NO: 641505 - RNA, 17 nt, Escherichia coli CFT073
gaccagcaccgccagca

SEQ ID NO: 641506 - RNA, 19 nt, Escherichia coli CFT073
gaccagcgucguauccagc

SEQ ID NO: 641507 - RNA, 16 nt, Escherichia coli CFT073
gaccagcgaaaccuga

SEQ ID NO: 641508 - RNA, 18 nt, Escherichia coli CFT073
gacaaacgccggauggca

SEQ ID NO: 641509 - RNA, 14 nt, Escherichia coli CFT073
gacaaaauccccuu

SEQ ID NO: 641510 - RNA, 17 nt, Escherichia coli CFT073
gacaaacagcgagaaca

SEQ ID NO: 641511 - RNA, 18 nt, Escherichia coli CFT073
gacaaaccagguaucguu

SEQ ID NO: 641512 - RNA, 23 nt, Escherichia coli CFT073
gacaaaucuuucacuuuugccag

SEQ ID NO: 641513 - RNA, 19 nt, Escherichia coli CFT073
gacaaaucauacaggcgga

SEQ ID NO: 641514 - RNA, 13 nt, Escherichia coli CFT073
gacaacaacauca

SEQ ID NO: 641515 - RNA, 14 nt, Escherichia coli CFT073
gacaaauguugcau

SEQ ID NO: 641516 - RNA, 21 nt, Escherichia coli CFT073
gaauuugucgauuuccaucuc

SEQ ID NO: 641517 - RNA, 14 nt, Escherichia coli CFT073
cuuuguaaccugcu

SEQ ID NO: 641518 - RNA, 15 nt, Escherichia coli CFT073
gaauuuuaauauguu

SEQ ID NO: 641519 - RNA, 14 nt, Escherichia coli CFT073
gacaaaaauaccac

SEQ ID NO: 641520 - RNA, 15 nt, Escherichia coli CFT073
gacaaaaauaccacc

SEQ ID NO: 641521 - RNA, 19 nt, Escherichia coli CFT073
gacaaaacuuuuaucaauu

SEQ ID NO: 641522 - RNA, 20 nt, Escherichia coli CFT073
gacaagcguaauuauucccg

SEQ ID NO: 641523 - RNA, 14 nt, Escherichia coli CFT073
gacaagcucucuuc

SEQ ID NO: 641524 - RNA, 18 nt, Escherichia coli CFT073
gacaacucauuccccgga

SEQ ID NO: 641525 - RNA, 20 nt, Escherichia coli CFT073
gacaacuuuugcaggaagcu

SEQ ID NO: 641526 - RNA, 14 nt, Escherichia coli CFT073
gacaacguuuucaa

SEQ ID NO: 641527 - RNA, 18 nt, Escherichia coli CFT073
gacaacgaucgacaaaac

SEQ ID NO: 641528 - RNA, 21 nt, Escherichia coli CFT073
gacaaccugaccuuuuuucag

SEQ ID NO: 641529 - RNA, 21 nt, Escherichia coli CFT073
gacaacaccgauagaaccaaa

SEQ ID NO: 641530 - RNA, 11 nt, Escherichia coli CFT073
gacaacaguca

SEQ ID NO: 641531 - RNA, 17 nt, Escherichia coli CFT073
gacaacagucaaccgcc

SEQ ID NO: 641532 - RNA, 16 nt, Escherichia coli CFT073
gacaauuacucgccuu

SEQ ID NO: 641533 - RNA, 15 nt, Escherichia coli CFT073
gacaauuaaacuuua

SEQ ID NO: 641534 - RNA, 17 nt, Escherichia coli CFT073
gacaauguaucuuucau

SEQ ID NO: 641535 - RNA, 20 nt, Escherichia coli CFT073
gacaaucgccagugauugcu

SEQ ID NO: 641536 - RNA, 17 nt, Escherichia coli CFT073
gacaaucaccaggucac

SEQ ID NO: 641537 - RNA, 23 nt, Escherichia coli CFT073
gacaaucaccaggucaccagaca

SEQ ID NO: 641538 - RNA, 13 nt, Escherichia coli CFT073
gacaaucaucgcc

SEQ ID NO: 641539 - RNA, 16 nt, Escherichia coli CFT073
gacaauccagcgaaau

SEQ ID NO: 641540 - RNA, 22 nt, Escherichia coli CFT073
gacaauccagcgaaauaaaagu

SEQ ID NO: 641541 - RNA, 19 nt, Escherichia coli CFT073
gacaauccuucccugcagu

SEQ ID NO: 641542 - RNA, 16 nt, Escherichia coli CFT073
gacaauaauaucuuuc

SEQ ID NO: 641543 - RNA, 21 nt, Escherichia coli CFT073
gacaauaauucccagcaccgc

SEQ ID NO: 641544 - RNA, 23 nt, Escherichia coli CFT073
gacaauaauucccagcaccgcag

SEQ ID NO: 641545 - RNA, 15 nt, Escherichia coli CFT073
gacaagguaguagaa

SEQ ID NO: 641546 - RNA, 16 nt, Escherichia coli CFT073
gacaagguaguagaaa

SEQ ID NO: 641547 - RNA, 13 nt, Escherichia coli CFT073
gacaauaaacagc

SEQ ID NO: 641548 - RNA, 19 nt, Escherichia coli CFT073
gacagaccaaaacgugcag

SEQ ID NO: 641549 - RNA, 21 nt, Escherichia coli CFT073
gacagaaaucagaguuugcca

SEQ ID NO: 641550 - RNA, 13 nt, Escherichia coli CFT073
gacagaacccggc

SEQ ID NO: 641551 - RNA, 23 nt, Escherichia coli CFT073
gacacuggaaacagccaaucaua

SEQ ID NO: 641552 - RNA, 18 nt, Escherichia coli CFT073
gacacuggcagugugccu

SEQ ID NO: 641553 - RNA, 22 nt, Escherichia coli CFT073
gacacugugccgguaacugcuu

SEQ ID NO: 641554 - RNA, 22 nt, Escherichia coli CFT073
gacacugccacuuuuucccugu

SEQ ID NO: 641555 - RNA, 15 nt, Escherichia coli CFT073
gacagauuuauaaaa

SEQ ID NO: 641556 - RNA, 17 nt, Escherichia coli CFT073
gacagauuuauaaaauc

SEQ ID NO: 641557 - RNA, 22 nt, Escherichia coli CFT073
gacagauuuauaaaauccaacu

SEQ ID NO: 641558 - RNA, 15 nt, Escherichia coli CFT073
gacagcaggaaaaug

SEQ ID NO: 641559 - RNA, 23 nt, Escherichia coli CFT073
gacagcaccacuggcgauauugc

SEQ ID NO: 641560 - RNA, 15 nt, Escherichia coli CFT073
gacagccucaagcac

SEQ ID NO: 641561 - RNA, 19 nt, Escherichia coli CFT073
gacagcgauuaccauuuca

SEQ ID NO: 641562 - RNA, 15 nt, Escherichia coli CFT073
gacagcgauuccagu

SEQ ID NO: 641563 - RNA, 17 nt, Escherichia coli CFT073
gacagccccugugccag

SEQ ID NO: 641564 - RNA, 20 nt, Escherichia coli CFT073
gacagcccggcauguuucaa

SEQ ID NO: 641565 - RNA, 17 nt, Escherichia coli CFT073
gacagccccaccagcaa

SEQ ID NO: 641566 - RNA, 18 nt, Escherichia coli CFT073
gacagccccaccagcaaa

SEQ ID NO: 641567 - RNA, 20 nt, Escherichia coli CFT073
gacagccccaccagcaaaua

SEQ ID NO: 641568 - RNA, 21 nt, Escherichia coli CFT073
gacagccauaaagaaaucacc

SEQ ID NO: 641569 - RNA, 14 nt, Escherichia coli CFT073
gacagccaucccca

SEQ ID NO: 641570 - RNA, 20 nt, Escherichia coli CFT073
gacagcgugagcagggugaa

SEQ ID NO: 641571 - RNA, 21 nt, Escherichia coli CFT073
gacagcuuagacaacgccgcu

SEQ ID NO: 641572 - RNA, 12 nt, Escherichia coli CFT073
gacaccaaacag

SEQ ID NO: 641573 - RNA, 16 nt, Escherichia coli CFT073
gacaccagcacaucau

SEQ ID NO: 641574 - RNA, 22 nt, Escherichia coli CFT073
gacaccagccagacucagcaac

SEQ ID NO: 641575 - RNA, 13 nt, Escherichia coli CFT073
gacacaaugccau

SEQ ID NO: 641576 - RNA, 14 nt, Escherichia coli CFT073
gacacaggcagcaa

SEQ ID NO: 641577 - RNA, 19 nt, Escherichia coli CFT073
gacacaggcagcaaucacu

SEQ ID NO: 641578 - RNA, 19 nt, Escherichia coli CFT073
gacacaguucuucaaaaau

SEQ ID NO: 641579 - RNA, 15 nt, Escherichia coli CFT073
gacacauaaauaaca

SEQ ID NO: 641580 - RNA, 14 nt, Escherichia coli CFT073
gacacaucagcaac

SEQ ID NO: 641581 - RNA, 15 nt, Escherichia coli CFT073
gacacaucuaaugcu

SEQ ID NO: 641582 - RNA, 13 nt, Escherichia coli CFT073
gacacgcaucacg

SEQ ID NO: 641583 - RNA, 23 nt, Escherichia coli CFT073
gacaccuguaaguuacuaaaagu

SEQ ID NO: 641584 - RNA, 18 nt, Escherichia coli CFT073
gacaccggcuuucaccug

SEQ ID NO: 641585 - RNA, 18 nt, Escherichia coli CFT073
gacaccgcugcuucucuu

SEQ ID NO: 641586 - RNA, 19 nt, Escherichia coli CFT073
gacaccgcuguugcuucca

SEQ ID NO: 641587 - RNA, 15 nt, Escherichia coli CFT073
gacaccggcagagau

SEQ ID NO: 641588 - RNA, 13 nt, Escherichia coli CFT073
gacgcauccggca

SEQ ID NO: 641589 - RNA, 17 nt, Escherichia coli CFT073
gacgcaucgcccagcca

SEQ ID NO: 641590 - RNA, 19 nt, Escherichia coli CFT073
gacgcaucuguaugucagu

SEQ ID NO: 641591 - RNA, 18 nt, Escherichia coli CFT073
gacgcaucuuauccagcc

SEQ ID NO: 641592 - RNA, 18 nt, Escherichia coli CFT073
gacgcagguugugcuggg

SEQ ID NO: 641593 - RNA, 20 nt, Escherichia coli CFT073
gacgccacaacgauaaucca

SEQ ID NO: 641594 - RNA, 20 nt, Escherichia coli CFT073
gacgccacuaucugauaauc

SEQ ID NO: 641595 - RNA, 12 nt, Escherichia coli CFT073
gacgccagaacc

SEQ ID NO: 641596 - RNA, 19 nt, Escherichia coli CFT073
gacgcccugcgcgggugaa

SEQ ID NO: 641597 - RNA, 21 nt, Escherichia coli CFT073
gacgccccugcgcucguucuu

SEQ ID NO: 641598 - RNA, 14 nt, Escherichia coli CFT073
gacgcgauccgccg

SEQ ID NO: 641599 - RNA, 13 nt, Escherichia coli CFT073
gacgcgaagcaca

SEQ ID NO: 641600 - RNA, 15 nt, Escherichia coli CFT073
gacgcgccagcagcg

SEQ ID NO: 641601 - RNA, 15 nt, Escherichia coli CFT073
gacgcgcuuguccug

SEQ ID NO: 641602 - RNA, 17 nt, Escherichia coli CFT073
gacgccugcagcaucgg

SEQ ID NO: 641603 - RNA, 17 nt, Escherichia coli CFT073
gacgccugccagcucuu

SEQ ID NO: 641604 - RNA, 21 nt, Escherichia coli CFT073
gacgccgcuggugucgcaccu

SEQ ID NO: 641605 - RNA, 21 nt, Escherichia coli CFT073
gacggccucugcggaggccgu

SEQ ID NO: 641606 - RNA, 12 nt, Escherichia coli CFT073
gacggcgagcgu

SEQ ID NO: 641607 - RNA, 15 nt, Escherichia coli CFT073
gacggcgagcguucg

SEQ ID NO: 641608 - RNA, 21 nt, Escherichia coli CFT073
gacggccccgcgccagcgggc

SEQ ID NO: 641609 - RNA, 15 nt, Escherichia coli CFT073
gacggccaucccagu

SEQ ID NO: 641610 - RNA, 18 nt, Escherichia coli CFT073
gacgcugaauaaucccca

SEQ ID NO: 641611 - RNA, 14 nt, Escherichia coli CFT073
gacgcuccgcacuu

SEQ ID NO: 641612 - RNA, 15 nt, Escherichia coli CFT073
gacgcgggccacaua

SEQ ID NO: 641613 - RNA, 16 nt, Escherichia coli CFT073
gacgcguaaauccagc

SEQ ID NO: 641614 - RNA, 17 nt, Escherichia coli CFT073
gacgauaggucauauca

SEQ ID NO: 641615 - RNA, 15 nt, Escherichia coli CFT073
gacgaucaacccagu

SEQ ID NO: 641616 - RNA, 13 nt, Escherichia coli CFT073
gacgaggcgcugg

SEQ ID NO: 641617 - RNA, 16 nt, Escherichia coli CFT073
gacgaucgcugaugaa

SEQ ID NO: 641618 - RNA, 13 nt, Escherichia coli CFT073
gacgaucgcgcag

SEQ ID NO: 641619 - RNA, 14 nt, Escherichia coli CFT073
gacgaucgccacuu

SEQ ID NO: 641620 - RNA, 18 nt, Escherichia coli CFT073
gacgaguccuuccuggcu

SEQ ID NO: 641621 - RNA, 19 nt, Escherichia coli CFT073
gacgaggauuucgccgccc

SEQ ID NO: 641622 - RNA, 17 nt, Escherichia coli CFT073
gacgauuuucccugagu

SEQ ID NO: 641623 - RNA, 22 nt, Escherichia coli CFT073
gacgauuccggcaaauaacaga

SEQ ID NO: 641624 - RNA, 22 nt, Escherichia coli CFT073
gacgauuguagaaaaucucaau

SEQ ID NO: 641625 - RNA, 21 nt, Escherichia coli CFT073
gacgcaggcgcgcuguggugu

SEQ ID NO: 641626 - RNA, 15 nt, Escherichia coli CFT073
gacgacaggcaagca

SEQ ID NO: 641627 - RNA, 18 nt, Escherichia coli CFT073
gacgaauaccuucuuccu

SEQ ID NO: 641628 - RNA, 17 nt, Escherichia coli CFT073
gacgaccgccgcucacc

SEQ ID NO: 641629 - RNA, 15 nt, Escherichia coli CFT073
gacgacgguuuccac

SEQ ID NO: 641630 - RNA, 13 nt, Escherichia coli CFT073
gaccuuuuuucag

SEQ ID NO: 641631 - RNA, 23 nt, Escherichia coli CFT073
gacgaaaacucgcuaaccacugu

SEQ ID NO: 641632 - RNA, 19 nt, Escherichia coli CFT073
gaccuucauagguaaacau

SEQ ID NO: 641633 - RNA, 17 nt, Escherichia coli CFT073
gaccuucuucagcaaua

SEQ ID NO: 641634 - RNA, 14 nt, Escherichia coli CFT073
gaccuugccaaggu

SEQ ID NO: 641635 - RNA, 17 nt, Escherichia coli CFT073
gacccagcgccagcaua

SEQ ID NO: 641636 - RNA, 20 nt, Escherichia coli CFT073
gacccagcaccaguaccauu

SEQ ID NO: 641637 - RNA, 20 nt, Escherichia coli CFT073
gacccagcgcgaucgcgcca

SEQ ID NO: 641638 - RNA, 14 nt, Escherichia coli CFT073
gacccaucuuguca

SEQ ID NO: 641639 - RNA, 23 nt, Escherichia coli CFT073
gaccaguuguaaucugcaccagg

SEQ ID NO: 641640 - RNA, 22 nt, Escherichia coli CFT073
gaccauaaaugcgcucgaucag

SEQ ID NO: 641641 - RNA, 13 nt, Escherichia coli CFT073
gaccauaaugaug

SEQ ID NO: 641642 - RNA, 13 nt, Escherichia coli CFT073
gaccauacuggcg

SEQ ID NO: 641643 - RNA, 20 nt, Escherichia coli CFT073
gaccaucggcacgaccagga

SEQ ID NO: 641644 - RNA, 21 nt, Escherichia coli CFT073
gaccaucagcaugacaaaaaa

SEQ ID NO: 641645 - RNA, 14 nt, Escherichia coli CFT073
gaccgacaccggca

SEQ ID NO: 641646 - RNA, 23 nt, Escherichia coli CFT073
gaccgaauccuuauauaaaacac

SEQ ID NO: 641647 - RNA, 15 nt, Escherichia coli CFT073
gaccgauaaccugcc

SEQ ID NO: 641648 - RNA, 13 nt, Escherichia coli CFT073
gaccgccagcgcc

SEQ ID NO: 641649 - RNA, 12 nt, Escherichia coli CFT073
gaccgcaugcag

SEQ ID NO: 641650 - RNA, 15 nt, Escherichia coli CFT073
gacccgcagccagca

SEQ ID NO: 641651 - RNA, 21 nt, Escherichia coli CFT073
gacccggcaagccuaccggca

SEQ ID NO: 641652 - RNA, 18 nt, Escherichia coli CFT073
gaccucacgguuuugcuc

SEQ ID NO: 641653 - RNA, 14 nt, Escherichia coli CFT073
gaccuagcaaacua

SEQ ID NO: 641654 - RNA, 22 nt, Escherichia coli CFT073
gaccucgcuauuuacaucgcga

SEQ ID NO: 641655 - RNA, 24 nt, Escherichia coli CFT073
gaccguugauuuuguuggcauggu

SEQ ID NO: 641656 - RNA, 17 nt, Escherichia coli CFT073
gaccgucuuuauccagc

SEQ ID NO: 641657 - RNA, 23 nt, Escherichia coli CFT073
gaccucuuaaugcaggcagcacu

SEQ ID NO: 641658 - RNA, 18 nt, Escherichia coli CFT073
gaccugacuguuccagua

SEQ ID NO: 641659 - RNA, 18 nt, Escherichia coli CFT073
gaccugucgcagauauug

SEQ ID NO: 641660 - RNA, 18 nt, Escherichia coli CFT073
gaccuguugcccaugcuu

SEQ ID NO: 641661 - RNA, 14 nt, Escherichia coli CFT073
gaccuggucgcugg

SEQ ID NO: 641662 - RNA, 21 nt, Escherichia coli CFT073
gaccugugccgccgcccggca

SEQ ID NO: 641663 - RNA, 16 nt, Escherichia coli CFT073
gaccuggcgcuucacu

SEQ ID NO: 641664 - RNA, 18 nt, Escherichia coli CFT073
gaccgcgggacaaauaau

SEQ ID NO: 641665 - RNA, 15 nt, Escherichia coli CFT073
gaccgcuucaggaac

SEQ ID NO: 641666 - RNA, 18 nt, Escherichia coli CFT073
gaccgcuucaggaacugc

SEQ ID NO: 641667 - RNA, 18 nt, Escherichia coli CFT073
gaccgcuguuaugcacac

SEQ ID NO: 641668 - RNA, 17 nt, Escherichia coli CFT073
gaccgcuuuuugauaag

SEQ ID NO: 641669 - RNA, 15 nt, Escherichia coli CFT073
gaccgggauuuucaa

SEQ ID NO: 641670 - RNA, 18 nt, Escherichia coli CFT073
gaccgguccacuuccugc

SEQ ID NO: 641671 - RNA, 18 nt, Escherichia coli CFT073
gaccguacaaccaaaucu

SEQ ID NO: 641672 - RNA, 17 nt, Escherichia coli CFT073
gagagacauuggcaaaa

SEQ ID NO: 641673 - RNA, 19 nt, Escherichia coli CFT073
gagagacauuggcaaaacc

SEQ ID NO: 641674 - RNA, 20 nt, Escherichia coli CFT073
gagagaagcgcguucauccc

SEQ ID NO: 641675 - RNA, 13 nt, Escherichia coli CFT073
gagagagaaaaua

SEQ ID NO: 641676 - RNA, 18 nt, Escherichia coli CFT073
gagagaauuaaccagaaa

SEQ ID NO: 641677 - RNA, 18 nt, Escherichia coli CFT073
gagagcaaccagcaaugc

SEQ ID NO: 641678 - RNA, 15 nt, Escherichia coli CFT073
gagagccccagccgc

SEQ ID NO: 641679 - RNA, 22 nt, Escherichia coli CFT073
gagaggcugaaggcgcuccccu

SEQ ID NO: 641680 - RNA, 17 nt, Escherichia coli CFT073
gagaggguuagggugag

SEQ ID NO: 641681 - RNA, 19 nt, Escherichia coli CFT073
gagaggguuagggugaggg

SEQ ID NO: 641682 - RNA, 11 nt, Escherichia coli CFT073
gagagccuucg

SEQ ID NO: 641683 - RNA, 19 nt, Escherichia coli CFT073
gagacucaccaaucggcag

SEQ ID NO: 641684 - RNA, 19 nt, Escherichia coli CFT073
gagacgguauuacccggcc

SEQ ID NO: 641685 - RNA, 20 nt, Escherichia coli CFT073
gagacgguauuacccggccc

SEQ ID NO: 641686 - RNA, 16 nt, Escherichia coli CFT073
gagaauuccggcagag

SEQ ID NO: 641687 - RNA, 18 nt, Escherichia coli CFT073
gagaaucgacaccaguuc

SEQ ID NO: 641688 - RNA, 14 nt, Escherichia coli CFT073
gagaaugccagcag

SEQ ID NO: 641689 - RNA, 16 nt, Escherichia coli CFT073
gagaaugccagcagca

SEQ ID NO: 641690 - RNA, 18 nt, Escherichia coli CFT073
gagaaucaacacaccgcc

SEQ ID NO: 641691 - RNA, 16 nt, Escherichia coli CFT073
gagaaucaguuuuuuc

SEQ ID NO: 641692 - RNA, 20 nt, Escherichia coli CFT073
gagacauuggcaaaaccaaa

SEQ ID NO: 641693 - RNA, 19 nt, Escherichia coli CFT073
gagacacugcgaucgcccg

SEQ ID NO: 641694 - RNA, 13 nt, Escherichia coli CFT073
gagaagcaccgcc

SEQ ID NO: 641695 - RNA, 19 nt, Escherichia coli CFT073
gagaagcauccugcacuuc

SEQ ID NO: 641696 - RNA, 23 nt, Escherichia coli CFT073
gagaagcauccugcacuucaaau

SEQ ID NO: 641697 - RNA, 17 nt, Escherichia coli CFT073
gagaagcugcugccgcu

SEQ ID NO: 641698 - RNA, 16 nt, Escherichia coli CFT073
gagaaggcguucacgc

SEQ ID NO: 641699 - RNA, 14 nt, Escherichia coli CFT073
gagaauagcgccau

SEQ ID NO: 641700 - RNA, 21 nt, Escherichia coli CFT073
gagaauaaaacaagcagcugc

SEQ ID NO: 641701 - RNA, 24 nt, Escherichia coli CFT073
gagaauaaaacaagcagcugccag

SEQ ID NO: 641702 - RNA, 18 nt, Escherichia coli CFT073
gagaagguugccauaucu

SEQ ID NO: 641703 - RNA, 17 nt, Escherichia coli CFT073
gagaacggcgcaccaga

SEQ ID NO: 641704 - RNA, 18 nt, Escherichia coli CFT073
gagaacgucgcagggaga

SEQ ID NO: 641705 - RNA, 12 nt, Escherichia coli CFT073
gagaacugcugc

SEQ ID NO: 641706 - RNA, 13 nt, Escherichia coli CFT073
gagaagauccaug

SEQ ID NO: 641707 - RNA, 15 nt, Escherichia coli CFT073
gagaagaccgccgcu

SEQ ID NO: 641708 - RNA, 21 nt, Escherichia coli CFT073
gacuuucaaacgccacagcaa

SEQ ID NO: 641709 - RNA, 20 nt, Escherichia coli CFT073
gacuuuacccggccacagaa

SEQ ID NO: 641710 - RNA, 22 nt, Escherichia coli CFT073
gacuuuacuaauagcaaaauau

SEQ ID NO: 641711 - RNA, 22 nt, Escherichia coli CFT073
gacuugugcgcuuguucauaau

SEQ ID NO: 641712 - RNA, 12 nt, Escherichia coli CFT073
gacuuuucagau

SEQ ID NO: 641713 - RNA, 15 nt, Escherichia coli CFT073
gacuuuugcccggca

SEQ ID NO: 641714 - RNA, 17 nt, Escherichia coli CFT073
gacuuuugcccggcaug

SEQ ID NO: 641715 - RNA, 15 nt, Escherichia coli CFT073
gacuuucuuuucccu

SEQ ID NO: 641716 - RNA, 20 nt, Escherichia coli CFT073
gacuuucuccgcauccggcg

SEQ ID NO: 641717 - RNA, 19 nt, Escherichia coli CFT073
gagaaacauccgguuucau

SEQ ID NO: 641718 - RNA, 18 nt, Escherichia coli CFT073
gagaaaccacaucaaucc

SEQ ID NO: 641719 - RNA, 15 nt, Escherichia coli CFT073
gagaaagagugcgcc

SEQ ID NO: 641720 - RNA, 16 nt, Escherichia coli CFT073
gagaaagcaaaaauaa

SEQ ID NO: 641721 - RNA, 22 nt, Escherichia coli CFT073
gagaaaauguauuucaucauca

SEQ ID NO: 641722 - RNA, 21 nt, Escherichia coli CFT073
gagaaauauaaagaaugaaau

SEQ ID NO: 641723 - RNA, 23 nt, Escherichia coli CFT073
gagaaauauaaagaaugaaauuc

SEQ ID NO: 641724 - RNA, 23 nt, Escherichia coli CFT073
gagaaauccggggcaauuucagu

SEQ ID NO: 641725 - RNA, 19 nt, Escherichia coli CFT073
gagaacaagauugccugau

SEQ ID NO: 641726 - RNA, 11 nt, Escherichia coli CFT073
gagaacagaua

SEQ ID NO: 641727 - RNA, 14 nt, Escherichia coli CFT073
gacuuauucuucaa

SEQ ID NO: 641728 - RNA, 16 nt, Escherichia coli CFT073
gacuucagccagugcu

SEQ ID NO: 641729 - RNA, 18 nt, Escherichia coli CFT073
gacuucaguggaaucauc

SEQ ID NO: 641730 - RNA, 20 nt, Escherichia coli CFT073
gacuucaucggaaugcacag

SEQ ID NO: 641731 - RNA, 21 nt, Escherichia coli CFT073
gacuuccugcaaucuuuccug

SEQ ID NO: 641732 - RNA, 22 nt, Escherichia coli CFT073
gacuuccugcaaucuuuccugc

SEQ ID NO: 641733 - RNA, 18 nt, Escherichia coli CFT073
gacuuccugccucuuugc

SEQ ID NO: 641734 - RNA, 16 nt, Escherichia coli CFT073
gacuuccaccagcggc

SEQ ID NO: 641735 - RNA, 22 nt, Escherichia coli CFT073
gacuucauucagaaaaacuaca

SEQ ID NO: 641736 - RNA, 12 nt, Escherichia coli CFT073
gacuucccuccc

SEQ ID NO: 641737 - RNA, 18 nt, Escherichia coli CFT073
gacugugauuguuuaaaa

SEQ ID NO: 641738 - RNA, 23 nt, Escherichia coli CFT073
gacugugauuguuuaaaaauaca

SEQ ID NO: 641739 - RNA, 14 nt, Escherichia coli CFT073
gacuguucaccacu

SEQ ID NO: 641740 - RNA, 23 nt, Escherichia coli CFT073
gacuguucauuuuguaggccuga

SEQ ID NO: 641741 - RNA, 15 nt, Escherichia coli CFT073
gacuguugaaauaca

SEQ ID NO: 641742 - RNA, 18 nt, Escherichia coli CFT073
gacuuacuuccugucuuc

SEQ ID NO: 641743 - RNA, 13 nt, Escherichia coli CFT073
gacuguaaaucug

SEQ ID NO: 641744 - RNA, 15 nt, Escherichia coli CFT073
gacuguaagccauca

SEQ ID NO: 641745 - RNA, 17 nt, Escherichia coli CFT073
gacugggccuuucgcuu

SEQ ID NO: 641746 - RNA, 18 nt, Escherichia coli CFT073
gacucuguagcgggaaag

SEQ ID NO: 641747 - RNA, 21 nt, Escherichia coli CFT073
gacucuguuaugguacuuucu

SEQ ID NO: 641748 - RNA, 18 nt, Escherichia coli CFT073
gacucuguggcgggaaag

SEQ ID NO: 641749 - RNA, 19 nt, Escherichia coli CFT073
gacucucgccagagaucgc

SEQ ID NO: 641750 - RNA, 14 nt, Escherichia coli CFT073
gacucugaaacucg

SEQ ID NO: 641751 - RNA, 19 nt, Escherichia coli CFT073
gacugaaaggucaucauca

SEQ ID NO: 641752 - RNA, 16 nt, Escherichia coli CFT073
gacugaauugccagca

SEQ ID NO: 641753 - RNA, 23 nt, Escherichia coli CFT073
gacugacgcagcagaccgucgga

SEQ ID NO: 641754 - RNA, 13 nt, Escherichia coli CFT073
gacugacuucaac

SEQ ID NO: 641755 - RNA, 18 nt, Escherichia coli CFT073
gacugaaccagcgccggu

SEQ ID NO: 641756 - RNA, 14 nt, Escherichia coli CFT073
gacugauauccagc

SEQ ID NO: 641757 - RNA, 15 nt, Escherichia coli CFT073
gacugauaucugccc

SEQ ID NO: 641758 - RNA, 17 nt, Escherichia coli CFT073
gacugaucaauaucagc

SEQ ID NO: 641759 - RNA, 17 nt, Escherichia coli CFT073
gacugaugacaaacgca

SEQ ID NO: 641760 - RNA, 14 nt, Escherichia coli CFT073
gacugaugcccugc

SEQ ID NO: 641761 - RNA, 21 nt, Escherichia coli CFT073
gacuggcauugauucgccgcc

SEQ ID NO: 641762 - RNA, 16 nt, Escherichia coli CFT073
gacuggccauggauuc

SEQ ID NO: 641763 - RNA, 17 nt, Escherichia coli CFT073
gacuggccauggauuca

SEQ ID NO: 641764 - RNA, 14 nt, Escherichia coli CFT073
gacugcuuuuucaa

SEQ ID NO: 641765 - RNA, 17 nt, Escherichia coli CFT073
gacugcuuuuucaauuu

SEQ ID NO: 641766 - RNA, 17 nt, Escherichia coli CFT073
gacuggaacaagccaaa

SEQ ID NO: 641767 - RNA, 22 nt, Escherichia coli CFT073
gacuggaacaagccaaauccag

SEQ ID NO: 641768 - RNA, 17 nt, Escherichia coli CFT073
gacuacuuucaugcuca

SEQ ID NO: 641769 - RNA, 15 nt, Escherichia coli CFT073
gacuauuuacagauu

SEQ ID NO: 641770 - RNA, 16 nt, Escherichia coli CFT073
gacuauuucaucagaa

SEQ ID NO: 641771 - RNA, 20 nt, Escherichia coli CFT073
gacuaucuuauaaaggcgcu

SEQ ID NO: 641772 - RNA, 12 nt, Escherichia coli CFT073
gacuauuaauau

SEQ ID NO: 641773 - RNA, 17 nt, Escherichia coli CFT073
gacuauuaauauauauu

SEQ ID NO: 641774 - RNA, 13 nt, Escherichia coli CFT073
gacucagcaacag

SEQ ID NO: 641775 - RNA, 21 nt, Escherichia coli CFT073
gacucacguuacuuaacaccc

SEQ ID NO: 641776 - RNA, 16 nt, Escherichia coli CFT073
gacucaccugauuacc

SEQ ID NO: 641777 - RNA, 22 nt, Escherichia coli CFT073
gacgguuaaaaacagccagcag

SEQ ID NO: 641778 - RNA, 21 nt, Escherichia coli CFT073
gacgguugaucucaucuucca

SEQ ID NO: 641779 - RNA, 16 nt, Escherichia coli CFT073
gacgguuuccaggcag

SEQ ID NO: 641780 - RNA, 17 nt, Escherichia coli CFT073
gacgguuuccaggcagc

SEQ ID NO: 641781 - RNA, 23 nt, Escherichia coli CFT073
gacguagaaaaucaccccgagcg

SEQ ID NO: 641782 - RNA, 22 nt, Escherichia coli CFT073
gacggucgguaaacccggccug

SEQ ID NO: 641783 - RNA, 22 nt, Escherichia coli CFT073
gacgggcgcugguaacaucgcc

SEQ ID NO: 641784 - RNA, 23 nt, Escherichia coli CFT073
gacggcgcucuugcggcauuucg

SEQ ID NO: 641785 - RNA, 15 nt, Escherichia coli CFT073
gacggcuccccgccc

SEQ ID NO: 641786 - RNA, 17 nt, Escherichia coli CFT073
gacguuucaucgcagac

SEQ ID NO: 641787 - RNA, 22 nt, Escherichia coli CFT073
gacguuuuagccauaaacgggc

SEQ ID NO: 641788 - RNA, 20 nt, Escherichia coli CFT073
gacguuuuacagcaacgggc

SEQ ID NO: 641789 - RNA, 14 nt, Escherichia coli CFT073
gacuaacuucugau

SEQ ID NO: 641790 - RNA, 17 nt, Escherichia coli CFT073
gacguuaagaucaaacc

SEQ ID NO: 641791 - RNA, 12 nt, Escherichia coli CFT073
gacguucagcca

SEQ ID NO: 641792 - RNA, 14 nt, Escherichia coli CFT073
gacguucuuccugu

SEQ ID NO: 641793 - RNA, 15 nt, Escherichia coli CFT073
gacguuguccagcuu

SEQ ID NO: 641794 - RNA, 18 nt, Escherichia coli CFT073
gacgucucaaucaccacc

SEQ ID NO: 641795 - RNA, 21 nt, Escherichia coli CFT073
gacgugcacaaacuucuucag

SEQ ID NO: 641796 - RNA, 15 nt, Escherichia coli CFT073
gacgugcccuuucag

SEQ ID NO: 641797 - RNA, 18 nt, Escherichia coli CFT073
gaggaucuccacccgcaa

SEQ ID NO: 641798 - RNA, 16 nt, Escherichia coli CFT073
gaggcaaccagcacgc

SEQ ID NO: 641799 - RNA, 20 nt, Escherichia coli CFT073
gaggccgcggcucaggcgca

SEQ ID NO: 641800 - RNA, 18 nt, Escherichia coli CFT073
gaggccagcggcuuuuua

SEQ ID NO: 641801 - RNA, 21 nt, Escherichia coli CFT073
gaggccgagcuaauaaucauc

SEQ ID NO: 641802 - RNA, 15 nt, Escherichia coli CFT073
gaggaagcugcccuu

SEQ ID NO: 641803 - RNA, 21 nt, Escherichia coli CFT073
gaggaaggcacguacaugcag

SEQ ID NO: 641804 - RNA, 21 nt, Escherichia coli CFT073
gaggaacaauccucccuuacc

SEQ ID NO: 641805 - RNA, 22 nt, Escherichia coli CFT073
gaggaccgaauccuuauauaaa

SEQ ID NO: 641806 - RNA, 14 nt, Escherichia coli CFT073
gagcuuucuuauuc

SEQ ID NO: 641807 - RNA, 23 nt, Escherichia coli CFT073
gagcuuauauacucuaaauaauu

SEQ ID NO: 641808 - RNA, 24 nt, Escherichia coli CFT073
gagcuuauauacucuaaauaauuc

SEQ ID NO: 641809 - RNA, 14 nt, Escherichia coli CFT073
gagcuuauccagca

SEQ ID NO: 641810 - RNA, 22 nt, Escherichia coli CFT073
gagcgauggcgggaucgccgga

SEQ ID NO: 641811 - RNA, 14 nt, Escherichia coli CFT073
gagcgacaaacucc

SEQ ID NO: 641812 - RNA, 17 nt, Escherichia coli CFT073
gagccugaauaaacgcc

SEQ ID NO: 641813 - RNA, 23 nt, Escherichia coli CFT073
gagccuucggggcucguuuuugu

SEQ ID NO: 641814 - RNA, 16 nt, Escherichia coli CFT073
gagcgcguaguucagg

SEQ ID NO: 641815 - RNA, 20 nt, Escherichia coli CFT073
gagcggaaacagcggcugcu

SEQ ID NO: 641816 - RNA, 14 nt, Escherichia coli CFT073
gagcgcgaggugga

SEQ ID NO: 641817 - RNA, 17 nt, Escherichia coli CFT073
gagcgccuuauccggcc

SEQ ID NO: 641818 - RNA, 16 nt, Escherichia coli CFT073
gagcgccagcauggca

SEQ ID NO: 641819 - RNA, 21 nt, Escherichia coli CFT073
gagcuaugaauagucgccagc

SEQ ID NO: 641820 - RNA, 15 nt, Escherichia coli CFT073
gagcuauuuaccagc

SEQ ID NO: 641821 - RNA, 15 nt, Escherichia coli CFT073
gagcuaccggcagga

SEQ ID NO: 641822 - RNA, 12 nt, Escherichia coli CFT073
gagcugagugcg

SEQ ID NO: 641823 - RNA, 15 nt, Escherichia coli CFT073
gagcugagugcgaaa

SEQ ID NO: 641824 - RNA, 21 nt, Escherichia coli CFT073
gagcugcaacuggcggcggcg

SEQ ID NO: 641825 - RNA, 18 nt, Escherichia coli CFT073
gagcugccaguugcgcuu

SEQ ID NO: 641826 - RNA, 16 nt, Escherichia coli CFT073
gagcugcguagacuuc

SEQ ID NO: 641827 - RNA, 18 nt, Escherichia coli CFT073
gagcguuuuaucaggcau

SEQ ID NO: 641828 - RNA, 13 nt, Escherichia coli CFT073
gagcuaaacagag

SEQ ID NO: 641829 - RNA, 13 nt, Escherichia coli CFT073
gagcgguaaucug

SEQ ID NO: 641830 - RNA, 23 nt, Escherichia coli CFT073
gagcgguuccagauauucauaga

SEQ ID NO: 641831 - RNA, 19 nt, Escherichia coli CFT073
gagcgggggcucccaccgc

SEQ ID NO: 641832 - RNA, 15 nt, Escherichia coli CFT073
gagccgauauccgga

SEQ ID NO: 641833 - RNA, 22 nt, Escherichia coli CFT073
gagccgauaaagcgaccaacca

SEQ ID NO: 641834 - RNA, 22 nt, Escherichia coli CFT073
gagcccacuguuugaucugcug

SEQ ID NO: 641835 - RNA, 18 nt, Escherichia coli CFT073
gagcccgcuucgccugcc

SEQ ID NO: 641836 - RNA, 19 nt, Escherichia coli CFT073
gagcccucaagccacuucc

SEQ ID NO: 641837 - RNA, 20 nt, Escherichia coli CFT073
gagccaguacagcccgccgg

SEQ ID NO: 641838 - RNA, 21 nt, Escherichia coli CFT073
gagccaguacagcccgccgga

SEQ ID NO: 641839 - RNA, 20 nt, Escherichia coli CFT073
gagccagcaccgcuggcuca

SEQ ID NO: 641840 - RNA, 18 nt, Escherichia coli CFT073
gagcaucgcccaggcgac

SEQ ID NO: 641841 - RNA, 17 nt, Escherichia coli CFT073
gagcaucacuauacucc

SEQ ID NO: 641842 - RNA, 14 nt, Escherichia coli CFT073
gagcaucgcgagga

SEQ ID NO: 641843 - RNA, 17 nt, Escherichia coli CFT073
gagccaaacgcccagcu

SEQ ID NO: 641844 - RNA, 19 nt, Escherichia coli CFT073
gagcauucccgccaucguu

SEQ ID NO: 641845 - RNA, 22 nt, Escherichia coli CFT073
gagcaguccaagaacuaguagc

SEQ ID NO: 641846 - RNA, 18 nt, Escherichia coli CFT073
gagcaguaauccagcaaa

SEQ ID NO: 641847 - RNA, 23 nt, Escherichia coli CFT073
gagcaguaauccagcaaacuggc

SEQ ID NO: 641848 - RNA, 21 nt, Escherichia coli CFT073
gagcaguagcgucgccagcag

SEQ ID NO: 641849 - RNA, 10 nt, Escherichia coli CFT073
gagcaaugau

SEQ ID NO: 641850 - RNA, 17 nt, Escherichia coli CFT073
gagcaaggccaaauagg

SEQ ID NO: 641851 - RNA, 15 nt, Escherichia coli CFT073
gagcaaguaguccgc

SEQ ID NO: 641852 - RNA, 17 nt, Escherichia coli CFT073
gagcaaggcauaggcuu

SEQ ID NO: 641853 - RNA, 13 nt, Escherichia coli CFT073
gagcaauuuccgg

SEQ ID NO: 641854 - RNA, 22 nt, Escherichia coli CFT073
gagcacauauucuuugccgucu

SEQ ID NO: 641855 - RNA, 15 nt, Escherichia coli CFT073
gagcacaucagcgcc

SEQ ID NO: 641856 - RNA, 21 nt, Escherichia coli CFT073
gagcaaugaucucaauaguuc

SEQ ID NO: 641857 - RNA, 19 nt, Escherichia coli CFT073
gagcaaacaguucugcagc

SEQ ID NO: 641858 - RNA, 17 nt, Escherichia coli CFT073
gagcaaaccacaggccg

SEQ ID NO: 641859 - RNA, 17 nt, Escherichia coli CFT073
gagcacuaacaugacac

SEQ ID NO: 641860 - RNA, 20 nt, Escherichia coli CFT073
gagcacugcgcccgccagca

SEQ ID NO: 641861 - RNA, 14 nt, Escherichia coli CFT073
gagcagcaaaaugg

SEQ ID NO: 641862 - RNA, 13 nt, Escherichia coli CFT073
gagcagcacaaug

SEQ ID NO: 641863 - RNA, 21 nt, Escherichia coli CFT073
gagcagagaaacgccagcagc

SEQ ID NO: 641864 - RNA, 18 nt, Escherichia coli CFT073
gagcacgaccuugccaag

SEQ ID NO: 641865 - RNA, 21 nt, Escherichia coli CFT073
gagcacgaccuugccaagguc

SEQ ID NO: 641866 - RNA, 15 nt, Escherichia coli CFT073
gagauguugcugcuc

SEQ ID NO: 641867 - RNA, 18 nt, Escherichia coli CFT073
gagaugggugugcugacc

SEQ ID NO: 641868 - RNA, 15 nt, Escherichia coli CFT073
gagaugaauuuauaa

SEQ ID NO: 641869 - RNA, 18 nt, Escherichia coli CFT073
gagaugacgccacuggcu

SEQ ID NO: 641870 - RNA, 23 nt, Escherichia coli CFT073
gagaucguuaugcaaaugagaau

SEQ ID NO: 641871 - RNA, 16 nt, Escherichia coli CFT073
gagagucacgcagcau

SEQ ID NO: 641872 - RNA, 20 nt, Escherichia coli CFT073
gagaguuuguuucccccacu

SEQ ID NO: 641873 - RNA, 18 nt, Escherichia coli CFT073
gagaguuagcguccggcu

SEQ ID NO: 641874 - RNA, 18 nt, Escherichia coli CFT073
gagaguguuuuaucugug

SEQ ID NO: 641875 - RNA, 22 nt, Escherichia coli CFT073
gagauaaucgcgguuacucugu

SEQ ID NO: 641876 - RNA, 20 nt, Escherichia coli CFT073
gagauaacuggcaaaaacaa

SEQ ID NO: 641877 - RNA, 17 nt, Escherichia coli CFT073
gagauaagcaacaaacu

SEQ ID NO: 641878 - RNA, 20 nt, Escherichia coli CFT073
gagauaaaaacucaaaaaaa

SEQ ID NO: 641879 - RNA, 14 nt, Escherichia coli CFT073
gagauacaggccac

SEQ ID NO: 641880 - RNA, 14 nt, Escherichia coli CFT073
gagauacucaagca

SEQ ID NO: 641881 - RNA, 22 nt, Escherichia coli CFT073
gagauacucaagcaaccagguu

SEQ ID NO: 641882 - RNA, 15 nt, Escherichia coli CFT073
gagauauuccccaga

SEQ ID NO: 641883 - RNA, 16 nt, Escherichia coli CFT073
gagauauuucaccagc

SEQ ID NO: 641884 - RNA, 16 nt, Escherichia coli CFT073
gagaucaccuugcagu

SEQ ID NO: 641885 - RNA, 19 nt, Escherichia coli CFT073
gagauccagcuucgccagc

SEQ ID NO: 641886 - RNA, 12 nt, Escherichia coli CFT073
gagauccaggcc

SEQ ID NO: 641887 - RNA, 16 nt, Escherichia coli CFT073
gagaucccccgcacac

SEQ ID NO: 641888 - RNA, 14 nt, Escherichia coli CFT073
gagauccgcacuca

SEQ ID NO: 641889 - RNA, 22 nt, Escherichia coli CFT073
gagaucgaccggauuagucugg

SEQ ID NO: 641890 - RNA, 14 nt, Escherichia coli CFT073
gagugaggcguggc

SEQ ID NO: 641891 - RNA, 18 nt, Escherichia coli CFT073
gagugauacguaaaccac

SEQ ID NO: 641892 - RNA, 15 nt, Escherichia coli CFT073
gaguggcccagguua

SEQ ID NO: 641893 - RNA, 15 nt, Escherichia coli CFT073
gaguggcuccaugug

SEQ ID NO: 641894 - RNA, 21 nt, Escherichia coli CFT073
gagugguggggcauugaaaau

SEQ ID NO: 641895 - RNA, 13 nt, Escherichia coli CFT073
gaguguaauccug

SEQ ID NO: 641896 - RNA, 15 nt, Escherichia coli CFT073
gaguguauucaugcc

SEQ ID NO: 641897 - RNA, 17 nt, Escherichia coli CFT073
gagugugcacagcaucc

SEQ ID NO: 641898 - RNA, 20 nt, Escherichia coli CFT073
gaguguuacgccugccgcau

SEQ ID NO: 641899 - RNA, 21 nt, Escherichia coli CFT073
gaguuugccaccaacaguaau

SEQ ID NO: 641900 - RNA, 15 nt, Escherichia coli CFT073
gaguuuauagccugu

SEQ ID NO: 641901 - RNA, 17 nt, Escherichia coli CFT073
gaguuguaauuuaaauc

SEQ ID NO: 641902 - RNA, 12 nt, Escherichia coli CFT073
gaguagcccuuc

SEQ ID NO: 641903 - RNA, 12 nt, Escherichia coli CFT073
gaguagccagcu

SEQ ID NO: 641904 - RNA, 15 nt, Escherichia coli CFT073
gaguagccagcugcc

SEQ ID NO: 641905 - RNA, 16 nt, Escherichia coli CFT073
gaguagcucaccagca

SEQ ID NO: 641906 - RNA, 21 nt, Escherichia coli CFT073
gaguagcucaccagcaggcac

SEQ ID NO: 641907 - RNA, 18 nt, Escherichia coli CFT073
gaguccgguagcgagggu

SEQ ID NO: 641908 - RNA, 17 nt, Escherichia coli CFT073
gaguaguggaaaccggc

SEQ ID NO: 641909 - RNA, 22 nt, Escherichia coli CFT073
gaguauaaaaaagggugcagga

SEQ ID NO: 641910 - RNA, 19 nt, Escherichia coli CFT073
gagugaccaccaauaaccg

SEQ ID NO: 641911 - RNA, 11 nt, Escherichia coli CFT073
gagugaacacg

SEQ ID NO: 641912 - RNA, 13 nt, Escherichia coli CFT073
gagugaacccccu

SEQ ID NO: 641913 - RNA, 17 nt, Escherichia coli CFT073
gagucuuucagacugag

SEQ ID NO: 641914 - RNA, 18 nt, Escherichia coli CFT073
gagucuuugcuugcgaaa

SEQ ID NO: 641915 - RNA, 15 nt, Escherichia coli CFT073
gauaacaaucaccaa

SEQ ID NO: 641916 - RNA, 17 nt, Escherichia coli CFT073
gauaacaaucaucaacc

SEQ ID NO: 641917 - RNA, 16 nt, Escherichia coli CFT073
gauaacucaaaaauaa

SEQ ID NO: 641918 - RNA, 11 nt, Escherichia coli CFT073
gauaacccugc

SEQ ID NO: 641919 - RNA, 15 nt, Escherichia coli CFT073
gauaacccagcagcc

SEQ ID NO: 641920 - RNA, 17 nt, Escherichia coli CFT073
gauaaccccagauggau

SEQ ID NO: 641921 - RNA, 13 nt, Escherichia coli CFT073
gauaaccacguuc

SEQ ID NO: 641922 - RNA, 20 nt, Escherichia coli CFT073
gauaagaggcgcgcggguga

SEQ ID NO: 641923 - RNA, 20 nt, Escherichia coli CFT073
gauaagacgcgucagugucu

SEQ ID NO: 641924 - RNA, 17 nt, Escherichia coli CFT073
gauaagacgcguuaagc

SEQ ID NO: 641925 - RNA, 20 nt, Escherichia coli CFT073
gauaagacagcgucacauca

SEQ ID NO: 641926 - RNA, 13 nt, Escherichia coli CFT073
gauaagacauaac

SEQ ID NO: 641927 - RNA, 21 nt, Escherichia coli CFT073
gauaacucaaaaauaaucauc

SEQ ID NO: 641928 - RNA, 17 nt, Escherichia coli CFT073
gauaacuggcaaaaaca

SEQ ID NO: 641929 - RNA, 17 nt, Escherichia coli CFT073
gauaacuguuaaauaac

SEQ ID NO: 641930 - RNA, 14 nt, Escherichia coli CFT073
gaguuuuuccuuuc

SEQ ID NO: 641931 - RNA, 15 nt, Escherichia coli CFT073
gaguuuuaaaaccau

SEQ ID NO: 641932 - RNA, 16 nt, Escherichia coli CFT073
gaguuugccgcugucc

SEQ ID NO: 641933 - RNA, 20 nt, Escherichia coli CFT073
gauaaacaucgggacaugau

SEQ ID NO: 641934 - RNA, 17 nt, Escherichia coli CFT073
gauaaaccuccagcauc

SEQ ID NO: 641935 - RNA, 19 nt, Escherichia coli CFT073
gauaaaccuccagcaucag

SEQ ID NO: 641936 - RNA, 21 nt, Escherichia coli CFT073
gauaaacguauaguggaauug

SEQ ID NO: 641937 - RNA, 12 nt, Escherichia coli CFT073
gauaaauauuau

SEQ ID NO: 641938 - RNA, 14 nt, Escherichia coli CFT073
gauaaauauuauug

SEQ ID NO: 641939 - RNA, 16 nt, Escherichia coli CFT073
gagguggagucagggg

SEQ ID NO: 641940 - RNA, 20 nt, Escherichia coli CFT073
gaggugccaccagugcaggc

SEQ ID NO: 641941 - RNA, 19 nt, Escherichia coli CFT073
gagguagcgauagaaauca

SEQ ID NO: 641942 - RNA, 22 nt, Escherichia coli CFT073
gagguauacgcuguggcgcugg

SEQ ID NO: 641943 - RNA, 14 nt, Escherichia coli CFT073
gaggucgcacugcu

SEQ ID NO: 641944 - RNA, 15 nt, Escherichia coli CFT073
gaguaaaccgccugu

SEQ ID NO: 641945 - RNA, 15 nt, Escherichia coli CFT073
gaguaaacggcagag

SEQ ID NO: 641946 - RNA, 20 nt, Escherichia coli CFT073
gaguaaauaaccuuaucguu

SEQ ID NO: 641947 - RNA, 13 nt, Escherichia coli CFT073
gaguaaauauagc

SEQ ID NO: 641948 - RNA, 15 nt, Escherichia coli CFT073
gaguaaugcaugacu

SEQ ID NO: 641949 - RNA, 13 nt, Escherichia coli CFT073
gaguaauuaaacu

SEQ ID NO: 641950 - RNA, 12 nt, Escherichia coli CFT073
gaguacauccac

SEQ ID NO: 641951 - RNA, 15 nt, Escherichia coli CFT073
gaguaauagccugau

SEQ ID NO: 641952 - RNA, 11 nt, Escherichia coli CFT073
gaggguggcac

SEQ ID NO: 641953 - RNA, 23 nt, Escherichia coli CFT073
gaggguuucuucaaacugcagca

SEQ ID NO: 641954 - RNA, 23 nt, Escherichia coli CFT073
gagguaaauuugccaucucugca

SEQ ID NO: 641955 - RNA, 22 nt, Escherichia coli CFT073
gagguaagcuucagaauggaaa

SEQ ID NO: 641956 - RNA, 23 nt, Escherichia coli CFT073
gaggggaacacggcuuucugcaa

SEQ ID NO: 641957 - RNA, 16 nt, Escherichia coli CFT073
gaggcuaauaaacagg

SEQ ID NO: 641958 - RNA, 15 nt, Escherichia coli CFT073
gaggcuuauccggca

SEQ ID NO: 641959 - RNA, 18 nt, Escherichia coli CFT073
gagggacuccggauucaa

SEQ ID NO: 641960 - RNA, 22 nt, Escherichia coli CFT073
gauaagccagaccacagguaau

SEQ ID NO: 641961 - RNA, 22 nt, Escherichia coli CFT073
gauaagccagcaaccaacgcua

SEQ ID NO: 641962 - RNA, 16 nt, Escherichia coli CFT073
gauaagcaacaaacuc

SEQ ID NO: 641963 - RNA, 19 nt, Escherichia coli CFT073
gauaagcuugcgcaucggg

SEQ ID NO: 641964 - RNA, 21 nt, Escherichia coli CFT073
gauaaggccaccagcggcacc

SEQ ID NO: 641965 - RNA, 22 nt, Escherichia coli CFT073
gauaagugagcgauucaaauuc

SEQ ID NO: 641966 - RNA, 14 nt, Escherichia coli CFT073
gauaagucacuaau

SEQ ID NO: 641967 - RNA, 19 nt, Escherichia coli CFT073
gauaagucacuaauugcag

SEQ ID NO: 641968 - RNA, 19 nt, Escherichia coli CFT073
gauaaggugucaauccuuc

SEQ ID NO: 641969 - RNA, 15 nt, Escherichia coli CFT073
gauacguugccguau

SEQ ID NO: 641970 - RNA, 21 nt, Escherichia coli CFT073
gauacguuuuaaugauuucca

SEQ ID NO: 641971 - RNA, 13 nt, Escherichia coli CFT073
gauacucaagcaa

SEQ ID NO: 641972 - RNA, 14 nt, Escherichia coli CFT073
gauaccugauuaaa

SEQ ID NO: 641973 - RNA, 22 nt, Escherichia coli CFT073
gauacggugcacaaugccugau

SEQ ID NO: 641974 - RNA, 12 nt, Escherichia coli CFT073
gauagccaggcg

SEQ ID NO: 641975 - RNA, 19 nt, Escherichia coli CFT073
gauagacuguugaaauaca

SEQ ID NO: 641976 - RNA, 19 nt, Escherichia coli CFT073
gauagaaccacgcaaaggc

SEQ ID NO: 641977 - RNA, 23 nt, Escherichia coli CFT073
gauagaauagccuuuagcgagcg

SEQ ID NO: 641978 - RNA, 15 nt, Escherichia coli CFT073
gauauaaccauggcu

SEQ ID NO: 641979 - RNA, 20 nt, Escherichia coli CFT073
gauauacgcuuucagcacuu

SEQ ID NO: 641980 - RNA, 22 nt, Escherichia coli CFT073
gauauagaccaucggcgcuggc

SEQ ID NO: 641981 - RNA, 22 nt, Escherichia coli CFT073
gauaguggcucaggcucucauu

SEQ ID NO: 641982 - RNA, 16 nt, Escherichia coli CFT073
gauaggugguauagaa

SEQ ID NO: 641983 - RNA, 14 nt, Escherichia coli CFT073
gauagcuguaccug

SEQ ID NO: 641984 - RNA, 19 nt, Escherichia coli CFT073
gauagcuuacggcgcugug

SEQ ID NO: 641985 - RNA, 15 nt, Escherichia coli CFT073
gauagcgcgccagcc

SEQ ID NO: 641986 - RNA, 22 nt, Escherichia coli CFT073
gauagcccaacgaucccaacug

SEQ ID NO: 641987 - RNA, 15 nt, Escherichia coli CFT073
gaucaucauccagca

SEQ ID NO: 641988 - RNA, 21 nt, Escherichia coli CFT073
gaucaucaucgcgauccccca

SEQ ID NO: 641989 - RNA, 22 nt, Escherichia coli CFT073
gaucauccauguggcauuggua

SEQ ID NO: 641990 - RNA, 12 nt, Escherichia coli CFT073
gaucauccgccu

SEQ ID NO: 641991 - RNA, 14 nt, Escherichia coli CFT073
gaucaucgacagua

SEQ ID NO: 641992 - RNA, 16 nt, Escherichia coli CFT073
gaucaucucaacaaac

SEQ ID NO: 641993 - RNA, 15 nt, Escherichia coli CFT073
gauccagcgguugga

SEQ ID NO: 641994 - RNA, 15 nt, Escherichia coli CFT073
gauccagcucuuccu

SEQ ID NO: 641995 - RNA, 16 nt, Escherichia coli CFT073
gauccagcucuuccuc

SEQ ID NO: 641996 - RNA, 17 nt, Escherichia coli CFT073
gaucauacugaacuuau

SEQ ID NO: 641997 - RNA, 18 nt, Escherichia coli CFT073
gaucaguuacucugcaag

SEQ ID NO: 641998 - RNA, 17 nt, Escherichia coli CFT073
gaucauaugcacaauca

SEQ ID NO: 641999 - RNA, 15 nt, Escherichia coli CFT073
gaucagcaaaauggc

SEQ ID NO: 642000 - RNA, 13 nt, Escherichia coli CFT073
gaucagcaaauaa

SEQ ID NO: 642001 - RNA, 16 nt, Escherichia coli CFT073
gaucacuuccagcagu

SEQ ID NO: 642002 - RNA, 20 nt, Escherichia coli CFT073
gaucagaagcauaaccgagc

SEQ ID NO: 642003 - RNA, 23 nt, Escherichia coli CFT073
gaucacucacccgccagcgcgcg

SEQ ID NO: 642004 - RNA, 17 nt, Escherichia coli CFT073
gauauuccccagacgag

SEQ ID NO: 642005 - RNA, 23 nt, Escherichia coli CFT073
gauauuccccagacgagagugac

SEQ ID NO: 642006 - RNA, 13 nt, Escherichia coli CFT073
gauauucccccac

SEQ ID NO: 642007 - RNA, 20 nt, Escherichia coli CFT073
gauauucucgcuccaguuuu

SEQ ID NO: 642008 - RNA, 22 nt, Escherichia coli CFT073
gauauuucaccagcgcacguaa

SEQ ID NO: 642009 - RNA, 17 nt, Escherichia coli CFT073
gauauuuuuuuccuaaa

SEQ ID NO: 642010 - RNA, 20 nt, Escherichia coli CFT073
gaucaaaaaaaucuucacug

SEQ ID NO: 642011 - RNA, 15 nt, Escherichia coli CFT073
gauauucauagagaa

SEQ ID NO: 642012 - RNA, 10 nt, Escherichia coli CFT073
gauauucauu

SEQ ID NO: 642013 - RNA, 15 nt, Escherichia coli CFT073
gauauaugucaccag

SEQ ID NO: 642014 - RNA, 19 nt, Escherichia coli CFT073
gauauagccuaacacagca

SEQ ID NO: 642015 - RNA, 13 nt, Escherichia coli CFT073
gaucaaauccaau

SEQ ID NO: 642016 - RNA, 12 nt, Escherichia coli CFT073
gaucaauaccau

SEQ ID NO: 642017 - RNA, 13 nt, Escherichia coli CFT073
gaucaauccccag

SEQ ID NO: 642018 - RNA, 14 nt, Escherichia coli CFT073
gaucaaauaaccgg

SEQ ID NO: 642019 - RNA, 20 nt, Escherichia coli CFT073
gaucaaauaaccgguauugc

SEQ ID NO: 642020 - RNA, 16 nt, Escherichia coli CFT073
gaucaaauacuucaau

SEQ ID NO: 642021 - RNA, 15 nt, Escherichia coli CFT073
gaucaaucugcucuu

SEQ ID NO: 642022 - RNA, 17 nt, Escherichia coli CFT073
gaucaccaauaccagca

SEQ ID NO: 642023 - RNA, 12 nt, Escherichia coli CFT073
gaucacagagcc

SEQ ID NO: 642024 - RNA, 16 nt, Escherichia coli CFT073
gaucacaauguaaauc

SEQ ID NO: 642025 - RNA, 19 nt, Escherichia coli CFT073
gaucaccguagaaggcgac

SEQ ID NO: 642026 - RNA, 20 nt, Escherichia coli CFT073
gaucaccguagaaggcgaca

SEQ ID NO: 642027 - RNA, 20 nt, Escherichia coli CFT073
gaucacccacaccaccgcaa

SEQ ID NO: 642028 - RNA, 20 nt, Escherichia coli CFT073
gaugauuuccgccagcgggg

SEQ ID NO: 642029 - RNA, 21 nt, Escherichia coli CFT073
gaugcaaacgauuaucaacac

SEQ ID NO: 642030 - RNA, 15 nt, Escherichia coli CFT073
gaugauacuugcacc

SEQ ID NO: 642031 - RNA, 19 nt, Escherichia coli CFT073
gaugaucaaaaaaaucuuc

SEQ ID NO: 642032 - RNA, 15 nt, Escherichia coli CFT073
gaugcacuucagggc

SEQ ID NO: 642033 - RNA, 12 nt, Escherichia coli CFT073
gaugcaccugcg

SEQ ID NO: 642034 - RNA, 24 nt, Escherichia coli CFT073
gaugcaccugcguugccgcaucag

SEQ ID NO: 642035 - RNA, 14 nt, Escherichia coli CFT073
gaugcaacuguuuu

SEQ ID NO: 642036 - RNA, 17 nt, Escherichia coli CFT073
gaugaguaucuuauuga

SEQ ID NO: 642037 - RNA, 22 nt, Escherichia coli CFT073
gaugaguaucuuauugaaagau

SEQ ID NO: 642038 - RNA, 14 nt, Escherichia coli CFT073
gaugaguauuucau

SEQ ID NO: 642039 - RNA, 21 nt, Escherichia coli CFT073
gaugaguauuucauccggcgu

SEQ ID NO: 642040 - RNA, 22 nt, Escherichia coli CFT073
gaugauaaccccgcaauuucau

SEQ ID NO: 642041 - RNA, 13 nt, Escherichia coli CFT073
gaugacgccagcc

SEQ ID NO: 642042 - RNA, 12 nt, Escherichia coli CFT073
gaugaaggugcu

SEQ ID NO: 642043 - RNA, 17 nt, Escherichia coli CFT073
gaugaagucgaucagac

SEQ ID NO: 642044 - RNA, 14 nt, Escherichia coli CFT073
gauggcgggccugg

SEQ ID NO: 642045 - RNA, 21 nt, Escherichia coli CFT073
gaugcucacagaguauuucca

SEQ ID NO: 642046 - RNA, 21 nt, Escherichia coli CFT073
gaugcggcgugaacgccuuau

SEQ ID NO: 642047 - RNA, 20 nt, Escherichia coli CFT073
gaugcggcgauuaauccagu

SEQ ID NO: 642048 - RNA, 12 nt, Escherichia coli CFT073
gaugcucuccgc

SEQ ID NO: 642049 - RNA, 23 nt, Escherichia coli CFT073
gaugccauuuugcaccuucagaa

SEQ ID NO: 642050 - RNA, 22 nt, Escherichia coli CFT073
gaugccuucaguuuccagcaaa

SEQ ID NO: 642051 - RNA, 17 nt, Escherichia coli CFT073
gaugcgcuggcgcaacu

SEQ ID NO: 642052 - RNA, 21 nt, Escherichia coli CFT073
gaugcgcgagguaacaauaaa

SEQ ID NO: 642053 - RNA, 17 nt, Escherichia coli CFT073
gaugcgcguaguacuuu

SEQ ID NO: 642054 - RNA, 18 nt, Escherichia coli CFT073
gaucuggaauggaaacag

SEQ ID NO: 642055 - RNA, 18 nt, Escherichia coli CFT073
gaucugcgucgcuuucca

SEQ ID NO: 642056 - RNA, 14 nt, Escherichia coli CFT073
gaucuuccaguucu

SEQ ID NO: 642057 - RNA, 18 nt, Escherichia coli CFT073
gaucuuccccuuuugccu

SEQ ID NO: 642058 - RNA, 21 nt, Escherichia coli CFT073
gaucuucgccugaaacagaag

SEQ ID NO: 642059 - RNA, 21 nt, Escherichia coli CFT073
gaugaaauacuaaauaugaaa

SEQ ID NO: 642060 - RNA, 22 nt, Escherichia coli CFT073
gaugaaauacuaaauaugaaaa

SEQ ID NO: 642061 - RNA, 16 nt, Escherichia coli CFT073
gaugaaauaguugcau

SEQ ID NO: 642062 - RNA, 18 nt, Escherichia coli CFT073
gaugaaaacgccaccaga

SEQ ID NO: 642063 - RNA, 15 nt, Escherichia coli CFT073
gaucuuuaucaagca

SEQ ID NO: 642064 - RNA, 16 nt, Escherichia coli CFT073
gaucuuuaucaagcac

SEQ ID NO: 642065 - RNA, 13 nt, Escherichia coli CFT073
gaucuuucacgcc

SEQ ID NO: 642066 - RNA, 19 nt, Escherichia coli CFT073
gaucuuuaauguccuuuuc

SEQ ID NO: 642067 - RNA, 22 nt, Escherichia coli CFT073
gaugaaaaaaccagaaagggaa

SEQ ID NO: 642068 - RNA, 23 nt, Escherichia coli CFT073
gaugaaaaaaccagaaagggaag

SEQ ID NO: 642069 - RNA, 14 nt, Escherichia coli CFT073
gaucuuugcccaua

SEQ ID NO: 642070 - RNA, 23 nt, Escherichia coli CFT073
gaucuccuccagcgcuuccagaa

SEQ ID NO: 642071 - RNA, 19 nt, Escherichia coli CFT073
gaucugaccuauuucauuc

SEQ ID NO: 642072 - RNA, 19 nt, Escherichia coli CFT073
gaucugacgugcacaaacu

SEQ ID NO: 642073 - RNA, 19 nt, Escherichia coli CFT073
gaucugcaaauucaauaaa

SEQ ID NO: 642074 - RNA, 14 nt, Escherichia coli CFT073
gaucugcacagcau

SEQ ID NO: 642075 - RNA, 18 nt, Escherichia coli CFT073
gaucugcacagcauucag

SEQ ID NO: 642076 - RNA, 15 nt, Escherichia coli CFT073
gaucugauuuucuuc

SEQ ID NO: 642077 - RNA, 17 nt, Escherichia coli CFT073
gaucugccauauccagc

SEQ ID NO: 642078 - RNA, 15 nt, Escherichia coli CFT073
gaucuacagccuuau

SEQ ID NO: 642079 - RNA, 12 nt, Escherichia coli CFT073
gaucuaccaguu

SEQ ID NO: 642080 - RNA, 18 nt, Escherichia coli CFT073
gaucuaccaguuccagcg

SEQ ID NO: 642081 - RNA, 16 nt, Escherichia coli CFT073
gaucucacguccacca

SEQ ID NO: 642082 - RNA, 15 nt, Escherichia coli CFT073
gaucgugugccacca

SEQ ID NO: 642083 - RNA, 22 nt, Escherichia coli CFT073
gaucguguggauaauccauccc

SEQ ID NO: 642084 - RNA, 23 nt, Escherichia coli CFT073
gaucguugaccuggaugccugca

SEQ ID NO: 642085 - RNA, 19 nt, Escherichia coli CFT073
gaucccaugccgaaugccg

SEQ ID NO: 642086 - RNA, 16 nt, Escherichia coli CFT073
gauccccgcaagcccc

SEQ ID NO: 642087 - RNA, 17 nt, Escherichia coli CFT073
gauccccgcagcaaaca

SEQ ID NO: 642088 - RNA, 16 nt, Escherichia coli CFT073
gaucccagagcgggca

SEQ ID NO: 642089 - RNA, 17 nt, Escherichia coli CFT073
gauuucucuggagaaau

SEQ ID NO: 642090 - RNA, 19 nt, Escherichia coli CFT073
gauuucgauccggcacgca

SEQ ID NO: 642091 - RNA, 13 nt, Escherichia coli CFT073
gauuugcuggaag

SEQ ID NO: 642092 - RNA, 13 nt, Escherichia coli CFT073
gauuuggcagcac

SEQ ID NO: 642093 - RNA, 16 nt, Escherichia coli CFT073
gauuugguucuauugc

SEQ ID NO: 642094 - RNA, 22 nt, Escherichia coli CFT073
gauuugucauaugcaaugcauc

SEQ ID NO: 642095 - RNA, 20 nt, Escherichia coli CFT073
gauuugugcacgugccagau

SEQ ID NO: 642096 - RNA, 17 nt, Escherichia coli CFT073
gauuuccaucuccagcu

SEQ ID NO: 642097 - RNA, 21 nt, Escherichia coli CFT073
gauuuccaucuccagcugcuc

SEQ ID NO: 642098 - RNA, 14 nt, Escherichia coli CFT073
gauuuccaacgaau

SEQ ID NO: 642099 - RNA, 11 nt, Escherichia coli CFT073
gauuucauuca

SEQ ID NO: 642100 - RNA, 19 nt, Escherichia coli CFT073
gauuuccggcaucgccagc

SEQ ID NO: 642101 - RNA, 22 nt, Escherichia coli CFT073
gauuuccggucaacccaaccug

SEQ ID NO: 642102 - RNA, 20 nt, Escherichia coli CFT073
gcaaaaaacacucuucaaca

SEQ ID NO: 642103 - RNA, 16 nt, Escherichia coli CFT073
gcaaaaaaccaucccu

SEQ ID NO: 642104 - RNA, 13 nt, Escherichia coli CFT073
gauuuuuuugcag

SEQ ID NO: 642105 - RNA, 19 nt, Escherichia coli CFT073
gauuuucuacuucuuucac

SEQ ID NO: 642106 - RNA, 12 nt, Escherichia coli CFT073
gauuuucugcuc

SEQ ID NO: 642107 - RNA, 16 nt, Escherichia coli CFT073
gauuuucuucauugcc

SEQ ID NO: 642108 - RNA, 14 nt, Escherichia coli CFT073
gauuuucuuccagu

SEQ ID NO: 642109 - RNA, 22 nt, Escherichia coli CFT073
gauuuaccguuaagcuggaaau

SEQ ID NO: 642110 - RNA, 20 nt, Escherichia coli CFT073
gauuuacuaaaacuucauuu

SEQ ID NO: 642111 - RNA, 21 nt, Escherichia coli CFT073
gauuuauguaccgucaucgcc

SEQ ID NO: 642112 - RNA, 12 nt, Escherichia coli CFT073
gauuucaucgcc

SEQ ID NO: 642113 - RNA, 15 nt, Escherichia coli CFT073
gauuggguuaagccg

SEQ ID NO: 642114 - RNA, 14 nt, Escherichia coli CFT073
gauuguagaaaauc

SEQ ID NO: 642115 - RNA, 15 nt, Escherichia coli CFT073
gauuguaggccggau

SEQ ID NO: 642116 - RNA, 23 nt, Escherichia coli CFT073
gauugcauccgauuguuccugcu

SEQ ID NO: 642117 - RNA, 16 nt, Escherichia coli CFT073
gauugccgcgagaacu

SEQ ID NO: 642118 - RNA, 16 nt, Escherichia coli CFT073
gauucgccgaugcaua

SEQ ID NO: 642119 - RNA, 16 nt, Escherichia coli CFT073
gauucgccgccgcaua

SEQ ID NO: 642120 - RNA, 16 nt, Escherichia coli CFT073
gauucggcgcaaugau

SEQ ID NO: 642121 - RNA, 20 nt, Escherichia coli CFT073
gauucgcguugcauaaagcu

SEQ ID NO: 642122 - RNA, 20 nt, Escherichia coli CFT073
gauucaaauccagucuuucg

SEQ ID NO: 642123 - RNA, 13 nt, Escherichia coli CFT073
gauucaaugcaau

SEQ ID NO: 642124 - RNA, 20 nt, Escherichia coli CFT073
gauucagucuuaaaaagcag

SEQ ID NO: 642125 - RNA, 22 nt, Escherichia coli CFT073
gauucagcccgagguuauuuug

SEQ ID NO: 642126 - RNA, 16 nt, Escherichia coli CFT073
gauucagcaacaucac

SEQ ID NO: 642127 - RNA, 21 nt, Escherichia coli CFT073
gauucacuucgcucuuaucac

SEQ ID NO: 642128 - RNA, 21 nt, Escherichia coli CFT073
gauuagucugguugagcagua

SEQ ID NO: 642129 - RNA, 15 nt, Escherichia coli CFT073
gauuagccauucuuu

SEQ ID NO: 642130 - RNA, 20 nt, Escherichia coli CFT073
gauucaugauacuccacauc

SEQ ID NO: 642131 - RNA, 15 nt, Escherichia coli CFT073
gauucauccaguucc

SEQ ID NO: 642132 - RNA, 13 nt, Escherichia coli CFT073
gauucauccggca

SEQ ID NO: 642133 - RNA, 16 nt, Escherichia coli CFT073
gauucaucucuucuuc

SEQ ID NO: 642134 - RNA, 19 nt, Escherichia coli CFT073
gauuccaggucaaucccag

SEQ ID NO: 642135 - RNA, 17 nt, Escherichia coli CFT073
gauuccaguaaguuaug

SEQ ID NO: 642136 - RNA, 13 nt, Escherichia coli CFT073
gauuccacucauu

SEQ ID NO: 642137 - RNA, 14 nt, Escherichia coli CFT073
gauuccaauauuaa

SEQ ID NO: 642138 - RNA, 16 nt, Escherichia coli CFT073
gauuccugcgcuucca

SEQ ID NO: 642139 - RNA, 19 nt, Escherichia coli CFT073
gauuccggcaaauaacaga

SEQ ID NO: 642140 - RNA, 23 nt, Escherichia coli CFT073
gauuccgccgauggugcagcaga

SEQ ID NO: 642141 - RNA, 21 nt, Escherichia coli CFT073
gauuccgggccaccaugccca

SEQ ID NO: 642142 - RNA, 17 nt, Escherichia coli CFT073
gauucccagcaacagca

SEQ ID NO: 642143 - RNA, 15 nt, Escherichia coli CFT073
gaugugaacugacuc

SEQ ID NO: 642144 - RNA, 18 nt, Escherichia coli CFT073
gaugugaggcugauuugc

SEQ ID NO: 642145 - RNA, 12 nt, Escherichia coli CFT073
gaugugcuccau

SEQ ID NO: 642146 - RNA, 11 nt, Escherichia coli CFT073
gaugugccauu

SEQ ID NO: 642147 - RNA, 17 nt, Escherichia coli CFT073
gauggcuccgggcaggg

SEQ ID NO: 642148 - RNA, 19 nt, Escherichia coli CFT073
gauggcuccgggcagggcg

SEQ ID NO: 642149 - RNA, 19 nt, Escherichia coli CFT073
gauggcugggguaccugga

SEQ ID NO: 642150 - RNA, 23 nt, Escherichia coli CFT073
gauggcuauuacuuuaagccuuc

SEQ ID NO: 642151 - RNA, 16 nt, Escherichia coli CFT073
gauuacaggaacugca

SEQ ID NO: 642152 - RNA, 13 nt, Escherichia coli CFT073
gauguuccgccau

SEQ ID NO: 642153 - RNA, 14 nt, Escherichia coli CFT073
gauguucaauaaaa

SEQ ID NO: 642154 - RNA, 19 nt, Escherichia coli CFT073
gcaguuacugcccgcacac

SEQ ID NO: 642155 - RNA, 13 nt, Escherichia coli CFT073
gcagugucagcac

SEQ ID NO: 642156 - RNA, 19 nt, Escherichia coli CFT073
gcaguguucuggcuugcug

SEQ ID NO: 642157 - RNA, 16 nt, Escherichia coli CFT073
gcagugguaucaauau

SEQ ID NO: 642158 - RNA, 19 nt, Escherichia coli CFT073
gcagugaaguaauaaucaa

SEQ ID NO: 642159 - RNA, 14 nt, Escherichia coli CFT073
gcagugaauuucua

SEQ ID NO: 642160 - RNA, 12 nt, Escherichia coli CFT073
gcaguggcuucg

SEQ ID NO: 642161 - RNA, 13 nt, Escherichia coli CFT073
gcaguaaugguuu

SEQ ID NO: 642162 - RNA, 17 nt, Escherichia coli CFT073
gcaguaacugcuguagu

SEQ ID NO: 642163 - RNA, 12 nt, Escherichia coli CFT073
gcaguaccagau

SEQ ID NO: 642164 - RNA, 18 nt, Escherichia coli CFT073
gcaguacguuuugagccu

SEQ ID NO: 642165 - RNA, 21 nt, Escherichia coli CFT073
gcaguucugccaggcuggcag

SEQ ID NO: 642166 - RNA, 17 nt, Escherichia coli CFT073
gcaguuccagcaucugu

SEQ ID NO: 642167 - RNA, 22 nt, Escherichia coli CFT073
gcauaagaccgugagcaaugca

SEQ ID NO: 642168 - RNA, 14 nt, Escherichia coli CFT073
gcauacaacgccau

SEQ ID NO: 642169 - RNA, 15 nt, Escherichia coli CFT073
gcauaacucaccauc

SEQ ID NO: 642170 - RNA, 17 nt, Escherichia coli CFT073
gcauaacgcuggggaau

SEQ ID NO: 642171 - RNA, 22 nt, Escherichia coli CFT073
gcauaacgcuggggaaugccau

SEQ ID NO: 642172 - RNA, 19 nt, Escherichia coli CFT073
gcauaaccgguaccugccg

SEQ ID NO: 642173 - RNA, 14 nt, Escherichia coli CFT073
gcauaacaaaaugc

SEQ ID NO: 642174 - RNA, 20 nt, Escherichia coli CFT073
gcauaacacaauaccuucug

SEQ ID NO: 642175 - RNA, 19 nt, Escherichia coli CFT073
gcaggguauugcgcgccgc

SEQ ID NO: 642176 - RNA, 13 nt, Escherichia coli CFT073
gcagggcgggaga

SEQ ID NO: 642177 - RNA, 15 nt, Escherichia coli CFT073
gcagguacgguacug

SEQ ID NO: 642178 - RNA, 18 nt, Escherichia coli CFT073
gcagguaaaacggcagaa

SEQ ID NO: 642179 - RNA, 14 nt, Escherichia coli CFT073
gcagguaagaguuu

SEQ ID NO: 642180 - RNA, 20 nt, Escherichia coli CFT073
gcaggguuugcaucgccaug

SEQ ID NO: 642181 - RNA, 23 nt, Escherichia coli CFT073
gcagguugaaguugaugaagcuu

SEQ ID NO: 642182 - RNA, 16 nt, Escherichia coli CFT073
gcagguugagcaacaa

SEQ ID NO: 642183 - RNA, 16 nt, Escherichia coli CFT073
gcaguaaacgccaggg

SEQ ID NO: 642184 - RNA, 20 nt, Escherichia coli CFT073
gcaguaaauaaaaaauccac

SEQ ID NO: 642185 - RNA, 12 nt, Escherichia coli CFT073
gcaguaaaucgu

SEQ ID NO: 642186 - RNA, 17 nt, Escherichia coli CFT073
gcagguaguuaucugcc

SEQ ID NO: 642187 - RNA, 14 nt, Escherichia coli CFT073
gcagguagcgccuu

SEQ ID NO: 642188 - RNA, 15 nt, Escherichia coli CFT073
gcagguagcagcagc

SEQ ID NO: 642189 - RNA, 21 nt, Escherichia coli CFT073
gcaggagcgauuaugaaacaa

SEQ ID NO: 642190 - RNA, 18 nt, Escherichia coli CFT073
gcaggaucuccaguuccc

SEQ ID NO: 642191 - RNA, 15 nt, Escherichia coli CFT073
gcaggcuggcgacga

SEQ ID NO: 642192 - RNA, 14 nt, Escherichia coli CFT073
gcaggcugcgcgcu

SEQ ID NO: 642193 - RNA, 13 nt, Escherichia coli CFT073
gcaggaaauauaa

SEQ ID NO: 642194 - RNA, 17 nt, Escherichia coli CFT073
gcagcuuccggccagca

SEQ ID NO: 642195 - RNA, 22 nt, Escherichia coli CFT073
gcagcuuacgcgccagagcugg

SEQ ID NO: 642196 - RNA, 12 nt, Escherichia coli CFT073
gcagcugugccg

SEQ ID NO: 642197 - RNA, 16 nt, Escherichia coli CFT073
gcagcuguuucaucuc

SEQ ID NO: 642198 - RNA, 20 nt, Escherichia coli CFT073
gcaggaauagauuaugaaau

SEQ ID NO: 642199 - RNA, 19 nt, Escherichia coli CFT073
gcaggacgcucccucaaua

SEQ ID NO: 642200 - RNA, 18 nt, Escherichia coli CFT073
gcagcucgcacgccacgc

SEQ ID NO: 642201 - RNA, 21 nt, Escherichia coli CFT073
gcagcucgcguucggaaauau

SEQ ID NO: 642202 - RNA, 12 nt, Escherichia coli CFT073
gcagcuccugcu

SEQ ID NO: 642203 - RNA, 17 nt, Escherichia coli CFT073
gcagcuccugcucugac

SEQ ID NO: 642204 - RNA, 15 nt, Escherichia coli CFT073
gcagcucacgcacga

SEQ ID NO: 642205 - RNA, 20 nt, Escherichia coli CFT073
gcagcucacuucgauccagu

SEQ ID NO: 642206 - RNA, 14 nt, Escherichia coli CFT073
gcagcgacucacga

SEQ ID NO: 642207 - RNA, 18 nt, Escherichia coli CFT073
gcagaugcacaagcggca

SEQ ID NO: 642208 - RNA, 16 nt, Escherichia coli CFT073
gcagauggcagccauc

SEQ ID NO: 642209 - RNA, 15 nt, Escherichia coli CFT073
gcagaugcugugccu

SEQ ID NO: 642210 - RNA, 21 nt, Escherichia coli CFT073
gcagaugcugugccuccugcg

SEQ ID NO: 642211 - RNA, 19 nt, Escherichia coli CFT073
gcagaucgcggccuaccug

SEQ ID NO: 642212 - RNA, 15 nt, Escherichia coli CFT073
gcagauaccacauca

SEQ ID NO: 642213 - RNA, 13 nt, Escherichia coli CFT073
gcagauaauaguc

SEQ ID NO: 642214 - RNA, 18 nt, Escherichia coli CFT073
gcagauacauugccacca

SEQ ID NO: 642215 - RNA, 20 nt, Escherichia coli CFT073
gcagauccaguuacccagcg

SEQ ID NO: 642216 - RNA, 23 nt, Escherichia coli CFT073
gcagauaucccgccagcaccagc

SEQ ID NO: 642217 - RNA, 12 nt, Escherichia coli CFT073
gcagaucaccaa

SEQ ID NO: 642218 - RNA, 16 nt, Escherichia coli CFT073
gcagaucaaauucaau

SEQ ID NO: 642219 - RNA, 16 nt, Escherichia coli CFT073
gcagcaagugcggcgc

SEQ ID NO: 642220 - RNA, 17 nt, Escherichia coli CFT073
gcagcaauauguugaua

SEQ ID NO: 642221 - RNA, 21 nt, Escherichia coli CFT073
gcagcaaggcuauucagcagu

SEQ ID NO: 642222 - RNA, 20 nt, Escherichia coli CFT073
gcagcaagcgcaucggaaga

SEQ ID NO: 642223 - RNA, 18 nt, Escherichia coli CFT073
gcagaucuuucugcaggg

SEQ ID NO: 642224 - RNA, 19 nt, Escherichia coli CFT073
gcagccuuucacaucagaa

SEQ ID NO: 642225 - RNA, 15 nt, Escherichia coli CFT073
gcagccuuaccggag

SEQ ID NO: 642226 - RNA, 16 nt, Escherichia coli CFT073
gcagccgauuuuaugu

SEQ ID NO: 642227 - RNA, 18 nt, Escherichia coli CFT073
gcagcccauaagcaaaag

SEQ ID NO: 642228 - RNA, 22 nt, Escherichia coli CFT073
gcagccauuuguuggcgcugcu

SEQ ID NO: 642229 - RNA, 23 nt, Escherichia coli CFT073
gcagccauuuguuggcgcugcug

SEQ ID NO: 642230 - RNA, 16 nt, Escherichia coli CFT073
gcagccauucauucaa

SEQ ID NO: 642231 - RNA, 14 nt, Escherichia coli CFT073
gcagccaugaugaa

SEQ ID NO: 642232 - RNA, 17 nt, Escherichia coli CFT073
gcagccaguuguugaua

SEQ ID NO: 642233 - RNA, 20 nt, Escherichia coli CFT073
gcagccagcguuacccagac

SEQ ID NO: 642234 - RNA, 13 nt, Escherichia coli CFT073
gcagccaggccau

SEQ ID NO: 642235 - RNA, 16 nt, Escherichia coli CFT073
gcagccacggcagcaa

SEQ ID NO: 642236 - RNA, 17 nt, Escherichia coli CFT073
gcagcaggaucuccagu

SEQ ID NO: 642237 - RNA, 20 nt, Escherichia coli CFT073
gcagacauuccccgccagga

SEQ ID NO: 642238 - RNA, 16 nt, Escherichia coli CFT073
gcagaccagagcugau

SEQ ID NO: 642239 - RNA, 16 nt, Escherichia coli CFT073
gcagacagcgccaggc

SEQ ID NO: 642240 - RNA, 15 nt, Escherichia coli CFT073
gcagaauuggcauca

SEQ ID NO: 642241 - RNA, 19 nt, Escherichia coli CFT073
gcagaaugaaugauacaga

SEQ ID NO: 642242 - RNA, 15 nt, Escherichia coli CFT073
gcagacaaaauccug

SEQ ID NO: 642243 - RNA, 18 nt, Escherichia coli CFT073
gcagacguaauguauuua

SEQ ID NO: 642244 - RNA, 16 nt, Escherichia coli CFT073
gcagacguagaaaauc

SEQ ID NO: 642245 - RNA, 23 nt, Escherichia coli CFT073
gcagacguuuuuucugccccagu

SEQ ID NO: 642246 - RNA, 19 nt, Escherichia coli CFT073
gcagagcauucccgccauc

SEQ ID NO: 642247 - RNA, 14 nt, Escherichia coli CFT073
gcagagccugaaua

SEQ ID NO: 642248 - RNA, 15 nt, Escherichia coli CFT073
gcagauaacccagca

SEQ ID NO: 642249 - RNA, 17 nt, Escherichia coli CFT073
gcagauaacccagcagc

SEQ ID NO: 642250 - RNA, 22 nt, Escherichia coli CFT073
gcagauaacccagcagcccgag

SEQ ID NO: 642251 - RNA, 16 nt, Escherichia coli CFT073
gcagaguuuccaggcu

SEQ ID NO: 642252 - RNA, 18 nt, Escherichia coli CFT073
gcagaguuuccaggcugg

SEQ ID NO: 642253 - RNA, 13 nt, Escherichia coli CFT073
gcagaguuuccag

SEQ ID NO: 642254 - RNA, 20 nt, Escherichia coli CFT073
gcagagcaucauuuucagcu

SEQ ID NO: 642255 - RNA, 17 nt, Escherichia coli CFT073
gcagagcauccagcagc

SEQ ID NO: 642256 - RNA, 22 nt, Escherichia coli CFT073
gcagagaucgccccggcaagaa

SEQ ID NO: 642257 - RNA, 13 nt, Escherichia coli CFT073
gcagagagucacg

SEQ ID NO: 642258 - RNA, 21 nt, Escherichia coli CFT073
gcagacuuuuugcggcagcaa

SEQ ID NO: 642259 - RNA, 15 nt, Escherichia coli CFT073
gcagacuguaaaucu

SEQ ID NO: 642260 - RNA, 23 nt, Escherichia coli CFT073
gcagagaaaaugccgcacaucac

SEQ ID NO: 642261 - RNA, 15 nt, Escherichia coli CFT073
gcagagaaaccacau

SEQ ID NO: 642262 - RNA, 18 nt, Escherichia coli CFT073
gcagagaaaccacaucaa

SEQ ID NO: 642263 - RNA, 20 nt, Escherichia coli CFT073
gcagagaaacgccagcagca

SEQ ID NO: 642264 - RNA, 16 nt, Escherichia coli CFT073
gcagaauccggcgcuc

SEQ ID NO: 642265 - RNA, 20 nt, Escherichia coli CFT073
gcagaauccggcgcucauca

SEQ ID NO: 642266 - RNA, 23 nt, Escherichia coli CFT073
gcagaauccggcgcucaucaggc

SEQ ID NO: 642267 - RNA, 18 nt, Escherichia coli CFT073
gcagaacguccgcaggau

SEQ ID NO: 642268 - RNA, 15 nt, Escherichia coli CFT073
gcagaagcagcagga

SEQ ID NO: 642269 - RNA, 16 nt, Escherichia coli CFT073
gcagaagcagcaggac

SEQ ID NO: 642270 - RNA, 13 nt, Escherichia coli CFT073
gcagaagcccagu

SEQ ID NO: 642271 - RNA, 22 nt, Escherichia coli CFT073
gcagaaauaaaagccugaucaa

SEQ ID NO: 642272 - RNA, 13 nt, Escherichia coli CFT073
gcagaaauacccc

SEQ ID NO: 642273 - RNA, 17 nt, Escherichia coli CFT073
gcagaaauaccccgcca

SEQ ID NO: 642274 - RNA, 19 nt, Escherichia coli CFT073
gcagaaauaccccgccagc

SEQ ID NO: 642275 - RNA, 16 nt, Escherichia coli CFT073
gcagaacagaucccac

SEQ ID NO: 642276 - RNA, 13 nt, Escherichia coli CFT073
gcagaacauccag

SEQ ID NO: 642277 - RNA, 21 nt, Escherichia coli CFT073
gcagaaacaaccucuuuuuuc

SEQ ID NO: 642278 - RNA, 19 nt, Escherichia coli CFT073
gcagaaacaucauccccau

SEQ ID NO: 642279 - RNA, 12 nt, Escherichia coli CFT073
gcagaaaccagg

SEQ ID NO: 642280 - RNA, 14 nt, Escherichia coli CFT073
gcagaaacgacacc

SEQ ID NO: 642281 - RNA, 17 nt, Escherichia coli CFT073
gcacuuuuucaucaggu

SEQ ID NO: 642282 - RNA, 22 nt, Escherichia coli CFT073
gcacuuuaucgaucacauccag

SEQ ID NO: 642283 - RNA, 17 nt, Escherichia coli CFT073
gcacuuguuuaugccag

SEQ ID NO: 642284 - RNA, 18 nt, Escherichia coli CFT073
gcacuuucggauuacugc

SEQ ID NO: 642285 - RNA, 11 nt, Escherichia coli CFT073
gcacuuccuga

SEQ ID NO: 642286 - RNA, 15 nt, Escherichia coli CFT073
gcacuucuuccgggc

SEQ ID NO: 642287 - RNA, 24 nt, Escherichia coli CFT073
gcacuugaguaauuaauacgccag

SEQ ID NO: 642288 - RNA, 14 nt, Escherichia coli CFT073
gcacuuccagcggc

SEQ ID NO: 642289 - RNA, 20 nt, Escherichia coli CFT073
gcacgaaucgauaaccccag

SEQ ID NO: 642290 - RNA, 15 nt, Escherichia coli CFT073
gcacgacacaaugcc

SEQ ID NO: 642291 - RNA, 13 nt, Escherichia coli CFT073
gcacgacacagcu

SEQ ID NO: 642292 - RNA, 17 nt, Escherichia coli CFT073
gcacgaauugcuuccag

SEQ ID NO: 642293 - RNA, 18 nt, Escherichia coli CFT073
gcacgaauugcuuccagu

SEQ ID NO: 642294 - RNA, 14 nt, Escherichia coli CFT073
gcaccuaaagcgcg

SEQ ID NO: 642295 - RNA, 20 nt, Escherichia coli CFT073
gcaccggaaauugcugccgc

SEQ ID NO: 642296 - RNA, 22 nt, Escherichia coli CFT073
gcaccugcucaggcagaagaga

SEQ ID NO: 642297 - RNA, 14 nt, Escherichia coli CFT073
gcaccugccagcgc

SEQ ID NO: 642298 - RNA, 20 nt, Escherichia coli CFT073
gcaccuaucgcgucgccggu

SEQ ID NO: 642299 - RNA, 18 nt, Escherichia coli CFT073
gcaccgccuccagcgaca

SEQ ID NO: 642300 - RNA, 18 nt, Escherichia coli CFT073
gcaccgcgacaaucaggu

SEQ ID NO: 642301 - RNA, 15 nt, Escherichia coli CFT073
gcaccgcgccacugg

SEQ ID NO: 642302 - RNA, 13 nt, Escherichia coli CFT073
gcaccgcgcccac

SEQ ID NO: 642303 - RNA, 17 nt, Escherichia coli CFT073
gcaccgaccaucggcac

SEQ ID NO: 642304 - RNA, 16 nt, Escherichia coli CFT073
gcaccgaacaagaaac

SEQ ID NO: 642305 - RNA, 13 nt, Escherichia coli CFT073
gcacccggcacua

SEQ ID NO: 642306 - RNA, 14 nt, Escherichia coli CFT073
gcacccaaugccau

SEQ ID NO: 642307 - RNA, 14 nt, Escherichia coli CFT073
gcacccaucgccag

SEQ ID NO: 642308 - RNA, 18 nt, Escherichia coli CFT073
gcaccccacaaacagaau

SEQ ID NO: 642309 - RNA, 15 nt, Escherichia coli CFT073
gcacccgccagcgcg

SEQ ID NO: 642310 - RNA, 14 nt, Escherichia coli CFT073
gcacccgccagcgc

SEQ ID NO: 642311 - RNA, 16 nt, Escherichia coli CFT073
gcacccgaugcggcag

SEQ ID NO: 642312 - RNA, 14 nt, Escherichia coli CFT073
gcacaaccgccaga

SEQ ID NO: 642313 - RNA, 14 nt, Escherichia coli CFT073
gcacaaccgccgga

SEQ ID NO: 642314 - RNA, 18 nt, Escherichia coli CFT073
gcacaaauagccagcaga

SEQ ID NO: 642315 - RNA, 22 nt, Escherichia coli CFT073
gcacaaauagccagcagagcaa

SEQ ID NO: 642316 - RNA, 15 nt, Escherichia coli CFT073
gcacaaaguggcggc

SEQ ID NO: 642317 - RNA, 16 nt, Escherichia coli CFT073
gcacaaaguggcggcu

SEQ ID NO: 642318 - RNA, 15 nt, Escherichia coli CFT073
gcacaaauagccagc

SEQ ID NO: 642319 - RNA, 23 nt, Escherichia coli CFT073
gcaaugagacgguuaaaaacagc

SEQ ID NO: 642320 - RNA, 20 nt, Escherichia coli CFT073
gcaaugcaaucaaauggcug

SEQ ID NO: 642321 - RNA, 22 nt, Escherichia coli CFT073
gcaaugcacacaaaauugccgc

SEQ ID NO: 642322 - RNA, 19 nt, Escherichia coli CFT073
gcaaugcagaauuugcacc

SEQ ID NO: 642323 - RNA, 13 nt, Escherichia coli CFT073
gcacaaacgccac

SEQ ID NO: 642324 - RNA, 16 nt, Escherichia coli CFT073
gcaaugccauccagcu

SEQ ID NO: 642325 - RNA, 17 nt, Escherichia coli CFT073
gcaaugccauccagcuu

SEQ ID NO: 642326 - RNA, 16 nt, Escherichia coli CFT073
gcacagguugcacgga

SEQ ID NO: 642327 - RNA, 15 nt, Escherichia coli CFT073
gcacaguacgcgccc

SEQ ID NO: 642328 - RNA, 16 nt, Escherichia coli CFT073
gcacagcccgccgcca

SEQ ID NO: 642329 - RNA, 23 nt, Escherichia coli CFT073
gcacagcccgccgccauccugaa

SEQ ID NO: 642330 - RNA, 15 nt, Escherichia coli CFT073
gcacagcgacaagcu

SEQ ID NO: 642331 - RNA, 14 nt, Escherichia coli CFT073
gcacacgauuccaa

SEQ ID NO: 642332 - RNA, 16 nt, Escherichia coli CFT073
gcacaccgucagccag

SEQ ID NO: 642333 - RNA, 20 nt, Escherichia coli CFT073
gcacaccuucaagaacggcu

SEQ ID NO: 642334 - RNA, 20 nt, Escherichia coli CFT073
gcaccaggguggcaaaugca

SEQ ID NO: 642335 - RNA, 19 nt, Escherichia coli CFT073
gcaccagccccuggaaaaa

SEQ ID NO: 642336 - RNA, 17 nt, Escherichia coli CFT073
gcaccauccgcccacac

SEQ ID NO: 642337 - RNA, 17 nt, Escherichia coli CFT073
gcaccaucgcgauccac

SEQ ID NO: 642338 - RNA, 13 nt, Escherichia coli CFT073
gcaccaucucuua

SEQ ID NO: 642339 - RNA, 12 nt, Escherichia coli CFT073
gcaccaucagcu

SEQ ID NO: 642340 - RNA, 17 nt, Escherichia coli CFT073
gcaccacacaucggcag

SEQ ID NO: 642341 - RNA, 23 nt, Escherichia coli CFT073
gcaccacacgacgcgccagcagc

SEQ ID NO: 642342 - RNA, 20 nt, Escherichia coli CFT073
gcaccagcagcgucagcacu

SEQ ID NO: 642343 - RNA, 11 nt, Escherichia coli CFT073
gcaccagcagc

SEQ ID NO: 642344 - RNA, 10 nt, Escherichia coli CFT073
gcaccagcag

SEQ ID NO: 642345 - RNA, 12 nt, Escherichia coli CFT073
gcaccagcaccg

SEQ ID NO: 642346 - RNA, 22 nt, Escherichia coli CFT073
gcaccagcaccguguuuucguc

SEQ ID NO: 642347 - RNA, 18 nt, Escherichia coli CFT073
gcacaucgcugugcugcu

SEQ ID NO: 642348 - RNA, 13 nt, Escherichia coli CFT073
gcacaugcaacuu

SEQ ID NO: 642349 - RNA, 17 nt, Escherichia coli CFT073
gcacaugcauaaagcgg

SEQ ID NO: 642350 - RNA, 16 nt, Escherichia coli CFT073
gcaccaaguucuucac

SEQ ID NO: 642351 - RNA, 17 nt, Escherichia coli CFT073
gcaccaaguucuucacu

SEQ ID NO: 642352 - RNA, 20 nt, Escherichia coli CFT073
gcaccaaguucuucacugac

SEQ ID NO: 642353 - RNA, 16 nt, Escherichia coli CFT073
gcaccaauauugacug

SEQ ID NO: 642354 - RNA, 21 nt, Escherichia coli CFT073
gcacauuagcgaccuucugaa

SEQ ID NO: 642355 - RNA, 13 nt, Escherichia coli CFT073
gcacauuaaaaug

SEQ ID NO: 642356 - RNA, 17 nt, Escherichia coli CFT073
gcacauuccagaugcgc

SEQ ID NO: 642357 - RNA, 19 nt, Escherichia coli CFT073
gcaauacccugacccagac

SEQ ID NO: 642358 - RNA, 18 nt, Escherichia coli CFT073
gcaaucacgcccgccaga

SEQ ID NO: 642359 - RNA, 14 nt, Escherichia coli CFT073
gcaauacguuucau

SEQ ID NO: 642360 - RNA, 19 nt, Escherichia coli CFT073
gcaaucagcguaaaggccg

SEQ ID NO: 642361 - RNA, 14 nt, Escherichia coli CFT073
gcaaucacuuccuc

SEQ ID NO: 642362 - RNA, 15 nt, Escherichia coli CFT073
gcaaucacuuccuca

SEQ ID NO: 642363 - RNA, 23 nt, Escherichia coli CFT073
gcaaucaguuuguuauauucacu

SEQ ID NO: 642364 - RNA, 20 nt, Escherichia coli CFT073
gcaaucaguuuuuguugaua

SEQ ID NO: 642365 - RNA, 16 nt, Escherichia coli CFT073
gcaaucaucguacugu

SEQ ID NO: 642366 - RNA, 17 nt, Escherichia coli CFT073
gcaaucauucccagacc

SEQ ID NO: 642367 - RNA, 20 nt, Escherichia coli CFT073
gcaauccugcuuuuuuccag

SEQ ID NO: 642368 - RNA, 23 nt, Escherichia coli CFT073
gcaauccugcuuuuuuccagcca

SEQ ID NO: 642369 - RNA, 23 nt, Escherichia coli CFT073
gcaauccaguccaccuggccugc

SEQ ID NO: 642370 - RNA, 23 nt, Escherichia coli CFT073
gcaaucccguugccacucaggca

SEQ ID NO: 642371 - RNA, 18 nt, Escherichia coli CFT073
gcaaucauucccagaccu

SEQ ID NO: 642372 - RNA, 20 nt, Escherichia coli CFT073
gcaaucgcuuugacuaaaga

SEQ ID NO: 642373 - RNA, 21 nt, Escherichia coli CFT073
gcaaucgggaucccuuuguaa

SEQ ID NO: 642374 - RNA, 13 nt, Escherichia coli CFT073
gcaaucgccucca

SEQ ID NO: 642375 - RNA, 14 nt, Escherichia coli CFT073
gcaauaaaacaggg

SEQ ID NO: 642376 - RNA, 13 nt, Escherichia coli CFT073
gcaauaacacgcg

SEQ ID NO: 642377 - RNA, 14 nt, Escherichia coli CFT073
gcaauaaucucaau

SEQ ID NO: 642378 - RNA, 19 nt, Escherichia coli CFT073
gcaauaaucucaauauccg

SEQ ID NO: 642379 - RNA, 12 nt, Escherichia coli CFT073
gcaauaauaaua

SEQ ID NO: 642380 - RNA, 17 nt, Escherichia coli CFT073
gcaauaaccaucagcuc

SEQ ID NO: 642381 - RNA, 21 nt, Escherichia coli CFT073
gcaauaacgaagucguuagua

SEQ ID NO: 642382 - RNA, 13 nt, Escherichia coli CFT073
gcaaguucccgga

SEQ ID NO: 642383 - RNA, 13 nt, Escherichia coli CFT073
gcaaggcgcgggu

SEQ ID NO: 642384 - RNA, 18 nt, Escherichia coli CFT073
gcaaggcgcgacaucucu

SEQ ID NO: 642385 - RNA, 17 nt, Escherichia coli CFT073
gcaaggcaaucugcucu

SEQ ID NO: 642386 - RNA, 14 nt, Escherichia coli CFT073
gcaacguuccagca

SEQ ID NO: 642387 - RNA, 17 nt, Escherichia coli CFT073
gcaacuccaucaagcua

SEQ ID NO: 642388 - RNA, 15 nt, Escherichia coli CFT073
gcaacuaccagcagu

SEQ ID NO: 642389 - RNA, 17 nt, Escherichia coli CFT073
gcaacgucagucccaac

SEQ ID NO: 642390 - RNA, 16 nt, Escherichia coli CFT073
gcaacgucagugacug

SEQ ID NO: 642391 - RNA, 15 nt, Escherichia coli CFT073
gcaacgucuucccga

SEQ ID NO: 642392 - RNA, 14 nt, Escherichia coli CFT073
gcaacugauauuua

SEQ ID NO: 642393 - RNA, 23 nt, Escherichia coli CFT073
gcaacugcccaggcaaaaaggcc

SEQ ID NO: 642394 - RNA, 16 nt, Escherichia coli CFT073
gcaacuggaaaugauc

SEQ ID NO: 642395 - RNA, 21 nt, Escherichia coli CFT073
gcaacugcgccgcgagcauuu

SEQ ID NO: 642396 - RNA, 21 nt, Escherichia coli CFT073
gcaagaggguuauuuguucag

SEQ ID NO: 642397 - RNA, 19 nt, Escherichia coli CFT073
gcaagaguaaacaucuucu

SEQ ID NO: 642398 - RNA, 14 nt, Escherichia coli CFT073
gcaagagcaaauaa

SEQ ID NO: 642399 - RNA, 15 nt, Escherichia coli CFT073
gcaagagcaaauaaa

SEQ ID NO: 642400 - RNA, 16 nt, Escherichia coli CFT073
gcaagagcaaauaaaa

SEQ ID NO: 642401 - RNA, 20 nt, Escherichia coli CFT073
gcaagacgcauaauccaggc

SEQ ID NO: 642402 - RNA, 15 nt, Escherichia coli CFT073
gcaagacgaaaaaug

SEQ ID NO: 642403 - RNA, 17 nt, Escherichia coli CFT073
gcaagacgaaaaaugaa

SEQ ID NO: 642404 - RNA, 15 nt, Escherichia coli CFT073
gcaagaccgcgacca

SEQ ID NO: 642405 - RNA, 17 nt, Escherichia coli CFT073
gcaacugucccauucca

SEQ ID NO: 642406 - RNA, 12 nt, Escherichia coli CFT073
gcaacacauuac

SEQ ID NO: 642407 - RNA, 21 nt, Escherichia coli CFT073
gcaacacguugccaucguggg

SEQ ID NO: 642408 - RNA, 14 nt, Escherichia coli CFT073
gcaaaacccaggcu

SEQ ID NO: 642409 - RNA, 17 nt, Escherichia coli CFT073
gcaacaagauuagccau

SEQ ID NO: 642410 - RNA, 12 nt, Escherichia coli CFT073
gcaacaacagcg

SEQ ID NO: 642411 - RNA, 14 nt, Escherichia coli CFT073
gcaaaagcaggcac

SEQ ID NO: 642412 - RNA, 23 nt, Escherichia coli CFT073
gcaacaucaaaucacagcaccuu

SEQ ID NO: 642413 - RNA, 16 nt, Escherichia coli CFT073
gcaacagcgcgcccgg

SEQ ID NO: 642414 - RNA, 16 nt, Escherichia coli CFT073
gcaacagguaacccag

SEQ ID NO: 642415 - RNA, 16 nt, Escherichia coli CFT073
gcaacaguaauaaugc

SEQ ID NO: 642416 - RNA, 22 nt, Escherichia coli CFT073
gcaacaguauccgggcauccag

SEQ ID NO: 642417 - RNA, 16 nt, Escherichia coli CFT073
gcaaccacaaccucag

SEQ ID NO: 642418 - RNA, 14 nt, Escherichia coli CFT073
gcaaccacaacgca

SEQ ID NO: 642419 - RNA, 14 nt, Escherichia coli CFT073
gcaaccacacccac

SEQ ID NO: 642420 - RNA, 13 nt, Escherichia coli CFT073
gcaaccagcaccg

SEQ ID NO: 642421 - RNA, 18 nt, Escherichia coli CFT073
gcaaccaaugccgccagg

SEQ ID NO: 642422 - RNA, 15 nt, Escherichia coli CFT073
gcaaccagcaggugu

SEQ ID NO: 642423 - RNA, 21 nt, Escherichia coli CFT073
gcaaccaacgcuagcagcagc

SEQ ID NO: 642424 - RNA, 22 nt, Escherichia coli CFT073
gcaaccaacgcuagcagcagcg

SEQ ID NO: 642425 - RNA, 16 nt, Escherichia coli CFT073
gcaacaugucagcaau

SEQ ID NO: 642426 - RNA, 15 nt, Escherichia coli CFT073
gcaaccuucgccaga

SEQ ID NO: 642427 - RNA, 18 nt, Escherichia coli CFT073
gcaaccuugcugcgggcg

SEQ ID NO: 642428 - RNA, 19 nt, Escherichia coli CFT073
gcaacgaaauagccaggca

SEQ ID NO: 642429 - RNA, 14 nt, Escherichia coli CFT073
gcaaccuaaccaaa

SEQ ID NO: 642430 - RNA, 22 nt, Escherichia coli CFT073
gcaacccuugacccguuuuaaa

SEQ ID NO: 642431 - RNA, 13 nt, Escherichia coli CFT073
gcaacccccacac

SEQ ID NO: 642432 - RNA, 16 nt, Escherichia coli CFT073
gcaaccgccaacagca

SEQ ID NO: 642433 - RNA, 14 nt, Escherichia coli CFT073
gcaaccgcuggcca

SEQ ID NO: 642434 - RNA, 22 nt, Escherichia coli CFT073
gcaacgccuuugucgggcaggc

SEQ ID NO: 642435 - RNA, 22 nt, Escherichia coli CFT073
gcaacgcgcuuugaugcguucu

SEQ ID NO: 642436 - RNA, 19 nt, Escherichia coli CFT073
gcaacgagacucaauggca

SEQ ID NO: 642437 - RNA, 15 nt, Escherichia coli CFT073
gcaacgcaaacugcu

SEQ ID NO: 642438 - RNA, 20 nt, Escherichia coli CFT073
gcaacgccccuucugccgca

SEQ ID NO: 642439 - RNA, 23 nt, Escherichia coli CFT073
gcaacgguagaugacuuuguacc

SEQ ID NO: 642440 - RNA, 14 nt, Escherichia coli CFT073
gcaacggaaaagca

SEQ ID NO: 642441 - RNA, 16 nt, Escherichia coli CFT073
gcaacggcaucgccaa

SEQ ID NO: 642442 - RNA, 19 nt, Escherichia coli CFT073
gcggcugacaugcaguuga

SEQ ID NO: 642443 - RNA, 21 nt, Escherichia coli CFT073
gcggcugcccaucaucgucgu

SEQ ID NO: 642444 - RNA, 13 nt, Escherichia coli CFT073
gcggcugauaauc

SEQ ID NO: 642445 - RNA, 22 nt, Escherichia coli CFT073
gcggcuuaguugaucgacaaaa

SEQ ID NO: 642446 - RNA, 19 nt, Escherichia coli CFT073
gcggcucucuuucuccagc

SEQ ID NO: 642447 - RNA, 20 nt, Escherichia coli CFT073
gcgggauaaucgcgccgcga

SEQ ID NO: 642448 - RNA, 17 nt, Escherichia coli CFT073
gcgggcaaucggcugca

SEQ ID NO: 642449 - RNA, 21 nt, Escherichia coli CFT073
gcggggagaaugccagcagca

SEQ ID NO: 642450 - RNA, 22 nt, Escherichia coli CFT073
gcgggcgaaucaacuccagaau

SEQ ID NO: 642451 - RNA, 16 nt, Escherichia coli CFT073
gcggggcuaccgccag

SEQ ID NO: 642452 - RNA, 20 nt, Escherichia coli CFT073
gcggggcuaccgccagacca

SEQ ID NO: 642453 - RNA, 23 nt, Escherichia coli CFT073
gcggggaucacuggcagggaaag

SEQ ID NO: 642454 - RNA, 21 nt, Escherichia coli CFT073
gcggggaucacuccccgccgu

SEQ ID NO: 642455 - RNA, 14 nt, Escherichia coli CFT073
gcguaaauugcugu

SEQ ID NO: 642456 - RNA, 20 nt, Escherichia coli CFT073
gcgguuuucuuguuccugca

SEQ ID NO: 642457 - RNA, 22 nt, Escherichia coli CFT073
gcgguuugaguucaccgccauu

SEQ ID NO: 642458 - RNA, 20 nt, Escherichia coli CFT073
gcgguugcugucggcggcga

SEQ ID NO: 642459 - RNA, 23 nt, Escherichia coli CFT073
gcgguuggcaaucaguuuuuguu

SEQ ID NO: 642460 - RNA, 21 nt, Escherichia coli CFT073
gcggugucuaacgaugccagc

SEQ ID NO: 642461 - RNA, 16 nt, Escherichia coli CFT073
gcgguuacgcaccggu

SEQ ID NO: 642462 - RNA, 23 nt, Escherichia coli CFT073
gcgguuacgccgcauccgacauc

SEQ ID NO: 642463 - RNA, 14 nt, Escherichia coli CFT073
gcguaccugccgcg

SEQ ID NO: 642464 - RNA, 17 nt, Escherichia coli CFT073
gcguaccuugcggcggu

SEQ ID NO: 642465 - RNA, 19 nt, Escherichia coli CFT073
gcguacuggcaaucgccag

SEQ ID NO: 642466 - RNA, 16 nt, Escherichia coli CFT073
gcguagaguccagcgc

SEQ ID NO: 642467 - RNA, 15 nt, Escherichia coli CFT073
gcguacaaucgccac

SEQ ID NO: 642468 - RNA, 21 nt, Escherichia coli CFT073
gcguacaaucgccacauugcu

SEQ ID NO: 642469 - RNA, 21 nt, Escherichia coli CFT073
gcguaauaaauuuugccaccg

SEQ ID NO: 642470 - RNA, 18 nt, Escherichia coli CFT073
gcguaccaguggcggcau

SEQ ID NO: 642471 - RNA, 12 nt, Escherichia coli CFT073
gcguacagcgcg

SEQ ID NO: 642472 - RNA, 20 nt, Escherichia coli CFT073
gcgguauggucacugagccc

SEQ ID NO: 642473 - RNA, 13 nt, Escherichia coli CFT073
gcggucaaccauc

SEQ ID NO: 642474 - RNA, 15 nt, Escherichia coli CFT073
gcggguucuggcgca

SEQ ID NO: 642475 - RNA, 14 nt, Escherichia coli CFT073
gcggguggugcgca

SEQ ID NO: 642476 - RNA, 16 nt, Escherichia coli CFT073
gcggguuaaccagcac

SEQ ID NO: 642477 - RNA, 17 nt, Escherichia coli CFT073
gcggguuaaccagcacc

SEQ ID NO: 642478 - RNA, 17 nt, Escherichia coli CFT073
gcggucgcugccgccau

SEQ ID NO: 642479 - RNA, 23 nt, Escherichia coli CFT073
gcggucaccggaacuuucaccac

SEQ ID NO: 642480 - RNA, 14 nt, Escherichia coli CFT073
gcggucagcugcug

SEQ ID NO: 642481 - RNA, 23 nt, Escherichia coli CFT073
gcggucaucgguaauacgugaaa

SEQ ID NO: 642482 - RNA, 18 nt, Escherichia coli CFT073
gcggucggguuaagccca

SEQ ID NO: 642483 - RNA, 15 nt, Escherichia coli CFT073
gcgguguaggccuga

SEQ ID NO: 642484 - RNA, 19 nt, Escherichia coli CFT073
gcggugguuaguuagcaga

SEQ ID NO: 642485 - RNA, 23 nt, Escherichia coli CFT073
gcgcuguuacuuucacaaugccc

SEQ ID NO: 642486 - RNA, 19 nt, Escherichia coli CFT073
gcgcuguuagcgugcagga

SEQ ID NO: 642487 - RNA, 14 nt, Escherichia coli CFT073
gcgcuguuccaggu

SEQ ID NO: 642488 - RNA, 17 nt, Escherichia coli CFT073
gcgcuuaacgauuugag

SEQ ID NO: 642489 - RNA, 23 nt, Escherichia coli CFT073
gcggcagaacguccgcaggauga

SEQ ID NO: 642490 - RNA, 16 nt, Escherichia coli CFT073
gcggcagagcaaacag

SEQ ID NO: 642491 - RNA, 22 nt, Escherichia coli CFT073
gcgcugguaacaucgccagaga

SEQ ID NO: 642492 - RNA, 16 nt, Escherichia coli CFT073
gcggcagcgugccagg

SEQ ID NO: 642493 - RNA, 19 nt, Escherichia coli CFT073
gcggcaggaugcccaugcc

SEQ ID NO: 642494 - RNA, 22 nt, Escherichia coli CFT073
gcggcagcucuuucucgcucag

SEQ ID NO: 642495 - RNA, 13 nt, Escherichia coli CFT073
gcggcaugugaug

SEQ ID NO: 642496 - RNA, 16 nt, Escherichia coli CFT073
gcggcaucuguacacg

SEQ ID NO: 642497 - RNA, 16 nt, Escherichia coli CFT073
gcggcaucuucuccac

SEQ ID NO: 642498 - RNA, 13 nt, Escherichia coli CFT073
gcggccaaaggga

SEQ ID NO: 642499 - RNA, 15 nt, Escherichia coli CFT073
gcggccaaagggagc

SEQ ID NO: 642500 - RNA, 18 nt, Escherichia coli CFT073
gcggccaaagggagcaga

SEQ ID NO: 642501 - RNA, 19 nt, Escherichia coli CFT073
gcggcauugacaucaggau

SEQ ID NO: 642502 - RNA, 21 nt, Escherichia coli CFT073
gcggccagacgcgccgccacc

SEQ ID NO: 642503 - RNA, 22 nt, Escherichia coli CFT073
gcggccagcauugcgccagcga

SEQ ID NO: 642504 - RNA, 18 nt, Escherichia coli CFT073
gcggcgaaccagccguug

SEQ ID NO: 642505 - RNA, 16 nt, Escherichia coli CFT073
gcggcgaaaacgccuc

SEQ ID NO: 642506 - RNA, 23 nt, Escherichia coli CFT073
gcggcgaaaacgccucauccggc

SEQ ID NO: 642507 - RNA, 14 nt, Escherichia coli CFT073
gcggcgaaggugcc

SEQ ID NO: 642508 - RNA, 18 nt, Escherichia coli CFT073
gcggcgaugaccgccacg

SEQ ID NO: 642509 - RNA, 20 nt, Escherichia coli CFT073
gcggcgaucuucaaacuggc

SEQ ID NO: 642510 - RNA, 18 nt, Escherichia coli CFT073
gcggcgaucuuuuaauaa

SEQ ID NO: 642511 - RNA, 16 nt, Escherichia coli CFT073
gcggcgaugaccgcca

SEQ ID NO: 642512 - RNA, 16 nt, Escherichia coli CFT073
gcggcgaucgccugcu

SEQ ID NO: 642513 - RNA, 17 nt, Escherichia coli CFT073
gcggcgauauccagcgc

SEQ ID NO: 642514 - RNA, 20 nt, Escherichia coli CFT073
gcggcgauauccagcgcggc

SEQ ID NO: 642515 - RNA, 15 nt, Escherichia coli CFT073
gcggcgauaaacagc

SEQ ID NO: 642516 - RNA, 16 nt, Escherichia coli CFT073
gcggcgauaauaccca

SEQ ID NO: 642517 - RNA, 18 nt, Escherichia coli CFT073
gcggccuccaacaacccu

SEQ ID NO: 642518 - RNA, 15 nt, Escherichia coli CFT073
gcucaauauauuaaa

SEQ ID NO: 642519 - RNA, 19 nt, Escherichia coli CFT073
gcucaauccuacauccagu

SEQ ID NO: 642520 - RNA, 16 nt, Escherichia coli CFT073
gcucaaucgcauggcu

SEQ ID NO: 642521 - RNA, 12 nt, Escherichia coli CFT073
gcucaaucugcg

SEQ ID NO: 642522 - RNA, 19 nt, Escherichia coli CFT073
gcuacugauguucgccaga

SEQ ID NO: 642523 - RNA, 19 nt, Escherichia coli CFT073
gcuacuggcaauccugcuu

SEQ ID NO: 642524 - RNA, 21 nt, Escherichia coli CFT073
gcucacuucacgcugccagcc

SEQ ID NO: 642525 - RNA, 23 nt, Escherichia coli CFT073
gcucacuucacgcugccagccgu

SEQ ID NO: 642526 - RNA, 21 nt, Escherichia coli CFT073
gcucacuucgauccagugauu

SEQ ID NO: 642527 - RNA, 19 nt, Escherichia coli CFT073
gcucagaauucugggauga

SEQ ID NO: 642528 - RNA, 21 nt, Escherichia coli CFT073
gcucacaucaugcgucaccag

SEQ ID NO: 642529 - RNA, 13 nt, Escherichia coli CFT073
gcucaccagcagg

SEQ ID NO: 642530 - RNA, 16 nt, Escherichia coli CFT073
gcucaccagcaggcac

SEQ ID NO: 642531 - RNA, 13 nt, Escherichia coli CFT073
gcucacccccauc

SEQ ID NO: 642532 - RNA, 15 nt, Escherichia coli CFT073
gcucacccccaucag

SEQ ID NO: 642533 - RNA, 16 nt, Escherichia coli CFT073
gcuccagauauugcuc

SEQ ID NO: 642534 - RNA, 22 nt, Escherichia coli CFT073
gcuccagauuacuuaaguuaua

SEQ ID NO: 642535 - RNA, 17 nt, Escherichia coli CFT073
gcuccagcaucuccugc

SEQ ID NO: 642536 - RNA, 18 nt, Escherichia coli CFT073
gcuccagcaucuccugca

SEQ ID NO: 642537 - RNA, 20 nt, Escherichia coli CFT073
gcuccagcaggaagcggcuc

SEQ ID NO: 642538 - RNA, 14 nt, Escherichia coli CFT073
gcucaguugguaga

SEQ ID NO: 642539 - RNA, 19 nt, Escherichia coli CFT073
gcucaguugguagagcacg

SEQ ID NO: 642540 - RNA, 21 nt, Escherichia coli CFT073
gcucagucggcgcuuuugcau

SEQ ID NO: 642541 - RNA, 12 nt, Escherichia coli CFT073
gcucaggugacg

SEQ ID NO: 642542 - RNA, 15 nt, Escherichia coli CFT073
gcucauauuccugca

SEQ ID NO: 642543 - RNA, 21 nt, Escherichia coli CFT073
gcucauaaaaucacgcgccug

SEQ ID NO: 642544 - RNA, 21 nt, Escherichia coli CFT073
gcucaucagcggcgaagccua

SEQ ID NO: 642545 - RNA, 18 nt, Escherichia coli CFT073
gcuccauaauugccagcu

SEQ ID NO: 642546 - RNA, 20 nt, Escherichia coli CFT073
gcuccaucagauucagcagc

SEQ ID NO: 642547 - RNA, 19 nt, Escherichia coli CFT073
gcuccaucaggucaucaau

SEQ ID NO: 642548 - RNA, 18 nt, Escherichia coli CFT073
gcuccaucauccgcggau

SEQ ID NO: 642549 - RNA, 22 nt, Escherichia coli CFT073
gcuccaucauccgcggauaaaa

SEQ ID NO: 642550 - RNA, 23 nt, Escherichia coli CFT073
gcuccaugcugcgggcgaucaua

SEQ ID NO: 642551 - RNA, 16 nt, Escherichia coli CFT073
gcuccaucgcaugcca

SEQ ID NO: 642552 - RNA, 21 nt, Escherichia coli CFT073
gcuccgggugugacaacaaca

SEQ ID NO: 642553 - RNA, 15 nt, Escherichia coli CFT073
gcuccguccagccac

SEQ ID NO: 642554 - RNA, 22 nt, Escherichia coli CFT073
gcuccgguacucaucagagaaa

SEQ ID NO: 642555 - RNA, 22 nt, Escherichia coli CFT073
gcuccgggcuaacacccgucgu

SEQ ID NO: 642556 - RNA, 19 nt, Escherichia coli CFT073
gcuccgggcugguuuucag

SEQ ID NO: 642557 - RNA, 18 nt, Escherichia coli CFT073
gcucgacgagaauuuccu

SEQ ID NO: 642558 - RNA, 20 nt, Escherichia coli CFT073
gcucgaagaguuccagcgcc

SEQ ID NO: 642559 - RNA, 23 nt, Escherichia coli CFT073
gcucgaagaguuccagcgccgcg

SEQ ID NO: 642560 - RNA, 16 nt, Escherichia coli CFT073
gcucgaauauaacuaa

SEQ ID NO: 642561 - RNA, 16 nt, Escherichia coli CFT073
gcucgacaccaaacag

SEQ ID NO: 642562 - RNA, 18 nt, Escherichia coli CFT073
gcucgacagcgcuaauac

SEQ ID NO: 642563 - RNA, 18 nt, Escherichia coli CFT073
gcuccugaucaagcuggc

SEQ ID NO: 642564 - RNA, 24 nt, Escherichia coli CFT073
gcuccugaucaagcuggcgcuggc

SEQ ID NO: 642565 - RNA, 23 nt, Escherichia coli CFT073
gcuccugcagaaaauccagcguc

SEQ ID NO: 642566 - RNA, 18 nt, Escherichia coli CFT073
gcucgcgguuagcggcuu

SEQ ID NO: 642567 - RNA, 19 nt, Escherichia coli CFT073
gcucgcgccgcauccgaca

SEQ ID NO: 642568 - RNA, 12 nt, Escherichia coli CFT073
gcucgcguucgg

SEQ ID NO: 642569 - RNA, 15 nt, Escherichia coli CFT073
gcucgcguucuguca

SEQ ID NO: 642570 - RNA, 21 nt, Escherichia coli CFT073
gcucgcugccaucgacuucuc

SEQ ID NO: 642571 - RNA, 16 nt, Escherichia coli CFT073
gcucgcuggcaggccg

SEQ ID NO: 642572 - RNA, 19 nt, Escherichia coli CFT073
gcucggaaauauucaacac

SEQ ID NO: 642573 - RNA, 15 nt, Escherichia coli CFT073
gcucggcaaacugcu

SEQ ID NO: 642574 - RNA, 19 nt, Escherichia coli CFT073
gcucggcaaacugcugaug

SEQ ID NO: 642575 - RNA, 21 nt, Escherichia coli CFT073
gcuaaaaaucccgccaucggc

SEQ ID NO: 642576 - RNA, 14 nt, Escherichia coli CFT073
gcuaaaccgcugcc

SEQ ID NO: 642577 - RNA, 19 nt, Escherichia coli CFT073
gcuaaaguacguaaaacaa

SEQ ID NO: 642578 - RNA, 16 nt, Escherichia coli CFT073
gcuaaauacugaccgu

SEQ ID NO: 642579 - RNA, 22 nt, Escherichia coli CFT073
gcuaacaaaaauaucgccucua

SEQ ID NO: 642580 - RNA, 19 nt, Escherichia coli CFT073
gcuaacaauucacacucug

SEQ ID NO: 642581 - RNA, 13 nt, Escherichia coli CFT073
gcuaacagcagca

SEQ ID NO: 642582 - RNA, 16 nt, Escherichia coli CFT073
gcuaaccaaacuucag

SEQ ID NO: 642583 - RNA, 14 nt, Escherichia coli CFT073
gcuaacuccugauu

SEQ ID NO: 642584 - RNA, 20 nt, Escherichia coli CFT073
gcuaacuccugauuccaggu

SEQ ID NO: 642585 - RNA, 13 nt, Escherichia coli CFT073
gcuaaggaaaucg

SEQ ID NO: 642586 - RNA, 21 nt, Escherichia coli CFT073
gcuaagcgcgcggccucaucu

SEQ ID NO: 642587 - RNA, 23 nt, Escherichia coli CFT073
gcuaauaccgucgaugccaauaa

SEQ ID NO: 642588 - RNA, 21 nt, Escherichia coli CFT073
gcuaccaaaccucaugggugg

SEQ ID NO: 642589 - RNA, 15 nt, Escherichia coli CFT073
gcuaccacuucccaa

SEQ ID NO: 642590 - RNA, 19 nt, Escherichia coli CFT073
gcuaccagaaagcgacccg

SEQ ID NO: 642591 - RNA, 21 nt, Escherichia coli CFT073
gcuaccaguugaugauguuca

SEQ ID NO: 642592 - RNA, 16 nt, Escherichia coli CFT073
gcuacccacuuccccu

SEQ ID NO: 642593 - RNA, 20 nt, Escherichia coli CFT073
gcuacacuuucugcaaacaa

SEQ ID NO: 642594 - RNA, 21 nt, Escherichia coli CFT073
gcuacacuuucugcaaacaag

SEQ ID NO: 642595 - RNA, 17 nt, Escherichia coli CFT073
gcuacaggguaaaaaga

SEQ ID NO: 642596 - RNA, 15 nt, Escherichia coli CFT073
gcuacauaacgcagc

SEQ ID NO: 642597 - RNA, 13 nt, Escherichia coli CFT073
gcuaauucaacgc

SEQ ID NO: 642598 - RNA, 22 nt, Escherichia coli CFT073
gcuaaugccaacguuaacgcgu

SEQ ID NO: 642599 - RNA, 14 nt, Escherichia coli CFT073
gcuacaacaugacc

SEQ ID NO: 642600 - RNA, 18 nt, Escherichia coli CFT073
gcuacucagcuggcgggu

SEQ ID NO: 642601 - RNA, 21 nt, Escherichia coli CFT073
gcuacggcuguaguucagaau

SEQ ID NO: 642602 - RNA, 16 nt, Escherichia coli CFT073
gcuacguagccagauu

SEQ ID NO: 642603 - RNA, 15 nt, Escherichia coli CFT073
gcuacguagcuguug

SEQ ID NO: 642604 - RNA, 22 nt, Escherichia coli CFT073
gcuacgcuuaucaggccugcaa

SEQ ID NO: 642605 - RNA, 17 nt, Escherichia coli CFT073
gcuacgccuuccgucag

SEQ ID NO: 642606 - RNA, 22 nt, Escherichia coli CFT073
gcuacgccuuccgucagcaaag

SEQ ID NO: 642607 - RNA, 21 nt, Escherichia coli CFT073
gcuacgcgagugugauuacag

SEQ ID NO: 642608 - RNA, 20 nt, Escherichia coli CFT073
gcuaccguugcggcgucaua

SEQ ID NO: 642609 - RNA, 17 nt, Escherichia coli CFT073
gcuaccgggaucuccuc

SEQ ID NO: 642610 - RNA, 15 nt, Escherichia coli CFT073
gcgucuuaucaggcc

SEQ ID NO: 642611 - RNA, 15 nt, Escherichia coli CFT073
gcgucuggcugggga

SEQ ID NO: 642612 - RNA, 23 nt, Escherichia coli CFT073
gcgucuggcuggggaaggcaaag

SEQ ID NO: 642613 - RNA, 18 nt, Escherichia coli CFT073
gcgucuggcccaugccag

SEQ ID NO: 642614 - RNA, 18 nt, Escherichia coli CFT073
gcgugaacgccuucuccg

SEQ ID NO: 642615 - RNA, 17 nt, Escherichia coli CFT073
gcgucuuaucuggccua

SEQ ID NO: 642616 - RNA, 16 nt, Escherichia coli CFT073
gcgucugaugaaagca

SEQ ID NO: 642617 - RNA, 22 nt, Escherichia coli CFT073
gcgucugaauaucaucacccug

SEQ ID NO: 642618 - RNA, 23 nt, Escherichia coli CFT073
gcguaucguucgccagcuccagc

SEQ ID NO: 642619 - RNA, 17 nt, Escherichia coli CFT073
gcguauccagcauaccu

SEQ ID NO: 642620 - RNA, 16 nt, Escherichia coli CFT073
gcguagugaaggcaaa

SEQ ID NO: 642621 - RNA, 20 nt, Escherichia coli CFT073
gcgugauuuuguaggucgga

SEQ ID NO: 642622 - RNA, 21 nt, Escherichia coli CFT073
gcgugauuuuuguaggucgga

SEQ ID NO: 642623 - RNA, 14 nt, Escherichia coli CFT073
gcgugacaccagca

SEQ ID NO: 642624 - RNA, 17 nt, Escherichia coli CFT073
gcgugccaccauucccu

SEQ ID NO: 642625 - RNA, 18 nt, Escherichia coli CFT073
gcgugcuccagucgcgug

SEQ ID NO: 642626 - RNA, 20 nt, Escherichia coli CFT073
gcgugcccgggucagcgcca

SEQ ID NO: 642627 - RNA, 17 nt, Escherichia coli CFT073
gcguugauuggcgcagg

SEQ ID NO: 642628 - RNA, 22 nt, Escherichia coli CFT073
gcguucugucgauaaacucaug

SEQ ID NO: 642629 - RNA, 19 nt, Escherichia coli CFT073
gcguucuguggcagggcag

SEQ ID NO: 642630 - RNA, 15 nt, Escherichia coli CFT073
gcguucucgccaaac

SEQ ID NO: 642631 - RNA, 22 nt, Escherichia coli CFT073
gcguucgguauuaauuugccag

SEQ ID NO: 642632 - RNA, 12 nt, Escherichia coli CFT073
gcguuuuuucau

SEQ ID NO: 642633 - RNA, 14 nt, Escherichia coli CFT073
gcguuuuuucauuu

SEQ ID NO: 642634 - RNA, 19 nt, Escherichia coli CFT073
gcguuucuucgaagaaaaa

SEQ ID NO: 642635 - RNA, 18 nt, Escherichia coli CFT073
gcguuugcgacaguaagc

SEQ ID NO: 642636 - RNA, 19 nt, Escherichia coli CFT073
gcguucgccagcgucaguu

SEQ ID NO: 642637 - RNA, 17 nt, Escherichia coli CFT073
gcguuagcuuaauaaga

SEQ ID NO: 642638 - RNA, 23 nt, Escherichia coli CFT073
gcguuccggcggcacagccagcg

SEQ ID NO: 642639 - RNA, 18 nt, Escherichia coli CFT073
gcguuaaugucgcgauca

SEQ ID NO: 642640 - RNA, 20 nt, Escherichia coli CFT073
gcguuaauuuccucuucccg

SEQ ID NO: 642641 - RNA, 20 nt, Escherichia coli CFT073
gcguuaagccaucccagaca

SEQ ID NO: 642642 - RNA, 18 nt, Escherichia coli CFT073
gcguuacgccaucuguuu

SEQ ID NO: 642643 - RNA, 23 nt, Escherichia coli CFT073
gcgccccuggucauaggcugccg

SEQ ID NO: 642644 - RNA, 13 nt, Escherichia coli CFT073
gcgcccgccagca

SEQ ID NO: 642645 - RNA, 15 nt, Escherichia coli CFT073
gcgcccgccagcauc

SEQ ID NO: 642646 - RNA, 21 nt, Escherichia coli CFT073
gcgccccacuucauaauccag

SEQ ID NO: 642647 - RNA, 19 nt, Escherichia coli CFT073
gcgcccugcaucacugaca

SEQ ID NO: 642648 - RNA, 21 nt, Escherichia coli CFT073
gcgcccggaaacgggcgcuga

SEQ ID NO: 642649 - RNA, 15 nt, Escherichia coli CFT073
gcgcccgcguuccug

SEQ ID NO: 642650 - RNA, 13 nt, Escherichia coli CFT073
gcgcaggagcggc

SEQ ID NO: 642651 - RNA, 20 nt, Escherichia coli CFT073
gcgcagcuuugugcuucagu

SEQ ID NO: 642652 - RNA, 14 nt, Escherichia coli CFT073
gcgccagaaaggua

SEQ ID NO: 642653 - RNA, 14 nt, Escherichia coli CFT073
gcgccagagcgcgg

SEQ ID NO: 642654 - RNA, 20 nt, Escherichia coli CFT073
gcgccagauaagaggcgcgc

SEQ ID NO: 642655 - RNA, 22 nt, Escherichia coli CFT073
gcgccagauaagaggcgcgcgg

SEQ ID NO: 642656 - RNA, 17 nt, Escherichia coli CFT073
gcgccagauagccgacc

SEQ ID NO: 642657 - RNA, 20 nt, Escherichia coli CFT073
gcgccagacgugcacgcagc

SEQ ID NO: 642658 - RNA, 17 nt, Escherichia coli CFT073
gcgccagacugacaauc

SEQ ID NO: 642659 - RNA, 23 nt, Escherichia coli CFT073
gcgccagacugaucaucgcccag

SEQ ID NO: 642660 - RNA, 12 nt, Escherichia coli CFT073
gcgccagcaaau

SEQ ID NO: 642661 - RNA, 19 nt, Escherichia coli CFT073
gcgccagcaagagcaaaua

SEQ ID NO: 642662 - RNA, 13 nt, Escherichia coli CFT073
gcgccagcgcgga

SEQ ID NO: 642663 - RNA, 17 nt, Escherichia coli CFT073
gcgcccaacacuucccc

SEQ ID NO: 642664 - RNA, 17 nt, Escherichia coli CFT073
gcgcccaaccagcaggu

SEQ ID NO: 642665 - RNA, 23 nt, Escherichia coli CFT073
gcgcccacaucacgccgcuggca

SEQ ID NO: 642666 - RNA, 17 nt, Escherichia coli CFT073
gcgccaguaccgccgca

SEQ ID NO: 642667 - RNA, 13 nt, Escherichia coli CFT073
gcgccagguggca

SEQ ID NO: 642668 - RNA, 21 nt, Escherichia coli CFT073
gcgccagcgucgcauccgaca

SEQ ID NO: 642669 - RNA, 17 nt, Escherichia coli CFT073
gcgccgcauugagaucu

SEQ ID NO: 642670 - RNA, 16 nt, Escherichia coli CFT073
gcgccgaguaaaaaaa

SEQ ID NO: 642671 - RNA, 22 nt, Escherichia coli CFT073
gcgccgcuacucugacccagaa

SEQ ID NO: 642672 - RNA, 16 nt, Escherichia coli CFT073
gcgccggcgcaccggu

SEQ ID NO: 642673 - RNA, 23 nt, Escherichia coli CFT073
gcgccgugaacgugaccaugagc

SEQ ID NO: 642674 - RNA, 13 nt, Escherichia coli CFT073
gcgcuccuguucc

SEQ ID NO: 642675 - RNA, 14 nt, Escherichia coli CFT073
gcgcuccggcacuu

SEQ ID NO: 642676 - RNA, 23 nt, Escherichia coli CFT073
gcgcucccgcaggagcgccgaau

SEQ ID NO: 642677 - RNA, 20 nt, Escherichia coli CFT073
gcgcucugcuagauaagcaa

SEQ ID NO: 642678 - RNA, 18 nt, Escherichia coli CFT073
gcgcugauuaccuuccug

SEQ ID NO: 642679 - RNA, 15 nt, Escherichia coli CFT073
gcgcugcaccagguu

SEQ ID NO: 642680 - RNA, 13 nt, Escherichia coli CFT073
gcgcugcggccug

SEQ ID NO: 642681 - RNA, 23 nt, Escherichia coli CFT073
gcgcuaacggagaauccagcccc

SEQ ID NO: 642682 - RNA, 13 nt, Escherichia coli CFT073
gcgcuaacucauc

SEQ ID NO: 642683 - RNA, 17 nt, Escherichia coli CFT073
gcgcguuuucaaccgga

SEQ ID NO: 642684 - RNA, 13 nt, Escherichia coli CFT073
gcgcuaccagagc

SEQ ID NO: 642685 - RNA, 22 nt, Escherichia coli CFT073
gcgcucaauauaacgaucggcg

SEQ ID NO: 642686 - RNA, 13 nt, Escherichia coli CFT073
gcgcucagaguac

SEQ ID NO: 642687 - RNA, 13 nt, Escherichia coli CFT073
gcgcguuaacucc

SEQ ID NO: 642688 - RNA, 21 nt, Escherichia coli CFT073
gcgccguuucagccagagaag

SEQ ID NO: 642689 - RNA, 22 nt, Escherichia coli CFT073
gcgcgaccaucggaucggccau

SEQ ID NO: 642690 - RNA, 19 nt, Escherichia coli CFT073
gcgcgaauauggcggcggc

SEQ ID NO: 642691 - RNA, 14 nt, Escherichia coli CFT073
gcgcgaccgccaug

SEQ ID NO: 642692 - RNA, 16 nt, Escherichia coli CFT073
gcgcgacggugcggcu

SEQ ID NO: 642693 - RNA, 18 nt, Escherichia coli CFT073
gcgcgacugaaaggucau

SEQ ID NO: 642694 - RNA, 18 nt, Escherichia coli CFT073
gcgcgagccauaaaccga

SEQ ID NO: 642695 - RNA, 13 nt, Escherichia coli CFT073
gcgcgaggccagc

SEQ ID NO: 642696 - RNA, 16 nt, Escherichia coli CFT073
gcgcgagguaacaaua

SEQ ID NO: 642697 - RNA, 20 nt, Escherichia coli CFT073
gcgcggaacaagucggcgug

SEQ ID NO: 642698 - RNA, 22 nt, Escherichia coli CFT073
gcgcggaccccgcgcucgcgca

SEQ ID NO: 642699 - RNA, 22 nt, Escherichia coli CFT073
gcgcgcugcgucuuccacuuca

SEQ ID NO: 642700 - RNA, 14 nt, Escherichia coli CFT073
gcgcggcagcggga

SEQ ID NO: 642701 - RNA, 23 nt, Escherichia coli CFT073
gcgagcaaaaucguaagcaggag

SEQ ID NO: 642702 - RNA, 22 nt, Escherichia coli CFT073
gcgagccgccgcauuaugguga

SEQ ID NO: 642703 - RNA, 21 nt, Escherichia coli CFT073
gcgaggaucaucggugugaga

SEQ ID NO: 642704 - RNA, 12 nt, Escherichia coli CFT073
gcgacuggcuga

SEQ ID NO: 642705 - RNA, 22 nt, Escherichia coli CFT073
gcgacgaccacccaccgcagcc

SEQ ID NO: 642706 - RNA, 21 nt, Escherichia coli CFT073
gcgacgaccacccaccgcagc

SEQ ID NO: 642707 - RNA, 15 nt, Escherichia coli CFT073
gcgagguccagcucc

SEQ ID NO: 642708 - RNA, 15 nt, Escherichia coli CFT073
gcgaggggacuggcc

SEQ ID NO: 642709 - RNA, 17 nt, Escherichia coli CFT073
gcgaggggacuggccgg

SEQ ID NO: 642710 - RNA, 13 nt, Escherichia coli CFT073
gcgaucauuagcc

SEQ ID NO: 642711 - RNA, 19 nt, Escherichia coli CFT073
gcgauccacgcucgcuggc

SEQ ID NO: 642712 - RNA, 23 nt, Escherichia coli CFT073
gcgauacgccagacucucgccag

SEQ ID NO: 642713 - RNA, 17 nt, Escherichia coli CFT073
gcgauacugccgcccau

SEQ ID NO: 642714 - RNA, 20 nt, Escherichia coli CFT073
gcgauaccaguaauaagccc

SEQ ID NO: 642715 - RNA, 23 nt, Escherichia coli CFT073
gcgaugaaaaucgccggaugcgg

SEQ ID NO: 642716 - RNA, 15 nt, Escherichia coli CFT073
gcgaugaaauucacu

SEQ ID NO: 642717 - RNA, 17 nt, Escherichia coli CFT073
gcgaugaaauucacugu

SEQ ID NO: 642718 - RNA, 16 nt, Escherichia coli CFT073
gcgaugcaaaaucagg

SEQ ID NO: 642719 - RNA, 20 nt, Escherichia coli CFT073
gcgaucccggcucauccccu

SEQ ID NO: 642720 - RNA, 16 nt, Escherichia coli CFT073
gcgcagcacggugcgg

SEQ ID NO: 642721 - RNA, 13 nt, Escherichia coli CFT073
gcgcagcacccag

SEQ ID NO: 642722 - RNA, 17 nt, Escherichia coli CFT073
gcgcaauucgcgucggc

SEQ ID NO: 642723 - RNA, 10 nt, Escherichia coli CFT073
gcgcaaugac

SEQ ID NO: 642724 - RNA, 19 nt, Escherichia coli CFT073
gcgcaaugccauccagcuu

SEQ ID NO: 642725 - RNA, 20 nt, Escherichia coli CFT073
gcgcaauaugcggugccauu

SEQ ID NO: 642726 - RNA, 14 nt, Escherichia coli CFT073
gcgcaauauucaag

SEQ ID NO: 642727 - RNA, 13 nt, Escherichia coli CFT073
gcgcaaucgccag

SEQ ID NO: 642728 - RNA, 14 nt, Escherichia coli CFT073
gcgcagcuuccggc

SEQ ID NO: 642729 - RNA, 15 nt, Escherichia coli CFT073
gcgcagcggugagcc

SEQ ID NO: 642730 - RNA, 22 nt, Escherichia coli CFT073
gcgcagcucuuuauccagcagc

SEQ ID NO: 642731 - RNA, 16 nt, Escherichia coli CFT073
gcgcagcaucggcgca

SEQ ID NO: 642732 - RNA, 18 nt, Escherichia coli CFT073
gcgcagcauaaucggcug

SEQ ID NO: 642733 - RNA, 14 nt, Escherichia coli CFT073
gcgcagcaucggcg

SEQ ID NO: 642734 - RNA, 20 nt, Escherichia coli CFT073
gcgaugguguuggcaaucag

SEQ ID NO: 642735 - RNA, 22 nt, Escherichia coli CFT073
gcgaugguacuucaaucgccac

SEQ ID NO: 642736 - RNA, 14 nt, Escherichia coli CFT073
gcgauggcccgcuu

SEQ ID NO: 642737 - RNA, 18 nt, Escherichia coli CFT073
gcgauggcgucaucaccu

SEQ ID NO: 642738 - RNA, 22 nt, Escherichia coli CFT073
gcgauuacauacgcucuacugu

SEQ ID NO: 642739 - RNA, 18 nt, Escherichia coli CFT073
gcgauucauaugcgccag

SEQ ID NO: 642740 - RNA, 19 nt, Escherichia coli CFT073
gcgauucauaugcgccagc

SEQ ID NO: 642741 - RNA, 20 nt, Escherichia coli CFT073
gcgauugccggaugcaacgc

SEQ ID NO: 642742 - RNA, 23 nt, Escherichia coli CFT073
gcgauucccguuuauggucgggu

SEQ ID NO: 642743 - RNA, 22 nt, Escherichia coli CFT073
gcgcaauaccgauaucgccauu

SEQ ID NO: 642744 - RNA, 21 nt, Escherichia coli CFT073
gcgcaaauccacguuccagau

SEQ ID NO: 642745 - RNA, 13 nt, Escherichia coli CFT073
gcgcaacacccug

SEQ ID NO: 642746 - RNA, 22 nt, Escherichia coli CFT073
gcgcaacauccgcuuuugguuu

SEQ ID NO: 642747 - RNA, 16 nt, Escherichia coli CFT073
gcgcaaccacaacgca

SEQ ID NO: 642748 - RNA, 22 nt, Escherichia coli CFT073
gcgcaaccacaacgcacuggcg

SEQ ID NO: 642749 - RNA, 17 nt, Escherichia coli CFT073
gcgauugugacacgcgc

SEQ ID NO: 642750 - RNA, 19 nt, Escherichia coli CFT073
gcgauuuucguccaccagg

SEQ ID NO: 642751 - RNA, 17 nt, Escherichia coli CFT073
gcgcaaaggccagcaau

SEQ ID NO: 642752 - RNA, 15 nt, Escherichia coli CFT073
gcgcaaacagugacc

SEQ ID NO: 642753 - RNA, 17 nt, Escherichia coli CFT073
gcgcaaacccucuauac

SEQ ID NO: 642754 - RNA, 14 nt, Escherichia coli CFT073
gcgaaauugguaga

SEQ ID NO: 642755 - RNA, 16 nt, Escherichia coli CFT073
gcgaaccgucugaagg

SEQ ID NO: 642756 - RNA, 20 nt, Escherichia coli CFT073
gcgaacugguuucaauacuc

SEQ ID NO: 642757 - RNA, 15 nt, Escherichia coli CFT073
gcgaacgggauaaac

SEQ ID NO: 642758 - RNA, 20 nt, Escherichia coli CFT073
gcgaaaaagcguucaucuga

SEQ ID NO: 642759 - RNA, 22 nt, Escherichia coli CFT073
gccuuuuucaguuugcugacaa

SEQ ID NO: 642760 - RNA, 16 nt, Escherichia coli CFT073
gccuuuuucuccgagc

SEQ ID NO: 642761 - RNA, 19 nt, Escherichia coli CFT073
gccuuuuuuaauauuucau

SEQ ID NO: 642762 - RNA, 21 nt, Escherichia coli CFT073
gccuuuaccgcgcucgaagcg

SEQ ID NO: 642763 - RNA, 15 nt, Escherichia coli CFT073
gccuuucagccccag

SEQ ID NO: 642764 - RNA, 15 nt, Escherichia coli CFT073
gccuuucccuuucuu

SEQ ID NO: 642765 - RNA, 22 nt, Escherichia coli CFT073
gccuuucggcuccguuauucaa

SEQ ID NO: 642766 - RNA, 19 nt, Escherichia coli CFT073
gccuuucucgcgguucagu

SEQ ID NO: 642767 - RNA, 18 nt, Escherichia coli CFT073
gccuuuuuaauuugccag

SEQ ID NO: 642768 - RNA, 14 nt, Escherichia coli CFT073
gccuuugaucucua

SEQ ID NO: 642769 - RNA, 18 nt, Escherichia coli CFT073
gccuuugaugccaccagg

SEQ ID NO: 642770 - RNA, 21 nt, Escherichia coli CFT073
gccuuugaugccaccaggcag

SEQ ID NO: 642771 - RNA, 15 nt, Escherichia coli CFT073
gcgaccguucgccag

SEQ ID NO: 642772 - RNA, 16 nt, Escherichia coli CFT073
gcgaccguucgccagg

SEQ ID NO: 642773 - RNA, 15 nt, Escherichia coli CFT073
gcgacagccagccca

SEQ ID NO: 642774 - RNA, 22 nt, Escherichia coli CFT073
gcgacagccagcccaucgcuag

SEQ ID NO: 642775 - RNA, 15 nt, Escherichia coli CFT073
gcgacagcaaaaucu

SEQ ID NO: 642776 - RNA, 16 nt, Escherichia coli CFT073
gcgacagauucgcggg

SEQ ID NO: 642777 - RNA, 19 nt, Escherichia coli CFT073
gcgacagacggcgacgcgc

SEQ ID NO: 642778 - RNA, 14 nt, Escherichia coli CFT073
gcgaaggccagcac

SEQ ID NO: 642779 - RNA, 13 nt, Escherichia coli CFT073
gcgaagucacaaa

SEQ ID NO: 642780 - RNA, 14 nt, Escherichia coli CFT073
gcgacaaucccugc

SEQ ID NO: 642781 - RNA, 16 nt, Escherichia coli CFT073
gcgacaaagcucaccu

SEQ ID NO: 642782 - RNA, 15 nt, Escherichia coli CFT073
gcgacaaucccugca

SEQ ID NO: 642783 - RNA, 13 nt, Escherichia coli CFT073
gcgacaccagcau

SEQ ID NO: 642784 - RNA, 14 nt, Escherichia coli CFT073
gcgacaccagcaug

SEQ ID NO: 642785 - RNA, 14 nt, Escherichia coli CFT073
gcgacacgcaucac

SEQ ID NO: 642786 - RNA, 17 nt, Escherichia coli CFT073
gccuugcagccagaacu

SEQ ID NO: 642787 - RNA, 19 nt, Escherichia coli CFT073
gccuucgugcggcugcauc

SEQ ID NO: 642788 - RNA, 15 nt, Escherichia coli CFT073
gccuucuucuuucag

SEQ ID NO: 642789 - RNA, 22 nt, Escherichia coli CFT073
gccuucuucgcccacuuucugc

SEQ ID NO: 642790 - RNA, 19 nt, Escherichia coli CFT073
gccuucuguaaccuuuucc

SEQ ID NO: 642791 - RNA, 15 nt, Escherichia coli CFT073
gccuucuucauccag

SEQ ID NO: 642792 - RNA, 11 nt, Escherichia coli CFT073
gccuucugagc

SEQ ID NO: 642793 - RNA, 19 nt, Escherichia coli CFT073
gccuucugagcccacuguu

SEQ ID NO: 642794 - RNA, 22 nt, Escherichia coli CFT073
gccuucuccgggagaaggccuu

SEQ ID NO: 642795 - RNA, 15 nt, Escherichia coli CFT073
gccuuguauuaauac

SEQ ID NO: 642796 - RNA, 16 nt, Escherichia coli CFT073
gccuuaaccgccgcca

SEQ ID NO: 642797 - RNA, 18 nt, Escherichia coli CFT073
gccuuaaccgccgccaga

SEQ ID NO: 642798 - RNA, 14 nt, Escherichia coli CFT073
gccuguuuuuuuaa

SEQ ID NO: 642799 - RNA, 13 nt, Escherichia coli CFT073
gccuuaaaaacca

SEQ ID NO: 642800 - RNA, 19 nt, Escherichia coli CFT073
gccuuacgggcguauucaa

SEQ ID NO: 642801 - RNA, 14 nt, Escherichia coli CFT073
gccuuaccuguuau

SEQ ID NO: 642802 - RNA, 16 nt, Escherichia coli CFT073
gccuguugcacaauac

SEQ ID NO: 642803 - RNA, 19 nt, Escherichia coli CFT073
gccuguugugucggcugcg

SEQ ID NO: 642804 - RNA, 14 nt, Escherichia coli CFT073
gccuuauccggccu

SEQ ID NO: 642805 - RNA, 15 nt, Escherichia coli CFT073
gccuucacuuccggc

SEQ ID NO: 642806 - RNA, 18 nt, Escherichia coli CFT073
gccuucacggcuuuguca

SEQ ID NO: 642807 - RNA, 17 nt, Escherichia coli CFT073
gccuucagguuuuucag

SEQ ID NO: 642808 - RNA, 21 nt, Escherichia coli CFT073
gccuucagguuuuucagcugc

SEQ ID NO: 642809 - RNA, 13 nt, Escherichia coli CFT073
gccuuccagcagc

SEQ ID NO: 642810 - RNA, 14 nt, Escherichia coli CFT073
gccuuccagcagcu

SEQ ID NO: 642811 - RNA, 17 nt, Escherichia coli CFT073
gccuuccggcaguuuca

SEQ ID NO: 642812 - RNA, 21 nt, Escherichia coli CFT073
gccuuccgcaaacaggcgcag

SEQ ID NO: 642813 - RNA, 17 nt, Escherichia coli CFT073
gccuuccgucagcaaag

SEQ ID NO: 642814 - RNA, 14 nt, Escherichia coli CFT073
gccgcuaacagcag

SEQ ID NO: 642815 - RNA, 15 nt, Escherichia coli CFT073
gccgcuaacagcagc

SEQ ID NO: 642816 - RNA, 16 nt, Escherichia coli CFT073
gccgcuaacuuccugc

SEQ ID NO: 642817 - RNA, 23 nt, Escherichia coli CFT073
gccgcuacucugacccagaagac

SEQ ID NO: 642818 - RNA, 14 nt, Escherichia coli CFT073
gccgcguucgccag

SEQ ID NO: 642819 - RNA, 17 nt, Escherichia coli CFT073
gccgcgcauagcuggcg

SEQ ID NO: 642820 - RNA, 20 nt, Escherichia coli CFT073
gccgcuuucagagcggccuu

SEQ ID NO: 642821 - RNA, 20 nt, Escherichia coli CFT073
gccgcuuuuaugugcaauuu

SEQ ID NO: 642822 - RNA, 22 nt, Escherichia coli CFT073
gccggacgauuuauuuuucugg

SEQ ID NO: 642823 - RNA, 13 nt, Escherichia coli CFT073
gccggacgucagg

SEQ ID NO: 642824 - RNA, 14 nt, Escherichia coli CFT073
gccggacgcaccuu

SEQ ID NO: 642825 - RNA, 18 nt, Escherichia coli CFT073
gccggaucuuucaggaac

SEQ ID NO: 642826 - RNA, 20 nt, Escherichia coli CFT073
gccggauuugagaucggaaa

SEQ ID NO: 642827 - RNA, 23 nt, Escherichia coli CFT073
gccggaggcaaguuuccuccggc
